United States Patent 11,332,783 (SAMPLE ANALYSIS, PRESENCE DETERMINATION OF A TARGET SEQUENCE) - sequence listing, part 2

SEQ ID NO: 14821 - DNA, 75 bp, Artificial Sequence
  Synthetic
agcagatatgtcagtgctgtattctacaatagggaaggcatttccaggtttgactgggaacttactcaatcagat

SEQ ID NO: 14822 - DNA, 75 bp, Artificial Sequence
  Synthetic
tttgcagacgacttcaattttaagccacactcaacaaaaatagagataaatgcagacatgtcaaaatggagtgca

SEQ ID NO: 14823 - DNA, 75 bp, Artificial Sequence
  Synthetic
tacatgtactggaaagcgattccgatcactaatgaaacagtatattgcttgctctaacgggggtgttaagttata

SEQ ID NO: 14824 - DNA, 75 bp, Artificial Sequence
  Synthetic
attagagaatgagaaatatgaagattcattctttgttatcgacaaattattgctatatactgagaaaaacaacca

SEQ ID NO: 14825 - DNA, 75 bp, Artificial Sequence
  Synthetic
caagatgttctcttcaagtatttttggttatttgctcttgaccctgcactttataaggcggagaaagaaaggatt

SEQ ID NO: 14826 - DNA, 75 bp, Artificial Sequence
  Synthetic
ccaacgaccaaacaaacctctaacgcttgtaggtgataagctttgcattggtgacaaatactgtatgatagcatt

SEQ ID NO: 14827 - DNA, 75 bp, Artificial Sequence
  Synthetic
attgaccgggatcctaaaatttattaaacatattaatgcaaaaaacatcactggagaactcaagaaatttgagcc

SEQ ID NO: 14828 - DNA, 75 bp, Artificial Sequence
  Synthetic
ttatacttcttatgcaattacatggacaaagtactagttattcctgatgatgtgatgacgtcgatattagatcaa

SEQ ID NO: 14829 - DNA, 75 bp, Artificial Sequence
  Synthetic
tgacccaatggtgatagatgaaaatatacaaaaactggattgttatagtttggctgccaccgaccaatcagatgg

SEQ ID NO: 14830 - DNA, 75 bp, Artificial Sequence
  Synthetic
aaggagtgattttagggtgactggaagtaaatacgacactaagactagtggggtacctggcattaggagatgtga

SEQ ID NO: 14831 - DNA, 75 bp, Artificial Sequence
  Synthetic
tggctgccaccgaccaatcagatgggatgttgaaacctgaaaggtctattcgactcttcaaaacaggcgaatgta

SEQ ID NO: 14832 - DNA, 75 bp, Artificial Sequence
  Synthetic
gacgccattaatcgtatcttgtacaggaaagaggttcagaaatattttaaaaatctttatttcatgcagttcaaa

SEQ ID NO: 14833 - DNA, 75 bp, Artificial Sequence
  Synthetic
cgtgtaaaacgagaacaggacattatatatgaaatgacaaatgggctaaaacaaaactgggtttctattaaacga

SEQ ID NO: 14834 - DNA, 75 bp, Artificial Sequence
  Synthetic
aactggcttcagggcaatctaaattacacatctagctatttacattcctgttgtatgaatgtctacaaagatatt

SEQ ID NO: 14835 - DNA, 75 bp, Artificial Sequence
  Synthetic
tataaatactccactatagttcataagaagagtgatttagttgatgagtattgtctaagcccaaattgtgatcta

SEQ ID NO: 14836 - DNA, 75 bp, Artificial Sequence
  Synthetic
gctatataagcaaactaatctgcctctagtatattttgataggaaattatgtatcggagatagatactgcgatat

SEQ ID NO: 14837 - DNA, 75 bp, Artificial Sequence
  Synthetic
atcaagaatgtagctctgctcctagaaggcgacgttttagtaaactcaatggttcattcagatgataaccacact

SEQ ID NO: 14838 - DNA, 75 bp, Artificial Sequence
  Synthetic
tgaatttgaaccacaaatagttgattcaaacatccaacatttaaaatgttttgctagccctcctacggacaactc

SEQ ID NO: 14839 - DNA, 75 bp, Artificial Sequence
  Synthetic
acctagctgactgctcttggagtgaatcaactcattctactttaagccaaaaagtgatatctcacacggatatag

SEQ ID NO: 14840 - DNA, 75 bp, Artificial Sequence
  Synthetic
tcaataacaatgattcaagacaaactctcagatgatatcattattgaatactgcattaaattatttgaaaagata

SEQ ID NO: 14841 - DNA, 75 bp, Artificial Sequence
  Synthetic
taatggcatgaatcaagagaccaagtcaatcaaaattgcacagctgggagagtgcaaagttaataatttcccgtc

SEQ ID NO: 14842 - DNA, 75 bp, Artificial Sequence
  Synthetic
aatcattcatatctagtgtcaaactctccttgcataatgatctgattcagcaccactttaggccgctaagtaaca

SEQ ID NO: 14843 - DNA, 75 bp, Artificial Sequence
  Synthetic
tgcctatcatttggaaaccaggccaacatgaagaaaacttatgttacaaatttcatcaaagaatttgtttctctg

SEQ ID NO: 14844 - DNA, 75 bp, Artificial Sequence
  Synthetic
taaaattgttaaatctgccagcggtaagtattatccatacacaacattggttcataagcaagaagaaaccattga

SEQ ID NO: 14845 - DNA, 75 bp, Artificial Sequence
  Synthetic
tgccgcatataaagcccaatttcaaatcaataaatgttcaagggacaatttctggcggcaagattcaagacagct

SEQ ID NO: 14846 - DNA, 75 bp, Artificial Sequence
  Synthetic
ttcaatatctatggagaaccgttctcagtatacggtcgatttttgcttactgcagtaggtgactgtgcattcctt

SEQ ID NO: 14847 - DNA, 75 bp, Artificial Sequence
  Synthetic
cgaatattgctttagtcatgattgtcagcgagcattatatcccagacatgaaagcaagctaacagagtgcaactg

SEQ ID NO: 14848 - DNA, 75 bp, Artificial Sequence
  Synthetic
atataacattctcaataccattaatgactggactatcgcagggtttcacgttgcaagaccagaaaggcaacaccc

SEQ ID NO: 14849 - DNA, 75 bp, Artificial Sequence
  Synthetic
ggcccgtatgaggatacagcaagcaggttatctgctactcaaactgcaatcaaacatggcgctcaaccatctgtt

SEQ ID NO: 14850 - DNA, 75 bp, Artificial Sequence
  Synthetic
ggatagctctgaacatcgggttgtggatccccgagtgatggtccataatgatattgaatcctttatatcaagtat

SEQ ID NO: 14851 - DNA, 75 bp, Artificial Sequence
  Synthetic
tctttgacattatagcatatgtgaaaagtgcacgtgtaattgcgacatataaccatgaatataaaacaggaccca

SEQ ID NO: 14852 - DNA, 75 bp, Artificial Sequence
  Synthetic
gcttgggttgcaattgcacttactcagtggataacacatagtacttataacatgctacctggacaaaacaacgat

SEQ ID NO: 14853 - DNA, 75 bp, Artificial Sequence
  Synthetic
caagctatccttacataacgatctagtaacacaccattttaagcccttgcaaaacatgccccatattaaacctaa

SEQ ID NO: 14854 - DNA, 75 bp, Artificial Sequence
  Synthetic
cagtgagcatcaatgttcaacataatgaacaatgcacagggtcctgtcccagtagtatacccagaaaagataatt

SEQ ID NO: 14855 - DNA, 75 bp, Artificial Sequence
  Synthetic
ccactgaatgttttaacttcgcaaaacagatttgacataccgatagaactctgtggattattaaatacagatctg

SEQ ID NO: 14856 - DNA, 75 bp, Artificial Sequence
  Synthetic
agtagtatacccagaaaagataattggctaactttctctcgcgaacataccagtacttggggttgtgaagaatgg

SEQ ID NO: 14857 - DNA, 75 bp, Artificial Sequence
  Synthetic
ttttaaatcaataacattgcaaggaactatatcatctggaaaggttcaagacagttatatagtattcaatgtccc

SEQ ID NO: 14858 - DNA, 75 bp, Artificial Sequence
  Synthetic
ccgacattagcaatagcaggcttagaagcaggcaatttgacttatttggtcaatttgtctagaagaatgtccaag

SEQ ID NO: 14859 - DNA, 75 bp, Artificial Sequence
  Synthetic
cctcataacaggtgtatcacaaggttacactgtaacagccccagatggcaagcccctatttgatacagtcgtata

SEQ ID NO: 14860 - DNA, 75 bp, Artificial Sequence
  Synthetic
cattagagaagaagcaacagttatttctagaataaataacgagcagttggaagttgagttttgtgtttcagaacc

SEQ ID NO: 14861 - DNA, 75 bp, Artificial Sequence
  Synthetic
cataagattagcacaggttaaagcaagttatgcaaaggaatacactactggtccaactattgcaatcaacattca

SEQ ID NO: 14862 - DNA, 75 bp, Artificial Sequence
  Synthetic
gtccagctactgcgtgaaagcattcaatctcaatatgcagacatagaatcttgggatttaagtaagttgacgcag

SEQ ID NO: 14863 - DNA, 75 bp, Artificial Sequence
  Synthetic
tacaggtacaatgtgtaataccatcaatgtacttgagccagtactgggagagcatatgcagtttgaagtccacag

SEQ ID NO: 14864 - DNA, 75 bp, Artificial Sequence
  Synthetic
tcataacgagaagtgtacagggaattgtccagagataattccaaaaaaaggagagacatggctgtcattctcaaa

SEQ ID NO: 14865 - DNA, 75 bp, Artificial Sequence
  Synthetic
atggataaatttaaacttaagttgttgaggttcatgacgttagactcagctatgagtagcgacgacggcatgggg

SEQ ID NO: 14866 - DNA, 75 bp, Artificial Sequence
  Synthetic
tgtacaaactaatctattacctgaagtggctttaatcaaaaataggagggtgtacaaggggtcaataaacaagaa

SEQ ID NO: 14867 - DNA, 75 bp, Artificial Sequence
  Synthetic
agaacacacaagcgcatggggttgtgaagaatggggatgtctggcagttgggactggctgtgtatatggatcatg

SEQ ID NO: 14868 - DNA, 75 bp, Artificial Sequence
  Synthetic
gaaactagcgatatgcgttctcggtctctattaacgccacggaaatttacaacacatgcatctttagttaggtta

SEQ ID NO: 14869 - DNA, 75 bp, Artificial Sequence
  Synthetic
aggtgtgttcaaccctcaatgtggttcagtccaatcatttgatggtaaactctacggtgttgggaatccaaagtt

SEQ ID NO: 14870 - DNA, 75 bp, Artificial Sequence
  Synthetic
ccaagatgtcatacggccagaagcaactgtctacaaaaaaagtaaccaagagcagcctgatgttgaactttgcgt

SEQ ID NO: 14871 - DNA, 75 bp, Artificial Sequence
  Synthetic
gaatcttacaatgacttccagaaactggtacaggaccagaggcaaatagacaacttattcgaattctttatcagg

SEQ ID NO: 14872 - DNA, 75 bp, Artificial Sequence
  Synthetic
tgactacatttgccatgcattatcaaggaaggatatagttgtgagaaaatgttatgaaaatcactactattcatg

SEQ ID NO: 14873 - DNA, 75 bp, Artificial Sequence
  Synthetic
tacagatccaacagggaccttgtgtaataaaattgatgcactagagccaataattggtgagcacttccaagtaga

SEQ ID NO: 14874 - DNA, 75 bp, Artificial Sequence
  Synthetic
atgccgcaattgttggttactaaaggggagacaactgaagagtttatgaaatcaatcttgttcaggtacaatagc

SEQ ID NO: 14875 - DNA, 75 bp, Artificial Sequence
  Synthetic
cgctacactcaaggaggctgtagaaatcaaatcaaatatcacaaattctaaaactatgctttataatgataacgc

SEQ ID NO: 14876 - DNA, 75 bp, Artificial Sequence
  Synthetic
actcacaacggtccaaacaaatttcttaccagatgtgattttggaaaagaataaaaacatctatgtgggatctat

SEQ ID NO: 14877 - DNA, 75 bp, Artificial Sequence
  Synthetic
aggaaattcaaagaatccttatcaatacaaaacccagcacagctttttatagaacaagtgttatttgcaaacaag

SEQ ID NO: 14878 - DNA, 75 bp, Artificial Sequence
  Synthetic
tttactcggtagtgcatccatcaagataatgttgggcgatctaatatatcaacaagcatcagtgcaagaaagaga

SEQ ID NO: 14879 - DNA, 75 bp, Artificial Sequence
  Synthetic
caataggaaagggacattctctcaaggctgtggttcagtacagcaatttggtggggatacatatggtgtaggaaa

SEQ ID NO: 14880 - DNA, 75 bp, Artificial Sequence
  Synthetic
cccatgattgactatactagcatacatgacagactttttggaatacaagacgatcctaatatagatgactgtacg

SEQ ID NO: 14881 - DNA, 75 bp, Artificial Sequence
  Synthetic
cataagaggccatgcaacttgcggaggctgcacagattgttttaatgatgttgcatgtaaagtcagcatgacttc

SEQ ID NO: 14882 - DNA, 75 bp, Artificial Sequence
  Synthetic
tcccaaattcgactatgtttgccatgctatgtcgcggaaagatatagttgttagaaaatgctatgaaaaccatta

SEQ ID NO: 14883 - DNA, 75 bp, Artificial Sequence
  Synthetic
atgataatcgggaaaaagacctttattgagacgtatcgacagatacaagtagatcttaataaatttgagattacc

SEQ ID NO: 14884 - DNA, 75 bp, Artificial Sequence
  Synthetic
aaatggtgtttatcagtgcccgatagtgtcttcctgtgattcatatatcaataatgtttatattaacgaaggcac

SEQ ID NO: 14885 - DNA, 75 bp, Artificial Sequence
  Synthetic
tttcgcatgcaaaaccttggaactgaggcaagacttaaaattccagaaaacaaaagacaaccagcatttaacgaa

SEQ ID NO: 14886 - DNA, 75 bp, Artificial Sequence
  Synthetic
ataatgtttatattaacgaaggcacaaatgatatcaacttaaaattccgatgtctcaaggcagaaatcaaaatta

SEQ ID NO: 14887 - DNA, 75 bp, Artificial Sequence
  Synthetic
aaccaagatgtcaaaaccatttatgcattctgtctaatgaatgatcctatattagtagcatgtgctaacaatatt

SEQ ID NO: 14888 - DNA, 75 bp, Artificial Sequence
  Synthetic
tgacaatataatgttggggtcagccaaggtgcggatgattttaggcgatattcaattcagtcaaatgcaaccaag

SEQ ID NO: 14889 - DNA, 75 bp, Artificial Sequence
  Synthetic
ttgctatctatgcatggtctgcaaatgaatcgcaacggaatgacatgttgtatgatgccagaaataaaatctcga

SEQ ID NO: 14890 - DNA, 75 bp, Artificial Sequence
  Synthetic
aaggtcatatatcactcaccggctttagtactacgagcatacgtaccagaaaataataatatcaagggagctgaa

SEQ ID NO: 14891 - DNA, 75 bp, Artificial Sequence
  Synthetic
cagggcccaattatctggacatgcaatatgtggggggtgccaagactgcttcaatgatgtagtgtgcaaagttac

SEQ ID NO: 14892 - DNA, 75 bp, Artificial Sequence
  Synthetic
cctgatgaaatgcatcgtgaacagtaccatctagaggagtttattgccaaaactaaacttcgtgaaagtatgcaa

SEQ ID NO: 14893 - DNA, 75 bp, Artificial Sequence
  Synthetic
cctaactgctgaatcctcttaccgatgtaagatagcttctaactgcatatcatacattgagaacgttcaggtaac

SEQ ID NO: 14894 - DNA, 75 bp, Artificial Sequence
  Synthetic
tgagctaagtttgtggggaaaatatgtcttgcttgcattagccatagttatcagtatcctgatccttataaaagt

SEQ ID NO: 14895 - DNA, 75 bp, Artificial Sequence
  Synthetic
gctagaattgcaaaaaacgaacttaaaactatgggtagggacttcaaatttgagatccaagaattaacaaaattt

SEQ ID NO: 14896 - DNA, 75 bp, Artificial Sequence
  Synthetic
cgaaggcacaggggatatttcattgaaatttaaatgcagcactaatgtcataactctagacctgtgttcaattcc

SEQ ID NO: 14897 - DNA, 75 bp, Artificial Sequence
  Synthetic
aataaggccactggcaaggtatattgttgcagtacttaaagagaatgacaaagtgtacaaactggaaaacaagct

SEQ ID NO: 14898 - DNA, 75 bp, Artificial Sequence
  Synthetic
tatcagatatgttatgattatataaaatctactgaacataaaatcaaaatattcatcctacctaaacgagcttac

SEQ ID NO: 14899 - DNA, 75 bp, Artificial Sequence
  Synthetic
gattaatgttaaatcagagattattaagactagccaaaagcttgatctaacaagtgccgatcaatcgtcatatat

SEQ ID NO: 14900 - DNA, 75 bp, Artificial Sequence
  Synthetic
aacaagctgaaatagtcgaattaaaatagacataatgggagggtggtgggagttttctgctaatataataattat

SEQ ID NO: 14901 - DNA, 75 bp, Artificial Sequence
  Synthetic
actccaattgacttctgtggcatgattacaggtaacacattaaaagatcaatgctggtttactatacactattta

SEQ ID NO: 14902 - DNA, 75 bp, Artificial Sequence
  Synthetic
cttacattagtagtcgctgtgactgcaatgcctcctcgtaatacgaatgggggtcgatgcttttatggtggcgac

SEQ ID NO: 14903 - DNA, 75 bp, Artificial Sequence
  Synthetic
aaaggagttcgacaacaaatgtaatacttggctttgcagagcatacaatgagggtatatctttcatactccaacc

SEQ ID NO: 14904 - DNA, 75 bp, Artificial Sequence
  Synthetic
aagcagattacagtaccagcaaggaaagcccatatagcaacatcgttagacttagagatacaaatagcctacgag

SEQ ID NO: 14905 - DNA, 75 bp, Artificial Sequence
  Synthetic
aatttggggagagttcacaatctggggcaaatatctactaattgtcgcgattatactaatattaatattaatatt

SEQ ID NO: 14906 - DNA, 75 bp, Artificial Sequence
  Synthetic
aatgattattacaattctcaacgtgcttacattagtagtcgctgtgactgcaatgcctcctcgtaatacgaatgg

SEQ ID NO: 14907 - DNA, 75 bp, Artificial Sequence
  Synthetic
gcattgcgattaattgcacattttgcagacacatttattgctgaaaattcaagagttccatttctcaagcaagtc

SEQ ID NO: 14908 - DNA, 75 bp, Artificial Sequence
  Synthetic
tgctaaagtcttgaagcctcttgcctttgcaattataaccctgctaaagcgcaatgatgaaatttacaggctgga

SEQ ID NO: 14909 - DNA, 75 bp, Artificial Sequence
  Synthetic
atgtttcgccagatcaattcaacatcaccaatgagtgaaatctgtgtcagagatgacatatccctagttaaatct

SEQ ID NO: 14910 - DNA, 75 bp, Artificial Sequence
  Synthetic
atatcaaatttcttatataagggtattcaaatgcaagtgctatacaataagataaaagcttcccgacttaggaca

SEQ ID NO: 14911 - DNA, 75 bp, Artificial Sequence
  Synthetic
gaataaaataaaataaaatatattgtcttaacatggatattcttattgggtttggggtgggggaaatgcagctta

SEQ ID NO: 14912 - DNA, 75 bp, Artificial Sequence
  Synthetic
aaaatattaccaattctgttttacatgggcgatttggaacagcttgatgtagacaggtatgatgcagaaaaggca

SEQ ID NO: 14913 - DNA, 75 bp, Artificial Sequence
  Synthetic
ccactattaactacgtatctctatggcaagccaatttatctttgatgatgttccacaacggaatgcagctacatt

SEQ ID NO: 14914 - DNA, 75 bp, Artificial Sequence
  Synthetic
atggatattcttattgggtttggggtgggggaaatgcagcttagtaaatgacatgagttgattgtggtagaacac

SEQ ID NO: 14915 - DNA, 75 bp, Artificial Sequence
  Synthetic
gaagagcagataacatggaataattggcaggtatctagagaatttacaactggaccaattgacttgtcaataaaa

SEQ ID NO: 14916 - DNA, 75 bp, Artificial Sequence
  Synthetic
taacccggacacggggtatgtggcgtttatcagtaagtatgggcaacatctcaacttcactgttgctcgagtctt

SEQ ID NO: 14917 - DNA, 75 bp, Artificial Sequence
  Synthetic
ttggagtccccagcattaaaccactataccatacatgggacaactatcaagaatggctggttcaagacaaaggtt

SEQ ID NO: 14918 - DNA, 75 bp, Artificial Sequence
  Synthetic
ggatatgggagatctataagaattataggagaagatacacgactgactgcagctgaactacaaatcaaccgcatg

SEQ ID NO: 14919 - DNA, 75 bp, Artificial Sequence
  Synthetic
cttcctcaaccaaaaaaaggccaaaatggtcttacataagacggcacaaccaagtgtcgaccttacttttggtgg

SEQ ID NO: 14920 - DNA, 75 bp, Artificial Sequence
  Synthetic
ataccatacatgggacaactatcaagaatggctggttcaagacaaaggtttctatagacctggacaacacctgtg

SEQ ID NO: 14921 - DNA, 75 bp, Artificial Sequence
  Synthetic
agaaatgatataatatcaagacatggacaatcactgttgaacaagccacatggtctaagatttgaaaaaatggat

SEQ ID NO: 14922 - DNA, 75 bp, Artificial Sequence
  Synthetic
ggtcaaattcacagtggttaataaccattttccccaatacattgcaaatcctgtgccagacactgcccttacact

SEQ ID NO: 14923 - DNA, 75 bp, Artificial Sequence
  Synthetic
gaagtagaatttttggatgacaaactgcattatattgtctatcagttaagggacagaaaacgctattattacaat

SEQ ID NO: 14924 - DNA, 75 bp, Artificial Sequence
  Synthetic
ccataggatgtcagggtatctagccagatgggttgctgagctctgccgaggaaaccaaattaaactagcggaggc

SEQ ID NO: 14925 - DNA, 75 bp, Artificial Sequence
  Synthetic
tatttagtgtatctgctcataccaattttttacccgtttgtaaagctctatggcctattgctgcagagattctgc

SEQ ID NO: 14926 - DNA, 75 bp, Artificial Sequence
  Synthetic
agcaacattgattgtcatgccattagcagaggtcaagggttgcacctggaacgatgggtacacaatgtacctagg

SEQ ID NO: 14927 - DNA, 75 bp, Artificial Sequence
  Synthetic
tggcctattgctgcagagattctgcaagcaatgcaaaaattgcttattaccgattcatcctttcagtccttgtcc

SEQ ID NO: 14928 - DNA, 75 bp, Artificial Sequence
  Synthetic
atattgtctacaaatgcaatatatgaacataatgacaggttgagccaaacgaggtcaagaagaaataaccgatgg

SEQ ID NO: 14929 - DNA, 75 bp, Artificial Sequence
  Synthetic
atttgccccaggtgcagaaatgttcttagagacattcgaattttacccgcttgttattgatatgcacagagtttt

SEQ ID NO: 14930 - DNA, 75 bp, Artificial Sequence
  Synthetic
aacaacatgtatctgtggaatggtttataattctactgaagctttaaaagttcatagaaaatgtttgaattgcac

SEQ ID NO: 14931 - DNA, 75 bp, Artificial Sequence
  Synthetic
atacctgtctgtccggtagcaatatcgaagtatgtcaatacagatagacctatattagatagaatagaaatgctc

SEQ ID NO: 14932 - DNA, 75 bp, Artificial Sequence
  Synthetic
gaaggatgggatggatgtcaacttcatgcggaaagtactccgccagcgttatgggacactgactgcagaggagtg

SEQ ID NO: 14933 - DNA, 75 bp, Artificial Sequence
  Synthetic
tggctacaaaaccctgactaaaacgaggtatttatgtaaaaaaagactccccaatatggcattggccacaatcag

SEQ ID NO: 14934 - DNA, 75 bp, Artificial Sequence
  Synthetic
aacattgataatactaagctaactagtctacaagtggctgttagcgatactgcaatggttaaaaaggcagcactt

SEQ ID NO: 14935 - DNA, 75 bp, Artificial Sequence
  Synthetic
gatgacaactaagatagaagcagtcagggctgcattcaactctgttgctcagatctcttgggctaagactggatt

SEQ ID NO: 14936 - DNA, 75 bp, Artificial Sequence
  Synthetic
cacagtactgttctttactttcataacccctataacggctgaatgctataattatacgagcttaccagcagattt

SEQ ID NO: 14937 - DNA, 75 bp, Artificial Sequence
  Synthetic
gcaaaaatgtctttctttgaaggtccacctatacagtgtgggggtatagatctttcaaaattgatgcagaaccag

SEQ ID NO: 14938 - DNA, 75 bp, Artificial Sequence
  Synthetic
ctctcctgctgcaagagccttccttgccaactttggaatccaaatctaaaaatataccagtttcaaagttccctt

SEQ ID NO: 14939 - DNA, 75 bp, Artificial Sequence
  Synthetic
accatcataaacttagatatcaacaagatttcatcaataagtctattagacctttgtagaatattttcatgtagg

SEQ ID NO: 14940 - DNA, 75 bp, Artificial Sequence
  Synthetic
ggctattcaaatgatcaagatgcatttgagttcttatctgatgaagttatgaatgaagacatttctgaagaacta

SEQ ID NO: 14941 - DNA, 75 bp, Artificial Sequence
  Synthetic
ttacctttcttttctttgtgtatcatgtctatgtgatacacgccaattctgctgcttgtgagatctaagcacagt

SEQ ID NO: 14942 - DNA, 75 bp, Artificial Sequence
  Synthetic
tgcctcaatcattatggttatatcagcagtccacctgtatatacgaatatgctatgtattttgcgcttactgcgg

SEQ ID NO: 14943 - DNA, 75 bp, Artificial Sequence
  Synthetic
gacagttcgccagttttaaaaattacatatacaaaaaaatcaaattcacaaaacacatttaagaatgctatagta

SEQ ID NO: 14944 - DNA, 75 bp, Artificial Sequence
  Synthetic
cacagtggggcatttatcttcccttgttggcatggtgagaatttgcaagtatagttaattagtggagaacactac

SEQ ID NO: 14945 - DNA, 75 bp, Artificial Sequence
  Synthetic
taactacgcattgcaatggcaaatcaatttattttcaacgatgttccacaacggaatgcagctacatttaatccg

SEQ ID NO: 14946 - DNA, 75 bp, Artificial Sequence
  Synthetic
aaggctttagtacgtgaatgcgacagatttgaagagatatttgatctttcagatgacgggtttacctcagatagc

SEQ ID NO: 14947 - DNA, 75 bp, Artificial Sequence
  Synthetic
acggaatgcagctacatttaatccggatgcagggtatgtggcatttatcagtaagtatgggcagcagctcaactt

SEQ ID NO: 14948 - DNA, 75 bp, Artificial Sequence
  Synthetic
gctatgtattttgcgcttactgcggaatggtacacgaaaagaagggtctgattttactagataatttcacatctc

SEQ ID NO: 14949 - DNA, 75 bp, Artificial Sequence
  Synthetic
aatttggaactgttagagaatctagtctggatactaaaccacttaaagaccaaccaatggtctacagaattgatg

SEQ ID NO: 14950 - DNA, 75 bp, Artificial Sequence
  Synthetic
tactgttgctagagtcttcttcctcaaccagaagaaggccaagatggtcttacataagacgccacaaccaagtgt

SEQ ID NO: 14951 - DNA, 75 bp, Artificial Sequence
  Synthetic
gtgcattatcttcctgattattattgctgtcactcctgcttttagtgcttgcatacaagaaaaagaaatcgaaac

SEQ ID NO: 14952 - DNA, 75 bp, Artificial Sequence
  Synthetic
gaatgtatccacatgtgcttatacagaaatgaaatggaccatatataccacaatttccaaataccagatgtgttt

SEQ ID NO: 14953 - DNA, 75 bp, Artificial Sequence
  Synthetic
aattgtgttgctccaatgaaatacaaaactgccaaatatactaacctactgtgcattatcttcctgattattatt

SEQ ID NO: 14954 - DNA, 75 bp, Artificial Sequence
  Synthetic
gcatacaagaaaaagaaatcgaaacaatagatgatgctgcaatgtgtatcggtctgtatcaaaatataactcagc

SEQ ID NO: 14955 - DNA, 75 bp, Artificial Sequence
  Synthetic
gtaacaaacccaattgagctgagtattaaatggttagatgtaatagaattcctagaaatgatccttgctcatgac

SEQ ID NO: 14956 - DNA, 75 bp, Artificial Sequence
  Synthetic
tttacagtggttaataaccattttccccagtatactgcaaatccggtgtcagacactgcctttacgctccatcgc

SEQ ID NO: 14957 - DNA, 75 bp, Artificial Sequence
  Synthetic
atctcgggctacttagctcgatgggttgctgagcagtgcaaggctaatcagatcaaacttgcagaggcagctgct

SEQ ID NO: 14958 - DNA, 75 bp, Artificial Sequence
  Synthetic
tttaagtctgaaccctggatatcaataatgaaccactctatcacaaaagctatagattactcgcgtttagaacat

SEQ ID NO: 14959 - DNA, 75 bp, Artificial Sequence
  Synthetic
agaactctcatcaacattaagcagtcatgaaattgaattcctcctaccagctgtcaaaccatcattcgattatct

SEQ ID NO: 14960 - DNA, 75 bp, Artificial Sequence
  Synthetic
aaaaagacgagtgcgcaggcaaatatatccaaattcataaaggggaagaaaatgggtggtcgatcaaaattcgat

SEQ ID NO: 14961 - DNA, 75 bp, Artificial Sequence
  Synthetic
acgagtgcgcaggcaaatatatccaaattcataaaggggaagaaaatgggtggtcgatcaaaattcgatttttaa

SEQ ID NO: 14962 - DNA, 75 bp, Artificial Sequence
  Synthetic
cctggtgctgagatgtttctggaaacctttgagttttacccattggttattgacatgcaccgtgtgataaaggat

SEQ ID NO: 14963 - DNA, 75 bp, Artificial Sequence
  Synthetic
caacagcttcaaaaaacacttggcatcagcaggaccagacagcataaaatggaaaacatatattcaaaataacaa

SEQ ID NO: 14964 - DNA, 75 bp, Artificial Sequence
  Synthetic
tgacatgcaccgtgtgataaaggatgggatggatgtcaacttcatgaggaaggtcttacgccagagatatgggca

SEQ ID NO: 14965 - DNA, 75 bp, Artificial Sequence
  Synthetic
cttacacttatgcaatgatcatgttgtcaaaatgatatgccgctgtgtgattaagcaagaggaatgcagctctac

SEQ ID NO: 14966 - DNA, 75 bp, Artificial Sequence
  Synthetic
aggtcttacgccagagatatgggcagctgactgcagaagaatggatgacatctaagttggacgcagtcaaggctg

SEQ ID NO: 14967 - DNA, 75 bp, Artificial Sequence
  Synthetic
gtcaaaatgatatgccgctgtgtgattaagcaagaggaatgcagctctacaaaagtggatgatggagaacagatt

SEQ ID NO: 14968 - DNA, 75 bp, Artificial Sequence
  Synthetic
aaaagtggatgatggagaacagattgcacagtactataaaaaaaacaaagaattttataaggctgatttggagat

SEQ ID NO: 14969 - DNA, 75 bp, Artificial Sequence
  Synthetic
gctgactgcagaagaatggatgacatctaagttggacgcagtcaaggctgcatttagctcagttgcccagatatc

SEQ ID NO: 14970 - DNA, 75 bp, Artificial Sequence
  Synthetic
ctgggccaaatctggcttctcacctgcagctagagctttcctggctcaatttggtattcagatctaatctctgct

SEQ ID NO: 14971 - DNA, 75 bp, Artificial Sequence
  Synthetic
attatacacagtcatatcaagagcaatcccaggattagttggtaatttactgcgacaggttctgaaatcccaaaa

SEQ ID NO: 14972 - DNA, 75 bp, Artificial Sequence
  Synthetic
gattctccagtttccttgcttctatttctaagtgcaccatgtctatgtggtgcacacctttgttcagctgcatgg

SEQ ID NO: 14973 - DNA, 75 bp, Artificial Sequence
  Synthetic
atttctaagtgcaccatgtctatgtggtgcacacctttgttcagctgcatggattttattgtttatagttaatta

SEQ ID NO: 14974 - DNA, 75 bp, Artificial Sequence
  Synthetic
atacgaggagtcattgcatgtcttaaacaagataaaaaaagatgtttcaaaaaataatcagctgaatggcatagt

SEQ ID NO: 14975 - DNA, 75 bp, Artificial Sequence
  Synthetic
aatgattattacaattctcaacataattacattagcagtcattgtgactgcaatgcctcctcgtaatacgaatgg

SEQ ID NO: 14976 - DNA, 75 bp, Artificial Sequence
  Synthetic
caatgcctcctcgtaatacgaatgggggtcgatgcttttatggcggcaatatgtttcgccagatcaactcaacat

SEQ ID NO: 14977 - DNA, 75 bp, Artificial Sequence
  Synthetic
aaaagtagatgatggagaacagattgtgcattactataagaggaacaaagaactttataaagccgatctggagat

SEQ ID NO: 14978 - DNA, 75 bp, Artificial Sequence
  Synthetic
ggaatttctgatacatattaattcgaaaaatataactgaagaggttagggaattgagaatcaggcctgatcttag

SEQ ID NO: 14979 - DNA, 75 bp, Artificial Sequence
  Synthetic
tatcaggggatccaaattcacagacaaaaacccaggaactcccaacatcaaagaatgccaaactccactgtttat

SEQ ID NO: 14980 - DNA, 75 bp, Artificial Sequence
  Synthetic
attggttatcacaaactggcagcaaatagggaagttatcgagtcaagtatgtcgtactacaggttgtattacgtc

SEQ ID NO: 14981 - DNA, 75 bp, Artificial Sequence
  Synthetic
tacatgtactgggaaaagatttcgatcactgatgaagcagtatattgcttgctccaatgggggcgtcaagttata

SEQ ID NO: 14982 - DNA, 75 bp, Artificial Sequence
  Synthetic
ttcaagatattcttggaacttttatagtatttgacataaatcatgagggcatcttagcacccaagacatatgctt

SEQ ID NO: 14983 - DNA, 75 bp, Artificial Sequence
  Synthetic
ccagcgaccaaacaaacctctagcacttgtagacaataagctttgcattggtgacaaatactgtatgatagcatt

SEQ ID NO: 14984 - DNA, 75 bp, Artificial Sequence
  Synthetic
ataatgtttatattaatgaaggaacaaatgatatcagcttgaagttccgatgtttaaaggcagaaatcaaaatca

SEQ ID NO: 14985 - DNA, 75 bp, Artificial Sequence
  Synthetic
gtgacaaatactgtatgatagcattcgatccaatggtgatagatgagaatatacaaaaactggattgttatagcc

SEQ ID NO: 14986 - DNA, 75 bp, Artificial Sequence
  Synthetic
tgcagagcttataatgagggaattggatttgtcttagaaccattatggaatgagttaagtttgtgggggaaatat

SEQ ID NO: 14987 - DNA, 75 bp, Artificial Sequence
  Synthetic
agaacgggacactggcaatgttgtgttggagtctccagcattaaatcattacaccatacatgggacaactatcaa

SEQ ID NO: 14988 - DNA, 75 bp, Artificial Sequence
  Synthetic
aaatagcaggggcattatctagaattgcagtatcaataaatcaaaaaaattataaatactccactatagttcata

SEQ ID NO: 14989 - DNA, 75 bp, Artificial Sequence
  Synthetic
tgcagtatcaataaatcaaaaaaattataaatactccactatagttcataggaagagtgatttagttgatgagta

SEQ ID NO: 14990 - DNA, 75 bp, Artificial Sequence
  Synthetic
acaaatgcagagctgatattactatgctgcttctctgcaatctcttgctttgtggccattatcttgacaaagaca

SEQ ID NO: 14991 - DNA, 75 bp, Artificial Sequence
  Synthetic
tatttagtgtatctgcttataccaattttttacccgtttgttaagctttatggcttattgttgctaagattctgt

SEQ ID NO: 14992 - DNA, 75 bp, Artificial Sequence
  Synthetic
atcgactcattctaccctaagccagaaagttatatctcatacagatatagaatcatttatatccagtgttaagct

SEQ ID NO: 14993 - DNA, 75 bp, Artificial Sequence
  Synthetic
tggcttattgttgctaagattctgtaagcaatgtaaaaattgcttattaccaattcatccttttagcccatgtcc

SEQ ID NO: 14994 - DNA, 75 bp, Artificial Sequence
  Synthetic
ctccttgcataatgatctaatccagcaccattttaggccactaagtaatatgccgcacgtaaagcccaactttaa

SEQ ID NO: 14995 - DNA, 75 bp, Artificial Sequence
  Synthetic
acataacattctcaataccattaatgactggactatcgcaaggttttacattacaagatcataaaggcaataccc

SEQ ID NO: 14996 - DNA, 75 bp, Artificial Sequence
  Synthetic
cacagtactattctttacttttataacccctataacagctgaatgctacaattacacaagcttaccagcagattt

SEQ ID NO: 14997 - DNA, 75 bp, Artificial Sequence
  Synthetic
tcttcgacattatagcatatgtgaaaagtgcacgtgtaattgcgacatataatcatgaatacaagacaggaccta

SEQ ID NO: 14998 - DNA, 75 bp, Artificial Sequence
  Synthetic
aagtgcacgtgtaattgcgacatataatcatgaatacaagacaggacctacagtgagtatcaatgttcagcataa

SEQ ID NO: 14999 - DNA, 75 bp, Artificial Sequence
  Synthetic
tcagatctaatctttgctgattctccagtttccttgcttctatttctaagtgcaccatgtctatgtggtgcacac

SEQ ID NO: 15000 - DNA, 75 bp, Artificial Sequence
  Synthetic
tgagcaatgcacggggtcttgccccagcagtatacctaaaaaggataattggctaaccttctctcgtgaacatac

SEQ ID NO: 15001 - DNA, 75 bp, Artificial Sequence
  Synthetic
gcagtccacctgtatatacggatatgttatgtattttgtgcttattgcggaatggtacacgaaaagaagggcctg

SEQ ID NO: 15002 - DNA, 75 bp, Artificial Sequence
  Synthetic
tagcacctggggttgtgaggagtggggttgcttagcgataggtacggggtgcgtatatggatcttgtcaagatgt

SEQ ID NO: 15003 - DNA, 75 bp, Artificial Sequence
  Synthetic
cattagagaagaagcaacagttatttccagagtaaataatgaacagctagaagttgaattttgcgtttcagaacc

SEQ ID NO: 15004 - DNA, 75 bp, Artificial Sequence
  Synthetic
tccagagtaaataatgaacagctagaagttgaattttgcgtttcagaacctacaagcacaatgtgcaatactatc

SEQ ID NO: 15005 - DNA, 75 bp, Artificial Sequence
  Synthetic
gtgcattgtcttcctgatcatcattgctgttacccctgcttttagtgcttgcatacaagaaaaggaaatagaaac

SEQ ID NO: 15006 - DNA, 75 bp, Artificial Sequence
  Synthetic
gctgttacccctgcttttagtgcttgcatacaagaaaaggaaatagaaacaatagatgatgctgcaatgtgcatt

SEQ ID NO: 15007 - DNA, 75 bp, Artificial Sequence
  Synthetic
aatgtacttgagccagtattgggagagcacatgcaatttgaagtccacagtgtacagactaatctattacctgag

SEQ ID NO: 15008 - DNA, 75 bp, Artificial Sequence
  Synthetic
gtagctttaattaaaaataggagggtgtacaagggatcaataaacaaaaaaggtgtgtttaatcctcagtgtggc

SEQ ID NO: 15009 - DNA, 75 bp, Artificial Sequence
  Synthetic
catgaaattgaattcctcctgccagctgttaagccatcattcgactatctgacaattaaatcatctacatctaaa

SEQ ID NO: 15010 - DNA, 75 bp, Artificial Sequence
  Synthetic
aggtgtgtttaatcctcagtgtggctcagttcaatcatttgatggtaaactttatggcgttggaaatccaaagtt

SEQ ID NO: 15011 - DNA, 75 bp, Artificial Sequence
  Synthetic
aatttatagctgcaaatctctatcctaataatttcaaaaaacacctgacaccagcagggccagacagcatacaat

SEQ ID NO: 15012 - DNA, 75 bp, Artificial Sequence
  Synthetic
tgattatatttgccacgcattatcaagaaaggatatagttgtaaggaaatgttatgaaaatcattactattcgtg

SEQ ID NO: 15013 - DNA, 75 bp, Artificial Sequence
  Synthetic
agaaaggatatagttgtaaggaaatgttatgaaaatcattactattcgtgcgctacactcaaagaagctgtagaa

SEQ ID NO: 15014 - DNA, 75 bp, Artificial Sequence
  Synthetic
ggagaacatatattcaaaataacaacttgcatttatgcaacgaccatgttgtcaaaatgatatgccgctgcgtaa

SEQ ID NO: 15015 - DNA, 75 bp, Artificial Sequence
  Synthetic
attaaatcaaacatcacaaattctaagactatgctttataatgataatgctttacttggtagtgcatctgtaaag

SEQ ID NO: 15016 - DNA, 75 bp, Artificial Sequence
  Synthetic
gtcaaaatgatatgccgctgcgtaatcaagcaagaggaatgcagctctacaacagtagatgatggtgaacagatt

SEQ ID NO: 15017 - DNA, 75 bp, Artificial Sequence
  Synthetic
tttacttggtagtgcatctgtaaagataatgttaggcgatttaatataccagcaagcatcagtgcaagagaaaga

SEQ ID NO: 15018 - DNA, 75 bp, Artificial Sequence
  Synthetic
aacagtagatgatggtgaacagattgtgcattactataagaggaataaagaattttataaagctgatctagagat

SEQ ID NO: 15019 - DNA, 75 bp, Artificial Sequence
  Synthetic
cataaggggccatgctacttgtggaggctgtacagattgttttaacgacgttgcatgcaaaattagtatgacttc

SEQ ID NO: 15020 - DNA, 75 bp, Artificial Sequence
  Synthetic
actgtacacagtcatatcaagggcaatcccaggactggtcggtaatttactgcgacaagttctaaagtctcaaaa

SEQ ID NO: 15021 - DNA, 75 bp, Artificial Sequence
  Synthetic
aataagattaagaaagatgtttcgaaaattaaccaactgaatggtatagtagaattcttgatacatattaattca

SEQ ID NO: 15022 - DNA, 75 bp, Artificial Sequence
  Synthetic
aaattaaccaactgaatggtatagtagaattcttgatacatattaattcaaagaacataacagaagaggttaggg

SEQ ID NO: 15023 - DNA, 75 bp, Artificial Sequence
  Synthetic
tgccttaaggcagaaatcaagattagtatctgtggtagagagatgcctgtgaaatctgagataattaaagacaca

SEQ ID NO: 15024 - DNA, 75 bp, Artificial Sequence
  Synthetic
aagaactcagggactcctaacatcaaagaatgccaaactccaatgtttatcacatgtactgggaagagattccga

SEQ ID NO: 15025 - DNA, 75 bp, Artificial Sequence
  Synthetic
tgagttaagcttgtggggaaaatatgtcctgcttgcattagctataattatcagtgttctgatccttataaaagt

SEQ ID NO: 15026 - DNA, 75 bp, Artificial Sequence
  Synthetic
ccagcgaccaaacaaacccctaacacttgtaggcgataaactttgcattggtgacaaatactgtatgatagcatt

SEQ ID NO: 15027 - DNA, 75 bp, Artificial Sequence
  Synthetic
aataagctgaaataatcaaattaaaatagacataatgggagggtggtgggagttttctgctgatataataattat

SEQ ID NO: 15028 - DNA, 75 bp, Artificial Sequence
  Synthetic
aaatagcaggggtattatctagaattgcagtgtcaataaatcagaaaaattataaatactccactatagttcata

SEQ ID NO: 15029 - DNA, 75 bp, Artificial Sequence
  Synthetic
atataacattctcaataccattgatgactggactatcacagggtttcacattgcaagatcacaaaggtaacaccc

SEQ ID NO: 15030 - DNA, 75 bp, Artificial Sequence
  Synthetic
agtagtatacctaaaaaagataattggctcaccttctctcgcgagcataccagcacctggggctgtgaagaatgg

SEQ ID NO: 15031 - DNA, 75 bp, Artificial Sequence
  Synthetic
gtgtgtatgggtcttgccaagatgtcattagagaagaagcaacagttatttccagagtaaataatgagcagttgg

SEQ ID NO: 15032 - DNA, 75 bp, Artificial Sequence
  Synthetic
tccagagtaaataatgagcagttggaagttgaattttgtgtttcagagcctacaggtacaatgtgtaatactatc

SEQ ID NO: 15033 - DNA, 75 bp, Artificial Sequence
  Synthetic
aatagatgatgctgcaatgtgcattggtctatatcaaaatataacccagccaaaggaatacaatgcctttgtgaa

SEQ ID NO: 15034 - DNA, 75 bp, Artificial Sequence
  Synthetic
ttgcatgtaaggtcagcatgacttcaaatggtgtttatcagtgcccaatagtatcttcctgtgattcttatatca

SEQ ID NO: 15035 - DNA, 75 bp, Artificial Sequence
  Synthetic
gtatcttcctgtgattcttatatcaataatgtttatattaatgaaggcacaaatgatgttagcttgaagtttcga

SEQ ID NO: 15036 - DNA, 75 bp, Artificial Sequence
  Synthetic
aagaagctggatttagctagtgctgatcaaacatcctatatcaaagagtttgataaaaaatgcgccacatggcta

SEQ ID NO: 15037 - DNA, 75 bp, Artificial Sequence
  Synthetic
tgagttaagtttgtgggggaaatatgttatgcttgcattagctataattaccagcatcctgatccttataaaagt

SEQ ID NO: 15038 - DNA, 75 bp, Artificial Sequence
  Synthetic
aagtgtacaaactggaaaataaattgaaataatctaatttaaatagacataatgggagggtggtgggagttttct

SEQ ID NO: 15039 - DNA, 75 bp, Artificial Sequence
  Synthetic
aataaattgaaataatctaatttaaatagacataatgggagggtggtgggagttttctgctgatataataattat

SEQ ID NO: 15040 - DNA, 75 bp, Artificial Sequence
  Synthetic
aatgattattacaattatcactataattacattagcagtcactgtaactgcaatgcctccacgtaatacaaacgg

SEQ ID NO: 15041 - DNA, 75 bp, Artificial Sequence
  Synthetic
gggtagatgcttttacggtggcaatatgtttcgccaaattaattcaacatcaccaatgagcgaaatctgtgttag

SEQ ID NO: 15042 - DNA, 75 bp, Artificial Sequence
  Synthetic
ggacgatatatccctggttaaatctatcggttatcataaactggcagcaaacaggaaagttattgagtcaagcat

SEQ ID NO: 15043 - DNA, 75 bp, Artificial Sequence
  Synthetic
atcatactacagattatattatgtcaaaaattggtttgagtgcaatcccgtccaagatattcttggaacttttat

SEQ ID NO: 15044 - DNA, 75 bp, Artificial Sequence
  Synthetic
ggtcttcgatgtgaatcatgagggtgtattagcacctaagacttatgcctgtagagctacttgctcgataagttt

SEQ ID NO: 15045 - DNA, 75 bp, Artificial Sequence
  Synthetic
ggaacgagacactggaaatgttgtcttagaatccccggcattaaatcactatactatacatgggacaactatcaa

SEQ ID NO: 15046 - DNA, 75 bp, Artificial Sequence
  Synthetic
aaacggctggttcaagacaaaagtttccatagacctagacaacacatgtgaagacttgcacattacatgcggtca

SEQ ID NO: 15047 - DNA, 75 bp, Artificial Sequence
  Synthetic
taaaaccctcaatgtccatgcatgcttcaggcaacataaatcatgcattcgttacttcaaaggatcaatcttgcc

SEQ ID NO: 15048 - DNA, 75 bp, Artificial Sequence
  Synthetic
tgaaatcatgattgagtcaatctgcacaaacgcagagttgatattattatgttgtttttctgcaatttcttgttt

SEQ ID NO: 15049 - DNA, 75 bp, Artificial Sequence
  Synthetic
tgtggcaattgtcttgacaaaaacgtacctagtatatctgctcataccagttttttacccatttgtaaaggctta

SEQ ID NO: 15050 - DNA, 75 bp, Artificial Sequence
  Synthetic
tggtttattgctgcagagattctgcaaacaatgcaaaaattgcttattgccaattcatcctttcagcccttgccc

SEQ ID NO: 15051 - DNA, 75 bp, Artificial Sequence
  Synthetic
aacaacatgtatctgtggaatggtttataattctactgaagctttaaaagtccacagaaaatgtttgaactgcac

SEQ ID NO: 15052 - DNA, 75 bp, Artificial Sequence
  Synthetic
aataagttgaaataatctaatttaaatagacataatgggagggtggtgggagttttctgctaatataataattat

SEQ ID NO: 15053 - DNA, 75 bp, Artificial Sequence
  Synthetic
tgggtataagactctgactaaaacaagatatttgtgcaaaaaaagactccccaatatggcactagccataatcag

SEQ ID NO: 15054 - DNA, 75 bp, Artificial Sequence
  Synthetic
aggtatttatgtaaaaaaagactccccaatatggtattggccacaatcagcacagtactgttcttcacttttata

SEQ ID NO: 15055 - DNA, 75 bp, Artificial Sequence
  Synthetic
tacaatactgttcttcacatttataactcctataacagctgaatgctataactatacaagcttacctacagactt

SEQ ID NO: 15056 - DNA, 75 bp, Artificial Sequence
  Synthetic
ccaagctgccatagatagaaacaattcttgcacgcgtgaacaattgataatgatcatattaacaatcttgtgtat

SEQ ID NO: 15057 - DNA, 75 bp, Artificial Sequence
  Synthetic
tgcctcgattatcgtagttatatcagcagtccacctatacatacgtatatgctatgtgttctgtgcttactgtgg

SEQ ID NO: 15058 - DNA, 75 bp, Artificial Sequence
  Synthetic
gcagtccacctatacatacgtatatgctatgtgttctgtgcttactgtggaatggtacatgagaagaagggctta

SEQ ID NO: 15059 - DNA, 75 bp, Artificial Sequence
  Synthetic
atcttactagataacttcacatcccattgtcttacatgcatttgccgtgataagagtatacatagggctaacaac

SEQ ID NO: 15060 - DNA, 75 bp, Artificial Sequence
  Synthetic
aattgtgttgctccaatgaagtataaaactgtcaaatataccaatctattatgtattttctctctaattatcatt

SEQ ID NO: 15061 - DNA, 75 bp, Artificial Sequence
  Synthetic
gctgttactcctgcttttagtgcttgcatacaagagaaagacattgaaacaatagatgatgctgcaatgtgtatt

SEQ ID NO: 15062 - DNA, 75 bp, Artificial Sequence
  Synthetic
ggtctgtatcaaaatataactcagccgaaagagtacaacgctttcgtgaaagaactctcatcaacattaagtagt

SEQ ID NO: 15063 - DNA, 75 bp, Artificial Sequence
  Synthetic
atcccaggactagttggtaatttactgcgacaggttctgaaatcccaaaaatatggggagtcattgcatgtcttg

SEQ ID NO: 15064 - DNA, 75 bp, Artificial Sequence
  Synthetic
catgaaattgaattcctcttaccagctgtcaaaccgtcatttgattttttaataaccaaatcgtccacatccaaa

SEQ ID NO: 15065 - DNA, 75 bp, Artificial Sequence
  Synthetic
gatctccatagtgccaccacctatgagtttatagctgccaatctataccctaataacttcaagaggcatctaaca

SEQ ID NO: 15066 - DNA, 75 bp, Artificial Sequence
  Synthetic
acctagttgactgctcttggagtgaatcgactcactctaccctaaaccagaaagtgatatctcacacagatatag

SEQ ID NO: 15067 - DNA, 75 bp, Artificial Sequence
  Synthetic
ccagcagggccagacagcatacaatggagaacatacattcaaaataacaacttacacttatgcaatgaccatgtt

SEQ ID NO: 15068 - DNA, 75 bp, Artificial Sequence
  Synthetic
gtcaaaatgatatgtcgttgcatactcaaacaagaagaatgcagttctacaaaaacggatgatggggaccagatt

SEQ ID NO: 15069 - DNA, 75 bp, Artificial Sequence
  Synthetic
aacatatgcaatttgaagtccacagtgtacagactaatctattgccagagatagctttaattaaaaataggaaag

SEQ ID NO: 15070 - DNA, 75 bp, Artificial Sequence
  Synthetic
gtccagtactataagaaaaataaagaattttataaagctgacttagaaatactttacacaactatatcaagagca

SEQ ID NO: 15071 - DNA, 75 bp, Artificial Sequence
  Synthetic
agaaaagatatagtcgtgaggaaatgctatgaaaatcattactattcctgcgctacactcaaagaagctgtagaa

SEQ ID NO: 15072 - DNA, 75 bp, Artificial Sequence
  Synthetic
atcccagggttggttgggaatttattgagacaggttttaagatctcagaaatatgaagagtcattacatatattg

SEQ ID NO: 15073 - DNA, 75 bp, Artificial Sequence
  Synthetic
agactatgctttacaatgataatgctttacttggtagtgcgtctgtaaagataatgttaggcgacttaatatacc

SEQ ID NO: 15074 - DNA, 75 bp, Artificial Sequence
  Synthetic
aataagataaagaaagacgtcgcaaaaaataatcaactaaatggcatagtggatttcctgatacacatcaattca

SEQ ID NO: 15075 - DNA, 75 bp, Artificial Sequence
  Synthetic
aaaaatataaccgaggaagttagagaattaagaattaggcctgatcttagtgtcagaggatccaaattcacagac

SEQ ID NO: 15076 - DNA, 75 bp, Artificial Sequence
  Synthetic
tgtcagaggatccaaattcacagacaaaaacccaggaatttctaacatcaaggaatgtcagactccattgtttat

SEQ ID NO: 15077 - DNA, 75 bp, Artificial Sequence
  Synthetic
aaaaacccaggaatttctaacatcaaggaatgtcagactccattgtttattacatgtactgggaagaggtttcgg

SEQ ID NO: 15078 - DNA, 75 bp, Artificial Sequence
  Synthetic
tgcagagcttataatgaaggaattggctttgtcttagaaccattatggaatgagttaagcttgtgggggaaatat

SEQ ID NO: 15079 - DNA, 75 bp, Artificial Sequence
  Synthetic
tcgttaatgaaacagtatattgcttgttccaatggaggtgtcaagttatatcaacgacctaacaaacctttagtg

SEQ ID NO: 15080 - DNA, 75 bp, Artificial Sequence
  Synthetic
cttataagcgataaactttgcatcggtgacagatattgtatgatatcatttgacccaatggtgatagatgaaaat

SEQ ID NO: 15081 - DNA, 75 bp, Artificial Sequence
  Synthetic
atgcgaaaattagattgttatagcttagctgccacagaccaatcagacggaatgttgaaacctgaaagatctatt

SEQ ID NO: 15082 - DNA, 75 bp, Artificial Sequence
  Synthetic
cggctcctcaagacaggtgaatgcaaaatagcaggagtattatccagaattgcagtatcagtgaatcagagaaat

SEQ ID NO: 15083 - DNA, 75 bp, Artificial Sequence
  Synthetic
tataaatactctactatagttcataagaaaagtgatttagttgatgagtattgtctaagcccaaattgcgatcta

SEQ ID NO: 15084 - DNA, 75 bp, Artificial Sequence
  Synthetic
gattgctatccatattacccaactaatctggacgactgctcctggagtgaatcaacccattctactctgagccag

SEQ ID NO: 15085 - DNA, 75 bp, Artificial Sequence
  Synthetic
tacatgtactgggaaaagatttcggtcactgatgaaacagtacattgcttgctccaacgggggtgtcaagttata

SEQ ID NO: 15086 - DNA, 75 bp, Artificial Sequence
  Synthetic
aaggtaatatctcatacagatatagaatcatttatatccagtgttaagctctcgctacataacgatttaatccaa

SEQ ID NO: 15087 - DNA, 75 bp, Artificial Sequence
  Synthetic
caccatttcagaccgcttagtaacatgccacacataaagcccaatttcaagtcaataaatgttcaaggaacgatt

SEQ ID NO: 15088 - DNA, 75 bp, Artificial Sequence
  Synthetic
gtcaataaatgttcaaggaacgatttctggtggcaagattcaagacagctacataacattctcaataccattaat

SEQ ID NO: 15089 - DNA, 75 bp, Artificial Sequence
  Synthetic
tctggtggcaagattcaagacagctacataacattctcaataccattaatgactgggctatcgcaaggtttcact

SEQ ID NO: 15090 - DNA, 75 bp, Artificial Sequence
  Synthetic
ttacaggatcccaaaggtaatactctctttgacattgtagcatacgtaaaaagtgcacgcgtgattgcaacatat

SEQ ID NO: 15091 - DNA, 75 bp, Artificial Sequence
  Synthetic
aaccatgaatacaaaacagggcctacagtaagcatcaatgttcaacacaatgaaaaatgcacaggatcctgcccc

SEQ ID NO: 15092 - DNA, 75 bp, Artificial Sequence
  Synthetic
agtaatatacctaaaaaggagaattggttgaccttctctcgtgagcatactagcacatggggctgcgaggaatgg

SEQ ID NO: 15093 - DNA, 75 bp, Artificial Sequence
  Synthetic
ggttgcctagcaataggcacagggtgtgtgtatgggtcttgccaagatgtcatcaaagaagaagcaacagttatt

SEQ ID NO: 15094 - DNA, 75 bp, Artificial Sequence
  Synthetic
tccaaggtgaataacgagcaattggaggttgaattctgtgtttcagatcctacaagcacaatgtgcaatactatc

SEQ ID NO: 15095 - DNA, 75 bp, Artificial Sequence
  Synthetic
aataagctgaaataaaaaattaaagatagacataatgggagggtggtgggagtttcctgctgatataataattat

SEQ ID NO: 15096 - DNA, 75 bp, Artificial Sequence
  Synthetic
aatgtgcttgagccagtattaggagagcacatgcagtttgaagtccacagtgtacaaactaacttactacctgaa

SEQ ID NO: 15097 - DNA, 75 bp, Artificial Sequence
  Synthetic
gtagctttaattaaaaatagaagagtatacaagggttcaataaataagaggggcgtatttaaccctcaatgtggt

SEQ ID NO: 15098 - DNA, 75 bp, Artificial Sequence
  Synthetic
tcagttcaatcatttgatggtaaactctatggtattggaaatccgaaatttgactatatttgccatgcattgtca

SEQ ID NO: 15099 - DNA, 75 bp, Artificial Sequence
  Synthetic
aggaaagatatagtcgttaggaaatgttatgaaaatcattattattcatgtagtgtgcttaaagaagctgtggaa

SEQ ID NO: 15100 - DNA, 75 bp, Artificial Sequence
  Synthetic
aacaacatgtatctgtgggatggtttataattctagtgaggccttaaaagttcacagaaaatgcttaaactgcac

SEQ ID NO: 15101 - DNA, 75 bp, Artificial Sequence
  Synthetic
attaaatcaaatattacaaattcgaaaattatgctttacaatgataatactctgcttggcagtgcttctataaag

SEQ ID NO: 15102 - DNA, 75 bp, Artificial Sequence
  Synthetic
ataatgttaggtgatttaatataccaacaatcatcaatacaggaaaaggatataaggggtcatgcaacctgcggg

SEQ ID NO: 15103 - DNA, 75 bp, Artificial Sequence
  Synthetic
gttatgtattttgtgcttattgtggaatggtacatgaaaagaagggtctagttttactagataatttcacatctc

SEQ ID NO: 15104 - DNA, 75 bp, Artificial Sequence
  Synthetic
ggctgcacagattgctttaacgacgttgcatgcaaaattagtataacttcgaacggtgtttatcaatgcccgata

SEQ ID NO: 15105 - DNA, 75 bp, Artificial Sequence
  Synthetic
gtgtcttcctgcgattcttatatcaataatgtttatattaatgaaggcacaaatgatgtcaacctaaaattccga

SEQ ID NO: 15106 - DNA, 75 bp, Artificial Sequence
  Synthetic
gtgcattgtcttcctgattatcattgctgttactcctgcttttagtgcttgcacacaagagaaggaaatagaaac

SEQ ID NO: 15107 - DNA, 75 bp, Artificial Sequence
  Synthetic
tgtcttaaggcagaaatcaaaattagtatctgtgataaagaaatatctgtgaaatctgagataattaaagacaca

SEQ ID NO: 15108 - DNA, 75 bp, Artificial Sequence
  Synthetic
ctgttaagccatcattcgactatctgacaactaaatcatctacatctaaagatctccacagtgccactattcatg

SEQ ID NO: 15109 - DNA, 75 bp, Artificial Sequence
  Synthetic
aagaaactagatttagcaagtgccgaccaaacatcttatatcaaagagtttgacaaaaaatgcagtacatggcta

SEQ ID NO: 15110 - DNA, 75 bp, Artificial Sequence
  Synthetic
tgtagagcctacaatgaggggattggctttattttggaaccactatggaatgagttaggcttgtgggggaagtat

SEQ ID NO: 15111 - DNA, 75 bp, Artificial Sequence
  Synthetic
gtcctgattgcattaactataattatcagtatcttgatccttataaaagtgataaggccattggcaagatatatc

SEQ ID NO: 15112 - DNA, 75 bp, Artificial Sequence
  Synthetic
gtcagagtactcaaagagaatgacaaggtgtacaaattagaaaataaactaaaataaccaaattaaattagacat

SEQ ID NO: 15113 - DNA, 75 bp, Artificial Sequence
  Synthetic
aataagattaagaaagacgtttcaaaaattaaccaactgaatggcatagtagaattcttaatacatattaattca

SEQ ID NO: 15114 - DNA, 75 bp, Artificial Sequence
  Synthetic
aataaactaaaataaccaaattaaattagacataatgggagggtggtgggaattttctgctgatataataatcat

SEQ ID NO: 15115 - DNA, 75 bp, Artificial Sequence
  Synthetic
agtagtgtactccactattaactacttattgcaatggcaaatcaatttgttttcaacgatgttccacaacggaat

SEQ ID NO: 15116 - DNA, 75 bp, Artificial Sequence
  Synthetic
gcagctacatttaatccggacacggggtatgtggcatttatcagtaagtatgggcaacatctcaacttttctgtt

SEQ ID NO: 15117 - DNA, 75 bp, Artificial Sequence
  Synthetic
gctagagtcttcttcctcaaccagaagaaagccaagatggtcctacataagacgccacaaccgagtgtcgatctt

SEQ ID NO: 15118 - DNA, 75 bp, Artificial Sequence
  Synthetic
ccagagaccaaacaaacccctaacacttgtaggcgataagctctgcattggtgataaatactgtatgatagcatt

SEQ ID NO: 15119 - DNA, 75 bp, Artificial Sequence
  Synthetic
acatttgctggggtcaaattcacagtggttaataaccattttccccagtacactgcaaatacagtgtcagacact

SEQ ID NO: 15120 - DNA, 75 bp, Artificial Sequence
  Synthetic
gcctttaccctccaccgcatctcagggtatctagcaagatgggttgctgagcaatgcaagggcaaccagattaag

SEQ ID NO: 15121 - DNA, 75 bp, Artificial Sequence
  Synthetic
ctagctgaggcagctgcgactattgttatgccactggctgagatcaagggctgcacatggaatgatggttatacc

SEQ ID NO: 15122 - DNA, 75 bp, Artificial Sequence
  Synthetic
atgtatctgggtttcgctcctggggcagaaatgttcctagagacctttgagttctacccacttgtcatagacatg

SEQ ID NO: 15123 - DNA, 75 bp, Artificial Sequence
  Synthetic
ctccttgcacaatgatctgatccaacaccatttcaggccgctaagcaacatgccacatataaagcctaatttcaa

SEQ ID NO: 15124 - DNA, 75 bp, Artificial Sequence
  Synthetic
catcgcgtcttaaaagacggaatggatgtgaacttcatgagaaaggtcttacgccagagatatggtcagctcaca

SEQ ID NO: 15125 - DNA, 75 bp, Artificial Sequence
  Synthetic
tctggcagcaagattcaagacagctatataacattctcaataccattgatgactggactatcacaaggttttaca

SEQ ID NO: 15126 - DNA, 75 bp, Artificial Sequence
  Synthetic
gcggaagaatggatgacaactaaggttgatgcagtgaaagcagcatttggatctgttgcccagatatcttgggcc

SEQ ID NO: 15127 - DNA, 75 bp, Artificial Sequence
  Synthetic
aagtgcgcgtgtagttgcgacatataatcatgactataaaactggacccacagtgagcatcaatgttcaacataa

SEQ ID NO: 15128 - DNA, 75 bp, Artificial Sequence
  Synthetic
aaatccggattctcccctgcagcacgtgctttccttactcagtttggcatccagatctaggcacctcttccagtc

SEQ ID NO: 15129 - DNA, 75 bp, Artificial Sequence
  Synthetic
ttttcctaattttccctcttagtgtaccatgtctatgtgatacacgccatttcagcagtattgattattcattca

SEQ ID NO: 15130 - DNA, 75 bp, Artificial Sequence
  Synthetic
ggctgcctagcaataggcacggggtgtgtatatggatcctgccaagatgtcattagagaagaagcaacggttatt

SEQ ID NO: 15131 - DNA, 75 bp, Artificial Sequence
  Synthetic
accatgtctatgtgatacacgccatttcagcagtattgattattcattcatagttaaatagtggagtacactact

SEQ ID NO: 15132 - DNA, 75 bp, Artificial Sequence
  Synthetic
gcattgcaatggcaaatcaattcattttcaacgatgttccacaacggaatgcagctacatttaatccggatgcag

SEQ ID NO: 15133 - DNA, 75 bp, Artificial Sequence
  Synthetic
aaactatgctttataacgataatgctttacttggtagtgcatcaataaggataatgttaggcgatctaatatatc

SEQ ID NO: 15134 - DNA, 75 bp, Artificial Sequence
  Synthetic
aacaggcatcagtgcaagaaagagatataagaggtcatgcaacttgtggaggttgcacagattgttttaatgatg

SEQ ID NO: 15135 - DNA, 75 bp, Artificial Sequence
  Synthetic
ggttgcacagattgttttaatgatgttgcatgcaaaatcagcatgacttcaaatggtgtttaccagtgcccgata

SEQ ID NO: 15136 - DNA, 75 bp, Artificial Sequence
  Synthetic
cactgcaaatccagtgtcagacactgcctttacgcttcaccgcatctcgggctacttagctcgctgggttgctga

SEQ ID NO: 15137 - DNA, 75 bp, Artificial Sequence
  Synthetic
tttgcagaggcagctgccacaattgtgatgccactggctgaggtgaagggttgcacctggagtgacgggtatgca

SEQ ID NO: 15138 - DNA, 75 bp, Artificial Sequence
  Synthetic
aagaagctggatttagctagtgctgaccaaacatcctatatcaaggaatttgataaaaaatgtgccacatggcta

SEQ ID NO: 15139 - DNA, 75 bp, Artificial Sequence
  Synthetic
ttgcacctggagtgacgggtatgcaatgtacctgggatttgcccctggtgctgagatgtttctggaaacctttga

SEQ ID NO: 15140 - DNA, 75 bp, Artificial Sequence
  Synthetic
tggacgcagtcaaggctgcatttggctcagttgcccaaatatcctgggctaaatctggcttctcacctgcagcta

SEQ ID NO: 15141 - DNA, 75 bp, Artificial Sequence
  Synthetic
ctcagttgcccaaatatcctgggctaaatctggcttctcacctgcagctagagctttcctggctcaatttggtat

SEQ ID NO: 15142 - DNA, 75 bp, Artificial Sequence
  Synthetic
aaatctggcttctcacctgcagctagagctttcctggctcaatttggtatccagatctaagcttaactgattctc

SEQ ID NO: 15143 - DNA, 75 bp, Artificial Sequence
  Synthetic
gagctttcctggctcaatttggtatccagatctaagcttaactgattctccagttttttcttttttctcttccta

SEQ ID NO: 15144 - DNA, 75 bp, Artificial Sequence
  Synthetic
ttttttctcttcctaagtgcaccatgtctatgtggtgcacacctttgttcagctgcttggattttattgtttata

SEQ ID NO: 15145 - DNA, 75 bp, Artificial Sequence
  Synthetic
gcagtccacctatacatacgtatatgctatgtgttctgtgcttactgtggaatggtatacgagaagaagggctta

SEQ ID NO: 15146 - DNA, 75 bp, Artificial Sequence
  Synthetic
aaaaacccaggaatttctaacatcaaggaatgtcagactccattgtttattacatgtattgggaagaggttttgg

SEQ ID NO: 15147 - DNA, 75 bp, Artificial Sequence
  Synthetic
aaaagtggatgatggtggacagattgcacagtactacaaaagaaacaaagaattttataaagctgatttggagat

SEQ ID NO: 15148 - DNA, 75 bp, Artificial Sequence
  Synthetic
aattttataaagctgatttggagatattatacacagttatatcaagagcaatcccaggactagttggtaatttac

SEQ ID NO: 15149 - DNA, 75 bp, Artificial Sequence
  Synthetic
aagaatgccaaactccactgtttattacatgtactgggaaaagatttcgatcactgatgaaacagtacattgctt

SEQ ID NO: 15150 - DNA, 75 bp, Artificial Sequence
  Synthetic
gtgacaaatactgcatgatagcatttgacccaatggtgatagatgaaaatatacaaaaactggactgttatagcc

SEQ ID NO: 15151 - DNA, 75 bp, Artificial Sequence
  Synthetic
aagtgcgcgtgtaattgcaacatataatcatgagtacaagacaggacctacagtaagtatcaatgttcagcataa

SEQ ID NO: 15152 - DNA, 75 bp, Artificial Sequence
  Synthetic
aatcatgagtacaagacaggacctacagtaagtatcaatgttcagcataatgagcaatgcacgggatcttgcccc

SEQ ID NO: 15153 - DNA, 75 bp, Artificial Sequence
  Synthetic
caccaatgagtgaaatctgtgtcagagatgacatatccctggttaaatccattggttatcacaagttggcagcaa

SEQ ID NO: 15154 - DNA, 75 bp, Artificial Sequence
  Synthetic
atagagaggttatcgagtcaagtatgtcgtactacagattgtattatgtcaagaattggttcgagtgcaatccag

SEQ ID NO: 15155 - DNA, 75 bp, Artificial Sequence
  Synthetic
gcagtccacctgtacatacggatatgctatgtattttgtgcttactgtggaatggtgcatgaaaagaagggcttg

SEQ ID NO: 15156 - DNA, 75 bp, Artificial Sequence
  Synthetic
tctatagatctggacaacacatgtgaggacctacatattacatgtggtcataaaactcttaatgttcatgcatgc

SEQ ID NO: 15157 - DNA, 75 bp, Artificial Sequence
  Synthetic
tttaggcaacataaatcatgtattcgttacttcaaggggtcaatcttacccgaaatcatgatcgagtcaatctgt

SEQ ID NO: 15158 - DNA, 75 bp, Artificial Sequence
  Synthetic
cattagagaagaagcaacagttatttctagaataaataacgagcagttggaagttgagttttgtgtttcagagtc

SEQ ID NO: 15159 - DNA, 75 bp, Artificial Sequence
  Synthetic
cgaaatcatgatcgagtcaatctgtacaaatgcagagctgatattactctgctgcttctctgcaatctcttgctt

SEQ ID NO: 15160 - DNA, 75 bp, Artificial Sequence
  Synthetic
atcgactcactctaccctaaaccagaaagtgatatctcacacagatatagaatcatttatatctagtgttaagct

SEQ ID NO: 15161 - DNA, 75 bp, Artificial Sequence
  Synthetic
aggtatttgtgtaaaaagagactccctaatatggtattggccattatcagcacagtactattctttactttcata

SEQ ID NO: 15162 - DNA, 75 bp, Artificial Sequence
  Synthetic
tacgcattgcaatggcaaatcaattcattttcaacgatgttccacaacggaatgcagctacatttaatccggatg

SEQ ID NO: 15163 - DNA, 75 bp, Artificial Sequence
  Synthetic
acccctataacagctgaatgctataattacacaagtttacctgcagattttcaagctgctatagataaaaataat

SEQ ID NO: 15164 - DNA, 75 bp, Artificial Sequence
  Synthetic
tcatgcacacgtgagcaattgataatgatcatattaacaatcctatgtattgcctcgatcattgtagttatatca

SEQ ID NO: 15165 - DNA, 75 bp, Artificial Sequence
  Synthetic
gcagttcacctgtatatacggatatgttatgtattttgtgcttattgcggaatggtgcatgaaaagaagggccta

SEQ ID NO: 15166 - DNA, 75 bp, Artificial Sequence
  Synthetic
ttgtgatgccgctggctgaggtaaagggttgcacttggagtgacgggtatgcaatgtacctagggtttgcccctg

SEQ ID NO: 15167 - DNA, 75 bp, Artificial Sequence
  Synthetic
gtgcattgtcttcttgattatcattgctattacccctgcttttagtgcttgcatacaagagaaagaaatagaaac

SEQ ID NO: 15168 - DNA, 75 bp, Artificial Sequence
  Synthetic
tgagttttacccactggttatcgacatgcaccgtgtgataaaggatgggatggatgtcaacttcatgaggaaggt

SEQ ID NO: 15169 - DNA, 75 bp, Artificial Sequence
  Synthetic
atgcaccgtgtgataaaggatgggatggatgtcaacttcatgaggaaggtcttacgccagaggtatgggcagctg

SEQ ID NO: 15170 - DNA, 75 bp, Artificial Sequence
  Synthetic
gatcttcatagtgctattattcacgaatttatagctgcaaatctctatcctaataatttcaaaaaacatttgaca

SEQ ID NO: 15171 - DNA, 75 bp, Artificial Sequence
  Synthetic
ttgcttctatttctaagtgcaccatgtctatgtggtgcacacctttgttcagctgcttggattttattgtttata

SEQ ID NO: 15172 - DNA, 75 bp, Artificial Sequence
  Synthetic
aaaaatagatgatggagagcagattgtgcattactataagggaaacaaagagctttataaggctgatctggagat

SEQ ID NO: 15173 - DNA, 75 bp, Artificial Sequence
  Synthetic
actgtacacagtcatatcgagagcaatcccaggactggtcggcaatttactgcgacaagttcttaagtctcaaaa

SEQ ID NO: 15174 - DNA, 75 bp, Artificial Sequence
  Synthetic
gtcgtactacaggttgtattacgtcaaaaattggttcgagtgcaatcctgttcaagatattcttggaacttttat

SEQ ID NO: 15175 - DNA, 75 bp, Artificial Sequence
  Synthetic
agaattcttaatacatattaattcgaagaacattacagaagaggttagggaattaagaattaggcctgatcttag

SEQ ID NO: 15176 - DNA, 75 bp, Artificial Sequence
  Synthetic
tattaggggatccaaattcacaaacaagagcccaggaactcctaacatcaaagaatgccaaactccaatgttcat

SEQ ID NO: 15177 - DNA, 75 bp, Artificial Sequence
  Synthetic
aagaatgccaaactccaatgttcataacatgtactgggaagaggtttcgatcactaacgaaacagtatattgctt

SEQ ID NO: 15178 - DNA, 75 bp, Artificial Sequence
  Synthetic
gttccaatggaggtgttaagctataccagcgaccaaacaaaccgctaacacttgtaggcgacaaactttgcattg

SEQ ID NO: 15179 - DNA, 75 bp, Artificial Sequence
  Synthetic
gtgacaaatactgtatgatagcatttgacccaatggtagtagatgaaaatatacaaaaactggactgttatagtt

SEQ ID NO: 15180 - DNA, 75 bp, Artificial Sequence
  Synthetic
atacaaaaactggactgttatagtttagctgctacagaccagtcaaatggaatgttgaaacctgaaaggtctatt

SEQ ID NO: 15181 - DNA, 75 bp, Artificial Sequence
  Synthetic
aaatagcaggggttttatctagaattgcaatgtcaataaatcagaagaattataagtactctgctatagttcata

SEQ ID NO: 15182 - DNA, 75 bp, Artificial Sequence
  Synthetic
tataagtactctgctatagttcataagaagagtgatttggttgatgagtattgtctaagcccaaattgtgatcta

SEQ ID NO: 15183 - DNA, 75 bp, Artificial Sequence
  Synthetic
agaagagtgatttggttgatgagtattgtctaagcccaaattgtgatctagattgctacccttattattcagaca

SEQ ID NO: 15184 - DNA, 75 bp, Artificial Sequence
  Synthetic
tggttaataaccattttccccagtacactgcaaatccagtgtcagacactgcctttacgctccatcgcatctcag

SEQ ID NO: 15185 - DNA, 75 bp, Artificial Sequence
  Synthetic
ctccttgcacaatgatctgatccaacaccatttcaggccactaagtaacatgccacatataaagcccaatttcaa

SEQ ID NO: 15186 - DNA, 75 bp, Artificial Sequence
  Synthetic
gctatttagctcgctggattgctgagcagtgcaagggtaaccagatcaagtttgcagaggcagctgccacagttg

SEQ ID NO: 15187 - DNA, 75 bp, Artificial Sequence
  Synthetic
tgatgcctttggctgaagtgaagggctgcacttggagtgatgggtatgcaatgtacttgggatttgccccaggtg

SEQ ID NO: 15188 - DNA, 75 bp, Artificial Sequence
  Synthetic
tctttgacattatagcatatgtgaaaagtgcacgtgtagttgcaacatataaccatgagtataaaacaggaccca

SEQ ID NO: 15189 - DNA, 75 bp, Artificial Sequence
  Synthetic
ctgaaatgttcctcgagacatttgagttctacccactggttatcgacatgcaccgtgtgataaaagatgggatgg

SEQ ID NO: 15190 - DNA, 75 bp, Artificial Sequence
  Synthetic
cagtgagcatcaatgttcaacataatgaacaatgcacaggatcctgccctagtaacatacctaaaaaagataatt

SEQ ID NO: 15191 - DNA, 75 bp, Artificial Sequence
  Synthetic
atgtcaacttcatgaggaaggtcctacgccagaggtatggacagctgactgcagaagagtggatgacatctaagt

SEQ ID NO: 15192 - DNA, 75 bp, Artificial Sequence
  Synthetic
ggctaaccttctctcgcgagcataccagcacctggggttgtgaagaatggggttgcttagcaataggcacggggt

SEQ ID NO: 15193 - DNA, 75 bp, Artificial Sequence
  Synthetic
tagacgcagtcaaggctgcatttggctcagttgcccagatatcttgggccaagtctggcttctcacctgcagcta

SEQ ID NO: 15194 - DNA, 75 bp, Artificial Sequence
  Synthetic
gagctttcctggcccaatttggtatccagatctaatcttaactgattctccagtcttctgtcttctctttctaag

SEQ ID NO: 15195 - DNA, 75 bp, Artificial Sequence
  Synthetic
aatgtacttgaaccagtactgggagagcacatgcagtttgaagtccacagtgtacagactaatctattacctgaa

SEQ ID NO: 15196 - DNA, 75 bp, Artificial Sequence
  Synthetic
tgcaccatgtctatgtggtgcatacctttattcagctgcttggattttattgtttatagttaattagtggagcac

SEQ ID NO: 15197 - DNA, 75 bp, Artificial Sequence
  Synthetic
atgtctatgtggtgcatacctttattcagctgcttggattttattgtttatagttaattagtggagcacactact

SEQ ID NO: 15198 - DNA, 75 bp, Artificial Sequence
  Synthetic
gtggctttgatcaaaaataggagggtgtacaaggggtcaataaacaagaaaggtgtattcaaccctcaatgtggt

SEQ ID NO: 15199 - DNA, 75 bp, Artificial Sequence
  Synthetic
aggaaagacatagttgtgagaaaatgttacgaaaatcactactattcatgcgctacgctcaaggaggctgtagaa

SEQ ID NO: 15200 - DNA, 75 bp, Artificial Sequence
  Synthetic
ggctgcacagattgttttaatgatgttgcgtgcaaaatcagcataacttcaaatggtgtttatcaatgtccaata

SEQ ID NO: 15201 - DNA, 75 bp, Artificial Sequence
  Synthetic
gtgtcttcctgtgattcttatatcaataatgtttatattaatgaaggcacaaatgatgtgagcttgaaattccga

SEQ ID NO: 15202 - DNA, 75 bp, Artificial Sequence
  Synthetic
aatgattattacaattctcaacatccttacattagtagtcgctgtgactgcaatgcctcctcgtaatacgaatgg

SEQ ID NO: 15203 - DNA, 75 bp, Artificial Sequence
  Synthetic
aaatgatgtgagcttgaaattccgatgtttaaaggcagaaatcaaaattagtatttgtggtaaagagatacctgt

SEQ ID NO: 15204 - DNA, 75 bp, Artificial Sequence
  Synthetic
tgtttaaaggcagaaatcaaaattagtatttgtggtaaagagatacctgtcaaatcagagataattaaggataca

SEQ ID NO: 15205 - DNA, 75 bp, Artificial Sequence
  Synthetic
caaatcagagataattaaggatacaaagaaactagatttagctagtgctgatcaaacatcctacatcaaagagtt

SEQ ID NO: 15206 - DNA, 75 bp, Artificial Sequence
  Synthetic
atagagaagtcattgaatcaagcatgtcatactacaggctgtattatgtcaaaaattggtttgagtgcaatccag

SEQ ID NO: 15207 - DNA, 75 bp, Artificial Sequence
  Synthetic
tgacaaaaaatgcgccacatggctatgcagagcttataatgagggaattggatttatcttacaaccattatggaa

SEQ ID NO: 15208 - DNA, 75 bp, Artificial Sequence
  Synthetic
aaaaattggtttgagtgcaatccagttcaggatatcctcggaacttttatggtcttcgatgtgaatcatgagggc

SEQ ID NO: 15209 - DNA, 75 bp, Artificial Sequence
  Synthetic
tgagttaagcttgtgggggaaatatgttttgcttacattagccataattatcagtatcctgatccttataaaagt

SEQ ID NO: 15210 - DNA, 75 bp, Artificial Sequence
  Synthetic
gttttgcttacattagccataattatcagtatcctgatccttataaaagtgataagaccactagcaaggtatatt

SEQ ID NO: 15211 - DNA, 75 bp, Artificial Sequence
  Synthetic
ttggaatcctcagcattgaaccactatacaatacatgggacaactatcaaaaatggctggttcaagacaaaggtc

SEQ ID NO: 15212 - DNA, 75 bp, Artificial Sequence
  Synthetic
tctatagatctagacaacacctgtgaagacctgcatattacttgcggccataaaactcttaatgttcatgcgtgc

SEQ ID NO: 15213 - DNA, 75 bp, Artificial Sequence
  Synthetic
taaaactcttaatgttcatgcgtgcttcaggcaacataagtcatgtattcgttacttcaagggatcaatcttacc

SEQ ID NO: 15214 - DNA, 75 bp, Artificial Sequence
  Synthetic
caccaatgagcgagatctgcgtcagagatgacatatccctggttaaatctattggttatcacaaactggcagcaa

SEQ ID NO: 15215 - DNA, 75 bp, Artificial Sequence
  Synthetic
attggttatcacaaactggcagcaaatagggaagttatcgaatcaagtatgtcgtactacaggttgtattacgtc

SEQ ID NO: 15216 - DNA, 75 bp, Artificial Sequence
  Synthetic
acaaatgcagagctgatattattatgctgcttttctgcaatctcttgttttgtggctatcatcttgacaaggaca

SEQ ID NO: 15217 - DNA, 75 bp, Artificial Sequence
  Synthetic
tgaagtcatgattgagtcaatctgtacaaatgcagagctgatattattatgctgcttttctgcaatctcttgttt

SEQ ID NO: 15218 - DNA, 75 bp, Artificial Sequence
  Synthetic
ttcaagatattcttggaacttttatagtatttgacgtaaatcatgagggcatcttagcacctaagacatatgctt

SEQ ID NO: 15219 - DNA, 75 bp, Artificial Sequence
  Synthetic
gtagagctacgtgttcaataagcttagaacgggacactggcaatgttgtgttggagtctccagcattaaatcatt

SEQ ID NO: 15220 - DNA, 75 bp, Artificial Sequence
  Synthetic
aacaatatgcatatgtggaatggtttataattctactgaagctttaaaagttcatagaaaatgtttgaattgcac

SEQ ID NO: 15221 - DNA, 75 bp, Artificial Sequence
  Synthetic
tggctacaaaaccttgactaaaacaaggtatttgtgtaaaaaaagactccctaatatggcattggccacgatcag

SEQ ID NO: 15222 - DNA, 75 bp, Artificial Sequence
  Synthetic
cacagtactgttttttactttcataacccctataacagctgaatgctataattatacaagcttaccagaagattt

SEQ ID NO: 15223 - DNA, 75 bp, Artificial Sequence
  Synthetic
tcaagctgccatagataaaaataattcttgtacacgtgaacaattgataatgattatattaacagtcctatgcat

SEQ ID NO: 15224 - DNA, 75 bp, Artificial Sequence
  Synthetic
tgcctcaattattacggtcatagcagcagttcacctgtacatacgaatatgctatgtattttgtgcttactgtgg

SEQ ID NO: 15225 - DNA, 75 bp, Artificial Sequence
  Synthetic
taaaagcatacacagagccaacaataattgtgttgctccgatgaaatacaaaactgccaagtataccaatctagt

SEQ ID NO: 15226 - DNA, 75 bp, Artificial Sequence
  Synthetic
aatggtgcacgaaaagaagggcctgattttattagacaactttacatctcattgccttacgtgcatttgtcgtga

SEQ ID NO: 15227 - DNA, 75 bp, Artificial Sequence
  Synthetic
aatagatgatgctgcaatgtgtattggtctatatcaaaatataactcagccaaaaaagtacaatacttttgtgaa

SEQ ID NO: 15228 - DNA, 75 bp, Artificial Sequence
  Synthetic
gtgcattactataagaggaacaaagaattttataaagctgatctagagatactgtacacagttatatcaagggca

SEQ ID NO: 15229 - DNA, 75 bp, Artificial Sequence
  Synthetic
agaactgtcatcaacgttaagcagccatgaaattgaatttctcctaccagctgtcaaaccatcattcgattatct

SEQ ID NO: 15230 - DNA, 75 bp, Artificial Sequence
  Synthetic
gtatgaggagtcattacatgtcctaaataagattaagaaagatgtttcgaaaattaaccaactgaatggcatagt

SEQ ID NO: 15231 - DNA, 75 bp, Artificial Sequence
  Synthetic
gataagtaaatcatctacatctaaagatcttcatagtgccaccatccatgagtttatagctgctaatctataccc

SEQ ID NO: 15232 - DNA, 75 bp, Artificial Sequence
  Synthetic
aaattaaccaactgaatggcatagtagaattcttgatacatattaattcaaagaacataacagaagaggttagga

SEQ ID NO: 15233 - DNA, 75 bp, Artificial Sequence
  Synthetic
caacaacttcaaaaagcacttggcatcagcagggccagatagcatacaatggaggacatatattcaaaataacaa

SEQ ID NO: 15234 - DNA, 75 bp, Artificial Sequence
  Synthetic
agttaagaattaagcctgatcttagtatcagggggtccaaatttacaaccaagaactcagggactcctaacatca

SEQ ID NO: 15235 - DNA, 75 bp, Artificial Sequence
  Synthetic
gtacagtactacaaaagaaacaaagagttttataaggctgatttggagatactatacacagtcgtatcaagagca

SEQ ID NO: 15236 - DNA, 75 bp, Artificial Sequence
  Synthetic
atcccaggactggttggtaatttactgcggcaagttctgaaatcccaaaaatatgaggaatcattgcatgtctta

SEQ ID NO: 15237 - DNA, 75 bp, Artificial Sequence
  Synthetic
aataagataaaaaaagatgtttcaaaaaataatcagttgaatggaatagtggaattcctgatacatattaattca

SEQ ID NO: 15238 - DNA, 75 bp, Artificial Sequence
  Synthetic
ggaattcctgatacatattaattcaaaaaatataactgaagaggttagagaattgagaattaggcctgatctcag

SEQ ID NO: 15239 - DNA, 75 bp, Artificial Sequence
  Synthetic
tatcaggggatctaaattcacagacaagaacccaggaacccctaacatcaaagaatgccaaactccattgttcat

SEQ ID NO: 15240 - DNA, 75 bp, Artificial Sequence
  Synthetic
tacatgtactgggaagagatttcgatcactaatgaagcagtacattgcttgctctaatgggggcatcaagttata

SEQ ID NO: 15241 - DNA, 75 bp, Artificial Sequence
  Synthetic
tccagagtaaataatgagcagttggaagttgaattttgtgtttcggagcctacaggtacaatgtgtaacactatt

SEQ ID NO: 15242 - DNA, 75 bp, Artificial Sequence
  Synthetic
ccagcgaccaaacaaacctctaacacttataggcaataagctttgcattggcgacaaatactgtatgatagcatt

SEQ ID NO: 15243 - DNA, 75 bp, Artificial Sequence
  Synthetic
cgatccgatagtgatagacgagagtatacaaaaactggattgttatagcctagctgctacagaccaatcagatgg

SEQ ID NO: 15244 - DNA, 75 bp, Artificial Sequence
  Synthetic
aatgctgaaacctgagaggtccattcgactccttaaaacaggcgaatgtaaaatagcaggggcactatctaggat

SEQ ID NO: 15245 - DNA, 75 bp, Artificial Sequence
  Synthetic
tgcagtatcaataaatcaaaaaaattataaatactccactatagttcataagaaaagtgatttagttgatgagta

SEQ ID NO: 15246 - DNA, 75 bp, Artificial Sequence
  Synthetic
aacaagcatcagtgcaagaaagagatataagaggccatgcaacttgtggaggttgcacagattgttttaacgatg

SEQ ID NO: 15247 - DNA, 75 bp, Artificial Sequence
  Synthetic
ttgtctaagcccaaattgcgacttagattgctacccttattatccagccaacctagttgactgctcttggagtga

SEQ ID NO: 15248 - DNA, 75 bp, Artificial Sequence
  Synthetic
ggttgcacagattgttttaacgatgttgcatgtaaagtcagcatgacttcaaatggtgtttatcagtgcccaata

SEQ ID NO: 15249 - DNA, 75 bp, Artificial Sequence
  Synthetic
tgtttaaaggcagaaatcaaaataagtatttgtggtaaagagatccctgtcaaatctgaaataattaaggataca

SEQ ID NO: 15250 - DNA, 75 bp, Artificial Sequence
  Synthetic
atcgactcattctaccctaagccaaaaagtgatatctcacacagatatagaatcatttatatctagtgttaagct

SEQ ID NO: 15251 - DNA, 75 bp, Artificial Sequence
  Synthetic
tgcagagcttataatgagggaattggatttatcttggaaccattatggaatgagttgagtttgtgggggaaatat

SEQ ID NO: 15252 - DNA, 75 bp, Artificial Sequence
  Synthetic
ctccttgcacaatgatctgatccagcatcattttaggccgctaagtaatatgccacatgtaaagcctaatttcaa

SEQ ID NO: 15253 - DNA, 75 bp, Artificial Sequence
  Synthetic
gatttatcttggaaccattatggaatgagttgagtttgtgggggaaatatgttatgcttgcattagctataatta

SEQ ID NO: 15254 - DNA, 75 bp, Artificial Sequence
  Synthetic
tgccacatgtaaagcctaatttcaagtcgataaatgttcaagggacggtttccggcagtaagattcaagacagtt

SEQ ID NO: 15255 - DNA, 75 bp, Artificial Sequence
  Synthetic
aataaggccactggcaagatatattgtcgcaatacttaaagagaacgacaaagtgtacaaactggaaaataaatt

SEQ ID NO: 15256 - DNA, 75 bp, Artificial Sequence
  Synthetic
aatgattattacaattctcaacgtgcttacattagtagtcactgtgactgcaatgcctccccgtaatacgaatgg

SEQ ID NO: 15257 - DNA, 75 bp, Artificial Sequence
  Synthetic
tctttgacatcatagcatatgtgaaaagtgcacgtgtaattgcgacatacaaccatgaatacaagacaggaccta

SEQ ID NO: 15258 - DNA, 75 bp, Artificial Sequence
  Synthetic
gggtcgatgcttttatggtggcgatatgtttcgccagatcaattcaacatcaccaatgagtgaaatctgtgtcag

SEQ ID NO: 15259 - DNA, 75 bp, Artificial Sequence
  Synthetic
caccaatgagtgaaatctgtgtcagagatgatatatccctagttaagtctattggttatcacaaactggcagcaa

SEQ ID NO: 15260 - DNA, 75 bp, Artificial Sequence
  Synthetic
cagtgagtatcaatgttcagcataatgagcagtgcacgggatcttgtcccagcagtatacctaaaaaagataatt

SEQ ID NO: 15261 - DNA, 75 bp, Artificial Sequence
  Synthetic
atagagaagttattgagtcaagcatgtcatactatcggttatattatgtcaaaaattggtttgagtgcaatccag

SEQ ID NO: 15262 - DNA, 75 bp, Artificial Sequence
  Synthetic
ggttaaccttctctcgtgaacatactagcacctggggttgtgaagaatggggttgtttagcaataggcacgggat

SEQ ID NO: 15263 - DNA, 75 bp, Artificial Sequence
  Synthetic
aaaaattggtttgagtgcaatccagttcaagacatcctcggaacttttatggtgttcgatgtgaatcatgagggc

SEQ ID NO: 15264 - DNA, 75 bp, Artificial Sequence
  Synthetic
ggttgtttagcaataggcacgggatgcgtgtatgggtcttgccaagatgtcattagagaggaagcaacagttatt

SEQ ID NO: 15265 - DNA, 75 bp, Artificial Sequence
  Synthetic
attttagcacctaaaacatatgcttgcagagctacctgctcaataagcttggaacgagacactggcaatgttgtg

SEQ ID NO: 15266 - DNA, 75 bp, Artificial Sequence
  Synthetic
tacaagcacaatgtgcaatactatcaatgtacttgaaccagtattgggagagcacatgcaatttgaagtccacag

SEQ ID NO: 15267 - DNA, 75 bp, Artificial Sequence
  Synthetic
tgtgcagactaatctactacccgaagtagctttaattaaaaataggagagtgtacaaaggatcaataaacaaaaa

SEQ ID NO: 15268 - DNA, 75 bp, Artificial Sequence
  Synthetic
tctatagatctggacaacacctgtgaagacctacatattacttgcggccacaaaacccttaatgttcatgcatgc

SEQ ID NO: 15269 - DNA, 75 bp, Artificial Sequence
  Synthetic
tgattacatttgccatgcattatcaagaaaggatatagttgtaaggaaatgctatgaaaatcattattattcatg

SEQ ID NO: 15270 - DNA, 75 bp, Artificial Sequence
  Synthetic
agaaaggatatagttgtaaggaaatgctatgaaaatcattattattcatgtgccacacttaaagaagctgtagaa

SEQ ID NO: 15271 - DNA, 75 bp, Artificial Sequence
  Synthetic
tggcctattgctgcagagattctgcaagcaatgcaaaaattgcttattaccaattcatcctttcagtccctgccc

SEQ ID NO: 15272 - DNA, 75 bp, Artificial Sequence
  Synthetic
cataaggggtcatgcaacttgtggaggctgcacagattgttttaacgatgttgcatgtaaagttagcatgacttc

SEQ ID NO: 15273 - DNA, 75 bp, Artificial Sequence
  Synthetic
aaatggtgtttatcagtgcccagtagtgtcttcttgtgattcttatatcaataatgtttatataaatgaaggcac

SEQ ID NO: 15274 - DNA, 75 bp, Artificial Sequence
  Synthetic
tataattctactgaagctttgaaagttcatagaaaatgcttaaattgcactggctacaaaaccctgactaaaaca

SEQ ID NO: 15275 - DNA, 75 bp, Artificial Sequence
  Synthetic
aaatgatgtcaatttgaaattccggtgccttaaggcagagatcaagattaatatctgtggtaaagaaatacctgt

SEQ ID NO: 15276 - DNA, 75 bp, Artificial Sequence
  Synthetic
aggtatttatgtaaaaaaagactccccaatatggtattggccacaatcagcacagtactattcttcacttttata

SEQ ID NO: 15277 - DNA, 75 bp, Artificial Sequence
  Synthetic
gaaatctgagataatcaaagacacaaagaagctagatttggctagtgctgaccaaacgtcctatatcaaagaatt

SEQ ID NO: 15278 - DNA, 75 bp, Artificial Sequence
  Synthetic
acccctataacagctgaatgctacaattatacgagcttaccagcagactttcaagctgccatagataaaaacaat

SEQ ID NO: 15279 - DNA, 75 bp, Artificial Sequence
  Synthetic
tgataaaaaatgtgccacatggctatgcagagcttacaatgagggaattggctttgtcttggaaccattgtggaa

SEQ ID NO: 15280 - DNA, 75 bp, Artificial Sequence
  Synthetic
tcttgtgcacgtgagcagctaataatgatcatattaacaatcctatgtattgcctcaatcattatggttatatca

SEQ ID NO: 15281 - DNA, 75 bp, Artificial Sequence
  Synthetic
tgagttaagcttatggggaaaatatgtcctgctcgcattagctataattatcagtgttctaatccttataaaagt

SEQ ID NO: 15282 - DNA, 75 bp, Artificial Sequence
  Synthetic
gcagtccacctgtatatacgaataaattatgtattttgtgcttactgcggaatggtgcatgaaaagaaaggccta

SEQ ID NO: 15283 - DNA, 75 bp, Artificial Sequence
  Synthetic
aataaggccattggcaagatatattgttgcagtacttaaagagaatgacaaagtgtacaaactggaaaacaagtt

SEQ ID NO: 15284 - DNA, 75 bp, Artificial Sequence
  Synthetic
atcttactagataatttcacatctcattgccttacatgcatctgtcgtgacaaaagcttacacagagccaacaat

SEQ ID NO: 15285 - DNA, 75 bp, Artificial Sequence
  Synthetic
aacaagttgaaataatcaaattaagatagacataatgggagggtggtgggagttttctgctgatataataattat

SEQ ID NO: 15286 - DNA, 75 bp, Artificial Sequence
  Synthetic
gatgactaaatcatccacatctaaagatcttcatagtgctactattcatgaatttatagctgctaatctataccc

SEQ ID NO: 15287 - DNA, 75 bp, Artificial Sequence
  Synthetic
gtcaaaatgatatgccgttgtgtgattaagcaagaggaatgcagttctacaaaagtggatgacgatgggcagatt

SEQ ID NO: 15288 - DNA, 75 bp, Artificial Sequence
  Synthetic
gcacagtactacaaaagaaacaaagaattttataaagctgatttggagatattatacacagttatatcaagagca

SEQ ID NO: 15289 - DNA, 75 bp, Artificial Sequence
  Synthetic
tgcgacaggttctgaaatcccaaaaatatggggagtcattgcatgtcttgaataagataaagaaagatgtttcaa

SEQ ID NO: 15290 - DNA, 75 bp, Artificial Sequence
  Synthetic
aataagataaagaaagatgtttcaaagaacaatcaactgaatggcatagtagaatttctaatgcatattaattca

SEQ ID NO: 15291 - DNA, 75 bp, Artificial Sequence
  Synthetic
tatcagaggatcaaaattcacagacaagaacccaggaactcctaacgtcaaagaatgccagactccactgttcat

SEQ ID NO: 15292 - DNA, 75 bp, Artificial Sequence
  Synthetic
gctccaacgggggtgtcaagttataccagcgaccaaacaagcctctagcacttgtaggcaataagctttgcattg

SEQ ID NO: 15293 - DNA, 75 bp, Artificial Sequence
  Synthetic
ccagcgaccaaacaagcctctagcacttgtaggcaataagctttgcattggtgacaaatactgcatgatagcatt

SEQ ID NO: 15294 - DNA, 75 bp, Artificial Sequence
  Synthetic
ttcaagatattcttggaacctttatggtgttcgatataaatcatgagggcatcctagcacctaagacatatgctt

SEQ ID NO: 15295 - DNA, 75 bp, Artificial Sequence
  Synthetic
gtgacaaatactgcatgatagcatttgacccaatggtgatagacgagaatatacaaaaactggactgttatagcc

SEQ ID NO: 15296 - DNA, 75 bp, Artificial Sequence
  Synthetic
cgactcctcaaaacaggcgaatgtaagatagcaggagcattatccagaattgcagtatcgataaatcaaaaaaat

SEQ ID NO: 15297 - DNA, 75 bp, Artificial Sequence
  Synthetic
tataattctagtgaagccttaaaagtccatagaaaatgcttaaattgcgctggttacaagactctgactaaaaca

SEQ ID NO: 15298 - DNA, 75 bp, Artificial Sequence
  Synthetic
ttgtctaagcccaaattgtgacatagattgctacccttattacccagccaacttagttgactgctcttggagtga

SEQ ID NO: 15299 - DNA, 75 bp, Artificial Sequence
  Synthetic
actcctataacagctgaatgctataattacacaagcttaccagcagattttcaagctgctatagataaaaataat

SEQ ID NO: 15300 - DNA, 75 bp, Artificial Sequence
  Synthetic
ttccttacataatgatctgatccaacaccattttaggccgctaagtaatatgccgcatgtgaagcctaacttcaa

SEQ ID NO: 15301 - DNA, 75 bp, Artificial Sequence
  Synthetic
gtcaataaatgttcaaggaacaatttctggtagtaagattcaagacagctacataacattttcaataccattaat

SEQ ID NO: 15302 - DNA, 75 bp, Artificial Sequence
  Synthetic
acataacattttcaataccattaatgactggactatcgcaaggtttcacattgcaagaccataaaggcaataccc

SEQ ID NO: 15303 - DNA, 75 bp, Artificial Sequence
  Synthetic
aatcatgagtacaagacaggacctacagtaagtatcaatgttcagcataatgagcaatgcacaggatcttgcccc

SEQ ID NO: 15304 - DNA, 75 bp, Artificial Sequence
  Synthetic
agcagtattcctaaaaaggataattggctaaccttctctcgtgaacatactagcacttggggttgcgaagaatgg

SEQ ID NO: 15305 - DNA, 75 bp, Artificial Sequence
  Synthetic
ggctaaccttctctcgtgaacatactagcacttggggttgcgaagaatggggctgcttagcaataggcacggggt

SEQ ID NO: 15306 - DNA, 75 bp, Artificial Sequence
  Synthetic
catgaaattgaactcctcctgccaactgtcaagccatcattcgattacctaacaactaaatcatctacatctaaa

SEQ ID NO: 15307 - DNA, 75 bp, Artificial Sequence
  Synthetic
gatctccatagtgctactattcatgaatttatagctgcaaatctctatcctaataatttcaaaaaacatttgaca

SEQ ID NO: 15308 - DNA, 75 bp, Artificial Sequence
  Synthetic
gcgtatatgggtcttgccaagatgtcattagggaggaagcaacagttatttccagagtaaataatgaacagctag

SEQ ID NO: 15309 - DNA, 75 bp, Artificial Sequence
  Synthetic
aacacatgcaatttgaagtccacagtgtacagactaatctattgccagagatagctttaattaaaaataggaggg

SEQ ID NO: 15310 - DNA, 75 bp, Artificial Sequence
  Synthetic
tgtataaggggtcaataaacaaaaaaggtgtgtttaatccccaatgtggctcagttcaatcatttgatggtaaac

SEQ ID NO: 15311 - DNA, 75 bp, Artificial Sequence
  Synthetic
tcagttcaatcatttgatggtaaactttacggtattgggaacccaaagtttgattacatttgccacgcattatcg

SEQ ID NO: 15312 - DNA, 75 bp, Artificial Sequence
  Synthetic
gacaactaatagtgtgttattaagttatttatttaaacaatgtatatattcatgtatttaggggcacactactag

SEQ ID NO: 15313 - DNA, 75 bp, Artificial Sequence
  Synthetic
aattaagaattaggcctgatcttagtattagggggtccaaatttacaaacaagagcccaggaactcctaacatca

SEQ ID NO: 15314 - DNA, 75 bp, Artificial Sequence
  Synthetic
gctatgagaatcattactattcctgcgctacactcaaagaagctgtagaaattaaaccaaacatcacaaattcta

SEQ ID NO: 15315 - DNA, 75 bp, Artificial Sequence
  Synthetic
tttacttggtagtgcgtctgtaaagataatgttaggcgacttaatataccagcaaacgtcagtgcaagagaaaga

SEQ ID NO: 15316 - DNA, 75 bp, Artificial Sequence
  Synthetic
cataagaggccatgcaacttgtggaggctgcacagattgttttaacgatgttgcatgtaaaattagtatgacttc

SEQ ID NO: 15317 - DNA, 75 bp, Artificial Sequence
  Synthetic
gtgacaaatactgtatgatagcatttgacccaatggtaatagatgaaaatatacaaaaactagattgttatagtt

SEQ ID NO: 15318 - DNA, 75 bp, Artificial Sequence
  Synthetic
ggctgcacagattgttttaacgatgttgcatgtaaaattagtatgacttcaaatggtgtttatcagtgcccggta

SEQ ID NO: 15319 - DNA, 75 bp, Artificial Sequence
  Synthetic
tgacccaatggtaatagatgaaaatatacaaaaactagattgttatagtttagctgctacagaccaatcaaatgg

SEQ ID NO: 15320 - DNA, 75 bp, Artificial Sequence
  Synthetic
gtgtcttcttgtgattcctatatcaataatgtttatataaatgagggcacaaatgatgtaaacttgaaatttcga

SEQ ID NO: 15321 - DNA, 75 bp, Artificial Sequence
  Synthetic
aaatgatgtaaacttgaaatttcgatgccttaaggcagaaatcaagattagtatctgtggtaaagagatacctgt

SEQ ID NO: 15322 - DNA, 75 bp, Artificial Sequence
  Synthetic
tgccttaaggcagaaatcaagattagtatctgtggtaaagagatacctgtgaaatctgagataattaaagataca

SEQ ID NO: 15323 - DNA, 75 bp, Artificial Sequence
  Synthetic
agtatggattcaaagttggatttgctgggtttggggggtggggattagctgctactcggaatttgtaaagaaatt

SEQ ID NO: 15324 - DNA, 75 bp, Artificial Sequence
  Synthetic
gaaatctgagataattaaagatacaaagaagctagatttggctagtgccgaccaaacgtcctatattaaagagtt

SEQ ID NO: 15325 - DNA, 75 bp, Artificial Sequence
  Synthetic
tgacaaaaaatgtgctacatggctatgcagagcttataatgaaggaattggctttgtcttagaaccattatggaa

SEQ ID NO: 15326 - DNA, 75 bp, Artificial Sequence
  Synthetic
tgcagagcttataatgaaggaattggctttgtcttagaaccattatggaatgagttaagcctatgggggaaatat

SEQ ID NO: 15327 - DNA, 75 bp, Artificial Sequence
  Synthetic
gtcctgcttgcgttagctataattattggtgtcctgatccttgtgaaagtgataaggccattggcaagatacatt

SEQ ID NO: 15328 - DNA, 75 bp, Artificial Sequence
  Synthetic
aaccatgactataaaacaggacccacagtgagtatcaatgttcaacataatgaacaatgcacaggatcctgccct

SEQ ID NO: 15329 - DNA, 75 bp, Artificial Sequence
  Synthetic
aaataagctgaaataaaaattaaagatagacataatgggagggtggtgggagtttcctgctgatataataattat

SEQ ID NO: 15330 - DNA, 75 bp, Artificial Sequence
  Synthetic
atggcaaatcaattcattttcaacgatgttccacaacggaatgcagctacatttaatccggatgcagggtatgtg

SEQ ID NO: 15331 - DNA, 75 bp, Artificial Sequence
  Synthetic
aaccaagtgtcgatcttacttttgcaggggtcaaatttacagtggttaataaccattttccccagtatactgcaa

SEQ ID NO: 15332 - DNA, 75 bp, Artificial Sequence
  Synthetic
aggggtcaaatttacagtggttaataaccattttccccagtatactgcaaatccagtgtcagacactgcctttac

SEQ ID NO: 15333 - DNA, 75 bp, Artificial Sequence
  Synthetic
gcgtcttcctgtgattcttatatcaataatgtttatattaatgaaggtacaaatgatgtcagcttgaaattccga

SEQ ID NO: 15334 - DNA, 75 bp, Artificial Sequence
  Synthetic
ggagtgatgggtatgcaatgtacctagggtttgcccctggtgctgagatgtttttggaaacttttgagttttacc

SEQ ID NO: 15335 - DNA, 75 bp, Artificial Sequence
  Synthetic
tgacaaaaaatgcgccacatggctatgcagagcttataatgagggaattggatttatcttagagccactatggaa

SEQ ID NO: 15336 - DNA, 75 bp, Artificial Sequence
  Synthetic
gttttgcttacattagccataattatcagtatcctgatccttgtaaaagtgataaggccactagcaagatatatt

SEQ ID NO: 15337 - DNA, 75 bp, Artificial Sequence
  Synthetic
gtcgcaatacttaaagaaaatgacaaagtgtataaactggaaaataagctgaaataatctaatttaaatagacat

SEQ ID NO: 15338 - DNA, 75 bp, Artificial Sequence
  Synthetic
atctttgctgatcctccagtttccttgcttctatttctaagtgcaccatgtctatgtggtgcacacctttgttca

SEQ ID NO: 15339 - DNA, 75 bp, Artificial Sequence
  Synthetic
acaatcgtaatgccgctggctgaagtgaagggctgcacctggagtgatgggtacgcaatgtacctaggctttgcc

SEQ ID NO: 15340 - DNA, 75 bp, Artificial Sequence
  Synthetic
tgaagggctgcacctggagtgatgggtacgcaatgtacctaggctttgcccctggtgctgagatgtttctggaaa

SEQ ID NO: 15341 - DNA, 75 bp, Artificial Sequence
  Synthetic
gtgtattgtcttcttgattattattggtattacccctgcttttagtacttgcatacaagaaaaagaaatagaaac

SEQ ID NO: 15342 - DNA, 75 bp, Artificial Sequence
  Synthetic
gtgcattactataagaggaacaaagaactttataaagccgatctggagatactgtacacagtcatatcgagagca

SEQ ID NO: 15343 - DNA, 75 bp, Artificial Sequence
  Synthetic
aatgaatattacaatcgcatacattattgcactgacaagtgcagtgcttgcaatgccaccacgcaataccaatgg

SEQ ID NO: 15344 - DNA, 75 bp, Artificial Sequence
  Synthetic
gggcaagtgcttctatggcggtcgtatattccgtcaggttaactcaacatccccaatgagtgagatatgcatcag

SEQ ID NO: 15345 - DNA, 75 bp, Artificial Sequence
  Synthetic
agatgacatctccctaattaaatcaatcggctatcacaaattgtcaggagacaaacagtctatagaatcaagcat

SEQ ID NO: 15346 - DNA, 75 bp, Artificial Sequence
  Synthetic
aaccatgactataaaacagggcccacagtaagcatcaatgtccaacataatgagcaatgtacaggatcctgcccc

SEQ ID NO: 15347 - DNA, 75 bp, Artificial Sequence
  Synthetic
gtcttattacaggttgtactatgttaaggattggtttgaatgtaacccagttcaagatagtatgggaacattcac

SEQ ID NO: 15348 - DNA, 75 bp, Artificial Sequence
  Synthetic
tgtttttgatgtggatcacgatggtgtattgtctcctaaaacttatgcttgcagagccagttgtaccataagtgt

SEQ ID NO: 15349 - DNA, 75 bp, Artificial Sequence
  Synthetic
gtggctttgatcaagaataggagagtatacagggggtcaataaacaagaaaggtgtattcaaccctcagtgtggt

SEQ ID NO: 15350 - DNA, 75 bp, Artificial Sequence
  Synthetic
agagcgagacagtggaagcattgtccttgattctccagctctaaatcattatgtcatacaaggtactactatcaa

SEQ ID NO: 15351 - DNA, 75 bp, Artificial Sequence
  Synthetic
aaatggatggtttaaaactagagtatctatcgatttagaaaatacatgtgaagatgtccatgttacatgtggcca

SEQ ID NO: 15352 - DNA, 75 bp, Artificial Sequence
  Synthetic
ccaaacaatgaatgttcatgcatgttttagacagcacaaatcatgcattagatatttcaaaggctctatattgcc

SEQ ID NO: 15353 - DNA, 75 bp, Artificial Sequence
  Synthetic
agagattatgatagagtcaatatgcactaatgcagaactaatattgctatgctgcttctcggctattgcctgcat

SEQ ID NO: 15354 - DNA, 75 bp, Artificial Sequence
  Synthetic
aattgcaataatactgacaaagacatacttagtatatctgttgatacctattttttatccttttgtcaaagtcta

SEQ ID NO: 15355 - DNA, 75 bp, Artificial Sequence
  Synthetic
tggtttaatcttggagagattttgtaagcaatgcaaaaattgcttgctgccaatccacccatttacaacttgccc

SEQ ID NO: 15356 - DNA, 75 bp, Artificial Sequence
  Synthetic
tactatatgtatctgtggtatggtgtataattcaactgaagccctaaaagtacataggagatgttataattgcac

SEQ ID NO: 15357 - DNA, 75 bp, Artificial Sequence
  Synthetic
tggctataaaactctaacaaaaactcgttatttatgcaaaaagaggttacccaatatggctttagcaatcatcgt

SEQ ID NO: 15358 - DNA, 75 bp, Artificial Sequence
  Synthetic
tacaatattgtttttcacatttataacaccaataactgctgagtgctataattataccagtttacccgaagactt

SEQ ID NO: 15359 - DNA, 75 bp, Artificial Sequence
  Synthetic
ccagaatgcaattgacactggccattcatgcttgaaagagcagttagtgatgcttgtgttaacccttgtttgtat

SEQ ID NO: 15360 - DNA, 75 bp, Artificial Sequence
  Synthetic
tttgattattatattgataatgttttcagcccatttatatataagagtattctacatattctgcccttactgcgg

SEQ ID NO: 15361 - DNA, 75 bp, Artificial Sequence
  Synthetic
tggctacaagactctgactaaaacaaggtatttgtgtaaaaagaaactccctaatgtggtattggccactatcag

SEQ ID NO: 15362 - DNA, 75 bp, Artificial Sequence
  Synthetic
aatggtacacaagaaaaaaggcttggtgatgttagaaaacttcacttcacattgcctaacttgcatatgtcagga

SEQ ID NO: 15363 - DNA, 75 bp, Artificial Sequence
  Synthetic
caagagtatccatcgagcttccaataattgcattgcgccaatcaaatataagaccagtaagtatactaatgccat

SEQ ID NO: 15364 - DNA, 75 bp, Artificial Sequence
  Synthetic
aaactgccaagtataccaatctagtgtgcattgtcttcctgattatcattgctgttacccctgcttttagtgctt

SEQ ID NO: 15365 - DNA, 75 bp, Artificial Sequence
  Synthetic
atgtgtagggttcttaattttgatagctgcaaccccggccttaacacaatgtatttctgataaggatatagaatc

SEQ ID NO: 15366 - DNA, 75 bp, Artificial Sequence
  Synthetic
gattgatgaagcatcaatgtgtattggtttgtaccaaaatataactcaagcaaaggattacaatgctctcgtgac

SEQ ID NO: 15367 - DNA, 75 bp, Artificial Sequence
  Synthetic
agagctatcaaagaacatgagtagccatgaaatagaagccctcctaccagacgtaaaaccttcatttgatctgct

SEQ ID NO: 15368 - DNA, 75 bp, Artificial Sequence
  Synthetic
atcccaggattggtcggtaatttactgcgacaagttctaaagtcgcaaaagtatgaggagtcattacatgtccta

SEQ ID NO: 15369 - DNA, 75 bp, Artificial Sequence
  Synthetic
tgtaaagaagtccagtacaacaacagatttacattctgcaaccatgtatgagtttatagctgcaaacttgtatcc

SEQ ID NO: 15370 - DNA, 75 bp, Artificial Sequence
  Synthetic
gtatgaggagtcattacatgtcctaaataagattaagaatgacgtttcaaagattaaccaactgaatggcatagt

SEQ ID NO: 15371 - DNA, 75 bp, Artificial Sequence
  Synthetic
agaattcttgatacatattaattcaaagaacataacagaagaggtcagggagttaagaattaagcctgatcttag

SEQ ID NO: 15372 - DNA, 75 bp, Artificial Sequence
  Synthetic
agatagcttcaggaaacacttagtatcagcagggccccaaagtatacaatggaggacatatattcaaaacaacaa

SEQ ID NO: 15373 - DNA, 75 bp, Artificial Sequence
  Synthetic
tctacatttatgcaatgagcatattgtgaaaatgatatgcagatgcgtagtaaatcaagaaaactgcccaacaac

SEQ ID NO: 15374 - DNA, 75 bp, Artificial Sequence
  Synthetic
aagaactcagggactcctaacatcaaagaatgccaaactccattgtttatcacatgcactgggaagagattccga

SEQ ID NO: 15375 - DNA, 75 bp, Artificial Sequence
  Synthetic
caaatacgatgatggagaccagatcactgcttactacacaaagcacaaagacttttataaagcagatttggagat

SEQ ID NO: 15376 - DNA, 75 bp, Artificial Sequence
  Synthetic
tcattaatgaaacagtatattgcatgctccaatggaggtgttaagttgtaccagagaccaaacaaacccctaaca

SEQ ID NO: 15377 - DNA, 75 bp, Artificial Sequence
  Synthetic
actttataacactgtttcaagagcaataccaggactaacagggaacttattgaaactagtccgtaagtctcagaa

SEQ ID NO: 15378 - DNA, 75 bp, Artificial Sequence
  Synthetic
ccagagaccaaacaaacccctaacactcgtaggcgataagctctgcattggtgacaaatactgtatgatagcatt

SEQ ID NO: 15379 - DNA, 75 bp, Artificial Sequence
  Synthetic
tgacccagcagtagtagatgaaaatatacaaaaactggattgctatagtttggctgccacagaccaatcaaatgg

SEQ ID NO: 15380 - DNA, 75 bp, Artificial Sequence
  Synthetic
atatgatgaagccctacacgttctaaataagatcaagcgagacgtttcaagtattaatcaattaaatgggatagt

SEQ ID NO: 15381 - DNA, 75 bp, Artificial Sequence
  Synthetic
taatttcttaatccacatcaattccaagaacattactggagatgcaaaggaactaaaaattcaaccaccattacc

SEQ ID NO: 15382 - DNA, 75 bp, Artificial Sequence
  Synthetic
gattgctacccttattattcaggcaacctagctgactgctcttggagtgaatcaactcattctactttgagccaa

SEQ ID NO: 15383 - DNA, 75 bp, Artificial Sequence
  Synthetic
acctagctgactgctcttggagtgaatcaactcattctactttgagccaaaaagtgatatctcatacagatatag

SEQ ID NO: 15384 - DNA, 75 bp, Artificial Sequence
  Synthetic
atcaactcattctactttgagccaaaaagtgatatctcatacagatatagaatcattcatatctagtattaaact

SEQ ID NO: 15385 - DNA, 75 bp, Artificial Sequence
  Synthetic
agtaagaggcacaaagtatgagaataaaaaatctggcgatcgagatataaaggaatgctcaactccattatttat

SEQ ID NO: 15386 - DNA, 75 bp, Artificial Sequence
  Synthetic
aacatgtactgggaaaaggtttagatccttggtaaagcaatatatctcttgttctaatggtggtgtaaagatgta

SEQ ID NO: 15387 - DNA, 75 bp, Artificial Sequence
  Synthetic
tcagcggcctactaagcctttaatagtccagaatgggaagctatgtgttggtgataaatattgtttaattccctt

SEQ ID NO: 15388 - DNA, 75 bp, Artificial Sequence
  Synthetic
agaaccattgacagttgatgctgatattataaagttggagtgttacggcaatcctgcaaccgaccaatcagatgg

SEQ ID NO: 15389 - DNA, 75 bp, Artificial Sequence
  Synthetic
aatgatgacacctgaacgtagtataaggttggtgaaaacaggtaaatgcagaattaacggtaacacagcaaatgt

SEQ ID NO: 15390 - DNA, 75 bp, Artificial Sequence
  Synthetic
cgctacactcaaggaagctgtagaaatcaaatcaaatatcacaaactctaaaactatgctttataacgataatgc

SEQ ID NO: 15391 - DNA, 75 bp, Artificial Sequence
  Synthetic
ggcaatctcaacgcaaaataaatatttcgcatacactacaatagcacacaaaaaaagtgaattagtggatgaata

SEQ ID NO: 15392 - DNA, 75 bp, Artificial Sequence
  Synthetic
ctgcctgagtcccaattgtgatatggaaacctatccataccatgtacaaaatctagctagctgctcatggaagga

SEQ ID NO: 15393 - DNA, 75 bp, Artificial Sequence
  Synthetic
atctattcattctattctagaccaaaaagttgtctcccacacagacatagagtcatttatatccagtgtaaagct

SEQ ID NO: 15394 - DNA, 75 bp, Artificial Sequence
  Synthetic
atcaaacgtcctatatcaaagagtttgataaaaaatgcgccacatggctatgcagagcttacaatgagggaattg

SEQ ID NO: 15395 - DNA, 75 bp, Artificial Sequence
  Synthetic
ctctttacacaatgacttgattcagcatcatttccggcctctggtgaatatgcctcatgtaaaaccaaattataa

SEQ ID NO: 15396 - DNA, 75 bp, Artificial Sequence
  Synthetic
atcaattagcatacaaggaaccttgtccggtgggaagattcaagatagcttcattacatttacaataccattgat

SEQ ID NO: 15397 - DNA, 75 bp, Artificial Sequence
  Synthetic
gttatgcttgcattagctataattatcagtatcctaatccttataaaagtaataaggccactggcaagatatatt

SEQ ID NO: 15398 - DNA, 75 bp, Artificial Sequence
  Synthetic
agtagtgtacccctaaatacaacatacaacatggacaattacaagatcaatcaatatcgtgctaggatcaacgat

SEQ ID NO: 15399 - DNA, 75 bp, Artificial Sequence
  Synthetic
cgcactggggatccgcgttttccagtatccatccgaagttctccattcaatagtgaggaatctgacgactgccat

SEQ ID NO: 15400 - DNA, 75 bp, Artificial Sequence
  Synthetic
cccagccaatctaacatattgaccattctctttttgagacagtctgcaactgtcaatgacaaaccattacaaact

SEQ ID NO: 15401 - DNA, 75 bp, Artificial Sequence
  Synthetic
ctgaacgtgtggaatcaacggagccacatctgactagtgcccagcatgagcggctccaccgccattgggctgact

SEQ ID NO: 15402 - DNA, 75 bp, Artificial Sequence
  Synthetic
ccttgttcaacaattgtgtcacaagtattaaatagttctgtaggatttttacatctaaagtttcctatacaagct

SEQ ID NO: 15403 - DNA, 75 bp, Artificial Sequence
  Synthetic
acagaggtgatctccataataacattcatactagtgattgctatatttgtgattgagattgttagctgtgttacg

SEQ ID NO: 15404 - DNA, 75 bp, Artificial Sequence
  Synthetic
gagaaaaacttaataaatagaggaacaactttaccttcaacctcaaagtgtgacttgaattcacctacaagaggg

SEQ ID NO: 15405 - DNA, 75 bp, Artificial Sequence
  Synthetic
atgatgactctgaaagcaatcacattgaaaaaaagactcagcttttgtcagggttgtgggaaaaatgctagtctt

SEQ ID NO: 15406 - DNA, 75 bp, Artificial Sequence
  Synthetic
ctacaacaatactttggtgaaacatgtttgtttaggaagtttgacagtgcatatatataattcattagatacatc

SEQ ID NO: 15407 - DNA, 75 bp, Artificial Sequence
  Synthetic
gtcattctcccctgcaaaaacaaggtctgcatggaatgtgctctgaagatgagatgcccagtttgctatgaagca

SEQ ID NO: 15408 - DNA, 75 bp, Artificial Sequence
  Synthetic
atttcttctctaatgctatttatgtgttttgctctaaacattctttttacaatcactaccatgtcatctgatgtg

SEQ ID NO: 15409 - DNA, 75 bp, Artificial Sequence
  Synthetic
tgcctttggtgtgagaatcctgatggatctctttcctcactagcactcatcaacaaggaaagaaacaaagtcagg

SEQ ID NO: 15410 - DNA, 75 bp, Artificial Sequence
  Synthetic
ttcatggagattaatttaatgttgaagagttcattgactttgttacaaatatattctgaggccaatgagccataa

SEQ ID NO: 15411 - DNA, 75 bp, Artificial Sequence
  Synthetic
gacaacctccccgaaccataaaggctcagacaaacaacccaccgaccaatggacagagagacaacaaccggaaag

SEQ ID NO: 15412 - DNA, 75 bp, Artificial Sequence
  Synthetic
agatcagatgtatagtgtaatatcccttgtcccatgtcaaaataactgtgtatttgagaaggcaccttattgtca

SEQ ID NO: 15413 - DNA, 75 bp, Artificial Sequence
  Synthetic
gagcaagaaagagacaacccagaccaccggagacggccctgccgtctccggtggtctggggggtctcctgtgcct

SEQ ID NO: 15414 - DNA, 75 bp, Artificial Sequence
  Synthetic
tgtgtctttattttctttgttttcaactggtttatgaaataggtttcatagcttctttccttgtcaggtcgcctt

SEQ ID NO: 15415 - DNA, 75 bp, Artificial Sequence
  Synthetic
ccgcccgttcccgccgggacctccgctgctcagtcctccagggtctcgggctcaggtgtcccagatgcccagtcc

SEQ ID NO: 15416 - DNA, 75 bp, Artificial Sequence
  Synthetic
tcacgattgtttaaactaatatctgtcattgtttgataaatgtcttcaattattgtcacaggtacttcaacagcc

SEQ ID NO: 15417 - DNA, 75 bp, Artificial Sequence
  Synthetic
ttgtaaagcatgagtctgtgccccttatatagcagtggtcctgctgggtaactcacaagcaacccttttaatcta

SEQ ID NO: 15418 - DNA, 75 bp, Artificial Sequence
  Synthetic
ttaaataggtgccacttgagaattgtttttgcaaaggccaaattcaactttttcccattagctcctcttatttct

SEQ ID NO: 15419 - DNA, 75 bp, Artificial Sequence
  Synthetic
tggaacaccagagtgggaccttttgtagtgaaaaccctatctgtgaatgttagaaattctgcaaaggagtcaagt

SEQ ID NO: 15420 - DNA, 75 bp, Artificial Sequence
  Synthetic
tcaagtgcctcatacaacatatggtactgaattggactattgtaaggcccccattttgaatgatccatacttagt

SEQ ID NO: 15421 - DNA, 75 bp, Artificial Sequence
  Synthetic
tgatgaaaacccatggtaactaccttttcaactgtagaataaccaaaaattctgcttaccatcccccacagagca

SEQ ID NO: 15422 - DNA, 75 bp, Artificial Sequence
  Synthetic
atgatataaccattatagaaggctctacttatctctttcataaaactgtcaaacttcttctcagaagacaaacag

SEQ ID NO: 15423 - DNA, 75 bp, Artificial Sequence
  Synthetic
tcaaatctagcctttggaagacatgatatttctcccttcattcttgttatgaaatatgtcctcactaacttccaa

SEQ ID NO: 15424 - DNA, 75 bp, Artificial Sequence
  Synthetic
ctattctccagcaaagagcccaaattccttgacgattcttcaagcactctagtgatcagttttgtgtctgagtca

SEQ ID NO: 15425 - DNA, 75 bp, Artificial Sequence
  Synthetic
agctcctcccattcagcctctgacatatgagtcattattgatcccactaaatctgattccagaggaatcacacaa

SEQ ID NO: 15426 - DNA, 75 bp, Artificial Sequence
  Synthetic
ccaacataaagttctcttggccctccgacttgttccttaaatgatagtccaaattggagcaatttgttgttaggc

SEQ ID NO: 15427 - DNA, 75 bp, Artificial Sequence
  Synthetic
cccatgaataaaaaacatggttttccatttggttttgagttttccacaaccacaacatctctaaactccaacgtg

SEQ ID NO: 15428 - DNA, 75 bp, Artificial Sequence
  Synthetic
cctatttcagagttctttatatccatatctaatgtcgaaaacagaatgtttctcagtgttggtgcaccaaaacta

SEQ ID NO: 15429 - DNA, 75 bp, Artificial Sequence
  Synthetic
tctaatatctcaggttcatcaaaatctgagtcagaaatgatcacccttttaagaaacatgaagtcttgatagtga

SEQ ID NO: 15430 - DNA, 75 bp, Artificial Sequence
  Synthetic
acatttaacaaccgttcttgaattgactctgaatttgtgactctacttgaaatcatcatcttttttctgtacttg

SEQ ID NO: 15431 - DNA, 75 bp, Artificial Sequence
  Synthetic
gcacgtcctgtgtgtgtgatcagtgtcgcctgaatcttgagatcattgctgatttgctgaaggcagcactgcaac

SEQ ID NO: 15432 - DNA, 75 bp, Artificial Sequence
  Synthetic
tctgataattttagaatggaactttggggaccagaatggtgtgtgtatgtcccttgaaaattgttgaatcccgcc

SEQ ID NO: 15433 - DNA, 75 bp, Artificial Sequence
  Synthetic
tttattggattagatgttcccaatttggcacctctaagccatgtgccatcttctaggggaaactctggggtgcct

SEQ ID NO: 15434 - DNA, 75 bp, Artificial Sequence
  Synthetic
cataaaagaagaaatttgaaacttgagaaaatgtcaccttcctgtaatctagcaactactaaacctgctgaaaca

SEQ ID NO: 15435 - DNA, 75 bp, Artificial Sequence
  Synthetic
ctcccatacacaaccacattgctagatgttatttcatttggttcatcttccttctgtctataatgtgactctcta

SEQ ID NO: 15436 - DNA, 75 bp, Artificial Sequence
  Synthetic
ttatctaaagacactaattcagcatcccttgggaaagatgagggtaatctggttatgactgattcaatgatctcc

SEQ ID NO: 15437 - DNA, 75 bp, Artificial Sequence
  Synthetic
cccaaaaggacttgttgaatatacctcctaacaccagattctccatgcgattttaggtcttccatggaaccttca

SEQ ID NO: 15438 - DNA, 75 bp, Artificial Sequence
  Synthetic
ttcatgcagtcttctgacaaaatgtcacttgtcaagtctgatagttttgttgacatgcatgttgacttgataagg

SEQ ID NO: 15439 - DNA, 75 bp, Artificial Sequence
  Synthetic
tatggggcgagttttgttgcatccatgaccatagtcttatcaataatttttggctccaatattgaatctaagatc

SEQ ID NO: 15440 - DNA, 75 bp, Artificial Sequence
  Synthetic
ttcttggactcagtacctacaatagaactaatagtttcaagaacaatttcataattagttagttctttctcatct

SEQ ID NO: 15441 - DNA, 75 bp, Artificial Sequence
  Synthetic
attctattaactattgcttgcaagccttttcttgcagtcctttcaggtcctctcttctcaagcttcatggttcgt

SEQ ID NO: 15442 - DNA, 75 bp, Artificial Sequence
  Synthetic
gggaccccagccttgtttgtgatttcttctttgatctcatcagcaacatccagcatttgcaacaaaaattcacca

SEQ ID NO: 15443 - DNA, 75 bp, Artificial Sequence
  Synthetic
ctgagcaatctacctggttcataatagtccaccaacacgactgcctcctcctgcctatcaattctaccatcaaaa

SEQ ID NO: 15444 - DNA, 75 bp, Artificial Sequence
  Synthetic
tactccagttcatctagcaacccctcatccccgatgattctttcaattgttgagctaagttcttcaagcttgaca

SEQ ID NO: 15445 - DNA, 75 bp, Artificial Sequence
  Synthetic
atagacaatcctttattggcacactctatcaacaactccatttcaggtctaactttccaagagtgtctcatgagc

SEQ ID NO: 15446 - DNA, 75 bp, Artificial Sequence
  Synthetic
attattgtagacttctctgtggtgatacctttattcctttctttgatggaactggatttcactgtgtttttgtgt

SEQ ID NO: 15447 - DNA, 75 bp, Artificial Sequence
  Synthetic
agccttttgtctggtggtacaatatctttaagatacttatcaaaaagatcaggcattgtcatttcaatggctgca

SEQ ID NO: 15448 - DNA, 75 bp, Artificial Sequence
  Synthetic
aacttctcacaaattatgcgttttataattaattttgggttgtataaaacatcaagtgcactctcaatttcacca

SEQ ID NO: 15449 - DNA, 75 bp, Artificial Sequence
  Synthetic
gttaactcatctaacccaaatctgaattctgcagtgttgacaagtgatgttctcatataaatgcttttattcatc

SEQ ID NO: 15450 - DNA, 75 bp, Artificial Sequence
  Synthetic
ttttttgtccttttaaaggtgcttttgttagatgtgagatccaatacatcaaccgaggacgacaaaacattctca

SEQ ID NO: 15451 - DNA, 75 bp, Artificial Sequence
  Synthetic
tgcttatccatttcactttcaactccacaaacccaatcaccaactgcacagactgattgcatgaccaaggaggga

SEQ ID NO: 15452 - DNA, 75 bp, Artificial Sequence
  Synthetic
tcagacagaagtggttcaccattttgtccattaaacttgttcattttaacccaccgcaagaagtcgctcatgact

SEQ ID NO: 15453 - DNA, 75 bp, Artificial Sequence
  Synthetic
aagacttcagctactggtttaacaacatttttggactcctttaaggtcaggaatgtgccatcacccttcctaatg

SEQ ID NO: 15454 - DNA, 75 bp, Artificial Sequence
  Synthetic
ggcttgtaaactgatggctttacttcaatagtgggtgcatttaaaaagaatctttctgactcatcctcaaacttg

SEQ ID NO: 15455 - DNA, 75 bp, Artificial Sequence
  Synthetic
catgcaccagataagctaatactcaatccaatgaaccctgtcaccactgagctttgaaaagcagacctctcgaga

SEQ ID NO: 15456 - DNA, 75 bp, Artificial Sequence
  Synthetic
tctattaattcatcaacattttttgaattaataatgggatttgacatgaactcaattttgggtttcatgaacttc

SEQ ID NO: 15457 - DNA, 75 bp, Artificial Sequence
  Synthetic
ccttctgctatcagtaagccaagaccctgctttgaatatctagagtagtggttgatcagttttttgattaacaag

SEQ ID NO: 15458 - DNA, 75 bp, Artificial Sequence
  Synthetic
tcaaagcagtctcgcatgtcatttaatctatcaggtgattcttttgtaatcaagtgacaaaggtaggatatattc

SEQ ID NO: 15459 - DNA, 75 bp, Artificial Sequence
  Synthetic
ttctcacatgtctcatttattgttgtgcccaaattgagtttgcttctgacaattaatttgaattctccattgaga

SEQ ID NO: 15460 - DNA, 75 bp, Artificial Sequence
  Synthetic
aaacaccaagtgacttttaaaaacaaactcatgtttccacagcttaatacagtattgattaagtcatgtgcaagg

SEQ ID NO: 15461 - DNA, 75 bp, Artificial Sequence
  Synthetic
gttgggaaccataaagtgatttctcctaattctgatttactgatgtctaccatcttattatatgctacagatggt

SEQ ID NO: 15462 - DNA, 75 bp, Artificial Sequence
  Synthetic
cttcttagaaagtactcatctgttgtgatacaattaccaacaactttactgaccaggtccttatggtgtattagt

SEQ ID NO: 15463 - DNA, 75 bp, Artificial Sequence
  Synthetic
gctattgatgactctcttaactcttttatcaccttaagtaactcaagcttcagcacatcaagtttcaattttcca

SEQ ID NO: 15464 - DNA, 75 bp, Artificial Sequence
  Synthetic
gataaggcatccattatataatatctttgtgactgtaactctacttgtagtcttttagttggatttgtcaacact

SEQ ID NO: 15465 - DNA, 75 bp, Artificial Sequence
  Synthetic
attcccaaatccatcagccaactctctaaagatctcagttttctgtaagaaagacagccctccaaccagtcttgt

SEQ ID NO: 15466 - DNA, 75 bp, Artificial Sequence
  Synthetic
ccataaatcaatacctttaacttatgcaatgtttgttttgctagctcttccgtcataatgtttgatgtaagaaat

SEQ ID NO: 15467 - DNA, 75 bp, Artificial Sequence
  Synthetic
tgtcttgattctacaggcttcatcaaaggatcagcaacatatcctaaccagcctaacatctcaaccattctccct

SEQ ID NO: 15468 - DNA, 75 bp, Artificial Sequence
  Synthetic
gggttaatagcttgttgactcttaattacattgtctgttatatcagcaatcggtgtgtcaataaatgttaataaa

SEQ ID NO: 15469 - DNA, 75 bp, Artificial Sequence
  Synthetic
tttagtgagtcagccaccttcagagacataccattacaaatcccctgttcaacaatagcatcacatgtgttgaaa

SEQ ID NO: 15470 - DNA, 75 bp, Artificial Sequence
  Synthetic
tctttgtattgtctgagtacggcattgatactctcactggagaatatcagtggaaacagtctagatggattaata

SEQ ID NO: 15471 - DNA, 75 bp, Artificial Sequence
  Synthetic
agttccatcggtgttttgcatctgaaattgttgattgaggctgcaaaaaacttcgtgaatagaggaaccatggtg

SEQ ID NO: 15472 - DNA, 75 bp, Artificial Sequence
  Synthetic
ttaaaggataaaaatatatttacgtgatgattcttagcaacctgggtttccacaagcaaactgaatgccttttga

SEQ ID NO: 15473 - DNA, 75 bp, Artificial Sequence
  Synthetic
gcctcaacttcaaaatgtgatttgaattctccaacaagtggactacagcaaaatttgggagaaatgtgtttgttc

SEQ ID NO: 15474 - DNA, 75 bp, Artificial Sequence
  Synthetic
ccttcaccagaagctttgtagatcaatagctgtccttttctgctttggaagaaatattcagtctcattacttgac

SEQ ID NO: 15475 - DNA, 75 bp, Artificial Sequence
  Synthetic
agacagttggacaccaaacacagaaagttcgtaatcaaaagtagttcatccttctgattactgtcctcattttta

SEQ ID NO: 15476 - DNA, 75 bp, Artificial Sequence
  Synthetic
ctaggacaactctttgttttttgagataacagaagatttaaagcacaatcttctattctttgcttgtctatgttg

SEQ ID NO: 15477 - DNA, 75 bp, Artificial Sequence
  Synthetic
tacttaatgtgaaacaataagaccatatcatcagatgtgttcatggtacttgacctaactccaaaaatttctttt

SEQ ID NO: 15478 - DNA, 75 bp, Artificial Sequence
  Synthetic
ttatagtcctttgtttttccctctcgttctcgggcaatcttgtagtttatgaatggctcagggactggacctctg

SEQ ID NO: 15479 - DNA, 75 bp, Artificial Sequence
  Synthetic
atcttttttgttatgtattcggatgctaaggaaccgtagagatctgatgtgtgatgtaagattccctggcccata

SEQ ID NO: 15480 - DNA, 75 bp, Artificial Sequence
  Synthetic
ttcctcatcttaaaattgggttttacaattttacatgacttcaccatttcaatggcatctttgagtaaatcgtgt

SEQ ID NO: 15481 - DNA, 75 bp, Artificial Sequence
  Synthetic
tcaaaccaagagtggatttgtgaaggcacgggtttgttggatagaacagcatccaccataaatgtttcaaaagtt

SEQ ID NO: 15482 - DNA, 75 bp, Artificial Sequence
  Synthetic
atgtagccttttggtgtggaagcttgtagtttgaacattgagatcatcaatcgtttctttagcttttccaattgt

SEQ ID NO: 15483 - DNA, 75 bp, Artificial Sequence
  Synthetic
ctttctttcccaatttgtctgtctcttctccccaagcttacatcaagagaagaaaggatgacatcttcagctaag

SEQ ID NO: 15484 - DNA, 75 bp, Artificial Sequence
  Synthetic
ctaaaattggagtcaatagatttgacactcactagtctgtcattcacacttggaaaccagccacttgggtaatca

SEQ ID NO: 15485 - DNA, 75 bp, Artificial Sequence
  Synthetic
atttggggtgtctccactgccttaaacaaatgccattttagaatggtcttagcgaatgagaaatctagtcgtctc

SEQ ID NO: 15486 - DNA, 75 bp, Artificial Sequence
  Synthetic
ttcatttctggtagactcatgaacgccatataatcatagagaatgttttgatgtcttcttgagtttaataagttt

SEQ ID NO: 15487 - DNA, 75 bp, Artificial Sequence
  Synthetic
ccatctgtgtcattgatactctccatcgcctcaaacattaaatggtactggagaggactgttaaaggggccccat

SEQ ID NO: 15488 - DNA, 75 bp, Artificial Sequence
  Synthetic
aaagatttaagtttattgagcaaactcaaatgtttagttggaaggtttagacctgttgttgcagagctcattaat

SEQ ID NO: 15489 - DNA, 75 bp, Artificial Sequence
  Synthetic
tttgagtgatccatgcttaaaacaatctcattttcaaaaaaagaccttgcaattcttttcatgaagttggaaaac

SEQ ID NO: 15490 - DNA, 75 bp, Artificial Sequence
  Synthetic
ctcatgagcctcaagggcttgtaatctttaggctggagctctatgtctctccacttatgaattagctttgttatc

SEQ ID NO: 15491 - DNA, 75 bp, Artificial Sequence
  Synthetic
ttcttatctgaattaaggcagctattgttaagcctgttaccaatgttccttgaagtttcttccaaaactctagtt

SEQ ID NO: 15492 - DNA, 75 bp, Artificial Sequence
  Synthetic
tgtggcccatcccatgctgtattgaagggtaatttattttgtgtttctaaacttgcaagccatgagagaatatcg

SEQ ID NO: 15493 - DNA, 75 bp, Artificial Sequence
  Synthetic
attagttttgtatcagaatccccaacatatagttctctgggtccaccaacctgctcttttattgcaagtccaaat

SEQ ID NO: 15494 - DNA, 75 bp, Artificial Sequence
  Synthetic
gcgtctagtgtctcagagggttcatccaagtctgtgtacaactttgtgccactaaactctgatgttaaagtttta

SEQ ID NO: 15495 - DNA, 75 bp, Artificial Sequence
  Synthetic
tggagtggcttgttgtttggcccaatttcagaattcttcatctctaaatttagtgtggaaaaaaggatatttctc

SEQ ID NO: 15496 - DNA, 75 bp, Artificial Sequence
  Synthetic
aaatcataagttgttaatgatctttttaactcatcatattcttcttcactaatccattgggatgatttgtcagaa

SEQ ID NO: 15497 - DNA, 75 bp, Artificial Sequence
  Synthetic
aatgttggtgcaccatattttattgctatgagtctatcctgtaatgcttctgaatttgtaacccttgttgaaagc

SEQ ID NO: 15498 - DNA, 75 bp, Artificial Sequence
  Synthetic
tatgacaagattgataatgacaattttagtaactcaaaaagtagtcgctctggcacattgccgtttctgggtttt

SEQ ID NO: 15499 - DNA, 75 bp, Artificial Sequence
  Synthetic
atgctttctcctctatatttattggagattgacaagaatgaactttgggggcctgatctatgatcatatgttccc

SEQ ID NO: 15500 - DNA, 75 bp, Artificial Sequence
  Synthetic
gtttctgaaataacaatgatgttgaaaagccaaccttcatgctttagatgatcttctacaccactatacttgagc

SEQ ID NO: 15501 - DNA, 75 bp, Artificial Sequence
  Synthetic
tgaaaattgttaaaccctgcccaaagaagcaggaacttaaaacttgagaaaaactccttcaactcatattttgtg

SEQ ID NO: 15502 - DNA, 75 bp, Artificial Sequence
  Synthetic
ttgtctgatgtaatcttccttttttggtcggatggcattgaccgtgtgctggcttctagtacaattatagtcatg

SEQ ID NO: 15503 - DNA, 75 bp, Artificial Sequence
  Synthetic
acaaccatacctgctgatatattagtcacatcaatggtgtcaacattcctaggaaattctagtggggctcttgac

SEQ ID NO: 15504 - DNA, 75 bp, Artificial Sequence
  Synthetic
ttggctctatcaatagtgtacccatcaggtacaatgtgttggaatgttgggtgaattggaattgctctgtcgatt

SEQ ID NO: 15505 - DNA, 75 bp, Artificial Sequence
  Synthetic
attgtctcaccaacaattctttcataagcctcctttctgagcaggtctgtagggagatctgacaatttagtgctg

SEQ ID NO: 15506 - DNA, 75 bp, Artificial Sequence
  Synthetic
accatattcagtgatatttctttcgtgttgtgaataattcctaggtctctgcagcagttaagttcatggatggtt

SEQ ID NO: 15507 - DNA, 75 bp, Artificial Sequence
  Synthetic
taacacgtagaacgaacaaggtcacaaacttcaggacctagcagttcacgaatcacatccaaaaccaagcagtac

SEQ ID NO: 15508 - DNA, 75 bp, Artificial Sequence
  Synthetic
gctcttaatctgattgcactcatggctaacttgtaggggtcatccactattgatgactgtttgtaaaggtcaggt

SEQ ID NO: 15509 - DNA, 75 bp, Artificial Sequence
  Synthetic
ttggttttttgaagatcatttatctcctttggattcatttttttaagctcatcatcaatctcatgtaagcattta

SEQ ID NO: 15510 - DNA, 75 bp, Artificial Sequence
  Synthetic
tcaatgcttagaatctcaagaatgacgttttttaggaggttggtgtccgggtccattgccctcgtggctggtctg

SEQ ID NO: 15511 - DNA, 75 bp, Artificial Sequence
  Synthetic
ttgatttgtaggaggaagtcatttagatcttcttcagaatcagtttcaacaatgagtccctgaacaattcccaag

SEQ ID NO: 15512 - DNA, 75 bp, Artificial Sequence
  Synthetic
ggctctgccgctccctccgtgcgtgcccgctgtctcccgctcagtgtctggctctctccggtgccccaccctcca

SEQ ID NO: 15513 - DNA, 75 bp, Artificial Sequence
  Synthetic
aactcctcataagccaatctggttttcttccttttttcaccgccagctttccagttcctttccttcacagattca

SEQ ID NO: 15514 - DNA, 75 bp, Artificial Sequence
  Synthetic
cgcactggggatccgagttaaagtatcaatcttccgtgtataatctcaagagatgcattatccatggctgcactc

SEQ ID NO: 15515 - DNA, 75 bp, Artificial Sequence
  Synthetic
gccccaccctccaagtgtgtgtctttcggtatttactcatgtaaaagtatctaaataacgcggatcctcagtgcg

SEQ ID NO: 15516 - DNA, 75 bp, Artificial Sequence
  Synthetic
ccccctgatttaaagctcttggctgtgcttggatcatctccagctttggttgattttgttattctcttgtgtagt

SEQ ID NO: 15517 - DNA, 75 bp, Artificial Sequence
  Synthetic
caggggccgcaccaagtgtgaggcccacacagcaaaagccctcataataattctcctgacagccaactgcaaagc

SEQ ID NO: 15518 - DNA, 75 bp, Artificial Sequence
  Synthetic
ctctcgcttatcactctcttaagaagcttctcagtgtcatattgctggtctagtacatcattcatgtggtggttc

SEQ ID NO: 15519 - DNA, 75 bp, Artificial Sequence
  Synthetic
cctcattgctgagatgctccaagcagcagcaggcaacgacagctccatctgtcatggaatgatgtttaccgaacc

SEQ ID NO: 15520 - DNA, 75 bp, Artificial Sequence
  Synthetic
ttagatctcttgaacgtactcttatttgaggttagatccaagacatcaatgtttgaagttaggtaatccttcggg

SEQ ID NO: 15521 - DNA, 75 bp, Artificial Sequence
  Synthetic
agttggttcatttctaggcataaatcccaacaccactgatgacccatttgaactacatgctctttcactgaacca

SEQ ID NO: 15522 - DNA, 75 bp, Artificial Sequence
  Synthetic
ttaagtaattgctcaccatcaatgccattaaatttttctgttgagatccactttagaaaatcagcaagaataggt

SEQ ID NO: 15523 - DNA, 75 bp, Artificial Sequence
  Synthetic
aaatgtgactgacaagatcatgatctttcaaaatggattgaaactatttgggtctgaaacaaggaattatagcat

SEQ ID NO: 15524 - DNA, 75 bp, Artificial Sequence
  Synthetic
tcatatagaaaaggttttgtctcaaaggaaggttcctcacactgaataaaatcgttgacctcctgttccattctc

SEQ ID NO: 15525 - DNA, 75 bp, Artificial Sequence
  Synthetic
aaccagcggtcctggacttctggttggcttctttggtcacagtagatcaggagtctataaaaaccttactttcac

SEQ ID NO: 15526 - DNA, 75 bp, Artificial Sequence
  Synthetic
tcaaccagctcatcaacactcttacaatcataaatcatattagacatgaactgaaactttggtttgaagaacttt

SEQ ID NO: 15527 - DNA, 75 bp, Artificial Sequence
  Synthetic
aaacaacacaacattcaaaatttgtgtttcttgcaaaagtagattcaatatcactcttgttgtatacaataaatt

SEQ ID NO: 15528 - DNA, 75 bp, Artificial Sequence
  Synthetic
tcataacagtctcttaaatctgacaacctgtctggggtctcctttgtgatcaaatggcacaagtacgatatgttc

SEQ ID NO: 15529 - DNA, 75 bp, Artificial Sequence
  Synthetic
cacaaagaaggctagcacaaccatttgccctgatgaatttgttcgaaagaagcgcagtgatgtaatagtgtcata

SEQ ID NO: 15530 - DNA, 75 bp, Artificial Sequence
  Synthetic
aaggcccatgtcacttttaagaacagacctatatttttacaagaaagaatttcattgatcagtccgtgggcaaga

SEQ ID NO: 15531 - DNA, 75 bp, Artificial Sequence
  Synthetic
caacttaacctgtgttatattacacaacaagaacatgatcacccatcacaaaactgctttaaatgcagaattttc

SEQ ID NO: 15532 - DNA, 75 bp, Artificial Sequence
  Synthetic
tctcttaaataatattcatcataagtaatacagtttccaataactttggctttcaagtccttgtggtgaatgata

SEQ ID NO: 15533 - DNA, 75 bp, Artificial Sequence
  Synthetic
accaagaggcttacaacaattgtctaccaagaatgatgtggaacctggttgtgactctaatgttggtatctttgg

SEQ ID NO: 15534 - DNA, 75 bp, Artificial Sequence
  Synthetic
gacaaagtatccataatgtagtatctctgtgattgtagctctatctgcagtcttttggttggagttgtcaaaata

SEQ ID NO: 15535 - DNA, 75 bp, Artificial Sequence
  Synthetic
acatagcagtgggactgacgcaggatgggggattgcaggtttcttcacattagggataacaaattcacttcaaat

SEQ ID NO: 15536 - DNA, 75 bp, Artificial Sequence
  Synthetic
ccgtaaatcaggtatgtgaccttgaccttaagatcatcaatctgcttgtcagaatattcagatgaaattaagaat

SEQ ID NO: 15537 - DNA, 75 bp, Artificial Sequence
  Synthetic
atctgaaattgaacatgttacagatgctatagcgtgtaaaattataaaaactgcaaattatacaaccaacgccct

SEQ ID NO: 15538 - DNA, 75 bp, Artificial Sequence
  Synthetic
tcattcacagattcctgtctcttaattgtttcctgcagcctttcagcatcttcacagattggattaatcagcata

SEQ ID NO: 15539 - DNA, 75 bp, Artificial Sequence
  Synthetic
gttcttattgaacaaagaagagtcagaaattagagaccatgtagttgaacatgaactagccttgaattacttact

SEQ ID NO: 15540 - DNA, 75 bp, Artificial Sequence
  Synthetic
attaattgatcaactaagttcgcaatgggctttgcgctaaatatgagtgggaaaagtcttgaagggttaatattg

SEQ ID NO: 15541 - DNA, 75 bp, Artificial Sequence
  Synthetic
ggcgcaccaaggtggcctttgcaatgtggtgaagggcccaatgtgttgttcagacattgatgatttttcaaaaaa

SEQ ID NO: 15542 - DNA, 75 bp, Artificial Sequence
  Synthetic
aaagaatagaaactgtatctaagctcaccctgcttgtagcttttacaaagaatactaaatgccttctgtccttca

SEQ ID NO: 15543 - DNA, 75 bp, Artificial Sequence
  Synthetic
tgtctcagacatgattgacaaagtccatgaagaaatgaagaaattttatcatgagccagacccattcggaggtct

SEQ ID NO: 15544 - DNA, 75 bp, Artificial Sequence
  Synthetic
cctgtgcacttgtacagtaggagacagccattaactgattgaaagaaaaactcttcactcatgctggctcttggt

SEQ ID NO: 15545 - DNA, 75 bp, Artificial Sequence
  Synthetic
aggatcaattgggttctttggaactttgtttggacatattttgcagtggattccaatcatccttttaaccatatt

SEQ ID NO: 15546 - DNA, 75 bp, Artificial Sequence
  Synthetic
gtgcttcttgttttctgggaaagaatgagatttaatgcaaccttttcaatagtatctgtctcatcggatgttaca

SEQ ID NO: 15547 - DNA, 75 bp, Artificial Sequence
  Synthetic
tatgtgtttcatctgttcgtgggtcaaaaaatagagagaccaaccgtcccgacgggtcggttgtctgcttgtctc

SEQ ID NO: 15548 - DNA, 75 bp, Artificial Sequence
  Synthetic
atggttgtttgtggctcataaggtacatcattaatgatttttagacataatgatggctgaggtacaaggactctt

SEQ ID NO: 15549 - DNA, 75 bp, Artificial Sequence
  Synthetic
ccggtgggccgccctggctgctcttttcctccgggggttgtcgcttggtggtttcggttggtttgtctgtctccc

SEQ ID NO: 15550 - DNA, 75 bp, Artificial Sequence
  Synthetic
gctggcaacccaaaatacatagtcttcaacactggaggttcaatgaaattattagatgattcttctagaaattta

SEQ ID NO: 15551 - DNA, 75 bp, Artificial Sequence
  Synthetic
ggcgggccgccctggctgctcttttcctccgggggttggggcttggtggtcgtggctgggcctgcgggctggtta

SEQ ID NO: 15552 - DNA, 75 bp, Artificial Sequence
  Synthetic
atgagaattttcaattctcccaatttttgtttgctgcctacttcattctgaaggctttggagtgattttatcatt

SEQ ID NO: 15553 - DNA, 75 bp, Artificial Sequence
  Synthetic
ctgaactggtttggggtcctcgattgtgatatggcccttagcagcacaagcaaacatcatgcaatctactagtgc

SEQ ID NO: 15554 - DNA, 75 bp, Artificial Sequence
  Synthetic
ctctcaactaattttttgtacactgagagtggtgaatctacagaatccacccgcacaagtctgtcattcacactt

SEQ ID NO: 15555 - DNA, 75 bp, Artificial Sequence
  Synthetic
acagtgtggactagtcaaggcaccagttttgtcctttacagttccagagtgtttgcatggaaggatgtctgagac

SEQ ID NO: 15556 - DNA, 75 bp, Artificial Sequence
  Synthetic
gggaaccaaccctttggaaaatcatgaatctctgaatctcttacaaagagcatcaatgcaatgtaatcatacacc

SEQ ID NO: 15557 - DNA, 75 bp, Artificial Sequence
  Synthetic
tatgtccaaaatgccttcgtggtaactcatataatcctttttcttccactttgaatctgctacatttatgtcaga

SEQ ID NO: 15558 - DNA, 75 bp, Artificial Sequence
  Synthetic
ttattctgcttccttctggtgtttaatagatttagtgattttagtttgttcagtagactcaagtgattggttcta

SEQ ID NO: 15559 - DNA, 75 bp, Artificial Sequence
  Synthetic
cctcccataaaacttcagaagttctttgatgtcagagccttgacaatgtacaatctgatcttttggtattgcact

SEQ ID NO: 15560 - DNA, 75 bp, Artificial Sequence
  Synthetic
aaatttaagcctgttacagcacttctcattatttctaaaagccgcaactgcttgtcttcccttttaaaatcttgt

SEQ ID NO: 15561 - DNA, 75 bp, Artificial Sequence
  Synthetic
aaacattgacttgatgtttttgtcaataaacaggtttatgtggtctgccatatctgaagcaatcaacccatgtga

SEQ ID NO: 15562 - DNA, 75 bp, Artificial Sequence
  Synthetic
atcatctctgttattttgggaccttcccagtttaaactgaaaggtaatttctcgctgtttttcagcatccagtca

SEQ ID NO: 15563 - DNA, 75 bp, Artificial Sequence
  Synthetic
gtgccttgacgcctttttgaaactctctgagtctttagggagtctgaaaatatggatatattgattcttttcaac

SEQ ID NO: 15564 - DNA, 75 bp, Artificial Sequence
  Synthetic
aagagatctttatatgggtcttctgctgactcaatatcaaaaagtaacctttgtcccttaaattcctctgtcaag

SEQ ID NO: 15565 - DNA, 75 bp, Artificial Sequence
  Synthetic
accataaagtgctatttcaacagggtctgtggctgaaccttctatgtcaatgaaaacctctttgttattcttgaa

SEQ ID NO: 15566 - DNA, 75 bp, Artificial Sequence
  Synthetic
gttctaaaatcataacttgttaatgacttcttgagttccaaataatcctcttctgagatccaattgcaaatgtct

SEQ ID NO: 15567 - DNA, 75 bp, Artificial Sequence
  Synthetic
caatttctgtgccatgtcagaaagaactaaagagcgtgggtcaattatttctaactcattaggactgtcttcact

SEQ ID NO: 15568 - DNA, 75 bp, Artificial Sequence
  Synthetic
gtagtgtaagatagaattgataatgatgttgatagtaatttgaacatgaggatttcaggaatcctccctattctc

SEQ ID NO: 15569 - DNA, 75 bp, Artificial Sequence
  Synthetic
gggactgctgagaaaatcatcaataccaccactagtttccagctcaactggcttaagaatctttttagaatcatc

SEQ ID NO: 15570 - DNA, 75 bp, Artificial Sequence
  Synthetic
ggtttcttttctgaaattgtgataacattaagtgtccaaccaagtggtcgcagcaagttctcgaaaccatcatac

SEQ ID NO: 15571 - DNA, 75 bp, Artificial Sequence
  Synthetic
ttttagccacttgtttggtggactttgtggcaggtctaaatccattaaatcagggtatagttttgatggtgcata

SEQ ID NO: 15572 - DNA, 75 bp, Artificial Sequence
  Synthetic
tttaatctgtcaagttgaaccttcttagtttgatcagatggctcagtcctagtactcacttctaaaactgttaga

SEQ ID NO: 15573 - DNA, 75 bp, Artificial Sequence
  Synthetic
tgggggaggtctcctcagtttaaaaactgtgttgtcccaaccgcgacctgttagatttgatcttatagacacaac

SEQ ID NO: 15574 - DNA, 75 bp, Artificial Sequence
  Synthetic
acgttattatttttgtcaatcaagtaaccatcaggaacaattgttttgactgtctcatgtgatccaatggcctca

SEQ ID NO: 15575 - DNA, 75 bp, Artificial Sequence
  Synthetic
acatgcaccatttggtgaaacacataccttataaaacaagtcttcaaaaagtgttctctcctcatcaagtttgat

SEQ ID NO: 15576 - DNA, 75 bp, Artificial Sequence
  Synthetic
tcgaacaattcgttcatctccttgagatcattgttgtgtttgagccctgtatctctgcagcaattcaactcatgg

SEQ ID NO: 15577 - DNA, 75 bp, Artificial Sequence
  Synthetic
ttcaagttgtaggtccttttgggctgcaacaagcacagacaaaagctttgttctgttctgatctgttaccatgat

SEQ ID NO: 15578 - DNA, 75 bp, Artificial Sequence
  Synthetic
atagttgatctaagtttaattgcgttcatggccatctctccagctgtatttgatatccatcctggtctatacaaa

SEQ ID NO: 15579 - DNA, 75 bp, Artificial Sequence
  Synthetic
cttttcaagctttggatgactacttattgaattagcagccttcacaacacttttcactgtgatattatagcctga

SEQ ID NO: 15580 - DNA, 75 bp, Artificial Sequence
  Synthetic
tccctttcataagacaacacctctagcacaagacccttgagtctctctagttcggagtcctctggacatatggag

SEQ ID NO: 15581 - DNA, 75 bp, Artificial Sequence
  Synthetic
tgagttttttggtacactgaattcaacaacatcaagacagtgatgttttgatgataaagctttaattactgaggc

SEQ ID NO: 15582 - DNA, 75 bp, Artificial Sequence
  Synthetic
ctcatagttgcctggttgttgtcacctcaccacccttgatgcatcaaataaacttttcacatttgagagatctgg

SEQ ID NO: 15583 - DNA, 75 bp, Artificial Sequence
  Synthetic
attaacaaacattcctgcatccagcaatgatatatcatttagagcttcaaacaattctttgaatgtacatccaga

SEQ ID NO: 15584 - DNA, 75 bp, Artificial Sequence
  Synthetic
cgcactggggatccgagttttccagtatcgaacaaaaataaacaatcaaaaggagtccaatctcaagccaacaac

SEQ ID NO: 15585 - DNA, 75 bp, Artificial Sequence
  Synthetic
cacctcaccacccttgatgcatcaaataaacttttcacatttgagagatctggaaatacgcggatcctcagtgcg

SEQ ID NO: 15586 - DNA, 75 bp, Artificial Sequence
  Synthetic
tctctgtagcatgatggagactgtaatcgatggtgaagtaccaaactgatttgctagttcttctgagctaacacc

SEQ ID NO: 15587 - DNA, 75 bp, Artificial Sequence
  Synthetic
cacaagagcgccgacaagaaaggagccagcaaaaaagcacaaggcaccaaggctcctgcccacaaaggcagccct

SEQ ID NO: 15588 - DNA, 75 bp, Artificial Sequence
  Synthetic
aatccatgatttgggtttgttgttctcatttctggggttgggtttttgagggacaaagctagcgaatagtgaact

SEQ ID NO: 15589 - DNA, 75 bp, Artificial Sequence
  Synthetic
gaagaccagaatgatgagtcatatccggttggtgctctgctcagctctgctgtctatgatgtcctgcccaacatc

SEQ ID NO: 15590 - DNA, 75 bp, Artificial Sequence
  Synthetic
aaatctctcatggtcttcatgactgagaccagtctcaaattcaaatttgcttgagggtttgtctctgccaccttt

SEQ ID NO: 15591 - DNA, 75 bp, Artificial Sequence
  Synthetic
tgggacaattggtgaaatgctttccttggcggcatcaagcaactctagcatatgtcacggcatgcagttcactga

SEQ ID NO: 15592 - DNA, 75 bp, Artificial Sequence
  Synthetic
gtattctgcttttttctttattcgttccagattgtcaatgcattgcattagatcttcatctgacatttgtgttga

SEQ ID NO: 15593 - DNA, 75 bp, Artificial Sequence
  Synthetic
accaactgagtcattcatgggaatcctgccaaatgagaccctaccaatgttcatcttctctattatgcacagtga

SEQ ID NO: 15594 - DNA, 75 bp, Artificial Sequence
  Synthetic
atctatttcaactacaacctgttctgaggtcacatttgttccttcagccaagtatttgttaagttttcttagttt

SEQ ID NO: 15595 - DNA, 75 bp, Artificial Sequence
  Synthetic
ggctgtgcccaaggtggggaagactttgagaatcagccatgatatgaaactctttggaggggaagctgtcaatta

SEQ ID NO: 15596 - DNA, 75 bp, Artificial Sequence
  Synthetic
ttgtagatcatccctggtttttgtctctttcctcagacgtcttagtacatcattcacctcattaatgtttatttt

SEQ ID NO: 15597 - DNA, 75 bp, Artificial Sequence
  Synthetic
catgatatttgtcaacaagattctttatgaaccaatttcttactacaactacactggctcttgtagacaacaagg

SEQ ID NO: 15598 - DNA, 75 bp, Artificial Sequence
  Synthetic
tgcactaatcagtttgacatctttaaagaggtcgttgtttaggttggcctggaaaggccttaggactttatttag

SEQ ID NO: 15599 - DNA, 75 bp, Artificial Sequence
  Synthetic
gctctcatcctgtgtgagggtttattccgatcttgttaatggctccaaaggcaacccatcagtgaagcttggttt

SEQ ID NO: 15600 - DNA, 75 bp, Artificial Sequence
  Synthetic
atgtttctttacaactaactgattcatggccttgtttgggtggagggggcctctgctgctgggctgttcgttgtt

SEQ ID NO: 15601 - DNA, 75 bp, Artificial Sequence
  Synthetic
cacagccatcgaactcaacaaaaccaaaaacaccgactttcacaacttaggcttcaaaatttgcttctcctgtag

SEQ ID NO: 15602 - DNA, 75 bp, Artificial Sequence
  Synthetic
ggcaggctgcttggggcgcaggggacgagattgccctgcgcacaaccacgctgtccaattccctgttgagatgct

SEQ ID NO: 15603 - DNA, 75 bp, Artificial Sequence
  Synthetic
agatcataatggaataagattggttgtctacaacaaaaataaccgcactgcacaattgatgatgtgtcccagtga

SEQ ID NO: 15604 - DNA, 75 bp, Artificial Sequence
  Synthetic
agatgctgtccacctgtgtttattcacttttgatttatcttaaagatagatcttgaaactcggatcctctgtgcg

SEQ ID NO: 15605 - DNA, 75 bp, Artificial Sequence
  Synthetic
attaatcttctctcaggacttcactattaattcaacatcggtgaatcctagtgaggaggccgcagtaccattgct

SEQ ID NO: 15606 - DNA, 75 bp, Artificial Sequence
  Synthetic
gaatgtgacaggttacacgtgcattgccttacacaacaaaaatatgctcacccaccatagccccgctctttccag

SEQ ID NO: 15607 - DNA, 75 bp, Artificial Sequence
  Synthetic
tgggtccaaggtagacaacacactggaacctggttgtgactccaacgttggactcttcggccatagcacagggac

SEQ ID NO: 15608 - DNA, 75 bp, Artificial Sequence
  Synthetic
cgattatggctgggggcttgcaaatttctttagtgcaggcataacaaactcacttcaaatatcacaattagaaca

SEQ ID NO: 15609 - DNA, 75 bp, Artificial Sequence
  Synthetic
tgtgactgacgccattgcatgcaagatagccaaaacatccaactacacaaccacagccctgttcctgttaaacaa

SEQ ID NO: 15610 - DNA, 75 bp, Artificial Sequence
  Synthetic
ggaagaaggtgaaatcagagatcatgtcattgagcatgaagttgctctaaattatctcttagctcatcagggtgg

SEQ ID NO: 15611 - DNA, 75 bp, Artificial Sequence
  Synthetic
actctgcagtgttgtgaagggcccaatgtgttgctctgacattgatgactttagaaggaatgtttctgatatgat

SEQ ID NO: 15612 - DNA, 75 bp, Artificial Sequence
  Synthetic
tgataaagttcatgaagaaatgaagaaattctatcatgaaccagatccctttggtgggcttggcacttggggctt

SEQ ID NO: 15613 - DNA, 75 bp, Artificial Sequence
  Synthetic
ctatggtaccatttttgggcatgtgctacagtggattcctataataattatggtagtcgtggtttgttttgtttg

SEQ ID NO: 15614 - DNA, 75 bp, Artificial Sequence
  Synthetic
cagctgggtaagaaagtaacaccacgtgcccaccctctggttgtttgtttcccggaatggtagtcgtggtttgtt

SEQ ID NO: 15615 - DNA, 75 bp, Artificial Sequence
  Synthetic
ttgtttgcagctgggtaagaaagcaacaccacgtggcccaccctctggttgtttgtttcccggtccgcccgccct

SEQ ID NO: 15616 - DNA, 75 bp, Artificial Sequence
  Synthetic
gggtgctttgttcggtccgggcttggttgtttggacccgtttagatggtggctggggttgggtcctttgtttttt

SEQ ID NO: 15617 - DNA, 75 bp, Artificial Sequence
  Synthetic
tgcctccacttgctgttctactgaacatcaggcaatccagcagagcacaatgtggtgcagtcagggctcctttct

SEQ ID NO: 15618 - DNA, 75 bp, Artificial Sequence
  Synthetic
tgtccttcactgttcctgagtgcttgcaggggaaaacttcagatagctcatcaagtatattctcatgatatttca

SEQ ID NO: 15619 - DNA, 75 bp, Artificial Sequence
  Synthetic
taaattcttcccttttccacttacagtctgtgggctttaaatcttttctaccaaagaatttaaggcactcctcaa

SEQ ID NO: 15620 - DNA, 75 bp, Artificial Sequence
  Synthetic
tatctgacccttggcagaagattcttgctgagagcggtactttggaaaagaaagcctcaatgtttttgtcagtct

SEQ ID NO: 15621 - DNA, 75 bp, Artificial Sequence
  Synthetic
gcaggtctggatggtcagatatatcatccaacaaaagaccatgtgcatgtttggatgcctttttgaaaccatcct

SEQ ID NO: 15622 - DNA, 75 bp, Artificial Sequence
  Synthetic
tgtcctttggcatcctaaaaatatgcacaaatttgcctgtgtcgggattgaacagtgctatttccacaggatctt

SEQ ID NO: 15623 - DNA, 75 bp, Artificial Sequence
  Synthetic
gagctgtaccttctatgtccataaacacagagtctcctcccttgaaaaggtcttcacaagcgtttgccatataaa

SEQ ID NO: 15624 - DNA, 75 bp, Artificial Sequence
  Synthetic
gaactcttggatcagggatctcagagtctgagcttgcactttctggacttcttatgtactcatcaatctcatctg

SEQ ID NO: 15625 - DNA, 75 bp, Artificial Sequence
  Synthetic
cagcaggcttgaagatgtaaattttggactcttcttcagttttcttgtcacccttcactggtggaagtgcatcca

SEQ ID NO: 15626 - DNA, 75 bp, Artificial Sequence
  Synthetic
agtcaagatccatcaaatcagggtacaatcttggagcataaggaggtggtcttctcaaacggaagatggtatttt

SEQ ID NO: 15627 - DNA, 75 bp, Artificial Sequence
  Synthetic
cccaacccctgcctgttagttctgatcttatggaaaccacacaagggccgtttggcgagacacagattttataga

SEQ ID NO: 15628 - DNA, 75 bp, Artificial Sequence
  Synthetic
agatatcttcaaacagtcccctttcttcattcacttgtattttgatgttaagttctctctgtatggtcagtaagg

SEQ ID NO: 15629 - DNA, 75 bp, Artificial Sequence
  Synthetic
ttcttattatttcaaccctattgtcatcatcaataaccaatttctcgacctttgggagctttgacaacacatttg

SEQ ID NO: 15630 - DNA, 75 bp, Artificial Sequence
  Synthetic
ctgcctttaccacagctttgactgtaatgttgtaaccagaagagttctttggcactgtatattcaacacaatcta

SEQ ID NO: 15631 - DNA, 75 bp, Artificial Sequence
  Synthetic
aacaaggatgttgagaagtcatggcctttaccacagaagcgttcacaaacataccctgatccaacagtgagatgt

SEQ ID NO: 15632 - DNA, 75 bp, Artificial Sequence
  Synthetic
catgtagagcatccagtatttgcttgaaaggagaatttgtcctcatcattattagacagatagtaatggcgggtg

SEQ ID NO: 15633 - DNA, 75 bp, Artificial Sequence
  Synthetic
atgtcccaaactggtttgcaagatctgctgggctgattcccacccatgatttgggagtggagaatgctgcaggtc

SEQ ID NO: 15634 - DNA, 75 bp, Artificial Sequence
  Synthetic
ctgggtccttctttggggcaaacctgttgaacaacttgttgaacatttcgtgatcactttttgacattccagtct

SEQ ID NO: 15635 - DNA, 75 bp, Artificial Sequence
  Synthetic
ctgactcaaactcactgatgcgtggtcttgatcctcctttgtattccgcctttttctttataacgtctatatttt

SEQ ID NO: 15636 - DNA, 75 bp, Artificial Sequence
  Synthetic
caatgcactgaattaactcttcatcactcattaatgaagagtcaatctccacagtcctctgagttgccaccatgc

SEQ ID NO: 15637 - DNA, 75 bp, Artificial Sequence
  Synthetic
ctgagaggcctgcagcagtttcatttagatctctcagatttttcagatcatttggtccctttgtctccttcctta

SEQ ID NO: 15638 - DNA, 75 bp, Artificial Sequence
  Synthetic
gtctcctcagggtgtcattgactttattgatgtcaagacccacccttagtgctttcacatctttaaaaatctgat

SEQ ID NO: 15639 - DNA, 75 bp, Artificial Sequence
  Synthetic
tgttgagctccctttgatagggtgccaacatcttgttcaacttcttttttaaggctagctgatttacagcagctt

SEQ ID NO: 15640 - DNA, 75 bp, Artificial Sequence
  Synthetic
tttgaaaggctgccatgttgcttgcagagctctggtctcacttttggggatagtcttgcaggtattgtccctttg

SEQ ID NO: 15641 - DNA, 75 bp, Artificial Sequence
  Synthetic
tggtctcacttttggggatagtcttgcaggtattgtccctttggctatcgctgtgaaactcggatcctctgtgcg

SEQ ID NO: 15642 - DNA, 75 bp, Artificial Sequence
  Synthetic
cgcactggggatccgcgtttcagtataaatcttccaaggttctactgaagttctacatctctaagtgcaaagcca

SEQ ID NO: 15643 - DNA, 75 bp, Artificial Sequence
  Synthetic
atgagtatgtgcatcaacggcacaaacagcattggtatctccaacgaggttgtcctctccctaactctcatctcc

SEQ ID NO: 15644 - DNA, 75 bp, Artificial Sequence
  Synthetic
agtctcaccaccctgatactcctaatcataaacaccatcacaatgtttggtctaaaggccctcacattgaagaag

SEQ ID NO: 15645 - DNA, 75 bp, Artificial Sequence
  Synthetic
agactcagtttctgcactgcctgtggcaagaactcaagtctggtcaaactaccatgcaagcacaaatgctgcatt

SEQ ID NO: 15646 - DNA, 75 bp, Artificial Sequence
  Synthetic
cagtgtcctcttgctaatctgaaatgtcccatctgctatgagccttgtttgtggtgcgaaaaagctgatggctca

SEQ ID NO: 15647 - DNA, 75 bp, Artificial Sequence
  Synthetic
cttgagtctctctcactgatgaagaagaacctgcaagaactcccctaagaccaaccacagcacgcagcgcccggc

SEQ ID NO: 15648 - DNA, 75 bp, Artificial Sequence
  Synthetic
ggacgggtcgggcgtgcgcctgtgcctgctcttgccgtgtctgcggctggggctgtcctggggacctactcctcc

SEQ ID NO: 15649 - DNA, 75 bp, Artificial Sequence
  Synthetic
agcacttcaactctggcctcctcgggctcctgcttctctctccactcagaaaccctaagagttttatatgacatc

SEQ ID NO: 15650 - DNA, 75 bp, Artificial Sequence
  Synthetic
aacccctttagatcctcaacaagtacacctttcttatggtgaaacactaaagttgattcctttgtctcatagatt

SEQ ID NO: 15651 - DNA, 75 bp, Artificial Sequence
  Synthetic
ctcccattcaattgtaagatcttttcaaacgattgcagtttgtggagaccataactgacagcacttgaattatta

SEQ ID NO: 15652 - DNA, 75 bp, Artificial Sequence
  Synthetic
aaccttaggtaaacatttctaacaacatggtctatggcatccaatttagatctcggtagaagtgacacatcatcc

SEQ ID NO: 15653 - DNA, 75 bp, Artificial Sequence
  Synthetic
ggtgtcatgttcagaattgcagttttaaggaggcttttaagagttgcatcattcttctcattatggcacccaatg

SEQ ID NO: 15654 - DNA, 75 bp, Artificial Sequence
  Synthetic
ccctgttctgcaattttggttaaaccaattggaaatagtgatgccatgtacaacacgacaggctgaccgtgccca

SEQ ID NO: 15655 - DNA, 75 bp, Artificial Sequence
  Synthetic
actgtcttttcaatcactttaacatcgccaaactcaattagatcaatcgactcaggataatcagaatattctaag

SEQ ID NO: 15656 - DNA, 75 bp, Artificial Sequence
  Synthetic
tgttttctcttcagtagtagaaagtcttgaagatgaggcctacctaccacagtggctaacactgcctgtgactcc

SEQ ID NO: 15657 - DNA, 75 bp, Artificial Sequence
  Synthetic
acacccccttccacaaactcttgcctgatggtcaaagaaatctttggttttgaatccctataggaaatagttgta

SEQ ID NO: 15658 - DNA, 75 bp, Artificial Sequence
  Synthetic
gtccagtatcctttaattggttcttcaggagttcctgtaaactgataatcaaaaaggttctgatcaccatcagca

SEQ ID NO: 15659 - DNA, 75 bp, Artificial Sequence
  Synthetic
tgttcctcaccaaatttgtagtatgattttctgccaagcagcacttgcttaatatatctcatcaatccactaacc

SEQ ID NO: 15660 - DNA, 75 bp, Artificial Sequence
  Synthetic
ttgatatcctttagtacctctagactactggtaaatggttcagtcttcaacacatcaccaattaaagatggctct

SEQ ID NO: 15661 - DNA, 75 bp, Artificial Sequence
  Synthetic
accatttgtggtctgagtattgaagataatatcatcccatcacaaattctgtttagttcttgtactgcagtacca

SEQ ID NO: 15662 - DNA, 75 bp, Artificial Sequence
  Synthetic
gatttgtgagttttttgaagtggtaatgatctagtaactaggtgttctaatttaaaatactcagtcagcattaca

SEQ ID NO: 15663 - DNA, 75 bp, Artificial Sequence
  Synthetic
gattcttccttcctatcaaacttaccatcaaaaacagacatccctaactttgaacactcaacaagcagctccatt

SEQ ID NO: 15664 - DNA, 75 bp, Artificial Sequence
  Synthetic
tcgggtcttacagaccaatttgttctcaggttgagccttttgtcaattggcacaagtgtggctagaaacttgtca

SEQ ID NO: 15665 - DNA, 75 bp, Artificial Sequence
  Synthetic
aacaactctggtgatgttagctccaatgttgcagttaattcatccaatccatagttgaaagttggtgtgtttata

SEQ ID NO: 15666 - DNA, 75 bp, Artificial Sequence
  Synthetic
agacttgttctaacatacacaccatgtggttggaatttgttcaactgtctgtcctcaccacaaacccaatcacca

SEQ ID NO: 15667 - DNA, 75 bp, Artificial Sequence
  Synthetic
atagaacaaacagagtccattagtaaggttgtataaacttcacaaacctcttttgtgatctgttttgattggtga

SEQ ID NO: 15668 - DNA, 75 bp, Artificial Sequence
  Synthetic
attggaatgaaattcccattttctgacttcacacaaggcccagataaactaattgacaagcctataaaccctgtc

SEQ ID NO: 15669 - DNA, 75 bp, Artificial Sequence
  Synthetic
acaactgaactctgaaatgctgatctttccaaaccttcgctgattaagagtcccagaccttgcttagtgaatcgt

SEQ ID NO: 15670 - DNA, 75 bp, Artificial Sequence
  Synthetic
gagtagtgattcatcagttttttgactaatggattctcacagctttctacaagagtctgaccaagatttaacttg

SEQ ID NO: 15671 - DNA, 75 bp, Artificial Sequence
  Synthetic
cttcttacaatgagtcggaaaccaccccacagagttggaaaccatatatctattttacccagatgtgtccttacc

SEQ ID NO: 15672 - DNA, 75 bp, Artificial Sequence
  Synthetic
acatctctcattttctcaagtgctactattggtgcaatcattctcatcctaaggctttggattacctcataaagc

SEQ ID NO: 15673 - DNA, 75 bp, Artificial Sequence
  Synthetic
ttacccctgacaacatcaagagtcaactcctcaacaccattctccaacagccaagtttctaatgacctcagtttt

SEQ ID NO: 15674 - DNA, 75 bp, Artificial Sequence
  Synthetic
ctataactcaagcagcccatcaaccaatcttgttgtcgactggtgtgtgggtgcatttgagggtcagaactataa

SEQ ID NO: 15675 - DNA, 75 bp, Artificial Sequence
  Synthetic
cgcaccggggatcctaggctttccttgatcatggatgttcacttgatcgaattgagagatcttgtgagaaagtgg

SEQ ID NO: 15676 - DNA, 75 bp, Artificial Sequence
  Synthetic
aaggttttacctgcaaagtctccaacatgtttccgccatcaatcatgcaggcacctgccttgactgctgcagaca

SEQ ID NO: 15677 - DNA, 75 bp, Artificial Sequence
  Synthetic
gtccctgatgacctggaactgtcagaacagaaaaacattatgttagcacagacacaaatcagagcaacagttgta

SEQ ID NO: 15678 - DNA, 75 bp, Artificial Sequence
  Synthetic
ggctcaaattgtatcctgatatgttaatctgtgcaggctcttgtgtgatgagctttaggcaaggatgtttctcag

SEQ ID NO: 15679 - DNA, 75 bp, Artificial Sequence
  Synthetic
gagagcttaaaacttttgtccacgattgtagaagtagactcctgtaaaaaacactcctgtgtccacaacactagc

SEQ ID NO: 15680 - DNA, 75 bp, Artificial Sequence
  Synthetic
tcagtttctccaagtcagacaggtttgggtatttcactgtatacacaagccccaatgatgtcaaagcttgaacaa

SEQ ID NO: 15681 - DNA, 75 bp, Artificial Sequence
  Synthetic
aaaactgtcaacgcaatacttagggagcacaagatcattgggcccactttaccggatgtgactccagatgggtac

SEQ ID NO: 15682 - DNA, 75 bp, Artificial Sequence
  Synthetic
catcattcatctgctctcctccttgttgggtcatacaagcaatggtgagcgctggcatagaaccaaactggttta

SEQ ID NO: 15683 - DNA, 75 bp, Artificial Sequence
  Synthetic
tgtgtgattggggatgtattaatactccttgaagtgtttgttagaacaaatcaagaatcatttgaaaaaaagttt

SEQ ID NO: 15684 - DNA, 75 bp, Artificial Sequence
  Synthetic
caagaaggctactatccttaatatcccagactttcacaacacctccagctggacctcttggacccatacccatcc

SEQ ID NO: 15685 - DNA, 75 bp, Artificial Sequence
  Synthetic
aatcaggattttgagaagttgatgcaaatgagtgcagatctgaaaaagtgtggtgtaactcttgtgcctacaata

SEQ ID NO: 15686 - DNA, 75 bp, Artificial Sequence
  Synthetic
ccatcatcttcaggatttctgatctttgattcagctgagacgaggttaagttccctccgtacacacctggtagcc

SEQ ID NO: 15687 - DNA, 75 bp, Artificial Sequence
  Synthetic
gatggcagaagtacatattatgttgattttattcctgactgggttgtggaaaggttaagatggttgataagcaga

SEQ ID NO: 15688 - DNA, 75 bp, Artificial Sequence
  Synthetic
cacctccttctgtcctctgcaccttctttctcagtttgtctaaatcagaggccaactccatcaattcatcttttg

SEQ ID NO: 15689 - DNA, 75 bp, Artificial Sequence
  Synthetic
ttgatgtcaagtcttagggaggatggtcaagaaattgaagagctggaatatgagaggctcatcagcagtctatct

SEQ ID NO: 15690 - DNA, 75 bp, Artificial Sequence
  Synthetic
acaaaccacccactttcaagatgttgtccttttgtgttgatctcatcatcatgagagcatcaacctccttgttca

SEQ ID NO: 15691 - DNA, 75 bp, Artificial Sequence
  Synthetic
agtcttgaaaaccaaagtttagggcttgaatcactattagcgatgagagaaaaaggtctttcctataaggaaaca

SEQ ID NO: 15692 - DNA, 75 bp, Artificial Sequence
  Synthetic
tgtctctcagtctggtcaggtctgcctcaccccttttgtccttcctcatcatcctctgcacttgtgcgacctgat

SEQ ID NO: 15693 - DNA, 75 bp, Artificial Sequence
  Synthetic
ttagataagttgtttctagaaggaatggagaacaagttgacagttgatgagtccagaaccaggattatgaagatg

SEQ ID NO: 15694 - DNA, 75 bp, Artificial Sequence
  Synthetic
ggaagtcaagtgcagaaattatggctcttgcatccgcaagaacatctccctttacagcatgggtccagttggata

SEQ ID NO: 15695 - DNA, 75 bp, Artificial Sequence
  Synthetic
tttcaaatttttaggacattgttagaaagtggttatctggagaggaagtatcaaacaacagatcgagaggacatg

SEQ ID NO: 15696 - DNA, 75 bp, Artificial Sequence
  Synthetic
gacctcttctgagggattgagtccaacggaatgagggtacgttctcagaactcatgttcgagatcgttagcaaag

SEQ ID NO: 15697 - DNA, 75 bp, Artificial Sequence
  Synthetic
ttaaaaagattaagggatcatgaattcattgtgtgttctaaaagtgttgagtacacttttgactgtcccaattgc

SEQ ID NO: 15698 - DNA, 75 bp, Artificial Sequence
  Synthetic
gagggtacgttctcagaactcatgttcgagatcgttagcaaagcgttatcctaaatgcctaggatccactgtgcg

SEQ ID NO: 15699 - DNA, 75 bp, Artificial Sequence
  Synthetic
cgcaccggggatcctaggcatttccttgatcacgcctgtgtgactccaaaatggggcaagttgtcacatttctgc

SEQ ID NO: 15700 - DNA, 75 bp, Artificial Sequence
  Synthetic
tctgttcatctctataaagtgttgaatctacttttaaatcaaggctcacgaggtgctcctcatcagtgtctggga

SEQ ID NO: 15701 - DNA, 75 bp, Artificial Sequence
  Synthetic
tgcccgaagcctcatagaatcacatcaaattcactgtgtgcctgtggctactacaagattccaaagaaaccggtt

SEQ ID NO: 15702 - DNA, 75 bp, Artificial Sequence
  Synthetic
gaatatatgaagactttatcgatctgtaataagattaagtcaatgaaaattttaaacaccagaaggaacactctt

SEQ ID NO: 15703 - DNA, 75 bp, Artificial Sequence
  Synthetic
ggattgagtccaacggaatgagggtacgttctcagaactcatgttcgagatcgttagcaaagcgttatcctaaat

SEQ ID NO: 15704 - DNA, 75 bp, Artificial Sequence
  Synthetic
ctaattcttgacactataatgctaaacaagtttttagatctagaaaaagtatttggtcatgtcgttgtagagaga

SEQ ID NO: 15705 - DNA, 75 bp, Artificial Sequence
  Synthetic
gtcatgatcatgcagtctttaatgacagtgaatgataggcttttatcaatcgatgtcttaatggaaatgttggag

SEQ ID NO: 15706 - DNA, 75 bp, Artificial Sequence
  Synthetic
aaaaagatgaccaggaatccgttgtggtttttgaaagttaatgagaaattaagaaaactttgtcctcccgaggtg

SEQ ID NO: 15707 - DNA, 75 bp, Artificial Sequence
  Synthetic
tatcaaagtatagaagagtatgtacatgaggttgacagggatcactggtttgagttgaaactgacactacatcaa

SEQ ID NO: 15708 - DNA, 75 bp, Artificial Sequence
  Synthetic
acgtggcctgcaaaacccctaattgactataagggaaaaatgaggtgtacttgtgttgagaaggactctaacaat

SEQ ID NO: 15709 - DNA, 75 bp, Artificial Sequence
  Synthetic
aagaatcaattgagtgatttgactgaagaaaaatttcaactccttttaaagaaattatcaagtttctgtttgggg

SEQ ID NO: 15710 - DNA, 75 bp, Artificial Sequence
  Synthetic
attactaatagcttgaaaacatctgcagtggcaaaattaagagtaaatcaaccagatgattattatgggaaagtt

SEQ ID NO: 15711 - DNA, 75 bp, Artificial Sequence
  Synthetic
acctgtagtgaagtgttcttccagagtcttgataaagagcattcagcagttctgttgtaccagaaaactggtgag

SEQ ID NO: 15712 - DNA, 75 bp, Artificial Sequence
  Synthetic
aaatcaagggcatacggtcttgcttttaacaatgtggttacaggtcagtatacaacagaagctagtttttactgt

SEQ ID NO: 15713 - DNA, 75 bp, Artificial Sequence
  Synthetic
gatcccaaaaggttctttctgcctatcatgagtgatgttgtgttgtttagaatgtgtaatgaaatgctcagttgg

SEQ ID NO: 15714 - DNA, 75 bp, Artificial Sequence
  Synthetic
ctggattatttaagtgatgatgtcatgttagaagtaaggacatgtctgtatagacttgtattgtcaattttgtgt

SEQ ID NO: 15715 - DNA, 75 bp, Artificial Sequence
  Synthetic
actccttcaaagagagtgcaagtttatattcaggggttaaggtattttattatggcctttgttaatgaattccat

SEQ ID NO: 15716 - DNA, 75 bp, Artificial Sequence
  Synthetic
tgcactgggttgcttgacaagttgaaagtgactgcactcactgaatcagagcgctattgcatgaagttatgtgat

SEQ ID NO: 15717 - DNA, 75 bp, Artificial Sequence
  Synthetic
gaccttgttgtgaaagtattgaatagtgtggaggatgaaaacatggcaaaagccttcaagtttgtgttgaacaca

SEQ ID NO: 15718 - DNA, 75 bp, Artificial Sequence
  Synthetic
tcttacttatgtcatctcataacaaaggaaacccctgataggctgacagatcaaataaaatgcttcgaaaagttt

SEQ ID NO: 15719 - DNA, 75 bp, Artificial Sequence
  Synthetic
ttagaacccaaattggattttgggagcgtcattgttaatccagactcatcctgcgagctaacagcaggacaagaa

SEQ ID NO: 15720 - DNA, 75 bp, Artificial Sequence
  Synthetic
gaacagttttatcagggtttggagaagcttttcacagataagaagttggagtcatcatatgccaacaagccaggt

SEQ ID NO: 15721 - DNA, 75 bp, Artificial Sequence
  Synthetic
gtttgcaaagaggttttgaatgtttgtatgtctctatttaatagtggcgcgcttgaggttaagccattgttgaac

SEQ ID NO: 15722 - DNA, 75 bp, Artificial Sequence
  Synthetic
cacgatcctataactccttcctttacgagcactgcattagatttgtccagtaataaaagtgtggtggtaccaaaa

SEQ ID NO: 15723 - DNA, 75 bp, Artificial Sequence
  Synthetic
cttgatgaattgggtgaggtattgactgagtatgattattctaaactagtttcaagtgttgtggtggatctggtt

SEQ ID NO: 15724 - DNA, 75 bp, Artificial Sequence
  Synthetic
gagcactttaaaaccaaaggaaagtatgttgtatcccccaggtctcttcagtataaaatctacaagagattatcg

SEQ ID NO: 15725 - DNA, 75 bp, Artificial Sequence
  Synthetic
aacttagttcagcagagggcagggaaaggaaataaggagtcagagttaactgaggaagagttcttggaacaggtc

SEQ ID NO: 15726 - DNA, 75 bp, Artificial Sequence
  Synthetic
actgcagaacagttggaggttatcaataaggttgaaacaaaggtgtcaagaacattatcagggattaaattgtca

SEQ ID NO: 15727 - DNA, 75 bp, Artificial Sequence
  Synthetic
tctgatacagaaaatgcaaaacatgatgatgattaccatctgaagaaactgtggtctaaagacattatggtgagg

SEQ ID NO: 15728 - DNA, 75 bp, Artificial Sequence
  Synthetic
attaaggcagagacgagcttacatgaagtcaaagattttaatgttgacacattgccatttgatttatacagagaa

SEQ ID NO: 15729 - DNA, 75 bp, Artificial Sequence
  Synthetic
ttggtggatgcaatttacaatgatccagcagcaaattcccattatttctcggagagaattttcaatccatgtcct

SEQ ID NO: 15730 - DNA, 75 bp, Artificial Sequence
  Synthetic
ttagagttgctcatcaagaatctgacattgaaggcatataaagaagaggatttctttgagtgtttcaaatacatt

SEQ ID NO: 15731 - DNA, 75 bp, Artificial Sequence
  Synthetic
ttgatcagcagtaattttgacaacaaggtaggaaaatatgatcataagaatcgtagtcgtttgggtttgtcaagc

SEQ ID NO: 15732 - DNA, 75 bp, Artificial Sequence
  Synthetic
gcagcattgcttgtcaaagatgaagctagaatcagtatgagagagagtaattcagaatctatagctaagaggcta

SEQ ID NO: 15733 - DNA, 75 bp, Artificial Sequence
  Synthetic
gataagagtttctttaccaactcatcattaaggaacctctgcttttactcagatgaatcaccaacagagaggacc

SEQ ID NO: 15734 - DNA, 75 bp, Artificial Sequence
  Synthetic
agtgtttcaagtaatgttgggaagttgaagtttggcttgtcttacaaagagcaggtaggtgggaatagggaattg

SEQ ID NO: 15735 - DNA, 75 bp, Artificial Sequence
  Synthetic
tatgtaggtgatttgaataccaagcttaccacgagattggtggaggactatgctgaatcactgacatcagatatg

SEQ ID NO: 15736 - DNA, 75 bp, Artificial Sequence
  Synthetic
aagtatacttgccttaataatgaaaatgagtttgagagagcattgttagatatgaaatcagttgtgaggcaaagt

SEQ ID NO: 15737 - DNA, 75 bp, Artificial Sequence
  Synthetic
ggtctagctgtaagcatggaccattccaaatgggggccacatatgtcaccagcgttgttctcactgatgttacgg

SEQ ID NO: 15738 - DNA, 75 bp, Artificial Sequence
  Synthetic
ggtttagatttccggcttaaagatggcacacttatcgataaagaagcagtggtgaacattcttagttggcacatt

SEQ ID NO: 15739 - DNA, 75 bp, Artificial Sequence
  Synthetic
cacaaaatggttgaagtacctttcaatgttgttgaagcatatttaaaggggttcataaaaagggggttgggattg

SEQ ID NO: 15740 - DNA, 75 bp, Artificial Sequence
  Synthetic
atggatagaggtggtgcgactagggttgaggaattcatgtttggttattttgatcaaggaatcgtaccgtcacac

SEQ ID NO: 15741 - DNA, 75 bp, Artificial Sequence
  Synthetic
atttcatcagtcattgacatgggtcaagggattctacacaatttgtcggatttatatgggttgataaccgagcaa

SEQ ID NO: 15742 - DNA, 75 bp, Artificial Sequence
  Synthetic
ttcatagtttatgctttagacttgtgttactcatcttctttcatggcttacacatcaagtgatgatgaaatattg

SEQ ID NO: 15743 - DNA, 75 bp, Artificial Sequence
  Synthetic
ctttccatttctaacagttttaagagaaatgatggttcaatggatatggacttagcaattgaagcacttgagttc

SEQ ID NO: 15744 - DNA, 75 bp, Artificial Sequence
  Synthetic
cactatttcttatctgatagacttaataaatttgtaagtccgaagactgttgcaggaacctttgctagtgaattc

SEQ ID NO: 15745 - DNA, 75 bp, Artificial Sequence
  Synthetic
aagtctagattttttatctggtcacaagaagtacccttacttacgaaatttgttgcagcatcactacataatgtg

SEQ ID NO: 15746 - DNA, 75 bp, Artificial Sequence
  Synthetic
aaagcaaaggctccttcgcagttagccgaaacaatagatactattcttgatcagtctgttgcaaatggtgtctcc

SEQ ID NO: 15747 - DNA, 75 bp, Artificial Sequence
  Synthetic
attgaaattattggggcaattgccccgagaacgaatgcgcttataacatatagtgggcatccatttaatcttttc

SEQ ID NO: 15748 - DNA, 75 bp, Artificial Sequence
  Synthetic
ttatgcttagaggaaacagatgtgagagactgggttgatggatcaagagggtatagattgcaaaggtctatagag

SEQ ID NO: 15749 - DNA, 75 bp, Artificial Sequence
  Synthetic
aatgcatttcctgatgatgttctaccagaaattattcgctctgcctgcagaaaaatcttttataggattcaatca

SEQ ID NO: 15750 - DNA, 75 bp, Artificial Sequence
  Synthetic
ggaactttagaagaggactatattgtgacaacattgcaacaatcgccagatgattgcttaaaacagatgctaaca

SEQ ID NO: 15751 - DNA, 75 bp, Artificial Sequence
  Synthetic
tcatgtgatgtggagaaagaggcaatagatgatatatgcaactatagatggttgaatctaagagctcatggggat

SEQ ID NO: 15752 - DNA, 75 bp, Artificial Sequence
  Synthetic
cttagactcgttcttaggaccaaaattatgacatcaactagaacattacaaaaggaggaagtcccaagcctgatt

SEQ ID NO: 15753 - DNA, 75 bp, Artificial Sequence
  Synthetic
aaatcagtgcagtccaaactttcaaagaactttgttcggggggcaaagaagatcttagctgacgcaataaacaag

SEQ ID NO: 15754 - DNA, 75 bp, Artificial Sequence
  Synthetic
tcagctttccaaagttgtatctcttctggctttgttggggtctgcaaaagtatgggatcaaaatgtgttagggat

SEQ ID NO: 15755 - DNA, 75 bp, Artificial Sequence
  Synthetic
ggtaaaggaggattcaagtacatcaaagacattttaaaagaaattaaacaccatgagaagcctgactgtcatttt

SEQ ID NO: 15756 - DNA, 75 bp, Artificial Sequence
  Synthetic
tgcaaagagctgaagggtatttattgtagtgagcttcttgaaaacatatcagaattttctagacctcttttctgg

SEQ ID NO: 15757 - DNA, 75 bp, Artificial Sequence
  Synthetic
gattatttttcattggtcctttcgaatgcttgtgagttgggtaactgggtcttttgtaagatagaaataccaaaa

SEQ ID NO: 15758 - DNA, 75 bp, Artificial Sequence
  Synthetic
agtgtgtaccacttgaataatcctaaccatttttggccaatcaagccatccagtcatgctgaattagaagagaag

SEQ ID NO: 15759 - DNA, 75 bp, Artificial Sequence
  Synthetic
gtgggaatgaatcatgttctgtattcaattagaagaaatttcccagtgttatttgatgagcatataagcccttat

SEQ ID NO: 15760 - DNA, 75 bp, Artificial Sequence
  Synthetic
ttgtcagacttgaatatgttaaagttgaattgggtgcaaaagattagatttctagacatttgtgtagcaattgac

SEQ ID NO: 15761 - DNA, 75 bp, Artificial Sequence
  Synthetic
atgacctcagagtgtttgggtattatatcacacatcattagaaggaaaagagaagagttgtatattgtgaaacag

SEQ ID NO: 15762 - DNA, 75 bp, Artificial Sequence
  Synthetic
agtgaattgtcaatgtctcataccagagtttctcttccactagagagaggattcaacatagaacctgatgaagtc

SEQ ID NO: 15763 - DNA, 75 bp, Artificial Sequence
  Synthetic
tgtcacaattttcttttacaaatattgtttgagtcaatgatacacccagtgcttttgacgactagtcaatttaag

SEQ ID NO: 15764 - DNA, 75 bp, Artificial Sequence
  Synthetic
aggtacttttggtacagtgaggttgaacttttgcctaaggaggcattgcacgatttaggacagtttactcagttc

SEQ ID NO: 15765 - DNA, 75 bp, Artificial Sequence
  Synthetic
ataattgattgtaaagtgttaaatagctcaagggcaatgtgtctggatgatctagatgtaggttatgttagtagt

SEQ ID NO: 15766 - DNA, 75 bp, Artificial Sequence
  Synthetic
aaagtcaagagaacagacacctacttgaatttatcaactttcatgacaaatcttgactgggaaaatagacatgag

SEQ ID NO: 15767 - DNA, 75 bp, Artificial Sequence
  Synthetic
tactcttcatttgaagacttgatcctgagttccccatctgaagtcttcttatttgagatcaccttcactttttca

SEQ ID NO: 15768 - DNA, 75 bp, Artificial Sequence
  Synthetic
catattagaaggagccacaagtttagatatgacagatcaacaaattacattttgaaaaccaaattggttattgag

SEQ ID NO: 15769 - DNA, 75 bp, Artificial Sequence
  Synthetic
aagtctgaattagttaatggggaggatggtgtctattgcgtgacaccgcactctatagagtattatgtctcccag

SEQ ID NO: 15770 - DNA, 75 bp, Artificial Sequence
  Synthetic
tcatctggtaatcacatcagtctagatggtgtgtctttattggtgttggaccctctaatctcaggtagagaattg

SEQ ID NO: 15771 - DNA, 75 bp, Artificial Sequence
  Synthetic
gtgaacatggatgaacttttacaaaaccaggatgtgacattttctgctccatcacaaattttaagcaagattaaa

SEQ ID NO: 15772 - DNA, 75 bp, Artificial Sequence
  Synthetic
ttggatttcaagcctttcaccaaggaaataaagaataagttctcctataagttgataggacctgatgtagatatg

SEQ ID NO: 15773 - DNA, 75 bp, Artificial Sequence
  Synthetic
tcaccattgcaccttgataaaggggcaattaaagaaggtgacaggattgtttcacaaattgagattcaggtgtca

SEQ ID NO: 15774 - DNA, 75 bp, Artificial Sequence
  Synthetic
tttaagtctgttatcacagcaatagagcttttagatgaagatcaacgtaagatctttgtgggcaatttatttgtg

SEQ ID NO: 15775 - DNA, 75 bp, Artificial Sequence
  Synthetic
tatttaacttctctcaagtcagttaacagagcactatccatgtcagaatcagacttgaggctattggtggaaaac

SEQ ID NO: 15776 - DNA, 75 bp, Artificial Sequence
  Synthetic
tatccaagtgtaattgagtatatgttaagtggttgcgatggatggcttaattgtggctcattctcactgatcaaa

SEQ ID NO: 15777 - DNA, 75 bp, Artificial Sequence
  Synthetic
agtaaaacactacagtgtatcatgttggctgatgagagaggtccctataggatcaaaggacaaaactgcagaaga

SEQ ID NO: 15778 - DNA, 75 bp, Artificial Sequence
  Synthetic
ttgtttccaacggaggaggcaatagagatcgaataaaccgcctggcccccgggggccgggggggcccccggcgcg

SEQ ID NO: 15779 - DNA, 75 bp, Artificial Sequence
  Synthetic
cccccggagggggcgcgcctgggggcctaccggcctagggttcgtagggtggtgctgatgggctgtcttcgaaga

SEQ ID NO: 15780 - DNA, 75 bp, Artificial Sequence
  Synthetic
tgatcttttttggcaagggttttgagcagatctcgcagaagtcggttctgctcagcattcttgtcaggcacccaa

SEQ ID NO: 15781 - DNA, 75 bp, Artificial Sequence
  Synthetic
gacaaaggtaatggtcgccacaggcaatcaagcctttattcacaaaccagcaagatttgcaattgaacctgccat

SEQ ID NO: 15782 - DNA, 75 bp, Artificial Sequence
  Synthetic
agagaccttgaggaagattaagtgtcatgggcactctcccctctatgtccttgtcaccatgacgatctctcactt

SEQ ID NO: 15783 - DNA, 75 bp, Artificial Sequence
  Synthetic
ccttgctatatcttagtcccattttagaagaatccacacacaatgcgtgaacaataaaagcctaagatcctcggt

SEQ ID NO: 15784 - DNA, 75 bp, Artificial Sequence
  Synthetic
tgctatatcttagtcccattttagaagaatccacacacaatgcgtgaacaataaaagcctaagatcctcggtgcg

SEQ ID NO: 15785 - DNA, 75 bp, Artificial Sequence
  Synthetic
tttaggataacgctttgctaacgatctcgaacatgagttctgagaatgtaccctcattccgctggactcaatccc

SEQ ID NO: 15786 - DNA, 75 bp, Artificial Sequence
  Synthetic
ttagaaggggtctgtccaactggacccatgctgtgaagggagacgttcttgcggatgcgagggccatagtctctg

SEQ ID NO: 15787 - DNA, 75 bp, Artificial Sequence
  Synthetic
cgcttgacttccaccaagttgcacaagtgcaaagaatgatgaggaaggataaaaggagcgaggcggatctgacca

SEQ ID NO: 15788 - DNA, 75 bp, Artificial Sequence
  Synthetic
gattgagagacatgaataaagaggttgacgctcttatgatgatgaggtctgcacaaaaagacaatatcttgaaag

SEQ ID NO: 15789 - DNA, 75 bp, Artificial Sequence
  Synthetic
tgggtggattgtcaaaagatgagttgatggagctggcttctgacctagacaaactgaggaagaaggtccagagga

SEQ ID NO: 15790 - DNA, 75 bp, Artificial Sequence
  Synthetic
cagaagggggtggtcaaccaggtgtatatgcagggaacctaacttcatctcagctgaatcagagatcagaaatcc

SEQ ID NO: 15791 - DNA, 75 bp, Artificial Sequence
  Synthetic
tgaagatgatggggatgggtacaggtccaagaggcccagttggaggtgttgtgaaggtttgggacatcaaggaca

SEQ ID NO: 15792 - DNA, 75 bp, Artificial Sequence
  Synthetic
gcagcctccttgtcaatcaatttggctctatgccagcactaaccatcgcctgcatgacacagcaaggaggagaac

SEQ ID NO: 15793 - DNA, 75 bp, Artificial Sequence
  Synthetic
agatgaatgatgtggttcaagccctaacatctctgggacttgtgtacacagtgaagtatccgaacttgtctgact

SEQ ID NO: 15794 - DNA, 75 bp, Artificial Sequence
  Synthetic
tagagaaattgaccgagaaacatccctgtctgaagctcatcacacaagagcctgctcagatcaacatttcggggt

SEQ ID NO: 15795 - DNA, 75 bp, Artificial Sequence
  Synthetic
acaatctaagcttgtctgctgcagtcaaggcggatgcttgtatgattgatggtggcaacatgttggaaactttac

SEQ ID NO: 15796 - DNA, 75 bp, Artificial Sequence
  Synthetic
aggttaaaccctcaatgtttagcacccttatcaagacaattcttgaagtgaaaaacagagaaggcatgtttgtga

SEQ ID NO: 15797 - DNA, 75 bp, Artificial Sequence
  Synthetic
gtccatcccctgggcagagaaatccctacgaaaacatattatacaaggtttgtctgtcaggagatggttggccgt

SEQ ID NO: 15798 - DNA, 75 bp, Artificial Sequence
  Synthetic
acattggctcaagatcacaaatcaaaggaagagcatgggagaacaccactgttgatcttgagggcaaaccatcag

SEQ ID NO: 15799 - DNA, 75 bp, Artificial Sequence
  Synthetic
tgaaccaccctccagtgaggaatggtggttcaccagatctaaaacaaatacccaagacaaaggaagatgaggtga

SEQ ID NO: 15800 - DNA, 75 bp, Artificial Sequence
  Synthetic
taagagccattgaacagcttgacccgagaggaacaacctgggtggatattgagggtccaccaggtgatcctgttg

SEQ ID NO: 15801 - DNA, 75 bp, Artificial Sequence
  Synthetic
aacttgctctatttcaaccagaaactggcaattacttgcattgctacagaagaccacacaatgaaaacgcattca

SEQ ID NO: 15802 - DNA, 75 bp, Artificial Sequence
  Synthetic
aggaccagagcaagttctctcatggcttgttgctcaaagatctggctgatacacagccaggactcatctcgtgca

SEQ ID NO: 15803 - DNA, 75 bp, Artificial Sequence
  Synthetic
taataagacaccttccaaacaacatggtgttgactgcacaaggtaatgatgacataatcaaactacttgagatgc

SEQ ID NO: 15804 - DNA, 75 bp, Artificial Sequence
  Synthetic
atggaagaagagacattaaggtgttggatgtgaagttgtcatcagatcaagctcgtctaatggaggatgtggtat

SEQ ID NO: 15805 - DNA, 75 bp, Artificial Sequence
  Synthetic
gggaacgttacaacatgctctgcgtgaaacacactgggctcgtcattaagaagaagaagaagggtgcagctccag

SEQ ID NO: 15806 - DNA, 75 bp, Artificial Sequence
  Synthetic
gatcagccaatccccattgcgcattgttggactgtataatgtttgatgccactgtcacaggctatcttcgagacc

SEQ ID NO: 15807 - DNA, 75 bp, Artificial Sequence
  Synthetic
aaaaaccgaaaagacttcttccacttgacactctatacagagacaatgctaatctaattaacctttaaaaccttc

SEQ ID NO: 15808 - DNA, 75 bp, Artificial Sequence
  Synthetic
taattgaaggcctcgatgtcacaccccctagggggtgtgacatcgaggcgctgggagagcgaattacttgccttt

SEQ ID NO: 15809 - DNA, 75 bp, Artificial Sequence
  Synthetic
tctgacccatctagtcggtctttttggaattttatagtaaccgcaggcacacaatgagtttgatgtaatcctatg

SEQ ID NO: 15810 - DNA, 75 bp, Artificial Sequence
  Synthetic
gggttttgggcacccttcgccgactaagtgtcgatgtgttgggatgccaacaagctgcaagaacactgtgctggt

SEQ ID NO: 15811 - DNA, 75 bp, Artificial Sequence
  Synthetic
gaagaaaaccaaggaccagaagcagatgtcagttaaggcaatgggtgtctttccctgcctatcctcatattcttt

SEQ ID NO: 15812 - DNA, 75 bp, Artificial Sequence
  Synthetic
cagcagcatctcattgtacaaattttgactttcccacaaccactcatttttaaagtgtgtctcatttaagtaaga

SEQ ID NO: 15813 - DNA, 75 bp, Artificial Sequence
  Synthetic
gccattgcgcataagccaacattgaggcaaactatgtttgcctgtgatggtgtcattcacataccagaacttagt

SEQ ID NO: 15814 - DNA, 75 bp, Artificial Sequence
  Synthetic
gtaattacagtaaggaatcttggctagctgcttcaaactattcctaatcaccaaactatctgatatcaaaccatt

SEQ ID NO: 15815 - DNA, 75 bp, Artificial Sequence
  Synthetic
aatgctcctcttcagaagatttacactgttctcaacattcagctgaagggttttaatggcgttttggttgaagtc

SEQ ID NO: 15816 - DNA, 75 bp, Artificial Sequence
  Synthetic
aaacagtctcattgtgtcacaaaactcaacattgtggtccttgttgcactttgccatcacagcattatcaaaaca

SEQ ID NO: 15817 - DNA, 75 bp, Artificial Sequence
  Synthetic
ttttattcctgcccatactattgcccattgttctaaacaatatccacctgggacatgtgctccgcttgagtccga

SEQ ID NO: 15818 - DNA, 75 bp, Artificial Sequence
  Synthetic
gatgtcccatgtgaagaatccaagtagttgtctcgacacagaactataagctactttgttcaaagccatccgaat

SEQ ID NO: 15819 - DNA, 75 bp, Artificial Sequence
  Synthetic
tgttgacattggtgagtaagagcaatgattctcccaggttgtattctgaatgatgaggtaattatagtgtgtgaa

SEQ ID NO: 15820 - DNA, 75 bp, Artificial Sequence
  Synthetic
tccctcacagttggtataattgcatttgccatccattgtgcaatggctgtcacactttcccacccaagctgcttt

SEQ ID NO: 15821 - DNA, 75 bp, Artificial Sequence
  Synthetic
gttgtcaccaatgatctgagcaagagaagcaatgagatgtctgccgacttcacctccatgatctccaatagtgag

SEQ ID NO: 15822 - DNA, 75 bp, Artificial Sequence
  Synthetic
gttgtattgtatgagcagcccagcaccctctgacactctgcatctcgctccaacatgtctggtgacatggagcac

SEQ ID NO: 15823 - DNA, 75 bp, Artificial Sequence
  Synthetic
attgaagtgaagctcattaagcagccacttgagtgtgtgccctgcttcacctgtcttgtcacagttggtgatgtt

SEQ ID NO: 15824 - DNA, 75 bp, Artificial Sequence
  Synthetic
cccgaatgccaaacttctgatcctgctcatattagcataactgtcaagagaagtgtttgtaagagtcagttcaat

SEQ ID NO: 15825 - DNA, 75 bp, Artificial Sequence
  Synthetic
tccccaggtggttccttttgggcctttataatagtggtgtgtgttgtttttgctgcaagattgagggaggttgtc

SEQ ID NO: 15826 - DNA, 75 bp, Artificial Sequence
  Synthetic
aaacattctagttaggtttagttcgacgtgtgagagctcatgtcttctgtcaatcatcagaccatcacattttct

SEQ ID NO: 15827 - DNA, 75 bp, Artificial Sequence
  Synthetic
acctgcaaggcaaaggaaaattgcgagttgcacaaccccacacttccaaaagttgaccaatcctttcagaataca

SEQ ID NO: 15828 - DNA, 75 bp, Artificial Sequence
  Synthetic
gataatagaaatggcaatcaaggcaatgttaattgcctcattgatcacctcgggtagagactgtagaaatgtgac

SEQ ID NO: 15829 - DNA, 75 bp, Artificial Sequence
  Synthetic
atcacctcgggtagagactgtagaaatgtgacaacttgtcccattttggagtcacacaggcgtgatcaaggaaat

SEQ ID NO: 15830 - DNA, 75 bp, Artificial Sequence
  Synthetic
cgcacagtggatcctaggcatttccttgatcacgcctgtgtgactccaaaatggggcaagttgtcacatttctgc

SEQ ID NO: 15831 - DNA, 75 bp, Artificial Sequence
  Synthetic
ttgatcacgcctgtgtgactccaaaatggggcaagttgtcacatttctgcaatctcttcccgaggtaatcaatga

SEQ ID NO: 15832 - DNA, 75 bp, Artificial Sequence
  Synthetic
ggcaataaatattgccctgattgccatatctatcatctgcattttaaaagggttgattaatttttggaggtgtgg

SEQ ID NO: 15833 - DNA, 75 bp, Artificial Sequence
  Synthetic
agttgtacaacttgcaattttcctttgccttgcaggcaggaattgtgatagcctaatgatcgataggagacatga

SEQ ID NO: 15834 - DNA, 75 bp, Artificial Sequence
  Synthetic
actttcacatgttgaactaaatttgaccagaatgtttgacaatcttcctcaatcttgcagtaaaaataacacaca

SEQ ID NO: 15835 - DNA, 75 bp, Artificial Sequence
  Synthetic
ccactactacaaaggccccaaggggaccaactggggaattgagctgaccctcacaaacacctctttagacagcta

SEQ ID NO: 15836 - DNA, 75 bp, Artificial Sequence
  Synthetic
tgccaacatgagcaagatcaggagcttagcgtttggaaacatcaccaactgtgacaagacaggtgaagctgggca

SEQ ID NO: 15837 - DNA, 75 bp, Artificial Sequence
  Synthetic
cacactgaaatggttgctcaatgaactccacttcaatgttcttcatgtcaccagacacgttggagcaagatgcag

SEQ ID NO: 15838 - DNA, 75 bp, Artificial Sequence
  Synthetic
agtgtcaggcggtgctggattgcttatacaatacaacctcactattggagatcatggaggtgaagttggcagaca

SEQ ID NO: 15839 - DNA, 75 bp, Artificial Sequence
  Synthetic
tctcattgcttccctcgctcagattattggtgacaacaaagcagcctgggtaggaaagtgcgacagccgttgttc

SEQ ID NO: 15840 - DNA, 75 bp, Artificial Sequence
  Synthetic
gatggacggcaagtgcaactacaccaactgtgagggttttacacattacaactaccttatcattcagaacacaac

SEQ ID NO: 15841 - DNA, 75 bp, Artificial Sequence
  Synthetic
atgggaaaaccattgctcttattcaccaatgtcaacaattcggatggttctaaacaaagtgggctacagttctgt

SEQ ID NO: 15842 - DNA, 75 bp, Artificial Sequence
  Synthetic
gtcgagacagttgctcggatttttcacatgggacatctcggactcaagtggggcacatgttccaggtggatactg

SEQ ID NO: 15843 - DNA, 75 bp, Artificial Sequence
  Synthetic
tttagagcagtgggcaatagtttgggcagggattaagtgttttgataatgctgtgatggcaaaatgcaacaagga

SEQ ID NO: 15844 - DNA, 75 bp, Artificial Sequence
  Synthetic
tcataatgttgagttctgtgacacaatgaggctgtttgattttaatcaaaatgccattaaaactctccaattaaa

SEQ ID NO: 15845 - DNA, 75 bp, Artificial Sequence
  Synthetic
tgttgagaatagtgtgaatcttctgaagagaagcatcaatggtctaatctcagatagcctggtcattaggaatag

SEQ ID NO: 15846 - DNA, 75 bp, Artificial Sequence
  Synthetic
tctcaagcaactagccaagattccttactgcaattataccaaattctggtatgtaaatgacactatcacaggcag

SEQ ID NO: 15847 - DNA, 75 bp, Artificial Sequence
  Synthetic
acatagtttacctcagtgttggcttgtacgtaatggctcctacttaaatgagacacactttaagaatgaatggtt

SEQ ID NO: 15848 - DNA, 75 bp, Artificial Sequence
  Synthetic
gtgggaaagccaaaatctgtacaatgagatgttgctaaaagaatatgaagacaggcaaggcaaaacaccgattgc

SEQ ID NO: 15849 - DNA, 75 bp, Artificial Sequence
  Synthetic
tctaactgacatttgcttttggtccttggttttcttcactagcacagtgtttctgcagctcattggaatcccaac

SEQ ID NO: 15850 - DNA, 75 bp, Artificial Sequence
  Synthetic
ccatcgacacctaattggcgaaggatgcccgaagcctcatagaatcacatcaaattcactgtgtgcctgtggcta

SEQ ID NO: 15851 - DNA, 75 bp, Artificial Sequence
  Synthetic
tgcccgaagcctcatagaatcacatcaaattcactgtgtgcctgtggctactacaagattccaaagaaaccagtt

SEQ ID NO: 15852 - DNA, 75 bp, Artificial Sequence
  Synthetic
agatgggttagaaaaggtaagtaagtcgcttttccagcgcctcgatgtcacaccccctagggggtgtgacatcga

SEQ ID NO: 15853 - DNA, 75 bp, Artificial Sequence
  Synthetic
ggccttcagttagaaggtcttaaaggttgattaagttggcattgtctctgtacaaggtatcaagtgggagaagcc

SEQ ID NO: 15854 - DNA, 75 bp, Artificial Sequence
  Synthetic
tctttggcttttgatcccgaagatagcctgtgacagttgcatcaaacattatgcaatccaataatgcacaatgag

SEQ ID NO: 15855 - DNA, 75 bp, Artificial Sequence
  Synthetic
ggttggctgatcctggggcagcacccttcttcttcttctttatcacaagtccagtgtgtttcacacaaagcatgt

SEQ ID NO: 15856 - DNA, 75 bp, Artificial Sequence
  Synthetic
tgtaacgttcccacacaacgtcttccatgagacgggcttggtctgatgataactttacatctagcactttgatgt

SEQ ID NO: 15857 - DNA, 75 bp, Artificial Sequence
  Synthetic
ctcttctcccatgcatttcaagcaatttgattatatcatcgttaccctgcgcagtcagcaccatgttgtttggga

SEQ ID NO: 15858 - DNA, 75 bp, Artificial Sequence
  Synthetic
ggtgtcttatgatacatgaaataagtcctggttgtgtgtcagctagatccttgagcaacaatccgtgagagaatt

SEQ ID NO: 15859 - DNA, 75 bp, Artificial Sequence
  Synthetic
tactttgatctctaaatgcattctcattgtgtggtcttctgtagcaatgtaaatagttgccagtttctggctgaa

SEQ ID NO: 15860 - DNA, 75 bp, Artificial Sequence
  Synthetic
acaaagcaagttcgacaggatcacccggtgggccttcaatgtccacccaagttgttcctctcggatctagttgct

SEQ ID NO: 15861 - DNA, 75 bp, Artificial Sequence
  Synthetic
caatagcccttattacttcatcttccttagccttaggtatctgtttcaagtctggtgaaccaccattcctcactg

SEQ ID NO: 15862 - DNA, 75 bp, Artificial Sequence
  Synthetic
gggggtgatctgctgatggcctcccttccaggtctacagtggtgttctcccatgctcttcctttgatttgtgacc

SEQ ID NO: 15863 - DNA, 75 bp, Artificial Sequence
  Synthetic
ttgaacctatgtatggccaaccatctcctgaaagacaaaccttgtataatatgttttcatatgggtttctttgtc

SEQ ID NO: 15864 - DNA, 75 bp, Artificial Sequence
  Synthetic
ccggagaagcactcacaaacatcccttctctgttcttcacttcaagaattgttttgataagggtgctgaacattg

SEQ ID NO: 15865 - DNA, 75 bp, Artificial Sequence
  Synthetic
cgcaccgtggatcctaggcgtaactttcacgcttattgctctgttacagttccgacatgggcaattgtaatgtca

SEQ ID NO: 15866 - DNA, 75 bp, Artificial Sequence
  Synthetic
tcaacttgtgtggcatcattagttgagagatttaaaacaaaaggcaaattcaatctggacccgaatgagattgag

SEQ ID NO: 15867 - DNA, 75 bp, Artificial Sequence
  Synthetic
agcaagaaacccaaccccagtcaacaagacccaaaacaacttcaactgagacagaacttctcagaactcctccag

SEQ ID NO: 15868 - DNA, 75 bp, Artificial Sequence
  Synthetic
tttttaatcatggataatctgacaaatttgctggctattaagggttctgctgtgaaagagagagaagagttgtct

SEQ ID NO: 15869 - DNA, 75 bp, Artificial Sequence
  Synthetic
tcagcctccacggtagatacaactgcaaatgttgttggtttgctgataaaaaccttgtggtgtgctcagatcact

SEQ ID NO: 15870 - DNA, 75 bp, Artificial Sequence
  Synthetic
atgttatatgagcagctatccgacgatgccataaaggcttttgaagagttaagacaagatgtagaatttactctt

SEQ ID NO: 15871 - DNA, 75 bp, Artificial Sequence
  Synthetic
atctctgtctgagatgcttgaacttgatgttcagaacctctgatctgtgcaacatctgctggaaacctctaccca

SEQ ID NO: 15872 - DNA, 75 bp, Artificial Sequence
  Synthetic
gggagaatgagaactccagaaaaaaagaagaagacaacaaacttttatggcaattgtacattggagtccctttgg

SEQ ID NO: 15873 - DNA, 75 bp, Artificial Sequence
  Synthetic
ctcgcatagcgactccagtcgagcccagcgcaccaccggaatgaggcagcagacaaaccacaccggcaaaaaccc

SEQ ID NO: 15874 - DNA, 75 bp, Artificial Sequence
  Synthetic
gctccctttaatgtcatgaaggcgattagaactgagactagcattcatgaaatcagagactttgatcccaatatt

SEQ ID NO: 15875 - DNA, 75 bp, Artificial Sequence
  Synthetic
cgggggccccgcaaggggcccccaccggggaaccccggggggcgttgatcctgtctggtctactctatctccatc

SEQ ID NO: 15876 - DNA, 75 bp, Artificial Sequence
  Synthetic
ttgccacctgaaatttatgaagaattatgcacatctgtttttgaatcgtcactaaaggaatctttctttctaaat

SEQ ID NO: 15877 - DNA, 75 bp, Artificial Sequence
  Synthetic
actgtgccgacttgacgcagaggtctacaaacaactcctcttaacctcatattgccagaactgtccgacacaacc

SEQ ID NO: 15878 - DNA, 75 bp, Artificial Sequence
  Synthetic
gaggttcttgatatttgcccactcgaacttttattgaagaacttgacaacaagatgtttcgaagaacaggagttt

SEQ ID NO: 15879 - DNA, 75 bp, Artificial Sequence
  Synthetic
agatcacctaaggtcttgctgaaacacacactaaaatctaaaaattctaaccagtcattatatgcttcaaaagac

SEQ ID NO: 15880 - DNA, 75 bp, Artificial Sequence
  Synthetic
ttcgattgctttaagtatttattaattcatgctgggtttgatcagagattaggtacatatgagcacaagagtaag

SEQ ID NO: 15881 - DNA, 75 bp, Artificial Sequence
  Synthetic
ataagaagtgaacgtctatgtgtctcatatataaaaagaaattcttcttgagatattttcaccctttgttttgtg

SEQ ID NO: 15882 - DNA, 75 bp, Artificial Sequence
  Synthetic
tctaggttagggttatctgaagatgtgtttaagctgagagatgatgttagaatgagtcaaagggagagtaactct

SEQ ID NO: 15883 - DNA, 75 bp, Artificial Sequence
  Synthetic
gcctttatgtagggccacaatcccatcaaaaaacttccaatctctccatctgtctccagggcacccaatgccttc

SEQ ID NO: 15884 - DNA, 75 bp, Artificial Sequence
  Synthetic
gaagccatcgcaaggaggcttgataaaagcttcttcaccagtgcagctttaaggaatctatgcttctattcagaa

SEQ ID NO: 15885 - DNA, 75 bp, Artificial Sequence
  Synthetic
aaaatgacgtttcctgtcagctcagtcaacaggtgtgacagttttttatcccctacaacaagacatcctccactc

SEQ ID NO: 15886 - DNA, 75 bp, Artificial Sequence
  Synthetic
gaatcccctacagaatacacttgtattagtccgaacactggcaatttgaagtttggtttaagttataaggaacaa

SEQ ID NO: 15887 - DNA, 75 bp, Artificial Sequence
  Synthetic
ataaccaatggcacatcagaaaattcgggacccacgatttcatatgcatacttgtcttcaacttctgattgataa

SEQ ID NO: 15888 - DNA, 75 bp, Artificial Sequence
  Synthetic
gttggttctaatagggagctttatgtaggtgaccttaatacaaaaatgatgacaagacttgtagaggattttgct

SEQ ID NO: 15889 - DNA, 75 bp, Artificial Sequence
  Synthetic
tcactgagatccaaaaacacttcttcaggaaacattcttgtttcaggtatgggcaactcagcatccctaaataag

SEQ ID NO: 15890 - DNA, 75 bp, Artificial Sequence
  Synthetic
gaagctgttgctaagtccatgaactacacctgtttaaactctgagaaagaattcgagaaggccatctgtgacatg

SEQ ID NO: 15891 - DNA, 75 bp, Artificial Sequence
  Synthetic
tccagaatgtttatcccccttttcccacatagggttggatgatgagagacaagcgttaccccatcaagaaaccga

SEQ ID NO: 15892 - DNA, 75 bp, Artificial Sequence
  Synthetic
aagatggctgttaatgctggggacatttgctgctcactagatcactcaaagtgggggcccttcatgagcccagcc

SEQ ID NO: 15893 - DNA, 75 bp, Artificial Sequence
  Synthetic
tgctctttcacatcaccagaggccctcagcgtcaagttttcaactttcaaaacacctctggaatcattaactaac

SEQ ID NO: 15894 - DNA, 75 bp, Artificial Sequence
  Synthetic
ctctttctttctttcattaatgaattaaaattgaaggatcatgaaacaagtgctctgattgattgcagaccagtt

SEQ ID NO: 15895 - DNA, 75 bp, Artificial Sequence
  Synthetic
attacgcagaccattgtgtaggaatacacaacaagcctagtcagacgatattttgttgaaagccttttgtgttcc

SEQ ID NO: 15896 - DNA, 75 bp, Artificial Sequence
  Synthetic
ctaagtgttttgaggtggcatttgcacaaagctgttgaggtgccattcaatgtggcagaggcgtattgcaccggg

SEQ ID NO: 15897 - DNA, 75 bp, Artificial Sequence
  Synthetic
agctgcaaattcaatgtaaattttatttcgttgttgtttgagttttcagatagtggaaaagaagtttgttcctcg

SEQ ID NO: 15898 - DNA, 75 bp, Artificial Sequence
  Synthetic
atgctgaagaggagattaggtttgatgagcctacaatctcaatcagtgtctgaggaatttttccatcaacagtta

SEQ ID NO: 15899 - DNA, 75 bp, Artificial Sequence
  Synthetic
acaccagaccattcaaaatctaacaaacggaattttggctcaccaatttctgagacaacaaaccccattgttaga

SEQ ID NO: 15900 - DNA, 75 bp, Artificial Sequence
  Synthetic
ttaatggggaaggaagtgccaagtcatattatgtctgtgttagacatggggcagggaatacttcacaacctctct

SEQ ID NO: 15901 - DNA, 75 bp, Artificial Sequence
  Synthetic
tcatctaacatcatcgctctatccacattgtacttcttaatcaataaaacaaagtctgtcaactcaccaacatct

SEQ ID NO: 15902 - DNA, 75 bp, Artificial Sequence
  Synthetic
gatctttatggactgatcacagaacagtttttgaattattgtttagatttgctttttgatgtggtgcccatttct

SEQ ID NO: 15903 - DNA, 75 bp, Artificial Sequence
  Synthetic
atttggttctcatcttccaacctaagaacctccccaaaccaaaaaaaggatcttaatgttgaagttgtcatcaca

SEQ ID NO: 15904 - DNA, 75 bp, Artificial Sequence
  Synthetic
tacacatcaagtgatgatcaaataacaatgataaaattcccaactacaaatgcacctgaggggggggagagtcaa

SEQ ID NO: 15905 - DNA, 75 bp, Artificial Sequence
  Synthetic
agtgggttgataaaagtagaaaaggtcaactgaattttaaaatttgaacagatctgttgaggactcaaacctaca

SEQ ID NO: 15906 - DNA, 75 bp, Artificial Sequence
  Synthetic
tctgattggttagaagttctttgttttcatgacttcttgtcctccaagctaaacaaatttgtaagtcccaagagt

SEQ ID NO: 15907 - DNA, 75 bp, Artificial Sequence
  Synthetic
tcatagtcaacatattcaacttgccttacatgcgcagatgcacactcattttgtttcactatgtacaatgaattg

SEQ ID NO: 15908 - DNA, 75 bp, Artificial Sequence
  Synthetic
gtttgtgggagttttgctgcagagtttaagtcaaggttttttgttatgggtgaagaaacccccttactcacaaaa

SEQ ID NO: 15909 - DNA, 75 bp, Artificial Sequence
  Synthetic
tctctccctttcaataaatgagaaattataccaagattctcgttcatcatatcaagagctatgcaaacatctagg

SEQ ID NO: 15910 - DNA, 75 bp, Artificial Sequence
  Synthetic
tttgtctcagcagcactccacaatgttaagtgcaaaacacctactcagcttgccgagacaattgatacaatttgt

SEQ ID NO: 15911 - DNA, 75 bp, Artificial Sequence
  Synthetic
tattttaattttgtgaaatcagtagttcgactcacctgcaaatcactcatgaacggtaccaaatgctcctcaaat

SEQ ID NO: 15912 - DNA, 75 bp, Artificial Sequence
  Synthetic
gatcagtgtgttgctaatggtgtaggggtcaccattgttggtgagatatcaaagagggttaataggttaataaaa

SEQ ID NO: 15913 - DNA, 75 bp, Artificial Sequence
  Synthetic
attttagggtaatttctctttacagattgtagaacatggtttaatcctaactgatcttcaaccagacgcacacct

SEQ ID NO: 15914 - DNA, 75 bp, Artificial Sequence
  Synthetic
tactctggttatccacagactccctttttagctgtggaagtccaggatgtgaaagattgggtggatggttcaaga

SEQ ID NO: 15915 - DNA, 75 bp, Artificial Sequence
  Synthetic
cttggcttcactgcccaaaaaagattgggattgcttaatagagttggtttaggtggtatttgaacacaagaaaag

SEQ ID NO: 15916 - DNA, 75 bp, Artificial Sequence
  Synthetic
ggttatagattgcaacgaaatgtggagaactgtctatctgatcatcctcagttagagcttataaggaaaagtgcc

SEQ ID NO: 15917 - DNA, 75 bp, Artificial Sequence
  Synthetic
acccactcaccaagttcacaagcattcgtcaaaaccaaagaaaaataatcccaaagtattggtcttgagaacatt

SEQ ID NO: 15918 - DNA, 75 bp, Artificial Sequence
  Synthetic
aaaaaggttttaacaaagatcaaaagggggctcatatttgaagagcatttagttcagctgataggaaaaggtggt

SEQ ID NO: 15919 - DNA, 75 bp, Artificial Sequence
  Synthetic
gagacattctctagtgcttcatcacagaaaacaatgcctggagccaaagaacatatgtcacatgaacaaattttc

SEQ ID NO: 15920 - DNA, 75 bp, Artificial Sequence
  Synthetic
gacaatgcaatggaagctttcctctcttacatagactgttcggaaatagaaaaaagggaggctttgcgttatcgt

SEQ ID NO: 15921 - DNA, 75 bp, Artificial Sequence
  Synthetic
accttactgatcacatctttgatgtataaaaacccaccactcccatctctgacacacttgctccccatactctta

SEQ ID NO: 15922 - DNA, 75 bp, Artificial Sequence
  Synthetic
tggttgaatctgtcttccaatggagatctaagacttgtcttaagaaccaagttaatgtcagcaagaagggtactg

SEQ ID NO: 15923 - DNA, 75 bp, Artificial Sequence
  Synthetic
caaaagcctatgaacccagaagctacagacgattgaaaggctgacttgtttatagattcagctaatatctttttt

SEQ ID NO: 15924 - DNA, 75 bp, Artificial Sequence
  Synthetic
gaaaaagaacaaataccaactttaattaagacattacaatcaaagctttcaaagaatttctcaagaggtgcaaaa

SEQ ID NO: 15925 - DNA, 75 bp, Artificial Sequence
  Synthetic
gcacctcttgagaaattctttgaaagctttgattgtaatgtcttaattaaagttggtatttgttctttttccagt

SEQ ID NO: 15926 - DNA, 75 bp, Artificial Sequence
  Synthetic
aagatattagctgaatctataaacaagtcagcctttcaatcgtctgtagcttctgggttcataggcttttgtaag

SEQ ID NO: 15927 - DNA, 75 bp, Artificial Sequence
  Synthetic
acccttcttgctgacattagcttggttcttaagacaagtcttagatctccattggaagacagattcaaccaacga

SEQ ID NO: 15928 - DNA, 75 bp, Artificial Sequence
  Synthetic
agtatggggagcaagtgtgtcagagatgggagtggtgggtttttatacatcaaagatgtgatcagtaaggtgaaa

SEQ ID NO: 15929 - DNA, 75 bp, Artificial Sequence
  Synthetic
taacgcaaagcctcccttttttctatttccgaacagtctatgtaagagaggaaagcttccattgcattgtcacca

SEQ ID NO: 15930 - DNA, 75 bp, Artificial Sequence
  Synthetic
atttgttcatgtgacatatgttctttggctccaggcattgttttctgtgatgaagcactagagaatgtctcaatg

SEQ ID NO: 15931 - DNA, 75 bp, Artificial Sequence
  Synthetic
ccttttcctatcagctgaactaaatgctcttcaaatatgagcccccttttgatctttgttaaaacctttttggca

SEQ ID NO: 15932 - DNA, 75 bp, Artificial Sequence
  Synthetic
ttctcaagaccaatactttgggattatttttctttggttttgacgaatgcttgtgaacttggtgagtgggtcttt

SEQ ID NO: 15933 - DNA, 75 bp, Artificial Sequence
  Synthetic
cttttccttataagctctaactgaggatgatcagatagacagttctccacatttcgttgcaatctataacctctt

SEQ ID NO: 15934 - DNA, 75 bp, Artificial Sequence
  Synthetic
tcttgtgttcaaataccacctaaaccaactctattaagcaatcccaatcttttttgggcagtgaagccaagaggt

SEQ ID NO: 15935 - DNA, 75 bp, Artificial Sequence
  Synthetic
gaaccatccacccaatctttcacatcctggacttccacagctaaaaagggagtctgtggataaccagagtatttt

SEQ ID NO: 15936 - DNA, 75 bp, Artificial Sequence
  Synthetic
gtgcgtctggttgaagatcagttaggattaaaccatgttctacaatctgtaaagagaaattaccctaaaatattt

SEQ ID NO: 15937 - DNA, 75 bp, Artificial Sequence
  Synthetic
attaacctattaaccctctttgatatctcaccaacaatggtgacccctacaccattagcaacacactgatcacaa

SEQ ID NO: 15938 - DNA, 75 bp, Artificial Sequence
  Synthetic
gaggagcatttggtaccgttcatgagtgatttgcaggtgagtcgaactactgatttcacaaaattaaaataccta

SEQ ID NO: 15939 - DNA, 75 bp, Artificial Sequence
  Synthetic
attgtatcaattgtctcggcaagctgagtaggtgttttgcacttaacattgtggagtgctgctgagacaaatttt

SEQ ID NO: 15940 - DNA, 75 bp, Artificial Sequence
  Synthetic
gatgtttgcatagctcttgatatgatgaacgagaatcttggtataatttctcatttattgaaagggagagacaat

SEQ ID NO: 15941 - DNA, 75 bp, Artificial Sequence
  Synthetic
gtgagtaagggggtttcttcacccataacaaaaaaccttgacttaaactctgcagcaaaactcccacaaacactc

SEQ ID NO: 15942 - DNA, 75 bp, Artificial Sequence
  Synthetic
tcattgtacatagtgaaacaaaatgagtgtgcatctgcgcatgtaaggcaagttgaatatgttgactatgatgta

SEQ ID NO: 15943 - DNA, 75 bp, Artificial Sequence
  Synthetic
ttgggacttacaaatttgtttagcttggaggacaagaagtcatgaaaacaaagaacttctaaccaatcagattga

SEQ ID NO: 15944 - DNA, 75 bp, Artificial Sequence
  Synthetic
ggtttgagtcctcaacagatctgttcaaattttaaaattcagttgaccttttcttcttttatcaacccacttgtg

SEQ ID NO: 15945 - DNA, 75 bp, Artificial Sequence
  Synthetic
ctctcccccccctcaggtgcatttgtagttgggaattttatcattgttatttgatcatcacttgatgtgtaagaa

SEQ ID NO: 15946 - DNA, 75 bp, Artificial Sequence
  Synthetic
atgacaacttcaacattaagatcctttttttggtttggggaggttcttaggttggaagatgagaaccaaatagat

SEQ ID NO: 15947 - DNA, 75 bp, Artificial Sequence
  Synthetic
atgggcaccacatcaaaaagcaaatctaaacaataattcaaaaactgttctgtgatcagtccataaagatcagag

SEQ ID NO: 15948 - DNA, 75 bp, Artificial Sequence
  Synthetic
gttggtgagttgacagactttgttttattgattaagaagtacaatgtggatagagcgatgatgttagatgatcta

SEQ ID NO: 15949 - DNA, 75 bp, Artificial Sequence
  Synthetic
aggttgtgaagtattccctgccccatgtctaacacagacataatatgacttggcacttccttccccattaataac

SEQ ID NO: 15950 - DNA, 75 bp, Artificial Sequence
  Synthetic
acaatggggtttgttgtctcagaaattggtgagccaaaattccgtttgttagattttgaatggtctggtgtcgag

SEQ ID NO: 15951 - DNA, 75 bp, Artificial Sequence
  Synthetic
tgttgatggaaaaattcctcagacactgattgagattgtaggctcatcaaacctaatctcctcttcagcatcccg

SEQ ID NO: 15952 - DNA, 75 bp, Artificial Sequence
  Synthetic
gaacaaacttcttttccactatctgaaaactcaaacaacaacgaaataaaatttacattgaatttgcagctggaa

SEQ ID NO: 15953 - DNA, 75 bp, Artificial Sequence
  Synthetic
gtgcaatacgcctctgccacattgaatggcacctcaacagctttgtgcaaatgccacctcaaaacacttagaact

SEQ ID NO: 15954 - DNA, 75 bp, Artificial Sequence
  Synthetic
cacaaaaggctttcaacaaaatatcgtctgactaggcttgttgtgtattcctacacaatggtctgcgtaatgtta

SEQ ID NO: 15955 - DNA, 75 bp, Artificial Sequence
  Synthetic
ggtctgcaatcaatcagagcacttgtttcatgatccttcaattttaattcattaatgaaagaaagaaagagggct

SEQ ID NO: 15956 - DNA, 75 bp, Artificial Sequence
  Synthetic
gttaatgattccagaggtgttttgaaagttgaaaacttgacgctgagggcctctggtgatgtgaaagagcatcgg

SEQ ID NO: 15957 - DNA, 75 bp, Artificial Sequence
  Synthetic
gggctcatgaagggcccccactttgagtgatctagtgagcagcaaatgtccccagcattaacagccatcttcatg

SEQ ID NO: 15958 - DNA, 75 bp, Artificial Sequence
  Synthetic
tttcttgatggggtaacgcttgtctctcatcatccaaccctatgtgggaaaagggggataaacattctggactta

SEQ ID NO: 15959 - DNA, 75 bp, Artificial Sequence
  Synthetic
tcacagatggccttctcgaattctttctcagagtttaaacaggtgtagttcatggacttagcaacagcttcagca

SEQ ID NO: 15960 - DNA, 75 bp, Artificial Sequence
  Synthetic
tttagggatgctgagttgcccatacctgaaacaagaatgtttcctgaagaagtgtttttggatctcagtgattat

SEQ ID NO: 15961 - DNA, 75 bp, Artificial Sequence
  Synthetic
aaatcctctacaagtcttgtcatcatttttgtattaaggtcacctacataaagctccctattagaaccaacttgt

SEQ ID NO: 15962 - DNA, 75 bp, Artificial Sequence
  Synthetic
caatcagaagttgaagacaagtatgcatatgaaatcgtgggtcccgaattttctgatgtgccattggttatgagt

SEQ ID NO: 15963 - DNA, 75 bp, Artificial Sequence
  Synthetic
tccttataacttaaaccaaacttcaaattgccagtgttcggactaatacaagtgtattctgtaggggattcttct

SEQ ID NO: 15964 - DNA, 75 bp, Artificial Sequence
  Synthetic
ggaggatgtcttgttgtaggggataaaaaactgtcacacctgttgactgagctgacaggaaacgtcattttgaag

SEQ ID NO: 15965 - DNA, 75 bp, Artificial Sequence
  Synthetic
gaatagaagcatagattccttaaagctgcactggtgaagaagcttttatcaagcctccttgcgatggcttcagag

SEQ ID NO: 15966 - DNA, 75 bp, Artificial Sequence
  Synthetic
gcattgggtgccctggagacagatggagagattggaagttttttgatgggattgtggccctacataaaggccaca

SEQ ID NO: 15967 - DNA, 75 bp, Artificial Sequence
  Synthetic
ttactctccctttgactcattctaacatcatctctcagcttaaacacatcttcagataaccctaacctagactta

SEQ ID NO: 15968 - DNA, 75 bp, Artificial Sequence
  Synthetic
aaacaaagggtgaaaatatctcaagaagaatttctttttatatatgagacacatagacgttcacttcttatgtct

SEQ ID NO: 15969 - DNA, 75 bp, Artificial Sequence
  Synthetic
ctcttgtgctcatatgtacctaatctctgatcaaacccagcttgaattaataaatacttaaagcaatcgaaaaac

SEQ ID NO: 15970 - DNA, 75 bp, Artificial Sequence
  Synthetic
tttgaagcatataatgactggttagaatttttagattttagtgtgtgtttcagcaagaccttaggtgatctggtt

SEQ ID NO: 15971 - DNA, 75 bp, Artificial Sequence
  Synthetic
tcctgttcttcgaaacatcttgttgtcaagttcttcaataaaagttcgagtgggcaaatatcaagaacctcattt

SEQ ID NO: 15972 - DNA, 75 bp, Artificial Sequence
  Synthetic
gtgtcggacagttctggcaatatgaggttaagaggagttgtttgtagacctctgcgtcaagtcggcacagtgatg

SEQ ID NO: 15973 - DNA, 75 bp, Artificial Sequence
  Synthetic
agaaagaaagattcctttagtgacgattcaaaaacagatgtgcataattcttcataaatttcaggtggcaaaata

SEQ ID NO: 15974 - DNA, 75 bp, Artificial Sequence
  Synthetic
gagatagagtagaccagacaggatcaacgccccccggggttccccggtgggggccccttgcggggcccccggggt

SEQ ID NO: 15975 - DNA, 75 bp, Artificial Sequence
  Synthetic
ttgggatcaaagtctctgatttcatgaatgctagtctcagttctaatcgccttcatgacattaaagggagcccaa

SEQ ID NO: 15976 - DNA, 75 bp, Artificial Sequence
  Synthetic
ttttgccggtgtggtttgtctgctgcctcattccggtggtgcgctgggctcgactggaatcgctatgcgagtggg

SEQ ID NO: 15977 - DNA, 75 bp, Artificial Sequence
  Synthetic
agggactccaatgtacaattgccataaaagtttgttgtcttcttctttttttctggagttctcattctcccaaga

SEQ ID NO: 15978 - DNA, 75 bp, Artificial Sequence
  Synthetic
tagaggtttccagcagatgttgcacagatcagaggttctgagcatcaagttcaagcatctcagacagagatagtg

SEQ ID NO: 15979 - DNA, 75 bp, Artificial Sequence
  Synthetic
gtaaattctacatcttgtcttaactcttcaaaagcctttatggcatcgtcggatagctgctcatataacatagac

SEQ ID NO: 15980 - DNA, 75 bp, Artificial Sequence
  Synthetic
atctgagcacaccacaaggtttttatcagcaaaccaacaacatttgcagttgtatctaccgtggaggctgactgg

SEQ ID NO: 15981 - DNA, 75 bp, Artificial Sequence
  Synthetic
aactcttctctctctttcacagcagaacccttaatagccagcaaatttgtcagattatccatgattaaaaactca

SEQ ID NO: 15982 - DNA, 75 bp, Artificial Sequence
  Synthetic
aggagttctgagaagttctgtctcagttgaagttgttttgggtcttgttgactggggttgggtttcttgcttgac

SEQ ID NO: 15983 - DNA, 75 bp, Artificial Sequence
  Synthetic
atctcattcgggtccagattgaatttgccttttgttttaaatctctcaactaatgatgccacacaagttgaaacc

SEQ ID NO: 15984 - DNA, 75 bp, Artificial Sequence
  Synthetic
tgacattacaattgcccatgtcggaactgtaacagagcaataagcgtgaaagttacgcctaggatccccggtgcg

SEQ ID NO: 15985 - DNA, 75 bp, Artificial Sequence
  Synthetic
agcttttgcttgtcataaacagaaacaatgtttccaagctcatctagctttggtatcacaacacttttattactg

SEQ ID NO: 15986 - DNA, 75 bp, Artificial Sequence
  Synthetic
tgggtcacggtcttgagggcgaccccaagctgcactgtcagccaaagagatctaccaatgccgaattcaccctcc

SEQ ID NO: 15987 - DNA, 75 bp, Artificial Sequence
  Synthetic
gacaagtctaatgctgtgcttgtaaaacttggtctaaatggattcaccttcaaactaccgttaacttttagctta

SEQ ID NO: 15988 - DNA, 75 bp, Artificial Sequence
  Synthetic
ctcatcagggaatgacatgccaggtgggtactgtcttgaggaatggatgcttattgcagcaaaactcaaatgctt

SEQ ID NO: 15989 - DNA, 75 bp, Artificial Sequence
  Synthetic
cctttgttaaacagtgtcaaacaataactcagcaagtctctagaaacccctggctgtttcatatcttctatattg

SEQ ID NO: 15990 - DNA, 75 bp, Artificial Sequence
  Synthetic
ccaataacattagtcgacatgtgtttttggagtgctattttcttcacaacaagtctcttcttacacttggttgga

SEQ ID NO: 15991 - DNA, 75 bp, Artificial Sequence
  Synthetic
aagatgtccttagaaaagaatttgctaacgccacccaccatggcatcttcttgttccttcgtcaatgtgccattg

SEQ ID NO: 15992 - DNA, 75 bp, Artificial Sequence
  Synthetic
gtagtaagggcttcaggctgagttcaggtaagtgaccatcaagtacagactgaaacattatgcagtctagaaggg

SEQ ID NO: 15993 - DNA, 75 bp, Artificial Sequence
  Synthetic
agagagggattcacaacaaagaaaccgaattctaatttgggttccaaaaacttttcgaaacattttatctgatca

SEQ ID NO: 15994 - DNA, 75 bp, Artificial Sequence
  Synthetic
tccatccatatggtgttggatggatctaacttttgcattgcctctctcacaactgcttcctgcagctcagaaaga

SEQ ID NO: 15995 - DNA, 75 bp, Artificial Sequence
  Synthetic
gttaacctatcaggagtttcctttgtcactagatgacaaaggtagcttacattgagtaggaatttaaactttctt

SEQ ID NO: 15996 - DNA, 75 bp, Artificial Sequence
  Synthetic
tctcttgtaataatctgaaggcagtcatgctcaactgtaagtttctctaaatcatccagattagggtacttccct

SEQ ID NO: 15997 - DNA, 75 bp, Artificial Sequence
  Synthetic
gacataaacgcatcaggatccgaaccaaaatctaaaaccattcggaacatcctcacgcttagcctctgtattaat

SEQ ID NO: 15998 - DNA, 75 bp, Artificial Sequence
  Synthetic
gtcagaccttttgtccagttgagattgggacaaatttcccatatataatcttggaccaccactgggtctctctcc

SEQ ID NO: 15999 - DNA, 75 bp, Artificial Sequence
  Synthetic
acatctgatgcagatttacattctactactagtttagacatcaattgaacatggtgagcttggtttacaaaggcc

SEQ ID NO: 16000 - DNA, 75 bp, Artificial Sequence
  Synthetic
ataatgaagtaccttagtccttgtaggaaagtttgattccttttagaaggggagcaaagaatgctaagcaccagt

SEQ ID NO: 16001 - DNA, 75 bp, Artificial Sequence
  Synthetic
agtcttaaaagagggtccacttctctagctaattcctcacaaaaatctagccagctcaccatttctgcacacatt

SEQ ID NO: 16002 - DNA, 75 bp, Artificial Sequence
  Synthetic
aacaagagtactgtatcagaaaagatggggaggaagaatcgctttgggtcacagtaaaaggaaccaacctcttcg

SEQ ID NO: 16003 - DNA, 75 bp, Artificial Sequence
  Synthetic
agttgccctttatctgacaagtacaatgagtagcaccttgatctttcacctgttttttgataaaacaaaagtccg

SEQ ID NO: 16004 - DNA, 75 bp, Artificial Sequence
  Synthetic
tacaactcattggttaaaaagaacttttgaacataacattctttcaatctaacagtgccgaaataatttttgtgg

SEQ ID NO: 16005 - DNA, 75 bp, Artificial Sequence
  Synthetic
tccacctcattcactaacaatctggatgaaaatgaggttttcatggaattggttaatgacaaagacacatgagaa

SEQ ID NO: 16006 - DNA, 75 bp, Artificial Sequence
  Synthetic
agacatttaaaaagacaaatctgctgttgctctgataaggtttcaaattccttgtgtgagcacccatctcctgag

SEQ ID NO: 16007 - DNA, 75 bp, Artificial Sequence
  Synthetic
tgaatttgcaccttgtacctcatgaccggcctctcagtacataattcttcagctagtgaggtaaggctatcaaac

SEQ ID NO: 16008 - DNA, 75 bp, Artificial Sequence
  Synthetic
ttaggttctgtgatatattttgaaacataatcccaaaggtctggttccgccctttttaaaattgagttacatttc

SEQ ID NO: 16009 - DNA, 75 bp, Artificial Sequence
  Synthetic
ttcacccagtgggcactaatttccaatttcttctttaaaagcttcctggcagataagatatccaacactctgtca

SEQ ID NO: 16010 - DNA, 75 bp, Artificial Sequence
  Synthetic
tttgaaaacagcaacatttgtccgatgatgagtcctgattccttcaagaaacacaactcagtaggattattttcg

SEQ ID NO: 16011 - DNA, 75 bp, Artificial Sequence
  Synthetic
aaaacatcaataacaaaattgagcataattaaatctaagaacaacagagtgtttcttctagtattaaagactttt

SEQ ID NO: 16012 - DNA, 75 bp, Artificial Sequence
  Synthetic
tttccttttattttattgcacactgatagaaccaaaagatattccttttcaatctgtgattttgcaatgaactca

SEQ ID NO: 16013 - DNA, 75 bp, Artificial Sequence
  Synthetic
tcaggaattccttcagataaagaatgaccacgctttaatttttgcatcaatttgtaacaaatatcaagtatttta

SEQ ID NO: 16014 - DNA, 75 bp, Artificial Sequence
  Synthetic
caacagcaaaaaggacattttgaagtcccagagttagcatgtaaacccagattttccaagctttgcaatagcttt

SEQ ID NO: 16015 - DNA, 75 bp, Artificial Sequence
  Synthetic
gccttgtcagttttgacaaaattacccatccccttaacaaaaacctcctttctataccaattcttcatttttatt

SEQ ID NO: 16016 - DNA, 75 bp, Artificial Sequence
  Synthetic
aaaccttctctgattttagattctcgaagatcattattgaaacctgtcaataaactctcatccagtctactttca

SEQ ID NO: 16017 - DNA, 75 bp, Artificial Sequence
  Synthetic
taattgagacaatgtctcttgagacactcaatattttcaaatcctaaactctgattcccagttttggacaaactg

SEQ ID NO: 16018 - DNA, 75 bp, Artificial Sequence
  Synthetic
tgaaccaacctctggtattcctgttcctcgatgtcaatctttgaatcaccccttgattccctcaacaagtcaata

SEQ ID NO: 16019 - DNA, 75 bp, Artificial Sequence
  Synthetic
agcaaccacctaaatctttctgttgcccaatctggcatcagattggtgttgtaattgcatcttccatccacaatt

SEQ ID NO: 16020 - DNA, 75 bp, Artificial Sequence
  Synthetic
ggcactaaagtgatccctgctttctgaacatcttcttttaatgttaacaattttgacatatcacgcttccatttc

SEQ ID NO: 16021 - DNA, 75 bp, Artificial Sequence
  Synthetic
ttttcaaactcttcagggttaactctaacaaaggtttcaagaagaatcaatgttttattaaaaaatctaaagcca

SEQ ID NO: 16022 - DNA, 75 bp, Artificial Sequence
  Synthetic
tcaggaattaccttaggcaaagttggagtaactactccgttgtcagataggattacatcaacaaacttctgactt

SEQ ID NO: 16023 - DNA, 75 bp, Artificial Sequence
  Synthetic
gagttgtgctcacaggaattcttcttacaggactctatctcaactaaacaggaaagtaacttaaagccttccatt

SEQ ID NO: 16024 - DNA, 75 bp, Artificial Sequence
  Synthetic
aaaatcatgcccatctccacctgagataacaaaagttctctttgataggaaagttcaggtatttcaggaacctgc

SEQ ID NO: 16025 - DNA, 75 bp, Artificial Sequence
  Synthetic
ctgctttctcacaaagtctttcaaagaattgatcttttcatccatagtcaaaattcgcctaggatcctcggtgcg

SEQ ID NO: 16026 - DNA, 75 bp, Artificial Sequence
  Synthetic
cgcacagtggatcctaggcgcaattgttcacgcaattttgcatatctattaacaattgatcatgggtcaacttgt

SEQ ID NO: 16027 - DNA, 75 bp, Artificial Sequence
  Synthetic
tagtttctttcaggacatacaactctttttccaagaggctctcaatgtggctctagctgttgtcaccgtcctggc

SEQ ID NO: 16028 - DNA, 75 bp, Artificial Sequence
  Synthetic
tatcattaaggggcttgtgaacctttggaaatcaggtctcttccagttcctctttttcttaatcctggcaggaag

SEQ ID NO: 16029 - DNA, 75 bp, Artificial Sequence
  Synthetic
gtcttgctccttcagaattggtcatcatacaacttttgaatctgtcacaatgtcagttgggggagtctttcacga

SEQ ID NO: 16030 - DNA, 75 bp, Artificial Sequence
  Synthetic
acttcctgctttgtgcaggatcaataacagccacagtctaattcaactgtctcacaacagtagtttagctttgtc

SEQ ID NO: 16031 - DNA, 75 bp, Artificial Sequence
  Synthetic
tgtcgaatatgtggatttgtgtgtcgttctagagtcagaccagtatttagtggctggggattactccaactgtac

SEQ ID NO: 16032 - DNA, 75 bp, Artificial Sequence
  Synthetic
tggggaagcgacaggatacaactgggttattgactggacgctaaagggtctgggtcacggtcttgagggcgaccc

SEQ ID NO: 16033 - DNA, 75 bp, Artificial Sequence
  Synthetic
gttattgactggacgctaaagggtctgggtcacggtcttgagggcgaccccaagctgcactgtcagccaaagaga

SEQ ID NO: 16034 - DNA, 75 bp, Artificial Sequence
  Synthetic
tgggtcacggtcttgagggcgaccccaagctgcactgtcagccaaagagatctaccaatgctgaattcaccctcc

SEQ ID NO: 16035 - DNA, 75 bp, Artificial Sequence
  Synthetic
aacttaatatatctcggaggcatacaaatgaccactacagggaaagaattgaaacaggaataaggcacatgtttg

SEQ ID NO: 16036 - DNA, 75 bp, Artificial Sequence
  Synthetic
gtccgttcaagattttgactaaagaagggaaggattgtgtaatcttaaggaacacaacttggaaagaacagtgtg

SEQ ID NO: 16037 - DNA, 75 bp, Artificial Sequence
  Synthetic
tcaaaagtcattacaacacactagcatttctattaaaaaacacagccaactctctcccaaagagaaggcccttgg

SEQ ID NO: 16038 - DNA, 75 bp, Artificial Sequence
  Synthetic
ccttttttagttggtcactttctgactcatcagggaatgacatgccaggtgggtactgtcttgaggaatggatgc

SEQ ID NO: 16039 - DNA, 75 bp, Artificial Sequence
  Synthetic
ctcatcagggaatgacatgccaggtgggtactgtcttgaggaatggatgctcattgcagcaaaactcaaatgctt

SEQ ID NO: 16040 - DNA, 75 bp, Artificial Sequence
  Synthetic
tggaaacacagctcttgctaagtgcaacttaaatcatgattctgaattttgtgacatgttgaaactgtacgaatt

SEQ ID NO: 16041 - DNA, 75 bp, Artificial Sequence
  Synthetic
caacaagaatgcaatttccaaactaaacaaccagacaagagaagctgtgaatgcattgacccactcaataaacag

SEQ ID NO: 16042 - DNA, 75 bp, Artificial Sequence
  Synthetic
cctaatttctgatgaccttttgatgaaaaacaaattaagagaatttcttaaggtcccatactgcaactacacaaa

SEQ ID NO: 16043 - DNA, 75 bp, Artificial Sequence
  Synthetic
gttttggtatgtaaatcacacaaaatctggtgaacattctctgccaaaatgttggttggtgaacaatgggagctt

SEQ ID NO: 16044 - DNA, 75 bp, Artificial Sequence
  Synthetic
tttaaatgaaagtgaatttaggaacgaatggatcttggagagtgatcacttgattgcagagatacttagtaagga

SEQ ID NO: 16045 - DNA, 75 bp, Artificial Sequence
  Synthetic
tgattgcagagatacttagtaaggaataccaagacaggcagggaaaaaccccaataacattagtcgacatgtgtt

SEQ ID NO: 16046 - DNA, 75 bp, Artificial Sequence
  Synthetic
ccaataacattagtcgacatgtgtttttggagtgctattttcttcgacaacaagtctctcttacacttggttgga

SEQ ID NO: 16047 - DNA, 75 bp, Artificial Sequence
  Synthetic
tttccaactcacagacatattgtaggagaagcatgtccattgccccataagatcaacagacatggagcttgtgcc

SEQ ID NO: 16048 - DNA, 75 bp, Artificial Sequence
  Synthetic
tgtgggctataccaaaaattaaagaagaagactgcttggagaaaaaggcaccaatagagaggctcagcctccctc

SEQ ID NO: 16049 - DNA, 75 bp, Artificial Sequence
  Synthetic
ctccatcggcccgggacatcccgggccgatggaggggccccccagtccgcggcctgggccgcggactggggaggc

SEQ ID NO: 16050 - DNA, 75 bp, Artificial Sequence
  Synthetic
atttgcctacatcacaaatgcattccttgcctgatacaccagactacctggtagtaagggcttcaggctgagttc

SEQ ID NO: 16051 - DNA, 75 bp, Artificial Sequence
  Synthetic
cttgcctgatacaccagactacctggtagtaagggcttcaggctgagttcaggtaagtgaccatcaagtacagac

SEQ ID NO: 16052 - DNA, 75 bp, Artificial Sequence
  Synthetic
gtagtaagggcttcaggctgagttcaggtaagtgaccatcaagtacagactgaaacatgatgcagtcgagcaggg

SEQ ID NO: 16053 - DNA, 75 bp, Artificial Sequence
  Synthetic
cacagtggggctctttttgaggaccattgtccttgtgcttctttttaggaactatcacaccattgtgtgccttgc

SEQ ID NO: 16054 - DNA, 75 bp, Artificial Sequence
  Synthetic
agagctcgccatatctctcccaaacttcctgttcaaaaattcgtgattgttctccagtgagtcttacatccacca

SEQ ID NO: 16055 - DNA, 75 bp, Artificial Sequence
  Synthetic
attttagatcttttcgcccatgtatgtcaaaaagtctttttatatcatcggcaccttgaactgtaatgacagtgt

SEQ ID NO: 16056 - DNA, 75 bp, Artificial Sequence
  Synthetic
tttgaggtagaagcccgatgatgtaacttagaagtccaggttgggcatcctcaagatcttttaaaagtattccgt

SEQ ID NO: 16057 - DNA, 75 bp, Artificial Sequence
  Synthetic
gggagtgtctactgccatttttgaaacctttttcatcatgtggttttctgtaacaatgtatatagtatccagttg

SEQ ID NO: 16058 - DNA, 75 bp, Artificial Sequence
  Synthetic
aaggttgaagaacagcaagttccacggggtccgtggggggcccctctatatccatccatatggtgttggatggat

SEQ ID NO: 16059 - DNA, 75 bp, Artificial Sequence
  Synthetic
ggggtccgtggggggcccctctatatccatccatatggtgttggatggatctaacttttgcattgcctctctcac

SEQ ID NO: 16060 - DNA, 75 bp, Artificial Sequence
  Synthetic
tccatccatatggtgttggatggatctaacttttgcattgcctctctcacaattgcttcctgcagctcagaaaga

SEQ ID NO: 16061 - DNA, 75 bp, Artificial Sequence
  Synthetic
ttggaaagtctcatgttttgaccattcctttcaggaccccttggtcctactgttggtttggtgtttaagtcaaca

SEQ ID NO: 16062 - DNA, 75 bp, Artificial Sequence
  Synthetic
cttgtgttgtcccatgatctccccacaatttgagaccttgaaccgatgtacggccaaccttctccagagagacac

SEQ ID NO: 16063 - DNA, 75 bp, Artificial Sequence
  Synthetic
aacttgtagagaaggttctcataggggttcctattcccaggtttctcatccacgaacatgccttctctctttttc

SEQ ID NO: 16064 - DNA, 75 bp, Artificial Sequence
  Synthetic
actttcagtgtggccatgataatggatgaaaagttgtccggtgtcactttgatggtttctaacatgttaccccca

SEQ ID NO: 16065 - DNA, 75 bp, Artificial Sequence
  Synthetic
tctataagggaagcaccagcttttgttgctgctgaaagactgaagttgtaaccagagatgtttaaagcactctca

SEQ ID NO: 16066 - DNA, 75 bp, Artificial Sequence
  Synthetic
accagagatgtttaaagcactctcatctcttgtaataatctgaaggcagtcatgctcaactgtaagtttctctaa

SEQ ID NO: 16067 - DNA, 75 bp, Artificial Sequence
  Synthetic
tctcttgtaataatctgaaggcagtcatgctcaactgtaagtttctctaaatcatccagattagggtacttcact

SEQ ID NO: 16068 - DNA, 75 bp, Artificial Sequence
  Synthetic
gtgtaaagaagacctaaagatgtcaaggcttgcaccacattgttcatagtctcccctccttgaacagtcatacat

SEQ ID NO: 16069 - DNA, 75 bp, Artificial Sequence
  Synthetic
gcaatggtcaatgcaggcattgacccaaactgattgtttaatttagacggatcagaaacatcccagagtctcaca

SEQ ID NO: 16070 - DNA, 75 bp, Artificial Sequence
  Synthetic
attccttgattaggtcctctttgctgttgaaatcctagtgaccttagaatgtcagaccttttgtccagttgagat

SEQ ID NO: 16071 - DNA, 75 bp, Artificial Sequence
  Synthetic
gttgaaatcctagtgaccttagaatgtcagaccttttgtccagttgagattgggacaaatttcccatatataatc

SEQ ID NO: 16072 - DNA, 75 bp, Artificial Sequence
  Synthetic
gtcagaccttttgtccagttgagattgggacaaatttcccatatataatcttggaccaccattgggtctctctcc

SEQ ID NO: 16073 - DNA, 75 bp, Artificial Sequence
  Synthetic
aatttttcttttaagcttttccaaatcactggccaaatccatgagttcgtctttccccagatcgccaactttcag

SEQ ID NO: 16074 - DNA, 75 bp, Artificial Sequence
  Synthetic
tactgtatttctttgagcacttttcatgctcattagcttatcaacttctttgttcaaatctctcagtttgtcgag

SEQ ID NO: 16075 - DNA, 75 bp, Artificial Sequence
  Synthetic
atcggcatcggttctcttcgttttgcgaagaagcctctggacttgggagacttgagtgaagtctaagctgtctgc

SEQ ID NO: 16076 - DNA, 75 bp, Artificial Sequence
  Synthetic
tattaacttggcgtccttcaggacacttcccttggtgggctctgtgaagctgcccagttcccgtctcagggcctg

SEQ ID NO: 16077 - DNA, 75 bp, Artificial Sequence
  Synthetic
agtccagcggaagctgggaatctctttggagtttgccatgaaaagttttttgcacaagagttagacaaaattgcc

SEQ ID NO: 16078 - DNA, 75 bp, Artificial Sequence
  Synthetic
ggaatctctttggagtttgccatgaaaagttttttgcacaagagttagacaaaattgcctaggatccactgtgcg

SEQ ID NO: 16079 - DNA, 75 bp, Artificial Sequence
  Synthetic
cgcaccgaggatcctaggcgaaatttgactatggatgaaaagatcaattctttgaaagactttgtgagaaagcag

SEQ ID NO: 16080 - DNA, 75 bp, Artificial Sequence
  Synthetic
gttcctgaaatacctgaactttcctatcaaagagaacttttgttatctcaggtggagatgggcatgattttaatg

SEQ ID NO: 16081 - DNA, 75 bp, Artificial Sequence
  Synthetic
gaaggctttaagttactttcctgtttagttgagatagagtcctgtaagaagaattcctgtgagcacaactcaagt

SEQ ID NO: 16082 - DNA, 75 bp, Artificial Sequence
  Synthetic
cagaagtttgttgatgtaatcctatctgacaacggagtggttactccaactttgcctaaggtaattcctgatggc

SEQ ID NO: 16083 - DNA, 75 bp, Artificial Sequence
  Synthetic
tttagattttttaataaaacattgattcttcttgaaacctttgttagagttaaccctgaagagtttgaaaagaaa

SEQ ID NO: 16084 - DNA, 75 bp, Artificial Sequence
  Synthetic
tggaagcgtgatatgtcaaaattgttaacattaaaagaagatgttcagaaagcagggatcactttagtgccaatt

SEQ ID NO: 16085 - DNA, 75 bp, Artificial Sequence
  Synthetic
gtggatggaagatgcaattacaacaccaatctgatgccagattgggcaacagaaagatttaggtggttgcttatt

SEQ ID NO: 16086 - DNA, 75 bp, Artificial Sequence
  Synthetic
gacttgttgagggaatcaaggggtgattcaaagattgacatcgaggaacaggaataccagaggttggttcacagt

SEQ ID NO: 16087 - DNA, 75 bp, Artificial Sequence
  Synthetic
ttgtccaaaactgggaatcagagtttaggatttgaaaatattgagtgtctcaagagacattgtctcaattatgaa

SEQ ID NO: 16088 - DNA, 75 bp, Artificial Sequence
  Synthetic
agtagactggatgagagtttattgacaggtttcaataatgatcttcgagaatctaaaatcagagaaggtttaata

SEQ ID NO: 16089 - DNA, 75 bp, Artificial Sequence
  Synthetic
aaaatgaagaattggtatagaaaggaggtttttgttaaggggatgggtaattttgtcaaaactgacaaggcaaag

SEQ ID NO: 16090 - DNA, 75 bp, Artificial Sequence
  Synthetic
ctattgcaaagcttggaaagtctgggtttgcatgctaattctgggacttcagaatgtcctttttgctgttgtaaa

SEQ ID NO: 16091 - DNA, 75 bp, Artificial Sequence
  Synthetic
atacttgatatttgttacaaattgatgcaaaaattaaagcatggtcattctttatctgaaggaattcctgatgag

SEQ ID NO: 16092 - DNA, 75 bp, Artificial Sequence
  Synthetic
ttcattgcaaaatcacagattgaaaaggaatatcttttggttctatcagtgtgcaataaaataaaaggaaaaaaa

SEQ ID NO: 16093 - DNA, 75 bp, Artificial Sequence
  Synthetic
gtctttaatactagaagaaacactctgttgttcttagatttaattatgctcaattttgttattgatgttttcgaa

SEQ ID NO: 16094 - DNA, 75 bp, Artificial Sequence
  Synthetic
aataatcctactgagttgtgtttcttgaaggaatcaggactcatcatcggacaaatgttgctgttttcaaatgac

SEQ ID NO: 16095 - DNA, 75 bp, Artificial Sequence
  Synthetic
agagtgttggatatcttatctgccaggaagcttttaaagaagaaattggaaattagtgcccactgggtgaagaaa

SEQ ID NO: 16096 - DNA, 75 bp, Artificial Sequence
  Synthetic
tgtaactcaattttaaaaagggcggaaccagacctttgggattatgtttcaaaatatatcacagaacctaagttt

SEQ ID NO: 16097 - DNA, 75 bp, Artificial Sequence
  Synthetic
gatagccttacctcactagctgaagaattatgtactgagaggccggtcatgaggtacaaggtgcaaattcactca

SEQ ID NO: 16098 - DNA, 75 bp, Artificial Sequence
  Synthetic
ggagatgggtgctcacacaaggaatttgaaaccttatcagagcaacagcagatttgtctttttaaatgtctttct

SEQ ID NO: 16099 - DNA, 75 bp, Artificial Sequence
  Synthetic
catgtgtctttgtcattaaccaattccatgaaaacctcattttcatccagattgttagtgaatgaggtggaccac

SEQ ID NO: 16100 - DNA, 75 bp, Artificial Sequence
  Synthetic
aaaaaatatttcggcactgttagattgaaagaatgttatgttcaaaagttctttttaaccaatgagttgtacgga

SEQ ID NO: 16101 - DNA, 75 bp, Artificial Sequence
  Synthetic
cttttgttttatcaaaaaacaggtgaaagatcaaggtgctactcattgtacttgtcagataaagggcaactcaaa

SEQ ID NO: 16102 - DNA, 75 bp, Artificial Sequence
  Synthetic
gaggttggttccttttactgtgacccaaagcgattcttcctccccatcttttctgatacagtactcttgttaatg

SEQ ID NO: 16103 - DNA, 75 bp, Artificial Sequence
  Synthetic
tgtgcagaaatggtgagctggctagatttttgtgaggaattagctagagaagtggaccctcttttaagactactg

SEQ ID NO: 16104 - DNA, 75 bp, Artificial Sequence
  Synthetic
gtgcttagcattctttgctccccttctaaaaggaatcaaactttcctacaaggactaaggtacttcattatggcc

SEQ ID NO: 16105 - DNA, 75 bp, Artificial Sequence
  Synthetic
tttgtaaaccaagctcaccatgttcaattgatgtctaaactagtagtagaatgtaaatctgcatcagatgtatta

SEQ ID NO: 16106 - DNA, 75 bp, Artificial Sequence
  Synthetic
atacagaggctaagcgtgaggatgttccgaatggttttagattttggttcggatcctgatgcgtttatgtcaaga

SEQ ID NO: 16107 - DNA, 75 bp, Artificial Sequence
  Synthetic
aagtttaaattcctactcaatgtaagctacctttgtcatctagtgacaaaggaaactcctgataggttaactgat

SEQ ID NO: 16108 - DNA, 75 bp, Artificial Sequence
  Synthetic
cagataaaatgtttcgaaaagtttttggaacccaaattagaattcggtttctttgttgtgaatccctctctcaat

SEQ ID NO: 16109 - DNA, 75 bp, Artificial Sequence
  Synthetic
ggcacattgacgaaggaacaagaagatgccatggtgggtggcgttagcaaattcttttctaaggacatcttcaat

SEQ ID NO: 16110 - DNA, 75 bp, Artificial Sequence
  Synthetic
atagaagatatgaaacagccaggggtttctagagacttgctgagttattgtttgacactgtttaacaaaggtaag

SEQ ID NO: 16111 - DNA, 75 bp, Artificial Sequence
  Synthetic
ctaaaagttaacggtagtttgaaggtgaatccatttagaccaagttttacaagcacagcattagacttgtccagt

SEQ ID NO: 16112 - DNA, 75 bp, Artificial Sequence
  Synthetic
aataaaagtgttgtgataccaaagctagatgagcttggaaacattgtttctgtttatgacaagcaaaagctggtt

SEQ ID NO: 16113 - DNA, 75 bp, Artificial Sequence
  Synthetic
acgagaaaaaaacgcatataagacaacctccaaacaaaacgggacaagtgaaaatgtctcttcaggggattcagc

SEQ ID NO: 16114 - DNA, 75 bp, Artificial Sequence
  Synthetic
aatccttaaagaatcacagtacacaatcaaaagagatgtggggacaaccacagctgtcactccatcttctctgca

SEQ ID NO: 16115 - DNA, 75 bp, Artificial Sequence
  Synthetic
cagctgtcactccatcttctctgcagagggaagtgtcactcttatgtggagagatactgtatgccaagcacacag

SEQ ID NO: 16116 - DNA, 75 bp, Artificial Sequence
  Synthetic
attactcacatgcagctgaagtaggaatgcagtacgtgagcaccacactgggagcagagcgtacacagcagatac

SEQ ID NO: 16117 - DNA, 75 bp, Artificial Sequence
  Synthetic
taaagaactcaggtagtgaggtgcaggcagtattgaccaagacatactctcttgggaagggcaaaaacagcaaag

SEQ ID NO: 16118 - DNA, 75 bp, Artificial Sequence
  Synthetic
tagaggtgtctgctgtgaaaatatatttacagttgctgagagtgagttctcctttgagaatcacagtgttaaatt

SEQ ID NO: 16119 - DNA, 75 bp, Artificial Sequence
  Synthetic
gggaggagttgcaaatgttagacatacatggggttgaaagaagttggattgaagaagttgacaaagaggcaagga

SEQ ID NO: 16120 - DNA, 75 bp, Artificial Sequence
  Synthetic
aaaccatggcctcagctacaaaggacaactcaggaccaataccacaaaatcaaagaccatcatccccggatgctc

SEQ ID NO: 16121 - DNA, 75 bp, Artificial Sequence
  Synthetic
ctatcatactactctgcataggagcattaatcttcacgaagctggcatcaacaatcgaagttgggctggagacag

SEQ ID NO: 16122 - DNA, 75 bp, Artificial Sequence
  Synthetic
tcgaaagattgaagaattacgaaactgtgtcaggatccactagaggaaagttgacaagaaattacatggtaatgt

SEQ ID NO: 16123 - DNA, 75 bp, Artificial Sequence
  Synthetic
tgccttggcagcatatcaatagattcaattttgtattcagctctactggttgcaaaataagtgtcaaagcatgta

SEQ ID NO: 16124 - DNA, 75 bp, Artificial Sequence
  Synthetic
gaaagtttactacaggagcttgtttatagagtatggcaaagcccttgggtcttcttccacaggaagcaaggcaga

SEQ ID NO: 16125 - DNA, 75 bp, Artificial Sequence
  Synthetic
ttggaaggttgattcaagacttaaatccgacagttttttattttgtaggagaaggagccggcaattggatggcaa

SEQ ID NO: 16126 - DNA, 75 bp, Artificial Sequence
  Synthetic
atagagtatggcaaagcccttgggtcttcttccacaggaagcaaggcagaaagcctgtttgtgaatattttcatg

SEQ ID NO: 16127 - DNA, 75 bp, Artificial Sequence
  Synthetic
aagcctgtttgtgaatattttcatgcaagcttatggtgcaggtcagacaatgctaagatggggggtaattgccag

SEQ ID NO: 16128 - DNA, 75 bp, Artificial Sequence
  Synthetic
gaacagcctgtgagtatccaaatgcaaagtttgtttacaggagccttaaagatgatttggaccatcatttccctt

SEQ ID NO: 16129 - DNA, 75 bp, Artificial Sequence
  Synthetic
atcatccaacaatataatgttgggtcatgtctccgtacaagcagaactcaaacaggttacggaggtatatgatct

SEQ ID NO: 16130 - DNA, 75 bp, Artificial Sequence
  Synthetic
aacaggttacggaggtatatgatctagttagagagatgggccctgagtcaggtcttcttcacctgaggcaaagcc

SEQ ID NO: 16131 - DNA, 75 bp, Artificial Sequence
  Synthetic
agttagagagatgggccctgagtcaggtcttcttcacctgaggcaaagccctaaggctgggttgttgtcacttgc

SEQ ID NO: 16132 - DNA, 75 bp, Artificial Sequence
  Synthetic
agaacaaccaaaagcacccaaacaagcacaggcccaccaagaccaacggggggcgcacccagcggggcagcgacg

SEQ ID NO: 16133 - DNA, 75 bp, Artificial Sequence
  Synthetic
taattgtcccaattttgcaagtgtggtgctagggaatgcctcaggattggggatacttggtatgtacagaggaag

SEQ ID NO: 16134 - DNA, 75 bp, Artificial Sequence
  Synthetic
gagggcagcgggagagccgcggcggcgggggggccgagcgcggcgagcgcaggcggcaggcggcggaccgaggca

SEQ ID NO: 16135 - DNA, 75 bp, Artificial Sequence
  Synthetic
ggatacttggtatgtacagaggaagagtaccaaatacagagctatttgctgcagcagaaagctatgcaagaagcc

SEQ ID NO: 16136 - DNA, 75 bp, Artificial Sequence
  Synthetic
gccgcggagcgggaccggcggacccgggccggggccgggcccaccgcaggtggggcccgcgcgcggaccgccgcc

SEQ ID NO: 16137 - DNA, 75 bp, Artificial Sequence
  Synthetic
taaaagaaagcaataagataaatttctcatctcttggtctgacagaagaggaaaaagaagctgctgagaactttc

SEQ ID NO: 16138 - DNA, 75 bp, Artificial Sequence
  Synthetic
gcctcggagcgcggcgcggacacggcgggcagcgcaggggggggtcccgggggggacggggcgaccggaggcctc

SEQ ID NO: 16139 - DNA, 75 bp, Artificial Sequence
  Synthetic
catgcaaggcagtaaactgtcatggatccgagtgttatgtccttctaacacttggccaccacaataacctaccat

SEQ ID NO: 16140 - DNA, 75 bp, Artificial Sequence
  Synthetic
tcaacataaatgaggaaggccagaatgattatgagtaattaaaaaacgggacaagtcaaaatgtcctttcctgag

SEQ ID NO: 16141 - DNA, 75 bp, Artificial Sequence
  Synthetic
agcggcggagcgccggccgagcgggaggacgccagcggggggacggccgcggccggtcccggggacggcaccgag

SEQ ID NO: 16142 - DNA, 75 bp, Artificial Sequence
  Synthetic
cttggccaccacaataacctaccatgtcacggggaggtacagagctccaagttaaaattggctgtgtgcaatgat

SEQ ID NO: 16143 - DNA, 75 bp, Artificial Sequence
  Synthetic
gggaaagatatattgcttatgggcaatgaagctgcaaaagcagcagaagctttccaaagatcactaaagaaaata

SEQ ID NO: 16144 - DNA, 75 bp, Artificial Sequence
  Synthetic
gcggacgggagggcgcccccggcggccgccctggcggggcgcaccacggagtcggccgcgggcgcggcgggggac

SEQ ID NO: 16145 - DNA, 75 bp, Artificial Sequence
  Synthetic
ggacataggagaacacagtcaattgttggagacaaaataatcacagtgtccgaaactgtagaaaagccaaccata

SEQ ID NO: 16146 - DNA, 75 bp, Artificial Sequence
  Synthetic
agcggcagggcagggaccgcgggatgggggagcgcagcggacggacggtccacgggaggcaacgcagcggcggag

SEQ ID NO: 16147 - DNA, 75 bp, Artificial Sequence
  Synthetic
agtaaatcaacaaaggttaccacaccccctgaaaggaaaaatgcatggggcgaaaagccagataccacaagaagc

SEQ ID NO: 16148 - DNA, 75 bp, Artificial Sequence
  Synthetic
gccggggcagcccagagcgggcgggccgcgccgaggcagccgagcggcggcacggcaccggagagcaccgcacca

SEQ ID NO: 16149 - DNA, 75 bp, Artificial Sequence
  Synthetic
cgaaaagccagataccacaagaagccaaacagaagaagccagaaacaaggccatgctggaggatgcaatccggtt

SEQ ID NO: 16150 - DNA, 75 bp, Artificial Sequence
  Synthetic
ccgaacagcgggggcagcggtcgggcagatgccgcaccaacagaggaggttggggtcggctcgggcctctggcga

SEQ ID NO: 16151 - DNA, 75 bp, Artificial Sequence
  Synthetic
gtacgaggaggtctttgctcctacgagtgatggcaagactcctgccgagaaaggaaaggaaacacctgaaaaacc

SEQ ID NO: 16152 - DNA, 75 bp, Artificial Sequence
  Synthetic
aaattattagataatcttggcagtgctgaacttaaaaagctaatcaaagtgacaggttacatgctgatgagtaag

SEQ ID NO: 16153 - DNA, 75 bp, Artificial Sequence
  Synthetic
aaggaaaggaaacacctgaaaaaccaaaaaagaaagtgacattcaagaatgatgaatcaggaagatacacaaaac

SEQ ID NO: 16154 - DNA, 75 bp, Artificial Sequence
  Synthetic
gggagatatgtttgtgggccctgcggggagagtgttccggagcatccgatgaatccatgttttggggacggcact

SEQ ID NO: 16155 - DNA, 75 bp, Artificial Sequence
  Synthetic
ttgagatggaagcactagaattgttatcagacaatgaggatgacgatgcagaatcatccgtgttgacttttgaag

SEQ ID NO: 16156 - DNA, 75 bp, Artificial Sequence
  Synthetic
aagtaatggaaggaaattaccttaagaaattacctatggtgaaggcttaaaacttacatatccgtgctggaaaat

SEQ ID NO: 16157 - DNA, 75 bp, Artificial Sequence
  Synthetic
gcatggatttgttcggatgatggggggagtttgccggctggttgctatgatggtggaacggatggagtggtttgc

SEQ ID NO: 16158 - DNA, 75 bp, Artificial Sequence
  Synthetic
aaaaggacacctctgctcttagtcttgaagccaggctggaatctattgacgagaaattgagcatgatactagggt

SEQ ID NO: 16159 - DNA, 75 bp, Artificial Sequence
  Synthetic
acgagaaaaaaacgcattcaagtcacaatagaaaagaaaaatgggacaagtaaaaatgtctcttgaaagtattag

SEQ ID NO: 16160 - DNA, 75 bp, Artificial Sequence
  Synthetic
tgtggagtttgtggaggcaactcgtgttgttgcgggcgagtagagtgcacatgtgggggtggagcgggactgcta

SEQ ID NO: 16161 - DNA, 75 bp, Artificial Sequence
  Synthetic
tgctaagaacactcaatgttgccacggctgggcccaccgcagccagagacggcatccgggatgcaatggtaggat

SEQ ID NO: 16162 - DNA, 75 bp, Artificial Sequence
  Synthetic
gctcagtgatctagagtacaagcatgcaatccttgatgagtcacaatatacaataaggagagatgttggtgctac

SEQ ID NO: 16163 - DNA, 75 bp, Artificial Sequence
  Synthetic
aaatattaaagtaatagttacttaaatttagtaatctggatatgaagcgcacaactagcaattagttattaaaaa

SEQ ID NO: 16164 - DNA, 75 bp, Artificial Sequence
  Synthetic
tgagagaagaattaattgctgatatcatcaaagaagcaaaagggaaggcagccgagatgatgaaagaggaagcaa

SEQ ID NO: 16165 - DNA, 75 bp, Artificial Sequence
  Synthetic
aactgctatcacaccctctgaactacagccaaaggtatccaccctgtgtggaatgattttatttgctaagcatgc

SEQ ID NO: 16166 - DNA, 75 bp, Artificial Sequence
  Synthetic
atgtgggggtggagcgggactgctatcctgctgctgtggctcatacagctggagttagtttagaagcaagttagt

SEQ ID NO: 16167 - DNA, 75 bp, Artificial Sequence
  Synthetic
agcagaagtcaaaaatagggaatgggagcgtaggcctaactgagaaggccaaggaactgaacaaaatagtggagg

SEQ ID NO: 16168 - DNA, 75 bp, Artificial Sequence
  Synthetic
gagcgtaggcctaactgagaaggccaaggaactgaacaaaatagtggaggacgagagcacaagtggtgagtcaga

SEQ ID NO: 16169 - DNA, 75 bp, Artificial Sequence
  Synthetic
agattatgaaccagcagcagaagttggcatgcagtacatcagcactgcattaggagctgataagacacagcagat

SEQ ID NO: 16170 - DNA, 75 bp, Artificial Sequence
  Synthetic
ggaagaagaagaggaagaagatgaagaagagagcaacccagatgatgacctatactcccttactatgtagttaat

SEQ ID NO: 16171 - DNA, 75 bp, Artificial Sequence
  Synthetic
actcaaaagctctggcagtgaagtgcaaggggtcatgaccaagatagtgacactccctgcagaaggtcccatacg

SEQ ID NO: 16172 - DNA, 75 bp, Artificial Sequence
  Synthetic
gaagagagcaacccagatgatgacctatactcccttactatgtagttaataaaaaaacgggacaagtggaaatgg

SEQ ID NO: 16173 - DNA, 75 bp, Artificial Sequence
  Synthetic
aaagcgggaagtacttaacatccatgacattgggcccgcatgggcagacaatgtggaacggactgcaagggagac

SEQ ID NO: 16174 - DNA, 75 bp, Artificial Sequence
  Synthetic
agtcctatctagtagacacctaccaaggtgtcccttacactgctgctgtacaaactgatttggtggagaaagacc

SEQ ID NO: 16175 - DNA, 75 bp, Artificial Sequence
  Synthetic
caaactgatttggtggagaaagaccaactgcctgcaaggttaacagtgtggttccctctattccaaaccaacaca

SEQ ID NO: 16176 - DNA, 75 bp, Artificial Sequence
  Synthetic
catgagcctaatggtaaaagagaaagctcaaatacccaagaaccaaaagccgtcagctcttgatgcacctgtgat

SEQ ID NO: 16177 - DNA, 75 bp, Artificial Sequence
  Synthetic
cctcctacagtgctactagagcagcttaagactctgacaattacaactttgtacacagcctctcagaatggccca

SEQ ID NO: 16178 - DNA, 75 bp, Artificial Sequence
  Synthetic
cttactatgtattggggcattaatattcactaagctcgcatccacggtagaggttgggctggaaactgctattag

SEQ ID NO: 16179 - DNA, 75 bp, Artificial Sequence
  Synthetic
atactgaaggtcaatgcatcagcacaaggggctgcaatgtcagcattgccaaaaagctttgatgttagtgcatca

SEQ ID NO: 16180 - DNA, 75 bp, Artificial Sequence
  Synthetic
gagagcctctcgggtgttaagtgatgcaatatcacgttaccctaggatggacataccacggattgccaaatcctt

SEQ ID NO: 16181 - DNA, 75 bp, Artificial Sequence
  Synthetic
aaaaagctttgatgttagtgcatcagtagcactagatgactacagcaaactagaatttgacaaactgacagtgtg

SEQ ID NO: 16182 - DNA, 75 bp, Artificial Sequence
  Synthetic
ctttgagctatttgaaaagaaagtgtactacaggaaccttttcatagagtacggtaaggcacttgggagtacgtc

SEQ ID NO: 16183 - DNA, 75 bp, Artificial Sequence
  Synthetic
tgagttaaaagcagtctatttgacaacaatgaaaccttatggtatggtctcaaagtttgtcaactcagccaaagc

SEQ ID NO: 16184 - DNA, 75 bp, Artificial Sequence
  Synthetic
ttccgggagtaggatggagagcctctttgttaacatcttcatgcaagcttatggagctgggcagactatgctaag

SEQ ID NO: 16185 - DNA, 75 bp, Artificial Sequence
  Synthetic
agtcggaaagaaaacacacgatttgattgctctctgtgacttccttgacctagagaagggagttccagtgactat

SEQ ID NO: 16186 - DNA, 75 bp, Artificial Sequence
  Synthetic
atggggtgttgtggcaagatcatccaataacatcatgttgggccatgtgtctgtgcaggcagagttaaggcaggt

SEQ ID NO: 16187 - DNA, 75 bp, Artificial Sequence
  Synthetic
tagagaagggagttccagtgactataccagcctatataaagtctgtgtcaataaaagagagtgaatcagcaactg

SEQ ID NO: 16188 - DNA, 75 bp, Artificial Sequence
  Synthetic
ctcagaagtgtatgatcttgttaggaaaatgggtcctgaatcaggcctcctccacttgaggcaaagtccaaaagc

SEQ ID NO: 16189 - DNA, 75 bp, Artificial Sequence
  Synthetic
agatcaagctataactcaagctaggattgctccatacgctggtttgatcatgataatgacaatgaacaaccctaa

SEQ ID NO: 16190 - DNA, 75 bp, Artificial Sequence
  Synthetic
aggcttactatcattaacaagttgccccaactttgcaagtgttgttttggggaatgcagctggcctaggcatcat

SEQ ID NO: 16191 - DNA, 75 bp, Artificial Sequence
  Synthetic
tgataatgacaatgaacaaccctaaggggatcttcaaaaaactgggtgcaggagttcaggtaatagtggagttag

SEQ ID NO: 16192 - DNA, 75 bp, Artificial Sequence
  Synthetic
tgggatgtataagggcagagcacccaacttggagttgttttctgcagcagaaagttatgctagatccctcaaaga

SEQ ID NO: 16193 - DNA, 75 bp, Artificial Sequence
  Synthetic
gagcatacgttcaagcagaaagcataagcagaatctgcaggaactggagccaccagggtacgagatatgtcctga

SEQ ID NO: 16194 - DNA, 75 bp, Artificial Sequence
  Synthetic
gagcaacaagattaaccttgctgcccttgggctaactgaagatgagagagaggctgccacatcatacctgggcgg

SEQ ID NO: 16195 - DNA, 75 bp, Artificial Sequence
  Synthetic
agtcaagatgaacacagagagtacacttaccaaatcacagtaacaatttcgtttttaaccctctcatagttatta

SEQ ID NO: 16196 - DNA, 75 bp, Artificial Sequence
  Synthetic
agatgaagacaagtcacagaagtttgagtaattaaaaattcgggacaagtgaaaatgtctttccccgaaggcaag

SEQ ID NO: 16197 - DNA, 75 bp, Artificial Sequence
  Synthetic
attgggacaagtgaaaatgtcttggaaagtggtactgctattggtattgctagctaccccaacaggggggctaga

SEQ ID NO: 16198 - DNA, 75 bp, Artificial Sequence
  Synthetic
gatatcttgatgatgggaagtgaagcagctaagttggcagaggcttatcagcaatcaatcaagaattccacttct

SEQ ID NO: 16199 - DNA, 75 bp, Artificial Sequence
  Synthetic
agaaagttatctagaggagtcatgcagtactgttactagaggatacctgagtgttttgaggacaggatggtatac

SEQ ID NO: 16200 - DNA, 75 bp, Artificial Sequence
  Synthetic
gtgagaagatccattagtggtgaccctgttagcacagtgtctgaaaaagttccattaccaccactatgtagctca

SEQ ID NO: 16201 - DNA, 75 bp, Artificial Sequence
  Synthetic
gtgttttgaggacaggatggtatacaaatgtgttcacacttgaggttggagatgtggaaaatctcacatgtaccg

SEQ ID NO: 16202 - DNA, 75 bp, Artificial Sequence
  Synthetic
aaatgtgttcacacttgaggttggagatgtggaaaatctcacatgtaccgacgggcccagcttaataagaacaga

SEQ ID NO: 16203 - DNA, 75 bp, Artificial Sequence
  Synthetic
gatgtggaaaatctcacatgtaccgacgggcccagcttaataagaacagaacttgaactgacaaaaaatgcactt

SEQ ID NO: 16204 - DNA, 75 bp, Artificial Sequence
  Synthetic
gaaacttctagaggagcatgcataagacccacaaaatcaaccctgcctcccatcaaggaagtggagtccatctac

SEQ ID NO: 16205 - DNA, 75 bp, Artificial Sequence
  Synthetic
gaggaactcaagacagtatcagcagatcaattggcaaaggaagctaggataatgtcaccaagaaaagcccggttt

SEQ ID NO: 16206 - DNA, 75 bp, Artificial Sequence
  Synthetic
cctaaactacccactgctccccctgatgccatgattgagaccgcccaccccataggggctccaaagaaagcacag

SEQ ID NO: 16207 - DNA, 75 bp, Artificial Sequence
  Synthetic
gttctgggtgccatagcattaggtgtggcaactgctgctgctgtgacggctggtgtagcgatagccaagacaatt

SEQ ID NO: 16208 - DNA, 75 bp, Artificial Sequence
  Synthetic
aaaagggtgaaatttgagagttcaaaagcaggcaaatacaccaagctagaagaagaagccctggagctcctgtcc

SEQ ID NO: 16209 - DNA, 75 bp, Artificial Sequence
  Synthetic
aggctagaaggagaagtggctgcaatcaagggtgctctcaggaaaacaaatgaggctgtatctacattaggaaat

SEQ ID NO: 16210 - DNA, 75 bp, Artificial Sequence
  Synthetic
tcaagggtgctctcaggaaaacaaatgaggctgtatctacattaggaaatggcgtgagggtacttgcaacagctg

SEQ ID NO: 16211 - DNA, 75 bp, Artificial Sequence
  Synthetic
gaccctgacgaagataatgatgagaaatcatctgtacttacatttgaggagaaggacaatgcaccatcatctata

SEQ ID NO: 16212 - DNA, 75 bp, Artificial Sequence
  Synthetic
gaggcgaggttggaggctatagaggaaaaactcagcatgatattggggatgttaaagaccctgagcatagccacc

SEQ ID NO: 16213 - DNA, 75 bp, Artificial Sequence
  Synthetic
tgaatgatctcaaggactttataagtaaaaaattgacacctgcaataaacaagaacaagtgtgacatctcagacc

SEQ ID NO: 16214 - DNA, 75 bp, Artificial Sequence
  Synthetic
gcagggccaaccgcagcgagagatggaatacgtgatgcaatggtgggagttagagaagagttgatcaatagcatt

SEQ ID NO: 16215 - DNA, 75 bp, Artificial Sequence
  Synthetic
ttaagatggcagtgagctttggacaatacaatcggaggttcctcaatgtggtaagacagttttctgacaatgcag

SEQ ID NO: 16216 - DNA, 75 bp, Artificial Sequence
  Synthetic
atggcggaagctaaagggaagattgcagagatgataaaggaagaagatgcacagagggcaaaaataggagatggg

SEQ ID NO: 16217 - DNA, 75 bp, Artificial Sequence
  Synthetic
gtattacgcctgcaatatctctagatttaatgactgacgctgagcttgtaagagctgtaagcaacatgcccacat

SEQ ID NO: 16218 - DNA, 75 bp, Artificial Sequence
  Synthetic
agtgtgaaactaacagagaaagctcgggaattgaacaggatgcttgaggatcaaagctcgagtggtgaatctgag

SEQ ID NO: 16219 - DNA, 75 bp, Artificial Sequence
  Synthetic
cttcaggacagatcaatctaatgcttgagaatcgggcaatggtcagaaggaaaggatttgggattttgattggag

SEQ ID NO: 16220 - DNA, 75 bp, Artificial Sequence
  Synthetic
acagaaagtgaagagactgaaccagatactgatggtgaaaatgatgatatatacagctttgatatgtagttatga

SEQ ID NO: 16221 - DNA, 75 bp, Artificial Sequence
  Synthetic
ggtgcagcttcctattttcggtgtgatagatacaccgtgttggaaggtgaaggctgctccattatgttcagggaa

SEQ ID NO: 16222 - DNA, 75 bp, Artificial Sequence
  Synthetic
tctgtgcagatgtagttgatgaattgcatggcacacaaagtctcttttgctggctgcatttgactgttccactaa

SEQ ID NO: 16223 - DNA, 75 bp, Artificial Sequence
  Synthetic
atagatacaccgtgttggaaggtgaaggctgctccattatgttcagggaaagacgggaattatgcatgtctcttg

SEQ ID NO: 16224 - DNA, 75 bp, Artificial Sequence
  Synthetic
aaaaatgggacaagtaaacatggagtcctatattatagatacctatcaaggtgtgccctacacagctgctgttca

SEQ ID NO: 16225 - DNA, 75 bp, Artificial Sequence
  Synthetic
cgagaggaccaaggttggtattgtcaaaatgctggatccacagtttattatccaaatgaggaggactgtgaagta

SEQ ID NO: 16226 - DNA, 75 bp, Artificial Sequence
  Synthetic
agtcgatctagttgagaaggacaacaaccctgcaaaactgacggtttggtttcctttattccagtccagcactcc

SEQ ID NO: 16227 - DNA, 75 bp, Artificial Sequence
  Synthetic
agaagtgatcatgtgttttgtgacacagcagctgggataaatgtagcaaaggagtcagaagagtgcaacaggaat

SEQ ID NO: 16228 - DNA, 75 bp, Artificial Sequence
  Synthetic
tgctccagtgctgctggaccagctaaaaactctgtcaatcactacacaatatactgcttcccctgaaggaccagt

SEQ ID NO: 16229 - DNA, 75 bp, Artificial Sequence
  Synthetic
atctcaacaacaaagtacccttgcaaggtaagtacagggcgtcacccaataagcatggtggccttatcaccactg

SEQ ID NO: 16230 - DNA, 75 bp, Artificial Sequence
  Synthetic
ttaaatggagataatcaatctattgatgttagcaaacctgttaggttgtcacaaggagttgatgaagttaaagct

SEQ ID NO: 16231 - DNA, 75 bp, Artificial Sequence
  Synthetic
aggtaagtacagggcgtcacccaataagcatggtggccttatcaccactgggtgctttggtagcctgttatgacg

SEQ ID NO: 16232 - DNA, 75 bp, Artificial Sequence
  Synthetic
gctacaagtaaatgctactgcacaaggtgcagccatgtcagctctgcccaagaagttttcagttagtgctgctgt

SEQ ID NO: 16233 - DNA, 75 bp, Artificial Sequence
  Synthetic
gtgtgagttgttccattggaagcaacaaggttggaataatcagacctttggggaaagggtgttcatacatcagca

SEQ ID NO: 16234 - DNA, 75 bp, Artificial Sequence
  Synthetic
agcacttgatgagtacagcaaacttgactttggggtactcacagtttgcgatgtaagagcagtttacctcaccac

SEQ ID NO: 16235 - DNA, 75 bp, Artificial Sequence
  Synthetic
tctgaagccatacggtatggtgtctaagattgtaacaaacatgaacaccgttgggcgcaaaactcatgacctgat

SEQ ID NO: 16236 - DNA, 75 bp, Artificial Sequence
  Synthetic
tacaatttatgagcaaagtcattcagtcggaaggtgtgatgcatccatcaccgataaagaagattttgagggttg

SEQ ID NO: 16237 - DNA, 75 bp, Artificial Sequence
  Synthetic
agccctttgtgacttcattgatatggagagaggcataccagtaactatccctgcttacataaaggcagtatccat

SEQ ID NO: 16238 - DNA, 75 bp, Artificial Sequence
  Synthetic
aaagttgaaggagaacaacacacaattaaagggaagccagtatctagcaattttgaccctatagagttccctgga

SEQ ID NO: 16239 - DNA, 75 bp, Artificial Sequence
  Synthetic
gatcagttcaacatagccctggatcaggtgtttgaaagtgttgagaagagccagaatctgatagaccagtcaaac

SEQ ID NO: 16240 - DNA, 75 bp, Artificial Sequence
  Synthetic
aggtgtttgaaagtgttgagaagagccagaatctgatagaccagtcaaacaagatattggatagcactaaaaagg

SEQ ID NO: 16241 - DNA, 75 bp, Artificial Sequence
  Synthetic
caaagattccgagtcagctacagttgaagccgcaatcagtggtgaagctgaccaggctatcactcaggcaagaat

SEQ ID NO: 16242 - DNA, 75 bp, Artificial Sequence
  Synthetic
agctccgtatgcagggttgattctggtcatgaccatgaacaaccccaaagggatattcaggaaactcggtgcagg

SEQ ID NO: 16243 - DNA, 75 bp, Artificial Sequence
  Synthetic
ggaatgcaggatttgtcatagtgatagtcctcattgtcctgctcatgctgggagcagttggtgtgggtgtcttct

SEQ ID NO: 16244 - DNA, 75 bp, Artificial Sequence
  Synthetic
aacacaagttattgtggagctagggccttatgtgcaggctgagagcttagggaaaatatgcaaaacatggaacca

SEQ ID NO: 16245 - DNA, 75 bp, Artificial Sequence
  Synthetic
ccagaggactaggtatgtcctgaagtcccgctaaaactggcaaacaaaagtccactattcttctgtagtttaata

SEQ ID NO: 16246 - DNA, 75 bp, Artificial Sequence
  Synthetic
ggacaagtccaagatgtctcgcaaggctccctgcaaatatgaagtacggggcaagtgcaatagaggcagtgaatg

SEQ ID NO: 16247 - DNA, 75 bp, Artificial Sequence
  Synthetic
aaaaatatggggcaagtaaaatgtacctcaaactgctactaataatttatttggtggtcggggccagtgggaaga

SEQ ID NO: 16248 - DNA, 75 bp, Artificial Sequence
  Synthetic
tggccagacaggtacctgttactaaggtccaattacctgctgaatcaattactgagaaatacagatagatcagat

SEQ ID NO: 16249 - DNA, 75 bp, Artificial Sequence
  Synthetic
tacaagaaacttacagtgaagaatcatgcagcactgtaaccaggggttacaaaagtgtgctcagaacgggttggt

SEQ ID NO: 16250 - DNA, 75 bp, Artificial Sequence
  Synthetic
ggcctgtcattaatctcaggagcagggcgagatgataggacacaagattttgttttggggtcaacaaatgtggtc

SEQ ID NO: 16251 - DNA, 75 bp, Artificial Sequence
  Synthetic
atacaaatgtgttcaacctagaaatagggaatgtggagaacataacatgtaatgatggtcctagccttatcagca

SEQ ID NO: 16252 - DNA, 75 bp, Artificial Sequence
  Synthetic
cagaactacattgataacaatgagaatataacaaaagcatcagcttgttatagtctgtataatatcataaaacaa

SEQ ID NO: 16253 - DNA, 75 bp, Artificial Sequence
  Synthetic
cttttctgcgacagtgcaatacactacagcaggaatgaagaagaagttgggttaatagcccaaaacataacacca

SEQ ID NO: 16254 - DNA, 75 bp, Artificial Sequence
  Synthetic
ctgaattgtcactaactcagaatgccttgcaggagcttagaactgtttctgccgatcagattacaaaggagaatc

SEQ ID NO: 16255 - DNA, 75 bp, Artificial Sequence
  Synthetic
gaatcctttcccataggaagaagaggtttgtgttgggtgcaattgcccttggagtggccaccacagctgctgtaa

SEQ ID NO: 16256 - DNA, 75 bp, Artificial Sequence
  Synthetic
gtgttgtcatatatggaaatgagcaaaacccctgcatccttgataaacaacttgaagaagcttcccaaggaaaaa

SEQ ID NO: 16257 - DNA, 75 bp, Artificial Sequence
  Synthetic
cagccggcgtagctttagctaaaacaataagattagaaggggaggtgaaagccatcaagctagctttgcgcagta

SEQ ID NO: 16258 - DNA, 75 bp, Artificial Sequence
  Synthetic
ctaaagaaattggcaaagctgatcattgaattgtcagcaggagtggaaaatgactctacagctgccatgcaagat

SEQ ID NO: 16259 - DNA, 75 bp, Artificial Sequence
  Synthetic
caaatgaggctgtgttcacattaggcaatggcgttcgcatcttggcaacagctgttaatgacctaaaagaattta

SEQ ID NO: 16260 - DNA, 75 bp, Artificial Sequence
  Synthetic
tgactctacagctgccatgcaagatagtgcaaactctgattaaatgcggagaacatggcctgatctttctgaaga

SEQ ID NO: 16261 - DNA, 75 bp, Artificial Sequence
  Synthetic
taagcaagaaattaacccctgcaataaaccaaaacaaatgcaacatagcagacataaggatggcaatcagctttg

SEQ ID NO: 16262 - DNA, 75 bp, Artificial Sequence
  Synthetic
tgaaattagatgatatggtatggactaaaaatgaattggtagacataatttccactgaaatagttaaagtgcatg

SEQ ID NO: 16263 - DNA, 75 bp, Artificial Sequence
  Synthetic
aaggtcctgggataacatggaaattgttggagtcacctcaccgagcatagttacatgcatgaacatagtgtattc

SEQ ID NO: 16264 - DNA, 75 bp, Artificial Sequence
  Synthetic
gacagaacaacagaaggtttctaaatgtggtgagacaattttctgacagtgcaggaataacttccgcagtgtctt

SEQ ID NO: 16265 - DNA, 75 bp, Artificial Sequence
  Synthetic
ctaatatattcaaatgtaggctagaggatatagaaatcatttatgttataacatctctaagttaataaaaaattg

SEQ ID NO: 16266 - DNA, 75 bp, Artificial Sequence
  Synthetic
tagatcttatgacagatgcagaattggttaaagccatcaaccgaatgccaacttcgtctggtcagattagcctca

SEQ ID NO: 16267 - DNA, 75 bp, Artificial Sequence
  Synthetic
ggacaagtcaacatggagcccctgaaagtctctggaagtggagggataccgatgaagacaaggcttaatatcata

SEQ ID NO: 16268 - DNA, 75 bp, Artificial Sequence
  Synthetic
tgctgaacaatagagcaatggttaggaggaaagggtttggaatacttataggtgtttacggggggactgtagtgt

SEQ ID NO: 16269 - DNA, 75 bp, Artificial Sequence
  Synthetic
gatgaagacaaggcttaatatcatacttgagaagtcaatcaataaaaccttgatcattttaggattactattaac

SEQ ID NO: 16270 - DNA, 75 bp, Artificial Sequence
  Synthetic
atatggtgcaactcccaatatttggagttatagagacaccctgctggagagtggtagctgcacccctctgtagac

SEQ ID NO: 16271 - DNA, 75 bp, Artificial Sequence
  Synthetic
tgcctcaactgtaattacaatcacactcacagtggagtatataagagtagaaaatgaattgctactttgcaagat

SEQ ID NO: 16272 - DNA, 75 bp, Artificial Sequence
  Synthetic
atgagagggagagttatgcttgtctgctgcgggaagatcaggggtggtactgcactaatgcaggatcaactgctt

SEQ ID NO: 16273 - DNA, 75 bp, Artificial Sequence
  Synthetic
ccggaaccaccaacacagccaacgatgacaactcctacactaaccagaaccagatcaaccaccgcatccctcaaa

SEQ ID NO: 16274 - DNA, 75 bp, Artificial Sequence
  Synthetic
actacccaaatgaagatgactgcgaggtaagagatgactatgtgttctgtgatactgcagcaggtataaatgttg

SEQ ID NO: 16275 - DNA, 75 bp, Artificial Sequence
  Synthetic
accagaccagtttcaaggaccactcatcccaccaatcccagctgctggagagaggaggaaaagtgccagaatatc

SEQ ID NO: 16276 - DNA, 75 bp, Artificial Sequence
  Synthetic
catcagaggtggagcagtgcaaccaaaacatatcaacctctacttacccttgcaaagttagcacagggagacacc

SEQ ID NO: 16277 - DNA, 75 bp, Artificial Sequence
  Synthetic
acagctaaatggtccaattgttttggcacatctctacctgtgagggtgaactgcacggtactaagagaattgtgt

SEQ ID NO: 16278 - DNA, 75 bp, Artificial Sequence
  Synthetic
ctgtaagcatggtagccttaacccccttgggaggtttagtatcatgttatgaaggtgtgagttgctccattggca

SEQ ID NO: 16279 - DNA, 75 bp, Artificial Sequence
  Synthetic
gatgagcagccaggcaatcacacaacagttcaagtatcaaggaggtgtacatgcatatatgcattaaattgggat

SEQ ID NO: 16280 - DNA, 75 bp, Artificial Sequence
  Synthetic
gcaacaaagtcgggatcattaaacaactcaacaaaggatgcacacacatacccaataatgaggcagacacaataa

SEQ ID NO: 16281 - DNA, 75 bp, Artificial Sequence
  Synthetic
atgcatatatgcattaaattgggattgtagtcatgcttgagagagaggccacaccagcagaccccaatgaggtcc

SEQ ID NO: 16282 - DNA, 75 bp, Artificial Sequence
  Synthetic
ctgtctttttagggaaatttgattacaaactggtagaaaagatatcttcagaccaacacattttcagccctgaca

SEQ ID NO: 16283 - DNA, 75 bp, Artificial Sequence
  Synthetic
ctatagacaacacaatttatcaactcagcaaggtggtgggtgagcaaaggaccatcaaaggagctccggtggtaa

SEQ ID NO: 16284 - DNA, 75 bp, Artificial Sequence
  Synthetic
tgtagtcatgcttgagagagaggccacaccagcagaccccaatgaggtccacagaaaaattaaaagcataaacca

SEQ ID NO: 16285 - DNA, 75 bp, Artificial Sequence
  Synthetic
attttttagttatttaaaaatcatgaatatgtctggacagtgccaaggccaagaaaaaccaacacgagaacaggt

SEQ ID NO: 16286 - DNA, 75 bp, Artificial Sequence
  Synthetic
aatatgtctggacagtgccaaggccaagaaaaaccaacacgagaacaggtgatccaatgactaaaaatgatcaga

SEQ ID NO: 16287 - DNA, 75 bp, Artificial Sequence
  Synthetic
ataatttcaaccctctactgttccctgaggatcaatttaacgtagccttagatcaagtatttgagagtgttgata

SEQ ID NO: 16288 - DNA, 75 bp, Artificial Sequence
  Synthetic
aatcaaaagacctgattgacaagtctaatgacttactggacatagaggttaagagtaatataggtgctgcattag

SEQ ID NO: 16289 - DNA, 75 bp, Artificial Sequence
  Synthetic
gtcaagaattttataaaaaggtctgattgcaagaaaaaactttttgccttgattttagggctagtcagctttgaa

SEQ ID NO: 16290 - DNA, 75 bp, Artificial Sequence
  Synthetic
ccatcacaattttagtagtgcttagcatgtcaatcgtagtgggcatagcttactatgtggttaaaaagaggaaag

SEQ ID NO: 16291 - DNA, 75 bp, Artificial Sequence
  Synthetic
ctcactatgaatataatgctgtctgtcatgtatgtggagtcaaatgaggccctaagtttatgtaggatccaaggg

SEQ ID NO: 16292 - DNA, 75 bp, Artificial Sequence
  Synthetic
ccaaagcatccaatggatatcctaaaacaacagggcaaagcaacatgggctacatcagttgagttacataaaaag

SEQ ID NO: 16293 - DNA, 75 bp, Artificial Sequence
  Synthetic
actcctgctccaagagataataagacaaacacagaaaacgcaacaaaggaaacaacactccacacaacgaccaca

SEQ ID NO: 16294 - DNA, 75 bp, Artificial Sequence
  Synthetic
tgggacaagtaaagatgtccagaaggaatccctgcagatatgaaacaagaggcaagtgcaaccgagggtcctcat

SEQ ID NO: 16295 - DNA, 75 bp, Artificial Sequence
  Synthetic
acaagggatccagaggtgagggaaacaaaaaccaccaagccccaggccaatgaaggagcaacaaacccaagcagg

SEQ ID NO: 16296 - DNA, 75 bp, Artificial Sequence
  Synthetic
gtacatttaaccacaattactggtcttggccagaccatgtattgttagtgcgggctaattatatgctgaatcagc

SEQ ID NO: 16297 - DNA, 75 bp, Artificial Sequence
  Synthetic
aacctcaccaccaagggagacaaacaccaaacgacaagagcaacaacagaggcagaactggaaaaacaaagcaag

SEQ ID NO: 16298 - DNA, 75 bp, Artificial Sequence
  Synthetic
tagttaggaacacagataggactgacgggttatctctcatatcaggagcagggagagaagacaggacacaggatt

SEQ ID NO: 16299 - DNA, 75 bp, Artificial Sequence
  Synthetic
ttgtgctcggttctgccaatgttgtccagaattatatagaagggaatgcaaccataacaaaatctgcggcttgtt

SEQ ID NO: 16300 - DNA, 75 bp, Artificial Sequence
  Synthetic
cccaaaagcacacccccgcaaggccaagcagcaaatcccccaccacaacacaagcaacagcacaaccgacaacac

SEQ ID NO: 16301 - DNA, 75 bp, Artificial Sequence
  Synthetic
atagcttgtacaacattatcaagcaacttcaagagaatgatgtgaaatctgcacgagacctgatggtagatgacc

SEQ ID NO: 16302 - DNA, 75 bp, Artificial Sequence
  Synthetic
caacagccccaaaagcaagcacagcacccaagaacagacaggcaacaaccaaaaaaaccgaaacggacaccacaa

SEQ ID NO: 16303 - DNA, 75 bp, Artificial Sequence
  Synthetic
ccaagcatgttgccctgcataaccttgtcttgtcctatatagacatgagtaagaatccagcaaatctcataaaca

SEQ ID NO: 16304 - DNA, 75 bp, Artificial Sequence
  Synthetic
cagcaagcagagcaaggaacaccaacaaccccacagagacagcaacaacaacccccaaagcaacaacagaaacag

SEQ ID NO: 16305 - DNA, 75 bp, Artificial Sequence
  Synthetic
gtctcaagaggctacctaaagaaaaacttaaaaaattggccaaaatcataattcagctttctgctggttcagaag

SEQ ID NO: 16306 - DNA, 75 bp, Artificial Sequence
  Synthetic
acaacagcacgagagacaacaaccccacagccaagaagaacagccggagctagcccaagagcaagttagttaatt

SEQ ID NO: 16307 - DNA, 75 bp, Artificial Sequence
  Synthetic
gggaaaatgccaatagtaataccctgcaaaagggtgacagcagtaattaggtgcaacaccttaggtgtatgcctg

SEQ ID NO: 16308 - DNA, 75 bp, Artificial Sequence
  Synthetic
tttaaaaggacatatgagcataacatcattaaccttggtgatctgatagaagaagtagcgaggatgattattata

SEQ ID NO: 16309 - DNA, 75 bp, Artificial Sequence
  Synthetic
gatcacataaataggaaacaatgcaatgaatgtagaaaagattttgaatttgtagcggtttacacatcttacact

SEQ ID NO: 16310 - DNA, 75 bp, Artificial Sequence
  Synthetic
taggtaaacactaccttaaaaaggataacacttcgaaagtggccatagagagccctgttgtagaacacatcagat

SEQ ID NO: 16311 - DNA, 75 bp, Artificial Sequence
  Synthetic
tagttatataaaaacaattgagcagcccccccgaaaaaagatggggcaagtcgagatgacctccactgtcaacct

SEQ ID NO: 16312 - DNA, 75 bp, Artificial Sequence
  Synthetic
agccctgttgtagaacacatcagattgagaaatgctttccagactagggtcagggagaaaaacctaagggtagtg

SEQ ID NO: 16313 - DNA, 75 bp, Artificial Sequence
  Synthetic
tggatcaagcacatcctcaagatggactatagcaaagtcgcagtgcatgctgtgtcttcggactatgatgaattg

SEQ ID NO: 16314 - DNA, 75 bp, Artificial Sequence
  Synthetic
gaacccgtcaacatgcaaagtgaagttatgagaaattcttacacctgtgaattgaatctactcaaacaactcata

SEQ ID NO: 16315 - DNA, 75 bp, Artificial Sequence
  Synthetic
ttacattgtgtgatgctgaattcaaagacagggatgattttttcaagatggtgacactatggagaaagcatgttt

SEQ ID NO: 16316 - DNA, 75 bp, Artificial Sequence
  Synthetic
attgaatctactcaaacaactcataacaagaagtaaagacataagctcactcaaacttgacatgatatgtgactg

SEQ ID NO: 16317 - DNA, 75 bp, Artificial Sequence
  Synthetic
tgctgttgttatatgtgcggtgctagttttgatcttccttgttgctacgataggcttgtctgtgaagctggctgt

SEQ ID NO: 16318 - DNA, 75 bp, Artificial Sequence
  Synthetic
tcaaacttgacatgatatgtgactggttgcaattaaaatcaacatccgaaaatccatctgtcctaaagtttgtgg

SEQ ID NO: 16319 - DNA, 75 bp, Artificial Sequence
  Synthetic
cacaataaaagaaaggaatacttgccagctgaggctatcagagctgagcacaactacagcaccaatcctgagatc

SEQ ID NO: 16320 - DNA, 75 bp, Artificial Sequence
  Synthetic
gttgcaattaaaatcaacatccgaaaatccatctgtcctaaagtttgtggatgtaaggtgtattcctgactgggt

SEQ ID NO: 16321 - DNA, 75 bp, Artificial Sequence
  Synthetic
atgtaaggtgtattcctgactgggtgagcacttggtttagcagctggtacaatttaaacaaacttatattagagt

SEQ ID NO: 16322 - DNA, 75 bp, Artificial Sequence
  Synthetic
aacaaatcagccatatctaggagggtcaacaagcacacccaaactgacaactgttacatctattaccgatctcac

SEQ ID NO: 16323 - DNA, 75 bp, Artificial Sequence
  Synthetic
ttaggcgtgaagaagtagcctgcacaggatccatcatttgtaaaacaatagggagcataatgttcatcatttcat

SEQ ID NO: 16324 - DNA, 75 bp, Artificial Sequence
  Synthetic
ccaccagtgtcctcaaaggaaagagttatgcaatggaacaataacatacataaactctgatggatgcctagatga

SEQ ID NO: 16325 - DNA, 75 bp, Artificial Sequence
  Synthetic
catttgggtgtgttatcaaaagcaacaagagcaaaagaatcagctttatgacatacaatcaggtgctgacatgga

SEQ ID NO: 16326 - DNA, 75 bp, Artificial Sequence
  Synthetic
aaaagaaggagaatccattgactgtatagagctcgtagccagatgtgtggaaactctatgcgatcccaaccccaa

SEQ ID NO: 16327 - DNA, 75 bp, Artificial Sequence
  Synthetic
aggatgtcatgttaagcaggttcaatgcaaatctatgtgtgtggatcagtaacagtcttaacaaaaatcaagaag

SEQ ID NO: 16328 - DNA, 75 bp, Artificial Sequence
  Synthetic
ctacaaccactgtatgtgcaccaagaacagcactgggctctggtgttgttacaattagagaaggggtaaacccat

SEQ ID NO: 16329 - DNA, 75 bp, Artificial Sequence
  Synthetic
catgcgctcaaccactgcaaccagcatatgaatatatacatacaagtagattagttaattaaaatcaaaagacgg

SEQ ID NO: 16330 - DNA, 75 bp, Artificial Sequence
  Synthetic
gagattgttgactctatgctcagtgtttgcagcaatgaggggttcacccttgttaaagaatttgaaggattcata

SEQ ID NO: 16331 - DNA, 75 bp, Artificial Sequence
  Synthetic
tttgcagcaatgaggggttcacccttgttaaagaatttgaaggattcataatgagtgagattctgaaaataacag

SEQ ID NO: 16332 - DNA, 75 bp, Artificial Sequence
  Synthetic
gacaagtatccagatggggtcagagctctacatcatagagggggtgagctcatctgaaatagtcctcaagcaagt

SEQ ID NO: 16333 - DNA, 75 bp, Artificial Sequence
  Synthetic
atgagtgagattctgaaaataacagagcatgctcagtttagcacaaggttcagaaacactttgttgaatgggtta

SEQ ID NO: 16334 - DNA, 75 bp, Artificial Sequence
  Synthetic
agcatgctcagtttagcacaaggttcagaaacactttgttgaatgggttagtagaccaactggcaaagatgaagg

SEQ ID NO: 16335 - DNA, 75 bp, Artificial Sequence
  Synthetic
cctcagaaggagcaaaaaaatactgttaggactggtgttatcagccttaggcttgacgctcactagcactattgt

SEQ ID NO: 16336 - DNA, 75 bp, Artificial Sequence
  Synthetic
gtctaaacaggaaaagggtttcaggcactgtcttagaaggaaaccagtatccaatgtatgagacaacattagcca

SEQ ID NO: 16337 - DNA, 75 bp, Artificial Sequence
  Synthetic
tatatctatttgtattagtgtagaacaggtcaaattacgacagtgtgtggacacttattgggcggaaaatggatc

SEQ ID NO: 16338 - DNA, 75 bp, Artificial Sequence
  Synthetic
ccaatgtatgagacaacattagccacactaggggaagctttaaaaacaataagactcctggtaaacaagaactta

SEQ ID NO: 16339 - DNA, 75 bp, Artificial Sequence
  Synthetic
cttacatccaggacagtcaacagaaaatacttcaacaagaggtaagactacaacaaaagaccctagaagattaca

SEQ ID NO: 16340 - DNA, 75 bp, Artificial Sequence
  Synthetic
ggcgactggagcaggaaagtttgagagctgtgggtatgtgcaagttgttgatggtgatatgcatgatcgcagtta

SEQ ID NO: 16341 - DNA, 75 bp, Artificial Sequence
  Synthetic
gcagtcagacttaataatgagatcacaaaaattctgaaattagagagtcttacagagttgagaggggccttcatt

SEQ ID NO: 16342 - DNA, 75 bp, Artificial Sequence
  Synthetic
tgctgtactgggtggtgttgattgtttgggcttattggctctttgtgaatcaggaccaatttgtcagggagatac

SEQ ID NO: 16343 - DNA, 75 bp, Artificial Sequence
  Synthetic
ttaaggatcataaaaggctttgttgacacaaacaagagatggcctaaaatcaagaatctcaaagtgttgagcaga

SEQ ID NO: 16344 - DNA, 75 bp, Artificial Sequence
  Synthetic
acacaaacaagagatggcctaaaatcaagaatctcaaagtgttgagcagaaggtggattatgtactttaaagcta

SEQ ID NO: 16345 - DNA, 75 bp, Artificial Sequence
  Synthetic
ttggtctgaagacggaaacttctgccgatgcactttttcttcccatggggtgagttgctgcaaaaaacccaaaag

SEQ ID NO: 16346 - DNA, 75 bp, Artificial Sequence
  Synthetic
caaggcaaccactgcccagaggaactccaaaccagctaacagcaaatcaactcctccggtacattcagacagggc

SEQ ID NO: 16347 - DNA, 75 bp, Artificial Sequence
  Synthetic
ttgcaataccagagagaacaaatcttgagatggtcttgaatgataaggccatctcaccacccaaaaatttaatat

SEQ ID NO: 16348 - DNA, 75 bp, Artificial Sequence
  Synthetic
cagcaaagaacataatccctcccaaggggagcaaccccgcagggggccaaccagcagcaagacaactattgctag

SEQ ID NO: 16349 - DNA, 75 bp, Artificial Sequence
  Synthetic
tgagatggtcttgaatgataaggccatctcaccacccaaaaatttaatatggtcagtgttccctaaaaattatct

SEQ ID NO: 16350 - DNA, 75 bp, Artificial Sequence
  Synthetic
ggtcagtgttccctaaaaattatcttccaacaaacatcagggagaaattcactgaagaaatgttcaactcaagtg

SEQ ID NO: 16351 - DNA, 75 bp, Artificial Sequence
  Synthetic
caccccttcaacagaggacactgctaaaccaacgattagcaaacctaaactcaccatcaggccctcgcaaagagg

SEQ ID NO: 16352 - DNA, 75 bp, Artificial Sequence
  Synthetic
actgaagaaatgttcaactcaagtgaaaaactgaagacaagaagggtgttggagtattacttaaaagacaacaag

SEQ ID NO: 16353 - DNA, 75 bp, Artificial Sequence
  Synthetic
tccatccggcagcacaaaagcagcctccagcacccccagccacaagaccaacaccagaggcaccagcaagacgac

SEQ ID NO: 16354 - DNA, 75 bp, Artificial Sequence
  Synthetic
cgaccagagaccccgcaccggacccactcccgaaaggcccagacaaacccacagcacagcaactccgccccccac

SEQ ID NO: 16355 - DNA, 75 bp, Artificial Sequence
  Synthetic
acagggaaagaacgtgagttaagtgtgggaaggatgtttgcaatgcaaccaggaaaacaaaggcaagttcagatc

SEQ ID NO: 16356 - DNA, 75 bp, Artificial Sequence
  Synthetic
aaccccaatccacaagggccgggccccaacccccaaaccaacaacagacctcaaggtcaacccaagggaaggcag

SEQ ID NO: 16357 - DNA, 75 bp, Artificial Sequence
  Synthetic
ttagcagaaaggctacttgcagacaatatagtaccattcttccctgagacattgacaaaatatggtgatttagaa

SEQ ID NO: 16358 - DNA, 75 bp, Artificial Sequence
  Synthetic
atatagtaccattcttccctgagacattgacaaaatatggtgatttagaattacaaaggattatggaaataaagt

SEQ ID NO: 16359 - DNA, 75 bp, Artificial Sequence
  Synthetic
cacaagcccaactgcaatacagaaaaacccaaccacacaaagtaatcttgttgactgcacactgtctgatccaga

SEQ ID NO: 16360 - DNA, 75 bp, Artificial Sequence
  Synthetic
ctgagttgtcatcagtaaagtcacggagaaatgacagttacaacaattatattgccagagcatcaatagtgactg

SEQ ID NO: 16361 - DNA, 75 bp, Artificial Sequence
  Synthetic
tgagccacaaaggatttgttaccaggtaggaacttacaatcctagtcaatcgggaacctgcaacatagaggttcc

SEQ ID NO: 16362 - DNA, 75 bp, Artificial Sequence
  Synthetic
atcttagtaagtttaaccaggcttttcggtatgagacatcttctgtctgtgcagatgtagttgatgaattgcatg

SEQ ID NO: 16363 - DNA, 75 bp, Artificial Sequence
  Synthetic
aaaatgttccacttatgggcatgcttgtatggctacattatatgacaccccattcaactgctggcgcaggaccag

SEQ ID NO: 16364 - DNA, 75 bp, Artificial Sequence
  Synthetic
gagatgcatctgtgattccggaggggagctgattgagtggtgctgtactagtcaataaaaactaacctttgacat

SEQ ID NO: 16365 - DNA, 75 bp, Artificial Sequence
  Synthetic
ctaaaataaagcaaaaagaagaaaaaagaagaaagaaagaaagaaagaagaagaacagcacacaacagaaaggag

SEQ ID NO: 16366 - DNA, 75 bp, Artificial Sequence
  Synthetic
ggaccaatatggacccatccaatgagcacacggtgaatgtgtatctgcctgactcctatttaaaaggagtcatct

SEQ ID NO: 16367 - DNA, 75 bp, Artificial Sequence
  Synthetic
ttagatgtggtatcagtcaaaaaccgtgtccaactaacatcattgttaaatggagataatcaatctattgatgtt

SEQ ID NO: 16368 - DNA, 75 bp, Artificial Sequence
  Synthetic
ctttcagcgaaacaaatgcaattggatcttgcattataggtcgaccatacctaaaggatgactacactgctcatg

SEQ ID NO: 16369 - DNA, 75 bp, Artificial Sequence
  Synthetic
ttgcaaccacaagtcctgtcattgagcatcaaagattaaaaggcttatttagtagtctaacaatcagcaagaact

SEQ ID NO: 16370 - DNA, 75 bp, Artificial Sequence
  Synthetic
gaaataagaaatgcttacaaagatatagggcacaagttaaaagagggagagacatatatatctagagacctacaa

SEQ ID NO: 16371 - DNA, 75 bp, Artificial Sequence
  Synthetic
atcagtttgttgaacccctcatgatgcagaatgagctgctcaagatctctgccggtacaaaactcaagaagctaa

SEQ ID NO: 16372 - DNA, 75 bp, Artificial Sequence
  Synthetic
aaggtgtgatgcatccatcaccgataaagaagattttgagggttggaccatggattaatactatcctagatgaca

SEQ ID NO: 16373 - DNA, 75 bp, Artificial Sequence
  Synthetic
agaaatggctaggccgaagcaaagatattagtgagatcaagctgaagatggttgcagactggctcaaacttgcac

SEQ ID NO: 16374 - DNA, 75 bp, Artificial Sequence
  Synthetic
tcaaaaccagtgcagagtcaataggaagcctgtgtcaagagttagagtttagaggcgaaagcctcttggtcagcc

SEQ ID NO: 16375 - DNA, 75 bp, Artificial Sequence
  Synthetic
atactcctgggaaagggaaagtgattgactgtatccaggtagacaacctacctgaatggctagagcaatggtttg

SEQ ID NO: 16376 - DNA, 75 bp, Artificial Sequence
  Synthetic
tcatcctaaggaatttttggctatatgaattatggatgcatgaatctaaaagtcatccacttgcagggaagcagc

SEQ ID NO: 16377 - DNA, 75 bp, Artificial Sequence
  Synthetic
attcatggttgatgcttaatgaactggtacaagcttataggtgcctggaagtgtcacagaccagtgctatcctcc

SEQ ID NO: 16378 - DNA, 75 bp, Artificial Sequence
  Synthetic
tatacagacagctgagcaagacattagcaataactcaaaagttctttggaataacaaaagaaactgatgttgtta

SEQ ID NO: 16379 - DNA, 75 bp, Artificial Sequence
  Synthetic
gtaaaagctgttggaatttcttctttgctatatcatcatttggctgcatcttgataagccggaaaagtaaaagga

SEQ ID NO: 16380 - DNA, 75 bp, Artificial Sequence
  Synthetic
atctgtggatgaatgttccaatgcagtttggtggaggtgatcctgtggtgctatataggtcattttaccggagga

SEQ ID NO: 16381 - DNA, 75 bp, Artificial Sequence
  Synthetic
tttgtttctgcacctataaccagttcttgacatggaaagatttggcacttagcaggttcaatgctaacctgtgtg

SEQ ID NO: 16382 - DNA, 75 bp, Artificial Sequence
  Synthetic
caccagatttcttgactgaagcagttagccatatgagtgtactactcaaagtgtatgggaaagcaaaagagggat

SEQ ID NO: 16383 - DNA, 75 bp, Artificial Sequence
  Synthetic
tctgggttagcaactgtttaaatagtactcaagaaggactaggactccggagcaaactcgttggagaactcctaa

SEQ ID NO: 16384 - DNA, 75 bp, Artificial Sequence
  Synthetic
attatcagtggacaaaaacaagagggctactctgaccacattaatgagagaccctcaagcagtgggatcagagag

SEQ ID NO: 16385 - DNA, 75 bp, Artificial Sequence
  Synthetic
atcgattatatcatgagactgatgagttgttgagtggtactggcaatgaaggattctggatagttaaggaattcg

SEQ ID NO: 16386 - DNA, 75 bp, Artificial Sequence
  Synthetic
acaggcaagagttactagtgaaataaatagagcagcagtcacaagtgtcctgagcctatcacctaatcagctttt

SEQ ID NO: 16387 - DNA, 75 bp, Artificial Sequence
  Synthetic
agggattcatcatgagtgaaattctgaggataactgaacatgcacagtttagtgtacgctttaggaacacactat

SEQ ID NO: 16388 - DNA, 75 bp, Artificial Sequence
  Synthetic
taaatggaatcgtagaaaaaattgggaaaatgcgtattgcctacagtcagcgaacttctaacactgccatagaaa

SEQ ID NO: 16389 - DNA, 75 bp, Artificial Sequence
  Synthetic
atcatagatatcccggagagcaaagtttgttggagaaaacaggaagagtgctcaagattataaagctactagtcc

SEQ ID NO: 16390 - DNA, 75 bp, Artificial Sequence
  Synthetic
gagtcattgccattccacaaggcagaaaaagttgtaaacatgatatctggaacaaaatctatcacaaacttacta

SEQ ID NO: 16391 - DNA, 75 bp, Artificial Sequence
  Synthetic
aaaacgatatgtccaatgctgcagagatgtattttatctttagaatattcggtcaccctatggtagaagaaaggg

SEQ ID NO: 16392 - DNA, 75 bp, Artificial Sequence
  Synthetic
caaaggacatcagcaatcaatggagaagacattgatagagcagtctcaatgatgttggagaatctagggttgctc

SEQ ID NO: 16393 - DNA, 75 bp, Artificial Sequence
  Synthetic
aggccatggatgctgttcgggagaacagtgaggccactaaaatattgagcctcagggctctgacagagatgagag

SEQ ID NO: 16394 - DNA, 75 bp, Artificial Sequence
  Synthetic
tctaggatactatctgtgtgccaagatgatataaccttacctaccaaagcgaatggtgatctgatatgttgtcaa

SEQ ID NO: 16395 - DNA, 75 bp, Artificial Sequence
  Synthetic
gagcttttatcctaagagtgatcaaaggttttgtaacaaattacaagaggtggccaagaataaagaacccttcta

SEQ ID NO: 16396 - DNA, 75 bp, Artificial Sequence
  Synthetic
cattgagtggcaggtggcgaatgtatatgagggctaaaacatatcctagtcaacttgagctatgtgctgaagact

SEQ ID NO: 16397 - DNA, 75 bp, Artificial Sequence
  Synthetic
tcttagagttagcaggtatcagcttctgccaagaattctatgtccctaacaggactagcctagaaatggtactca

SEQ ID NO: 16398 - DNA, 75 bp, Artificial Sequence
  Synthetic
gtccttgggttgggtccagcacacaagagaaaaaattggttcctgtttacaacaggcaaatcctctcaaagcagc

SEQ ID NO: 16399 - DNA, 75 bp, Artificial Sequence
  Synthetic
atgacaaggcaatctcccctccaaagtctttgatctggtctgtatatccaaaaaattatttacctccttctgtac

SEQ ID NO: 16400 - DNA, 75 bp, Artificial Sequence
  Synthetic
agaaagaacaactagaggcaatcggaaaactaagatgggtttataaggggactcaagggttaaggagattgttag

SEQ ID NO: 16401 - DNA, 75 bp, Artificial Sequence
  Synthetic
aggagcaatttcggttagaatccctggggaaagcagaacatgaaaaaactcgacgtgtactagagttttacttga

SEQ ID NO: 16402 - DNA, 75 bp, Artificial Sequence
  Synthetic
ataaaatctgcatagggagcttagggatcagttacaagaatgttaagccactcttgccaagatttatgagtgtta

SEQ ID NO: 16403 - DNA, 75 bp, Artificial Sequence
  Synthetic
aggatgccaactttaaccaggagaacttgaagaagtatgtagtgttacagcactaccttaatgataaagagcatg

SEQ ID NO: 16404 - DNA, 75 bp, Artificial Sequence
  Synthetic
ctcttgccaagatttatgagtgttaacttcctacacagactttccgtcagtagtagaccaatggaattcccagca

SEQ ID NO: 16405 - DNA, 75 bp, Artificial Sequence
  Synthetic
ttgtctctttgactggaaaagaaagggaattaagtgtggggaggatgtttgccatgcagccaggaaaacaaagac

SEQ ID NO: 16406 - DNA, 75 bp, Artificial Sequence
  Synthetic
aagtgcagatacttgcagaaaaactgttatctgataatatagtaccatttttcccagaaactcttacaagatatg

SEQ ID NO: 16407 - DNA, 75 bp, Artificial Sequence
  Synthetic
gggaatgaggacatcaacttggtgtttcaaaatgctatcagctgtgggataagtgtgatgagtgtagtggaacaa

SEQ ID NO: 16408 - DNA, 75 bp, Artificial Sequence
  Synthetic
gagacctggagttacaaagaattatggagcttaaatctgaactatcttcagtgaaagctaggaagagtgatagct

SEQ ID NO: 16409 - DNA, 75 bp, Artificial Sequence
  Synthetic
cttacaggcagaagccctaaacaattagtaatgattccccaactagaagaaattgacataatgcctccgcctgtc

SEQ ID NO: 16410 - DNA, 75 bp, Artificial Sequence
  Synthetic
acaacaattatatagctcgggcatcaatagtaacagatcttagcaagttcaaccaagcatttcggtatgaaacaa

SEQ ID NO: 16411 - DNA, 75 bp, Artificial Sequence
  Synthetic
catcagtttgtgctgatgttgccgacgagctccatggtactcagagcctattttgctggttacatttaacagtct

SEQ ID NO: 16412 - DNA, 75 bp, Artificial Sequence
  Synthetic
gacttagtgactctaggtaaaatgttaatgccttcaacaagtggagcaaagtctgaccaattttggaacagaaaa

SEQ ID NO: 16413 - DNA, 75 bp, Artificial Sequence
  Synthetic
ccgccaccactatgatatgcacttataggcatgcaccacctgacaccaaagggatttatgatattgactcaatcc

SEQ ID NO: 16414 - DNA, 75 bp, Artificial Sequence
  Synthetic
gaaaacttctttcatggcaacaatttggtagagtctctatctgcagcattggcttgtcattggtgcgggatctta

SEQ ID NO: 16415 - DNA, 75 bp, Artificial Sequence
  Synthetic
ctgagcagagtgggttgtatagataccacatgggaggaattgaggggtggtgtcaaaaaatgtggaccatggagg

SEQ ID NO: 16416 - DNA, 75 bp, Artificial Sequence
  Synthetic
actgaacagtgtaacgagaacaatatttttagaagagaatggggtgatggttttgttacggatcatgccttcata

SEQ ID NO: 16417 - DNA, 75 bp, Artificial Sequence
  Synthetic
caatatctctccttgatgttgtgtcggttaagaacagggttcagctaacatcactcctaaatggtgacaatcagt

SEQ ID NO: 16418 - DNA, 75 bp, Artificial Sequence
  Synthetic
gggatccagggggggagatattaaagatagagacatgatagatgaatctattgacaaattaataagagttgacaa

SEQ ID NO: 16419 - DNA, 75 bp, Artificial Sequence
  Synthetic
ccatagatgttagtaaacctgtgaggcttattggtactcagactgagatacaagcagactacagtttagcaataa

SEQ ID NO: 16420 - DNA, 75 bp, Artificial Sequence
  Synthetic
ctcgttctggaggatgtttagtaaagtgatacttgaacctaaagtgagaaaaagggtaatgctttttgatgtgaa

SEQ ID NO: 16421 - DNA, 75 bp, Artificial Sequence
  Synthetic
aaatgttgactgcagtcagggatgcttattctgacatagggcacaaattaaaagaaggtgaaacttatgtgtcaa

SEQ ID NO: 16422 - DNA, 75 bp, Artificial Sequence
  Synthetic
aaagggtaatgctttttgatgtgaaaatcctatcacttgtaggctatgcaggatttaaaaattggtttattgatc

SEQ ID NO: 16423 - DNA, 75 bp, Artificial Sequence
  Synthetic
gggatctgcaattcatgagtaagactatacagtctgaaggggtcatgtacccagcctcaattaagagagttttga

SEQ ID NO: 16424 - DNA, 75 bp, Artificial Sequence
  Synthetic
ggatttaaaaattggtttattgatcacctgagatctagtgacttgtgtgaagtgccatgggttgtcaatgctgat

SEQ ID NO: 16425 - DNA, 75 bp, Artificial Sequence
  Synthetic
acctgagatctagtgacttgtgtgaagtgccatgggttgtcaatgctgatagtgaagttgtagaggtgtctgctg

SEQ ID NO: 16426 - DNA, 75 bp, Artificial Sequence
  Synthetic
gagttggcccatggataaacactatactagacgatatcaagacaagcatggaagccataggtagcctttgtcagg

SEQ ID NO: 16427 - DNA, 75 bp, Artificial Sequence
  Synthetic
agtgagttctcctttgagaatcacagtgttaaattattcagacatggcccatgctatcaccaggctaataagaag

SEQ ID NO: 16428 - DNA, 75 bp, Artificial Sequence
  Synthetic
agttggagttccggggggaatcatttactacaagcttgataatacggaatttttggttatatgtccaatgttttg

SEQ ID NO: 16429 - DNA, 75 bp, Artificial Sequence
  Synthetic
atgctatcaccaggctaataagaaggaaatcaatgcatgatagtgtaccttcaatatctaggacactgtcacctg

SEQ ID NO: 16430 - DNA, 75 bp, Artificial Sequence
  Synthetic
tagaagcaaagagacacagtttagcaggtagtcagatatctaatgaattaaatagaacacttacccaagtaatga

SEQ ID NO: 16431 - DNA, 75 bp, Artificial Sequence
  Synthetic
tcaatatctaggacactgtcacctgcagagttagctcctgtagttgaaccaactgtgcagatgaacttgttccct

SEQ ID NO: 16432 - DNA, 75 bp, Artificial Sequence
  Synthetic
cagagttagctcctgtagttgaaccaactgtgcagatgaacttgttccctaaaatcacatttgaaagattgaaga

SEQ ID NO: 16433 - DNA, 75 bp, Artificial Sequence
  Synthetic
aatttttccaagtaggcagtgagtcagacacagtaaatctttatatgaatataccgatgcagctgggaggcggag

SEQ ID NO: 16434 - DNA, 75 bp, Artificial Sequence
  Synthetic
aaaatcacatttgaaagattgaagaattacgaaactgtgtcaggatctaccagaggaaagttgacaagaaattac

SEQ ID NO: 16435 - DNA, 75 bp, Artificial Sequence
  Synthetic
attacgaaactgtgtcaggatctaccagaggaaagttgacaagaaattacatggtaatgctgccttggcagcata

SEQ ID NO: 16436 - DNA, 75 bp, Artificial Sequence
  Synthetic
accctgttgttgtgtataggagcttctataggcggacacctgacttcctaacggaagtactaactcatgtagagt

SEQ ID NO: 16437 - DNA, 75 bp, Artificial Sequence
  Synthetic
tcaatagattcaattttgtattcagctctaccggttgcaaaataagtgtcaaagcatgtattggaaagttgattc

SEQ ID NO: 16438 - DNA, 75 bp, Artificial Sequence
  Synthetic
tgttactgacatcacttaatgttgatagaggtgtttacatgaggttcttcctcacactaatgaacacctgcaaaa

SEQ ID NO: 16439 - DNA, 75 bp, Artificial Sequence
  Synthetic
aagacttaaatccgacagttttttattttgtgggagaaggagccggcaattggatggcaagaacagcttgtgagt

SEQ ID NO: 16440 - DNA, 75 bp, Artificial Sequence
  Synthetic
acgacaatgcaacattaactacactcatgagagatcctcaggctattgggtcggaaaggcaggctaaaattacaa

SEQ ID NO: 16441 - DNA, 75 bp, Artificial Sequence
  Synthetic
tggatggcaagaacagcttgtgagtatccaaatgcaaaatttgtttacaggagccttaaagatgatttggatcat

SEQ ID NO: 16442 - DNA, 75 bp, Artificial Sequence
  Synthetic
gtgagatcaatcgtacagcagtcacaagtgtgctaagcctggctcctaaccagctttttagtgatagtgcagtac

SEQ ID NO: 16443 - DNA, 75 bp, Artificial Sequence
  Synthetic
catttccctttggagtttcagagagtcctggggaacatgaacagagttatagatggtggagaaggcctgtctatg

SEQ ID NO: 16444 - DNA, 75 bp, Artificial Sequence
  Synthetic
attttagccagaatgaggaagaaattggtactgttatgcaagatgtagggcctgtataccctcatggcttaaggg

SEQ ID NO: 16445 - DNA, 75 bp, Artificial Sequence
  Synthetic
gacacaacagatgcaactcagaaaactcattgggatctgatacatagaatttgtaaagatgcactgctaattaca

SEQ ID NO: 16446 - DNA, 75 bp, Artificial Sequence
  Synthetic
tcatatatgaagcattcccattccacaaagctgaaaaagtagttaacatgatagcaggtaccaaatctattacaa

SEQ ID NO: 16447 - DNA, 75 bp, Artificial Sequence
  Synthetic
gggatgattttttcaagatggtgacactatggagaaagcatgttttgtcgtgtagaatatgtacaacctatggac

SEQ ID NO: 16448 - DNA, 75 bp, Artificial Sequence
  Synthetic
atatattgcaaaggacatccgccataagtggtttagacattgatagagcagttcatatgatgttgctcaatctag

SEQ ID NO: 16449 - DNA, 75 bp, Artificial Sequence
  Synthetic
cagatctctacctgtttgcgaaatatcatgcaaaagagcaaagcataaaacttccctattttgttagatcaattg

SEQ ID NO: 16450 - DNA, 75 bp, Artificial Sequence
  Synthetic
gactgttagggaggatactagagtcaggacctgtcacagacaccattgagttgcgtcacaacaataggatacttt

SEQ ID NO: 16451 - DNA, 75 bp, Artificial Sequence
  Synthetic
tcatgcaaaagagcaaagcataaaacttccctattttgttagatcaattgctacatatgtcatgcaaggcagtaa

SEQ ID NO: 16452 - DNA, 75 bp, Artificial Sequence
  Synthetic
ctacatatgtcatgcaaggcagtaaactgtcaggatccgagtgttatgtccttctaacacttggccaccacaaca

SEQ ID NO: 16453 - DNA, 75 bp, Artificial Sequence
  Synthetic
gttgtcaattatcaaagcgcatacgggaaacatcatgggacggaatagaaattgtaggagtgtcatcccctagta

SEQ ID NO: 16454 - DNA, 75 bp, Artificial Sequence
  Synthetic
cttctaacacttggccaccacaacaacctaccatgtcacggggaggtacagagctccaaattaaaaatggctgtg

SEQ ID NO: 16455 - DNA, 75 bp, Artificial Sequence
  Synthetic
tgttatcatgcttggatataaactatgtgacagcagcacagaggccaggagtattaatagagaagttctcggcag

SEQ ID NO: 16456 - DNA, 75 bp, Artificial Sequence
  Synthetic
tgcaatgatttcagcattcctaggaaggtagaagtgaaggctgttgaggcaaactgcaaatctctgctttccggc

SEQ ID NO: 16457 - DNA, 75 bp, Artificial Sequence
  Synthetic
aaaagactacaagagggaagagagggcctaaggctccatgggttggatctagcacgcaggagaaaaaattaacag

SEQ ID NO: 16458 - DNA, 75 bp, Artificial Sequence
  Synthetic
ctaaggacacctataaatagggcagaattagatcgacaaaagaagatgttgacactaagaagttatcattcatca

SEQ ID NO: 16459 - DNA, 75 bp, Artificial Sequence
  Synthetic
gacactaagaagttatcattcatcagttgcaacagttggaggcagcagggtcatagaatcaaaatggttgagcaa

SEQ ID NO: 16460 - DNA, 75 bp, Artificial Sequence
  Synthetic
cagtgtacaacaggcaagccttatcaaaagagcagagagatcagttagaaacaataggtaagattagatgggtgt

SEQ ID NO: 16461 - DNA, 75 bp, Artificial Sequence
  Synthetic
gaaagctaccactataattgaatggttagaacatatcttgaattccccaaaaggggagttaaactatgatttttt

SEQ ID NO: 16462 - DNA, 75 bp, Artificial Sequence
  Synthetic
acagaggggtaacaggactacggagacttttagatctagtctgcatgggaaccttaggacttccctacaagctga

SEQ ID NO: 16463 - DNA, 75 bp, Artificial Sequence
  Synthetic
aaggggagttaaactatgatttttttgaggcactagagaacacctatccaaatatggttaaattactagataatc

SEQ ID NO: 16464 - DNA, 75 bp, Artificial Sequence
  Synthetic
taaaacccctgttgccaagattcatgagtgtcaatttcctgcatcgtcttgcagtgagcagtagaccgatggagt

SEQ ID NO: 16465 - DNA, 75 bp, Artificial Sequence
  Synthetic
ttggcagtgctgaacttaaaaagctaatcaaagtgacaggttacatgctgatgagtaagaaatgatggaaggaaa

SEQ ID NO: 16466 - DNA, 75 bp, Artificial Sequence
  Synthetic
ttccttcatcagtcccagcataccgcacaactaatttccactttgacacaagccctatcaacaaaagacttagtg

SEQ ID NO: 16467 - DNA, 75 bp, Artificial Sequence
  Synthetic
ttaccttaagaaattacttatagtgaaggcttaaaacttacatatccgtgctgaagaatactaaagtgatagtta

SEQ ID NO: 16468 - DNA, 75 bp, Artificial Sequence
  Synthetic
agagatttggaaatgaggacattaacttggtcttccaaaatgctataagctgtgggattagtgtcatgtgtatag

SEQ ID NO: 16469 - DNA, 75 bp, Artificial Sequence
  Synthetic
cttaaatttagtaatctgaatatgaagcgcacaactagcaattagttatttaaaaatgagaaactaaaattggat

SEQ ID NO: 16470 - DNA, 75 bp, Artificial Sequence
  Synthetic
tggagcaattaacggggaagagcccaaagttagtcgtgctagagccaattgtggaagatatagacataatgtctg

SEQ ID NO: 16471 - DNA, 75 bp, Artificial Sequence
  Synthetic
acgagaaaaaaacgcattcaagcaggttctagaaaaataatgggacaagtcaaaaatgtctcttgaaagtattag

SEQ ID NO: 16472 - DNA, 75 bp, Artificial Sequence
  Synthetic
tatgaagcgcacaactagcaattagttatttaaaaatgagaaactaaaattggatgaatacggtttttttgccgt

SEQ ID NO: 16473 - DNA, 75 bp, Artificial Sequence
  Synthetic
ctcctaatttccaagggagggtaaatttcaagagtgtgaagaaaattgtggctgatcagcacatcttcaaccctg

SEQ ID NO: 16474 - DNA, 75 bp, Artificial Sequence
  Synthetic
actcagtgacttggagtacaaacatgcaattcttgaagactctcagtatacaattagaagggatgttggtgctac

SEQ ID NO: 16475 - DNA, 75 bp, Artificial Sequence
  Synthetic
atcatatcagcctcacaatgctggggagactcttactgcccactataagaagcaactcaaatgcagagagaattg

SEQ ID NO: 16476 - DNA, 75 bp, Artificial Sequence
  Synthetic
cactgcgatcacaccttccgaactgcagccgcaagtatccacattatgcggtatggtgttgtttgcaaaacacac

SEQ ID NO: 16477 - DNA, 75 bp, Artificial Sequence
  Synthetic
caactgagaatttctttaatgggaacaacatagtagaggtgctatccagttgccttgcatgccattggtgtacaa

SEQ ID NO: 16478 - DNA, 75 bp, Artificial Sequence
  Synthetic
cgactatgagcctgcagcagaggtaggcatgcagtacattagtactgctctaggagctgatagaactcaacaaat

SEQ ID NO: 16479 - DNA, 75 bp, Artificial Sequence
  Synthetic
ttttgttgctcctcaccatggagaatagtattttccagaaagagtggggtgatgggtttgttacagaccatgctt

SEQ ID NO: 16480 - DNA, 75 bp, Artificial Sequence
  Synthetic
actgaaaaattccggtagtgaagtacagggtgttatgaccaagattgtaacactttcggcagagggttctgtcag

SEQ ID NO: 16481 - DNA, 75 bp, Artificial Sequence
  Synthetic
ttataaactttacatggttcctgatgagcttcaaaacatatttgctctgccactgggggagtgacgatgaaggag

SEQ ID NO: 16482 - DNA, 75 bp, Artificial Sequence
  Synthetic
aaagcgagaggtgctaaacattcacgatgtgggtgttgggtgggctgatgatgtcgaaaggactacaagagaagc

SEQ ID NO: 16483 - DNA, 75 bp, Artificial Sequence
  Synthetic
agctagacattgtagaagacccaattgacaggctagctagaatagacaatagtttttggcgtatgatgagcaagg

SEQ ID NO: 16484 - DNA, 75 bp, Artificial Sequence
  Synthetic
aatgggagcaatggttagggataaagtgcaactcacaaagaatcaaaagccgtctgccttggatgctcccgttat

SEQ ID NO: 16485 - DNA, 75 bp, Artificial Sequence
  Synthetic
ttttccttgaaccaaaagtcaagagacgattgatgctgtatgacaccacaatcctaaatgtctttggcagtatca

SEQ ID NO: 16486 - DNA, 75 bp, Artificial Sequence
  Synthetic
tctattatgcattggtgccctcattttcaccaagttggcctcaactgttgaagtaggccttgaaactgctatccg

SEQ ID NO: 16487 - DNA, 75 bp, Artificial Sequence
  Synthetic
gttttaaaaactggttcattgggaagcttaggtcagcagattatacagaaataccttggatagtaaatgcagaag

SEQ ID NO: 16488 - DNA, 75 bp, Artificial Sequence
  Synthetic
gcgtgcctcaagggtattaagcgatgccatatcacggtaccccaggatggacataccaaggattgccaaatcatt

SEQ ID NO: 16489 - DNA, 75 bp, Artificial Sequence
  Synthetic
gagacattgtggaacagaggcccgtcacggagtacctcaaaaccatggcagctgggactaatgtcaaagtgataa

SEQ ID NO: 16490 - DNA, 75 bp, Artificial Sequence
  Synthetic
ctttgaattgtttgagaagaaggtgtattacagaaatctatttattgaatacggtaaggcactcggaagtacatc

SEQ ID NO: 16491 - DNA, 75 bp, Artificial Sequence
  Synthetic
tgctgagttactcagacatggcacatgctatgacacggctgcttagatgcaaaaacatgcaggacaatgttccga

SEQ ID NO: 16492 - DNA, 75 bp, Artificial Sequence
  Synthetic
caccggaagcaggatggagagcctgtttgtgaatatttttatgcaagcttatggggcagggcaaacaatgctgcg

SEQ ID NO: 16493 - DNA, 75 bp, Artificial Sequence
  Synthetic
ccattaagaaggcagctaccccaaccgatgttacaccagctgtggacccaacaagagctttgttgttgtacccta

SEQ ID NO: 16494 - DNA, 75 bp, Artificial Sequence
  Synthetic
ctggggtgtcattgcacgatcctccaacaatataatgttgggccatgtatctgtccaagctgagttgaggcaagt

SEQ ID NO: 16495 - DNA, 75 bp, Artificial Sequence
  Synthetic
aagttacctttagcaaactgacaactttcaatgcggcatgtactagcctacgacaacccgggggaaacttgtcca

SEQ ID NO: 16496 - DNA, 75 bp, Artificial Sequence
  Synthetic
atctgaggtctatgacctagtgaggaaaatgggacctgagtcagggttactacacttacgccagagtcccaaagc

SEQ ID NO: 16497 - DNA, 75 bp, Artificial Sequence
  Synthetic
aaaatcacataactttgctgccttggcaccatgtgaaccgatacaatttcgtgcatagttctacagggtgcaagg

SEQ ID NO: 16498 - DNA, 75 bp, Artificial Sequence
  Synthetic
gggtcttttatcattgaccaactgtcccaattttgccagtgttgtcctcgggaacgccgccgggcttggtattat

SEQ ID NO: 16499 - DNA, 75 bp, Artificial Sequence
  Synthetic
tcagcataagaagctgcctcggtaaattggtggcaaaactagacctcagagttatttactttattggtgaaggtg

SEQ ID NO: 16500 - DNA, 75 bp, Artificial Sequence
  Synthetic
aggcatgtacaaaggtcgagcccccaaccttgagctgtttgctgctgctgaaagttatgcacggacattgagaga

SEQ ID NO: 16501 - DNA, 75 bp, Artificial Sequence
  Synthetic
cagggaacttgatgtcaaggacagcatgtgaatatcctggcttaaaatttgtctacaggagcctaaaagatgcta

SEQ ID NO: 16502 - DNA, 75 bp, Artificial Sequence
  Synthetic
gaacaacaagatcaacctagcggccttagggctcactgatgatgagagggaagcagcaacatcctacctaggggg

SEQ ID NO: 16503 - DNA, 75 bp, Artificial Sequence
  Synthetic
acgatcatcaccaccccacagaatatgtgcgtgtcatggggagcatcagcagaatagtggacttgggtgaggggt

SEQ ID NO: 16504 - DNA, 75 bp, Artificial Sequence
  Synthetic
aagcagcaacatcctacctagggggagatgatgagagatcatccaaatttgagtaattaaaaaaatatgggacaa

SEQ ID NO: 16505 - DNA, 75 bp, Artificial Sequence
  Synthetic
gtaacaatgtctttccctgaaggcaaggatattctaatgatgggcagcgaggctgcaaaaatggccgatgcctat

SEQ ID NO: 16506 - DNA, 75 bp, Artificial Sequence
  Synthetic
tagctatggaagcaactgatgccacaaggagagagcattgggatttcatacacagggtgagcaaagaacccttgt

SEQ ID NO: 16507 - DNA, 75 bp, Artificial Sequence
  Synthetic
caaagatcactaaggaacacctctgctggaggtcgttctattagtggggagcctattaacacaattgctgaaaag

SEQ ID NO: 16508 - DNA, 75 bp, Artificial Sequence
  Synthetic
tactgacagtgtgtgatgctgaactcaaagaccctgataatgtacttttattaatcatacagtggagaaagcatg

SEQ ID NO: 16509 - DNA, 75 bp, Artificial Sequence
  Synthetic
gtgccattaccccctttgtgcaaccccaccacaccaaagggatcatgtataaaacctaacaaagctcctgtcccc

SEQ ID NO: 16510 - DNA, 75 bp, Artificial Sequence
  Synthetic
tgctttcatgtaaaatatgcacatcatacgggacaagtgtgtacatgctgatcaaatatcatgcccagcaagagc

SEQ ID NO: 16511 - DNA, 75 bp, Artificial Sequence
  Synthetic
aaggtcaaagaaatagaatctatatatccaaaactcccgactgctccagttgccactgacactgagacttctacc

SEQ ID NO: 16512 - DNA, 75 bp, Artificial Sequence
  Synthetic
caaaaaaactcccacattttgtacgggtggtttctatatacgttatgcagggtagtaaagtctccggttcagagt

SEQ ID NO: 16513 - DNA, 75 bp, Artificial Sequence
  Synthetic
agtactgagtctgcagaaaagtctaaaaaggtcaagtttgacaaccccaaagtaggaaaatatactaaactggaa

SEQ ID NO: 16514 - DNA, 75 bp, Artificial Sequence
  Synthetic
gttatctgctcattactctcggacatcagaacacagctccttgctatggagaggtgcgtgctgcaaagtcagtaa

SEQ ID NO: 16515 - DNA, 75 bp, Artificial Sequence
  Synthetic
gaagaggcactagagctgttgtcagatcctgaagaagataatgatgaaaagtcatcaatattgacatttgaagaa

SEQ ID NO: 16516 - DNA, 75 bp, Artificial Sequence
  Synthetic
tggctctcactgaagtctacaagaatcctataaggctagacaagatagctgtcgaaatcaatctaaagtctttag

SEQ ID NO: 16517 - DNA, 75 bp, Artificial Sequence
  Synthetic
aaagatacagcatctacctctattgaagcaagattagaagcaatagaagaaaagttgagcatgatattgggcatg

SEQ ID NO: 16518 - DNA, 75 bp, Artificial Sequence
  Synthetic
ccccagggttatctttaccaatcacagaggtaagcatgttgaagtacctttcaaacctaacacacttggacaact

SEQ ID NO: 16519 - DNA, 75 bp, Artificial Sequence
  Synthetic
ctcaaaacattgaatattgcaactgctggcccaaccgccgccagagatgggatacgtgatgcaatgatagggatg

SEQ ID NO: 16520 - DNA, 75 bp, Artificial Sequence
  Synthetic
ccaagaatattagtgccaccattgggggcagcagagttgtagaaaagaaatgggcaatgtgcaaagttgcaaatg

SEQ ID NO: 16521 - DNA, 75 bp, Artificial Sequence
  Synthetic
agagaagagctgatcaacagcatcatgacagaggctaaagacaaaattgcagaaatgatgaaagaagaggacacc

SEQ ID NO: 16522 - DNA, 75 bp, Artificial Sequence
  Synthetic
tgacagaggctaaagacaaaattgcagaaatgatgaaagaagaggacacccagagggcaaaaataggagatggta

SEQ ID NO: 16523 - DNA, 75 bp, Artificial Sequence
  Synthetic
ttgtaagatggctatgtcatgtcagtaggatgcccaaaggcgacctgaattatgatttctttgaagtaatcgaga

SEQ ID NO: 16524 - DNA, 75 bp, Artificial Sequence
  Synthetic
gcacctatccagatatggtgaaattgctagacaaccttaactcttcagagttgaagaaactagtgaaagtgacag

SEQ ID NO: 16525 - DNA, 75 bp, Artificial Sequence
  Synthetic
gcgtgaagcttaccgaaaaagccaaagagttgaacaaaatcctagaagaccagagctcaagtggagagtcagaga

SEQ ID NO: 16526 - DNA, 75 bp, Artificial Sequence
  Synthetic
ggtacatactgagcacaaaatagaccataaagaatgattacacagtcgtatacagcaggtaagttgtaactaaaa

SEQ ID NO: 16527 - DNA, 75 bp, Artificial Sequence
  Synthetic
gtgaagaagagagtggagagtctgaatctgatgaggaagagagcgacatatacaatcttgatctgtagttatgaa

SEQ ID NO: 16528 - DNA, 75 bp, Artificial Sequence
  Synthetic
atccaataggaaaaaggggtgcattagttataaaaaacaaaaaacaaaaattaaaaatgtattgaatacggtttt

SEQ ID NO: 16529 - DNA, 75 bp, Artificial Sequence
  Synthetic
aaaatgggacaagtcaaaatggagtcctatataattgacacttatcagggggttccctacactgcagccgttcag

SEQ ID NO: 16530 - DNA, 75 bp, Artificial Sequence
  Synthetic
ggaaaaaggggtgcattagttataaaaaacaaaaaacaaaaattaaaaatgtattgaatacggtttttttgccgt

SEQ ID NO: 16531 - DNA, 75 bp, Artificial Sequence
  Synthetic
gttgacctcattgaaaaagactctaaccctgcaacactgactgtatggtttcccctattccagtcaagtacgcct

SEQ ID NO: 16532 - DNA, 75 bp, Artificial Sequence
  Synthetic
attaatcttcacgaagctggcatcaacaatcgaagttgggctggagacagctgttagaagggcaaaccgtgtgct

SEQ ID NO: 16533 - DNA, 75 bp, Artificial Sequence
  Synthetic
gaatgatgcattgaaaaggttcccaaggattgacatccccaaaattgcgaggtccttttatgatctgtttgagca

SEQ ID NO: 16534 - DNA, 75 bp, Artificial Sequence
  Synthetic
gccccagtgttattagatcaactgaaaactttatcaatcaccacccagtacacagcatccccggaaggccctgtg

SEQ ID NO: 16535 - DNA, 75 bp, Artificial Sequence
  Synthetic
ctccaagtcaatgcagcagcccaaggtgccgccatgtctgcactacctaagaaatttgccgtcagtgctgcagta

SEQ ID NO: 16536 - DNA, 75 bp, Artificial Sequence
  Synthetic
agttagagagatgggccctgagtcaggtcttcttcacctgaggcaaaaccctaaggcagggttgttgtcacttgc

SEQ ID NO: 16537 - DNA, 75 bp, Artificial Sequence
  Synthetic
gcacttgacgagtacagtaggttggaattcgggacattgactgtgtgtgatgtgaggtccatttatctgactacc

SEQ ID NO: 16538 - DNA, 75 bp, Artificial Sequence
  Synthetic
ttgaagccatatggcatggtctccaaaataatgacagatgtgaggtctgttgggaggaagactcatgacttgatc

SEQ ID NO: 16539 - DNA, 75 bp, Artificial Sequence
  Synthetic
gcattgtgtgattttatagacatagagaaaggggtgcccataaccatacctgcatatattaaagctgtctctatc

SEQ ID NO: 16540 - DNA, 75 bp, Artificial Sequence
  Synthetic
cgaaaaaccagataccacaagaagccaaacagaagaagctagaaacgaggccacgccggaggatgcaagccggtt

SEQ ID NO: 16541 - DNA, 75 bp, Artificial Sequence
  Synthetic
aagaactcagaatcagccactgtggaagctgcaataagtggggaagcagaccaggctataactcaagcaaggata

SEQ ID NO: 16542 - DNA, 75 bp, Artificial Sequence
  Synthetic
gctccatatgcagggctgatcttgattatgaccatgaacaaccctaaagggatctttaagaaattgggtgcaggt

SEQ ID NO: 16543 - DNA, 75 bp, Artificial Sequence
  Synthetic
atgcaagttatagtagaactggggccgtatgtacaagcagagagtctgggaaaaatctgcaagacatggaatcat

SEQ ID NO: 16544 - DNA, 75 bp, Artificial Sequence
  Synthetic
caacgaaccaggtatgtactgaggtcacgttgagggtaccctaaagcatagatctgttaatgttatagtcaataa

SEQ ID NO: 16545 - DNA, 75 bp, Artificial Sequence
  Synthetic
aaaaaacgggacaagtggaaatggagtcctatctagtagacacttaccaaggtgtcccttacactgctgctgtac

SEQ ID NO: 16546 - DNA, 75 bp, Artificial Sequence
  Synthetic
aaaattgggacaagtaggatggatgtaagaatctgtctcctattgttccttatatctaatcctagtagctgcata

SEQ ID NO: 16547 - DNA, 75 bp, Artificial Sequence
  Synthetic
aaactgatttggtggagaaagaccaactgcctgcaaggttaacagtgtgggtccctttattccaaaccaacacac

SEQ ID NO: 16548 - DNA, 75 bp, Artificial Sequence
  Synthetic
caagaaacatacaatgaagaatcctgcagtactgtaactaggggttataagagtgtgttaaggacagggtggtat

SEQ ID NO: 16549 - DNA, 75 bp, Artificial Sequence
  Synthetic
acgaatgtatttaacctcgaaatagggaatgttgagaacatcacttgcaatgatggacccagcctaattgacact

SEQ ID NO: 16550 - DNA, 75 bp, Artificial Sequence
  Synthetic
gagttagtactcacaaagaatgctttgagggagctcaaaacagtgtcagctgatcaagtggctaaggaaagcaga

SEQ ID NO: 16551 - DNA, 75 bp, Artificial Sequence
  Synthetic
ctatcctcacccaggagacgtagatttgtactgggtgcaattgcacttggtgttgcgacagctgctgccgtaaca

SEQ ID NO: 16552 - DNA, 75 bp, Artificial Sequence
  Synthetic
gctggtgtagcacttgcaaagacaattagattagagggagaggtgaaggcaattaagaatgccctccggaacaca

SEQ ID NO: 16553 - DNA, 75 bp, Artificial Sequence
  Synthetic
aatgaggcagtatccacattagggaatggtgtgagggtactagcaactgcagtcaatgacctcaaagaatttata

SEQ ID NO: 16554 - DNA, 75 bp, Artificial Sequence
  Synthetic
taaaagagagtgaatcagcaactgttgaagctgcaattagtggggaggcagatcaagctataactcaagctagga

SEQ ID NO: 16555 - DNA, 75 bp, Artificial Sequence
  Synthetic
agtaaaaaattgactcctgctattaaccagaacaaatgcaatatagcagatataaagatggcaattagttttggc

SEQ ID NO: 16556 - DNA, 75 bp, Artificial Sequence
  Synthetic
caaaataacagaaggttcctgaatgtggtgaggcaattctctgatagtgcaggtatcacatcagctgtgtctctt

SEQ ID NO: 16557 - DNA, 75 bp, Artificial Sequence
  Synthetic
gatttaatgacagatgatgaacttgttagagcaattaacagaatgccaacttcatcaggacagattagtttgatg

SEQ ID NO: 16558 - DNA, 75 bp, Artificial Sequence
  Synthetic
ttgaacaatcgtgccatggttagaaggaaggggtttggtatattgattggtgtttatgatggaacggtcgtttat

SEQ ID NO: 16559 - DNA, 75 bp, Artificial Sequence
  Synthetic
atggtacaactgcccatattcggcgtgattgagacaccttgttggagggtggtggcagcaccactctgtaggaaa

SEQ ID NO: 16560 - DNA, 75 bp, Artificial Sequence
  Synthetic
tgattgagacaccttgttggagggtggtggcagcaccactctgtaggaaacgccgcggcaattatgcttgtatac

SEQ ID NO: 16561 - DNA, 75 bp, Artificial Sequence
  Synthetic
gaaagttatctagaggagtcatacagtactgttactagaggatacctgagtgttttgaggacagggtggtataca

SEQ ID NO: 16562 - DNA, 75 bp, Artificial Sequence
  Synthetic
tgagagaagatcaagggtggtactgtacaaatgctggctctacagcttattatcctaataaagatgattgtgagg

SEQ ID NO: 16563 - DNA, 75 bp, Artificial Sequence
  Synthetic
taagggatgattatgtattttgtgacacagcagctggcattaatgtggccctagaagttgaccagtgcaactata

SEQ ID NO: 16564 - DNA, 75 bp, Artificial Sequence
  Synthetic
acatatcgacttctaaatacccatgcaaagtcagcacaggtagacaccctgtcagtatggtagccttaacccccc

SEQ ID NO: 16565 - DNA, 75 bp, Artificial Sequence
  Synthetic
tagggggtctagtgtcttgttatgagagtgtaagttgctccataggtagcaataaagtagggataataaaacagc

SEQ ID NO: 16566 - DNA, 75 bp, Artificial Sequence
  Synthetic
taggcaaagggtgcacccacattcccaacaacgaagctgacacgataaccattgataacactgtgtaccaattga

SEQ ID NO: 16567 - DNA, 75 bp, Artificial Sequence
  Synthetic
gcaaggttgtaggcgaacagaggaccataaaaggagctccagttgtgaacaattttaacccaatattattccctg

SEQ ID NO: 16568 - DNA, 75 bp, Artificial Sequence
  Synthetic
tggatcagttcaatgttgcacttgaccaagtatttgagagtatagatagatctcaggacttaatagataagtcta

SEQ ID NO: 16569 - DNA, 75 bp, Artificial Sequence
  Synthetic
acgacttgctaggtgcagatgccaagagcaaggctggaattgctatagcaatagtagtgctagtcattctaggaa

SEQ ID NO: 16570 - DNA, 75 bp, Artificial Sequence
  Synthetic
tcttctttttacttgcagtgatatattactgttccagagtccggaagaccaaaccaaagcatgattacccggcca

SEQ ID NO: 16571 - DNA, 75 bp, Artificial Sequence
  Synthetic
cgacaggtcatagcagcatggcttatgtcagttaagttatttaaaattgggacaagtgaagatgtctaggcgaaa

SEQ ID NO: 16572 - DNA, 75 bp, Artificial Sequence
  Synthetic
tccctgcagatatgaaatacggggcaaatgcaacaggggatcatcctgtacatttaaccataattattggtcctg

SEQ ID NO: 16573 - DNA, 75 bp, Artificial Sequence
  Synthetic
gcctgatcatgtgctcttagtcagagcaaactacatgcttaaccaattattgagaaacacagacaggacagatgg

SEQ ID NO: 16574 - DNA, 75 bp, Artificial Sequence
  Synthetic
cctatccttgatatcaggggcaggacgagaagatagaacccaggattttgttctaggatctgccaatgttgtaca

SEQ ID NO: 16575 - DNA, 75 bp, Artificial Sequence
  Synthetic
gaattatatagaagggaacacaacaatcaccaaatcagcagcctgctacagcctgtacaacattataaaacagct

SEQ ID NO: 16576 - DNA, 75 bp, Artificial Sequence
  Synthetic
ccaggaaaatgatgtgaaaacatccagagattcaatgcttgaagaccctaaacatgtggcgctacacaatctgat

SEQ ID NO: 16577 - DNA, 75 bp, Artificial Sequence
  Synthetic
ggaaagggtgttcatacatcagcaatcaagatgctgacactgttacaattgacaacacagtgtaccaattgagca

SEQ ID NO: 16578 - DNA, 75 bp, Artificial Sequence
  Synthetic
actatcttatgttgatatgagtaaaaatccggcaagtttgatcaacagcctcaagcggcttcccagagaaaaact

SEQ ID NO: 16579 - DNA, 75 bp, Artificial Sequence
  Synthetic
caaaaagcttgccaagatcatactacagctatctgcagggccagagagtgacaatgccagtggtaataccctgca

SEQ ID NO: 16580 - DNA, 75 bp, Artificial Sequence
  Synthetic
cagctatctgcagggccagagagtgacaatgccagtggtaataccctgcagaagggtgacagcaataattaagtg

SEQ ID NO: 16581 - DNA, 75 bp, Artificial Sequence
  Synthetic
caatgcacttggattgtgtatggttcgtaagatatatgattatagtattgcgagctggagtgatttaatagagga

SEQ ID NO: 16582 - DNA, 75 bp, Artificial Sequence
  Synthetic
ggtgtttgaaagtgttgagaagagtcagaatctgatagaccagtcaaacaagatattggatagcattgaaaaggg

SEQ ID NO: 16583 - DNA, 75 bp, Artificial Sequence
  Synthetic
agtagccaatatggtcctaatagatcacatcaataggaaacaatgtgtggagtgtcgaaaagatcttgagtttat

SEQ ID NO: 16584 - DNA, 75 bp, Artificial Sequence
  Synthetic
agctatatatacctcatataattagttaattaaaaccaattaagctataagtccaaaaaagggtgggacaagtca

SEQ ID NO: 16585 - DNA, 75 bp, Artificial Sequence
  Synthetic
cccaaattcccaatggaaatgaatggtgtgaacaacaaaggatttatcccttaattttagttactaaaaaattgg

SEQ ID NO: 16586 - DNA, 75 bp, Artificial Sequence
  Synthetic
gtgtgaacaacaaaggatttatcccttaattttagttactaaaaaattgggacaagtgaagatgtctcgcaaggc

SEQ ID NO: 16587 - DNA, 75 bp, Artificial Sequence
  Synthetic
taatgacttctaccgtcaaccttgggtcagacactgcttcaaaatggacagtgatcaagtcaaggtgcaattctt

SEQ ID NO: 16588 - DNA, 75 bp, Artificial Sequence
  Synthetic
tccctgcaaatatgaagtacggggcaagtgcaatagaggcagtgaatgcaaatttaaccataattattggtcctg

SEQ ID NO: 16589 - DNA, 75 bp, Artificial Sequence
  Synthetic
gctgcaggatcttggtgagttgtgctgctgtgatttgtgcaatcttagctttgatcttccttgttgctacgatcg

SEQ ID NO: 16590 - DNA, 75 bp, Artificial Sequence
  Synthetic
gattgtctgtgaaactggcattcacagtgcaggaggtccacaactgcaagcagaagttatcaggagcgagcacaa

SEQ ID NO: 16591 - DNA, 75 bp, Artificial Sequence
  Synthetic
ctacagctgcaatctatactaccccaagtacaatgatagaggcactacagacaaatcaacttaaactgacaacca

SEQ ID NO: 16592 - DNA, 75 bp, Artificial Sequence
  Synthetic
atgaaagacgtagtactccccctgactgcctggtagagaaaaaattgtgcgaaggtgaggtcaggtatctcaaaa

SEQ ID NO: 16593 - DNA, 75 bp, Artificial Sequence
  Synthetic
gtctgtataatatcataaaacaactgcaagagactgacgtaaggcaggccagagacaacaaagttgatgacagca

SEQ ID NO: 16594 - DNA, 75 bp, Artificial Sequence
  Synthetic
gcaagagactgacgtaaggcaggccagagacaacaaagttgatgacagcaagcatgttgctctacataatttagt

SEQ ID NO: 16595 - DNA, 75 bp, Artificial Sequence
  Synthetic
ctaaaggctgcttgggagcacgagagggtgaagatttgaattgtatagatttagtggtggagtgtgttgggaaac

SEQ ID NO: 16596 - DNA, 75 bp, Artificial Sequence
  Synthetic
cctgtggtcacaacgaggattacaaggaatgcatatgcaccaacaatgggacagcaactaagtgctgctacaact

SEQ ID NO: 16597 - DNA, 75 bp, Artificial Sequence
  Synthetic
atctcaatggggtccaaactatatatggttcagggcaccagtgcatatcaaactgcagtggggttctggctggac

SEQ ID NO: 16598 - DNA, 75 bp, Artificial Sequence
  Synthetic
atcgggaggaggtacatattggctatagtcctatcagctttcgggctgacctgcacagtcactattgcactcact

SEQ ID NO: 16599 - DNA, 75 bp, Artificial Sequence
  Synthetic
aatatattcaaatgtaggctagaggatattgaaatcatttatgttaaaacatttctaagttaataaaaaattggg

SEQ ID NO: 16600 - DNA, 75 bp, Artificial Sequence
  Synthetic
gttagcgtcatagttgaacagtcagtgttagaggagtgcagaaactacaatggaggagatagagattggtggtca

SEQ ID NO: 16601 - DNA, 75 bp, Artificial Sequence
  Synthetic
accacccaggagcagccaactactgcaccaagtgcgactccagcaggaaattatggaggattacaaacggctcga

SEQ ID NO: 16602 - DNA, 75 bp, Artificial Sequence
  Synthetic
acaagaaagtctgaaagctgtttgcatgtgcaaatttcttatggtgatatgtatagccgcagtgatactgtactg

SEQ ID NO: 16603 - DNA, 75 bp, Artificial Sequence
  Synthetic
ggtggttttgattgtatgggcttattggttctttgcaaatcaggaccaatttgtcagcgagataatcaagttgac

SEQ ID NO: 16604 - DNA, 75 bp, Artificial Sequence
  Synthetic
ccaacagccctctgccactgcagggtagatctttcaagtgtggactgctgcaaggtgaacaagattagcactaac

SEQ ID NO: 16605 - DNA, 75 bp, Artificial Sequence
  Synthetic
agcagcaccacctctgagccccagaagaccaacccggcatggcctagccaagacaacacagactccgatccaaat

SEQ ID NO: 16606 - DNA, 75 bp, Artificial Sequence
  Synthetic
cctcaaggcataaccaccagcacagccactctgctctcaacaagcctgggcctcatgctcacatcgaagactggg

SEQ ID NO: 16607 - DNA, 75 bp, Artificial Sequence
  Synthetic
acacacaaatcagggcccccccaagccttgccggggagcaacaccaacggaaaaacaaccacagaccgagaacta

SEQ ID NO: 16608 - DNA, 75 bp, Artificial Sequence
  Synthetic
tagttatgcttgagagagagactacactagccgaccctaatgaggtccacagaaaaagattaaaagcataaacca

SEQ ID NO: 16609 - DNA, 75 bp, Artificial Sequence
  Synthetic
gggtccacaaaccaaccaaattcaaccactaatgggcaacataataaacacacccaacgaatgacactcccgcca

SEQ ID NO: 16610 - DNA, 75 bp, Artificial Sequence
  Synthetic
aatatgtctggacagtgccaaggccaagaaaaaccaacacgagaacaggtgatccaatgattaaaaacgatcaga

SEQ ID NO: 16611 - DNA, 75 bp, Artificial Sequence
  Synthetic
agttacgacaacacaagaactatcctccagcacacaacaccctgggaaaagacattcagtacatacaagcccaca

SEQ ID NO: 16612 - DNA, 75 bp, Artificial Sequence
  Synthetic
gaaggaaaaacgggacaagtcaacatggaggtcaaggtagagaatgttggcaagtcacaggagcttaaagtcaaa

SEQ ID NO: 16613 - DNA, 75 bp, Artificial Sequence
  Synthetic
cactctccgaccaacgaatcagatcaatccctccccacaactcaaaacagcatcaactgtgaacattttgacccc

SEQ ID NO: 16614 - DNA, 75 bp, Artificial Sequence
  Synthetic
caaggcaaggaaaaaatctgctacagagtaggttcttacaactccaatattacaaagcaatgcagaattgatgtg

SEQ ID NO: 16615 - DNA, 75 bp, Artificial Sequence
  Synthetic
tacaaagcaatgcagaattgatgtgcctttgtgttccacttataacacagtgtgcatgaaaacatactataccga

SEQ ID NO: 16616 - DNA, 75 bp, Artificial Sequence
  Synthetic
caaaccacagagccaggcaccagcacccaaaagcacacccccgcaagaccaagcagcaaatcccccaccacaaca

SEQ ID NO: 16617 - DNA, 75 bp, Artificial Sequence
  Synthetic
accattctactgttggaggcgtatctggcgttgcttgtgtgatgacggagttggtctggttgagtggtgttgcac

SEQ ID NO: 16618 - DNA, 75 bp, Artificial Sequence
  Synthetic
cccaaaagcacacccccgcaagaccaagcagcaaatcccccaccacaacacaagcaatagcacaactgacaacac

SEQ ID NO: 16619 - DNA, 75 bp, Artificial Sequence
  Synthetic
tagttaactaaaaatgaacacatatatatctgataataaaaaaacacatcagatagtctaaaacaattaaaagaa

SEQ ID NO: 16620 - DNA, 75 bp, Artificial Sequence
  Synthetic
atatctgataataaaaaaacacatcagatagtctaaaacaattaaaagaatgaaaaacaaggaccaatatggaaa

SEQ ID NO: 16621 - DNA, 75 bp, Artificial Sequence
  Synthetic
gcaagagcaaagaggggccaacacagcacacaaccaaagaacagcccgagacaacagcaggagttagtttaagag

SEQ ID NO: 16622 - DNA, 75 bp, Artificial Sequence
  Synthetic
tatccgatgagtccgtcgtaaatgtctatctgcctgactcttacttaaagggggtcatttcattcagtgagacca

SEQ ID NO: 16623 - DNA, 75 bp, Artificial Sequence
  Synthetic
atgcaattggatcatgtgtactcaaccggccatacattaaggatgactatacagcacatgttgcaatgactaatc

SEQ ID NO: 16624 - DNA, 75 bp, Artificial Sequence
  Synthetic
tgaaggggttgtgaatgtgtacctacctgattcttatttaaagggtgtaatatcttttagtgaaaccaatgcaat

SEQ ID NO: 16625 - DNA, 75 bp, Artificial Sequence
  Synthetic
cagtgattgaacaccagaggttgagggccctcttcaagagtcttaccattagcagagaatatcgagtggtcgaac

SEQ ID NO: 16626 - DNA, 75 bp, Artificial Sequence
  Synthetic
ctcttatgatccagaaggagctgctaaaagttgcagcaggtgcaagactaaagaaactcaagaaatggttgggta

SEQ ID NO: 16627 - DNA, 75 bp, Artificial Sequence
  Synthetic
gaagcaaggatataagtgaagtcaaattgaaaatggtgactgattggcttaaactgtcacagacaccaggaaggg

SEQ ID NO: 16628 - DNA, 75 bp, Artificial Sequence
  Synthetic
gaaaaataatagatcgtattcaagtggagaacttacctgactggctggagcactggtttgattcttggttgatat

SEQ ID NO: 16629 - DNA, 75 bp, Artificial Sequence
  Synthetic
tgaatgacgtcatccagtcttataggtgtttggaagtatcccaaaccagtgctatattacggaaaagtagcctga

SEQ ID NO: 16630 - DNA, 75 bp, Artificial Sequence
  Synthetic
acttcttttttgctgtttcttctttcgggtgtataatcataagtcgcaagagtagaagaatatgtttttgtacct

SEQ ID NO: 16631 - DNA, 75 bp, Artificial Sequence
  Synthetic
acaatcaactcctgacttggaaggaccttgccttgagcagatttaatgcaaacttgtgtgtgtgggtgagcaatt

SEQ ID NO: 16632 - DNA, 75 bp, Artificial Sequence
  Synthetic
gcttaaatagtgcccaagacggccttggattaaggagcaaattagttggtgagttactcaaccgattgtactgtg

SEQ ID NO: 16633 - DNA, 75 bp, Artificial Sequence
  Synthetic
agactgatgagttattgagcatcactggcaatgaggggtatgggattgtaaaggaatttgaaggattcattatga

SEQ ID NO: 16634 - DNA, 75 bp, Artificial Sequence
  Synthetic
caaaaatcaagaagggttaggtcttagaagcaatttacaaggggccttggttaacaaattatatgagattgttga

SEQ ID NO: 16635 - DNA, 75 bp, Artificial Sequence
  Synthetic
gcgaaatattgcggatgactgaacatgcacaattcagtgtaaggttccggaatacgctattgaatggcatagctg

SEQ ID NO: 16636 - DNA, 75 bp, Artificial Sequence
  Synthetic
ataaaatagggaagatgagagctgcataccgaaggcggacacagaacacatctgttgagcatcatagatacccag

SEQ ID NO: 16637 - DNA, 75 bp, Artificial Sequence
  Synthetic
gcgagcatgaaatgctggaagcaacagggagagtgctgagaataattaagcttctggtgaataatgagattgcta

SEQ ID NO: 16638 - DNA, 75 bp, Artificial Sequence
  Synthetic
atgctgcagagatgtattttatattccgcatattcggacatcctatggtagaagaaagggaggctatggatgcag

SEQ ID NO: 16639 - DNA, 75 bp, Artificial Sequence
  Synthetic
taaacaagaacttagacaatgctgctgagctgtactacatttttaggatttttggccacccaatggttgaagaga

SEQ ID NO: 16640 - DNA, 75 bp, Artificial Sequence
  Synthetic
tgagggataacagtgaaactgcaaaaatcttaagtctggtggcccttacggagatgaggggggccttcattctga

SEQ ID NO: 16641 - DNA, 75 bp, Artificial Sequence
  Synthetic
tttggccacccaatggttgaagagagagaagctatggacgcagtcagacttaataatgagatcacaaaaattctg

SEQ ID NO: 16642 - DNA, 75 bp, Artificial Sequence
  Synthetic
gagtgatcaaaggtttcgtagggaactacaaaagatggccaaagataaagaatccatcaacattgagtcgaaggt

SEQ ID NO: 16643 - DNA, 75 bp, Artificial Sequence
  Synthetic
ggaagatgtacatgaatgcaaaaacatacccaagcaatcttgaattgtgtgtggaagacttcttggagctcgctg

SEQ ID NO: 16644 - DNA, 75 bp, Artificial Sequence
  Synthetic
ggatcagtttttgccaagaattctatgtacctagccagaccagtttggagatggtactgaatgataaagcaatat

SEQ ID NO: 16645 - DNA, 75 bp, Artificial Sequence
  Synthetic
gtactttaaagctaagagttatccaagccagttggaactaagtagtcaagatttccttgaattagcaggagtgca

SEQ ID NO: 16646 - DNA, 75 bp, Artificial Sequence
  Synthetic
ctcctcccaaatctctcatatggtccgtgtatccacgtaactaccttccgcaaaacatacaagacagattcaggt

SEQ ID NO: 16647 - DNA, 75 bp, Artificial Sequence
  Synthetic
gtttgagcaggagtttgcaataccagagagaacaaatcttgagatggtcttgaatgataaggccatctcaccacc

SEQ ID NO: 16648 - DNA, 75 bp, Artificial Sequence
  Synthetic
tggagtctcttgacagactagagcatgagcgcaccaggagggtgctagagttctacttaaaagatgctaatttta

SEQ ID NO: 16649 - DNA, 75 bp, Artificial Sequence
  Synthetic
agcaaagtgatctcaaaaaatatgttgtaggtcaagagtacttgaatgacaaagagcatgtggtctccttaacag

SEQ ID NO: 16650 - DNA, 75 bp, Artificial Sequence
  Synthetic
gttcaactcaagtgaaaaattgaagacaagaagggtgttggagtattacttaaaagacaacaagtttgaccagaa

SEQ ID NO: 16651 - DNA, 75 bp, Artificial Sequence
  Synthetic
gaaaagaaagggaactaagtgtaggtcgtatgtttgcaatgcaacctggaaagcaaagacaggtgcagatccttg

SEQ ID NO: 16652 - DNA, 75 bp, Artificial Sequence
  Synthetic
tgacctgaaaaagtatgttgttaggcaagagtacttgggtgataaagaacatgtagtgtcattaacagggaaaga

SEQ ID NO: 16653 - DNA, 75 bp, Artificial Sequence
  Synthetic
ctgagaaattgttatcagataacatagtgccatttttcccagagacattgactaggtatggagatctagaattac

SEQ ID NO: 16654 - DNA, 75 bp, Artificial Sequence
  Synthetic
aaagaatcatggaactcaagtccgaactatcgtctacaaaaaaacggaaaagtgatagctacaataattatatag

SEQ ID NO: 16655 - DNA, 75 bp, Artificial Sequence
  Synthetic
caagagcttcaatagtgactgatttgagcaagtttaaccaagcctttagatacgagactacttcagtgtgtgctg

SEQ ID NO: 16656 - DNA, 75 bp, Artificial Sequence
  Synthetic
atgttgcagacgaactgcatgggactcaaagccttttctgctggttacatctgactgtatcctccacaaccatga

SEQ ID NO: 16657 - DNA, 75 bp, Artificial Sequence
  Synthetic
tctgcacttatagacatgctccccctgacacaggtggaatctacgacatagaccagataccggagcaaagtggac

SEQ ID NO: 16658 - DNA, 75 bp, Artificial Sequence
  Synthetic
tgtataggttccacatgggtggcatagaaggctggtgccaaaagatgtggaccatggaagcaatatcactccttg

SEQ ID NO: 16659 - DNA, 75 bp, Artificial Sequence
  Synthetic
tcaaagaacagagtgggctttacaggtttcacatgggagggattgaggggtggtgccaaaagttgtggactatgg

SEQ ID NO: 16660 - DNA, 75 bp, Artificial Sequence
  Synthetic
atgtggtgtctgtgaggaatcgggtgcagctcacatcactgctgaatggggacaaccagtctatagatgtgagta

SEQ ID NO: 16661 - DNA, 75 bp, Artificial Sequence
  Synthetic
aacctgtgcgactcacaggtgctcaaactgaaatacaggctgattatagccttgccatcaagatgttaactgctg

SEQ ID NO: 16662 - DNA, 75 bp, Artificial Sequence
  Synthetic
taagggatgcctactataacataggacacaagttgaaggaaggggagacttatgtttcaagagacctccagttta

SEQ ID NO: 16663 - DNA, 75 bp, Artificial Sequence
  Synthetic
tgagcaagaccattcaatcagaaggcgtaatgtatcctgctgcaattaagaaggttctgcgagtgggtccctgga

SEQ ID NO: 16664 - DNA, 75 bp, Artificial Sequence
  Synthetic
taaacacaatactggatgacatcaagactagtatggaagctattggaagtctctgtcaagagttagaatttcgag

SEQ ID NO: 16665 - DNA, 75 bp, Artificial Sequence
  Synthetic
gggagtcatttgtgactagtcttatagttcggaatttctggttgtacatccagtgctttgtcgaggcaaaagatc

SEQ ID NO: 16666 - DNA, 75 bp, Artificial Sequence
  Synthetic
atagcttagcaggtgcacaaatatccaatgagcttaatagaactttaaccaaagttaagagattcttcaggttag

SEQ ID NO: 16667 - DNA, 75 bp, Artificial Sequence
  Synthetic
cagatgagagcagcactgttaacttgttcatgaacataccaatgcagttggggggaggggaccctgttgttgttt

SEQ ID NO: 16668 - DNA, 75 bp, Artificial Sequence
  Synthetic
ataggagtttttatagacggacaccagattttttgacagaggtgttaacacacatggagttactactaacagcaa

SEQ ID NO: 16669 - DNA, 75 bp, Artificial Sequence
  Synthetic
tagagatggatagaggagtttatatgaacttcttcttaacactgttgaacacatgcaaaaatgatagagccactc

SEQ ID NO: 16670 - DNA, 75 bp, Artificial Sequence
  Synthetic
ttaccacactgatgagagaccctcaagctattgggtcagaaaggcaggctaaggtaacaagcgaaattaatagaa

SEQ ID NO: 16671 - DNA, 75 bp, Artificial Sequence
  Synthetic
gtgtactactcaaagtgtatgggaaagcaaaagagggatcaaagaaagattttttcaaagcattattatcagtgg

SEQ ID NO: 16672 - DNA, 75 bp, Artificial Sequence
  Synthetic
cagcagtaactagtgtgctcagccttgcaccaaaccccttgttcagtgatagtgctgtgcatttcagtcagaatg

SEQ ID NO: 16673 - DNA, 75 bp, Artificial Sequence
  Synthetic
aggaagaaataggcacagttatggaggatatatcacctgtctacccacatggactgagagtggtgtatgaagcat

SEQ ID NO: 16674 - DNA, 75 bp, Artificial Sequence
  Synthetic
tcccattccacaaagctgaaaaagttgtaaacatgattgccggaaccaaatccataacaaatatcctccaaagaa

SEQ ID NO: 16675 - DNA, 75 bp, Artificial Sequence
  Synthetic
cttctgctataagtggtgtagatattgacagagcagtccacatgatgttgctcaacttgggcctgttgggtagaa

SEQ ID NO: 16676 - DNA, 75 bp, Artificial Sequence
  Synthetic
tacttgagtctggacctatcactgacacaatagatctgaggagcaacaatcggattctttgttgtcagctttcca

SEQ ID NO: 16677 - DNA, 75 bp, Artificial Sequence
  Synthetic
aaagaataagagaaatgtcatgggatgggttggagattgtcggtgtatcatctccaagcatgttgtctagcttag

SEQ ID NO: 16678 - DNA, 75 bp, Artificial Sequence
  Synthetic
atattaattatgttacaatagcacagaagccaggtatcattgtagaaaaattctcagctgaaaaaacaacaagag

SEQ ID NO: 16679 - DNA, 75 bp, Artificial Sequence
  Synthetic
tgatatgttgtcaagtctctaggtctttgagagaaaggtcctgggataacatggaaattgttggagtcacctcac

SEQ ID NO: 16680 - DNA, 75 bp, Artificial Sequence
  Synthetic
ggaaaagaggtccgaaagcaccatgggtaggttcaagcacacaagagaaaaaattggtagctgtttacaacagac

SEQ ID NO: 16681 - DNA, 75 bp, Artificial Sequence
  Synthetic
aggccttatcgaaagaacaaaaagaccaattagaaaccataggcaaaatcaggtgggtctacaaaggcgttactg

SEQ ID NO: 16682 - DNA, 75 bp, Artificial Sequence
  Synthetic
gcctccgacgtcttctaaacttaatatgcttaggaacactgggtcttccatataagctgttaaaaccacttctac

SEQ ID NO: 16683 - DNA, 75 bp, Artificial Sequence
  Synthetic
ctcggtttatgagcgtcaatttcctacacaggcttgcagtgagcagcaggcctatggagttcccatcatcagtac

SEQ ID NO: 16684 - DNA, 75 bp, Artificial Sequence
  Synthetic
cggcgtatagaactacaaactttcattttgacactagtcctataaacaagcggttgagtgagagatttggcaatg

SEQ ID NO: 16685 - DNA, 75 bp, Artificial Sequence
  Synthetic
tggaattcccagcatctgtccctgcttacagaacgaccaattaccattttgacacaagtcctgtaaatcagactc

SEQ ID NO: 16686 - DNA, 75 bp, Artificial Sequence
  Synthetic
aggacattaaccttgtgttccaaaatgctataagttgtggaattagtgtcatgtgtgtggttgaacaattgactg

SEQ ID NO: 16687 - DNA, 75 bp, Artificial Sequence
  Synthetic
tgagtgaaagatttgggaatgaggacatcaacttggtgtttcaaaatgctatcagctgtgggataagtgtgatga

SEQ ID NO: 16688 - DNA, 75 bp, Artificial Sequence
  Synthetic
ggcgtagccctaaacaagtgttactagaacctatcgtagaagatattgacataatgtccgcccctaatttccagg

SEQ ID NO: 16689 - DNA, 75 bp, Artificial Sequence
  Synthetic
gccacctgaatttcaagagtgtaagaaagattgtgactgatcaacatatctttaatccggaccacatcgacttgg

SEQ ID NO: 16690 - DNA, 75 bp, Artificial Sequence
  Synthetic
ttatgcttgggaagttgttattaccaactgtccgtagcaatataaataacaacaaaccagcaactgaaaacttct

SEQ ID NO: 16691 - DNA, 75 bp, Artificial Sequence
  Synthetic
ttaatggtaacaacatagtagaggcactaacaagctgtcttgcttgccactggtgcactgttttgattctactca

SEQ ID NO: 16692 - DNA, 75 bp, Artificial Sequence
  Synthetic
ctactgagaatagtattttccagaaagagtggggagatggattcataacagaccatgccttcataaacttcacat

SEQ ID NO: 16693 - DNA, 75 bp, Artificial Sequence
  Synthetic
ggttccttatgagcttcaaaacttatctcctatgccattggcaaactgaaaagaacaagacattggggatagtag

SEQ ID NO: 16694 - DNA, 75 bp, Artificial Sequence
  Synthetic
atcatgccttcatagatttcaaaacatttgtcggtgtatttaagaccaaactattgtgtgggtggggatccaggg

SEQ ID NO: 16695 - DNA, 75 bp, Artificial Sequence
  Synthetic
aggatcccatagacaggcttatcagagtagacaatagcttttggcggatgatgagcaaggtgttcctggaaccca

SEQ ID NO: 16696 - DNA, 75 bp, Artificial Sequence
  Synthetic
aagtaaaaagaagacttatgctttacgatacatctgtattgaatgttctgggtagtatcagtttcaaaaactggt

SEQ ID NO: 16697 - DNA, 75 bp, Artificial Sequence
  Synthetic
ttgttagccggttaagaacagtagactacatggagatcccatggattgtcaatgctgagggtgacatagtcgagc

SEQ ID NO: 16698 - DNA, 75 bp, Artificial Sequence
  Synthetic
aaaaacctgtcactgaatatttgaaaataatggctgcaggtgtccatgtaaaagtcataatgcttagttactccg

SEQ ID NO: 16699 - DNA, 75 bp, Artificial Sequence
  Synthetic
atatggcacatgctatgacacgcttgctaaggtgcaagaacatgcaagacaatgtgcccaccataaagaaaacag

SEQ ID NO: 16700 - DNA, 75 bp, Artificial Sequence
  Synthetic
tatctccaactgatgtcacaccctctgtagaccccactcgggccctactgctgttcccgaaagtcatctttagta

SEQ ID NO: 16701 - DNA, 75 bp, Artificial Sequence
  Synthetic
agttgaccactttcaatgcaacatgcagtacagctaagcagtctggcagcaatttgacaaaaaactacatgactt

SEQ ID NO: 16702 - DNA, 75 bp, Artificial Sequence
  Synthetic
gacactgtcacctgcagagttagctcctgtagttgaaccaactgtgcagatgaacttgttccctaaaatcacatt

SEQ ID NO: 16703 - DNA, 75 bp, Artificial Sequence
  Synthetic
taatgccttggcaccacatcaaccgttataactttgtccatagctccacagggtgtaaggtaagtgtaaagggat

SEQ ID NO: 16704 - DNA, 75 bp, Artificial Sequence
  Synthetic
gtataggcaagttgataacaaaacttgaactaagaattatctacttcatcggtgagggagctgggaatcttatgt

SEQ ID NO: 16705 - DNA, 75 bp, Artificial Sequence
  Synthetic
ccagaactgcatgtgaataccctaatctaaagtttgtatacaggagtctgaaagatgccaatgatcatcatcatc

SEQ ID NO: 16706 - DNA, 75 bp, Artificial Sequence
  Synthetic
tggaaagttgattcaagacttaaatccgacagttttttattttgtgggagaaggagccggcaattggatggcaag

SEQ ID NO: 16707 - DNA, 75 bp, Artificial Sequence
  Synthetic
ccacagagtatgtgcgtgtaatggggagtatcagcagaataatcgaccttggtgaagggttggcaatggaagcaa

SEQ ID NO: 16708 - DNA, 75 bp, Artificial Sequence
  Synthetic
ctgatgcaactaagagagaacattgggattttatccacagagtgtgcaaagatcctcttctgctaaccatctgtg

SEQ ID NO: 16709 - DNA, 75 bp, Artificial Sequence
  Synthetic
atgctgaactaaaaaacatggaggacgtcctgcatttagtgatacagtggaggaaacatgtactatcttgtaaca

SEQ ID NO: 16710 - DNA, 75 bp, Artificial Sequence
  Synthetic
tatgcacatcatatgggactaatgtgtacatgtttgttaagtatcatgcacaatctgaagcaaagaagctaccac

SEQ ID NO: 16711 - DNA, 75 bp, Artificial Sequence
  Synthetic
attttgtccgagtagtttcaatatatatcatgcaagggagtaaactatcaggatcggaatgttatatgttgttaa

SEQ ID NO: 16712 - DNA, 75 bp, Artificial Sequence
  Synthetic
cattaggtcaccagaacatggcaccttgctacggagaggttaggtctgcgaaatcaatcatggctttgacaagta

SEQ ID NO: 16713 - DNA, 75 bp, Artificial Sequence
  Synthetic
cttttaaacacccctgtagactagacaaatctgccatcgaggccaacctgaaatcactagcacctgggttgacac

SEQ ID NO: 16714 - DNA, 75 bp, Artificial Sequence
  Synthetic
tgccacttagtgagcctgctatgcaaaagtacttgttggatctttcaagcttaagtggaattaagaacacggggg

SEQ ID NO: 16715 - DNA, 75 bp, Artificial Sequence
  Synthetic
caaccattgggggaagcaaagtggtagagaagaagtgggctttgtgcaaagtgtcaaatatagtgaagtggttaa

SEQ ID NO: 16716 - DNA, 75 bp, Artificial Sequence
  Synthetic
gtcacgttctgaaaatgcccaaaggtgatttaaattacgattttttcgaggtgatagaaaacacatacccagaca

SEQ ID NO: 16717 - DNA, 75 bp, Artificial Sequence
  Synthetic
tggtgaagctattggacaacttaaacccgtcggagttgaaaaagctcgtcaaagtcaccgggtacatcctgggca

SEQ ID NO: 16718 - DNA, 75 bp, Artificial Sequence
  Synthetic
caaagtaataaagcaatatcaactcaacacataattatcacctgaaacacaactgaccttaaatgaatgttagtt

SEQ ID NO: 16719 - DNA, 75 bp, Artificial Sequence
  Synthetic
acaactgaccttaaatgaatgttagttaataaaaactaaaagctaaaaatttgatgaatacggtttttttctcgt

SEQ ID NO: 16720 - DNA, 75 bp, Artificial Sequence
  Synthetic
aattacttatagtgaaggcttaaaacttacatatccatgctgaagaatactaaagtgatagttacttaaacttaa

SEQ ID NO: 16721 - DNA, 75 bp, Artificial Sequence
  Synthetic
actcccaaagcaacaacagaaacaggcaagggcaaagaggggccaacacagcacacaaccaaagaacagcccgag

SEQ ID NO: 16722 - DNA, 75 bp, Artificial Sequence
  Synthetic
taatctgaatatgaagcacacaactagcaattagttatttaaaaatgaggaactaaaattggatgaatacggttt

SEQ ID NO: 16723 - DNA, 75 bp, Artificial Sequence
  Synthetic
tatgaagcacacaactagcaattagttatttaaaaatgaggaactaaaattggatgaatacggtttttttgccgt

SEQ ID NO: 16724 - DNA, 75 bp, Artificial Sequence
  Synthetic
aagcagcaacatcctacctagggggagatgatgagagatcatccaaatttgagtaattaaaaaatatgggacaag

SEQ ID NO: 16725 - DNA, 75 bp, Artificial Sequence
  Synthetic
aaaggatttgggattttgattggagtttatggtagctctgtggtctatatggtgcagcttcctattttcggtgtg

SEQ ID NO: 16726 - DNA, 75 bp, Artificial Sequence
  Synthetic
gggagcagaggtggccaagacaactccggaaccaccaacacagccaacgaagacaactcctacactaaccagaac

SEQ ID NO: 16727 - DNA, 75 bp, Artificial Sequence
  Synthetic
acaccagcagaccccaatgaggtccacagaaaaagattaaaagcataaaccaattttttagttatttaaaaatca

SEQ ID NO: 16728 - DNA, 75 bp, Artificial Sequence
  Synthetic
cagcacacaaccaaagaacagcccgagacaacagcacgagagacaacaaccccacagccaagaagaacagccagc

SEQ ID NO: 16729 - DNA, 75 bp, Artificial Sequence
  Synthetic
cccacagccaagaagaacagccagcaggccagccccaacaacaaaaatcgaagaggaggcagaaaccaccaaaac

SEQ ID NO: 16730 - DNA, 75 bp, Artificial Sequence
  Synthetic
aggccagccccaacaacaaaaatcgaagaggaggcagaaaccaccaaaaccagaacaaccaaaaacacccaaaca

SEQ ID NO: 16731 - DNA, 75 bp, Artificial Sequence
  Synthetic
cagaacaaccaaaaacacccaaacaagcacaggcccaccaagaccaacaaggagcacaccaagcaaaacagcgac

SEQ ID NO: 16732 - DNA, 75 bp, Artificial Sequence
  Synthetic
agaaaacaacaagagaaccacaacaacaaagagaccgaacacagcgagcacagacagcagacaacagaccagaac

SEQ ID NO: 16733 - DNA, 75 bp, Artificial Sequence
  Synthetic
aaccgcagagcaagaccaacaaacccaaaccagggccaaacccaccacaaatggggcccacccgcaaaccaccac

SEQ ID NO: 16734 - DNA, 75 bp, Artificial Sequence
  Synthetic
caccccagagcacaacacagacacaacaaacagcacaaaaggaagtcccaaggaggacaaaacgaccagagaccc

SEQ ID NO: 16735 - DNA, 75 bp, Artificial Sequence
  Synthetic
cagcagcaaaacaccaaccgagcaagaggacgccagcaagggaacggccgcggccaaccccggaggcagcgccga

SEQ ID NO: 16736 - DNA, 75 bp, Artificial Sequence
  Synthetic
ggcagacaggagagcacccccggcaaccaccccaacggggcgcaccacagaatcggccgcgggcacaacggggga

SEQ ID NO: 16737 - DNA, 75 bp, Artificial Sequence
  Synthetic
cgacagcggggcggaaaccacaagacggagaagcgcagcggacagacggcccacggggggcagcacagcagcgga

SEQ ID NO: 16738 - DNA, 75 bp, Artificial Sequence
  Synthetic
ggccgggacagcccagagcggacgggccacgccgaagcagccgagcggcggcacggcagcagggaacactgcacc

SEQ ID NO: 16739 - DNA, 75 bp, Artificial Sequence
  Synthetic
accgaacaacgaaagcagcggccgggcagacgccgcaccagcagaggaagccggggtcggcccaagcatccggcg

SEQ ID NO: 16740 - DNA, 75 bp, Artificial Sequence
  Synthetic
agggagacacgcctgcgggccccgcagagagagcgctccggagcatccgacgaatccatgccccggggacggcac

SEQ ID NO: 16741 - DNA, 75 bp, Artificial Sequence
  Synthetic
cgcatggacccgctcggatggtggagggaatttgccggctggccgccacgacagtggagcagatggggcggcccg

SEQ ID NO: 16742 - DNA, 75 bp, Artificial Sequence
  Synthetic
ccgcggagcccgtggaggcaacccgcgccgccgcgggcgagcagagcgcacgcgtgggggtggagcgggaccacc

SEQ ID NO: 16743 - DNA, 75 bp, Artificial Sequence
  Synthetic
cgcgtgggggtggagcgggaccaccatcctgccgctgtggctcacacaaccggagctagcccaagagcaagttag

SEQ ID NO: 16744 - DNA, 75 bp, Artificial Sequence
  Synthetic
ttaattaaaaagaaggaccaagttaaaaatggatccactaaatgaagaggttgtgaatgtgtacctacctgattc

SEQ ID NO: 16745 - DNA, 75 bp, Artificial Sequence
  Synthetic
ttatttaaagggtgtaatatcttttagtgaaaccaatgcaatagggtcttgccttctaggtaaacactaccttaa

SEQ ID NO: 16746 - DNA, 75 bp, Artificial Sequence
  Synthetic
gattgagacaccttgttggagggtggtggcagcaccactctgtaggaaaaagaaaggcaattatgcttgtatact

SEQ ID NO: 16747 - DNA, 75 bp, Artificial Sequence
  Synthetic
acaactatgatttgcacatataggcatgcccctccagaaacagaaggagtgtatgacattgataaaatcaaagaa

SEQ ID NO: 16748 - DNA, 75 bp, Artificial Sequence
  Synthetic
cacaaggagttgatgaagttaaagctgactatagcttggcagtgaaaatgttaaaagaaataagaaatgcttaca

SEQ ID NO: 16749 - DNA, 75 bp, Artificial Sequence
  Synthetic
ttaaaaagaaaggtcgggacaagtatctcaatggggtccaaactatatatggttcagggcaccagtgcatatcaa

SEQ ID NO: 16750 - DNA, 75 bp, Artificial Sequence
  Synthetic
ggttaatagcccaaaacataacaccagtctacccacatggattgagggtgctgtatgagtcattgccattccaca

SEQ ID NO: 16751 - DNA, 75 bp, Artificial Sequence
  Synthetic
ccagcagctctcaactaaaaggaataacaattgagaagttcagcacagataaaactacaagaggtcaaagaggac

SEQ ID NO: 16752 - DNA, 75 bp, Artificial Sequence
  Synthetic
agttaactaaaaatgaacacatatatatctgataataaaaaaacacatcagatagtctaaaacaattaaaagaat

SEQ ID NO: 16753 - DNA, 75 bp, Artificial Sequence
  Synthetic
gaaaacaaggaccaatatggaaatatccgatgagtccgtcgtaaatgtctatctgcctgactcttacttaaaggg

SEQ ID NO: 16754 - DNA, 75 bp, Artificial Sequence
  Synthetic
cagcaactaagtgctgctacaactaatgaattttgacaacactagtgccaaataataggcaacagtattatttaa

SEQ ID NO: 16755 - DNA, 75 bp, Artificial Sequence
  Synthetic
tacgagaaaaaaacgcatataagacaacttccaaacaaaacgggacaagtgaaaatgtctcttcaggggattcag

SEQ ID NO: 16756 - DNA, 75 bp, Artificial Sequence
  Synthetic
aatcaaaagagatgtggggacaaccactgctgttactccatcttctttgcagagggaaatatcacttctgtgcgg

SEQ ID NO: 16757 - DNA, 75 bp, Artificial Sequence
  Synthetic
agagatactgtatgccaagcacacagattactcacatgcagcagaagtaggaatgcagtatgtgagtaccacact

SEQ ID NO: 16758 - DNA, 75 bp, Artificial Sequence
  Synthetic
gggagcagagcgtacacagcagatactaaagaactcaggtagtgaggtgcaagcagtattgaccaaaacatactc

SEQ ID NO: 16759 - DNA, 75 bp, Artificial Sequence
  Synthetic
tcttggtaaaggcaaaaacagtaaaggggaggaattgcaaatgttagacatacatggggttgaaaaaagttgggt

SEQ ID NO: 16760 - DNA, 75 bp, Artificial Sequence
  Synthetic
tgaagaagttgacaaagaggcaaggaaaaccatggccacagccacaaaagacaattcagggccaataccacaaaa

SEQ ID NO: 16761 - DNA, 75 bp, Artificial Sequence
  Synthetic
tcaaagaccgtcatccccagatgctcctatcatattactctgcataggggcattaatcttcacaaagctggcatc

SEQ ID NO: 16762 - DNA, 75 bp, Artificial Sequence
  Synthetic
tgaatgatgcattgaaaaggttccctaggattgacattcccaaaattgcaaggtccttctatgatctgtttgaac

SEQ ID NO: 16763 - DNA, 75 bp, Artificial Sequence
  Synthetic
taggattgacattcccaaaattgcaaggtccttctatgatctgtttgaacagaaagtttactacaggagcttgtt

SEQ ID NO: 16764 - DNA, 75 bp, Artificial Sequence
  Synthetic
tatagagtatggcaaggcccttgggtcttcttccacaggaagcaaggcagagagtctgtttgtgaacattttcat

SEQ ID NO: 16765 - DNA, 75 bp, Artificial Sequence
  Synthetic
gcaagcttatggtgcaggccaaacaatgctaaggtggggagtgatcgccagatcttccaacaatataatgttagg

SEQ ID NO: 16766 - DNA, 75 bp, Artificial Sequence
  Synthetic
ccatgtctctgtacaagcggaactcaaacaggtcacggaggtatatgatctagttagagagatgggccccgagtc

SEQ ID NO: 16767 - DNA, 75 bp, Artificial Sequence
  Synthetic
aggtcttctccacctgaggcaaagccccaaggctgggttgttatcacttgccaattgtccaaattttgcaagtgt

SEQ ID NO: 16768 - DNA, 75 bp, Artificial Sequence
  Synthetic
ccaattgtccaaattttgcaagtgtggtgctagggaatgcctcaggactggggatacttggtatgtacagaggaa

SEQ ID NO: 16769 - DNA, 75 bp, Artificial Sequence
  Synthetic
ctaaaagaaagcaacaagataaatttctcatctcttggtctgacagaagaggaaaaagaagccgctgagaacttc

SEQ ID NO: 16770 - DNA, 75 bp, Artificial Sequence
  Synthetic
tctcatctcttggtctgacagaagaggaaaaagaagccgctgagaacttcctcaacataaatgaggaaggccaga

SEQ ID NO: 16771 - DNA, 75 bp, Artificial Sequence
  Synthetic
ggggaaagatatcttgcttatgggcaatgaagctgcaaaagcagcagaagcttttcaaagatcactaaagaaagt

SEQ ID NO: 16772 - DNA, 75 bp, Artificial Sequence
  Synthetic
aggacataggaggacacagtcaattgttggggataaaataatcacagtgtccgaaactgtagaaaagccaaccat

SEQ ID NO: 16773 - DNA, 75 bp, Artificial Sequence
  Synthetic
aagtaagttaaccaagatcaccacaccccccgaaaggaaaaatgcatggggtgaaaaaccagatgcaacaagaag

SEQ ID NO: 16774 - DNA, 75 bp, Artificial Sequence
  Synthetic
cccaacagaagaagccaaaaacgaggccacgcttgaggatgcaagccggttatacgaggaggtctttgctcctac

SEQ ID NO: 16775 - DNA, 75 bp, Artificial Sequence
  Synthetic
gggtgatggcaagactcctgccgagaaaggaaaggaaacaactgaaaaaccaaaaaagaaagttacattcaagaa

SEQ ID NO: 16776 - DNA, 75 bp, Artificial Sequence
  Synthetic
tgatgaatcaggaaaatacacaaaacttgagatggaggcactagaactgttatcagacaatgaggatgacgatgc

SEQ ID NO: 16777 - DNA, 75 bp, Artificial Sequence
  Synthetic
ggaatcatctgtgttgacttttgaagaaaaggacacctctgctcttagccttgaagccaggctggaatctattga

SEQ ID NO: 16778 - DNA, 75 bp, Artificial Sequence
  Synthetic
tgagaaattgagcatgatactagggctgctgagaacactcaatgttgccacagctgggcccactgcagctagaga

SEQ ID NO: 16779 - DNA, 75 bp, Artificial Sequence
  Synthetic
cggcatccgggatgcaatggtagggttgagagaagaattaattgctgacatcatcaaagaagcaaaagggaaggc

SEQ ID NO: 16780 - DNA, 75 bp, Artificial Sequence
  Synthetic
agctgagatgatgaaagaggaagcaaagcagaagtcaaaaataggaaatgggagcgtaggtttaactgagaaggc

SEQ ID NO: 16781 - DNA, 75 bp, Artificial Sequence
  Synthetic
agaagaaagcaacccagatgatgacctatactctcttactatgtagtcaataaaaaacgggacaagtggaaatgg

SEQ ID NO: 16782 - DNA, 75 bp, Artificial Sequence
  Synthetic
agtcctatctagtagacacctaccaaggtgttccttacactgctgctatacaaactgatttggtggaaaaagacc

SEQ ID NO: 16783 - DNA, 75 bp, Artificial Sequence
  Synthetic
aactacctgcaaggttaacagtgtggttccctctattccaaaccaacacacctcctacagtgctgctagagcagc

SEQ ID NO: 16784 - DNA, 75 bp, Artificial Sequence
  Synthetic
cctcctacagtgctgctagagcagcttaagactctgacaattacaactctgtatacagcctcccagaatggccca

SEQ ID NO: 16785 - DNA, 75 bp, Artificial Sequence
  Synthetic
aaaaagctttgatgttagtgcatcagtagcactagatgattacagcaaattagagtttgacaagctgacagtgtg

SEQ ID NO: 16786 - DNA, 75 bp, Artificial Sequence
  Synthetic
tgagttaaaagcagtctatttgacaacaatgaaaccttatggtatggtctctaagtttgtcaactcagccaaggc

SEQ ID NO: 16787 - DNA, 75 bp, Artificial Sequence
  Synthetic
agtcggaaagaaaacacatgatttgattgctctctgcgacttccttgacctagagaagggagttccagtgactat

SEQ ID NO: 16788 - DNA, 75 bp, Artificial Sequence
  Synthetic
gggacaagtgaaaatgtctcttcaggggattcagcttagtgatttgtcctataagcatgcaatccttaaagaatc

SEQ ID NO: 16789 - DNA, 75 bp, Artificial Sequence
  Synthetic
tagagaagggagttccagtgactataccagcttatataaaggctgtgtcaataaaagagagtgaatcagcaactg

SEQ ID NO: 16790 - DNA, 75 bp, Artificial Sequence
  Synthetic
gggattcagcttagtgatttgtcctataagcatgcaatccttaaagaatcacagtacacaatcaaaagagatgtg

SEQ ID NO: 16791 - DNA, 75 bp, Artificial Sequence
  Synthetic
ttgaagctgcaattagtggggaggcagatcaagctataactcaagccaggattgctccatacgctggcctgatca

SEQ ID NO: 16792 - DNA, 75 bp, Artificial Sequence
  Synthetic
tgattatgacaatgaacaaccctaaggggatcttcaaaaaattgggtgcaggagttcaggtgatagtagagttag

SEQ ID NO: 16793 - DNA, 75 bp, Artificial Sequence
  Synthetic
aagcacacagattactcacatgcagctgaagtaggaatgcagtatgtgagcaccacactgggagcagaacgtaca

SEQ ID NO: 16794 - DNA, 75 bp, Artificial Sequence
  Synthetic
ctgaagtaggaatgcagtatgtgagcaccacactgggagcagaacgtacacaacagatactaaagaactcaggta

SEQ ID NO: 16795 - DNA, 75 bp, Artificial Sequence
  Synthetic
agtcgagataaacccaaagggcacacccatccaatcacagaagcaatctcatttccagcccattcatggttaata

SEQ ID NO: 16796 - DNA, 75 bp, Artificial Sequence
  Synthetic
cccatccaatcacagaagcaatctcatttccagcccattcatggttaatacctgacttgatattatttagaaaaa

SEQ ID NO: 16797 - DNA, 75 bp, Artificial Sequence
  Synthetic
aacagcaaaggggaggagttgcaaatgttagacatacatggggttgaaaaaagttgggttgaagaagttgacaag

SEQ ID NO: 16798 - DNA, 75 bp, Artificial Sequence
  Synthetic
tgttagacatacatggggttgaaaaaagttgggttgaagaagttgacaaggaggcaaggaaaaccatggcctcag

SEQ ID NO: 16799 - DNA, 75 bp, Artificial Sequence
  Synthetic
agaaagttatctggaagagtcatgcagtactgttactagaggatatctgagcgttttaaggacagggtggtatac

SEQ ID NO: 16800 - DNA, 75 bp, Artificial Sequence
  Synthetic
gccggcatcaacaatcgaagttgggctggagacagctgttagaagggcaaaccgcgtgctgaatgatgcattgaa

SEQ ID NO: 16801 - DNA, 75 bp, Artificial Sequence
  Synthetic
gttctgggtgctatagcattaggtgtggcaactgctgctgcagtgacagctggtgtagcaatagccaagacaatt

SEQ ID NO: 16802 - DNA, 75 bp, Artificial Sequence
  Synthetic
cattttcatgcaagcttatggtgcaggtcagacaatgctaaggtggggggcaattgccagatcatccaacaatat

SEQ ID NO: 16803 - DNA, 75 bp, Artificial Sequence
  Synthetic
tggtgtagcaatagccaagacaattaggctagaaggagaagtagctgcaatcaaaggtgctctcaggaaaacaaa

SEQ ID NO: 16804 - DNA, 75 bp, Artificial Sequence
  Synthetic
aatgttgggccatgtctccgtacaagcggaactcaaacaggtcacggaggtatatgatctagtcagagagatggg

SEQ ID NO: 16805 - DNA, 75 bp, Artificial Sequence
  Synthetic
tgaggctgtatctacattaggaaatggtgtgagggtactggcaacagctgtgaatgatctcaaggactttataag

SEQ ID NO: 16806 - DNA, 75 bp, Artificial Sequence
  Synthetic
ccctgagtcaggtcttctccacctgaggcaaagccctaaggctggattgttgtcacttgctaattgtccaaattt

SEQ ID NO: 16807 - DNA, 75 bp, Artificial Sequence
  Synthetic
taaaaaattaacacctgcaataaacaagaacaagtgtgacatttcagaccttaaaatggcagtaagcttcggaca

SEQ ID NO: 16808 - DNA, 75 bp, Artificial Sequence
  Synthetic
tgtcacttgctaattgtccaaattttgcaagtgtggtgctaggaaatgcctcaggattggggatacttggtatgt

SEQ ID NO: 16809 - DNA, 75 bp, Artificial Sequence
  Synthetic
gtacaatcgaagattcctcaatgtggtgagacagttttctgacaatgcaggtatcacacctgcaatatctctaga

SEQ ID NO: 16810 - DNA, 75 bp, Artificial Sequence
  Synthetic
tttaatgactgatgctgagcttgtaagagctgtaagcaacatgcccacatcttcaggacagatcaacttgatgct

SEQ ID NO: 16811 - DNA, 75 bp, Artificial Sequence
  Synthetic
tgagaaccgggcaatggtcagaaggaaaggatttgggatcttgattggagtttatggtagctccgtggtctatat

SEQ ID NO: 16812 - DNA, 75 bp, Artificial Sequence
  Synthetic
aaaggatttgggatcttgattggagtttatggtagctccgtggtctatatggtgcagctacctattttcggtgtg

SEQ ID NO: 16813 - DNA, 75 bp, Artificial Sequence
  Synthetic
ctttcctgaggggaaagatatattgcttatgggcaatgaagctgcaaaagcagcagaagcttttcaaagatcact

SEQ ID NO: 16814 - DNA, 75 bp, Artificial Sequence
  Synthetic
atagacacaccatgttggaaggtgaaggctgctccattatgttcagggaaagacgggagttatgcatgtctcttg

SEQ ID NO: 16815 - DNA, 75 bp, Artificial Sequence
  Synthetic
aaagaaaataggacatagaagaacacagtcaattgttggggacaaaataatcacagtgtccgaaactgtagaaaa

SEQ ID NO: 16816 - DNA, 75 bp, Artificial Sequence
  Synthetic
cgagaggaccaaggttggtattgccaaaatgctggatctacagtatattatccaaatgaggaagactgtgaagtg

SEQ ID NO: 16817 - DNA, 75 bp, Artificial Sequence
  Synthetic
gccaaccataagtaagtcaacaaaggtcaccacaccccctgaaagaagaaatgcatggggcgaaaaaccagatac

SEQ ID NO: 16818 - DNA, 75 bp, Artificial Sequence
  Synthetic
agaagtgatcatgtgttttgtgatacagcagctgggataaatgtagcaaaggagtcagaagagtgcaacagaaac

SEQ ID NO: 16819 - DNA, 75 bp, Artificial Sequence
  Synthetic
cacaagaaaccaaacagaagaagccagaaacgaggccacactggaggatacaagccggttgtacgaggaggtctt

SEQ ID NO: 16820 - DNA, 75 bp, Artificial Sequence
  Synthetic
atctcaacaacaaagtacccctgcaaggtaagcaccgggcgtcacccaataagcatggtggccttatcaccacta

SEQ ID NO: 16821 - DNA, 75 bp, Artificial Sequence
  Synthetic
caagccggttgtacgaggaggtctttgctcctacgagtgatggcaagactccagccgaggaaggaatggaaacac

SEQ ID NO: 16822 - DNA, 75 bp, Artificial Sequence
  Synthetic
aggtaagcaccgggcgtcacccaataagcatggtggccttatcaccactaggtgctttggtggcctgttatgatg

SEQ ID NO: 16823 - DNA, 75 bp, Artificial Sequence
  Synthetic
atcaagatgctgacacagttacaattgacaacacagtgtaccaattgagcaaagtagagggagaacaacacacaa

SEQ ID NO: 16824 - DNA, 75 bp, Artificial Sequence
  Synthetic
tacacaaaacttgagatggaagcactagaattattatcagacaatgaggatgacgatgcagaatcatctgtgttg

SEQ ID NO: 16825 - DNA, 75 bp, Artificial Sequence
  Synthetic
tagaattattatcagacaatgaggatgacgatgcagaatcatctgtgttgacttttgaagaaaaagacacctctg

SEQ ID NO: 16826 - DNA, 75 bp, Artificial Sequence
  Synthetic
tcaaagggaagcctgtatctagcaatttcgacccaatagagtttcctgaagaccaattcaacatagccctggatc

SEQ ID NO: 16827 - DNA, 75 bp, Artificial Sequence
  Synthetic
aggtgtttgaaagtgttgagaagagccagaatctgatagaccagtcaaacaaaatactggaaagcactgagaagg

SEQ ID NO: 16828 - DNA, 75 bp, Artificial Sequence
  Synthetic
atctattgacgagaaattgagcatgatactagggttgctgagaacactcaatgttgccacggctgggcccaccgc

SEQ ID NO: 16829 - DNA, 75 bp, Artificial Sequence
  Synthetic
agctagagacggcatccgggacgcaatggtagggttgagagaagaattaattgctgacatcatcaaagaagcaaa

SEQ ID NO: 16830 - DNA, 75 bp, Artificial Sequence
  Synthetic
ggaatgcaggatttgtcatagtgatagtcctcattgtcctgctcatgctagctgcagttggtgtgggtatctttt

SEQ ID NO: 16831 - DNA, 75 bp, Artificial Sequence
  Synthetic
gctgcagttggtgtgggtatcttttttgtagttaagaagaggaaagctgctcccaaattcccaatggaaatgaat

SEQ ID NO: 16832 - DNA, 75 bp, Artificial Sequence
  Synthetic
aggaaaggcagccgagatgatgaaagaagaagcaaagcagaagtcaaaaatagggaatgggagcgtaggcctaac

SEQ ID NO: 16833 - DNA, 75 bp, Artificial Sequence
  Synthetic
tgagaaggctaaggaactgaacaagatagtggaggatgagagcacaagtggtgaatcagaggaagaagaagagga

SEQ ID NO: 16834 - DNA, 75 bp, Artificial Sequence
  Synthetic
atagtggaggatgagagcacaagtggtgaatcagaggaagaagaagaggaagaagacgaagaagagagcaaccca

SEQ ID NO: 16835 - DNA, 75 bp, Artificial Sequence
  Synthetic
caaattcaaccataattactggagttggccagacaggcacctgttactaaggtctaattacctgctgaatcaatt

SEQ ID NO: 16836 - DNA, 75 bp, Artificial Sequence
  Synthetic
tgtagttaataaaaaacgggacaagtggaaatggagtcctatcttgtagacacctaccaaggtgtcccttatact

SEQ ID NO: 16837 - DNA, 75 bp, Artificial Sequence
  Synthetic
tggaaatggagtcctatcttgtagacacctaccaaggtgtcccttatactgctgctgtacaaactgatttggtgg

SEQ ID NO: 16838 - DNA, 75 bp, Artificial Sequence
  Synthetic
actgagaaatacggatagatcagacggcctgtcattaatctcaggagcagggcgagacgataggacacaagattt

SEQ ID NO: 16839 - DNA, 75 bp, Artificial Sequence
  Synthetic
ggcctgtcattaatctcaggagcagggcgagacgataggacacaagattttgtgttggggtcaacaaatgtagtc

SEQ ID NO: 16840 - DNA, 75 bp, Artificial Sequence
  Synthetic
ctgcaagagactgatgtaaggcaggccagggacaacaaagttgatgacagcaagcatgtcgctctacataattta

SEQ ID NO: 16841 - DNA, 75 bp, Artificial Sequence
  Synthetic
gtgttgtcatatatggagatgagtaaaacccctgcatccttgataaacaacttgaagaagcttccgaaggaaaaa

SEQ ID NO: 16842 - DNA, 75 bp, Artificial Sequence
  Synthetic
gacagtgtgtgagttaaaagcagtctatttgacaacaatgaaaccttatggtatggtctcaaagtttgtcaactc

SEQ ID NO: 16843 - DNA, 75 bp, Artificial Sequence
  Synthetic
ctaaaaaaattggcaaagctgatcattgaattgtcagcaggagtggaaaatgactccacaactaccatgcaagat

SEQ ID NO: 16844 - DNA, 75 bp, Artificial Sequence
  Synthetic
tgactccacaactaccatgcaagatagtgcaaactctgattaaatgcggagagcacggcctcatttttctgaaga

SEQ ID NO: 16845 - DNA, 75 bp, Artificial Sequence
  Synthetic
tccactgaaatagttaaagtgcatgctaatatattcaaatgtagactagaggatatagaaatcatttatgttaaa

SEQ ID NO: 16846 - DNA, 75 bp, Artificial Sequence
  Synthetic
acatttctaagttaataaaaaatgggacaagtcaacatggagcccctgaaagtctctggaagtggagggatacca

SEQ ID NO: 16847 - DNA, 75 bp, Artificial Sequence
  Synthetic
atgaagacaaagcttagtattatacttaagaagtcagtcaataaaatcttaatcattttaggattactattaact

SEQ ID NO: 16848 - DNA, 75 bp, Artificial Sequence
  Synthetic
gcctcaactgtgatcacaataacactcacagtggaatatataagagttgaaaatgagctgcaactctgcaagatg

SEQ ID NO: 16849 - DNA, 75 bp, Artificial Sequence
  Synthetic
atgtcctgaagtcaagatgaacacagagagtacacctaccaaatcacagcagcaatttcgtttttaaccaactca

SEQ ID NO: 16850 - DNA, 75 bp, Artificial Sequence
  Synthetic
tagttaatacctagcttgatattatttagaaaaaattgggacaagtgaaaatgtcttggaaagtggtactgctat

SEQ ID NO: 16851 - DNA, 75 bp, Artificial Sequence
  Synthetic
ggagcaaaggtagccaagacaacccaggaaacacaaacaccaccaatgaagacaactctaatgccaaccagcaca

SEQ ID NO: 16852 - DNA, 75 bp, Artificial Sequence
  Synthetic
atgtcttggaaagtggtactgctattggtattgctagctaccccaacaggggggctagaagaaagttatctagag

SEQ ID NO: 16853 - DNA, 75 bp, Artificial Sequence
  Synthetic
agatcaaccgtcatatccttcaaaaccagaccagtttcaagggctactcatcccaccaatcccagctgctggaga

SEQ ID NO: 16854 - DNA, 75 bp, Artificial Sequence
  Synthetic
ggggctagaagaaagttatctagaggaatcatgcagtactgttactaggggatacctgagtgttttgaggacagg

SEQ ID NO: 16855 - DNA, 75 bp, Artificial Sequence
  Synthetic
gaggaggaaaagtgccagaatgtcatagctaaatggtccaattgttttggcacatctctacctgtgagggtgaat

SEQ ID NO: 16856 - DNA, 75 bp, Artificial Sequence
  Synthetic
tgcacagtactaagagaattgtgtgatgagcagctaggcaatcacacaacagctcaagtatcagggaagtgtaca

SEQ ID NO: 16857 - DNA, 75 bp, Artificial Sequence
  Synthetic
tgcatatatgcagtaaattgggattgtggttatgcttgagagagaaaatttaccagcagactttaatgaggtccg

SEQ ID NO: 16858 - DNA, 75 bp, Artificial Sequence
  Synthetic
ctgaaaaaggaatcaaatgaaaaatcaattttttagttatttaaaaaccatgagtatgtctgaaaaatgtcaagg

SEQ ID NO: 16859 - DNA, 75 bp, Artificial Sequence
  Synthetic
ccaagaaaaaccaacatgagaacaggtaatccgatgattacaatcaatcagacaagagaaaacgggacaagtcaa

SEQ ID NO: 16860 - DNA, 75 bp, Artificial Sequence
  Synthetic
gaaaacaaatgaggctgtatctacattaggaaatggtgtgagggtactggcaacagctgtgaatgatctcaagga

SEQ ID NO: 16861 - DNA, 75 bp, Artificial Sequence
  Synthetic
catggaggtcaagatagagaatgttggcaagtcacaagagcttagagttaaagtcaagaattttataaaaaggtc

SEQ ID NO: 16862 - DNA, 75 bp, Artificial Sequence
  Synthetic
tctcagaccttaagatggcagtgagctttggacaatacaatcggaggttcctcaatgtggtaagacagttctctg

SEQ ID NO: 16863 - DNA, 75 bp, Artificial Sequence
  Synthetic
tgattgcaagaaaaaactttttgccttgattttggggctgataagctttgatatcactatgaatataatgttgtc

SEQ ID NO: 16864 - DNA, 75 bp, Artificial Sequence
  Synthetic
acaacgcgggtattacgcctgcaatatcactagatttaatgactgatgctgagcttgtaagagctgtaagcaaca

SEQ ID NO: 16865 - DNA, 75 bp, Artificial Sequence
  Synthetic
tgtcatgtatgtggagtcaaataaggccctgagcttatgcagggtccaagggactcctgctccaagagacaacaa

SEQ ID NO: 16866 - DNA, 75 bp, Artificial Sequence
  Synthetic
atcactagatttaatgactgatgctgagcttgtaagagctgtaagcaacatgcccacgtcttcaggacagatcaa

SEQ ID NO: 16867 - DNA, 75 bp, Artificial Sequence
  Synthetic
gacaagcacagaaaacacagcaaaagaagcaacaccccacacaacgaccacaacaaggagcatagaagcaagggg

SEQ ID NO: 16868 - DNA, 75 bp, Artificial Sequence
  Synthetic
gacaaaaaccaccaagctccaagccaatggaagagcaacaaccccaagcaagaaccccactaccaggggagacaa

SEQ ID NO: 16869 - DNA, 75 bp, Artificial Sequence
  Synthetic
aaacaaaacaacaggagcaacaacaggggcagagccgggaaaacaaagcaagcaaaccacagaaccaggcaccag

SEQ ID NO: 16870 - DNA, 75 bp, Artificial Sequence
  Synthetic
cacccaaaagcacatctctgcaaggccaagcagcaaatccccggccacaacacaaacaacagcacaacaaacaac

SEQ ID NO: 16871 - DNA, 75 bp, Artificial Sequence
  Synthetic
actaacagttgcaaaaggaggcacagcacccaaggacagacagacaacaaccaagaaagccggaacggataccat

SEQ ID NO: 16872 - DNA, 75 bp, Artificial Sequence
  Synthetic
gacaacaagcagagcaaagcaaaccaccaatccaacagagacagaagcaacaacctacagagcaacaacagagac

SEQ ID NO: 16873 - DNA, 75 bp, Artificial Sequence
  Synthetic
agacaagaacaaagaggggccaacaccgcacacaaccaaagagcaacccgagacaacagcagaagaggcaacacc

SEQ ID NO: 16874 - DNA, 75 bp, Artificial Sequence
  Synthetic
agacctttggggaaagggtgttcatacatcagcaatcaagatgctgacactgttacaattgacaacccagtatac

SEQ ID NO: 16875 - DNA, 75 bp, Artificial Sequence
  Synthetic
cccacagccaagaagaacaaccagcaggccagccccaacaacaaacaccaaagagggggcagaaaccaccgaaac

SEQ ID NO: 16876 - DNA, 75 bp, Artificial Sequence
  Synthetic
caattgagcaaagttgaaggagaacaacacacaattaaagggaagccagtatctagcaattttgacccaatagag

SEQ ID NO: 16877 - DNA, 75 bp, Artificial Sequence
  Synthetic
cagaacaacaaaaaacacccaaacaagcacaagcccaccaagaccaacagggagcacacccagcaaaacagcgac

SEQ ID NO: 16878 - DNA, 75 bp, Artificial Sequence
  Synthetic
tttcctgaagatcagttcaacatagcactggatcaggtgtttgaaagtgttgagaagagcaagaatctgatagac

SEQ ID NO: 16879 - DNA, 75 bp, Artificial Sequence
  Synthetic
agaaaccagcaagagagccataacaacaaagggcccgaaaacagcgagcacagacagcagacaacagaccaggac

SEQ ID NO: 16880 - DNA, 75 bp, Artificial Sequence
  Synthetic
cagtcaaacaagatattggatagcactgaaaaggggaatgcaggatttgtcatggtgatagtcctcattgtcctg

SEQ ID NO: 16881 - DNA, 75 bp, Artificial Sequence
  Synthetic
aaccgcagagcaagaccaacagacccaacccaaggaaaaagcaaccacaaatggggcccatgcagaagacgccac

SEQ ID NO: 16882 - DNA, 75 bp, Artificial Sequence
  Synthetic
ctgaaaaggggaatgcaggatttgtcatggtgatagtcctcattgtcctgctcatgctggctgcagttggtgtag

SEQ ID NO: 16883 - DNA, 75 bp, Artificial Sequence
  Synthetic
gtatcttctttgtggttaagaagagaaaagctgctcccaaattcccaatggaaatgaatggtgtgaacaacaaag

SEQ ID NO: 16884 - DNA, 75 bp, Artificial Sequence
  Synthetic
cacaccagagcgcagcacagacacaacagacagcatggaagagaaccccaaggaggacaaaacgaccagagatcc

SEQ ID NO: 16885 - DNA, 75 bp, Artificial Sequence
  Synthetic
cagcagcaaagcaccaaccgagcaagaaaacgaaagcaaaggaacaactgcaaccaaccccagaaacaacaccga

SEQ ID NO: 16886 - DNA, 75 bp, Artificial Sequence
  Synthetic
tctcgcaaggctccctgcaaatatgaagtacggggcaagtgcaatagaggcagtgaatgcaagtttaaccataat

SEQ ID NO: 16887 - DNA, 75 bp, Artificial Sequence
  Synthetic
ggcagacacgagaacaccccccacaaccactccgacaaggcacaccacagaaccagccacaagcacaacaggggg

SEQ ID NO: 16888 - DNA, 75 bp, Artificial Sequence
  Synthetic
tactggagttggccagacaggtacctgttactaaggtccaattacctgctgaatcaattactgagaaatacagat

SEQ ID NO: 16889 - DNA, 75 bp, Artificial Sequence
  Synthetic
caacgccaaaacaaaaaccacaagatggaaaaacacagcagacagacagcccacaagaaacaacacaacaacaga

SEQ ID NO: 16890 - DNA, 75 bp, Artificial Sequence
  Synthetic
aaccaaaacagcccagagcaaccagaccacaccaaagcaactgggcaacaacacaacaccagagaatacaacacc

SEQ ID NO: 16891 - DNA, 75 bp, Artificial Sequence
  Synthetic
aatgtggtccagaattacattgacaacaatgagaatataacaaaagcgtcagcttgttacagtctgtataatatc

SEQ ID NO: 16892 - DNA, 75 bp, Artificial Sequence
  Synthetic
accagacaacaaaagcagcagccaaacagacgccgcaccaacagaagaactaaaaattggctcaagcccctggcg

SEQ ID NO: 16893 - DNA, 75 bp, Artificial Sequence
  Synthetic
aaagaggtatgtttatggaccctgcagagagaatgttctggaacatccgatggatccatgttttaaggacaacac

SEQ ID NO: 16894 - DNA, 75 bp, Artificial Sequence
  Synthetic
cataatttagtgttatcatatatggaaatgagcaaaacccctgcatccttgataaacaacttgaagaagcctccc

SEQ ID NO: 16895 - DNA, 75 bp, Artificial Sequence
  Synthetic
cacatggatttattcagacaatggaaggaatttgccagctgtttattatgatagtaatacagacaaaataatttg

SEQ ID NO: 16896 - DNA, 75 bp, Artificial Sequence
  Synthetic
aaatgagcaaaacccctgcatccttgataaacaacttgaagaagcctcccaaggaaaaactaaaaaaattggcaa

SEQ ID NO: 16897 - DNA, 75 bp, Artificial Sequence
  Synthetic
ctatggaatttatagaggaaactcatattgttacgggcgaatagagtgcacatgcaaaaacggcacaggactgct

SEQ ID NO: 16898 - DNA, 75 bp, Artificial Sequence
  Synthetic
atcctattgctgcaattcatacaactggagttaatccaagagcaaattagtcaattaaaaagaaggaccaagtta

SEQ ID NO: 16899 - DNA, 75 bp, Artificial Sequence
  Synthetic
gacataatttccactgaaatagttaaagtgcatgctaatatattcaaatgtaggctagaggatatagaaatcatt

SEQ ID NO: 16900 - DNA, 75 bp, Artificial Sequence
  Synthetic
aaaatggatccactaaacgaaggagttgtgaatgtgtacctacctgattcctatttgaagggtgtaatatctttt

SEQ ID NO: 16901 - DNA, 75 bp, Artificial Sequence
  Synthetic
agtgaaaccaatgcaataggatcttgccttctagggaaacactaccttaaaaaagataacacatcaaaagtagct

SEQ ID NO: 16902 - DNA, 75 bp, Artificial Sequence
  Synthetic
tatgttaatacatttctaagttaataaaaaaattgggacaagtcaacatggagcccctgaaagtctctggaagtg

SEQ ID NO: 16903 - DNA, 75 bp, Artificial Sequence
  Synthetic
atagaaagccctgttgtagagcacatcagattgaaaaatgctttccagactaggatcaaggagaagaacctaagg

SEQ ID NO: 16904 - DNA, 75 bp, Artificial Sequence
  Synthetic
taatatcatacttgagaagtcaatcaataaaatcttgatcattttaggattattattaattgcctcaactgtaat

SEQ ID NO: 16905 - DNA, 75 bp, Artificial Sequence
  Synthetic
gtagtggaacctgtcaacatgcaaagtgaagtcatgagaaattcttacacctgtgaactgaatttactcaaacaa

SEQ ID NO: 16906 - DNA, 75 bp, Artificial Sequence
  Synthetic
tacaatcacactcacagtggagtatataagagtagaaaatgaattgcaactttgcaagatgggagcagaagtggc

SEQ ID NO: 16907 - DNA, 75 bp, Artificial Sequence
  Synthetic
ctgtgaactgaatttactcaaacaacttataacgagaagcaaagacataagctcactcaaacttgacatgatatg

SEQ ID NO: 16908 - DNA, 75 bp, Artificial Sequence
  Synthetic
caagacaactctggaaccaccagcacagccaacgaagacaactcctacactaaccagcaccaggtcaaccaccgc

SEQ ID NO: 16909 - DNA, 75 bp, Artificial Sequence
  Synthetic
aaccttcaaaaccagaccagtttcaaggaccaatcatcacactaatcccagctgctggagagaggaggaaaagtg

SEQ ID NO: 16910 - DNA, 75 bp, Artificial Sequence
  Synthetic
ctgggtaagcacttggttcagcagctggtacaatttaaacaaacttatattagagtttaggcgtgaagaggtagc

SEQ ID NO: 16911 - DNA, 75 bp, Artificial Sequence
  Synthetic
ccagaacatcacagctaaatggtccaattgttttggcacatttctacctgtgagggtgaactgcacggtattaag

SEQ ID NO: 16912 - DNA, 75 bp, Artificial Sequence
  Synthetic
ctgcacagggtcaatcatatgcaaaacaatagggagcataatgtttattatttcatcatttgggtgtgttatcaa

SEQ ID NO: 16913 - DNA, 75 bp, Artificial Sequence
  Synthetic
aattgttttggcacatttctacctgtgagggtgaactgcacggtattaagagaattgtgtgatgagcagctaggc

SEQ ID NO: 16914 - DNA, 75 bp, Artificial Sequence
  Synthetic
aatcacacaacagttcaagtatcaaagaggtgtacatgcatatatgcattaaattgggattgtagttatgcttga

SEQ ID NO: 16915 - DNA, 75 bp, Artificial Sequence
  Synthetic
gagagaaactacactagcagactccaatgaggtccgcaaaagattaaaaaaacataaaccaattttttagttatt

SEQ ID NO: 16916 - DNA, 75 bp, Artificial Sequence
  Synthetic
taaaaatcatgagtatgtctggacagtgccaaggctaggaaaaactaacacgggaacaggtaatccaatgattac

SEQ ID NO: 16917 - DNA, 75 bp, Artificial Sequence
  Synthetic
gtgccaaggctaggaaaaactaacacgggaacaggtaatccaatgattacaaatgatcagagaaggaaaaacggg

SEQ ID NO: 16918 - DNA, 75 bp, Artificial Sequence
  Synthetic
taacagagcatgcacagtttagtacaaggtttagaaacactttattgaatgggttagtagaccaactggcaaaga

SEQ ID NO: 16919 - DNA, 75 bp, Artificial Sequence
  Synthetic
tgaggggcctaaataggaaaagagtttcaggcactgtcttagaaggaaaccagtatccaatgtatgagacaacat

SEQ ID NO: 16920 - DNA, 75 bp, Artificial Sequence
  Synthetic
cagtatccaatgtatgagacaacattagttacactaggggaagctttaaaaacaataagactcctagtaaacaag

SEQ ID NO: 16921 - DNA, 75 bp, Artificial Sequence
  Synthetic
aatgctgtctgtcatgtatgtggagtcaaatgaggccctgagtttatgtaggatccaagggactcccgctccaag

SEQ ID NO: 16922 - DNA, 75 bp, Artificial Sequence
  Synthetic
ggacaataagacaaacacagaaaacacaaaaaaggaaacaacattccacacaacgaccacaacaagggatccaga

SEQ ID NO: 16923 - DNA, 75 bp, Artificial Sequence
  Synthetic
cccaatggttgaagagagagaagctatggacgcagtcagacttaataatgaggtcacaaaaattctgaagttaga

SEQ ID NO: 16924 - DNA, 75 bp, Artificial Sequence
  Synthetic
gagtcttacagagttgagaggggcctttattttgagaatcataaaaggctttgttgacacaaataagagatggcc

SEQ ID NO: 16925 - DNA, 75 bp, Artificial Sequence
  Synthetic
ggtgagggaaacaaaaaccaccaagcccaagaccaatgaaggagcaacaagcccaagcaggaacctcaccaccaa

SEQ ID NO: 16926 - DNA, 75 bp, Artificial Sequence
  Synthetic
caaaatcaaaaatctcaaagtgttgagcagaaggtgggttatgtattttaaagcaaagagttacccaagccaatt

SEQ ID NO: 16927 - DNA, 75 bp, Artificial Sequence
  Synthetic
gggagacatacaccaaacgacaagagcaacaacagaggcagaactggaaaaacaaagcaagcaaaccatagagcc

SEQ ID NO: 16928 - DNA, 75 bp, Artificial Sequence
  Synthetic
aagcaaagagttacccaagccaattagaactgagtagtcaagatttccttgaattagcaggcgtgcagtttgagc

SEQ ID NO: 16929 - DNA, 75 bp, Artificial Sequence
  Synthetic
agacactagcaccaaaaagcacactcccacaaggccaagcagcgaatcccccaccacaacacaagcaactgcaca

SEQ ID NO: 16930 - DNA, 75 bp, Artificial Sequence
  Synthetic
actgacaacaccaacagccccaaaagcaagcatagcacccaagaacagacaggcaacaaccaaaaaaaccgaaac

SEQ ID NO: 16931 - DNA, 75 bp, Artificial Sequence
  Synthetic
taatatggtcagtgttccctaaaaattaccttccaacaaacatcagagaaagattcactgatgaaatgttcaact

SEQ ID NO: 16932 - DNA, 75 bp, Artificial Sequence
  Synthetic
gggcaccacaacaacaagcagagcaaagaaaaccaacaacccaacagagacagcaacaacaactctcaaagcaac

SEQ ID NO: 16933 - DNA, 75 bp, Artificial Sequence
  Synthetic
ttaccttccaacaaacatcagagaaagattcactgatgaaatgttcaactcaagtgaaaagttgaagacaagaag

SEQ ID NO: 16934 - DNA, 75 bp, Artificial Sequence
  Synthetic
aacagaaacaggcaagggcaaagaggggccaacacagcacacaatcaaagaacagcccgaaacaacagcaggaga

SEQ ID NO: 16935 - DNA, 75 bp, Artificial Sequence
  Synthetic
aacaactaccccacagtcaagaagaacaaccagcaggccagccccaacaacaaaaaccgaagaggaggcagaaac

SEQ ID NO: 16936 - DNA, 75 bp, Artificial Sequence
  Synthetic
taagtgtgggaaggatgttcgcaatgcaaccaggaaaacaaaggcaagttcagatcttggcagaaaagctacttg

SEQ ID NO: 16937 - DNA, 75 bp, Artificial Sequence
  Synthetic
caccaaaacaagaacaaccaaaagcacccaaacaagcacaggcccaccaggaccaacaagaagcacacccagcaa

SEQ ID NO: 16938 - DNA, 75 bp, Artificial Sequence
  Synthetic
cagacaacatagtaccattctttcctgagacattgacaaaatatggtgacctagaactacaaaggattatggaaa

SEQ ID NO: 16939 - DNA, 75 bp, Artificial Sequence
  Synthetic
aacagcgacagaaaacaacaagagaaccacaacaataaagagaccaaatacagcgaacacagacagcagacaaca

SEQ ID NO: 16940 - DNA, 75 bp, Artificial Sequence
  Synthetic
ctagaactacaaaggattatggaaataaaatctgagttgtcatcagtaaagtcacggagaaatgacagttacaac

SEQ ID NO: 16941 - DNA, 75 bp, Artificial Sequence
  Synthetic
gtcacggagaaatgacagttacaacaattatattgctagagcatcaatagtgactgatcttagtaaatttaacca

SEQ ID NO: 16942 - DNA, 75 bp, Artificial Sequence
  Synthetic
gaccagaacaactgcagagcaagaccgacagattcaaaccaaggccaaacccaccacaaatggggcccatgcgca

SEQ ID NO: 16943 - DNA, 75 bp, Artificial Sequence
  Synthetic
ggcatttcggtatgagacatcttctgtctgtgcagatgtagttgatgaattgcatggcacacagagtctattctg

SEQ ID NO: 16944 - DNA, 75 bp, Artificial Sequence
  Synthetic
aaccaccaccaccccagagcacaacacagacacaacaaacagcacaaaggaaagttccaaggaggacaaaacaac

SEQ ID NO: 16945 - DNA, 75 bp, Artificial Sequence
  Synthetic
ctggctgcatttgactgtgccgttgacgactatgatttgcacatataggcatgcccctccagaaacagaaggagt

SEQ ID NO: 16946 - DNA, 75 bp, Artificial Sequence
  Synthetic
cagagaccccagcagcaaaacaccaaccgatcaagaggatgccagcaaagggacaaccgcagccaatcccagaaa

SEQ ID NO: 16947 - DNA, 75 bp, Artificial Sequence
  Synthetic
acgactatgatttgcacatataggcatgcccctccagaaacagaaggagtgtatgatattgataaaatcaaagaa

SEQ ID NO: 16948 - DNA, 75 bp, Artificial Sequence
  Synthetic
aaacaccgaggcaaacacgagaacacccccaacaactaccccgacaaggcacaccacagaatcggccacaagcac

SEQ ID NO: 16949 - DNA, 75 bp, Artificial Sequence
  Synthetic
tgggagggattgaggggtggtgccaaaagttgtggactatggaggctatctctttgttagatgtggtatcagtca

SEQ ID NO: 16950 - DNA, 75 bp, Artificial Sequence
  Synthetic
aacaggggacaaaaccaaagcaaaaaccacaagatggaaaagcacagcagacagacaacccataaggaacagcac

SEQ ID NO: 16951 - DNA, 75 bp, Artificial Sequence
  Synthetic
aacagcagaaaccaagacagcccagagcaaacaacccacaccgaaacagctgagcaacaacacaacaccagagaa

SEQ ID NO: 16952 - DNA, 75 bp, Artificial Sequence
  Synthetic
cactacaccaccgaacaacaaaagcagcagccaaacagacgccgcaccaacagaagaaatagaaatcagatcaag

SEQ ID NO: 16953 - DNA, 75 bp, Artificial Sequence
  Synthetic
aagatatagggcacaagttaaaggagggagagacatatatatctagagacctacaattcatgagcaaggtcattc

SEQ ID NO: 16954 - DNA, 75 bp, Artificial Sequence
  Synthetic
cctctggcgaaggagatatgtttatgggccctgcagagagaatgttctggaacatccgatgaatccatgttttaa

SEQ ID NO: 16955 - DNA, 75 bp, Artificial Sequence
  Synthetic
agtcagagggcgtgatgcatccatcaccaataaagaagattctgagggttggaccatggattaatactatcttag

SEQ ID NO: 16956 - DNA, 75 bp, Artificial Sequence
  Synthetic
ggacaacactacatggatttattcggacaatggaaggaatttgccagctggttattatgatagtaaaacagataa

SEQ ID NO: 16957 - DNA, 75 bp, Artificial Sequence
  Synthetic
atgacatcaaaactagtgcagaatcaataggaagcctatgccaagagttagaatttagaggtgaaagcctcttgg

SEQ ID NO: 16958 - DNA, 75 bp, Artificial Sequence
  Synthetic
aataatttgctatggaatttatagaggtaactcatattgttatgggcgaatagagtgcacatgtaaaaatggaac

SEQ ID NO: 16959 - DNA, 75 bp, Artificial Sequence
  Synthetic
ttagcctcatcctaaggaatttttggctatatgaattatggatgcatgaatctaagagtcatccacttgcgggga

SEQ ID NO: 16960 - DNA, 75 bp, Artificial Sequence
  Synthetic
tagagtgcacatgtaaaaatggaacaggactactatcctactgctgcaactcgtacaactggagttagtttaaga

SEQ ID NO: 16961 - DNA, 75 bp, Artificial Sequence
  Synthetic
agcagctatatagacagctgagcaagacattagcaataactcaaaagttctttggaataacaaaggaaaccgatg

SEQ ID NO: 16962 - DNA, 75 bp, Artificial Sequence
  Synthetic
gcaagttagttaattaaaaagaaggaccaagttaaaaatggatccactaaatgaaggggttgtgaatgtgtacct

SEQ ID NO: 16963 - DNA, 75 bp, Artificial Sequence
  Synthetic
ttgttaatctgtggatgaatgttccaatgcaatttggtgggggtgaccctgtagtactgtataggtcattttacc

SEQ ID NO: 16964 - DNA, 75 bp, Artificial Sequence
  Synthetic
ggaggacaccagatttcttgactgaagcaatcagtcatatgagtgtactactcaaggtgtatgggaaagcgaaag

SEQ ID NO: 16965 - DNA, 75 bp, Artificial Sequence
  Synthetic
aggggtcaaagaaagagtttttcaaagcattattatcagtggacaaaaataagagggctactctgaccacattaa

SEQ ID NO: 16966 - DNA, 75 bp, Artificial Sequence
  Synthetic
tagaacacatcagattaagaaatgctttccagactaggatcaaggagaaaaacctaagggtagtggaacccgtca

SEQ ID NO: 16967 - DNA, 75 bp, Artificial Sequence
  Synthetic
tgagagaccctcaagcggtggggtcagagagacaggcaagagtcactagtgaaattaatagagcagcagtcacaa

SEQ ID NO: 16968 - DNA, 75 bp, Artificial Sequence
  Synthetic
gtgtcttgagcctatcacctaatcaacttttctgtgatagtgcaatacactacagcaggaatgaagaagaagttg

SEQ ID NO: 16969 - DNA, 75 bp, Artificial Sequence
  Synthetic
catgatatgtgactggttgcaattaaaatcgacatccgaaaatccatctgtcctaaagtttgtggatgtgaggtg

SEQ ID NO: 16970 - DNA, 75 bp, Artificial Sequence
  Synthetic
ggttaatagcccaaaacattacaccagtttatccacatgggctgagggtgttatatgagtcattgccattccaca

SEQ ID NO: 16971 - DNA, 75 bp, Artificial Sequence
  Synthetic
tattcctgactgggtgagcacttggttcagcagctggtacaatttaaacaagcttatattagagtttagacgtga

SEQ ID NO: 16972 - DNA, 75 bp, Artificial Sequence
  Synthetic
agtttatccacatgggctgagggtgttatatgagtcattgccattccacaaggcagagaaagttgtaaacatgat

SEQ ID NO: 16973 - DNA, 75 bp, Artificial Sequence
  Synthetic
agaagtagcctgcacagggtctattatttgtaaaacaatagggagcataatgtttatcatttcatcatttgggtg

SEQ ID NO: 16974 - DNA, 75 bp, Artificial Sequence
  Synthetic
atctggaacaaaatctatcacaaacttgctacaaaggacatcagcaatcaatggagaagacattgacagagcggt

SEQ ID NO: 16975 - DNA, 75 bp, Artificial Sequence
  Synthetic
ctcaatgatgttggagaatctagggttgctctctaggatactatctgtgagccaagatgatataatcttaccaac

SEQ ID NO: 16976 - DNA, 75 bp, Artificial Sequence
  Synthetic
caaagcaaacggtgatctgatatgttgtcaagtctctaggactttgagggaaaggtcctgggataacatggaaat

SEQ ID NO: 16977 - DNA, 75 bp, Artificial Sequence
  Synthetic
caaagagcccttgggttgggtccagtacacaggagaaaaaattggttcctgtttacaacagacaaatcctctcaa

SEQ ID NO: 16978 - DNA, 75 bp, Artificial Sequence
  Synthetic
gtttacaacagacaaatcctctcaaagcaacaaaaggaacaactagaggcaattggaaaactaagatgggtttat

SEQ ID NO: 16979 - DNA, 75 bp, Artificial Sequence
  Synthetic
cttagggatcagttacaagaatgtaaagccactcttgccaagatttatgagtgttaacttcttacacagactttc

SEQ ID NO: 16980 - DNA, 75 bp, Artificial Sequence
  Synthetic
cgttagtagtagaccaatggagtttccagcatctgtccctgcttacagaacaactaattaccatttcgacacaag

SEQ ID NO: 16981 - DNA, 75 bp, Artificial Sequence
  Synthetic
ccagcatctgtccctgcttacagaacaactaattaccatttcgacacaagtcctgtaaaccagactctgagtgaa

SEQ ID NO: 16982 - DNA, 75 bp, Artificial Sequence
  Synthetic
agatttggaaatgaggacatcaacttggtgtttcaaaatgctatcagctgtgggataagtgtgatgagtgtagta

SEQ ID NO: 16983 - DNA, 75 bp, Artificial Sequence
  Synthetic
gagcaacttacaggcagaagccctaaacagttagtaatgattccccaactagaagaaattgacataatgcctccg

SEQ ID NO: 16984 - DNA, 75 bp, Artificial Sequence
  Synthetic
cctgttttttcaggaaaatttgattataaactggtagaaaagatatcatcagatcaacacattttcagccccgac

SEQ ID NO: 16985 - DNA, 75 bp, Artificial Sequence
  Synthetic
aaattggacttggtgactctaggcaaaatgttaatgccttcaacaagtggagcaaagtctgaccaattttggaac

SEQ ID NO: 16986 - DNA, 75 bp, Artificial Sequence
  Synthetic
ccctaaaaattatcttccaacaaacatcagagagagattcactgaagaaatgttcaactcaagtgagaaattgaa

SEQ ID NO: 16987 - DNA, 75 bp, Artificial Sequence
  Synthetic
aggaaagaaaacttcttccatggcaataatttggtagagtctctttctgcagcattggcttgtcattggtgcggg

SEQ ID NO: 16988 - DNA, 75 bp, Artificial Sequence
  Synthetic
gacaagaagggtgttggagtattacttaaaagacaacaagtttgatcagaatgacctgaaaaaatatgttgttag

SEQ ID NO: 16989 - DNA, 75 bp, Artificial Sequence
  Synthetic
atcttaactgaacagtgtaatgagaataatatttttagaagagaatggggtgatggttttgttacggatcatgcc

SEQ ID NO: 16990 - DNA, 75 bp, Artificial Sequence
  Synthetic
atgacctgaaaaaatatgttgttaggcaagagtacttaggtgataaggaacatgtagtgtcattaacagggaaag

SEQ ID NO: 16991 - DNA, 75 bp, Artificial Sequence
  Synthetic
tttatagatttcaaaatatttatcggtgtatttaagactaaactattgtgtggatggggatccagggggggagat

SEQ ID NO: 16992 - DNA, 75 bp, Artificial Sequence
  Synthetic
attaaagatagagacatgatagacgaatctattgacaaattaataagagttgacaactctttctggaggatgttt

SEQ ID NO: 16993 - DNA, 75 bp, Artificial Sequence
  Synthetic
agtaaagtaatacttgaaccaaaagtgaagaaaagggtgatgctttttgatgtgaaaatcttatcacttgtaggc

SEQ ID NO: 16994 - DNA, 75 bp, Artificial Sequence
  Synthetic
tgtgaaaatcttatcacttgtaggctatgcgggatttaaaaactggtttattgaccacctgagatctagtgaatt

SEQ ID NO: 16995 - DNA, 75 bp, Artificial Sequence
  Synthetic
gtgtgaagtgccatgggttgtcaatgctgatagtgaaattgttgaggtgtctgctgtgaaaatatatttacagtt

SEQ ID NO: 16996 - DNA, 75 bp, Artificial Sequence
  Synthetic
gctgagggtgagttctcctttgagaatcacagtattgaattattcagacatggcccatgctattaccaggttaat

SEQ ID NO: 16997 - DNA, 75 bp, Artificial Sequence
  Synthetic
tggcccatgctattaccaggttaataagaaggaaatcaatgcatgacaatgtgccatcaatatctaggacactgt

SEQ ID NO: 16998 - DNA, 75 bp, Artificial Sequence
  Synthetic
tgaagaattatgaaactgtaccagggtctactagaggaaagttgacgagaaattacatggtgatgttgccttggc

SEQ ID NO: 16999 - DNA, 75 bp, Artificial Sequence
  Synthetic
agcatattaatagattcaattttgtattcagctctaccggttgcaaaataagtgttaaatcatgtattgggaagt

SEQ ID NO: 17000 - DNA, 75 bp, Artificial Sequence
  Synthetic
ttaggttgtcacaaggagttgatgaagttaaagctgactatagcctggcagtgaaaatgttaaaagaaataagaa

SEQ ID NO: 17001 - DNA, 75 bp, Artificial Sequence
  Synthetic
tttttattttgtgggagaaggagccggcaattggatggcaagaacagcttgtgagtatccaaatacaaagtttgt

SEQ ID NO: 17002 - DNA, 75 bp, Artificial Sequence
  Synthetic
ttacaggagtcttaaagacgatttagaccatcatttccctttggagtttcagagagtcctggggaacatgaatag

SEQ ID NO: 17003 - DNA, 75 bp, Artificial Sequence
  Synthetic
gcatccatcaccgataaagaagattttgagggttgggccatggatcaatactatcctagatgacatcaaaaccag

SEQ ID NO: 17004 - DNA, 75 bp, Artificial Sequence
  Synthetic
agagagtcctggggaacatgaatagagttatagatggtggagaaggtctatccatggatacaacagatgcaactc

SEQ ID NO: 17005 - DNA, 75 bp, Artificial Sequence
  Synthetic
agaaaactcattgggatctgatacatagaatttgtaaagatgcactgctaattacattgtgcgatgctgaattta

SEQ ID NO: 17006 - DNA, 75 bp, Artificial Sequence
  Synthetic
aagacagagatgactttttcaagatggtgacactatggagaaagcatgttttgtcgtgtagaatatgtacaactt

SEQ ID NO: 17007 - DNA, 75 bp, Artificial Sequence
  Synthetic
atgggacagatctctacctgtttgcaaaatatcatgcaaaggaggaaagcataaaacttccctattttgttagat

SEQ ID NO: 17008 - DNA, 75 bp, Artificial Sequence
  Synthetic
caattgccacatatgtcatgcaaggcagtaaactgtcaggatccgagtgctatgttcttctgacacttggtcacc

SEQ ID NO: 17009 - DNA, 75 bp, Artificial Sequence
  Synthetic
acaacaacctaccatgtcacggggaggtacagagctccaaattaaaaatggctgtgtgtaatgacttcagcatcc

SEQ ID NO: 17010 - DNA, 75 bp, Artificial Sequence
  Synthetic
ccaggaaagtagaagtgaaggctgttgaggcaaactgcaaatcactgctttctggcctaaggacacctataaaca

SEQ ID NO: 17011 - DNA, 75 bp, Artificial Sequence
  Synthetic
gagcagaattagatcggcaaaagaagatgttgacactaagaagttatcactcatcagttgcaacagttggaggca

SEQ ID NO: 17012 - DNA, 75 bp, Artificial Sequence
  Synthetic
gcagggtcatcgaatcaaaatggttgagcaagaaagctattaccataattgagtggttagaacacatcctggatt

SEQ ID NO: 17013 - DNA, 75 bp, Artificial Sequence
  Synthetic
ccccaaaaggggagttaaactacgattttttcgaggcattagagaacacctatccaaatatgattaaattattag

SEQ ID NO: 17014 - DNA, 75 bp, Artificial Sequence
  Synthetic
aaacatgatatctggaacaaaatctatcacaaacttgctacaaaggacgtcagcaatcaatggagaagacattga

SEQ ID NO: 17015 - DNA, 75 bp, Artificial Sequence
  Synthetic
ataatcttggcagtgctgaacttaaaaagctaattaaagtgacaggttacatgctgatgagtaagaaataatgga

SEQ ID NO: 17016 - DNA, 75 bp, Artificial Sequence
  Synthetic
agaaaattaccttaagaaattgcttgaaattaagacttaaaaataacatatccgtgttgaggaatattaaaatga

SEQ ID NO: 17017 - DNA, 75 bp, Artificial Sequence
  Synthetic
tagttacttaaatttaataatctgaatatgaagtgcacaatcagcaattagttattaaaaaatagggaactgaaa

SEQ ID NO: 17018 - DNA, 75 bp, Artificial Sequence
  Synthetic
ctttgagagaaaggtcctgggataacatggaaattgttggagtcacctcaccgagtatagttacatgtatgaaca

SEQ ID NO: 17019 - DNA, 75 bp, Artificial Sequence
  Synthetic
atgaagtgcacaatcagcaattagttattaaaaaatagggaactgaaattggatgaatacggtttttttgccgta

SEQ ID NO: 17020 - DNA, 75 bp, Artificial Sequence
  Synthetic
tagtgtattccagcagctctcaactaaaaggaataacaattgaaaagttcagcacagataaaactacaagaggtc

SEQ ID NO: 17021 - DNA, 75 bp, Artificial Sequence
  Synthetic
aaagaggaccaaaaagtccttgggttgggtccagcacacaagagaaaaaattggttcctgtttacaacaggcaaa

SEQ ID NO: 17022 - DNA, 75 bp, Artificial Sequence
  Synthetic
ttggttcctgtttacaacaggcaaatcctttcaaagcaacagaaagaacaactagaggcaatcgggaaactaaga

SEQ ID NO: 17023 - DNA, 75 bp, Artificial Sequence
  Synthetic
tgggtttataaggggactcaagggttaaggaggttgttagataaaatctgcatagggagcttagggatcagttac

SEQ ID NO: 17024 - DNA, 75 bp, Artificial Sequence
  Synthetic
gatttatgagtgttaacttcctacacagactttccgtcagcagtagaccaatggaatttccagcatctgtccctg

SEQ ID NO: 17025 - DNA, 75 bp, Artificial Sequence
  Synthetic
aatttgattacaaactggtagaaaagatatcttcagaccaacacattttcagccctgacaaattggacttagtga

SEQ ID NO: 17026 - DNA, 75 bp, Artificial Sequence
  Synthetic
tagtagtagactccgcaagaagaagcagaaactgaaaagaattattgaaaagatggaagggtggtatttgattgt

SEQ ID NO: 17027 - DNA, 75 bp, Artificial Sequence
  Synthetic
gtttgcatagtgggcacagtttcaaaacttcaaccatctgatactcttttgttcttaggtccactagaacaaggg

SEQ ID NO: 17028 - DNA, 75 bp, Artificial Sequence
  Synthetic
cttgggagtctgctctacattgacactggcaatgcctagaaccatctatgaactcaggatggaatgcccgcatac

SEQ ID NO: 17029 - DNA, 75 bp, Artificial Sequence
  Synthetic
ggaatcattcttaagcaatggtgcacaacatcatgtgcatttggggaccctggtgatatcatgtccactcccagt

SEQ ID NO: 17030 - DNA, 75 bp, Artificial Sequence
  Synthetic
tgtgggcttgggtcaaggttatattatagggtcaactgagctcgggctgattccgattgagactgtatcggattt

SEQ ID NO: 17031 - DNA, 75 bp, Artificial Sequence
  Synthetic
ggtatgaggtgtccagagcacactggatcatttaggaaaatttgcggttttgctactacaccagtttgtgaatat

SEQ ID NO: 17032 - DNA, 75 bp, Artificial Sequence
  Synthetic
gaagctagaaagctcatgtaattttgacctccatacaacctcaatgactcaaaaaagctatacacaagttgagtg

SEQ ID NO: 17033 - DNA, 75 bp, Artificial Sequence
  Synthetic
caaggaaataccatttctggatataaaagaatgatggcaacaaaagattcattccaatcatttaacttaacagaa

SEQ ID NO: 17034 - DNA, 75 bp, Artificial Sequence
  Synthetic
gaggaagaaaagtgatacaactgacacaacaaatgctgcatcaacaacatttgaagcacagactaagacagtaaa

SEQ ID NO: 17035 - DNA, 75 bp, Artificial Sequence
  Synthetic
cctcacatcacaacaaacaagcttgaatggatcgacccagatgggaatacaagagaccacgtaaaccttgtctta

SEQ ID NO: 17036 - DNA, 75 bp, Artificial Sequence
  Synthetic
ccttcgtgggacgtgtgtgctggcatcagaactctatgacacattgaagaaaattaaaaagacagtcctctgtta

SEQ ID NO: 17037 - DNA, 75 bp, Artificial Sequence
  Synthetic
aatagagatgtctcatttcaggatttaagtgataacccctgtaaagtagacctacacacacaagcaatagaaggg

SEQ ID NO: 17038 - DNA, 75 bp, Artificial Sequence
  Synthetic
tgatttaacctgtaaccaaacacattgccaaccaacagtctatctgattgcaccagtatctacatgcatgtcaat

SEQ ID NO: 17039 - DNA, 75 bp, Artificial Sequence
  Synthetic
gcatggggttctggtgtagggtttacactcacatgtactgtcggattaacagagtgcccaagttttatgacatca

SEQ ID NO: 17040 - DNA, 75 bp, Artificial Sequence
  Synthetic
aaggagctgcatggcaagtgtcttcactaataggattcaggtgatttatgagaagactcattgtgtcacagggca

SEQ ID NO: 17041 - DNA, 75 bp, Artificial Sequence
  Synthetic
attaaggcatgtgacctagctatgtgttatggatcaacagtaacaaaccttgccaggggctctaatacagtgaaa

SEQ ID NO: 17042 - DNA, 75 bp, Artificial Sequence
  Synthetic
actagttgagggtcaatgctttaatcctgcacatactctaactctctcacagccagcccacacctatgagatggt

SEQ ID NO: 17043 - DNA, 75 bp, Artificial Sequence
  Synthetic
gtagttggtaaaggaggccattcagggtcctcatttaaatgctgtcatgatacagattgctcctctgaaggttta

SEQ ID NO: 17044 - DNA, 75 bp, Artificial Sequence
  Synthetic
aacattaccagtcacctgcttttttacacctaaaaaatctgatcagttgaagctgataaagacatttgagggaat

SEQ ID NO: 17045 - DNA, 75 bp, Artificial Sequence
  Synthetic
cttgcatcagcccctcatcttgagagggtaacaggattcaatcaaattgattcagataaggtttatgatgatggt

SEQ ID NO: 17046 - DNA, 75 bp, Artificial Sequence
  Synthetic
aatcagtaaaacaggctgcacagagaatgcactgcaagggtattatgtttgcttccttggcagtcattcagaacc

SEQ ID NO: 17047 - DNA, 75 bp, Artificial Sequence
  Synthetic
gcaccaccttgcacattcaaatgctggttcactaagtcaggtgagtggcttcttgggatcttaaacgggaattgg

SEQ ID NO: 17048 - DNA, 75 bp, Artificial Sequence
  Synthetic
tttgcatgttccgagcttagaagacatccgttcagttgaagtgttcagtagaatgattatacatccaaggggtga

SEQ ID NO: 17049 - DNA, 75 bp, Artificial Sequence
  Synthetic
cagtgttttgtgtcccaggagagggcacaagaaaactgtctaagcattgacctcaactcctacattagatcatat

SEQ ID NO: 17050 - DNA, 75 bp, Artificial Sequence
  Synthetic
agatcatgatccaattcaaaactcacagggattcttacggatagttggcccaataacagcaaaagtgccaagtac

SEQ ID NO: 17051 - DNA, 75 bp, Artificial Sequence
  Synthetic
cacaagaaaactgtctaagcattgacctcaactcctacattagatcatatacatttatgcacttcctcatattta

SEQ ID NO: 17052 - DNA, 75 bp, Artificial Sequence
  Synthetic
cagttctactgatacccttaaagggactgcatttgctggtgtcccaatgtacagctctttatcaacactggtgag

SEQ ID NO: 17053 - DNA, 75 bp, Artificial Sequence
  Synthetic
aaccacagatccagagtatgtcttttcacccgggataataccagagtccaatcacagtacctgtgacaagaagac

SEQ ID NO: 17054 - DNA, 75 bp, Artificial Sequence
  Synthetic
tagtagtagactccttgagaagctactgctgcgaaagctggaatgagcaccctccaagaattgcaggaaaacatc

SEQ ID NO: 17055 - DNA, 75 bp, Artificial Sequence
  Synthetic
tatccctcttacatggacaggttatcttcccattgcaggcgagatggaaaaagtcactggatgtacagtcttctg

SEQ ID NO: 17056 - DNA, 75 bp, Artificial Sequence
  Synthetic
acagcacacgaacaacagctcgtgactgctcggcaaaagcttaaggatgccgagaaggcagtggaggtggacccg

SEQ ID NO: 17057 - DNA, 75 bp, Artificial Sequence
  Synthetic
tactttggcaggccctggagcaagttgtgaggcttactctgagcatggtatctttaatattagctcacctacttg

SEQ ID NO: 17058 - DNA, 75 bp, Artificial Sequence
  Synthetic
gatgacgttaacaagagcacactacaaagtagacgggcagctgtgtctacattggagaccaaactcggagaactt

SEQ ID NO: 17059 - DNA, 75 bp, Artificial Sequence
  Synthetic
tcttgtccacaaagtacagaaattcaggggctcagagcaaaagattaatttcatttgtcagagggttgatcaaga

SEQ ID NO: 17060 - DNA, 75 bp, Artificial Sequence
  Synthetic
aagaggcaacttgcagatttggtggcagctcaaaaattggctacaaaaccagttgatccaacagggcttgagcct

SEQ ID NO: 17061 - DNA, 75 bp, Artificial Sequence
  Synthetic
tgtagttgtttattgtaatgggcagaagaaggtaattctgacaaaggatctggtaataggccaatgcatatacac

SEQ ID NO: 17062 - DNA, 75 bp, Artificial Sequence
  Synthetic
gatgatcatctaaaggaaaaatcatctctgagatatgggaatgtcctggatgttaattcaattgatttggaagaa

SEQ ID NO: 17063 - DNA, 75 bp, Artificial Sequence
  Synthetic
tttcacaagcctgttctcattgatgcctgatgtggcccattcattagccgttgagttatgtgtgccaggtttgca

SEQ ID NO: 17064 - DNA, 75 bp, Artificial Sequence
  Synthetic
ccgagtggacagactgctgattggaaggctataggagcatacatcttagggtttgcaattccgatcatcctaaag

SEQ ID NO: 17065 - DNA, 75 bp, Artificial Sequence
  Synthetic
tggatgggcaactgtcatgcttctatcaaccttttgttttggatggatcctaataccagcaattaccttagttgt

SEQ ID NO: 17066 - DNA, 75 bp, Artificial Sequence
  Synthetic
gccttatacatgctgtcaacccgtgggagacaaactgtgaaagacaacaaagggaccaggataaggtttaaggat

SEQ ID NO: 17067 - DNA, 75 bp, Artificial Sequence
  Synthetic
cctaaaattcttaaagatggcaacattctcttgttcacattataccaatgagtcaaaattcaaatttatattaga

SEQ ID NO: 17068 - DNA, 75 bp, Artificial Sequence
  Synthetic
gattcttcctttgaagaagtcaatgggatacgtaaaccaaaacacctttacgtctcaatgccaactgcacagtcc

SEQ ID NO: 17069 - DNA, 75 bp, Artificial Sequence
  Synthetic
gaaagttaaggttgagtaccaaaagacaatgggatccatggtttgtgatatctgccaccatgagtgtgaaacagc

SEQ ID NO: 17070 - DNA, 75 bp, Artificial Sequence
  Synthetic
actatgaaggctgaagaaatcacgccaggacgatttaggacaattgcttgtggcctttttccagcacaggtcaaa

SEQ ID NO: 17071 - DNA, 75 bp, Artificial Sequence
  Synthetic
aaaagaattagaatcccataaacaaagctgcatcaacgggcaatgcccttactgtatgaccatgacagaggcaac

SEQ ID NO: 17072 - DNA, 75 bp, Artificial Sequence
  Synthetic
gcccgaaatataataagtcctgtaatgggagtaattggatttggcttctttgtaaaggattggatggatcggata

SEQ ID NO: 17073 - DNA, 75 bp, Artificial Sequence
  Synthetic
agaaagtgccttacaggctcattactctatttgtaaattaacaggcagattccaggaagctttaaagaaatcact

SEQ ID NO: 17074 - DNA, 75 bp, Artificial Sequence
  Synthetic
gaagagtttctggctgcagagtgtccattcttacctaagccaaaggtcgcctcagaagccttcatgtctaccaat

SEQ ID NO: 17075 - DNA, 75 bp, Artificial Sequence
  Synthetic
gaagagaccagaagtcaaaaagggttgttatcgtacattaggggtatttaggtacaagagtagatgctatgttgg

SEQ ID NO: 17076 - DNA, 75 bp, Artificial Sequence
  Synthetic
aagatgtattttctgaacagacagagacaagtcaatgaatctaaggttcaagatattatcgatttgatagaccat

SEQ ID NO: 17077 - DNA, 75 bp, Artificial Sequence
  Synthetic
gctggtgtggtgtgtgctcttaacatgtgaacttatcgtatgggctgctagtgcagagactccacttcttgagtc

SEQ ID NO: 17078 - DNA, 75 bp, Artificial Sequence
  Synthetic
gctgagaccgagtctgctaccttgtttacagagattgcaacaccccattcagtctgggtgtttgcatgtgcacct

SEQ ID NO: 17079 - DNA, 75 bp, Artificial Sequence
  Synthetic
aggatggtcagatacagcacatggtgtaggagaggttccaatgaaaacagatttggagctggatttttcacttcc

SEQ ID NO: 17080 - DNA, 75 bp, Artificial Sequence
  Synthetic
gaccggtgccctccaactgcattgtatgttgcaggggtaccggaacttggtgcatttttttctatccttcaggac

SEQ ID NO: 17081 - DNA, 75 bp, Artificial Sequence
  Synthetic
atcttcatcttcttacagctacagaagaaaactgaccaatcctgcaaacaaggaggaatcaatcccttttcattt

SEQ ID NO: 17082 - DNA, 75 bp, Artificial Sequence
  Synthetic
atgcgtaataccatcatggcatctaaatctgtagggactgcagaagagaagctaaagaaaaaatctgccttctac

SEQ ID NO: 17083 - DNA, 75 bp, Artificial Sequence
  Synthetic
tcagatggaaaagcaagtgatacatgcagaaattcaaacattggggcattggatggatgcaacattcaatattaa

SEQ ID NO: 17084 - DNA, 75 bp, Artificial Sequence
  Synthetic
caatcatacctaagaaggacacaatctatgggaatccaactggaccagaagatcataatcctttacatgctatca

SEQ ID NO: 17085 - DNA, 75 bp, Artificial Sequence
  Synthetic
aactgcatttcattgttatggtgcctgccaaaagtattcttacccgtggcaaactgcaaaatgtttcttcgagaa

SEQ ID NO: 17086 - DNA, 75 bp, Artificial Sequence
  Synthetic
tggggtaaagaagctgtgaatcacttccatcttggtgatgatatggaccctgaactcaggcagctagcacaatct

SEQ ID NO: 17087 - DNA, 75 bp, Artificial Sequence
  Synthetic
agattatcagtatgaaactggctggggttgcaatcctggggactgtcctggatttggaacgggctgcactgcttg

SEQ ID NO: 17088 - DNA, 75 bp, Artificial Sequence
  Synthetic
ctgatcgatactaaggtgaaggagatctccaaccaagagccacttaagttgtaggtgcttaatgaaatcatgatt

SEQ ID NO: 17089 - DNA, 75 bp, Artificial Sequence
  Synthetic
tggtgtgtatttagataagcttaaatctgttggaaaggcatataagatcatctctctgaaatacaccaggaaggt

SEQ ID NO: 17090 - DNA, 75 bp, Artificial Sequence
  Synthetic
gaagaaagactttccgggcttgtgccacatattaatcatctcaggacctatccttaatgtgattaatagggtttt

SEQ ID NO: 17091 - DNA, 75 bp, Artificial Sequence
  Synthetic
ttgcatccaactaggtacagagcaaacatgcaaacatattgatgcaaatgactgtttagtgacaccatctgtgaa

SEQ ID NO: 17092 - DNA, 75 bp, Artificial Sequence
  Synthetic
attataagggcagttaatggggttggttactaactatgggtaagggttcattaccatttttgcactagggttaaa

SEQ ID NO: 17093 - DNA, 75 bp, Artificial Sequence
  Synthetic
agtatgcattataggaactgtctcaaagctccagccttctgataccttgttgttcctaggccctttagaacaagg

SEQ ID NO: 17094 - DNA, 75 bp, Artificial Sequence
  Synthetic
gggccactacattgtatttgcactaagggaaatgggaggtgggttagtttgtatttagttgttaagttttttata

SEQ ID NO: 17095 - DNA, 75 bp, Artificial Sequence
  Synthetic
ggggattctactgaagcaatggtgtactacttcatgtgcatttggggatcctggtgatataatgtcaacaactag

SEQ ID NO: 17096 - DNA, 75 bp, Artificial Sequence
  Synthetic
atcatatgttaatgaggaattagctatatgatatcactgattgattggctatttttaggttaagtaattgtagtt

SEQ ID NO: 17097 - DNA, 75 bp, Artificial Sequence
  Synthetic
tggaatgagatgccccgaacatactgggtccttccgaaaaatttgtgggtttgcaacaacacctgtttgtgagta

SEQ ID NO: 17098 - DNA, 75 bp, Artificial Sequence
  Synthetic
aaatagttgtgttaagttagtatgttaaggtttataggttaagatttactaacaatcatattatgtcattagatg

SEQ ID NO: 17099 - DNA, 75 bp, Artificial Sequence
  Synthetic
ccaagggaacacaatctcaggatataaaagaatgatggccacaaaggattcattccaatctttcaatttgactga

SEQ ID NO: 17100 - DNA, 75 bp, Artificial Sequence
  Synthetic
taaatttcattcctggcttgcttctgctttcgcattgctaacctacaacaagactacctcacccactacccctcc

SEQ ID NO: 17101 - DNA, 75 bp, Artificial Sequence
  Synthetic
tccacatattacaacaaataaacttgaatggattgaccctgatggtaacacacgcgatcatgtaaatttagtatt

SEQ ID NO: 17102 - DNA, 75 bp, Artificial Sequence
  Synthetic
tagtagtagactccgcaagaagaagcaaaaactgaagaaagttatagaaaagatggaagggtggtatttgattgt

SEQ ID NO: 17103 - DNA, 75 bp, Artificial Sequence
  Synthetic
ctcccctattctacctcaacacatactacctcacatttgatttttcttgattgcttttcaaggagcatactacta

SEQ ID NO: 17104 - DNA, 75 bp, Artificial Sequence
  Synthetic
gaatagagatgtttcatttcaggatctaagtgataacccatgtaaggttgatctacacacacaagctatagaagg

SEQ ID NO: 17105 - DNA, 75 bp, Artificial Sequence
  Synthetic
cttgggagtctgctctactttgacactggcaatgccgaaaaccatttatgaactcaaaatggaatgcccgcatac

SEQ ID NO: 17106 - DNA, 75 bp, Artificial Sequence
  Synthetic
agcatggggttcaggtgttggatttacattaacttgtactgtcggattgactgagtgccctagtttcattacatc

SEQ ID NO: 17107 - DNA, 75 bp, Artificial Sequence
  Synthetic
tgtgggactcggtcaagggataattgttggttctacagagcttgggttgataccaattgagacagcatcagactt

SEQ ID NO: 17108 - DNA, 75 bp, Artificial Sequence
  Synthetic
aattaaagcatgtgatatggcaatgtgttacggatcaactgtctctaatttagctaggggttccaatacagtgaa

SEQ ID NO: 17109 - DNA, 75 bp, Artificial Sequence
  Synthetic
aaagcttgaaagttcatgcaatttcgatctgcatactacatccatgacccaaaaaagttatacacaggttgagtg

SEQ ID NO: 17110 - DNA, 75 bp, Artificial Sequence
  Synthetic
ggtagtaggtaaaggtgggcattcaggtcttcattcaaggtgctgtcatgatacagactgttcatctgagggtct

SEQ ID NO: 17111 - DNA, 75 bp, Artificial Sequence
  Synthetic
gagaaaaaagagcgacacaactgacacaactaatgctgcagccacgacattcgaatcacaagctaaaactgtgaa

SEQ ID NO: 17112 - DNA, 75 bp, Artificial Sequence
  Synthetic
tgtggcatcagcaccacatttagagagagttactgggtttaaccaaattgattctgacaaggtatatgacgatgg

SEQ ID NO: 17113 - DNA, 75 bp, Artificial Sequence
  Synthetic
ccttcgtgggacttgtgttttggctgcagagctatatgacaccttaaagaaggttaaaaagacggtgttgtgcta

SEQ ID NO: 17114 - DNA, 75 bp, Artificial Sequence
  Synthetic
tgctcctccatgtacattcaagtgctggttcactaagtctggagagtggctcctcggaattttaaatggtaactg

SEQ ID NO: 17115 - DNA, 75 bp, Artificial Sequence
  Synthetic
tgatcttacctgtaatcagacacattgtcagccaacagtttatttgattgcacctgtgattacatgtatgtcaat

SEQ ID NO: 17116 - DNA, 75 bp, Artificial Sequence
  Synthetic
gattgttgttgttgtgcttgtagtggttctgatcttttctataatactctttaatatcttatgcccacggagagg

SEQ ID NO: 17117 - DNA, 75 bp, Artificial Sequence
  Synthetic
aaggagctgcatggcaagtgtctttattagcaggatccagataatatatgaaaagacacactgtgtgacgggtca

SEQ ID NO: 17118 - DNA, 75 bp, Artificial Sequence
  Synthetic
gcacaagaagactgtttaatgtattgaatttactcatccatgcatttattcataataaactgcactaaccaacta

SEQ ID NO: 17119 - DNA, 75 bp, Artificial Sequence
  Synthetic
attaatagagggccaatgttttaatcctgcacacactctgacacttgctcagcctgctcacacatatgagacagt

SEQ ID NO: 17120 - DNA, 75 bp, Artificial Sequence
  Synthetic
atgctcatatgtctcaaaacactaaactttattacagtataacccttaattaaaaaaaacaaacactttactcat

SEQ ID NO: 17121 - DNA, 75 bp, Artificial Sequence
  Synthetic
tacactccctgttacctgtttttttacacctaaaaagtctgatcagcttaagttgataaaaacatttgaggggat

SEQ ID NO: 17122 - DNA, 75 bp, Artificial Sequence
  Synthetic
aaaaacaaacactttactcatatataacttcatattctcttaccgaggattttgttcctgcggagcatactacta

SEQ ID NO: 17123 - DNA, 75 bp, Artificial Sequence
  Synthetic
ttagaaaaatggaaaagtatagagagattcatcagagagttagggatcttgcacctggaacggtatcagcattag

SEQ ID NO: 17124 - DNA, 75 bp, Artificial Sequence
  Synthetic
aattagtaaaacaggctgtacagaaaatgcactacaaggctattatgtttgttttctcggaagtcattctgaacc

SEQ ID NO: 17125 - DNA, 75 bp, Artificial Sequence
  Synthetic
aatgcatagatctactggataggctctatgctgtcagacatgatctagttgatcagatgataaaacatgattggt

SEQ ID NO: 17126 - DNA, 75 bp, Artificial Sequence
  Synthetic
ccttcatgtcccaagtctaaaagacatccggtcagcagaagtcgttacccgaatgattgtccatcctagaggtga

SEQ ID NO: 17127 - DNA, 75 bp, Artificial Sequence
  Synthetic
ctgataataaagatgtagaaaggcctataggtcaagttctgctgatggctggcatacctaatgatattatacaag

SEQ ID NO: 17128 - DNA, 75 bp, Artificial Sequence
  Synthetic
ggaccatgacccaatccaaaactcacagggttaccttcggatagtgggaccattaacagcaaaagtaccgagcac

SEQ ID NO: 17129 - DNA, 75 bp, Artificial Sequence
  Synthetic
gcatggagaagaagattataccaaatagcccttctggacaagtgctgaagagctttttccggatgacaccagaca

SEQ ID NO: 17130 - DNA, 75 bp, Artificial Sequence
  Synthetic
cagctctagtgatactctgcagggaacagcatttgcaggtgttccaatgtatagctctttatctactttggtgag

SEQ ID NO: 17131 - DNA, 75 bp, Artificial Sequence
  Synthetic
actataaaattacaggcaatttgattgagtttattgaagtgactgtgacagctgatgtatcgcgaggtattaggg

SEQ ID NO: 17132 - DNA, 75 bp, Artificial Sequence
  Synthetic
gaatacagaccctgaatttgtattctcaccagggattataccagaatccaaccatagtgcgtgtgataagaagac

SEQ ID NO: 17133 - DNA, 75 bp, Artificial Sequence
  Synthetic
agaaaaaaataaagtatgaaggaggccttcaatttgttgagcatttacttgaaattgaatcaaggaagggtcaca

SEQ ID NO: 17134 - DNA, 75 bp, Artificial Sequence
  Synthetic
catcccactcacctggactggttacttaccgatctcaggtgaaatggagaaggtaacaggctgtacagtcttttg

SEQ ID NO: 17135 - DNA, 75 bp, Artificial Sequence
  Synthetic
taccacaaccctataaaataacattctcggtggttgcagttaaaacagatggatcaaacatctcaacccaatggc

SEQ ID NO: 17136 - DNA, 75 bp, Artificial Sequence
  Synthetic
cacattagctggccctggggcaagttgtgaggcttactctgaaagcggtatattcaacataagttccccaacatg

SEQ ID NO: 17137 - DNA, 75 bp, Artificial Sequence
  Synthetic
ctagtcgtaggaatgatggggtagttcagcacatgcgtctagtccaagctgatattaattatgtcagagagcatt

SEQ ID NO: 17138 - DNA, 75 bp, Artificial Sequence
  Synthetic
ccttgtcaataaagttcaaaagttcagaggttcagagcagaagatcaactttatctgccaacgagttgatcagga

SEQ ID NO: 17139 - DNA, 75 bp, Artificial Sequence
  Synthetic
taataaagttagatgagagagcatcattgaaagcaatgttcaacttaaaatttcatgtgtcaggccctaaattga

SEQ ID NO: 17140 - DNA, 75 bp, Artificial Sequence
  Synthetic
tgtcgttgtatattgtaatggccagaagaaggtgatcttgacaaaaaccttagtaattgggcagtgcatatacac

SEQ ID NO: 17141 - DNA, 75 bp, Artificial Sequence
  Synthetic
gatacttcaacatccctgattatagaccacagcagctatgtgaaccgcggattgataacttgatacaatattgta

SEQ ID NO: 17142 - DNA, 75 bp, Artificial Sequence
  Synthetic
ctttactagcctgttctcattgatgcctgatgttgctcattctctagcagtagagctgtgtgttccaggattgca

SEQ ID NO: 17143 - DNA, 75 bp, Artificial Sequence
  Synthetic
aaaattggttgacaaaagaacataagtttgtattcaaggaagttagtggagctaatgtaattcaagcacttgaaa

SEQ ID NO: 17144 - DNA, 75 bp, Artificial Sequence
  Synthetic
tgggtgggcaactgtaatgcttttgtccaccttttgctttgggtggatcctgataccagcaatcacattggtggt

SEQ ID NO: 17145 - DNA, 75 bp, Artificial Sequence
  Synthetic
gtcatgagcagtcacacttacagaaatacaatgaatcacggaaaccgagaaattttttactcttgcagcttacgg

SEQ ID NO: 17146 - DNA, 75 bp, Artificial Sequence
  Synthetic
tttgaaggttctaaaagtagcaacattctcatgctcacattatactaatgagtctaaatttaaattcatactgga

SEQ ID NO: 17147 - DNA, 75 bp, Artificial Sequence
  Synthetic
tgcaaggggcatatctgccatcaacaatcagttctgaccagtgcaatactaggattgggtgtccagaaatatcaa

SEQ ID NO: 17148 - DNA, 75 bp, Artificial Sequence
  Synthetic
aaaagtcaaggttgagtatcaaaaaacaatgggctcaatggtctgtgacatatgccaccatgagtgtgagacagc

SEQ ID NO: 17149 - DNA, 75 bp, Artificial Sequence
  Synthetic
aaaaccaaccagaaacaccagtacagatgcttgcattagatatagcttataagtatctaagccttacaaaggatg

SEQ ID NO: 17150 - DNA, 75 bp, Artificial Sequence
  Synthetic
caaagaattggaatctcataagcaaagttgcataaatggtcaatgtccatattgtatgactatgactgaggcaac

SEQ ID NO: 17151 - DNA, 75 bp, Artificial Sequence
  Synthetic
agttgattaactattacagtcctagagtgcactttcaatcaagccctaatgtaaaggaaccagggacattaaagt

SEQ ID NO: 17152 - DNA, 75 bp, Artificial Sequence
  Synthetic
agaaagtgcgctacaagctcattttgctatttgtaagcttacagggagattccaggaagccttaaaaaaatcatt

SEQ ID NO: 17153 - DNA, 75 bp, Artificial Sequence
  Synthetic
taggattatcacaattgaatccactctctaaatcaatccttgacaatgttggaaagcacaaaaaggataaagggt

SEQ ID NO: 17154 - DNA, 75 bp, Artificial Sequence
  Synthetic
gaagaaaccagaagtcagaaagggctgttaccgtactctaggagtttttagatacaagagcaggtgctatgttgg

SEQ ID NO: 17155 - DNA, 75 bp, Artificial Sequence
  Synthetic
ctctaaatcaatccttgacaatgttggaaagcacaaaaaggataaagggttatttggtgaggtcatagatagcat

SEQ ID NO: 17156 - DNA, 75 bp, Artificial Sequence
  Synthetic
cttagtttggtgtgtgttattgacatgtgagctcattgtatgggctgctagtgcagagacccccttgctagaatc

SEQ ID NO: 17157 - DNA, 75 bp, Artificial Sequence
  Synthetic
aaatgtggcaagtcaaatacagatcaatgcatgtgcaaaaataattgagcagatcttatcaaatcttgaaataaa

SEQ ID NO: 17158 - DNA, 75 bp, Artificial Sequence
  Synthetic
aatgcatgtgcaaaaataattgagcagatcttatcaaatcttgaaataaacattggagaaataaatgctagtatg

SEQ ID NO: 17159 - DNA, 75 bp, Artificial Sequence
  Synthetic
aggctggtcagatacagcacatggggttggggaggttccaatgaaaacagatttagagttagacttttccctacc

SEQ ID NO: 17160 - DNA, 75 bp, Artificial Sequence
  Synthetic
cattggagaaataaatgctagtatgccttcccctaataagacaacaggtgtagatgatttattgaataaattcta

SEQ ID NO: 17161 - DNA, 75 bp, Artificial Sequence
  Synthetic
atcatcatcatcttacagttataggcggaaacttaccaatcctgccaataaagaagaatcaatccccttccactt

SEQ ID NO: 17162 - DNA, 75 bp, Artificial Sequence
  Synthetic
tgataatgagcttgggaaatacatgttatctattctaaggaaaacagcagcatggcatataggtcatctagttag

SEQ ID NO: 17163 - DNA, 75 bp, Artificial Sequence
  Synthetic
tcagatggaaaagcaagtaatacatgcagaaatccaaaacttgggtcattggatggatgcaacatttaatataaa

SEQ ID NO: 17164 - DNA, 75 bp, Artificial Sequence
  Synthetic
agatatcacagaaagtttaattgcacatgccggtctgcgtcgttctaaatactggtcagtacatgcatatgacca

SEQ ID NO: 17165 - DNA, 75 bp, Artificial Sequence
  Synthetic
aacagcatttcactgctatggagcctgtcaaaaatattcatatccatggcagactgcaaagtgtttctttgaaaa

SEQ ID NO: 17166 - DNA, 75 bp, Artificial Sequence
  Synthetic
tgggaatgtaattctgtttattttgccatcaaagtcattagaagtagtaggttcttatataaggtattttacagt

SEQ ID NO: 17167 - DNA, 75 bp, Artificial Sequence
  Synthetic
agattatcaatatgagacaggttggggatgtaaccctggggactgccctggagtaggtacaggctgtacagcatg

SEQ ID NO: 17168 - DNA, 75 bp, Artificial Sequence
  Synthetic
atttaaggatggtataggattaatagatgcagacaatattgattctaaggccgaaattgatggtgttacttggtg

SEQ ID NO: 17169 - DNA, 75 bp, Artificial Sequence
  Synthetic
tggtgtttatcttgataaactaaagtctgtagggaaggcatacaaaatcatttccttaaagtatactagaaaagt

SEQ ID NO: 17170 - DNA, 75 bp, Artificial Sequence
  Synthetic
ttattccaaagtcatgagtattgatttaaacaggttgttggcattaaatatagcctttgagaaatcacttcttgc

SEQ ID NO: 17171 - DNA, 75 bp, Artificial Sequence
  Synthetic
gtgtattcaattgggtacagaacagacatgtaaacatattgatgcaaatgattgcctggtgaccccttctgttaa

SEQ ID NO: 17172 - DNA, 75 bp, Artificial Sequence
  Synthetic
cacagcaacatggttccaatattatactgaagaccaaggtcattttccccttcaacatgccttaaggtcaatctt

SEQ ID NO: 17173 - DNA, 75 bp, Artificial Sequence
  Synthetic
agtatgcattgtgggaacggtttctaaacttcagccttctgacactttgctgtttctcgggccgttagagcaagg

SEQ ID NO: 17174 - DNA, 75 bp, Artificial Sequence
  Synthetic
ttcttttcactttttactatgtgtgtcacagaagatgaaactatgtgcaatattcgataaccttcgttatctgat

SEQ ID NO: 17175 - DNA, 75 bp, Artificial Sequence
  Synthetic
tggcattattttaaaacaatggtgtactacatcttgtgcatttggggaccctggtgacatcatgtcgacaacaag

SEQ ID NO: 17176 - DNA, 75 bp, Artificial Sequence
  Synthetic
accatcagtaacatctttgtactctgggtatgagttgttaatagagaaattctttgaaaggccatttaagagttc

SEQ ID NO: 17177 - DNA, 75 bp, Artificial Sequence
  Synthetic
tgggatgagatgccctgagcatactggatctttccggaaaatctgtggatttgctacgacacctgtatgtgagta

SEQ ID NO: 17178 - DNA, 75 bp, Artificial Sequence
  Synthetic
actggatgtatacctttattctattataaagtctctgttaattagtttggcacagaataataaagttcgatttta

SEQ ID NO: 17179 - DNA, 75 bp, Artificial Sequence
  Synthetic
ccaaggtaacactatatctggatacaagagaatgatggctacaaaggattcttttcaatcatttaatcttactga

SEQ ID NO: 17180 - DNA, 75 bp, Artificial Sequence
  Synthetic
ctcaagagttcgcttgttaggactgacagttgatcattctacggtcggagcaagcggtgtttatccctctttaat

SEQ ID NO: 17181 - DNA, 75 bp, Artificial Sequence
  Synthetic
ccctcacataactacaaataagcttgaatggatcgatccagatggcaatacacgagatcatgtcaatcttgtatt

SEQ ID NO: 17182 - DNA, 75 bp, Artificial Sequence
  Synthetic
gtcccgtgttgtttataaacattatagaagtttaatctctgaagctacaacctgttttttcttatttgagaaggg

SEQ ID NO: 17183 - DNA, 75 bp, Artificial Sequence
  Synthetic
gaatagagatgtgtcatttcaagatttaagtgacaatccttgtaaggttgatttgcatacacaagctattgaagg

SEQ ID NO: 17184 - DNA, 75 bp, Artificial Sequence
  Synthetic
tttgcatgggaatttaccagaagaagctaagatacatcttgaaaccattgaatgggctcgaaaatttcaggagaa

SEQ ID NO: 17185 - DNA, 75 bp, Artificial Sequence
  Synthetic
ggcttggggttctggtgttgggtttacattgacttgcactgttggtttaactgaatgcccaagctttatgacatc

SEQ ID NO: 17186 - DNA, 75 bp, Artificial Sequence
  Synthetic
agagaaacaatatggtgatattcttctaaaggaaggctatacgattgaatctgtaatcaatggagaagttaatgt

SEQ ID NO: 17187 - DNA, 75 bp, Artificial Sequence
  Synthetic
aattaaagcatgtgatctagcaatgtgttatggttctacagttcataacttagcaaggggttcaaacacagtcaa

SEQ ID NO: 17188 - DNA, 75 bp, Artificial Sequence
  Synthetic
agaacaacagctcttttgtcaagaggtttcagagctaagtgcacaggaacttaacaaatatctacaagcgaaatc

SEQ ID NO: 17189 - DNA, 75 bp, Artificial Sequence
  Synthetic
agtggttggtaaaggtggacattcaggttcttcctttaagtgttgccatgacactgactgctcttctgaaggcct

SEQ ID NO: 17190 - DNA, 75 bp, Artificial Sequence
  Synthetic
tcaagttttatgtgctaatatcatgaataagcactgggataaaccgtattttagtcaaacacgcaatatcagtct

SEQ ID NO: 17191 - DNA, 75 bp, Artificial Sequence
  Synthetic
tgttgcatcagcaccacatcttgagagagtcactggttttaaccaaatcgactcggacaaggtctatgatgatgg

SEQ ID NO: 17192 - DNA, 75 bp, Artificial Sequence
  Synthetic
taaggggatgtccggcgcacttcaagaagatgggcatttagctgctagtgtaacactaattgaagcaattagatt

SEQ ID NO: 17193 - DNA, 75 bp, Artificial Sequence
  Synthetic
tgcccctccatgtacatttaagtgctggttcactaaatctggagagtggctcttggggattctcaacggcaattg

SEQ ID NO: 17194 - DNA, 75 bp, Artificial Sequence
  Synthetic
tttaaatagatcacagactaatccaaatgttattgatatgtatgagcagaccaaacaatcaaaggcacaggctag

SEQ ID NO: 17195 - DNA, 75 bp, Artificial Sequence
  Synthetic
gatagttgttgttgttcttgtggtggttctgattttctctataattttatttagcatcctttgtcctcgacgggg

SEQ ID NO: 17196 - DNA, 75 bp, Artificial Sequence
  Synthetic
gattgtcaggaaataccagggaacagaagcagatagaggattttttattacaacattaccaactagggtgcgact

SEQ ID NO: 17197 - DNA, 75 bp, Artificial Sequence
  Synthetic
acataagaagactgtttaagtataccatgtatttacttaagcatttataaatgtatagccttattaacccactaa

SEQ ID NO: 17198 - DNA, 75 bp, Artificial Sequence
  Synthetic
ggagataatagaagattatttcgatgcaattgcaaaggttgtgcctgaagagtacatttcttatggtggggataa

SEQ ID NO: 17199 - DNA, 75 bp, Artificial Sequence
  Synthetic
tgcttatataatccttgctatttaactttattactgtataaccctttattaaaaaaaacaaatactttactcaca

SEQ ID NO: 17200 - DNA, 75 bp, Artificial Sequence
  Synthetic
aaaggttctaaatattcaaaatgcactagagaaagcacttagatgggcatctggagtatcagaaattacaacaag

SEQ ID NO: 17201 - DNA, 75 bp, Artificial Sequence
  Synthetic
aaaaacaaatactttactcacataaaacttcatattctcttaccgaggattttgttcctgcggagcatactacta

SEQ ID NO: 17202 - DNA, 75 bp, Artificial Sequence
  Synthetic
tactggtaaaagcatcaagtttaagcgaaaattaatgtatgttagtgctgatgcaacaaaatggtcaccaggaga

SEQ ID NO: 17203 - DNA, 75 bp, Artificial Sequence
  Synthetic
ctcccctattctacctcaacacatactacctcatatttgatttttcttgattgcttttcaaggagcatactacta

SEQ ID NO: 17204 - DNA, 75 bp, Artificial Sequence
  Synthetic
caactctgccaaatttaggagatttacacaagcaatatatgatggtctatcagacaacaagctgaaatgttgtgt

SEQ ID NO: 17205 - DNA, 75 bp, Artificial Sequence
  Synthetic
tgttgatgcattgcgcaacatttatgagactgaattctttatgtctaggaaattacaccgatatattgatagtat

SEQ ID NO: 17206 - DNA, 75 bp, Artificial Sequence
  Synthetic
ggaagatcattcagatgcagttgaagacttcttggcatttttttcaaatggagtctcagccaatgtaaagggaaa

SEQ ID NO: 17207 - DNA, 75 bp, Artificial Sequence
  Synthetic
ttggcttcaaggaaatttgaataaatgctcatcgttatttggtgctgctgtctcattacttttccgggaggcctg

SEQ ID NO: 17208 - DNA, 75 bp, Artificial Sequence
  Synthetic
gaaacaattatttccagaattagaatgtttttttgaatttgcacatcattcagatgatgcattatttatttatgg

SEQ ID NO: 17209 - DNA, 75 bp, Artificial Sequence
  Synthetic
ctatttagagcctgaagatgatggaacagattggtttttgtatgtatctcagcagatacaggcaggaaactttca

SEQ ID NO: 17210 - DNA, 75 bp, Artificial Sequence
  Synthetic
ttggcatgctataaatcaagggatgtggaaaagtatgtttaacctacatgaacatttactgttaatgggttccat

SEQ ID NO: 17211 - DNA, 75 bp, Artificial Sequence
  Synthetic
taaagtatcacctaagaagacaacagtatcacccactaatgcagaatttctttctactttttttgagggttgtgc

SEQ ID NO: 17212 - DNA, 75 bp, Artificial Sequence
  Synthetic
tgtgtcaatcccttttgttaaaatattattaggttcattatcagatcttcccgggttaggtttctttgatgattt

SEQ ID NO: 17213 - DNA, 75 bp, Artificial Sequence
  Synthetic
agcagcagcacaaagtagatgtgtaaagccattagatttaggtgcttgtccacaattagctcaactagctatagt

SEQ ID NO: 17214 - DNA, 75 bp, Artificial Sequence
  Synthetic
gttatgcacaagcaaagttgagagattgtatggtactgctgatggaatggtaaactctccaacagcattccttaa

SEQ ID NO: 17215 - DNA, 75 bp, Artificial Sequence
  Synthetic
ggtaaataaagcacatgtaccagtaccacttggtggtgatggctcaatgtctattatggaacttgcaacagctgg

SEQ ID NO: 17216 - DNA, 75 bp, Artificial Sequence
  Synthetic
tttcgggatggcagataaaaatattctaaaaaatgcattcatatcctataagcatactcgtagagaaggtgatag

SEQ ID NO: 17217 - DNA, 75 bp, Artificial Sequence
  Synthetic
atatgtattgggtttatttaaatttttgatgtcattaagtgaagatgtattccagcatgatcgattaggtgagtt

SEQ ID NO: 17218 - DNA, 75 bp, Artificial Sequence
  Synthetic
tagttttgtaggtaaagttcaatggaaagtgtttactcccaaagctgaatttgaatttcacgatcaattttcgca

SEQ ID NO: 17219 - DNA, 75 bp, Artificial Sequence
  Synthetic
taactatttattagagtggacacgtcaacatcctgtgtatgactatattattcctagaaatagggataatttgct

SEQ ID NO: 17220 - DNA, 75 bp, Artificial Sequence
  Synthetic
tgtgtaccttgtgagaaagttgaatgatcctagcatcattacagctatgactatgcagtcaccattacaactccg

SEQ ID NO: 17221 - DNA, 75 bp, Artificial Sequence
  Synthetic
ttttcgtatgcaggcgaaacaacatatgaaagtatgccggtatgaaggtgaatgggtcacattcagggaggtact

SEQ ID NO: 17222 - DNA, 75 bp, Artificial Sequence
  Synthetic
tgctgcagctgatagttttgccacaagttaccagcctactgaaagggacatggatctctttaatacacttgtaag

SEQ ID NO: 17223 - DNA, 75 bp, Artificial Sequence
  Synthetic
ttgtacattctctaaagagtatgcttggaaagactttttaaatgaagtaaggtgtgaggttttaacaacaagaca

SEQ ID NO: 17224 - DNA, 75 bp, Artificial Sequence
  Synthetic
tgtacataggcctaaaattgctaggacatttacagttagggaaaaggaccaggctatacaaaatccaataaattc

SEQ ID NO: 17225 - DNA, 75 bp, Artificial Sequence
  Synthetic
tgtgattggctataagtatgctctcacagtagatgaagtcagtgatgtccttgatagtgcattcttcccagaatc

SEQ ID NO: 17226 - DNA, 75 bp, Artificial Sequence
  Synthetic
tttatccgcagacttacaggttatgaaagatggggtttacagggaattagggcttgatataagttctcctgaagt

SEQ ID NO: 17227 - DNA, 75 bp, Artificial Sequence
  Synthetic
tttaaaacgcatagcaccgctattatataaggcaggaagatcgcgtgttgttattgtggaagggaatgtagaggg

SEQ ID NO: 17228 - DNA, 75 bp, Artificial Sequence
  Synthetic
gacagctgagtcaatctgtagttattggcttaagacaatgtcattgattaaaacaattagagtaagacctaagaa

SEQ ID NO: 17229 - DNA, 75 bp, Artificial Sequence
  Synthetic
ggaagtactgaaagctatgtctttatatagtgttaaagaaaatattggattgcaggacgatattgcagcaacccg

SEQ ID NO: 17230 - DNA, 75 bp, Artificial Sequence
  Synthetic
actgtgcatagaaatctggaggtggtgtaaggcaaatgaacaggatgtcaaagaatggctaacatcattgtattt

SEQ ID NO: 17231 - DNA, 75 bp, Artificial Sequence
  Synthetic
actgtgcatagaaatctggaggtggtgtaaggcaaatgaacaggatgtcaaagaatggctaacatctttgtattt

SEQ ID NO: 17232 - DNA, 75 bp, Artificial Sequence
  Synthetic
actgtgcatagaaatctggaggtggtgtaaggcaaatgaacaggatgtcaaagaatggctaacatccttgtattt

SEQ ID NO: 17233 - DNA, 75 bp, Artificial Sequence
  Synthetic
actgtgcatagaaatctggaggtggtgtaaggcaaatgaacaggatgtcaaagaatggctaacatcgttgtattt

SEQ ID NO: 17234 - DNA, 75 bp, Artificial Sequence
  Synthetic
tgaaaagcaaacattgatggattggatagaaaggttcagaaggaaaggagttgtgcctattgatcctgagataca

SEQ ID NO: 17235 - DNA, 75 bp, Artificial Sequence
  Synthetic
atgtattggcctgctcttatatgatgtgttaggttataaaagtgtgttacaaatgcaagcaaaccgaagagccta

SEQ ID NO: 17236 - DNA, 75 bp, Artificial Sequence
  Synthetic
ttcaggtaagcagtatgatgcatactgtgtgcaaacatataacgaggaaacaaaactatatgaaggtgacctccg

SEQ ID NO: 17237 - DNA, 75 bp, Artificial Sequence
  Synthetic
tgtcacttttaattttggcctagactgtgcacggttagaagtcttttgggataaaagagagtatatcttagagac

SEQ ID NO: 17238 - DNA, 75 bp, Artificial Sequence
  Synthetic
atctattacccagcgacatgtattgcggttgttgatggaagaagtgtcacaagaattgattagatgtggaatgag

SEQ ID NO: 17239 - DNA, 75 bp, Artificial Sequence
  Synthetic
attcaaaacagaacaagtcaatcaaactcggagcttagtgttatttaaaacagaggctggttttgaatggggtaa

SEQ ID NO: 17240 - DNA, 75 bp, Artificial Sequence
  Synthetic
gcctaatgtgccatgtattgtatataaacactgtgttttgagaactggacttcgtacaaaacagccaattaataa

SEQ ID NO: 17241 - DNA, 75 bp, Artificial Sequence
  Synthetic
agagttcatgataaatgtacaaagtgatgggttccgtgcaatagcgcagatggatattgaaagtccacgattctt

SEQ ID NO: 17242 - DNA, 75 bp, Artificial Sequence
  Synthetic
gttggcacatgcatatcatacattgcgtaatatcagatatcaagcagtacaggcggtagggaatgtatggtttaa

SEQ ID NO: 17243 - DNA, 75 bp, Artificial Sequence
  Synthetic
aacagaacagcacaaactatttatcaacccaattatatcatcaggactcttagaaatttttatgaagggcttacc

SEQ ID NO: 17244 - DNA, 75 bp, Artificial Sequence
  Synthetic
tgctgctatacctcctgctgcatattctctaataatgaataaggctaaaatttctgtggatttgtttatgttcaa

SEQ ID NO: 17245 - DNA, 75 bp, Artificial Sequence
  Synthetic
tgaactattagcacttataaataggaataatattctcgaccttgatgggattgaagaaacatctgaaggttatag

SEQ ID NO: 17246 - DNA, 75 bp, Artificial Sequence
  Synthetic
tactgtgacatcaatgtctagcaagcagtggtctgaagagatgagcttaatgtccgatgatgatattgatgacat

SEQ ID NO: 17247 - DNA, 75 bp, Artificial Sequence
  Synthetic
ggaggattttactatagcactagatgatattgactttgaacaaataaatttggaagaggatatacaacatttttt

SEQ ID NO: 17248 - DNA, 75 bp, Artificial Sequence
  Synthetic
gcaggatgaatcagcatatgttggtgatttattaattcagacagaggacattgaagttaagaagatacgtggggt

SEQ ID NO: 17249 - DNA, 75 bp, Artificial Sequence
  Synthetic
gacaagagtattagagccagttaagctattaaaaagttgggtttctaaaggtcttgctatagacaaagtatacaa

SEQ ID NO: 17250 - DNA, 75 bp, Artificial Sequence
  Synthetic
tcccattgggataatcctaatggcaagatacatgtcaaaaacatataacttcagttcaacacctcttgcactact

SEQ ID NO: 17251 - DNA, 75 bp, Artificial Sequence
  Synthetic
aaacccatatgatttgacagaacttgaaagtgttgtaaagggatggggagaaactgtaaatgatcgattcaaaga

SEQ ID NO: 17252 - DNA, 75 bp, Artificial Sequence
  Synthetic
tttaggcgttgaggcacaagcagttgttaaagagaaaggtgtacagccagaagatgtactccctgattcattatc

SEQ ID NO: 17253 - DNA, 75 bp, Artificial Sequence
  Synthetic
ttcattatcctctttcaggcatgttgatgtcttgctacgaaggttgttcccgcgtgaccctgtatcaacattcta

SEQ ID NO: 17254 - DNA, 75 bp, Artificial Sequence
  Synthetic
gaagaagcaaaaaattaaagaagtgagtttaaaatggaagggtggtatctggttgctcttggaatctgctatacg

SEQ ID NO: 17255 - DNA, 75 bp, Artificial Sequence
  Synthetic
ggttgctcttggaatctgctatacgctgacactggcaatgcctaaaaccacttatgagcttaaaatggaatgccc

SEQ ID NO: 17256 - DNA, 75 bp, Artificial Sequence
  Synthetic
gcatactgtgggtctcggtcaaggttacattattggctcaacagaattgggtttgatctcaattgaggctgcatc

SEQ ID NO: 17257 - DNA, 75 bp, Artificial Sequence
  Synthetic
tacattattggctcaacagaattgggtttgatctcaattgaggctgcatctgatataaagcttgagagctcttgt

SEQ ID NO: 17258 - DNA, 75 bp, Artificial Sequence
  Synthetic
aattttgatcttcatacaacatctatggcccagaagagtttcacccaagttgaatggagaaagaaaagtgacaca

SEQ ID NO: 17259 - DNA, 75 bp, Artificial Sequence
  Synthetic
actgataccacaaatgctgcatccaccacctttgaagcacagaccaaaactgttaaccttagagggacctgtata

SEQ ID NO: 17260 - DNA, 75 bp, Artificial Sequence
  Synthetic
ttggcacctgaactttatgatacattaaagaaagtaaagaagacagtcctgtgctatgatcttacatgcaatcag

SEQ ID NO: 17261 - DNA, 75 bp, Artificial Sequence
  Synthetic
acacattgtcagccaactgtctatctgattgcacctgtactgacctgcatgtcaattagaagttgtatggctaga

SEQ ID NO: 17262 - DNA, 75 bp, Artificial Sequence
  Synthetic
gtgtttacaagtaggattcaggtgatctatgaaaagacacattgtgtaacaggtcagctgattgagggtcaatgt

SEQ ID NO: 17263 - DNA, 75 bp, Artificial Sequence
  Synthetic
ttcaacccagcacacacactgacattatctcaacctgctcacacttatgatactgtcaccctgcctatctcttgt

SEQ ID NO: 17264 - DNA, 75 bp, Artificial Sequence
  Synthetic
ttttttacaccaaaggagtcggagcagctaaaagttataaaaacatttgaagggattctgacaaagacagggtgc

SEQ ID NO: 17265 - DNA, 75 bp, Artificial Sequence
  Synthetic
acggagaatgcattgcagggttattatgtgtgttttttagggagtcattcagaacctttaattgttccgagtttg

SEQ ID NO: 17266 - DNA, 75 bp, Artificial Sequence
  Synthetic
gaggacatacggtctgctgaagttgttagtaggatgcttgtacaccctaggggagaagaccatgatgccatacag

SEQ ID NO: 17267 - DNA, 75 bp, Artificial Sequence
  Synthetic
aattcacaaagtcacttgagaatagtgggacctatcacagcaaaagtgccatcaactagttccacagataccctg

SEQ ID NO: 17268 - DNA, 75 bp, Artificial Sequence
  Synthetic
aaggggacagcctttgcaggcgtcccaatgtacagctccttatctacactagtcaaaaatgcagacccagaattt

SEQ ID NO: 17269 - DNA, 75 bp, Artificial Sequence
  Synthetic
caatgtacagctccttatctacactagtcaaaaatgcagacccagaatttgtgttttccccaggtataatacctg

SEQ ID NO: 17270 - DNA, 75 bp, Artificial Sequence
  Synthetic
aatctaatcacagtgtatgtgataagaagacagtacctatcacatggacaggctacctaccaatatcaggggaga

SEQ ID NO: 17271 - DNA, 75 bp, Artificial Sequence
  Synthetic
tggaaaaagtaactggatgtacagttttctgtacactggcgggacctggtgctagctgtgaggcctattctgaaa

SEQ ID NO: 17272 - DNA, 75 bp, Artificial Sequence
  Synthetic
atggtatctttaacattagttccccaacatgtcttgtcaacaaagtccaaagatttagaggatccgaacagaaga

SEQ ID NO: 17273 - DNA, 75 bp, Artificial Sequence
  Synthetic
taaattttatctgtcagcgggtagatcaggatgtcgtcgtatactgtaatggacagaagaaagtcatattaacca

SEQ ID NO: 17274 - DNA, 75 bp, Artificial Sequence
  Synthetic
aaactttggttattgggcagtgtatttatacattcacaagcctattttcattgatgcctgatgtagcccactcac

SEQ ID NO: 17275 - DNA, 75 bp, Artificial Sequence
  Synthetic
tcgctgtagaattatgtgtcccaggattacatgggtgggccactgtcatgcttctatcaacattctgcttcggat

SEQ ID NO: 17276 - DNA, 75 bp, Artificial Sequence
  Synthetic
gggtcttgattcctgcagtaacgttaataatattaaaatgtctaagggttctgacattttcttgttcccattaca

SEQ ID NO: 17277 - DNA, 75 bp, Artificial Sequence
  Synthetic
ctgacattttcttgttcccattacactaatgagtcaaaatttaaattcatcctggaaaaagttaaagtcgaatac

SEQ ID NO: 17278 - DNA, 75 bp, Artificial Sequence
  Synthetic
caaaagactatgggatcaatggtgtgcgatgtatgtcatcacgagtgtgaaacagcaaaggaacttgaatcacat

SEQ ID NO: 17279 - DNA, 75 bp, Artificial Sequence
  Synthetic
aacagcaaaggaacttgaatcacatagacaaagttgcatcaatggacaatgcccttattgcatgacaataactga

SEQ ID NO: 17280 - DNA, 75 bp, Artificial Sequence
  Synthetic
agcaactgaaagtgccttgcaagcccattattccatttgtaaattgacaggaagatttcaggaggcattaaaaaa

SEQ ID NO: 17281 - DNA, 75 bp, Artificial Sequence
  Synthetic
gtcacttaagaagccagaggtaaaaaaaggttgttacagaacacttggggtatttcgatataaaagtagatgtta

SEQ ID NO: 17282 - DNA, 75 bp, Artificial Sequence
  Synthetic
tgtgggtttggtatggtgcctattgttgacatgtgaaattgttatttgggccgcaagtgcagagactccactaat

SEQ ID NO: 17283 - DNA, 75 bp, Artificial Sequence
  Synthetic
ggaatcaggttggtcagatacagctcatggtgttggcgagattccaatgaagacagacttagaactagacttttc

SEQ ID NO: 17284 - DNA, 75 bp, Artificial Sequence
  Synthetic
actgccttcttcatcctcttatagttacaggagaaagctcacaaacccagctaataaggaagagtcaatttcctt

SEQ ID NO: 17285 - DNA, 75 bp, Artificial Sequence
  Synthetic
tcatttccagatggaaaaacaagtgattcatgctgagatccaacccttaggtcattggatggatgcaacatttaa

SEQ ID NO: 17286 - DNA, 75 bp, Artificial Sequence
  Synthetic
taccaagactgcatttcattgttatggtgcatgtcagaaatactcttatccatggcaaacatctaagtgcttctt

SEQ ID NO: 17287 - DNA, 75 bp, Artificial Sequence
  Synthetic
tgaaaaagattaccagtatgaaacaggttggggctgtaatcctggtgactgcccaggggttgggactggatgtac

SEQ ID NO: 17288 - DNA, 75 bp, Artificial Sequence
  Synthetic
tgcttgtggtgtttatcttgataaactaaaatctgtgggaaaagcctataagataatttctttaaaatacaccag

SEQ ID NO: 17289 - DNA, 75 bp, Artificial Sequence
  Synthetic
ctaaaatctgtgggaaaagcctataagataatttctttaaaatacaccagaaaggtttgcattcagttaggaaca

SEQ ID NO: 17290 - DNA, 75 bp, Artificial Sequence
  Synthetic
gaacaaacatgcaagcatattgatgcaaatgattgtttagtaacaccatctgtgaaggtttgtatagtgggcaca

SEQ ID NO: 17291 - DNA, 75 bp, Artificial Sequence
  Synthetic
gtttctaaactccaaccatctgatactcttttgttcctaggtccgttagaacaagggggggtcatccttaaacaa

SEQ ID NO: 17292 - DNA, 75 bp, Artificial Sequence
  Synthetic
acaagggggggtcatccttaaacaatggtgcacaacatcatgtgcatttggggaccctggtgatatcatgtctac

SEQ ID NO: 17293 - DNA, 75 bp, Artificial Sequence
  Synthetic
tcctagtggtatgaggtgtccagaacacactggatcattcaggaaaatttgtggttttgccactacaccagtttg

SEQ ID NO: 17294 - DNA, 75 bp, Artificial Sequence
  Synthetic
cgaataccaaggtaataccatttctggatataaaagaatgatggcaacaaaagattcattccaatcatttaactt

SEQ ID NO: 17295 - DNA, 75 bp, Artificial Sequence
  Synthetic
ggatataaaagaatgatggcaacaaaagattcattccaatcatttaacttaacagaacctcacatcacagcaaat

SEQ ID NO: 17296 - DNA, 75 bp, Artificial Sequence
  Synthetic
aagcttgaatggattgacccagatgggaatacaagagaccatgtaaaccttgtcttaaatagagatgtttcattt

SEQ ID NO: 17297 - DNA, 75 bp, Artificial Sequence
  Synthetic
ggaatacaagagaccatgtaaaccttgtcttaaatagagatgtttcatttcaggatttaagtgataacccctgta

SEQ ID NO: 17298 - DNA, 75 bp, Artificial Sequence
  Synthetic
caggatttaagtgataacccctgtaaagtggacttacacacacaagcaatagaaggggcatggggttctggtgta

SEQ ID NO: 17299 - DNA, 75 bp, Artificial Sequence
  Synthetic
gggtttacacttacatgtactgtcggattaacagagtgcccgagttttatgacatcaattaaggcatgtgatctt

SEQ ID NO: 17300 - DNA, 75 bp, Artificial Sequence
  Synthetic
gctatgtgttatggatcaacagtagcaaaccttgctaggggctctaatacagtaaaagtggttggtaagggaggt

SEQ ID NO: 17301 - DNA, 75 bp, Artificial Sequence
  Synthetic
cattcagggtcttcatttaaatgctgtcatgatacagattgctcctctgagggtctacttgcatcagccccacac

SEQ ID NO: 17302 - DNA, 75 bp, Artificial Sequence
  Synthetic
cttgagagagtgacaggcttcaatcaaatcgattcagataaggtttatgatgatggtgcaccaccttgcacattc

SEQ ID NO: 17303 - DNA, 75 bp, Artificial Sequence
  Synthetic
tgatggtgcaccaccttgcacattcaaatgctggttcaccaagtcaggtgagtggctccttgggatcttaaacgg

SEQ ID NO: 17304 - DNA, 75 bp, Artificial Sequence
  Synthetic
gaattggattgttgttgtagtgcttgttgtgatactcattctctctatcataatgttcagtgttctgtgccccag

SEQ ID NO: 17305 - DNA, 75 bp, Artificial Sequence
  Synthetic
gagaggacacaagaaaactgtctaggcattaaccgcaaatcccacattagattatatacatttatgcactttccc

SEQ ID NO: 17306 - DNA, 75 bp, Artificial Sequence
  Synthetic
atatttagctgcactaagatattaataaactctagttattgactttataagattattatggaactaacctcactt

SEQ ID NO: 17307 - DNA, 75 bp, Artificial Sequence
  Synthetic
taaactctagttattgactttataagattattatggaactaacctcacttaaaaaaaacaaatactttactcata

SEQ ID NO: 17308 - DNA, 75 bp, Artificial Sequence
  Synthetic
acctcacttaaaaaaaacaaatactttactcatatataactccatattctcttaccgaggctttaatccctgcgg

SEQ ID NO: 17309 - DNA, 75 bp, Artificial Sequence
  Synthetic
ctaaagctggaatgagcaccctccaagaattacaagaaaacatcacagcacacgaacaacagctcgtgactgctc

SEQ ID NO: 17310 - DNA, 75 bp, Artificial Sequence
  Synthetic
ggcaaaagcttaaagatgccgagaaggcggtggaggtggacccggatgacgttaacaagagcacactacaaaata

SEQ ID NO: 17311 - DNA, 75 bp, Artificial Sequence
  Synthetic
gttaacaagagcacactacaaaatagacgggcagctgtgtctacattggagaccaaactcggggaactcaagaga

SEQ ID NO: 17312 - DNA, 75 bp, Artificial Sequence
  Synthetic
caacttgcagatctggtggcagctcaaaaattggctacaaaaccagttgatccaacagggcttgagcctgatgac

SEQ ID NO: 17313 - DNA, 75 bp, Artificial Sequence
  Synthetic
catctgaaagagaaatcatctttgagatatgggaatgtcctggatgttaactcaatcgatttggaagaaccgagt

SEQ ID NO: 17314 - DNA, 75 bp, Artificial Sequence
  Synthetic
ggacagactgctgattggaaggctataggagcatatatcttagggtttgcaattccgatcatactaaaagcccta

SEQ ID NO: 17315 - DNA, 75 bp, Artificial Sequence
  Synthetic
tatatgctgtcaacccgtggaagacaggctgtgaaagacaacaaaggaaccaggataaggtttaaggatgattct

SEQ ID NO: 17316 - DNA, 75 bp, Artificial Sequence
  Synthetic
tcctttgaagaggtcaatgggatacgtaaaccgaaacacctttatgtctcaatgccaactgcacaatctactatg

SEQ ID NO: 17317 - DNA, 75 bp, Artificial Sequence
  Synthetic
aaggctgaggaaattacgccaggacggtttaggacaattgcttgtggcctctttccagcacaggtcaaagctcga

SEQ ID NO: 17318 - DNA, 75 bp, Artificial Sequence
  Synthetic
aatataataagtcctgtgatgggagtaatcggatttggcttctttgtgaaggactggatggatcggatagaggaa

SEQ ID NO: 17319 - DNA, 75 bp, Artificial Sequence
  Synthetic
ttcctggctgcagagtgtccattcctgcctaagccaaaggttgcctcagaagccttcatgtctaccaacaagatg

SEQ ID NO: 17320 - DNA, 75 bp, Artificial Sequence
  Synthetic
tattttctgaatagacaaagacaagtcaatgaatctaaggttcaagacatcattgatttaatagatcatgctgaa

SEQ ID NO: 17321 - DNA, 75 bp, Artificial Sequence
  Synthetic
actgaatctgctaccttgtttacagaaattgcaacaccccattcagtctgggtgtttgcatgtgcgcctgaccgg

SEQ ID NO: 17322 - DNA, 75 bp, Artificial Sequence
  Synthetic
tgccctccgactgcattgtatgttgcaggggtaccagaacttggtgcattcttttccattcttcaggacatgcgc

SEQ ID NO: 17323 - DNA, 75 bp, Artificial Sequence
  Synthetic
aataccatcatggcatccaaatctgtggggactgcagaagagaagctgaagaagaaatctgccttttatcaatct

SEQ ID NO: 17324 - DNA, 75 bp, Artificial Sequence
  Synthetic
gaagaaatctgccttttatcaatcttacctaagaaggacacaatctatggggattcaactggaccagaaaatcat

SEQ ID NO: 17325 - DNA, 75 bp, Artificial Sequence
  Synthetic
aattctctacatgctttcatggggtaaagaagctgtgaatcatttccatcttggtgatgatatggaccctgaact

SEQ ID NO: 17326 - DNA, 75 bp, Artificial Sequence
  Synthetic
aaggcagctagctcaatccctgattgacaccaaggtgaaggagatctccaaccaagagccacttaagttgtaagt

SEQ ID NO: 17327 - DNA, 75 bp, Artificial Sequence
  Synthetic
gcttaatgaaaggatgattgaagaaagactttccgggcttgtgccacatattaatcatctcaggacctatcctta

SEQ ID NO: 17328 - DNA, 75 bp, Artificial Sequence
  Synthetic
atgtgattaatagggtcttattataagggtggttaaggggtcagttactaactacgggtaagggttcattactat

SEQ ID NO: 17329 - DNA, 75 bp, Artificial Sequence
  Synthetic
tttttgcactagggttagagggccactacatcgtatttgcactacgggaaatgggaggtgggttagtctacatta

SEQ ID NO: 17330 - DNA, 75 bp, Artificial Sequence
  Synthetic
tagttgttaagtttttgtactcataggttaataaggaatcagctatattaaatcactgattgattggctattttt

SEQ ID NO: 17331 - DNA, 75 bp, Artificial Sequence
  Synthetic
ggttaataaggaatcagctatattaaatcactgattgattggctattttttttaggttaagtgactgcatttaaa

SEQ ID NO: 17332 - DNA, 75 bp, Artificial Sequence
  Synthetic
tagttgttttaagtttagtatgttaaggcctataggttaagatctactaacaattatattatgtcattggatgta

SEQ ID NO: 17333 - DNA, 75 bp, Artificial Sequence
  Synthetic
tcgcattgctaacctacaacacaactacctcatccacaaaccctcccctattctacctcaacacatactacctca

SEQ ID NO: 17334 - DNA, 75 bp, Artificial Sequence
  Synthetic
tagtagtagactccttgagaagctactactgcaaaagctggaatgagcaccctccaagaattgcaggaaaatatc

SEQ ID NO: 17335 - DNA, 75 bp, Artificial Sequence
  Synthetic
accgcacacgaacaacatctcgtcactgccaggcagaaacttaaagatgccgagaagaccgtggaagtggaccca

SEQ ID NO: 17336 - DNA, 75 bp, Artificial Sequence
  Synthetic
gatgaagtcaacaagagcacattacaaagtagacgggcggctgtgtctacattggagaccaaacttggagagctc

SEQ ID NO: 17337 - DNA, 75 bp, Artificial Sequence
  Synthetic
aagaggcagcttgcagatttggtggcagctcaaaagctggctgcaaagccagttgatccaacagggcttgagcct

SEQ ID NO: 17338 - DNA, 75 bp, Artificial Sequence
  Synthetic
gatgaccatctgaaggagaaatcatctttgaggtatgggaatgtcttggatgtcaactccattgaccttgaagaa

SEQ ID NO: 17339 - DNA, 75 bp, Artificial Sequence
  Synthetic
ccgagtggtcaaacagctgattggaaagcaattggggcttatatactgggatttgcaattccaatcatactgaaa

SEQ ID NO: 17340 - DNA, 75 bp, Artificial Sequence
  Synthetic
gcactatacatgttatccacccgtggaaggcaaacagttaaggacaacaaaggcaccagaataaggttcaaagat

SEQ ID NO: 17341 - DNA, 75 bp, Artificial Sequence
  Synthetic
gattcatcctttgaagaggtaaatgggatccggaagccgaaacatctttatgtttcaatgccaacagcacagtcc

SEQ ID NO: 17342 - DNA, 75 bp, Artificial Sequence
  Synthetic
acaatgaaagctgaagaaataacaccaggcaggtttagaactattgcttgtgggcttttccctgcacaagttaag

SEQ ID NO: 17343 - DNA, 75 bp, Artificial Sequence
  Synthetic
gccaggaatataattagtccagtcatgggggtaattggtttcagcttcttcgtcaaggactggatggaaagaatt

SEQ ID NO: 17344 - DNA, 75 bp, Artificial Sequence
  Synthetic
gaagatttcttagctgcagagtgtccgtttctacctaagcctaaaaccacctctgaggcattcatgtcaactaat

SEQ ID NO: 17345 - DNA, 75 bp, Artificial Sequence
  Synthetic
aaggcttatttcttaaacaggcagagacaggttgatgaatctcaagtcccagacatagcagaactgatagaacag

SEQ ID NO: 17346 - DNA, 75 bp, Artificial Sequence
  Synthetic
gcggaatctgagtcagcaactttattcacagaaattgcaagccctcattcagtatgggtatttgcatgtgcacca

SEQ ID NO: 17347 - DNA, 75 bp, Artificial Sequence
  Synthetic
gatagatgcccgcctacagccctgtatgttgcaggagtaccagaacttggggccttttttgctatactacaagac

SEQ ID NO: 17348 - DNA, 75 bp, Artificial Sequence
  Synthetic
atgaggaacacaataatggcatcaaagtcggtcgggactgcagaagagaagctcaagaagaagtctgctttctac

SEQ ID NO: 17349 - DNA, 75 bp, Artificial Sequence
  Synthetic
cagtcatacttgcggagaacccagtcaatggggattcagttggatcagaagattataatcctctatatgttgtca

SEQ ID NO: 17350 - DNA, 75 bp, Artificial Sequence
  Synthetic
tggggaaaggaggctgtcaatcattttcatcttggtgatgatatggatcctgagctcagacaactggctcaagct

SEQ ID NO: 17351 - DNA, 75 bp, Artificial Sequence
  Synthetic
ttgattgacacaaaagtaaaggagatttctaaccaagagccattgaaattgtaagtggataagggcagtatgatg

SEQ ID NO: 17352 - DNA, 75 bp, Artificial Sequence
  Synthetic
cttggacggtttttcgggcttgtgccacacaattaatcatctcagggctttactgtgaataacagggtttattat

SEQ ID NO: 17353 - DNA, 75 bp, Artificial Sequence
  Synthetic
tataagggtggtgttgggtcttattactaattacgggtaaattactatttgcactattttttaataaatatattt

SEQ ID NO: 17354 - DNA, 75 bp, Artificial Sequence
  Synthetic
gcactacagattttaaatactttatatgttatcccattattgtaatccatttaatcaaattaggtgttttaagta

SEQ ID NO: 17355 - DNA, 75 bp, Artificial Sequence
  Synthetic
agtcattaactagctgtatgaaatcagtgattgaccagctaggttattaattataatcaattatgccagtataat

SEQ ID NO: 17356 - DNA, 75 bp, Artificial Sequence
  Synthetic
catgtttgtgtttaattatagtaataatcctgaatatattaacaatatattataccaatagatgtaaatttcatt

SEQ ID NO: 17357 - DNA, 75 bp, Artificial Sequence
  Synthetic
ccatgctttgctgctttgcgctatattaaccttacaacaaagctacctcatccataacccttccccttttctacc

SEQ ID NO: 17358 - DNA, 75 bp, Artificial Sequence
  Synthetic
ttccccttttctacctcacaacatactacctcacattcgatttttcttgattgcttttcaaggagcatactacta

SEQ ID NO: 17359 - DNA, 75 bp, Artificial Sequence
  Synthetic
tagtagactccgcaagaagaagcaaaaaattaaagaagtgagtttaaaatggaagggtggtatctggttgctctt

SEQ ID NO: 17360 - DNA, 75 bp, Artificial Sequence
  Synthetic
ggagtctgctatacgctgacactggcaatgcctaaaaccatttatgagcttaaaatggaatgcccgcatactgtg

SEQ ID NO: 17361 - DNA, 75 bp, Artificial Sequence
  Synthetic
ttcatacaacatctatggcccagaagagtttcacccaagttgaatggagaaagaaaagtgacacaactgatacca

SEQ ID NO: 17362 - DNA, 75 bp, Artificial Sequence
  Synthetic
caaatgctgcatctaccacctttgaagcacaaaccaaaactgttaaccttagagggacctgtatattggcacctg

SEQ ID NO: 17363 - DNA, 75 bp, Artificial Sequence
  Synthetic
aactttatgatacattaaagaaagtaaaaaagacagttctgtgctatgatctcacatgcaatcaaacacattgtc

SEQ ID NO: 17364 - DNA, 75 bp, Artificial Sequence
  Synthetic
agccaactgtatatctgattgcacctgtactgacatgcatgtcaattagaagttgtatggctagtgtgtttacaa

SEQ ID NO: 17365 - DNA, 75 bp, Artificial Sequence
  Synthetic
gtaggattcaggtgatctatgaaaagacgcattgtgtaacaggtcagctgattgagggtcagtgcttcaacccag

SEQ ID NO: 17366 - DNA, 75 bp, Artificial Sequence
  Synthetic
cacacacattgacattatctcaacctgctcacacttatgatactgtcaccctgcctatctcttgtttttttacac

SEQ ID NO: 17367 - DNA, 75 bp, Artificial Sequence
  Synthetic
caaagaagtcggagcagctaaaagttataaaaacatttgaagggattctgacaaagacagggtgcacggagaatg

SEQ ID NO: 17368 - DNA, 75 bp, Artificial Sequence
  Synthetic
cattgcaaggttattatgtgtgttttttagggagtcattcagaacctttaatcgttccaagtctggaggacatac

SEQ ID NO: 17369 - DNA, 75 bp, Artificial Sequence
  Synthetic
gatctgctgaagttgtcagtaggatgcttgtacaccctataggagaggaccatgatgctatacaaaattcacaga

SEQ ID NO: 17370 - DNA, 75 bp, Artificial Sequence
  Synthetic
gttacttgagaatagtgggacctatcacagcaaaagtgccatcaactagttccacagataccctaaaggggatag

SEQ ID NO: 17371 - DNA, 75 bp, Artificial Sequence
  Synthetic
cctttgcgggcgtcccaatgtatagctccttctctacactagtcaggaatgcggacccagaatttgtgttttctc

SEQ ID NO: 17372 - DNA, 75 bp, Artificial Sequence
  Synthetic
caggtataatacctgaatctaatcacagtgtatgtgataagaagacagtacctatcacatggacaggctacctac

SEQ ID NO: 17373 - DNA, 75 bp, Artificial Sequence
  Synthetic
cagtgtatgtgataagaagacagtacctatcacatggacaggctacctaccaatatcaggggagatggaaaaagt

SEQ ID NO: 17374 - DNA, 75 bp, Artificial Sequence
  Synthetic
gactggatgtacagttttctgtacactggcaggacctggtgctagctgtgaggcctactctgagaatggtatctt

SEQ ID NO: 17375 - DNA, 75 bp, Artificial Sequence
  Synthetic
taacatcagttccccgacatgccttgtcaacaaagtccaaagatttagaggatctgaacagaagataaattttat

SEQ ID NO: 17376 - DNA, 75 bp, Artificial Sequence
  Synthetic
ctgtcagcgggtagatcaggatgtcgttgtatactgtaatgggcagaagaaagtcatattaaccaagactttggt

SEQ ID NO: 17377 - DNA, 75 bp, Artificial Sequence
  Synthetic
tattgggcagtgtatttatacattcacaagcctattttcattgatgcctgatgtagcccattcactcgctgtaga

SEQ ID NO: 17378 - DNA, 75 bp, Artificial Sequence
  Synthetic
attatgtgtcccaggattacatgggtgggccactgttatgcttctatcaacattctgcttcgggtgggtcttgat

SEQ ID NO: 17379 - DNA, 75 bp, Artificial Sequence
  Synthetic
cttgttcccattacactaatgagtcaaaatttaaattcatcctggaaaaagttaaagtcgaataccagaagacta

SEQ ID NO: 17380 - DNA, 75 bp, Artificial Sequence
  Synthetic
tgggatcaatggtgtgtgatgtatgtcatcacgagtgtgaaacagcaaaggaacttgaatcacatagacaaagtt

SEQ ID NO: 17381 - DNA, 75 bp, Artificial Sequence
  Synthetic
gcattaatggacaatgcccttattgcatgacaataactgaggcaactgaaagtgccttgcaagcccattattcca

SEQ ID NO: 17382 - DNA, 75 bp, Artificial Sequence
  Synthetic
tttgtaaattgacaggaagatttcaagaggcattaaaaaagtcacttaagaagccagaggtaaaaaaaggttgtt

SEQ ID NO: 17383 - DNA, 75 bp, Artificial Sequence
  Synthetic
acagaacacttggggtatttcgatacaaaagtagatgttatgtgggtttggtatggtgcctattgttgacatgtg

SEQ ID NO: 17384 - DNA, 75 bp, Artificial Sequence
  Synthetic
aaattgttatttgggctgcaagtgcagagactccactaatggagtcaggttggtcagatacagctcatggtgttg

SEQ ID NO: 17385 - DNA, 75 bp, Artificial Sequence
  Synthetic
gcgagattccaatgaagacagacttagagctagacttttcactgccctcttcatcctcttatagttacaggagaa

SEQ ID NO: 17386 - DNA, 75 bp, Artificial Sequence
  Synthetic
agctcacaaatccagctaataaggaagagtctattcccttccatttccagatggaaaaacaagtgattcatgctg

SEQ ID NO: 17387 - DNA, 75 bp, Artificial Sequence
  Synthetic
agatccagcccttaggtcattggatggatgcaacatttaatattaagactgcatttcattgttatggtgcatgtc

SEQ ID NO: 17388 - DNA, 75 bp, Artificial Sequence
  Synthetic
agaagtactcttatccatggcaaacatctaagtgcttctttgaaaaagactaccagtatgaaacaggctggggct

SEQ ID NO: 17389 - DNA, 75 bp, Artificial Sequence
  Synthetic
gtaatcctggtgactgcccaggggttgggactgggtgcactgcttgtggtgtttatcttgataaactaaaatctg

SEQ ID NO: 17390 - DNA, 75 bp, Artificial Sequence
  Synthetic
gtttatcttgataaactaaaatctgtgggaaaggcctataagataatttctttaaaatacaccaggaaggtttgc

SEQ ID NO: 17391 - DNA, 75 bp, Artificial Sequence
  Synthetic
attcagttaggaacagaacaaacatgcaagcatattgatgcaaatgattgtttagtaacaccatctgtgaaggtt

SEQ ID NO: 17392 - DNA, 75 bp, Artificial Sequence
  Synthetic
tgcatagtgggcacagtttctaaactccaaccatctgatactcttttgttcttaggtccattagaacaaggagga

SEQ ID NO: 17393 - DNA, 75 bp, Artificial Sequence
  Synthetic
atcatccttaaacaatggtgcacaacatcatgtgcatttggggaccccggtgatatcatgtctactcctagtggt

SEQ ID NO: 17394 - DNA, 75 bp, Artificial Sequence
  Synthetic
atgaggtgtccagaacacactggatcattcaggaaaatttgtggttttgccactacaccagtttgtgaatatcaa

SEQ ID NO: 17395 - DNA, 75 bp, Artificial Sequence
  Synthetic
gggaatactgtttctggatacaaaagaatgatggcaacaaaagattcatttcaatcatttaacttaacagaacct

SEQ ID NO: 17396 - DNA, 75 bp, Artificial Sequence
  Synthetic
gaatgatggcaacaaaagattcatttcaatcatttaacttaacagaacctcacatcacaacaaataagcttgaat

SEQ ID NO: 17397 - DNA, 75 bp, Artificial Sequence
  Synthetic
gtgataacccctgtaaagtggacttacacacacaggcaatagaaggggcatggggttctggtgtagggtttacac

SEQ ID NO: 17398 - DNA, 75 bp, Artificial Sequence
  Synthetic
ttacatgtactgtcggattaacagagtgccctagttttatgacatcaattaaggcatgtgatcttgctatgtgtt

SEQ ID NO: 17399 - DNA, 75 bp, Artificial Sequence
  Synthetic
atggatcaacagtagcaaaccttgccaggggctctaatacagtaaaagtagttggtaagggaggtcattcagggt

SEQ ID NO: 17400 - DNA, 75 bp, Artificial Sequence
  Synthetic
cttcatttaaatgctgtcatgatacagattgctcttctgagggtctacttgcatcagccccacatcttgagagag

SEQ ID NO: 17401 - DNA, 75 bp, Artificial Sequence
  Synthetic
tgggatcttaaacgggaattggattgttgttgtagtgcttgttgtgatactcattctctctatcataatgttcag

SEQ ID NO: 17402 - DNA, 75 bp, Artificial Sequence
  Synthetic
tgttctgtgccccaggagaggacacaagaaaactgtctaagcattaaccgcaaatttcacattagattatataca

SEQ ID NO: 17403 - DNA, 75 bp, Artificial Sequence
  Synthetic
tttatgcactttcccatatttagctgcactaagatattaacaaactctagttattgactttataagattattatg

SEQ ID NO: 17404 - DNA, 75 bp, Artificial Sequence
  Synthetic
gcactaagatattaacaaactctagttattgactttataagattattatggaattaacctcatttaaaaaaaaca

SEQ ID NO: 17405 - DNA, 75 bp, Artificial Sequence
  Synthetic
aaaaacaaatactttactcatatataactccatattctcttaccgaggcttttgttcctgcggagcatactacta

SEQ ID NO: 17406 - DNA, 75 bp, Artificial Sequence
  Synthetic
tagtagtagactccgcaagaagaagcaaagattgaaaaaaatcattgaagagatggaagggtggtatttgattgt

SEQ ID NO: 17407 - DNA, 75 bp, Artificial Sequence
  Synthetic
cttgggggtctgctctacagtcacactggcaatgcctaaaaccatttatgaactcaaaatggaatgtccacatac

SEQ ID NO: 17408 - DNA, 75 bp, Artificial Sequence
  Synthetic
cgttggtcttggtcaagggtatattataggctcgactgagcttaacttgatacccattggggctgcatcagacct

SEQ ID NO: 17409 - DNA, 75 bp, Artificial Sequence
  Synthetic
gaagctagaaagttcatgcgattttgacttatacaccacgccaatgacccaaaaaagctatacacaggttgaatg

SEQ ID NO: 17410 - DNA, 75 bp, Artificial Sequence
  Synthetic
gaggaagaaaagtgaaacaactgacaccacaaatgctgctgctacgacatttgaatcacagacaaagactgtaaa

SEQ ID NO: 17411 - DNA, 75 bp, Artificial Sequence
  Synthetic
cctacgtgggacctgtatcctggcctcagaattgtatgataccttgaataaaatcaagaagcctgtattgtgcta

SEQ ID NO: 17412 - DNA, 75 bp, Artificial Sequence
  Synthetic
tgatctcaactgcaaccaaacacgctgccagccaacagtttacttgattgcccctgtgatcacatgcatgtcaat

SEQ ID NO: 17413 - DNA, 75 bp, Artificial Sequence
  Synthetic
aaggagttgtatggcaagtgtgtctaacagcagaatccaaataatttatgaaaagacacattgtgtcactgggca

SEQ ID NO: 17414 - DNA, 75 bp, Artificial Sequence
  Synthetic
actagttgaaggccaatgctttaatccctcacacacgctaacacttgctcagcctgctcatacctatgagacagt

SEQ ID NO: 17415 - DNA, 75 bp, Artificial Sequence
  Synthetic
aactctccctgttacttgtttctttacaccaaagaagtctgaccaactcaagttagtaaaaacatttgaaggaat

SEQ ID NO: 17416 - DNA, 75 bp, Artificial Sequence
  Synthetic
aattaccaaaactggctgtacggaaaatgcactacagggttattatgtatgttttcttggaagtcactcagagcc

SEQ ID NO: 17417 - DNA, 75 bp, Artificial Sequence
  Synthetic
tctacatgtgccaagtctagaagatatccgttcagcagaggttgtcagtaggatgatagtacatcctcgaggtga

SEQ ID NO: 17418 - DNA, 75 bp, Artificial Sequence
  Synthetic
ggatcatgacccaatccaaaattcacaaggccacttgcggatagtcggaccgataacagcaaaggtaccaagcac

SEQ ID NO: 17419 - DNA, 75 bp, Artificial Sequence
  Synthetic
tagttctagtgacaccttacaaggaacggcattttctggtgtaccaatgtacagttcattatcaacacttgtacg

SEQ ID NO: 17420 - DNA, 75 bp, Artificial Sequence
  Synthetic
gagtgcagacccagaatttgtgttttcaccagggatcttgcctgaatctaaccatagtgtatgtgataaaaagac

SEQ ID NO: 17421 - DNA, 75 bp, Artificial Sequence
  Synthetic
tctccctctcacatggacaggttatttgcctatctctggtgaaatggaaaaagtaactggatgcactgtcttttg

SEQ ID NO: 17422 - DNA, 75 bp, Artificial Sequence
  Synthetic
taccttagctggcccaggagcaagttgtgaggcctattcagagaatgggatctttaacataagttccccaacatg

SEQ ID NO: 17423 - DNA, 75 bp, Artificial Sequence
  Synthetic
ccttgtcaataaagtgcagaaattccggggctctgaacaaaagatcaatttcatttgccaaagaatggatcagga

SEQ ID NO: 17424 - DNA, 75 bp, Artificial Sequence
  Synthetic
tgttgttgtttactgcaatggtcaaaagaaggtgatactgacaaaaacactagttattggacaatgcatttatac

SEQ ID NO: 17425 - DNA, 75 bp, Artificial Sequence
  Synthetic
attcacaagcctgttttcattaatgcctgatgttgcccattctttggcagttgaattatgtgtgcctgggctgca

SEQ ID NO: 17426 - DNA, 75 bp, Artificial Sequence
  Synthetic
cgggtgggccactgttatgctcctttccaccttttgttttggctggatcctaataccagcaattactctagttgt

SEQ ID NO: 17427 - DNA, 75 bp, Artificial Sequence
  Synthetic
cctaaagttcttaaaaatggcaacattctcatgctcacattatacaaatgaatctaagtttaagctcatactaga

SEQ ID NO: 17428 - DNA, 75 bp, Artificial Sequence
  Synthetic
gaaggtgaaagtagaataccagaaaacaatgggctcaatggtctgtgacatatgccaccatgaatgtgagacagc

SEQ ID NO: 17429 - DNA, 75 bp, Artificial Sequence
  Synthetic
aaaagtgttagaatcacataaacaaagctgcattaatggacagtgcccgtactgcatgactatgactgaggcaac

SEQ ID NO: 17430 - DNA, 75 bp, Artificial Sequence
  Synthetic
tgaaagtgctctacaagctcattattctatctgcaaattgacagggaggtttcaggaggctttaaaaaaatcatt

SEQ ID NO: 17431 - DNA, 75 bp, Artificial Sequence
  Synthetic
aaaaaaaccagaggtaaaaaggggttgttaccgtaccttaggtgtatttagatacaagagtagatgttatgttgg

SEQ ID NO: 17432 - DNA, 75 bp, Artificial Sequence
  Synthetic
attagtttggtgtgtgcttttaacatgtgagcttattgtctgggcagctagtgcggaaactccactgctggaatc

SEQ ID NO: 17433 - DNA, 75 bp, Artificial Sequence
  Synthetic
aggatggtcagatacagcccatggtgttggagaaatcccgatgaagactgatttagaacttgatttttcacttcc

SEQ ID NO: 17434 - DNA, 75 bp, Artificial Sequence
  Synthetic
ttcctcatcttcttacagctatagacgaaagctcactaaccctgcaaataaggaagaatcaatccctttccactt

SEQ ID NO: 17435 - DNA, 75 bp, Artificial Sequence
  Synthetic
tcaaatggaaaaacaagtgattcatgctgaaattcaaacattaggccattggatggatgccacatttaacattaa

SEQ ID NO: 17436 - DNA, 75 bp, Artificial Sequence
  Synthetic
gactgcatttcattgttatggggcatgccaaaaatattcatacccctggcaaactgcaaaatgcttttttgaaaa

SEQ ID NO: 17437 - DNA, 75 bp, Artificial Sequence
  Synthetic
ggattatcagtacgaaacaggttggggctgcaaccctggggattgtcctggggtaggtacaggttgcactgcctg

SEQ ID NO: 17438 - DNA, 75 bp, Artificial Sequence
  Synthetic
tggtgtttacctggacaaactaaaatctgtagggaaggcatataaaattatctcattgaagtatactcgaaaagt

SEQ ID NO: 17439 - DNA, 75 bp, Artificial Sequence
  Synthetic
ttgtatccaactaggaacagagcagacttgtaagcatattgatgcaaatgactgtttagtaactccatctgtaaa

SEQ ID NO: 17440 - DNA, 75 bp, Artificial Sequence
  Synthetic
agtatgtattgttgggactgtgtccaagcttcagccttcggatacgctacttttccttgggccgttagagcaagg

SEQ ID NO: 17441 - DNA, 75 bp, Artificial Sequence
  Synthetic
tggaataatactaaagcaatggtggaccacatcttgcgcctttggagatccaggggatataatgtcaacaactag

SEQ ID NO: 17442 - DNA, 75 bp, Artificial Sequence
  Synthetic
tggtatgagatgtccagagcatactggctcattcaggaagatctgtggatttgcaacaacacctgtatgtgagta

SEQ ID NO: 17443 - DNA, 75 bp, Artificial Sequence
  Synthetic
tcaagggaataccatctcaggctataaacgaatgatggcaacaaaggattcatttcaatcatttaacctcactga

SEQ ID NO: 17444 - DNA, 75 bp, Artificial Sequence
  Synthetic
cccacacatcacaacaaacaaacttgaatggattgaccctgatggcaatacaagggatcatgtaaatctcgtttt

SEQ ID NO: 17445 - DNA, 75 bp, Artificial Sequence
  Synthetic
aaatagagacgtctcatttcaggatttaagtgacaacccgtgtaaggttgatttacatacacaggcaatagaagg

SEQ ID NO: 17446 - DNA, 75 bp, Artificial Sequence
  Synthetic
ggcatggggttctggtgttggatttacacttacatgtacagttggtttgactgagtgtccaagtttcatgacctc

SEQ ID NO: 17447 - DNA, 75 bp, Artificial Sequence
  Synthetic
aatcaaagcctgtgaccttgcaatgtgttacggatcaacagttactaacctggctagagggtctaatacagttaa

SEQ ID NO: 17448 - DNA, 75 bp, Artificial Sequence
  Synthetic
ggttgttggaaaaggtggacattcaggctcctcattcaaatgttgtcatgatactgattgttcttctgaagggct

SEQ ID NO: 17449 - DNA, 75 bp, Artificial Sequence
  Synthetic
tgttgcatcggctccacaccttgagagggtcacagggttcaatcagattgactctgataaggtctatgatgatgg

SEQ ID NO: 17450 - DNA, 75 bp, Artificial Sequence
  Synthetic
tgctcccccttgtacattcaggtgctggttcaccaaatctggggaatggcttctaggaatcttgaatggtaactg

SEQ ID NO: 17451 - DNA, 75 bp, Artificial Sequence
  Synthetic
gattgttgttgtagtgctcatagtggtattgatcttttctatagtgctctttagtatcctctgcccccggagagg

SEQ ID NO: 17452 - DNA, 75 bp, Artificial Sequence
  Synthetic
acacaagaaagctgtgtaagtagaatactgtatgcatttatgaataataaaattcattaatttactaatgctttt

SEQ ID NO: 17453 - DNA, 75 bp, Artificial Sequence
  Synthetic
atgctgaccattaatgcactgtattactatataatcctttattaaaaaaaacaaatactttactcacataaaatt

SEQ ID NO: 17454 - DNA, 75 bp, Artificial Sequence
  Synthetic
aaaaacaaatactttactcacataaaattccattctcgcttaccgaggcttttgttcctgcggagcatactacta

SEQ ID NO: 17455 - DNA, 75 bp, Artificial Sequence
  Synthetic
tagtagtagactccttgagaagctactactgcgaaagctggaatgagcaccctccaagaactacaggaaaatatc

SEQ ID NO: 17456 - DNA, 75 bp, Artificial Sequence
  Synthetic
acagcacacgaacaacagctcgtgactgctcggcaaaagcttaaagatgccgaaaagacggtggaggtggacccg

SEQ ID NO: 17457 - DNA, 75 bp, Artificial Sequence
  Synthetic
gatgaggttaacaagagcacattacaaagtagacgggcagctgtgtctacattggagaccaaactcggagaactt

SEQ ID NO: 17458 - DNA, 75 bp, Artificial Sequence
  Synthetic
aagaggcagcttgcggatctggtggcagctcaaaaactggctacaaaaccagttgatccaacagggcttgagcct

SEQ ID NO: 17459 - DNA, 75 bp, Artificial Sequence
  Synthetic
cagctcaaaaactggctacaaaaccagttgatccaacagggcttgagcctgatgatcatctaaaagagaaatcat

SEQ ID NO: 17460 - DNA, 75 bp, Artificial Sequence
  Synthetic
ctctccgttatgggaatgtcctggatgtcaactccattgatcttgaagagccaagtggtcaaactgctgattgga

SEQ ID NO: 17461 - DNA, 75 bp, Artificial Sequence
  Synthetic
aagctattggggcctacatattaggatttgccataccaatcatcctgaaagctctctacatgctttccacccgtg

SEQ ID NO: 17462 - DNA, 75 bp, Artificial Sequence
  Synthetic
atttgccataccaatcatcctgaaagctctctacatgctttccacccgtgggagacagactgtcaaagacaacaa

SEQ ID NO: 17463 - DNA, 75 bp, Artificial Sequence
  Synthetic
ggggactagaataaggttcaaggatgactcatcatttgaagaggtcaacggtatccggaaaccgaagcatctcta

SEQ ID NO: 17464 - DNA, 75 bp, Artificial Sequence
  Synthetic
tgtgtcaatgccaactgcacaatcaacaatgaaggctgaagagataacacctggacggttcaggacaattgcatg

SEQ ID NO: 17465 - DNA, 75 bp, Artificial Sequence
  Synthetic
tggactcttccctgcacaagtgaaagccaggaacatcatcagcccagtcatgggagtaatcgggtttagcttctt

SEQ ID NO: 17466 - DNA, 75 bp, Artificial Sequence
  Synthetic
tgggagtaatcgggtttagcttctttgtgaaggattggatggaaaggattgaggatttcttggcagctgaatgcc

SEQ ID NO: 17467 - DNA, 75 bp, Artificial Sequence
  Synthetic
cattcttacctaaacccaaggcattgtctgaagcattcatggctactaataaagcttatttcctgaataggcaac

SEQ ID NO: 17468 - DNA, 75 bp, Artificial Sequence
  Synthetic
ggcaggtgaatgattcaaaagtccaagatatagttgacctcattgaccatgcagagattgaatcagcaacacttt

SEQ ID NO: 17469 - DNA, 75 bp, Artificial Sequence
  Synthetic
agatatagttgacctcattgaccatgcagagattgaatcagcaacacttttcacagacattgcaactcctcattc

SEQ ID NO: 17470 - DNA, 75 bp, Artificial Sequence
  Synthetic
agtttgggtattcgcatgtgcaccagatcgctgcccaccgacagccttatatgttgcaggggttcctgagctagg

SEQ ID NO: 17471 - DNA, 75 bp, Artificial Sequence
  Synthetic
ggctttctttgccatccttcaggacatgcgaaatacaatcatggcatcaaagtctgtaggaacagctgaagaaaa

SEQ ID NO: 17472 - DNA, 75 bp, Artificial Sequence
  Synthetic
agtctgtaggaacagctgaagaaaaactcaagaagaagtctgcattctaccagtcatacctaaggcggacacaat

SEQ ID NO: 17473 - DNA, 75 bp, Artificial Sequence
  Synthetic
atatgggaatccaactggaccaaaagatcataatcctttacatgctatcctggggcaaggaagcagtgaaccatt

SEQ ID NO: 17474 - DNA, 75 bp, Artificial Sequence
  Synthetic
gatcataatcctttacatgctatcctggggcaaggaagcagtgaaccatttccatcttggtgatgatatggatcc

SEQ ID NO: 17475 - DNA, 75 bp, Artificial Sequence
  Synthetic
tgagctcagacaacttgctcaatccttgattgataccaaggttaaggaaatttcaaaccaagagccattaaagct

SEQ ID NO: 17476 - DNA, 75 bp, Artificial Sequence
  Synthetic
gtaagagccataattataagagccattatgctatgagagccaaaatagtttacatcttgatggttatatcactca

SEQ ID NO: 17477 - DNA, 75 bp, Artificial Sequence
  Synthetic
ttatgctatgagagccaaaatagtttacatcttgatggttatatcactcagatggctttccgggcttgtgccaca

SEQ ID NO: 17478 - DNA, 75 bp, Artificial Sequence
  Synthetic
tatttaatcatctcaggaacctttaatgtgattaatacgggtttactatataaggggtggtgggttcaattacta

SEQ ID NO: 17479 - DNA, 75 bp, Artificial Sequence
  Synthetic
taaggggtggtgggttcaattactaactacgggtaaggggacattaatctttgcactagggttaagggtcattat

SEQ ID NO: 17480 - DNA, 75 bp, Artificial Sequence
  Synthetic
cttatagttgcactacaggggatcgggatatgggtttacattataatctataggttaatatataggataggtata

SEQ ID NO: 17481 - DNA, 75 bp, Artificial Sequence
  Synthetic
agtatgtatagtagtaagtatataagtagatggccaaatgaaatcattgattgaatggctagagtcaatttattg

SEQ ID NO: 17482 - DNA, 75 bp, Artificial Sequence
  Synthetic
attataggttaagtgttactatttatgtacttttaggtttaagatctactaacaattattgtatgccactagatg

SEQ ID NO: 17483 - DNA, 75 bp, Artificial Sequence
  Synthetic
taaatttcgttcattgctttgctgctttatgctatactaaccacaacaaactacctcatccaaaaaccctctcct

SEQ ID NO: 17484 - DNA, 75 bp, Artificial Sequence
  Synthetic
tccttttctacctcatctcaataaactacctcaattttgatttttcttgattgcttttcaaggagcatactacta

SEQ ID NO: 17485 - DNA, 75 bp, Artificial Sequence
  Synthetic
agtagtagactccttgagaagctactactgcgaaagctggaatgagcaccctccaagaattacaagaaaatatca

SEQ ID NO: 17486 - DNA, 75 bp, Artificial Sequence
  Synthetic
ctccaagaattacaagaaaatatcacagcacacgaacaacagctcgtgactgctcggcaaaagctcaaagatgcc

SEQ ID NO: 17487 - DNA, 75 bp, Artificial Sequence
  Synthetic
gaaaagacggtggaggtggacccggatgaggttaacaagagcacactacaaagtagacgggcagctgtgtctaca

SEQ ID NO: 17488 - DNA, 75 bp, Artificial Sequence
  Synthetic
aagtagacgggcagctgtgtctacattggagaccaagctcggggaactcaagagacaacttgcagatttggtggc

SEQ ID NO: 17489 - DNA, 75 bp, Artificial Sequence
  Synthetic
agctcaaaaactggctacaaaaccagttgatccaacagggcttgagcctgatgatcatctaaaggaaaagtcatc

SEQ ID NO: 17490 - DNA, 75 bp, Artificial Sequence
  Synthetic
cttaaggtatggcaatgtcctggatgtcaactccattgatctggaagaaccaagtggacagactgctgattggag

SEQ ID NO: 17491 - DNA, 75 bp, Artificial Sequence
  Synthetic
gtctattggggcttatatactaggctttgcaatcccaatcatcctaaaggccttgtatatgctttctacccgcgg

SEQ ID NO: 17492 - DNA, 75 bp, Artificial Sequence
  Synthetic
gcgtcagactgtcaaagacaataaagggactagaatacggtttaaggatgattcatcatttgaagaggtcaatgg

SEQ ID NO: 17493 - DNA, 75 bp, Artificial Sequence
  Synthetic
catccgaaagcccaagcacttgtatgtgtccatgccaacagcacagtcaacaatgaaggctgaggagataacacc

SEQ ID NO: 17494 - DNA, 75 bp, Artificial Sequence
  Synthetic
agggaggttcagaacaattgcatgtggcctcttccctgcacaagttaaggcaagaaacatcattagtcctgtcat

SEQ ID NO: 17495 - DNA, 75 bp, Artificial Sequence
  Synthetic
gggagttattggatttagcttctttgtaaaagattggatggaaaggatagaagactttttggcagctgaatgtcc

SEQ ID NO: 17496 - DNA, 75 bp, Artificial Sequence
  Synthetic
tttcctaccaaagccaaaggctccatctgaagcattcatggccactaacaaagcctattttttaaatagacaaag

SEQ ID NO: 17497 - DNA, 75 bp, Artificial Sequence
  Synthetic
gcaagtgaatgagtcaaaagtccaggatatagttgacctcattgaccatgcggagactgagtcagcaacattgtt

SEQ ID NO: 17498 - DNA, 75 bp, Artificial Sequence
  Synthetic
tacggatattgctactccacactcagtgtgggtgtttgcatgtgcaccagatcgttgtccaccaacagccttata

SEQ ID NO: 17499 - DNA, 75 bp, Artificial Sequence
  Synthetic
tgtcgccggtgttccagaattgggtgcattctttgccattttgcaggacatgcgaaacacaattatggcttcaaa

SEQ ID NO: 17500 - DNA, 75 bp, Artificial Sequence
  Synthetic
gtctgttgggacagctgaagaaaaactcaagaaaaaatctgccttctaccagtcatacttgagaaggacacaatc

SEQ ID NO: 17501 - DNA, 75 bp, Artificial Sequence
  Synthetic
tatggggattcaactggaccagaagatcataattctctacatgttatcatgggggaaagaagcagtgaaccactt

SEQ ID NO: 17502 - DNA, 75 bp, Artificial Sequence
  Synthetic
tcatcttggtgatgatatggatcctgagctcagacagctcgctcaatccttgattgatactaaggtgaaggagat

SEQ ID NO: 17503 - DNA, 75 bp, Artificial Sequence
  Synthetic
ttccaatcaagagccattaaagctgtgagagttgaaactatcaaagccatcactgccataggagccaatactagt

SEQ ID NO: 17504 - DNA, 75 bp, Artificial Sequence
  Synthetic
tgatatctaagaatcaggttggttagatggattttctgggcttgtgccaatcatttaatcatctcaggactctct

SEQ ID NO: 17505 - DNA, 75 bp, Artificial Sequence
  Synthetic
aatgtgattaatacgggttgatcatgagggtggtaagtgggtttcatttactaacaatgggtaagggaacactac

SEQ ID NO: 17506 - DNA, 75 bp, Artificial Sequence
  Synthetic
tatcttttgcactagggttaagggccattattctatatttgcactaatggggtaaggttaaatgttaagtcctta

SEQ ID NO: 17507 - DNA, 75 bp, Artificial Sequence
  Synthetic
gtttagataattgataagttagttataagatagattagaacttgattaagtggataaatagccagatgacatcat

SEQ ID NO: 17508 - DNA, 75 bp, Artificial Sequence
  Synthetic
tgattgatcggctatttttattaatcaatataggatttaatcttaagttaaggttaattatcagtatccttaggt

SEQ ID NO: 17509 - DNA, 75 bp, Artificial Sequence
  Synthetic
ttaagataaactaacaattattgtaatccattggatgtaaatttcgttcattgctttgctgctttctgctacact

SEQ ID NO: 17510 - DNA, 75 bp, Artificial Sequence
  Synthetic
aattcacaacaacactacctcatcccaaaaccctcccctttatctacctcacataaaactacctcaatttcgatt

SEQ ID NO: 17511 - DNA, 75 bp, Artificial Sequence
  Synthetic
tcccctttatctacctcacataaaactacctcaatttcgatttctcttgattgcttttcaaggagcatactacta

SEQ ID NO: 17512 - DNA, 75 bp, Artificial Sequence
  Synthetic
tagtagtatgctccgcaggaacaaaagcctcgaaaaaaagtaatggaattataggtgagtaaagatgttgttttt

SEQ ID NO: 17513 - DNA, 75 bp, Artificial Sequence
  Synthetic
tttagttttttatattagagtaataaatttataatattataagttagtacatataaactggcttttgtaatatgt

SEQ ID NO: 17514 - DNA, 75 bp, Artificial Sequence
  Synthetic
ttaagtgtgttagtttaaatgagtttagtaaataaatctgataatgtgacaacgatcatcatgtgatctcacaca

SEQ ID NO: 17515 - DNA, 75 bp, Artificial Sequence
  Synthetic
gtcttttttgaacttcttctagggcacaaaaaactaaataacaagattgagataaccaacaccacaacaagtaca

SEQ ID NO: 17516 - DNA, 75 bp, Artificial Sequence
  Synthetic
acaacaacaacccaatttccattcaaaatcccccataaccactctccagactttgtgaaccagcactttaaagta

SEQ ID NO: 17517 - DNA, 75 bp, Artificial Sequence
  Synthetic
catggaggtgcaccatcatcataaactttgtcagaatctatttggtttacaccagtaacgcgctcaagatgtgga

SEQ ID NO: 17518 - DNA, 75 bp, Artificial Sequence
  Synthetic
gcagatgcagcaagtccttcagtagagcaatctgtatcatggcaacatttgaaggcagaacctgaatgtcctcct

SEQ ID NO: 17519 - DNA, 75 bp, Artificial Sequence
  Synthetic
ttaccaacaaccttgactgtatttgaacccctagctaagttggtaactgtagaaccataacacattgccatgtca

SEQ ID NO: 17520 - DNA, 75 bp, Artificial Sequence
  Synthetic
catgctttaattgaagtcataaaacttggacattctgtcagactaactgtgcatgttaatgtaaaaccaacacct

SEQ ID NO: 17521 - DNA, 75 bp, Artificial Sequence
  Synthetic
gaaccccacgcaccctcaatggactgtgtgtgaaggtctactttgcaagggttgtcactcaagtcctgaaaggaa

SEQ ID NO: 17522 - DNA, 75 bp, Artificial Sequence
  Synthetic
acatctcggttcaacacgagattcacatgatctcttgtattgccgtctggatcaatccattctaatttgtttgtt

SEQ ID NO: 17523 - DNA, 75 bp, Artificial Sequence
  Synthetic
gtgagatgaggatccgttaaattgaaagattgaaaggaatcctttgttgccatcattcgtttgtaaccagaaata

SEQ ID NO: 17524 - DNA, 75 bp, Artificial Sequence
  Synthetic
gtattcccttgatactcacaaacaggtgttgtagcaaatgcacaaatttttctgaaggaacctgtgtgctcagga

SEQ ID NO: 17525 - DNA, 75 bp, Artificial Sequence
  Synthetic
catctcattcctgctgttgttgacattatatcacctggatcaccaaatgtgcaagatgtcgtacaccattgcttg

SEQ ID NO: 17526 - DNA, 75 bp, Artificial Sequence
  Synthetic
aggataatcccgccttgttctaatggaccaaggaacaagatggtatcagctggctgtagctttgaaacagtgcct

SEQ ID NO: 17527 - DNA, 75 bp, Artificial Sequence
  Synthetic
accatgcacacttttactgatggtgtaacgaggcaatcattggcatcaatatgtttgcatgtctgctcagttcct

SEQ ID NO: 17528 - DNA, 75 bp, Artificial Sequence
  Synthetic
agctgtatacaaactttccttgaatactttagggagataatcttgtatgccttacctacagacttcagcttatcc

SEQ ID NO: 17529 - DNA, 75 bp, Artificial Sequence
  Synthetic
agatagatcccacaagcagtacagccagttccaacaccagggcaatcaccagggttacaaccccatccgttttca

SEQ ID NO: 17530 - DNA, 75 bp, Artificial Sequence
  Synthetic
tactggtaatctttttcaaaaaagcattttgcagtctgccatggataagaatacttctgacatgcaccataacag

SEQ ID NO: 17531 - DNA, 75 bp, Artificial Sequence
  Synthetic
tggaatgcagttttgatgttaaaggttgcatccatccaatgcccaaggacttgcacttcagcatggatcacttgc

SEQ ID NO: 17532 - DNA, 75 bp, Artificial Sequence
  Synthetic
ttatccatctgaaagtgaaaaggtatggattcttctttatttgcaggattggtcaactttcttctatagctatat

SEQ ID NO: 17533 - DNA, 75 bp, Artificial Sequence
  Synthetic
gaagatgatgacggcagagaaaaatctagctccaaatcagtcttcagtggcacttcacccacaccatgtgctgtg

SEQ ID NO: 17534 - DNA, 75 bp, Artificial Sequence
  Synthetic
tcagaccacccgggctccacttgtgttgtttctgcactagcagcccatactataatttctgcagtgagtaaaatt

SEQ ID NO: 17535 - DNA, 75 bp, Artificial Sequence
  Synthetic
gcccagactaaaccaacataacatcggctcttatacctgaacaccccgagtgtacgatagcaacctcggtggatt

SEQ ID NO: 17536 - DNA, 75 bp, Artificial Sequence
  Synthetic
tctggtttctttagtgatttctttagagcctcttgaaacctaccagtcaatttgcaaatcccaaaatgtgcctga

SEQ ID NO: 17537 - DNA, 75 bp, Artificial Sequence
  Synthetic
agagcactttgtgtggcctcagtcattgtcatacagtatggacattgcccttcggggcagctctgtttatgtgtc

SEQ ID NO: 17538 - DNA, 75 bp, Artificial Sequence
  Synthetic
tctagctcttttgccgtctcacactcatgatgacaaacatcacataccattgaacccattgttttctggtattca

SEQ ID NO: 17539 - DNA, 75 bp, Artificial Sequence
  Synthetic
actttaaccttttctagaatgaatttaaactttgattcattgttataatgagagcatgagtaggtaagaaccctt

SEQ ID NO: 17540 - DNA, 75 bp, Artificial Sequence
  Synthetic
aagctcttcaatacaatcaaagtcacagtaggtatcaagagccatccaaagcaaaatgttgtgagtaaagacact

SEQ ID NO: 17541 - DNA, 75 bp, Artificial Sequence
  Synthetic
gtagcccagccatgcagcccagggacacataactccacagcaatagagtgtgcaacattaggcatcagtgaaaat

SEQ ID NO: 17542 - DNA, 75 bp, Artificial Sequence
  Synthetic
aggctagtaaatgtatagatgcattgtccaattactagtgttttagtcaaaattactttcttctgcccattgcaa

SEQ ID NO: 17543 - DNA, 75 bp, Artificial Sequence
  Synthetic
taaacaattacatcctgatcaactcgctgacaaataaagttgattttctgttctgaaccccggaatctctgcatc

SEQ ID NO: 17544 - DNA, 75 bp, Artificial Sequence
  Synthetic
ttgttgacaagacaagtaggtgaacttatattaaaaataccattctcagaataggcctcacagctggctccaggc

SEQ ID NO: 17545 - DNA, 75 bp, Artificial Sequence
  Synthetic
cccaccaatgtacaaaagactgtacaacctgtgactttttcaaattctcctgctataggaagatagccattccag

SEQ ID NO: 17546 - DNA, 75 bp, Artificial Sequence
  Synthetic
gtcagtggcatcgtctttttctcacatttactgtggtttgactctggtataatccctggcgaaaacacatactca

SEQ ID NO: 17547 - DNA, 75 bp, Artificial Sequence
  Synthetic
ggttctaccttactgactaaagtggataaggagctgtacataggcaatccagcaaaggcaacaccctgcattgta

SEQ ID NO: 17548 - DNA, 75 bp, Artificial Sequence
  Synthetic
tcagaagcactagagctcgggactttagccttaacaggccctactacacgtaatgagccttgtgcctcatttggg

SEQ ID NO: 17549 - DNA, 75 bp, Artificial Sequence
  Synthetic
aagtcatgatcttctcctctcggatggacaatcattcgactgacaacttctgctgaacggatgtcttctaagttt

SEQ ID NO: 17550 - DNA, 75 bp, Artificial Sequence
  Synthetic
ggcacaatcaatggttctgaatgacttcccaaaaaacagacataatatccttgaaatgcattactacagtctgtc

SEQ ID NO: 17551 - DNA, 75 bp, Artificial Sequence
  Synthetic
ttaccaacaataccttcaaaagtgttcacaacctttaactgatcagatttttttgcaattaaaaagcacactatt

SEQ ID NO: 17552 - DNA, 75 bp, Artificial Sequence
  Synthetic
ggtaaagtcagtgtctcatatgtatgagcaggctgagtcaatgtcagtgtgtgtgtggggttgaagcattgacct

SEQ ID NO: 17553 - DNA, 75 bp, Artificial Sequence
  Synthetic
tctattagctgaccataaacacagtgagttttctcaaagacgacttgaactcgactatccaatacactagccata

SEQ ID NO: 17554 - DNA, 75 bp, Artificial Sequence
  Synthetic
caactcctaatggacatacaagttaggataggagcaatcagatgtagtgtaggacggcaatgagtctggttgcat

SEQ ID NO: 17555 - DNA, 75 bp, Artificial Sequence
  Synthetic
gataaatcatagcacagaacagtcttttttatcttcttcaaagtatcatatagatctggtgataaaacacaagtt

SEQ ID NO: 17556 - DNA, 75 bp, Artificial Sequence
  Synthetic
cccctcagattcaccccttttgactgtgcctcaaatgtttctgcaccagcatttgttgtttctgtaacactagac

SEQ ID NO: 17557 - DNA, 75 bp, Artificial Sequence
  Synthetic
ttttttgcccaatcaacctgtgtatagctctgttgaaggacagatgttgtatgcaagtcaaaattgcatgagctt

SEQ ID NO: 17558 - DNA, 75 bp, Artificial Sequence
  Synthetic
tctacttttatatcttttacctggcttaacggaactaaaccaacatcaactgaaccagtaatgtacccttggcct

SEQ ID NO: 17559 - DNA, 75 bp, Artificial Sequence
  Synthetic
agaccaacagtatgcgggcattccatctttaactcatacatggttcttggcagtgcaaagacgatagtagagcag

SEQ ID NO: 17560 - DNA, 75 bp, Artificial Sequence
  Synthetic
accccaagaatggctaaaaccaaccctttaatcatttttcacactttgttggttttttgcttcttcttgcggagt

SEQ ID NO: 17561 - DNA, 75 bp, Artificial Sequence
  Synthetic
atggctaaaaccaaccctttaatcatttttcacactttgttggttttttgcttcttcttgcggagtctactacta

SEQ ID NO: 17562 - DNA, 75 bp, Artificial Sequence
  Synthetic
tagtagtatgctccttgaaaagcaatcaagaataaaacttatgaggtagtataattgaggtagtataaaggggag

SEQ ID NO: 17563 - DNA, 75 bp, Artificial Sequence
  Synthetic
gggatttgggatgaggtagttgttgtgatgttagtaaaaaggcatagcaaagcagcaaagcatggaacgaaattt

SEQ ID NO: 17564 - DNA, 75 bp, Artificial Sequence
  Synthetic
acatcttctggagttttaaattagtaacttacttaactaaacctaagatatatggttattgatattatgattaac

SEQ ID NO: 17565 - DNA, 75 bp, Artificial Sequence
  Synthetic
acaatttctaatacacagttgatcaactcagcaatatgcatcattatgatcaaaacacttaacataaactaaaga

SEQ ID NO: 17566 - DNA, 75 bp, Artificial Sequence
  Synthetic
ttacatacagattaaacatcaaagaaaacttacacctatgtcttaacaacaattacttatctactgattaaatat

SEQ ID NO: 17567 - DNA, 75 bp, Artificial Sequence
  Synthetic
gagatgatagtgttgattgtggccctttacccttagtaatcaccacccccacccatcacattataaaggaaccca

SEQ ID NO: 17568 - DNA, 75 bp, Artificial Sequence
  Synthetic
gtgcaattaattagacagtagcccctgagtaacaattggcacaagcccgaaaagccctcaatctttactaccagt

SEQ ID NO: 17569 - DNA, 75 bp, Artificial Sequence
  Synthetic
ctgactcacaacttcaaaggctcttggttggaaatctcttttaccttggtgtcaatcaatgactgtgctagctgc

SEQ ID NO: 17570 - DNA, 75 bp, Artificial Sequence
  Synthetic
ctcagctctggatccatatcatcccctagatggaaatgattcacagcctcctttccccagtgcagcatgtacatg

SEQ ID NO: 17571 - DNA, 75 bp, Artificial Sequence
  Synthetic
atgatgatcttctggtcgagctggattcccattgattgtgttctgcggagatatgattggtaaaaggctgatttt

SEQ ID NO: 17572 - DNA, 75 bp, Artificial Sequence
  Synthetic
ttcttcagtttctcttcagaagtgcctacagactttgaggccatgatggtatttctcatgtcctgtaggatggag

SEQ ID NO: 17573 - DNA, 75 bp, Artificial Sequence
  Synthetic
aagaatgccccaagctcaggaacgcctgcaacatataaagcagttggagggcatcgatcaggtgcacatgcaaaa

SEQ ID NO: 17574 - DNA, 75 bp, Artificial Sequence
  Synthetic
acccagacagaatgggggctggcaatatcatggaataatgtggcagattctgcctcagctgtctggatgaggtcc

SEQ ID NO: 17575 - DNA, 75 bp, Artificial Sequence
  Synthetic
acaatttcagccacctgggattcccgaacttgctgttgtctgttaattagataagccctatttgttgacatgaaa

SEQ ID NO: 17576 - DNA, 75 bp, Artificial Sequence
  Synthetic
ttctctgactgggattttggtttggggaggaatggacattctgcaccaaggaattcttcaatcctatccatccag

SEQ ID NO: 17577 - DNA, 75 bp, Artificial Sequence
  Synthetic
tccttcacaaagaagctaaacccaatgacacccatcacaggactgattatattccttgccttcacctgtgcagga

SEQ ID NO: 17578 - DNA, 75 bp, Artificial Sequence
  Synthetic
aaaagaccacaggcaatcgtccgaaatctccctggtgttatctcatcagccttcatagttgactgtgctgttggc

SEQ ID NO: 17579 - DNA, 75 bp, Artificial Sequence
  Synthetic
atagagacataaagatgttttggtttcctgatgccattaacttcttcaaaagaggaatcatccttgaacctgatc

SEQ ID NO: 17580 - DNA, 75 bp, Artificial Sequence
  Synthetic
cgggtccctttgttttcctttactgtctgtctccctcttgtggataacatgtaaagtgccttcaatatgatgggg

SEQ ID NO: 17581 - DNA, 75 bp, Artificial Sequence
  Synthetic
atagcaaagcccaagatgtacatcccaattgacaaccaatctgctgtttgcccacttggctcttccagatcaatc

SEQ ID NO: 17582 - DNA, 75 bp, Artificial Sequence
  Synthetic
gagttgacatcaaggacatttccataacgcagtgatgatttttccttcaaatggtcatcaggttcaagccctgtt

SEQ ID NO: 17583 - DNA, 75 bp, Artificial Sequence
  Synthetic
ggatcaactggttttgaagccagtttctgagctgccacaagatctgccagttgccttttgagttccccgagttta

SEQ ID NO: 17584 - DNA, 75 bp, Artificial Sequence
  Synthetic
ctctccaatgtagacacagctgcccgtctgttttgtaatgtgctcttattaacgtcatctgggtccacctccact

SEQ ID NO: 17585 - DNA, 75 bp, Artificial Sequence
  Synthetic
gccttctcggcatctttaagtttttgccgagcagcaactaattgctgttcgtgtactgtgatgttttcctgtatt

SEQ ID NO: 17586 - DNA, 75 bp, Artificial Sequence
  Synthetic
gatgttttcctgtatttcttggaggttgctcatcacagcttttgtagcagtagcttctcaaggagtctactacta

SEQ ID NO: 17587 - DNA, 75 bp, Artificial Sequence
  Synthetic
tagtagtagactccttgagaagctactgctgcgaaagctggaatgagcaacctccaagaattacaggaaaacatc

SEQ ID NO: 17588 - DNA, 75 bp, Artificial Sequence
  Synthetic
accgcacacgaacaacagctcgtgactgccaggcagaagcttaaagatgcagaaaaagcagttgatgtggaccca

SEQ ID NO: 17589 - DNA, 75 bp, Artificial Sequence
  Synthetic
gatgaagttaacaagagcacattacaaggtagacgggcggctgtgtcaacattggagacaaaactcggggaactt

SEQ ID NO: 17590 - DNA, 75 bp, Artificial Sequence
  Synthetic
aagagacagctggcagatttggttgcggctcaaagactggcttcaaaaccagttgatccaacagggattgagcct

SEQ ID NO: 17591 - DNA, 75 bp, Artificial Sequence
  Synthetic
gatgaccatctaaaggaaaaatcgtcactgagatatgggaatgtgctggatgtcaaccctatcgatcttgaagag

SEQ ID NO: 17592 - DNA, 75 bp, Artificial Sequence
  Synthetic
ccaagtggccagacagcagactggaaggcaattggggcttacatcttgggttttgcaatccctattatactaaag

SEQ ID NO: 17593 - DNA, 75 bp, Artificial Sequence
  Synthetic
gccttatatatgctgtcaacccgtggaaggcagacagtgaaagacaacaagggcactaggataaggttcaaggat

SEQ ID NO: 17594 - DNA, 75 bp, Artificial Sequence
  Synthetic
gattcatcctttgaagaagtgaatggaattcggaaaccaaagcatctttatatctctatgccaacagcacaatcc

SEQ ID NO: 17595 - DNA, 75 bp, Artificial Sequence
  Synthetic
accatgaaagctgaagagataacacctggaaggttcaggactattgcatgtgggttattccctgcacaagtgaaa

SEQ ID NO: 17596 - DNA, 75 bp, Artificial Sequence
  Synthetic
gcccggaatatcattagtccagtcatgggggtgattggttttggcttctttgtgaaagattggatggaaaggata

SEQ ID NO: 17597 - DNA, 75 bp, Artificial Sequence
  Synthetic
gaagattttctagcctctgagtgcccttttttacctaaacccaagaatccttcagaggcatttatggcaactaac

SEQ ID NO: 17598 - DNA, 75 bp, Artificial Sequence
  Synthetic
aaagcttacttcctcaacagacaaaagcaagttgatgagtctcaagttcccgatatagtagatttaattgaccat

SEQ ID NO: 17599 - DNA, 75 bp, Artificial Sequence
  Synthetic
gctgaagctgagtcagcaaccttattcaaagagattgccagtccacattctgtatgggtatttgcatgtgctcct

SEQ ID NO: 17600 - DNA, 75 bp, Artificial Sequence
  Synthetic
gacaggtgcccaccaactgcattatatgtagctgggttacctgaattgggtgccttctttgcgattttgcaggac

SEQ ID NO: 17601 - DNA, 75 bp, Artificial Sequence
  Synthetic
atgaggaataccatcatggcatccaagtcagttgggactgcagaagaaaaattaaagaaaaaatctgccttctat

SEQ ID NO: 17602 - DNA, 75 bp, Artificial Sequence
  Synthetic
caatcttacttaagacggacacaatccatgggaatacaattggaccaaaaaatcataattttgtacatgctgtcc

SEQ ID NO: 17603 - DNA, 75 bp, Artificial Sequence
  Synthetic
tggggtaaagaggctgtgaaccatttccatctgggtgatgatatggatccagagcttcgtcagcttgctcagtca

SEQ ID NO: 17604 - DNA, 75 bp, Artificial Sequence
  Synthetic
ttgattgataccaaggttaaggagatttcaaaccaaggacccttaaagctgtgaacagctattgggtgatcccac

SEQ ID NO: 17605 - DNA, 75 bp, Artificial Sequence
  Synthetic
ccacgtagcccccgcggccaatcccatgcccacccccgagcctctattttttcactcccagggttatatctcaca

SEQ ID NO: 17606 - DNA, 75 bp, Artificial Sequence
  Synthetic
cgcggtccactcgggctctataataactcccagggtccactgcccctcgccccctggtcatatcgcacactcggg

SEQ ID NO: 17607 - DNA, 75 bp, Artificial Sequence
  Synthetic
ggctgcggcatgatttcatccccatattgtagtttatgtttaaatagtttaactccgtttacgtgctcacggttc

SEQ ID NO: 17608 - DNA, 75 bp, Artificial Sequence
  Synthetic
cgcctcagcctgccatgaatccccatgattggatcgcaccagactcaggtaatatcactcattatgctgttgcaa

SEQ ID NO: 17609 - DNA, 75 bp, Artificial Sequence
  Synthetic
ttttagaaaagtatacctgccatatgtccagatctactaaaccatgatattatcatgactcggatgtaaatttca

SEQ ID NO: 17610 - DNA, 75 bp, Artificial Sequence
  Synthetic
tccctgctttgcagctttgcattgtactaatcttcaacaagactacctcacccacaacccttccctttttctacc

SEQ ID NO: 17611 - DNA, 75 bp, Artificial Sequence
  Synthetic
ccttccctttttctacctcaacacatactacctcaaattgatttttcttgatgcttctcaaggagcatactacta

SEQ ID NO: 17612 - DNA, 75 bp, Artificial Sequence
  Synthetic
tagtagtagactccttgagaagctactactgcgaaagctggaatgagcaccctccaagaattacaagaaaatatc

SEQ ID NO: 17613 - DNA, 75 bp, Artificial Sequence
  Synthetic
actggagaccaaactcggggaactcaagagacaacttgcagatctggtggcagctcaaaaactggctacaaaacc

SEQ ID NO: 17614 - DNA, 75 bp, Artificial Sequence
  Synthetic
agttgatccaacagggcttgagcctgatgatcatctaaaggaaaagtcatccctgagatatggtaatgttctgga

SEQ ID NO: 17615 - DNA, 75 bp, Artificial Sequence
  Synthetic
tgtcaactctattgatctagaagaaccaagtggacagactgctgattggagatctattggggcatatatacttgg

SEQ ID NO: 17616 - DNA, 75 bp, Artificial Sequence
  Synthetic
gtttgcaataccaattatcctcaaggccctatatatgctttctacccgggggcggcagactgtcaaggacaacaa

SEQ ID NO: 17617 - DNA, 75 bp, Artificial Sequence
  Synthetic
agggacaagaatccggtttaaagatgattcttcatttgaggaggtcaatggcatccgaaagcctaaacatttgta

SEQ ID NO: 17618 - DNA, 75 bp, Artificial Sequence
  Synthetic
tgtatccatgcctacagcacaatcaacaatgaaggctgaagagataacaccaggcagatttagaacaattgcatg

SEQ ID NO: 17619 - DNA, 75 bp, Artificial Sequence
  Synthetic
tggtctttttcctgcacaagtcaaagctagaaacatcattagtcctgtcatgggggtcattggattcagcttctt

SEQ ID NO: 17620 - DNA, 75 bp, Artificial Sequence
  Synthetic
tgtgaaggattggatggaaaggatagaagatttcctggcagctgaatgtcctttcttacccaaaccaaaggcacc

SEQ ID NO: 17621 - DNA, 75 bp, Artificial Sequence
  Synthetic
atctgaagcattcatggccaccaataaagcctacttcttgaacagacaacgacaggttaatgagtcaaaagttca

SEQ ID NO: 17622 - DNA, 75 bp, Artificial Sequence
  Synthetic
ggaaatagttgacctcattgatcacgcagagactgagtcagcaacattgtttacagatattgcaactccacactc

SEQ ID NO: 17623 - DNA, 75 bp, Artificial Sequence
  Synthetic
agtatgggtgtttgcatgtgcaccagatcgttgcccaccaacagccttatatgttgccggtgttccagaactggg

SEQ ID NO: 17624 - DNA, 75 bp, Artificial Sequence
  Synthetic
tgcattttttgctattctacaggatatgcggaatacaatcatggcatcaaagtctgtaggaacagctgaagagaa

SEQ ID NO: 17625 - DNA, 75 bp, Artificial Sequence
  Synthetic
gctgaagaaaaaatctgccttctaccagtcatacttgaggaggacacaatctatgggaattcagctggatcaaaa

SEQ ID NO: 17626 - DNA, 75 bp, Artificial Sequence
  Synthetic
gatcataatcctctatatgctatcatgggggaaggaggcagtaaatcactttcatcttggtgatgatatggatcc

SEQ ID NO: 17627 - DNA, 75 bp, Artificial Sequence
  Synthetic
tgagcttagacagcttgctcagtccttgattgacactaaggtgaaggagatttccaatcaggagccattaaagct

SEQ ID NO: 17628 - DNA, 75 bp, Artificial Sequence
  Synthetic
gtaagagctagtaaatttaagagccatcactgccataagagccagaactagtcaatatctgaagattatgttggt

SEQ ID NO: 17629 - DNA, 75 bp, Artificial Sequence
  Synthetic
tgggtggattttccgggcttgtgccacttatttaatcatctcaggattctctaatgtgattaatacgggttgatc

SEQ ID NO: 17630 - DNA, 75 bp, Artificial Sequence
  Synthetic
ataagggtggtaagtgggtttcaattactaactttgggtatgggaacactactatcctttgcactagggttaagg

SEQ ID NO: 17631 - DNA, 75 bp, Artificial Sequence
  Synthetic
gccactattatatatttgcactactgggattagggttaatgttaagtccatagtttcaagtagccgataagatag

SEQ ID NO: 17632 - DNA, 75 bp, Artificial Sequence
  Synthetic
tgataagatagacataggaattgattaagtagatagatagccagatgaaatcactgattgattggctatcaatgt

SEQ ID NO: 17633 - DNA, 75 bp, Artificial Sequence
  Synthetic
taatcattgtaggatatagttttaagttaaggttaatcattagcattcttagttttttaagatgaactaacaatt

SEQ ID NO: 17634 - DNA, 75 bp, Artificial Sequence
  Synthetic
attataatccactggatgtaaatttcgttcattgctttgctgctttctgctatattaactcacaacaacactacc

SEQ ID NO: 17635 - DNA, 75 bp, Artificial Sequence
  Synthetic
tcatccacaaaccctccccttttctacctcaaataaaactacctcaattctgatttctcttgattgcttttcaag

SEQ ID NO: 17636 - DNA, 75 bp, Artificial Sequence
  Synthetic
ctccccttttctacctcaaataaaactacctcaattctgatttctcttgattgcttttcaaggagcatactacta

SEQ ID NO: 17637 - DNA, 75 bp, Artificial Sequence
  Synthetic
tagtagtagactccttgataagctactgctgtaaaagctggaatgagcaacctccaagaattgcaagagaatatc

SEQ ID NO: 17638 - DNA, 75 bp, Artificial Sequence
  Synthetic
actgcacacgaacaacaactcgtgactgccaggcagaagctgaaagatgcagaaaaagccgtggacgtggaccca

SEQ ID NO: 17639 - DNA, 75 bp, Artificial Sequence
  Synthetic
gatgaggttaacaagagtacactacaaggtcgacgggcagctgtgtcaacattggagaccaaacttggagagctc

SEQ ID NO: 17640 - DNA, 75 bp, Artificial Sequence
  Synthetic
aagagacagcttgctgacttggtggcagctcaaaaactggctacaaaaccagttgatccaacagggattgagcct

SEQ ID NO: 17641 - DNA, 75 bp, Artificial Sequence
  Synthetic
gatgaccatctgaaggaaaaatcatccttgagatatgggaatgtccttgatgtcaattctattgacctggaagaa

SEQ ID NO: 17642 - DNA, 75 bp, Artificial Sequence
  Synthetic
ccaagtggacaaaccgctgactggaaggctattggagcatacatactgggttttgcaattccgatcatcctaaag

SEQ ID NO: 17643 - DNA, 75 bp, Artificial Sequence
  Synthetic
gctttgtacatgctgtcaacccgtggaaggcagacggtcaaggacaacaaggggactagaattagattcaaggat

SEQ ID NO: 17644 - DNA, 75 bp, Artificial Sequence
  Synthetic
gattcatcttttgaagaagtaaatgggattaggaagccaaagcatctctacatctccatgccgactgctcagtcc

SEQ ID NO: 17645 - DNA, 75 bp, Artificial Sequence
  Synthetic
acaatgaaagctgaggagataacacctgggaggtttagaacgattgtatgtggattgtttcctgctcaagtgaaa

SEQ ID NO: 17646 - DNA, 75 bp, Artificial Sequence
  Synthetic
gcccggaatatcataagcccagtgatgggggtcattggttttagtttctttgtgaaggattggatggaacggata

SEQ ID NO: 17647 - DNA, 75 bp, Artificial Sequence
  Synthetic
gagggattcttggcagcggaatgccctttcttacctaagcccaaaacagctgctgagacattcatggccaccaat

SEQ ID NO: 17648 - DNA, 75 bp, Artificial Sequence
  Synthetic
aaggcatacttttttaacaggcaacgccaggttgatgagtctcaagtcccagatattgttgaacttattgaccag

SEQ ID NO: 17649 - DNA, 75 bp, Artificial Sequence
  Synthetic
gctgagtctgagtctgccaccctgtttacagaaatagctagcccccattcagtgtgggtgtttgcatgtgcacct

SEQ ID NO: 17650 - DNA, 75 bp, Artificial Sequence
  Synthetic
gataggtgtccaccgacagcattatatgtggcaggagtgccagagctaggtgccttttttgccatactacaagat

SEQ ID NO: 17651 - DNA, 75 bp, Artificial Sequence
  Synthetic
atgagaaataccattatggcatcaaagtctgtgggaacagctgaggagaagttaaagaagaaatcagcattctat

SEQ ID NO: 17652 - DNA, 75 bp, Artificial Sequence
  Synthetic
caatcttatttgagacgaacacagtcaatggggattcaactggaccagaagatcatcatcctgtatatgttgtct

SEQ ID NO: 17653 - DNA, 75 bp, Artificial Sequence
  Synthetic
tggggtaaggaggctgtgaaccatttccatcttggtgatgatatggatcctgaattgagacaactagcacaggct

SEQ ID NO: 17654 - DNA, 75 bp, Artificial Sequence
  Synthetic
ttaattgatactaaagtgaaggagatctcaaaccaggagcctttgaagctgtaagtgtcaagggtgtagggtggt

SEQ ID NO: 17655 - DNA, 75 bp, Artificial Sequence
  Synthetic
gtttagtcttaatgatgggttttcaggggcttgtgccatatgtttaatcatctcaggggctgtctactgtgatta

SEQ ID NO: 17656 - DNA, 75 bp, Artificial Sequence
  Synthetic
acagggtgatattataagggtgggaagtgggtttactactaattacgggttactgtcctttgcactactattaaa

SEQ ID NO: 17657 - DNA, 75 bp, Artificial Sequence
  Synthetic
tacatttgcactattggggaaatggggatatacatgtagtcagtatgtattcaatatgtattcagtgtgtatcgt

SEQ ID NO: 17658 - DNA, 75 bp, Artificial Sequence
  Synthetic
tagttgtttagttgtttaggtaagtagctaactagttgtatgaaatcaataatcgatcaacttagttagtcatta

SEQ ID NO: 17659 - DNA, 75 bp, Artificial Sequence
  Synthetic
taaccaattatatcattatgcctttaagtcaagttaaatcattagatacactaatacttatatcttatccataga

SEQ ID NO: 17660 - DNA, 75 bp, Artificial Sequence
  Synthetic
tgtaaatttcattccgtgctttgctgctttatgctatactaatcataaacaaacctacctcatccacagaccctt

SEQ ID NO: 17661 - DNA, 75 bp, Artificial Sequence
  Synthetic
acccttccctttctacctcaaaaaaatactacctcgaatatgatttttcttgattgcttctcaaggagcatacta

SEQ ID NO: 17662 - DNA, 75 bp, Artificial Sequence
  Synthetic
tagtagtagactccttgagaagctactgctgcgaaagctggaatgagcaccctccaagaattacaagaaaacatc

SEQ ID NO: 17663 - DNA, 75 bp, Artificial Sequence
  Synthetic
acagcacacgaacaacagctcgtgactgctcggcaaaagctcaaagatgccgagaaggcggtggaggtggacccg

SEQ ID NO: 17664 - DNA, 75 bp, Artificial Sequence
  Synthetic
gatgacgttaacaagagcacactacaaagtagacgggcagctgtgtctacattggagaccaaactcggggaactc

SEQ ID NO: 17665 - DNA, 75 bp, Artificial Sequence
  Synthetic
aaagtagacgggcagctgtgtctacattggagaccaaactcggggaactcaagaggcaacttgcagatctggtgg

SEQ ID NO: 17666 - DNA, 75 bp, Artificial Sequence
  Synthetic
cagctcaaaaattggctacaaaaccagttgatccaacagggcttgagcctgatgaccatctgaaagagaaatcat

SEQ ID NO: 17667 - DNA, 75 bp, Artificial Sequence
  Synthetic
ctctgagatatgggaatgtcctggatgttaactcaattgatttggaagaaccgagtggacagactgctgattgga

SEQ ID NO: 17668 - DNA, 75 bp, Artificial Sequence
  Synthetic
aggctataggagcatatatcttagggtttgcaattccgatcatactaaaggccctatatatgctgtcaacccgtg

SEQ ID NO: 17669 - DNA, 75 bp, Artificial Sequence
  Synthetic
gaagacagactgtgaaagacaacaaaggaaccaggataaggtttaaggatgattcttcctttgaagaagtcaatg

SEQ ID NO: 17670 - DNA, 75 bp, Artificial Sequence
  Synthetic
ggatacgtaaaccaaaacacctttatgtctcaatgccaactgcacaatctactatgaaggctgaagaaatcacgc

SEQ ID NO: 17671 - DNA, 75 bp, Artificial Sequence
  Synthetic
cagggcggtttaggacaattgcttgtggccttttcccagcacaggtcaaagctcgaaatataataagtcctgtaa

SEQ ID NO: 17672 - DNA, 75 bp, Artificial Sequence
  Synthetic
tgggagtaattggatttggcttctttgtaaaggactggatggatcggatagaggaattcctggctgcagagtgtc

SEQ ID NO: 17673 - DNA, 75 bp, Artificial Sequence
  Synthetic
cattcttgcctaagccaaaggttgcttcagaagccttcatgtctaccaacaagatgtatttcctgaacagacaaa

SEQ ID NO: 17674 - DNA, 75 bp, Artificial Sequence
  Synthetic
gacaagtcaatgaatctaaggttcaagacattattgacttaatagatcatgctgaaactgagtctgctaccttgt

SEQ ID NO: 17675 - DNA, 75 bp, Artificial Sequence
  Synthetic
ttacagaaattgcaacaccccattcagtctgggtgtttgcatgtgcacctgaccggtgccctccgactgcattgt

SEQ ID NO: 17676 - DNA, 75 bp, Artificial Sequence
  Synthetic
atgttgcaggggtaccagaacttggtgcgttcttttccattcttcaggacatgcgtaataccatcatggcatcca

SEQ ID NO: 17677 - DNA, 75 bp, Artificial Sequence
  Synthetic
aatctgtgggaactgcagaagagaagctgaagaagaaatctgccttctatcaatcttacctaagaaggacacaat

SEQ ID NO: 17678 - DNA, 75 bp, Artificial Sequence
  Synthetic
caatcttacctaagaaggacacaatctatggggattcaactggaccaaaaaatcataattctctacatgctttca

SEQ ID NO: 17679 - DNA, 75 bp, Artificial Sequence
  Synthetic
tgaactaaggcagctagctcaatccctaattgacaccaaggtgaaggagatctccaaccaagagccactcaagtt

SEQ ID NO: 17680 - DNA, 75 bp, Artificial Sequence
  Synthetic
ctaattgacaccaaggtgaaggagatctccaaccaagagccactcaagttgtaagtgcttaatgaaaggatgatt

SEQ ID NO: 17681 - DNA, 75 bp, Artificial Sequence
  Synthetic
attataagggtggttaaggggtcagttactaactacgggtaagggttcattactatttttttgcactagggttag

SEQ ID NO: 17682 - DNA, 75 bp, Artificial Sequence
  Synthetic
agggccactacatcgtatttgcactacgggaaaggggaggtgggttagtctatattatagttgttaagtttttgt

SEQ ID NO: 17683 - DNA, 75 bp, Artificial Sequence
  Synthetic
actcataggttaataaggaatcagctatatgaaatcaatgattgattggctattttttttaggttaagtgattgc

SEQ ID NO: 17684 - DNA, 75 bp, Artificial Sequence
  Synthetic
tatatgaaatcaatgattgattggctattttttttaggttaagtgattgcatttaaatagttgttttaagtttag

SEQ ID NO: 17685 - DNA, 75 bp, Artificial Sequence
  Synthetic
ctactaacaattatattatgtcattggatgtaaatttcgttcttggcttgcttctgctttcgcattgctaaccta

SEQ ID NO: 17686 - DNA, 75 bp, Artificial Sequence
  Synthetic
cttctgctttcgcattgctaacctacaacataactacctcatccacaaaccctcccctattctacctcaacacat

SEQ ID NO: 17687 - DNA, 75 bp, Artificial Sequence
  Synthetic
ctcccctattctacctcaacacatactacctcatatttgatttttcttgattgcttttcaaggagtctactacta

SEQ ID NO: 17688 - DNA, 75 bp, Artificial Sequence
  Synthetic
cagctcaaaaactggctacaaaaccagttgatccaacagggcttgagcctgatgatcatctgaaagaaaaatcat

SEQ ID NO: 17689 - DNA, 75 bp, Artificial Sequence
  Synthetic
atttgccataccaatcatcctgaaagctctctacatgctttccacccgtgggagacaaactgtcaaagacaacaa

SEQ ID NO: 17690 - DNA, 75 bp, Artificial Sequence
  Synthetic
tggactcttccctgcacaagtgaaagccaggaacatcatcagtccagtcatgggagtaatcgggtttagcttctt

SEQ ID NO: 17691 - DNA, 75 bp, Artificial Sequence
  Synthetic
tgggagtaatcgggtttagcttctttgtgaaggattggatggaaaggattgaggatttcctggcagctgaatgcc

SEQ ID NO: 17692 - DNA, 75 bp, Artificial Sequence
  Synthetic
agatatagttgacctcattgaccatgcagagattgaatcagcaacacttttcacagacattgcaactccccattc

SEQ ID NO: 17693 - DNA, 75 bp, Artificial Sequence
  Synthetic
ctatgggaatccaactggaccaaaagatcataatcctttacatgctatcctggggcaaggaagcagtgaaccatt

SEQ ID NO: 17694 - DNA, 75 bp, Artificial Sequence
  Synthetic
gatcataatcctttacatgctatcctggggcaaggaagcagtgaaccatttccatcttggtgatgacatggatcc

SEQ ID NO: 17695 - DNA, 75 bp, Artificial Sequence
  Synthetic
gtaagagccataattataagagccattatgctatgagagcgaaaatagtttacatcttgatggttatatcagtca

SEQ ID NO: 17696 - DNA, 75 bp, Artificial Sequence
  Synthetic
ttatgctatgagagcgaaaatagtttacatcttgatggttatatcagtcagacggctttccgggcttgtgccaca

SEQ ID NO: 17697 - DNA, 75 bp, Artificial Sequence
  Synthetic
cttgtagttgcactacaggggattgggatatggtttacattataatctataggtcaatatataggataggtataa

SEQ ID NO: 17698 - DNA, 75 bp, Artificial Sequence
  Synthetic
gtatgtatagtagtaagtatataagtagatggccaaatgaaatcattgattgaatggctagagtcaatgtatgat

SEQ ID NO: 17699 - DNA, 75 bp, Artificial Sequence
  Synthetic
tataggttaagtgttactatttatgtatttttaggtttaagatctactaacaattattgtatgccactagatgta

SEQ ID NO: 17700 - DNA, 75 bp, Artificial Sequence
  Synthetic
aatttcgttcattgctttgctgctttacgctatactaaccacaacaaactacctcatccaaaaaccctccccttt

SEQ ID NO: 17701 - DNA, 75 bp, Artificial Sequence
  Synthetic
cccttttctacctcatctcaataaactacctcaattttgatttttcttgattgcttttcaaggagcatactacta

SEQ ID NO: 17702 - DNA, 75 bp, Artificial Sequence
  Synthetic
tagtagtagactccgggatagaaaaagttagaaaaatggaaaagtatagagagattcatcagagagttagggacc

SEQ ID NO: 17703 - DNA, 75 bp, Artificial Sequence
  Synthetic
ttgcacctggaacggtatcagcattagaatgcatagatctactggataggctctacgctgtcagacatgacctgg

SEQ ID NO: 17704 - DNA, 75 bp, Artificial Sequence
  Synthetic
ttgaccagatgataaaacatgactggtctgataataaagatgtagaaagacctataggtcaagttttactgatgg

SEQ ID NO: 17705 - DNA, 75 bp, Artificial Sequence
  Synthetic
ctggcatacctaatgatattatacaaggcatggagaagaagattataccaaatagcccttctggacaagtattga

SEQ ID NO: 17706 - DNA, 75 bp, Artificial Sequence
  Synthetic
aaagctttttccgaatgacaccagataattataaaattacaggtaacttgattgagtttattgaagtgactgtaa

SEQ ID NO: 17707 - DNA, 75 bp, Artificial Sequence
  Synthetic
cagctgatgtgtcacgaggtattagggagaagaaaataaagtatgaaggaggcctccaatttgttgagcacttac

SEQ ID NO: 17708 - DNA, 75 bp, Artificial Sequence
  Synthetic
tggaaactgaatcaaggaagggtaatataccgcaaccttataaaataacattctcagtggttgcagttaaaacag

SEQ ID NO: 17709 - DNA, 75 bp, Artificial Sequence
  Synthetic
atggatcaaacatctcgactcagtggcccagtcggaggaacgatggggtagttcagcacatgcgtctagtccaag

SEQ ID NO: 17710 - DNA, 75 bp, Artificial Sequence
  Synthetic
ctgatataaattatgtcagagagcatttaataaagttagatgagagagcatctttggaggcaatgtttaacttaa

SEQ ID NO: 17711 - DNA, 75 bp, Artificial Sequence
  Synthetic
agttccatgtatcaggccctaaactgagatactttaacatccctgattatagaccacagcagctatgtgaaccac

SEQ ID NO: 17712 - DNA, 75 bp, Artificial Sequence
  Synthetic
ggattgacaacttaatacaatattgcaagaattggttgacaaaagaacataagtttgtattcaaagaagtcagtg

SEQ ID NO: 17713 - DNA, 75 bp, Artificial Sequence
  Synthetic
gagctaatgtgattcaagcatttgagagtcatgaacagttacatttacagaaatacaacgaatcacgaaaaccaa

SEQ ID NO: 17714 - DNA, 75 bp, Artificial Sequence
  Synthetic
gaaattttttactcttgcagcttacagtgcaaggggcatatctaccatcaacaatcagttctgaccagtgcaata

SEQ ID NO: 17715 - DNA, 75 bp, Artificial Sequence
  Synthetic
ctaggattgggtgtctagaaatatcaaaaaaccaaccagaaacaccagtacagatgcttgcattggatatatctt

SEQ ID NO: 17716 - DNA, 75 bp, Artificial Sequence
  Synthetic
ataagtatctgagtcttacaagggatgagttgatcaattattatagccctagagtgcactttcaatcgagcccta

SEQ ID NO: 17717 - DNA, 75 bp, Artificial Sequence
  Synthetic
atgtgaaggaaccagggacactgaagttaggattatcacaattaaatccactctctaaatcaattcttgacaatg

SEQ ID NO: 17718 - DNA, 75 bp, Artificial Sequence
  Synthetic
ttggaaagcataaaaaggataaaggattatttggtgagatcatagatagcataaatgtggcaagtcaaatacaga

SEQ ID NO: 17719 - DNA, 75 bp, Artificial Sequence
  Synthetic
tgccttctcctaataagacaacaggtgtagatgacctgttaaataaattttatgataatgagcttggtaaatata

SEQ ID NO: 17720 - DNA, 75 bp, Artificial Sequence
  Synthetic
tgttatccattctgaggaaaacagcagcatggcatataggccatctagtcagagatatcacagaaagtttaattg

SEQ ID NO: 17721 - DNA, 75 bp, Artificial Sequence
  Synthetic
cacatgctgggctgcgccgttctaaatattggtcagtacatgcatatgaccatgggaatgtaattttgtttatct

SEQ ID NO: 17722 - DNA, 75 bp, Artificial Sequence
  Synthetic
tgccatcaaagtcactagaggtagtaggttcttatataaggtatttcacagtatttaaagatggtatagggttga

SEQ ID NO: 17723 - DNA, 75 bp, Artificial Sequence
  Synthetic
tagacgcagataatattgattctaaggccgaaattgatggtgtcacctggtgttattctaaggtcatgagtattg

SEQ ID NO: 17724 - DNA, 75 bp, Artificial Sequence
  Synthetic
atttaaacaggttattggctttgaacatagcttttgagaagtcacttcttgccacggctacatggttccaatatt

SEQ ID NO: 17725 - DNA, 75 bp, Artificial Sequence
  Synthetic
atactgaagaccaaggccattttccccttcaacatgcattaaggtcaatcttttctttccactttttactctgtg

SEQ ID NO: 17726 - DNA, 75 bp, Artificial Sequence
  Synthetic
tgtcacaaaagatgaagctatgtgcaatatttgataaccttcgttatctgataccatcagtaacatctttgtact

SEQ ID NO: 17727 - DNA, 75 bp, Artificial Sequence
  Synthetic
ctgggtacgagttgttaatagaaaaattctttgagagaccatttaagagttcactggatgtatacctttattcta

SEQ ID NO: 17728 - DNA, 75 bp, Artificial Sequence
  Synthetic
tcataaaatctctattaattagtttggcacaaaataataaagttcgattttactcaagagttcgtttgttaggat

SEQ ID NO: 17729 - DNA, 75 bp, Artificial Sequence
  Synthetic
tgacagttgatcactccacggtcggagcaagtggtgtttacccctctttaatgtcccgtgttgtttacaaacatt

SEQ ID NO: 17730 - DNA, 75 bp, Artificial Sequence
  Synthetic
acagaagtttaatctctgaagctacaacttgttttttcttatttgaaaagggtttgcatgggaatttaccagaag

SEQ ID NO: 17731 - DNA, 75 bp, Artificial Sequence
  Synthetic
aggctaaaatacatcttgaaaccattgaatgggctcggaagttccaggagaaagaaaaacaatatggtgatattc

SEQ ID NO: 17732 - DNA, 75 bp, Artificial Sequence
  Synthetic
ttctaaaggaaggctatacaattgaatctgtaatcaatggagaagttgatgtagaacaacagcttttttgtcagg

SEQ ID NO: 17733 - DNA, 75 bp, Artificial Sequence
  Synthetic
aggtctcagagctaagtgcacaagagctcaacaaatatttacaggcaaaatctcaagttttatgtgctaatatca

SEQ ID NO: 17734 - DNA, 75 bp, Artificial Sequence
  Synthetic
tgaataaacactgggacaaaccatatttcagtcaaacacgcaatatcagtctcaagggaatgtctggggcattgc

SEQ ID NO: 17735 - DNA, 75 bp, Artificial Sequence
  Synthetic
aagaggatggacatttagctgctagtgtgacactgattgaagcaattaggtttttaaatagatcacaaaccaatc

SEQ ID NO: 17736 - DNA, 75 bp, Artificial Sequence
  Synthetic
caaatgttattgatatgtatgagcagactaaacaatcaaaggcacaagctaggattgttaggaaataccagagaa

SEQ ID NO: 17737 - DNA, 75 bp, Artificial Sequence
  Synthetic
cagaagcagatagaggattttttatcacaacattaccaactagggtgcgattagaaataatagaagattatttcg

SEQ ID NO: 17738 - DNA, 75 bp, Artificial Sequence
  Synthetic
atgcaattgcaaaggttgtgcctgaagaatatatttcttatggtggggataaaaaagttctaaatattcagaatg

SEQ ID NO: 17739 - DNA, 75 bp, Artificial Sequence
  Synthetic
cactagagaaagcacttagatgggcatctggagtatcagaaattacaacaagcactggtaaaagcatcaagttta

SEQ ID NO: 17740 - DNA, 75 bp, Artificial Sequence
  Synthetic
agcggaaattaatgtatgttagtgctgatgccacaaaatggtcaccaggagataattctgctaagtttaggagat

SEQ ID NO: 17741 - DNA, 75 bp, Artificial Sequence
  Synthetic
ttacacaagcaatatatgatggcttatcagacaacaaactgaaatgttgtgttgttgatgcattacgtaacattt

SEQ ID NO: 17742 - DNA, 75 bp, Artificial Sequence
  Synthetic
atgagactgaattttttatgtccaggaaattacaccgatatattgatagtatggaaaatcattcagatgcggttg

SEQ ID NO: 17743 - DNA, 75 bp, Artificial Sequence
  Synthetic
aagatttcttggcatttttctcaaatggagtctcagccaatgtaaagggaaactggcttcaagggaacttaaata

SEQ ID NO: 17744 - DNA, 75 bp, Artificial Sequence
  Synthetic
aatgctcatcattatttggtgctgctgtctcattactttttcgggaggtctggaaacaattgtttccagaattag

SEQ ID NO: 17745 - DNA, 75 bp, Artificial Sequence
  Synthetic
agtgtttttttgaatttgcacatcattcagatgatgcattgttcatttatggctatctggagcctgaagatgatg

SEQ ID NO: 17746 - DNA, 75 bp, Artificial Sequence
  Synthetic
gaacagattggtttttgtatgtatcacagcagatacaggcaggaaactttcattggcatgctataaatcaagaga

SEQ ID NO: 17747 - DNA, 75 bp, Artificial Sequence
  Synthetic
tgtggaagagcatgtttaatctacatgagcacttactattaatgggttctattaaagtgtcacctaagaagacaa

SEQ ID NO: 17748 - DNA, 75 bp, Artificial Sequence
  Synthetic
cagtatcacctactaatgcagaatttctttctactttttttgaaggttgtgctgtgtcaatcccttttgttaaaa

SEQ ID NO: 17749 - DNA, 75 bp, Artificial Sequence
  Synthetic
tcttactgggttcattatcagatcttcctgggttaggtttctttgatgatttagcagcagcacaaagcagatgtg

SEQ ID NO: 17750 - DNA, 75 bp, Artificial Sequence
  Synthetic
taaagtcactagatttgggtgcttgcccacaattagctcaactagctatagtattatgcacaagcaaagttgaga

SEQ ID NO: 17751 - DNA, 75 bp, Artificial Sequence
  Synthetic
ggttgtatggtactgctgatggaatggtaaactctccaacagcattccttaaggtgaataaagcacacgtaccag

SEQ ID NO: 17752 - DNA, 75 bp, Artificial Sequence
  Synthetic
taccacttggtggtgatggctcaatgtctattatggagcttgcaacagctggttttgggatggcagataagaata

SEQ ID NO: 17753 - DNA, 75 bp, Artificial Sequence
  Synthetic
ttttaaaaaatgcattcatatcttataagcatactcgtagagatggtgataggtacgtattgggtttatttaaat

SEQ ID NO: 17754 - DNA, 75 bp, Artificial Sequence
  Synthetic
ttttgatgtcattaagtgaggatgtattccagcacgaccgattgggtgagtttagttttgtaggtaaagttcaat

SEQ ID NO: 17755 - DNA, 75 bp, Artificial Sequence
  Synthetic
ggaaagtgttcactcctaaagctgaatttgaatttcatgatcaattttcacataattatttattagagtggacac

SEQ ID NO: 17756 - DNA, 75 bp, Artificial Sequence
  Synthetic
gtcaacatcctgtgtatgactatattattcctagaaatagagataatttgcttgtataccttgtaagaaagttga

SEQ ID NO: 17757 - DNA, 75 bp, Artificial Sequence
  Synthetic
atgatcctagcatcattacagctatgactatgcagtcaccattacaacttcgtttccgtatgcaagcaaagcaac

SEQ ID NO: 17758 - DNA, 75 bp, Artificial Sequence
  Synthetic
atatgaaagtatgccggtatgaaggtgaatgggtcacattcagggaggtacttgctgcagctgatagttttgcta

SEQ ID NO: 17759 - DNA, 75 bp, Artificial Sequence
  Synthetic
cgagttaccaacctactgaaagggacatggatctctttaatacacttgtaagttgtacattttctaaagagtatg

SEQ ID NO: 17760 - DNA, 75 bp, Artificial Sequence
  Synthetic
cttggaaagactttttaaatgaagtaaggtgtgaggtcttaacaacaagacatgtacataggcctaaaattgcta

SEQ ID NO: 17761 - DNA, 75 bp, Artificial Sequence
  Synthetic
ggacattcactgttagagaaaaggaccaggctatacaaaatccaataaattcggtgattggctataagtatgctc

SEQ ID NO: 17762 - DNA, 75 bp, Artificial Sequence
  Synthetic
ttacagtggatgaagtcagtgatgttcttgatagtgcattcttcccagagtctctatctgcagacttacaggtta

SEQ ID NO: 17763 - DNA, 75 bp, Artificial Sequence
  Synthetic
tgaaagatggagtttacagagaattaggacttgatataagttctcctgaagtcctaaaacgcatagcaccactat

SEQ ID NO: 17764 - DNA, 75 bp, Artificial Sequence
  Synthetic
tatataaggcaggaaggtcacgtgttgttattgtggaaggaaatgtagaagggacagctgagtcaatctgtagtt

SEQ ID NO: 17765 - DNA, 75 bp, Artificial Sequence
  Synthetic
attggctcaagacaatgtcactgattaaaacaatcagagtaagacctaagaaggaggtactgaaagctatgtctt

SEQ ID NO: 17766 - DNA, 75 bp, Artificial Sequence
  Synthetic
tatatagtgttaaagaaaatattggattgcaggatgatattgcagcaactcgactatgcatagaaatctggagat

SEQ ID NO: 17767 - DNA, 75 bp, Artificial Sequence
  Synthetic
ggtgtaaggcaaatgaacaggatgttaaagaatggctaacatctctgtactttgaaaaacagacattgatggatt

SEQ ID NO: 17768 - DNA, 75 bp, Artificial Sequence
  Synthetic
gggtagaaaggtttagaaggaaaggagttgttcctattgatcctgaaatacaatgtattggcctactcttatatg

SEQ ID NO: 17769 - DNA, 75 bp, Artificial Sequence
  Synthetic
atgtattaggttataaaagtgtgttacaaatgcaagcaaaccgaagagcctattcaggtaagcaatatgatgcat

SEQ ID NO: 17770 - DNA, 75 bp, Artificial Sequence
  Synthetic
actgtgtgcaaacatataacgaggaaacaaaactatatgaaggtgaccttcgtgttacttttaattttggtttag

SEQ ID NO: 17771 - DNA, 75 bp, Artificial Sequence
  Synthetic
attgtgcaaggttagaagttttttgggataaaaaagagtatatcttagagacatctatcacccaacgacatgtgt

SEQ ID NO: 17772 - DNA, 75 bp, Artificial Sequence
  Synthetic
tgcggttactgatggaagaagtgtcacaagaattaattagatgtggaatgagattcaaaacagagcaagtcaatc

SEQ ID NO: 17773 - DNA, 75 bp, Artificial Sequence
  Synthetic
aaactcggagcttagtgttattcaaaacagaggctggttttgaatggggtaagcctaatgtgccatgtattgtat

SEQ ID NO: 17774 - DNA, 75 bp, Artificial Sequence
  Synthetic
ataaacactgtgtcttgagaactgggcttcgtacgaaacagccaattaataaagagttcatgataaatgtacaaa

SEQ ID NO: 17775 - DNA, 75 bp, Artificial Sequence
  Synthetic
gtgatggtttccgtgcaatagcacagatggatattgagagtccacggttcttgttagcacatgcatatcatacac

SEQ ID NO: 17776 - DNA, 75 bp, Artificial Sequence
  Synthetic
tgcgtgatattagatatcaagcagtgcaggcagtagggaatgtatggtttaaaacagaacagcacaaactattta

SEQ ID NO: 17777 - DNA, 75 bp, Artificial Sequence
  Synthetic
ttaacccaattatatcatcagggcttttagaaaactttatgaaaggcttacctgctgccatacctcctgctgcat

SEQ ID NO: 17778 - DNA, 75 bp, Artificial Sequence
  Synthetic
attccctcataatgaacaaggctaagatttctgtggatttgtttatgttcaatgagctattagcacttataaata

SEQ ID NO: 17779 - DNA, 75 bp, Artificial Sequence
  Synthetic
ggaataatatcctcaaccttgatgggattgaagaaacatctgaaggttatagtactgtgacatcaatgtctagca

SEQ ID NO: 17780 - DNA, 75 bp, Artificial Sequence
  Synthetic
agcagtggtctgaagagatgagtttaatgtctgatgatgatattgatgatatggaggactttactatagcactgg

SEQ ID NO: 17781 - DNA, 75 bp, Artificial Sequence
  Synthetic
atgatattgactttgaacaaataaatttggaagaggatatacaacactttctgcaggatgaatcagcatatgttg

SEQ ID NO: 17782 - DNA, 75 bp, Artificial Sequence
  Synthetic
gtgatttattgattcagacagaagacattgaggttaaaaagatacgtggggtgacaagagtattagagccagtca

SEQ ID NO: 17783 - DNA, 75 bp, Artificial Sequence
  Synthetic
agctattaaaaagctgggtttctaaaggccttgctatagacaaagtatacaatcctatcgggataatcttaatgg

SEQ ID NO: 17784 - DNA, 75 bp, Artificial Sequence
  Synthetic
caagatacatgtcaaaaacatacaatttcagttcaacacctcttgcactattaaatccatatgacttgacagaac

SEQ ID NO: 17785 - DNA, 75 bp, Artificial Sequence
  Synthetic
ttgaaagtgttgtaaagggatggggagaaactgtaaatgatcgattcaaagatttagatattgaggcacaaacag

SEQ ID NO: 17786 - DNA, 75 bp, Artificial Sequence
  Synthetic
ttgttaaagaaaagggtgtacagccagaagatgtactccctgattcattattctctttcaggcatgttgatgttt

SEQ ID NO: 17787 - DNA, 75 bp, Artificial Sequence
  Synthetic
tgctgcgaaggttgttcccgcgtgaccctgtatcaacattctattagtggattttataccttattcatacagtat

SEQ ID NO: 17788 - DNA, 75 bp, Artificial Sequence
  Synthetic
attctattagtggattttataccttattcatacagtatgtatattgtagtgttcttttcccggagcatactacta

SEQ ID NO: 17789 - DNA, 75 bp, Artificial Sequence
  Synthetic
tagtagtagactccgcaagaagaagcaaaaaattaaagaagtgagtttaaaatggaagggtggtatctggttgtt

SEQ ID NO: 17790 - DNA, 75 bp, Artificial Sequence
  Synthetic
cttggagtctgctatacgctgacactggcaatgcccaagaccatttatgagcttaaaatggaatgcccgcacact

SEQ ID NO: 17791 - DNA, 75 bp, Artificial Sequence
  Synthetic
gtgggtctcggtcaaggttacatcattggctcaacagaactaggtttgatctcaattgaggctgcatctgatata

SEQ ID NO: 17792 - DNA, 75 bp, Artificial Sequence
  Synthetic
ttggctcaacagaactaggtttgatctcaattgaggctgcatctgatataaagctcgagagctcttgcaattttg

SEQ ID NO: 17793 - DNA, 75 bp, Artificial Sequence
  Synthetic
ccacaaatgctgcgtccactacctttgaagcacaaactaaaactgttaaccttagagggacttgtatactggcac

SEQ ID NO: 17794 - DNA, 75 bp, Artificial Sequence
  Synthetic
ctgaactctatgatacattgaagaaagtaaaaaagacagtcctgtgctatgatctaacatgtaatcaaacacatt

SEQ ID NO: 17795 - DNA, 75 bp, Artificial Sequence
  Synthetic
gtcagccaactgtctatctgattgcacctgtattgacatgcatgtcaataagaagttgtatggctagtgtgttta

SEQ ID NO: 17796 - DNA, 75 bp, Artificial Sequence
  Synthetic
caagcaggattcaggtgatttatgaaaagacacattgtgtaacaggtcagctgattgagggtcagtgtttcaacc

SEQ ID NO: 17797 - DNA, 75 bp, Artificial Sequence
  Synthetic
cagcacacacattgacattatctcagcctgctcacacttatgatactgtcacccttcctatctcttgttttttca

SEQ ID NO: 17798 - DNA, 75 bp, Artificial Sequence
  Synthetic
caccaaagaagtcggagcaactaaaagttataaaaacatttgaaggaattctgacgaagacaggttgcacggaga

SEQ ID NO: 17799 - DNA, 75 bp, Artificial Sequence
  Synthetic
tacggtctgctgaagttgttagtaggatgcttgtacaccctaggggagaagaccatgatgccatacagaattcac

SEQ ID NO: 17800 - DNA, 75 bp, Artificial Sequence
  Synthetic
aaagtcacttaagaatagtgggacctatcacagcaaaagtgccatcaactagttccacagataccctaaagggga

SEQ ID NO: 17801 - DNA, 75 bp, Artificial Sequence
  Synthetic
cagcctttgcaggcgtcccaatgtatagctctttatctacactagtcagaaatgcagacccagaatttgtatttt

SEQ ID NO: 17802 - DNA, 75 bp, Artificial Sequence
  Synthetic
ctccaggtatagtacctgaatctaatcacagtacatgtgataagaagacagtacctatcacatggacaggctacc

SEQ ID NO: 17803 - DNA, 75 bp, Artificial Sequence
  Synthetic
taccaatatcaggtgagatggaaaaagtgactggatgtacagttttttgtacactagcaggacctggtgctagtt

SEQ ID NO: 17804 - DNA, 75 bp, Artificial Sequence
  Synthetic
gtgaggcctattctgaaaatggtatatttaacatcagttctccaacatgtcttgtaaacaaagtccaaagatttc

SEQ ID NO: 17805 - DNA, 75 bp, Artificial Sequence
  Synthetic
gtggatctgaacagaaaataaattttatctgtcagcgggtagatcaggatgttgttgtatactgcaatgggcaaa

SEQ ID NO: 17806 - DNA, 75 bp, Artificial Sequence
  Synthetic
agaaagtcatattaaccaaaactttggttattgggcagtgtatttatacattcacaagcctattttcattgatgc

SEQ ID NO: 17807 - DNA, 75 bp, Artificial Sequence
  Synthetic
ctgatgtagcccactcattggctgtagaattatgtgtcccgggattacatggatgggccactgtcatgcttctat

SEQ ID NO: 17808 - DNA, 75 bp, Artificial Sequence
  Synthetic
caacattctgctttgggtgggtcttgattcctgcggtcacattaataatattaaagtgtctaagggttttgacgt

SEQ ID NO: 17809 - DNA, 75 bp, Artificial Sequence
  Synthetic
tttcttgttcccattacactaatgagtcaaaatttaaattcatcctggaaaaagttaaaattgaataccaaaaga

SEQ ID NO: 17810 - DNA, 75 bp, Artificial Sequence
  Synthetic
ctatgggatcaatggtgtgcgatgtatgtcatcatgagtgtgaaacagcaaaagaacttgaatcacatagacaga

SEQ ID NO: 17811 - DNA, 75 bp, Artificial Sequence
  Synthetic
atgtcatcatgagtgtgaaacagcaaaagaacttgaatcacatagacagagttgtatcaatggacaatgtcctta

SEQ ID NO: 17812 - DNA, 75 bp, Artificial Sequence
  Synthetic
ttgcatgacaataactgaagcaactgaaagtgccttgcaagcccattattccatttgtaaattgacaggaagatt

SEQ ID NO: 17813 - DNA, 75 bp, Artificial Sequence
  Synthetic
tcaggaggcactgaaaaagtcacttaaaaagccagaggtaaaaaaaggttgttacagaacactcggggtatttag

SEQ ID NO: 17814 - DNA, 75 bp, Artificial Sequence
  Synthetic
aaaaagccagaggtaaaaaaaggttgttacagaacactcggggtatttagatataaaagtagatgttatgtgggt

SEQ ID NO: 17815 - DNA, 75 bp, Artificial Sequence
  Synthetic
ttggtatggtgcctattgttgacatgtgaaattgttatttgggccgcaagtgcagagactccactaatggagtca

SEQ ID NO: 17816 - DNA, 75 bp, Artificial Sequence
  Synthetic
ggctggtcagatacggctcatggtgttggtgagattccaatgaagacagacctcgagctggacttttcactgcct

SEQ ID NO: 17817 - DNA, 75 bp, Artificial Sequence
  Synthetic
tcttcatcctcttacagttataggagaaagctcacaaacccagccaataaagaagagtctattcccttccacttc

SEQ ID NO: 17818 - DNA, 75 bp, Artificial Sequence
  Synthetic
cagatggaaaaacaagtaattcatgctgaaatccaacccctgggtcattggatggatgcgacatttaatattaag

SEQ ID NO: 17819 - DNA, 75 bp, Artificial Sequence
  Synthetic
actgcatttcattgttatggtgcatgccagaaatactcttatccatggcagacatctaagtgcttctttgaaaag

SEQ ID NO: 17820 - DNA, 75 bp, Artificial Sequence
  Synthetic
gactaccagtatgaaacaggctggggctgtaatcctggtgactgcccaggggttgggactggatgcactgcttgt

SEQ ID NO: 17821 - DNA, 75 bp, Artificial Sequence
  Synthetic
ggtgtttatctcgataaactaaaatctgttgggaaggcctataagataatttctttaaaatataccagaaaggtt

SEQ ID NO: 17822 - DNA, 75 bp, Artificial Sequence
  Synthetic
tgtattcagttaggaacagaacaaacttgcaagcatattgatgcaaatgattgtttagtgacaccatctgtgaaa

SEQ ID NO: 17823 - DNA, 75 bp, Artificial Sequence
  Synthetic
ggaccaaccaccaaaaaggggtgtacacgaataccatctttccatttggccgagtctcattggtgctatacacat

SEQ ID NO: 17824 - DNA, 75 bp, Artificial Sequence
  Synthetic
accaaacaaggaatgcgcaagcatcctaaaatttaaatagcgtgatagtgatatcgagggagaatccttgtgatc

SEQ ID NO: 17825 - DNA, 75 bp, Artificial Sequence
  Synthetic
atatcgagggagaatccttgtgatcccgagtccggtatcgaggaagtaattctcccgacttatctcgcaagtatg

SEQ ID NO: 17826 - DNA, 75 bp, Artificial Sequence
  Synthetic
ccgagtccggtatcgaggaagtaattctcccgacttatctcgcaagtatgtcatctgtgttcacagattacgaca

SEQ ID NO: 17827 - DNA, 75 bp, Artificial Sequence
  Synthetic
cacgaataccatctttccatttggccgagtctcattggtgctatacacataatactatagcttcagggtgtgaag

SEQ ID NO: 17828 - DNA, 75 bp, Artificial Sequence
  Synthetic
tctaataaagagccttctcttctaacgacagtaagtatcttgttggcagacgagcttaataggaaaagctgcagt

SEQ ID NO: 17829 - DNA, 75 bp, Artificial Sequence
  Synthetic
cgacagtaagtatcttgttggcagacgagcttaataggaaaagctgcagtataattgcttcttcttatggatgtg

SEQ ID NO: 17830 - DNA, 75 bp, Artificial Sequence
  Synthetic
acaggagggctcttaagattaaacattccagtctgtgtaaccacatcagagaatccagaggagcgttgggcattg

SEQ ID NO: 17831 - DNA, 75 bp, Artificial Sequence
  Synthetic
ttccagtctgtgtaaccacatcagagaatccagaggagcgttgggcattggcaataatctgcctaaggtggatag

SEQ ID NO: 17832 - DNA, 75 bp, Artificial Sequence
  Synthetic
gttaatccgacacccatggtacatggtcggttgttttttaatggatcatattctgaacaggaacttgatcccagg

SEQ ID NO: 17833 - DNA, 75 bp, Artificial Sequence
  Synthetic
gtcggttgttttttaatggatcatattctgaacaggaacttgatcccaggatttttggagatttgtggactgcga

SEQ ID NO: 17834 - DNA, 75 bp, Artificial Sequence
  Synthetic
ctcagtttacatgcgagtaatatgaaggctcatgcgtcacttgctgcacgaagcagtgaagctgagctaactata

SEQ ID NO: 17835 - DNA, 75 bp, Artificial Sequence
  Synthetic
aggctcatgcgtcacttgctgcacgaagcagtgaagctgagctaactatacttgaaatggaaaatcttgatatgc

SEQ ID NO: 17836 - DNA, 75 bp, Artificial Sequence
  Synthetic
ccaatttatggaggtctagatgagacaaagctgaatctaacatcttatcttaaccatcccttgtacacaaaaaat

SEQ ID NO: 17837 - DNA, 75 bp, Artificial Sequence
  Synthetic
caaagctgaatctaacatcttatcttaaccatcccttgtacacaaaaaatgaatgggtgtcatgtaataaatcat

SEQ ID NO: 17838 - DNA, 75 bp, Artificial Sequence
  Synthetic
gcgcgacagctctttgcaatgattgacgatattaatacctcgtgtaggaatggatccccatttttaaatcccaac

SEQ ID NO: 17839 - DNA, 75 bp, Artificial Sequence
  Synthetic
acgatattaatacctcgtgtaggaatggatccccatttttaaatcccaacatcgaaagcgatagccctgcggaca

SEQ ID NO: 17840 - DNA, 75 bp, Artificial Sequence
  Synthetic
gctgggagagttgttactcaaggagtgatggtctgccattatgatagagaattgctagggaggtgtctcatagca

SEQ ID NO: 17841 - DNA, 75 bp, Artificial Sequence
  Synthetic
tgatggtctgccattatgatagagaattgctagggaggtgtctcatagcacgctttaatacatctacagtaatga

SEQ ID NO: 17842 - DNA, 75 bp, Artificial Sequence
  Synthetic
tcagcgatgaaaagtatgacagcacctgacacagcagccgaatctgaagcacggcggatagccaaatatgcacaa

SEQ ID NO: 17843 - DNA, 75 bp, Artificial Sequence
  Synthetic
ctgacacagcagccgaatctgaagcacggcggatagccaaatatgcacaacaaaatcgtgtaacccagcagacta

SEQ ID NO: 17844 - DNA, 75 bp, Artificial Sequence
  Synthetic
caacgatcaagttcatggtggccagttggaattgtttatttagttccggaatccatcatctcaattaatgagaca

SEQ ID NO: 17845 - DNA, 75 bp, Artificial Sequence
  Synthetic
ttggaattgtttatttagttccggaatccatcatctcaattaatgagacaaattcggtattcgacttatcgccta

SEQ ID NO: 17846 - DNA, 75 bp, Artificial Sequence
  Synthetic
ctcatccttagacatttcatgatctatgaaataaggagagcaacctcaatgggatccaatactactaaatattat

SEQ ID NO: 17847 - DNA, 75 bp, Artificial Sequence
  Synthetic
atgaaataaggagagcaacctcaatgggatccaatactactaaatattatgccatggttggagacgctgctgcat

SEQ ID NO: 17848 - DNA, 75 bp, Artificial Sequence
  Synthetic
cgacctgctgtttgtcctgcagtttgtgtgaccggtgtgtatcaagatctttggccgttatcaccattagctatt

SEQ ID NO: 17849 - DNA, 75 bp, Artificial Sequence
  Synthetic
gtgtgaccggtgtgtatcaagatctttggccgttatcaccattagctattgagaacaggacagccaccaacccta

SEQ ID NO: 17850 - DNA, 75 bp, Artificial Sequence
  Synthetic
attggaaccaaatatccagtcttggcaatggcagcactatcctcagatcttaagaaaattcagagtttaattcga

SEQ ID NO: 17851 - DNA, 75 bp, Artificial Sequence
  Synthetic
caatggcagcactatcctcagatcttaagaaaattcagagtttaattcgagtttatcagcagaaaggagaagagg

SEQ ID NO: 17852 - DNA, 75 bp, Artificial Sequence
  Synthetic
tttggagtagcagggccaaacaagtgggctcggtcagtacagttatttactgaccagactccagcatcatattca

SEQ ID NO: 17853 - DNA, 75 bp, Artificial Sequence
  Synthetic
gggctcggtcagtacagttatttactgaccagactccagcatcatattcaacaactacttgctttaaggacacca

SEQ ID NO: 17854 - DNA, 75 bp, Artificial Sequence
  Synthetic
gggaattaccccttaatatattcctacgctatgggggttggatcaattctagaagctagtgtaggtaaataccag

SEQ ID NO: 17855 - DNA, 75 bp, Artificial Sequence
  Synthetic
acgctatgggggttggatcaattctagaagctagtgtaggtaaataccagtttgctcgttcattcatgaacgata

SEQ ID NO: 17856 - DNA, 75 bp, Artificial Sequence
  Synthetic
ttgggtacctggaaaattgtaccccttttggttaaagtatctttagtttactcgtaagaaagcatgctcaattga

SEQ ID NO: 17857 - DNA, 75 bp, Artificial Sequence
  Synthetic
ttttggttaaagtatctttagtttactcgtaagaaagcatgctcaattgatttaagttaatattagttttaaaga

SEQ ID NO: 17858 - DNA, 75 bp, Artificial Sequence
  Synthetic
gatgagcaaatggcaaatgaacttcaattaacatcagaggcaagacaaagtgtcaaagagcttatggctagcctt

SEQ ID NO: 17859 - DNA, 75 bp, Artificial Sequence
  Synthetic
aattaacatcagaggcaagacaaagtgtcaaagagcttatggctagccttgatatgagcgaccatagtcccaacc

SEQ ID NO: 17860 - DNA, 75 bp, Artificial Sequence
  Synthetic
taaatggctgatctggaactatttaggttatttttgatttagactgggaatcaatcattgaatatagcatatata

SEQ ID NO: 17861 - DNA, 75 bp, Artificial Sequence
  Synthetic
ggttatttttgatttagactgggaatcaatcattgaatatagcatatataattaataaaattgttttaaaccgag

SEQ ID NO: 17862 - DNA, 75 bp, Artificial Sequence
  Synthetic
cctgccccgaccggtcaacaggaatcaagaacctctcagcctactcccccttcttcaggcaccatccagccacct

SEQ ID NO: 17863 - DNA, 75 bp, Artificial Sequence
  Synthetic
caagaacctctcagcctactcccccttcttcaggcaccatccagccacctgcaccagctgatccgccgagcacca

SEQ ID NO: 17864 - DNA, 75 bp, Artificial Sequence
  Synthetic
agatagtctttccctgtagatgactatttgagttaactggggaatatattaccaacatcatattgtaaaaaatat

SEQ ID NO: 17865 - DNA, 75 bp, Artificial Sequence
  Synthetic
atttgagttaactggggaatatattaccaacatcatattgtaaaaaatataaaaaaacctacataatataattgt

SEQ ID NO: 17866 - DNA, 75 bp, Artificial Sequence
  Synthetic
tctaacccacattaagccgcaggatccaaccagcacaccccgaaacagcaccatcaccctcggcctacaacccgc

SEQ ID NO: 17867 - DNA, 75 bp, Artificial Sequence
  Synthetic
ccaaccagcacaccccgaaacagcaccatcaccctcggcctacaacccgccaacaaattccagatagtagatttt

SEQ ID NO: 17868 - DNA, 75 bp, Artificial Sequence
  Synthetic
aactgcaattaaatcatgcagcaatctacacattaattcccttaattgtaatctgttaagttatcaaggagtcga

SEQ ID NO: 17869 - DNA, 75 bp, Artificial Sequence
  Synthetic
ctacacattaattcccttaattgtaatctgttaagttatcaaggagtcgattattttaataaaaaacttgttggt

SEQ ID NO: 17870 - DNA, 75 bp, Artificial Sequence
  Synthetic
tttataaaaaacgaaactgttttgatctgaaagaagagagaagtaagagagagaaaggaggaaatcaagggggaa

SEQ ID NO: 17871 - DNA, 75 bp, Artificial Sequence
  Synthetic
tctgaaagaagagagaagtaagagagagaaaggaggaaatcaagggggaaccatactgagaaggtctcatcttta

SEQ ID NO: 17872 - DNA, 75 bp, Artificial Sequence
  Synthetic
aatatgcgggcgaagccccgatagtgttccgaaatggaagttaaacaatcagatcaaattatattgcctgaagtt

SEQ ID NO: 17873 - DNA, 75 bp, Artificial Sequence
  Synthetic
gttccgaaatggaagttaaacaatcagatcaaattatattgcctgaagttcatctaaattcaccaatagtcaaaa

SEQ ID NO: 17874 - DNA, 75 bp, Artificial Sequence
  Synthetic
ctcgatctgctgactttaagcaatgatgtaatagagagcatccaacacgcagaatccgcaggatcccaaccacca

SEQ ID NO: 17875 - DNA, 75 bp, Artificial Sequence
  Synthetic
atgtaatagagagcatccaacacgcagaatccgcaggatcccaaccaccaacttatggccgatctacaataccaa

SEQ ID NO: 17876 - DNA, 75 bp, Artificial Sequence
  Synthetic
ctaacagatgagtatgatgactggtacacccgatgggatgatattatgagacgtgaatcaaaaactgccaggaga

SEQ ID NO: 17877 - DNA, 75 bp, Artificial Sequence
  Synthetic
acacccgatgggatgatattatgagacgtgaatcaaaaactgccaggagattttctttcttcaaagacaaaatta

SEQ ID NO: 17878 - DNA, 75 bp, Artificial Sequence
  Synthetic
acccagccacaaccttcgattagtcccagccaattagaccacatcagggtggaccaggatagcaacaagaatcat

SEQ ID NO: 17879 - DNA, 75 bp, Artificial Sequence
  Synthetic
ccagccaattagaccacatcagggtggaccaggatagcaacaagaatcatgacaacctcaaaaaccaattcgaca

SEQ ID NO: 17880 - DNA, 75 bp, Artificial Sequence
  Synthetic
gtccacccccggacattgcttgatctcactaccattgagaccacactagggattgggttcatggagaaatgtaag

SEQ ID NO: 17881 - DNA, 75 bp, Artificial Sequence
  Synthetic
tcactaccattgagaccacactagggattgggttcatggagaaatgtaagaagactctatatcgtacaattaagg

SEQ ID NO: 17882 - DNA, 75 bp, Artificial Sequence
  Synthetic
aatccctcagtcaaccgtacaaatgaagaggacaactcaaaattagtgcaacagagggatccaagcactacatgg

SEQ ID NO: 17883 - DNA, 75 bp, Artificial Sequence
  Synthetic
aagaggacaactcaaaattagtgcaacagagggatccaagcactacatgggaaggaggaagtatgctagatagag

SEQ ID NO: 17884 - DNA, 75 bp, Artificial Sequence
  Synthetic
acttcaactgattgtctcttttcagtcatcaatgatctcggtcagcaggatccattatacttatgtgcggatgac

SEQ ID NO: 17885 - DNA, 75 bp, Artificial Sequence
  Synthetic
tcatcaatgatctcggtcagcaggatccattatacttatgtgcggatgaccttattgagaacccagccgtgtttg

SEQ ID NO: 17886 - DNA, 75 bp, Artificial Sequence
  Synthetic
gctcatcaacccagtcacactgccacacatcagagtcccaataatctagatgacgacattaaaaaagggcccaga

SEQ ID NO: 17887 - DNA, 75 bp, Artificial Sequence
  Synthetic
cacatcagagtcccaataatctagatgacgacattaaaaaagggcccagacctcagataatagagaccacacata

SEQ ID NO: 17888 - DNA, 75 bp, Artificial Sequence
  Synthetic
gtgatgagacatctcattcgcggattcaggtcccagcctgcgaactgtagttaccaattgttctttgagtctacc

SEQ ID NO: 17889 - DNA, 75 bp, Artificial Sequence
  Synthetic
tcaggtcccagcctgcgaactgtagttaccaattgttctttgagtctacctggttgattggtgtgcttccggaga

SEQ ID NO: 17890 - DNA, 75 bp, Artificial Sequence
  Synthetic
tctccaatcaaaaaagacacagattcctcccaacaactttccccggccacagacgcgagtactccctttttttct

SEQ ID NO: 17891 - DNA, 75 bp, Artificial Sequence
  Synthetic
cctcccaacaactttccccggccacagacgcgagtactccctttttttctctgatggaaggtgcagcatcacaga

SEQ ID NO: 17892 - DNA, 75 bp, Artificial Sequence
  Synthetic
gagatggtattgatgtacactgacttagtagaagggcggaataatttactagctatagctcctcttaaccccctt

SEQ ID NO: 17893 - DNA, 75 bp, Artificial Sequence
  Synthetic
tagtagaagggcggaataatttactagctatagctcctcttaacccccttacattgccccttgtacctaagctcg

SEQ ID NO: 17894 - DNA, 75 bp, Artificial Sequence
  Synthetic
gatgcacctgcggggaatgccctagacgatgctcaatgtgttggaatgattcttaaatccatctccttattaaat

SEQ ID NO: 17895 - DNA, 75 bp, Artificial Sequence
  Synthetic
acgatgctcaatgtgttggaatgattcttaaatccatctccttattaaataataggctagatagtatagaggcaa

SEQ ID NO: 17896 - DNA, 75 bp, Artificial Sequence
  Synthetic
gtctataacacaatagcttcactagagtcccttgcatatggggcagtccaattacacgacagaagcgtcaatcat

SEQ ID NO: 17897 - DNA, 75 bp, Artificial Sequence
  Synthetic
agtcccttgcatatggggcagtccaattacacgacagaagcgtcaatcatgcaggtgaattcttttcttttgttt

SEQ ID NO: 17898 - DNA, 75 bp, Artificial Sequence
  Synthetic
gatacccaacaaattaaggcatcctgtgcactgcttgaaggacaaatggccatgatccaagttctcgaacctgga

SEQ ID NO: 17899 - DNA, 75 bp, Artificial Sequence
  Synthetic
gtgcactgcttgaaggacaaatggccatgatccaagttctcgaacctggacacgcagatgtatcatccctaaatg

SEQ ID NO: 17900 - DNA, 75 bp, Artificial Sequence
  Synthetic
ttggatttcatacggatcataagaggaatctactcaggattgactacagatcaagctgctgagatgttgtgtatt

SEQ ID NO: 17901 - DNA, 75 bp, Artificial Sequence
  Synthetic
gaatctactcaggattgactacagatcaagctgctgagatgttgtgtattatgagaatttggggccatcctttat

SEQ ID NO: 17902 - DNA, 75 bp, Artificial Sequence
  Synthetic
tgcccgacacctcccatctcaaataacacaattatagtgaaagatgatttagctcgaccatcatttactgaatcc

SEQ ID NO: 17903 - DNA, 75 bp, Artificial Sequence
  Synthetic
acacaattatagtgaaagatgatttagctcgaccatcatttactgaatcccctaaagttccaagtcagacagcat

SEQ ID NO: 17904 - DNA, 75 bp, Artificial Sequence
  Synthetic
aaaatgatcaatctggacatagttttccaagttctagcattcttcaaggcccaaatcattaatggctatcgcaag

SEQ ID NO: 17905 - DNA, 75 bp, Artificial Sequence
  Synthetic
tccaagttctagcattcttcaaggcccaaatcattaatggctatcgcaagagtcattctggtctgtggccgaata

SEQ ID NO: 17906 - DNA, 75 bp, Artificial Sequence
  Synthetic
atgtcaagatttgacttgagtgagcaaaagactaagaagatattagagtcaatcagccaaattcggagtaaagat

SEQ ID NO: 17907 - DNA, 75 bp, Artificial Sequence
  Synthetic
aaaagactaagaagatattagagtcaatcagccaaattcggagtaaagatgatgttaagagaatcaagcggatga

SEQ ID NO: 17908 - DNA, 75 bp, Artificial Sequence
  Synthetic
gcagctgagatcccgtatagtacagctctacagcattatcgcgaactcagtctgttagagtttgagaaaagtatt

SEQ ID NO: 17909 - DNA, 75 bp, Artificial Sequence
  Synthetic
ctctacagcattatcgcgaactcagtctgttagagtttgagaaaagtattgatttcgatttaggtgcagacttaa

SEQ ID NO: 17910 - DNA, 75 bp, Artificial Sequence
  Synthetic
atatcctagaagctataggccaagctatatcatgctttagattatattaactttagtgcattagaaacagctttc

SEQ ID NO: 17911 - DNA, 75 bp, Artificial Sequence
  Synthetic
tatatcatgctttagattatattaactttagtgcattagaaacagctttcagtgcatttaggttcgatgctttat

SEQ ID NO: 17912 - DNA, 75 bp, Artificial Sequence
  Synthetic
aattcatttagacacagcctcctccctgtctgtaagaatgaatcaagatatgcaattgattcaacaaacagactt

SEQ ID NO: 17913 - DNA, 75 bp, Artificial Sequence
  Synthetic
ctgtctgtaagaatgaatcaagatatgcaattgattcaacaaacagacttcttcttgatttcttacaatccagtg

SEQ ID NO: 17914 - DNA, 75 bp, Artificial Sequence
  Synthetic
gtattataaactgacaattgtggggcagtgatgaatgtagttctcagtgcggattgaatttatgatagtgggggt

SEQ ID NO: 17915 - DNA, 75 bp, Artificial Sequence
  Synthetic
cagtgatgaatgtagttctcagtgcggattgaatttatgatagtgggggtgtttgaacgggggagactcaatttc

SEQ ID NO: 17916 - DNA, 75 bp, Artificial Sequence
  Synthetic
gatgatgttgagttctgtgcctcgtattccctgaaagagaaagaaataaaaactgatggacgcatttttgcaaaa

SEQ ID NO: 17917 - DNA, 75 bp, Artificial Sequence
  Synthetic
attccctgaaagagaaagaaataaaaactgatggacgcatttttgcaaaacttacgaggaaaatgagaagctgcc

SEQ ID NO: 17918 - DNA, 75 bp, Artificial Sequence
  Synthetic
aaacttaatttagtataagctacttatttcgcattacaggtagtatagctcaaactcttattgagatgagatttc

SEQ ID NO: 17919 - DNA, 75 bp, Artificial Sequence
  Synthetic
atttcgcattacaggtagtatagctcaaactcttattgagatgagatttcaattattcatattaatcaggactag

SEQ ID NO: 17920 - DNA, 75 bp, Artificial Sequence
  Synthetic
gaaaacggagtatccatggagcaactagctctgacaaaatcattactagcaatgtctcaactatctcctagggta

SEQ ID NO: 17921 - DNA, 75 bp, Artificial Sequence
  Synthetic
tagctctgacaaaatcattactagcaatgtctcaactatctcctagggtagctgagcactcacctaggatcaagc

SEQ ID NO: 17922 - DNA, 75 bp, Artificial Sequence
  Synthetic
agggtatatgacaagggggaactgatccaagacaacaaaaagaatcccccacacgagcgaccccccggctccaac

SEQ ID NO: 17923 - DNA, 75 bp, Artificial Sequence
  Synthetic
tccaagacaacaaaaagaatcccccacacgagcgaccccccggctccaacaccagcccagacacaggggcccccc

SEQ ID NO: 17924 - DNA, 75 bp, Artificial Sequence
  Synthetic
aatcacgattccctagatagttgttcaaaaaatgattacaaaagaaatctacacgggattagaaaggagaaaatc

SEQ ID NO: 17925 - DNA, 75 bp, Artificial Sequence
  Synthetic
caaaaaatgattacaaaagaaatctacacgggattagaaaggagaaaatcacaatagctacttttttgaccactg

SEQ ID NO: 17926 - DNA, 75 bp, Artificial Sequence
  Synthetic
agctaaagctttatgtcaatgatggtgatccctccaacagactccttgcatttcctatagtgatgaaagagtctg

SEQ ID NO: 17927 - DNA, 75 bp, Artificial Sequence
  Synthetic
tgatccctccaacagactccttgcatttcctatagtgatgaaagagtctgctcaaggggggaaagtgcttcaacc

SEQ ID NO: 17928 - DNA, 75 bp, Artificial Sequence
  Synthetic
gctatggccttgaatcagctatttggtatcccacatggttacgagtggcatcatcttcgcctgcagaatactaca

SEQ ID NO: 17929 - DNA, 75 bp, Artificial Sequence
  Synthetic
gtatcccacatggttacgagtggcatcatcttcgcctgcagaatactacaatgtttgtgggggatccctttaatc

SEQ ID NO: 17930 - DNA, 75 bp, Artificial Sequence
  Synthetic
taatatttatcaactgctatgggttcattgaatcaatgaaggcaggagaagggccattccttgatgttaactcag

SEQ ID NO: 17931 - DNA, 75 bp, Artificial Sequence
  Synthetic
cattgaatcaatgaaggcaggagaagggccattccttgatgttaactcagatgggaagggtgaagttatcacagc

SEQ ID NO: 17932 - DNA, 75 bp, Artificial Sequence
  Synthetic
atcttcatcgtgtctcctagaggaggaattgaaggattgtgtcaaaaaatgtggactatgatttcaattagcgcg

SEQ ID NO: 17933 - DNA, 75 bp, Artificial Sequence
  Synthetic
gaattgaaggattgtgtcaaaaaatgtggactatgatttcaattagcgcgattaactgtgctgcgacaaaggttg

SEQ ID NO: 17934 - DNA, 75 bp, Artificial Sequence
  Synthetic
ttgcacgaagctgttaccagctcttagtcacagttaaaaaatcagcagacaacacggagagagtagtgtatactt

SEQ ID NO: 17935 - DNA, 75 bp, Artificial Sequence
  Synthetic
agtcacagttaaaaaatcagcagacaacacggagagagtagtgtatactttagcatcaaaacctcccgctctttc

SEQ ID NO: 17936 - DNA, 75 bp, Artificial Sequence
  Synthetic
actaaagaaatcaagaagggggagaatgcttctattgtcagtgaggaattggataatttaggagacacatttttt

SEQ ID NO: 17937 - DNA, 75 bp, Artificial Sequence
  Synthetic
atgcttctattgtcagtgaggaattggataatttaggagacacattttttaatgaatttaagcagattaattttg

SEQ ID NO: 17938 - DNA, 75 bp, Artificial Sequence
  Synthetic
ctgtgaagtgtcctagcaagctccagtcaggaatcccttacaaattcaggattatgtttgtgtctctgacatata

SEQ ID NO: 17939 - DNA, 75 bp, Artificial Sequence
  Synthetic
gtcaggaatcccttacaaattcaggattatgtttgtgtctctgacatatatacatcaatccactttataccgtgt

SEQ ID NO: 17940 - DNA, 75 bp, Artificial Sequence
  Synthetic
tttgtatactccaagaggatattttttgaaggcaaaatcctgagtcagtctttaaagaatgctttaaaattgcaa

SEQ ID NO: 17941 - DNA, 75 bp, Artificial Sequence
  Synthetic
ttgaaggcaaaatcctgagtcagtctttaaagaatgctttaaaattgcaattcgtatctgaccatgttggggaga

SEQ ID NO: 17942 - DNA, 75 bp, Artificial Sequence
  Synthetic
tacaagtcactctgattctggatttacctgaaaaacaccccatgggaaaatacctcataaatcaggatggagtct

SEQ ID NO: 17943 - DNA, 75 bp, Artificial Sequence
  Synthetic
acctgaaaaacaccccatgggaaaatacctcataaatcaggatggagtctacaaagctcatatctggatgcacat

SEQ ID NO: 17944 - DNA, 75 bp, Artificial Sequence
  Synthetic
gagaatggattcccaaaggatacagcattcatcctgaacttaatatctattacaagacaacttctgtttgatgaa

SEQ ID NO: 17945 - DNA, 75 bp, Artificial Sequence
  Synthetic
cattcatcctgaacttaatatctattacaagacaacttctgtttgatgaaacttattcaattacaaatgactata

SEQ ID NO: 17946 - DNA, 75 bp, Artificial Sequence
  Synthetic
agattaaggagaaagtcaggaaaatgggattaaaggttactcttgctgatttatggggacccactgtcgttgttg

SEQ ID NO: 17947 - DNA, 75 bp, Artificial Sequence
  Synthetic
gggattaaaggttactcttgctgatttatggggacccactgtcgttgttgaagcaacagggacaatgagtaaata

SEQ ID NO: 17948 - DNA, 75 bp, Artificial Sequence
  Synthetic
gctgtgttaatccccggacagacaggaggttacaatttcttgaacttagcaagactatttacacgaaatataggg

SEQ ID NO: 17949 - DNA, 75 bp, Artificial Sequence
  Synthetic
gaggttacaatttcttgaacttagcaagactatttacacgaaatataggggacccaattacttgttcactatttg

SEQ ID NO: 17950 - DNA, 75 bp, Artificial Sequence
  Synthetic
aaatctctcctgaagttgcaaaaattatatgggcctgtactacgaccatagggcaggcagttgtcatcattcaag

SEQ ID NO: 17951 - DNA, 75 bp, Artificial Sequence
  Synthetic
tatatgggcctgtactacgaccatagggcaggcagttgtcatcattcaagcctcaagcaggagcgagttacttac

SEQ ID NO: 17952 - DNA, 75 bp, Artificial Sequence
  Synthetic
aacatagttttacgcactccaggagatggttcatgggtcactctctgcatggatccgtatgctcttaatattcca

SEQ ID NO: 17953 - DNA, 75 bp, Artificial Sequence
  Synthetic
atggttcatgggtcactctctgcatggatccgtatgctcttaatattccatacattcagctgccactgacatacc

SEQ ID NO: 17954 - DNA, 75 bp, Artificial Sequence
  Synthetic
ttaaagagtttagtctcttctcaaaacctgctaaataattacccagggtggtataacacttgatatattttgact

SEQ ID NO: 17955 - DNA, 75 bp, Artificial Sequence
  Synthetic
acctgctaaataattacccagggtggtataacacttgatatattttgactatatagattcctcggtatatagaga

SEQ ID NO: 17956 - DNA, 75 bp, Artificial Sequence
  Synthetic
ttgtcaggtgtgagaattgatacacaagtagaagaggaaggagatctatgtcaatttttattggatcgagaggta

SEQ ID NO: 17957 - DNA, 75 bp, Artificial Sequence
  Synthetic
aagtagaagaggaaggagatctatgtcaatttttattggatcgagaggtagtccttcctcgtgttgcacatgtca

SEQ ID NO: 17958 - DNA, 75 bp, Artificial Sequence
  Synthetic
aatctcaaggtaagggaaattaactaaaaaccctgttgtctgcactgctcttccgactgtcactagcaatgctct

SEQ ID NO: 17959 - DNA, 75 bp, Artificial Sequence
  Synthetic
aaaaaccctgttgtctgcactgctcttccgactgtcactagcaatgctctgcataagggactgcacaactgtgta

SEQ ID NO: 17960 - DNA, 75 bp, Artificial Sequence
  Synthetic
gacacaactccaacaatcgtaagacatgctctaaatcatcatccgatatcaaggaagaagttagatttgattact

SEQ ID NO: 17961 - DNA, 75 bp, Artificial Sequence
  Synthetic
atgctctaaatcatcatccgatatcaaggaagaagttagatttgattactgattattcacttaattatctgattg

SEQ ID NO: 17962 - DNA, 75 bp, Artificial Sequence
  Synthetic
aaagcaattagtgggacatgcataagtgttaaatgatcaactagcaaagttaagttgcttaattacagtaataat

SEQ ID NO: 17963 - DNA, 75 bp, Artificial Sequence
  Synthetic
gtgttaaatgatcaactagcaaagttaagttgcttaattacagtaataatcataataacataagtgctgatagtc

SEQ ID NO: 17964 - DNA, 75 bp, Artificial Sequence
  Synthetic
aatttatgggagacaggtctgattcatcatgatacatgcagtgtcactttggcagactttactcgtgcaacttca

SEQ ID NO: 17965 - DNA, 75 bp, Artificial Sequence
  Synthetic
atcatgatacatgcagtgtcactttggcagactttactcgtgcaacttcatggagcaaccttttaaatgggagga

SEQ ID NO: 17966 - DNA, 75 bp, Artificial Sequence
  Synthetic
caattgtcaaaaatcaaaattaaatcaggaatgatctgggctctgcattatctctgttgctaagctaagttaaaa

SEQ ID NO: 17967 - DNA, 75 bp, Artificial Sequence
  Synthetic
caggaatgatctgggctctgcattatctctgttgctaagctaagttaaaattacttccactttgccaatcaaggt

SEQ ID NO: 17968 - DNA, 75 bp, Artificial Sequence
  Synthetic
ctaattacgaggacatcacgctgtacagaatgtgcattaggtgactcaaaattcacgtggttttatttgccagca

SEQ ID NO: 17969 - DNA, 75 bp, Artificial Sequence
  Synthetic
cagaatgtgcattaggtgactcaaaattcacgtggttttatttgccagcacctatcgacctatcggatccaagcc

SEQ ID NO: 17970 - DNA, 75 bp, Artificial Sequence
  Synthetic
tcaacatccagccccttaagaaatcaatcgatcacccaataagcagcgagaggaatcaccagccaagagaccatc

SEQ ID NO: 17971 - DNA, 75 bp, Artificial Sequence
  Synthetic
aatcgatcacccaataagcagcgagaggaatcaccagccaagagaccatcactacaaagggacaatcaactggta

SEQ ID NO: 17972 - DNA, 75 bp, Artificial Sequence
  Synthetic
agacgagccgcatcacttagcactataaaagggatgactaaccatcttcgagcatcattgagacttgcctcagtt

SEQ ID NO: 17973 - DNA, 75 bp, Artificial Sequence
  Synthetic
taaaagggatgactaaccatcttcgagcatcattgagacttgcctcagtttacatatgggcatacggggatactg

SEQ ID NO: 17974 - DNA, 75 bp, Artificial Sequence
  Synthetic
ttataatgttacaacttcccttgaccattcttcttagcattcttagtgctcaccagtcgctttgtctagacaaca

SEQ ID NO: 17975 - DNA, 75 bp, Artificial Sequence
  Synthetic
cattcttcttagcattcttagtgctcaccagtcgctttgtctagacaacagtaagctcattcatgcaggaatcat

SEQ ID NO: 17976 - DNA, 75 bp, Artificial Sequence
  Synthetic
acactgaatgaactaaggatactctgtcctattccaagttcatctaatatccaacatcgcttaattgacggggtc

SEQ ID NO: 17977 - DNA, 75 bp, Artificial Sequence
  Synthetic
gtcctattccaagttcatctaatatccaacatcgcttaattgacggggtcagcactgttaagttcacaccagcat

SEQ ID NO: 17978 - DNA, 75 bp, Artificial Sequence
  Synthetic
caatagtggtgagattgattccaaatatcccaagtaaccataaatcttgtgcaactagccaaatcaaattataca

SEQ ID NO: 17979 - DNA, 75 bp, Artificial Sequence
  Synthetic
tatcccaagtaaccataaatcttgtgcaactagccaaatcaaattatacaatgacacgttaacaagattgttgac

SEQ ID NO: 17980 - DNA, 75 bp, Artificial Sequence
  Synthetic
gttgtcattaatgatcaatcagttgaatctaatttaatctaccaacaaattatgctattgggattaggtatattt

SEQ ID NO: 17981 - DNA, 75 bp, Artificial Sequence
  Synthetic
aatctaatttaatctaccaacaaattatgctattgggattaggtatatttgagaccttatatccaatatatgttt

SEQ ID NO: 17982 - DNA, 75 bp, Artificial Sequence
  Synthetic
aatcgcagaattctgggaagagaaagaagcgttttgtaggcgcagtaattggagcagctgcccttggtttggcaa

SEQ ID NO: 17983 - DNA, 75 bp, Artificial Sequence
  Synthetic
gaagcgttttgtaggcgcagtaattggagcagctgcccttggtttggcaactgctgcacaggtgactgccactgt

SEQ ID NO: 17984 - DNA, 75 bp, Artificial Sequence
  Synthetic
tgtattagagaagtagaatcaggcagtatagtcactcctaatagacatgctccagcaattacctcgactccacaa

SEQ ID NO: 17985 - DNA, 75 bp, Artificial Sequence
  Synthetic
gtatagtcactcctaatagacatgctccagcaattacctcgactccacaaaacccgttcctttatgaccacaatc

SEQ ID NO: 17986 - DNA, 75 bp, Artificial Sequence
  Synthetic
actcgattcagaagacaaacgaggcggtgatggaacttaaagatgctgtgggccaaacagcagtagctattgaca

SEQ ID NO: 17987 - DNA, 75 bp, Artificial Sequence
  Synthetic
ggtgatggaacttaaagatgctgtgggccaaacagcagtagctattgacaaaactcaggccttcataaataatca

SEQ ID NO: 17988 - DNA, 75 bp, Artificial Sequence
  Synthetic
aatgaactgaatctggataatgaagatccattaggtcagatcctcttattaactcgatgtgttgcaaagctaatg

SEQ ID NO: 17989 - DNA, 75 bp, Artificial Sequence
  Synthetic
atccattaggtcagatcctcttattaactcgatgtgttgcaaagctaatgattgaatctgttgtggcagattatg

SEQ ID NO: 17990 - DNA, 75 bp, Artificial Sequence
  Synthetic
ttggggtccaattatctttgtaccttactgaattaacaacagtattcggcaaccaactgacaaacccagccctta

SEQ ID NO: 17991 - DNA, 75 bp, Artificial Sequence
  Synthetic
tactgaattaacaacagtattcggcaaccaactgacaaacccagcccttaccacactgtcattacaagccttgta

SEQ ID NO: 17992 - DNA, 75 bp, Artificial Sequence
  Synthetic
aactggataagtgaaactttaggttgtgatctacgttacttggttaaaatgctagggtatgaactgtgctcggcc

SEQ ID NO: 17993 - DNA, 75 bp, Artificial Sequence
  Synthetic
gtgatctacgttacttggttaaaatgctagggtatgaactgtgctcggccttagcatatcagatgtactatttga

SEQ ID NO: 17994 - DNA, 75 bp, Artificial Sequence
  Synthetic
aaaatcgtaacttagcctcactttatgaagcaaacctaattcaggggagaattactcaatatgactcaatgaatc

SEQ ID NO: 17995 - DNA, 75 bp, Artificial Sequence
  Synthetic
tgaagcaaacctaattcaggggagaattactcaatatgactcaatgaatcagttattaattattcaggtacaaat

SEQ ID NO: 17996 - DNA, 75 bp, Artificial Sequence
  Synthetic
cgaatcccgggtttgcaactggctaatattgcaattacattgactcacaaagagatattccgtcgcctgagtata

SEQ ID NO: 17997 - DNA, 75 bp, Artificial Sequence
  Synthetic
atattgcaattacattgactcacaaagagatattccgtcgcctgagtatatccggtctgataccagcaatgaacg

SEQ ID NO: 17998 - DNA, 75 bp, Artificial Sequence
  Synthetic
ttagtgttgacacacctataggagagggaaaggccctagtaccaaaatatgtcctatcctcagggagaataatgg

SEQ ID NO: 17999 - DNA, 75 bp, Artificial Sequence
  Synthetic
gggaaaggccctagtaccaaaatatgtcctatcctcagggagaataatggaagaggttgacctaagcagttgcgc

SEQ ID NO: 18000 - DNA, 75 bp, Artificial Sequence
  Synthetic
catagaggggcatcaatttatttaacagaattggagtcaggtgaggaaccaacatatttattacctaaccagctt

SEQ ID NO: 18001 - DNA, 75 bp, Artificial Sequence
  Synthetic
cagaattggagtcaggtgaggaaccaacatatttattacctaaccagcttgatggtgatcttggcccaaaggcag

SEQ ID NO: 18002 - DNA, 75 bp, Artificial Sequence
  Synthetic
cacttgaaacaataaattgcctgaatgggaatgttacacagtgtcaatttaccgccaacacaggaacccttgaat

SEQ ID NO: 18003 - DNA, 75 bp, Artificial Sequence
  Synthetic
tgggaatgttacacagtgtcaatttaccgccaacacaggaacccttgaatcgagatacgctgttataggaggatt

SEQ ID NO: 18004 - DNA, 75 bp, Artificial Sequence
  Synthetic
tctagacctcttcctttaattcggtccctgacccctattgagaagtgccaagtcttaacagatttcctgttatct

SEQ ID NO: 18005 - DNA, 75 bp, Artificial Sequence
  Synthetic
ccctgacccctattgagaagtgccaagtcttaacagatttcctgttatcttccgagcacattgaaggcgacacat

SEQ ID NO: 18006 - DNA, 75 bp, Artificial Sequence
  Synthetic
gtgtcattgcgcaaaatcttggcttaccaattacaatcatctcatccaatacttgtcagcgaattaatttagaac

SEQ ID NO: 18007 - DNA, 75 bp, Artificial Sequence
  Synthetic
accaattacaatcatctcatccaatacttgtcagcgaattaatttagaacaaatcactttgtctcttgggaacag

SEQ ID NO: 18008 - DNA, 75 bp, Artificial Sequence
  Synthetic
agcattgttaccaatctttattttctctcacgtaaaattcttgccaatatccggtcagatcctttaattaaatcg

SEQ ID NO: 18009 - DNA, 75 bp, Artificial Sequence
  Synthetic
tctcacgtaaaattcttgccaatatccggtcagatcctttaattaaatcgatattggaggaattgtacactcaag

SEQ ID NO: 18010 - DNA, 75 bp, Artificial Sequence
  Synthetic
ctccatcaaatcctctggatatctcagttgaattgaatcgagtcaacaccagtctctctaaagtggaatctctaa

SEQ ID NO: 18011 - DNA, 75 bp, Artificial Sequence
  Synthetic
agttgaattgaatcgagtcaacaccagtctctctaaagtggaatctctaataaaagaaagcaatagtatcctgga

SEQ ID NO: 18012 - DNA, 75 bp, Artificial Sequence
  Synthetic
gatccactgattagtaactctttgtctttctcggttgatctgactagttgcgggaggtcactttcgtatattccc

SEQ ID NO: 18013 - DNA, 75 bp, Artificial Sequence
  Synthetic
ctttctcggttgatctgactagttgcgggaggtcactttcgtatattcccgaactatcaattcaagatagtccgt

SEQ ID NO: 18014 - DNA, 75 bp, Artificial Sequence
  Synthetic
tcataataggactcattgttgtgtggtgtttcatattgacatgcctaatagttagaggatttatgcttcttgtaa

SEQ ID NO: 18015 - DNA, 75 bp, Artificial Sequence
  Synthetic
gtgtttcatattgacatgcctaatagttagaggatttatgcttcttgtaaaacaacaaaagtttaaaggactctc

SEQ ID NO: 18016 - DNA, 75 bp, Artificial Sequence
  Synthetic
tttaaatctgttggtacctcttctacaagttggtataaatatgctggattatattcatctgagttctttagagga

SEQ ID NO: 18017 - DNA, 75 bp, Artificial Sequence
  Synthetic
caagttggtataaatatgctggattatattcatctgagttctttagaggaatgcctcaaggagatgcattatatt

SEQ ID NO: 18018 - DNA, 75 bp, Artificial Sequence
  Synthetic
atttacccatgaaccaatcaccattcaaagttctctggcagctactaatatatcaagtatcgatcctgatcatat

SEQ ID NO: 18019 - DNA, 75 bp, Artificial Sequence
  Synthetic
caaagttctctggcagctactaatatatcaagtatcgatcctgatcatatcatggtattatcccttttattcttg

SEQ ID NO: 18020 - DNA, 75 bp, Artificial Sequence
  Synthetic
agtcatactatctggtacaactccctattctcaagctctcagaaccctcctcagagaaattatggcccatctcca

SEQ ID NO: 18021 - DNA, 75 bp, Artificial Sequence
  Synthetic
tattctcaagctctcagaaccctcctcagagaaattatggcccatctccaactcaatttctaaggtcaactgtat

SEQ ID NO: 18022 - DNA, 75 bp, Artificial Sequence
  Synthetic
agaatttcttcaagttgagcatgattaccatgatcattctctgtaaattcaaatcgtattataaaaaactataaa

SEQ ID NO: 18023 - DNA, 75 bp, Artificial Sequence
  Synthetic
taccatgatcattctctgtaaattcaaatcgtattataaaaaactataaattttataaacttagaatatgttaag

SEQ ID NO: 18024 - DNA, 75 bp, Artificial Sequence
  Synthetic
ttttgcacgctatggaacgaggttgatgatgcaaccgatttattatcagacaattgtgtgaattatatcatagat

SEQ ID NO: 18025 - DNA, 75 bp, Artificial Sequence
  Synthetic
atgatgcaaccgatttattatcagacaattgtgtgaattatatcatagatacagtacctgcactatcatgtaagt

SEQ ID NO: 18026 - DNA, 75 bp, Artificial Sequence
  Synthetic
ttcaccccttagactgctcacgacaagcagtacagtagacttcctcaagtgtccactcaatatggacaaatcata

SEQ ID NO: 18027 - DNA, 75 bp, Artificial Sequence
  Synthetic
agcagtacagtagacttcctcaagtgtccactcaatatggacaaatcatattacacagagcctgaagatcaaaga

SEQ ID NO: 18028 - DNA, 75 bp, Artificial Sequence
  Synthetic
agaatcggcttgataaattgcttcatcttgggatgtcatagtctcatgaaaggcgggagatttgttgttaaagtg

SEQ ID NO: 18029 - DNA, 75 bp, Artificial Sequence
  Synthetic
tcttgggatgtcatagtctcatgaaaggcgggagatttgttgttaaagtgaatgccattgataccactcgttatc

SEQ ID NO: 18030 - DNA, 75 bp, Artificial Sequence
  Synthetic
gctctgtctgatcgcatgtacctcagtaagtcaattgttctatccttggctcccccaagtcttgtccactctgat

SEQ ID NO: 18031 - DNA, 75 bp, Artificial Sequence
  Synthetic
gtaagtcaattgttctatccttggctcccccaagtcttgtccactctgatcagcctaaatagctcaattatcaca

SEQ ID NO: 18032 - DNA, 75 bp, Artificial Sequence
  Synthetic
agctgtgcatactgcaatctagaacagaaggaagtgttggtagtcgggtcggctacaggctcagtaaatcgtcat

SEQ ID NO: 18033 - DNA, 75 bp, Artificial Sequence
  Synthetic
agaaggaagtgttggtagtcgggtcggctacaggctcagtaaatcgtcattctgtcttacgtgagatcattagga

SEQ ID NO: 18034 - DNA, 75 bp, Artificial Sequence
  Synthetic
cctcatatatagagaagttgctataaatatacctttaacattagatagggttactgttgaggtagggactgcagt

SEQ ID NO: 18035 - DNA, 75 bp, Artificial Sequence
  Synthetic
aatatacctttaacattagatagggttactgttgaggtagggactgcagtaaaccagattactgatgcactcagg

SEQ ID NO: 18036 - DNA, 75 bp, Artificial Sequence
  Synthetic
acatgcatatggaagaactgtgatgatatagcatacaggatgtcagagctgtgtgataagatcattgaaggacgc

SEQ ID NO: 18037 - DNA, 75 bp, Artificial Sequence
  Synthetic
atatagcatacaggatgtcagagctgtgtgataagatcattgaaggacgccgactcataactcttacaactactg

SEQ ID NO: 18038 - DNA, 75 bp, Artificial Sequence
  Synthetic
tgattatagtgggggaatagaacatctggttttccaaaggaatacgcttattaatcgctcagtgagtgtctcaga

SEQ ID NO: 18039 - DNA, 75 bp, Artificial Sequence
  Synthetic
ctggttttccaaaggaatacgcttattaatcgctcagtgagtgtctcagatttaatagaacaccccagtttcata

SEQ ID NO: 18040 - DNA, 75 bp, Artificial Sequence
  Synthetic
atgacgcccagtacgactcacttgaattcacaagatctagctcgactgataacatcagttcttgataccctattg

SEQ ID NO: 18041 - DNA, 75 bp, Artificial Sequence
  Synthetic
attcacaagatctagctcgactgataacatcagttcttgataccctattgaaggaagtatttaatttgttatact

SEQ ID NO: 18042 - DNA, 75 bp, Artificial Sequence
  Synthetic
aggaactcgccactggtgctatagtcacaatataataggtcagggatgtgctgattctggagctagtatgatgta

SEQ ID NO: 18043 - DNA, 75 bp, Artificial Sequence
  Synthetic
cacaatataataggtcagggatgtgctgattctggagctagtatgatgtatatttcaatgggagcactgggtgtc

SEQ ID NO: 18044 - DNA, 75 bp, Artificial Sequence
  Synthetic
atgcaggggaagatctctacattagcgaccaccactgtgcggtcgttgatacctatctggattcagaatggtgta

SEQ ID NO: 18045 - DNA, 75 bp, Artificial Sequence
  Synthetic
cgaccaccactgtgcggtcgttgatacctatctggattcagaatggtgtacgaattaaaggatctcatcttgcaa

SEQ ID NO: 18046 - DNA, 75 bp, Artificial Sequence
  Synthetic
tgatagcctcaatcggaagagttgcagtatagtagcgacaactgagggttgtgacgtactctgcagtatagttac

SEQ ID NO: 18047 - DNA, 75 bp, Artificial Sequence
  Synthetic
agtatagtagcgacaactgagggttgtgacgtactctgcagtatagttacacaaacagaagaccaagattatgcc

SEQ ID NO: 18048 - DNA, 75 bp, Artificial Sequence
  Synthetic
acaactaaagaatacatcactatgacatcaacaccaaaattcataaaacggacatttaaaatagagcgggtcaaa

SEQ ID NO: 18049 - DNA, 75 bp, Artificial Sequence
  Synthetic
catcaacaccaaaattcataaaacggacatttaaaatagagcgggtcaaatggatattcgaacaggtcagctcga

SEQ ID NO: 18050 - DNA, 75 bp, Artificial Sequence
  Synthetic
atacacagagagatctttatcccagagtttattccttggaacatgggctgcgcaatatccagctgtaggatctgg

SEQ ID NO: 18051 - DNA, 75 bp, Artificial Sequence
  Synthetic
agtttattccttggaacatgggctgcgcaatatccagctgtaggatctggtataatgacacctgggcgagttata

SEQ ID NO: 18052 - DNA, 75 bp, Artificial Sequence
  Synthetic
gcgattaaatgtagccaagagatgtcaactcctcattaactaataacaatttgataacaaatcagggaatataat

SEQ ID NO: 18053 - DNA, 75 bp, Artificial Sequence
  Synthetic
caactcctcattaactaataacaatttgataacaaatcagggaatataattgtcgtcaatcgtagcccaacttat

SEQ ID NO: 18054 - DNA, 75 bp, Artificial Sequence
  Synthetic
cgaaagattcgctttattcacacataatggagacttagaatgcaggaacttaacacaatatcagaaagaagcaat

SEQ ID NO: 18055 - DNA, 75 bp, Artificial Sequence
  Synthetic
aatggagacttagaatgcaggaacttaacacaatatcagaaagaagcaatttactctgcatataagcctcccaag

SEQ ID NO: 18056 - DNA, 75 bp, Artificial Sequence
  Synthetic
aaatagttcatccatgcatgagaataatttattggtcatatttagaaataatacaatagtacctagtgtcagatg

SEQ ID NO: 18057 - DNA, 75 bp, Artificial Sequence
  Synthetic
aatttattggtcatatttagaaataatacaatagtacctagtgtcagatgattatataggtgtatctcattgttg

SEQ ID NO: 18058 - DNA, 75 bp, Artificial Sequence
  Synthetic
catggggaattgctctcttaaagtgatcaatacaagcacagttatgatgggtgcagaaggtcggctacaattagt

SEQ ID NO: 18059 - DNA, 75 bp, Artificial Sequence
  Synthetic
atcaatacaagcacagttatgatgggtgcagaaggtcggctacaattagttggggactccgttatgtactatcag

SEQ ID NO: 18060 - DNA, 75 bp, Artificial Sequence
  Synthetic
caaaaagaatcacaatatccttattcaggatcatgtcaatatatcaattgattctcttgtgaacatacaaaaagc

SEQ ID NO: 18061 - DNA, 75 bp, Artificial Sequence
  Synthetic
caggatcatgtcaatatatcaattgattctcttgtgaacatacaaaaagcttaggatgtataatagagttctgga

SEQ ID NO: 18062 - DNA, 75 bp, Artificial Sequence
  Synthetic
agacatcatcgccagagatatacaggtagtcataaacagcgaaccactccctctgagcaagttcccgcggccaac

SEQ ID NO: 18063 - DNA, 75 bp, Artificial Sequence
  Synthetic
gtagtcataaacagcgaaccactccctctgagcaagttcccgcggccaacctggactccaggagtatgtcaaaaa

SEQ ID NO: 18064 - DNA, 75 bp, Artificial Sequence
  Synthetic
aagaaaaaattaataattttaaattatgtgatgccaccgctgggtgcagtttagtcaaagttttccctataggtg

SEQ ID NO: 18065 - DNA, 75 bp, Artificial Sequence
  Synthetic
atgtgatgccaccgctgggtgcagtttagtcaaagttttccctataggtgttattgtctccttataacaatatca

SEQ ID NO: 18066 - DNA, 75 bp, Artificial Sequence
  Synthetic
ggcaatttccgcaggagagacactatctgaaatgacattctttggaggatatttagaggcatccacccaacgaaa

SEQ ID NO: 18067 - DNA, 75 bp, Artificial Sequence
  Synthetic
tctgaaatgacattctttggaggatatttagaggcatccacccaacgaaaagatccatggataggcgttgctaat

SEQ ID NO: 18068 - DNA, 75 bp, Artificial Sequence
  Synthetic
gcataatttaagcgtcttaataaggtagtctattgctcaatttgaaattaaaatgataagctattggaggataga

SEQ ID NO: 18069 - DNA, 75 bp, Artificial Sequence
  Synthetic
tagtctattgctcaatttgaaattaaaatgataagctattggaggatagaaaaatcatattgcccagaatttatt

SEQ ID NO: 18070 - DNA, 75 bp, Artificial Sequence
  Synthetic
agcatattcgtcatcaacgtgttttaggaacactagactggatcgaaatttctgcctgttaatctttgaattaac

SEQ ID NO: 18071 - DNA, 75 bp, Artificial Sequence
  Synthetic
aggaacactagactggatcgaaatttctgcctgttaatctttgaattaaccgataacttacttggagactggaga

SEQ ID NO: 18072 - DNA, 75 bp, Artificial Sequence
  Synthetic
gttagtacttaatctggtaatccgacttcgaattcgtatgaataaaaaatgatgaaagacaaacacaatattact

SEQ ID NO: 18073 - DNA, 75 bp, Artificial Sequence
  Synthetic
cttcgaattcgtatgaataaaaaatgatgaaagacaaacacaatattactcaacttattagtactcctattctaa

SEQ ID NO: 18074 - DNA, 75 bp, Artificial Sequence
  Synthetic
ttagtaatctcggctaataacctgaatgaacgacttaagaagggtaagactacaaaagtaagttatgaggtcata

SEQ ID NO: 18075 - DNA, 75 bp, Artificial Sequence
  Synthetic
atgaacgacttaagaagggtaagactacaaaagtaagttatgaggtcatacgagctgttgatgcagaatttaatt

SEQ ID NO: 18076 - DNA, 75 bp, Artificial Sequence
  Synthetic
gggaactttaaataaaacaatcgaatcattgggggcgaagcaagtggatctcgggctcgaggccgaaacactgga

SEQ ID NO: 18077 - DNA, 75 bp, Artificial Sequence
  Synthetic
aatctaattcattggttaccaattaattacagttttagatgataattgtaagtgataagagaatatattaatgat

SEQ ID NO: 18078 - DNA, 75 bp, Artificial Sequence
  Synthetic
tattcaatgaatatcaggcacttcaagaacaacttgtaaagccggctgtcaggagacctgatgttgcctcaacag

SEQ ID NO: 18079 - DNA, 75 bp, Artificial Sequence
  Synthetic
attacagttttagatgataattgtaagtgataagagaatatattaatgatcatagaacttatcaatattgtaatt

SEQ ID NO: 18080 - DNA, 75 bp, Artificial Sequence
  Synthetic
aggagacctgatgttgcctcaacaggtttactcagggcggaaatacctgtctgtgttacattgtctcaagacccc

SEQ ID NO: 18081 - DNA, 75 bp, Artificial Sequence
  Synthetic
taagtggttataaattgctctcaatagtagtaaagagttcggaatcagtagattaagaaaaaaagttagggggga

SEQ ID NO: 18082 - DNA, 75 bp, Artificial Sequence
  Synthetic
agtagtaaagagttcggaatcagtagattaagaaaaaaagttaggggggaaaattttctcatcagagaagaattt

SEQ ID NO: 18083 - DNA, 75 bp, Artificial Sequence
  Synthetic
caatgggcacaagtaatccatccagaagctcaccttgactcaccaatcgttggcaacaaactgatctacttttgg

SEQ ID NO: 18084 - DNA, 75 bp, Artificial Sequence
  Synthetic
aagctcaccttgactcaccaatcgttggcaacaaactgatctacttttggaagttatcaggcctaaaactaccag

SEQ ID NO: 18085 - DNA, 75 bp, Artificial Sequence
  Synthetic
aaagatcatgactactcaatatacaactctataacagctcaacgggatcgtttttgtcttggtctccaatccaaa

SEQ ID NO: 18086 - DNA, 75 bp, Artificial Sequence
  Synthetic
actctataacagctcaacgggatcgtttttgtcttggtctccaatccaaaggtctgtttcttgacctcttagatc

SEQ ID NO: 18087 - DNA, 75 bp, Artificial Sequence
  Synthetic
gaagcaaagcaattggctcacactgagaagaagattatactgcgagcggtcaagggtcactattcccaaatagtg

SEQ ID NO: 18088 - DNA, 75 bp, Artificial Sequence
  Synthetic
agaagaagattatactgcgagcggtcaagggtcactattcccaaatagtggaattgttttccactctttccaaga

SEQ ID NO: 18089 - DNA, 75 bp, Artificial Sequence
  Synthetic
gatcaacgcagacatccaacactgagtgatggttcaatatctatacttgaagatccaactatcttccttggtggt

SEQ ID NO: 18090 - DNA, 75 bp, Artificial Sequence
  Synthetic
gtgatggttcaatatctatacttgaagatccaactatcttccttggtggttcatctcaacttcacattcactcct

SEQ ID NO: 18091 - DNA, 75 bp, Artificial Sequence
  Synthetic
ccgtcttggagttgagacagcccaaagccagcagggagcgtttgacgagagaacagcccgagagatgggcttgac

SEQ ID NO: 18092 - DNA, 75 bp, Artificial Sequence
  Synthetic
caagttcgacaatcaacaagttacacgttttctggtgaaaatacacttgcagtggtaggcccagatgtcattatg

SEQ ID NO: 18093 - DNA, 75 bp, Artificial Sequence
  Synthetic
cgttttctggtgaaaatacacttgcagtggtaggcccagatgtcattatgattgctttgataaaagaacggaagt

SEQ ID NO: 18094 - DNA, 75 bp, Artificial Sequence
  Synthetic
gtcccagttcagttcgcgagccatcccgccctgcattcatcagtcaagaagaaaataggcagcctgcccagaatt

SEQ ID NO: 18095 - DNA, 75 bp, Artificial Sequence
  Synthetic
cttcagatactcagggtcagaccaagccagtcccgaatcaacccgcaccaagggccgacccagatgacattgatc

SEQ ID NO: 18096 - DNA, 75 bp, Artificial Sequence
  Synthetic
ggacgagcaatgattctagcagttactcatgtagaacctcatttaaatgacctccatgaaagattggtatcccta

SEQ ID NO: 18097 - DNA, 75 bp, Artificial Sequence
  Synthetic
ctcatgtagaacctcatttaaatgacctccatgaaagattggtatccctatggtctctcatagatactatcgcat

SEQ ID NO: 18098 - DNA, 75 bp, Artificial Sequence
  Synthetic
acctaatcaaacatttcataaactatagtagtcattgatttaagaaaaaattgggggcgacctcaactgtgaaac

SEQ ID NO: 18099 - DNA, 75 bp, Artificial Sequence
  Synthetic
gcatatgctgccgtccaattacatgatgctgatattgaccagtgtggtgaattcttctcctttaatttggcggag

SEQ ID NO: 18100 - DNA, 75 bp, Artificial Sequence
  Synthetic
atgctgatattgaccagtgtggtgaattcttctcctttaatttggcggagattggctcctgtcttgatcaatttt

SEQ ID NO: 18101 - DNA, 75 bp, Artificial Sequence
  Synthetic
cgccaatgatgaagaaattgcagaacttctgaacctcagcaccactgtaatcaaggagattcagaaatctgaact

SEQ ID NO: 18102 - DNA, 75 bp, Artificial Sequence
  Synthetic
tcagggttgactgtagatcagggagcagaaatgctttgtgtattgaggacttggggacatcctttactgtatgca

SEQ ID NO: 18103 - DNA, 75 bp, Artificial Sequence
  Synthetic
cagaaatgctttgtgtattgaggacttggggacatcctttactgtatgcagagaaggctgcaaagaaagtaagag

SEQ ID NO: 18104 - DNA, 75 bp, Artificial Sequence
  Synthetic
gaaatctaactgatctatgggaaaaggagactgcaagtcagaacaagacatcggctcaatctccacaaaccacac

SEQ ID NO: 18105 - DNA, 75 bp, Artificial Sequence
  Synthetic
ggagactgcaagtcagaacaagacatcggctcaatctccacaaaccacacaagttcagtctgatggaaatgagga

SEQ ID NO: 18106 - DNA, 75 bp, Artificial Sequence
  Synthetic
ctcagtttctttgtcactgacttaattaatggctttagaagggctcattcaggattatggcctaaaatagtccct

SEQ ID NO: 18107 - DNA, 75 bp, Artificial Sequence
  Synthetic
ttaatggctttagaagggctcattcaggattatggcctaaaatagtccctcagagtattacggaccccgttataa

SEQ ID NO: 18108 - DNA, 75 bp, Artificial Sequence
  Synthetic
cattatcggagtattgctcagattgagtttgaaaagagcattgaatatgatttaatatcggatttgagtgtgttc

SEQ ID NO: 18109 - DNA, 75 bp, Artificial Sequence
  Synthetic
agtttgaaaagagcattgaatatgatttaatatcggatttgagtgtgttcctgaaagataaggcaatatgcagac

SEQ ID NO: 18110 - DNA, 75 bp, Artificial Sequence
  Synthetic
aagggccctcgcatccagaatctccctgggtcccaagcagcaactcaacaggcgacccacccattggcaggggac

SEQ ID NO: 18111 - DNA, 75 bp, Artificial Sequence
  Synthetic
aagaaggcaactgaccagagacgccagagaaataataggctccttcttgattttctatcatctgacaattttgat

SEQ ID NO: 18112 - DNA, 75 bp, Artificial Sequence
  Synthetic
agagaaataataggctccttcttgattttctatcatctgacaattttgatcctcatgaagagtttagttatgtca

SEQ ID NO: 18113 - DNA, 75 bp, Artificial Sequence
  Synthetic
aaagagaaagaaatcaagattgacggacgaatctttgcaaaaatgactagaaaaatgagaaactgtcaagtacta

SEQ ID NO: 18114 - DNA, 75 bp, Artificial Sequence
  Synthetic
gacgaatctttgcaaaaatgactagaaaaatgagaaactgtcaagtactactagagagcttacttgcaactcatg

SEQ ID NO: 18115 - DNA, 75 bp, Artificial Sequence
  Synthetic
actaaatcactattggcaatgtcacagctcgccccaagggtgtctgaatatcaagggaaaataatgcgatctagc

SEQ ID NO: 18116 - DNA, 75 bp, Artificial Sequence
  Synthetic
agctcgccccaagggtgtctgaatatcaagggaaaataatgcgatctagccatagattatgtattaataataaaa

SEQ ID NO: 18117 - DNA, 75 bp, Artificial Sequence
  Synthetic
gctgctgttgtaattgcaggatttggagacgacccaactcaaattattgaagaaggtatcatggccaaagatgct

SEQ ID NO: 18118 - DNA, 75 bp, Artificial Sequence
  Synthetic
tctacgcaggaaacacaactcaagagtggatcacctttttgtgtgaatgtagaagccccgagtgagccacaaaag

SEQ ID NO: 18119 - DNA, 75 bp, Artificial Sequence
  Synthetic
gtggatcacctttttgtgtgaatgtagaagccccgagtgagccacaaaagaagaaaaccttgattgcaagcttcc

SEQ ID NO: 18120 - DNA, 75 bp, Artificial Sequence
  Synthetic
aaattgtttgccatgaaattaaaccagattctagggatccctcatggttttgaatggattcatcttcgcctccgg

SEQ ID NO: 18121 - DNA, 75 bp, Artificial Sequence
  Synthetic
acgcccgagtcaagcaggcaatatataatgcataatattgtaattatacaaacaatcaatactgctgtcggttgc

SEQ ID NO: 18122 - DNA, 75 bp, Artificial Sequence
  Synthetic
taatgcataatattgtaattatacaaacaatcaatactgctgtcggttgcacccaccttagcaaatcaataatct

SEQ ID NO: 18123 - DNA, 75 bp, Artificial Sequence
  Synthetic
agattctagggatccctcatggttttgaatggattcatcttcgcctccgggacacaactatgtttgttggggatc

SEQ ID NO: 18124 - DNA, 75 bp, Artificial Sequence
  Synthetic
aatgacagtattttcatagtttctcctagaggcggaattgaaggcttatgccaaaaaatgtggactatgatatcg

SEQ ID NO: 18125 - DNA, 75 bp, Artificial Sequence
  Synthetic
ctagaggcggaattgaaggcttatgccaaaaaatgtggactatgatatcgatctctgctatccacttatctgcga

SEQ ID NO: 18126 - DNA, 75 bp, Artificial Sequence
  Synthetic
atagccataactagagaggttaaagaaggggaaaatgcacaaatcgcaatgggggatctttctgaaatctctgag

SEQ ID NO: 18127 - DNA, 75 bp, Artificial Sequence
  Synthetic
aaggggaaaatgcacaaatcgcaatgggggatctttctgaaatctctgagaggttcttcactgagttcaaattag

SEQ ID NO: 18128 - DNA, 75 bp, Artificial Sequence
  Synthetic
tccaagcaattaaggagaattcagatcgatcgaaattcttccatccaaaagatgacttcaaacctgagacagtca

SEQ ID NO: 18129 - DNA, 75 bp, Artificial Sequence
  Synthetic
aaatctttttttgtatattcaaaaaggatcttttttgaagggcgcattctcagtcaagggctaaaaaatgcagca

SEQ ID NO: 18130 - DNA, 75 bp, Artificial Sequence
  Synthetic
ggatcttttttgaagggcgcattctcagtcaagggctaaaaaatgcagcaaagctcgtgatgatttcagacacta

SEQ ID NO: 18131 - DNA, 75 bp, Artificial Sequence
  Synthetic
agactcatcgagaatggtgctaacaaggcaagttgctggataattaattggattttgaacatgaagcaaataatt

SEQ ID NO: 18132 - DNA, 75 bp, Artificial Sequence
  Synthetic
aggcaagttgctggataattaattggattttgaacatgaagcaaataatttttgatacattcttctcattgagca

SEQ ID NO: 18133 - DNA, 75 bp, Artificial Sequence
  Synthetic
gggtgcccaaaagtatccacagcatctcgtctaccctactgtatagtgtgatgttggaggtaggattcaaagtgg

SEQ ID NO: 18134 - DNA, 75 bp, Artificial Sequence
  Synthetic
accatatcattagtgccaggacaattaggaggattaaattttctaaatgtctcaaggatgttcacaagaaatatt

SEQ ID NO: 18135 - DNA, 75 bp, Artificial Sequence
  Synthetic
taggaggattaaattttctaaatgtctcaaggatgttcacaagaaatattggtgatcctgtatctgcgtcactag

SEQ ID NO: 18136 - DNA, 75 bp, Artificial Sequence
  Synthetic
ttgcatggttccacctgtgcaatttcaaaaagacatcctctaagggaaagccgagaacgctagacgaactgagga

SEQ ID NO: 18137 - DNA, 75 bp, Artificial Sequence
  Synthetic
cgaaacatagttttcagaaaacctggagaaggatcatggattactttgtgcatggatccttacgcactcaatcta

SEQ ID NO: 18138 - DNA, 75 bp, Artificial Sequence
  Synthetic
gagaaggatcatggattactttgtgcatggatccttacgcactcaatctaccttatgtccaactcccgacaactt

SEQ ID NO: 18139 - DNA, 75 bp, Artificial Sequence
  Synthetic
ctattaagaggaacaagaattgagaatcaatatgaagaagaagaagagctggctcgctttttactgaatcgggag

SEQ ID NO: 18140 - DNA, 75 bp, Artificial Sequence
  Synthetic
atcaatatgaagaagaagaagagctggctcgctttttactgaatcgggagtcagtaatgcccagggttgctcatg

SEQ ID NO: 18141 - DNA, 75 bp, Artificial Sequence
  Synthetic
acagttgttatccaatcaagcgagaagggggaactcctaaggtctgatgatctcgagatacgaggtgctgtggcc

SEQ ID NO: 18142 - DNA, 75 bp, Artificial Sequence
  Synthetic
agggggaactcctaaggtctgatgatctcgagatacgaggtgctgtggcctccaagaaaggtagactgagctcat

SEQ ID NO: 18143 - DNA, 75 bp, Artificial Sequence
  Synthetic
attgataccactcaaactatcatcaagactgccctcatcagttaccccatatcattcaagaaatgtcaaaaaatc

SEQ ID NO: 18144 - DNA, 75 bp, Artificial Sequence
  Synthetic
agactgccctcatcagttaccccatatcattcaagaaatgtcaaaaaatcagcgagtatacagccaactatatca

SEQ ID NO: 18145 - DNA, 75 bp, Artificial Sequence
  Synthetic
catcagacgtgcgaaaaaaactaaatctgaaaaaaactgcccagactccacattaatctaggttgcagggaaata

SEQ ID NO: 18146 - DNA, 75 bp, Artificial Sequence
  Synthetic
tctgaaaaaaactgcccagactccacattaatctaggttgcagggaaataatacccgacatgcacaatactatca

SEQ ID NO: 18147 - DNA, 75 bp, Artificial Sequence
  Synthetic
atacaggcatggaatagaggacttatctctgatgacacgtgttcagttacattagcagattatactcgttctaac

SEQ ID NO: 18148 - DNA, 75 bp, Artificial Sequence
  Synthetic
tctctgatgacacgtgttcagttacattagcagattatactcgttctaactcatggcgacctctactacaaggac

SEQ ID NO: 18149 - DNA, 75 bp, Artificial Sequence
  Synthetic
tgggataacaattattaatccaatttcataattataaaaaattgctttaaaggttactgacgagtcgggggcgaa

SEQ ID NO: 18150 - DNA, 75 bp, Artificial Sequence
  Synthetic
tcattactatcttccggacggccatgtagagggtgtcttataaacgaccgaagctactcttggttcttcttacca

SEQ ID NO: 18151 - DNA, 75 bp, Artificial Sequence
  Synthetic
gtagagggtgtcttataaacgaccgaagctactcttggttcttcttaccaggagatataaacctgagtcatcccg

SEQ ID NO: 18152 - DNA, 75 bp, Artificial Sequence
  Synthetic
ttttagaatctacatattgaattatgggtaaaatatcaatatatctaattaatagcgtgctattattgctggtat

SEQ ID NO: 18153 - DNA, 75 bp, Artificial Sequence
  Synthetic
gagcaccgagctgcctcaataagcaatataaagaatatgacatgtcacttgagatcagcattgcgaggatcaagt

SEQ ID NO: 18154 - DNA, 75 bp, Artificial Sequence
  Synthetic
atataaagaatatgacatgtcacttgagatcagcattgcgaggatcaagtgtttatatctgggcatttggagaca

SEQ ID NO: 18155 - DNA, 75 bp, Artificial Sequence
  Synthetic
ctcacactcgctcagctccagtcactttgccctatacctagcacttcaaatatccaacatcggcttgaggatgga

SEQ ID NO: 18156 - DNA, 75 bp, Artificial Sequence
  Synthetic
catcggctcaaatcactgctgcagtcgctctcaagcaagcacaagataatgcaagaaacatactggcactcaaag

SEQ ID NO: 18157 - DNA, 75 bp, Artificial Sequence
  Synthetic
tttgccctatacctagcacttcaaatatccaacatcggcttgaggatggaataagcacagtcaaatttactcctg

SEQ ID NO: 18158 - DNA, 75 bp, Artificial Sequence
  Synthetic
caatcttactctgatggtcattcaatcgaatcaaatattatctaccagcaagtcatgattctagggacaggcatt

SEQ ID NO: 18159 - DNA, 75 bp, Artificial Sequence
  Synthetic
tcgaatcaaatattatctaccagcaagtcatgattctagggacaggcatttttgaaacattgtttcctttaggtc

SEQ ID NO: 18160 - DNA, 75 bp, Artificial Sequence
  Synthetic
tgttgtgttagagaagctgatgggggcacatatagtgagtctcggtatgcaatcccaactcttagtgtggaaagt

SEQ ID NO: 18161 - DNA, 75 bp, Artificial Sequence
  Synthetic
gcacatatagtgagtctcggtatgcaatcccaactcttagtgtggaaagttcaaatcctttcctctttgaccggt

SEQ ID NO: 18162 - DNA, 75 bp, Artificial Sequence
  Synthetic
tatcatgaaatgggattagagaatttagacccacctggtatcattatgaccctatcattgtgtatgtcaaaggtc

SEQ ID NO: 18163 - DNA, 75 bp, Artificial Sequence
  Synthetic
tagacccacctggtatcattatgaccctatcattgtgtatgtcaaaggtcattattgacactactgttggtgact

SEQ ID NO: 18164 - DNA, 75 bp, Artificial Sequence
  Synthetic
gtagctgaaagtcgggtgactattgaggagcttgatgtagcatcttgtaaattcagcagcacaaccctatactgc

SEQ ID NO: 18165 - DNA, 75 bp, Artificial Sequence
  Synthetic
atcaattggatttctgagtttacatattgtgatcttggagcgctatttacatcagcagctcgagacttatgtttg

SEQ ID NO: 18166 - DNA, 75 bp, Artificial Sequence
  Synthetic
attgtgatcttggagcgctatttacatcagcagctcgagacttatgtttgacaattgcatatcagttgtattatt

SEQ ID NO: 18167 - DNA, 75 bp, Artificial Sequence
  Synthetic
accacagagattggagcattatcatcccggtatataacactagatggaggggtcttagtcaattgtaagtcaatt

SEQ ID NO: 18168 - DNA, 75 bp, Artificial Sequence
  Synthetic
gatcgaattcctggaattcaacttgccaatatagcgctgacaatctcacatccactcatttgggcaagactccag

SEQ ID NO: 18169 - DNA, 75 bp, Artificial Sequence
  Synthetic
tgcagtaacatatgttgatgctacaatatgcaaaacaattcaattggatgacatacaactccagttggaagggtc

SEQ ID NO: 18170 - DNA, 75 bp, Artificial Sequence
  Synthetic
ccaatatagcgctgacaatctcacatccactcatttgggcaagactccaggcatctacagtactcaaaggtccat

SEQ ID NO: 18171 - DNA, 75 bp, Artificial Sequence
  Synthetic
ctacctccggttctttggatatcagcagtgagatagggaacatcaataatacggtgaatcgtgtggaggatttaa

SEQ ID NO: 18172 - DNA, 75 bp, Artificial Sequence
  Synthetic
ctcacatggggtctagaccaatttttatccatgacattatcgggtatggagaccgaaatgatattccctaattat

SEQ ID NO: 18173 - DNA, 75 bp, Artificial Sequence
  Synthetic
cagtgagatagggaacatcaataatacggtgaatcgtgtggaggatttaatccaccaatcggaggaatggctggc

SEQ ID NO: 18174 - DNA, 75 bp, Artificial Sequence
  Synthetic
tatccatgacattatcgggtatggagaccgaaatgatattccctaattatcaggatgatgatttaaatccgaaat

SEQ ID NO: 18175 - DNA, 75 bp, Artificial Sequence
  Synthetic
tatcctgggcgatggccaaaaattaagaccttagatcccattgaaaaatgtagtgtcatcactgaattttgtatg

SEQ ID NO: 18176 - DNA, 75 bp, Artificial Sequence
  Synthetic
agaccttagatcccattgaaaaatgtagtgtcatcactgaattttgtatgtggtcaattgaagctcaccttgatg

SEQ ID NO: 18177 - DNA, 75 bp, Artificial Sequence
  Synthetic
tttgatcattcaggccaaaacagagggtctaggctcgggttaataaaagttcaatcaatgtttgatttattaggc

SEQ ID NO: 18178 - DNA, 75 bp, Artificial Sequence
  Synthetic
acgacttttgtgacaaacatctacttccttactagaaaattactcacaatggcaagaggtaacgagtactgtaaa

SEQ ID NO: 18179 - DNA, 75 bp, Artificial Sequence
  Synthetic
ggtctaggctcgggttaataaaagttcaatcaatgtttgatttattaggctttccctactaattattaatgtatt

SEQ ID NO: 18180 - DNA, 75 bp, Artificial Sequence
  Synthetic
tccttactagaaaattactcacaatggcaagaggtaacgagtactgtaaagaatatattgcacaactttaccaag

SEQ ID NO: 18181 - DNA, 75 bp, Artificial Sequence
  Synthetic
acctgggggcgacctatttacaggctagtatatattaggaagtcctcatattgcactataatctcaaacaattat

SEQ ID NO: 18182 - DNA, 75 bp, Artificial Sequence
  Synthetic
caagacattatgtatactgatgagttttcgttttgtatttcaaatcccttcacccatagagatctccacattcat

SEQ ID NO: 18183 - DNA, 75 bp, Artificial Sequence
  Synthetic
tagtatatattaggaagtcctcatattgcactataatctcaaacaattatattacctcgtatccaccttgtctaa

SEQ ID NO: 18184 - DNA, 75 bp, Artificial Sequence
  Synthetic
tttcgttttgtatttcaaatcccttcacccatagagatctccacattcatcattgtaagatggaagacgctgatg

SEQ ID NO: 18185 - DNA, 75 bp, Artificial Sequence
  Synthetic
atagtcgaaaaacaacttggagggccatctttagatggtccgttcttcttattacaacaggatgcttagccttat

SEQ ID NO: 18186 - DNA, 75 bp, Artificial Sequence
  Synthetic
ctcacaaggaccataggaatggtgtctggttcttggtacaagatctcaggattgttagcgaaggggctatgcaaa

SEQ ID NO: 18187 - DNA, 75 bp, Artificial Sequence
  Synthetic
catctttagatggtccgttcttcttattacaacaggatgcttagccttatccattgttagcatagttcaaattgg

SEQ ID NO: 18188 - DNA, 75 bp, Artificial Sequence
  Synthetic
ctggttcttggtacaagatctcaggattgttagcgaaggggctatgcaaaggtctccctcatggacacgggctat

SEQ ID NO: 18189 - DNA, 75 bp, Artificial Sequence
  Synthetic
ctttgaaaaccactctgtctgatacactcaggaatccaattaaccagataaatgacatattcaggattgttgccc

SEQ ID NO: 18190 - DNA, 75 bp, Artificial Sequence
  Synthetic
tgttctaatacaatctattataattcgctattctcaaatgatttaaatcccccccaaagaaatctaggcccccag

SEQ ID NO: 18191 - DNA, 75 bp, Artificial Sequence
  Synthetic
aatgacatattcaggattgttgcccttgatattccattgcaagtaactagtatccaaaaagacctcgcaagtcaa

SEQ ID NO: 18192 - DNA, 75 bp, Artificial Sequence
  Synthetic
cgctattctcaaatgatttaaatcccccccaaagaaatctaggcccccagccatcacaattttatgcgagcacag

SEQ ID NO: 18193 - DNA, 75 bp, Artificial Sequence
  Synthetic
gaatttcaaatactatggcgagaatcagaaatcgaaacagacattacaacaaaagaatgcgtaaattatattctt

SEQ ID NO: 18194 - DNA, 75 bp, Artificial Sequence
  Synthetic
cagaaatcgaaacagacattacaacaaaagaatgcgtaaattatattcttgagacagttgagtcatgtagctgtc

SEQ ID NO: 18195 - DNA, 75 bp, Artificial Sequence
  Synthetic
taccaacaagcgattctgcactatatcatactatgttctcaaacactcataccaggatgcccaggtgttcttaag

SEQ ID NO: 18196 - DNA, 75 bp, Artificial Sequence
  Synthetic
tatatctcaatgggggttctccatgtgtcttcatctggcactcctatctttcttactactgcaagtgaactgata

SEQ ID NO: 18197 - DNA, 75 bp, Artificial Sequence
  Synthetic
tcatactatgttctcaaacactcataccaggatgcccaggtgttcttaagttatactttactcatgtagtattgg

SEQ ID NO: 18198 - DNA, 75 bp, Artificial Sequence
  Synthetic
ctgtgacattttgtgcagtattgtcatagagaaggagggagatgattattggtctgatactccgactccaatgcg

SEQ ID NO: 18199 - DNA, 75 bp, Artificial Sequence
  Synthetic
tatcacaatgcatattgcagtcaagagggacgtgaatgttacatagtgttcagaaagtctgctcatgtgccactt

SEQ ID NO: 18200 - DNA, 75 bp, Artificial Sequence
  Synthetic
agggacgtgaatgttacatagtgttcagaaagtctgctcatgtgccacttgcaaacttgctccctctgtttgata

SEQ ID NO: 18201 - DNA, 75 bp, Artificial Sequence
  Synthetic
ttacaacaggtatactcaaggctattaatcattagcacgaaattagcctcttacactaatagattgctgtcagga

SEQ ID NO: 18202 - DNA, 75 bp, Artificial Sequence
  Synthetic
taatcattagcacgaaattagcctcttacactaatagattgctgtcaggattaacaatgctctcaactacatcga

SEQ ID NO: 18203 - DNA, 75 bp, Artificial Sequence
  Synthetic
cctggcttcttgcgacaaaacgatcagaattcatcgcacttgcagtcgttgaaaagagactgtgtaacagtcgct

SEQ ID NO: 18204 - DNA, 75 bp, Artificial Sequence
  Synthetic
agaattcatcgcacttgcagtcgttgaaaagagactgtgtaacagtcgctctcaaagaaacaatccagatccgag

SEQ ID NO: 18205 - DNA, 75 bp, Artificial Sequence
  Synthetic
agtactgttggtaaaataagaacattactgatgatcacatgtcggaaaatggttcaaattcatattctacagatg

SEQ ID NO: 18206 - DNA, 75 bp, Artificial Sequence
  Synthetic
tactgatgatcacatgtcggaaaatggttcaaattcatattctacagatggcaatgaacaacccagtgaatatcc

SEQ ID NO: 18207 - DNA, 75 bp, Artificial Sequence
  Synthetic
tcccgagcataatttggatcggccagtaccttgatgcccctgttggaaggacttatcccagatttggaattgcaa

SEQ ID NO: 18208 - DNA, 75 bp, Artificial Sequence
  Synthetic
attccagttgatgaatgtataacactatctaacgcgccttcttacatccgacgttcattcaacaagcaagaactt

SEQ ID NO: 18209 - DNA, 75 bp, Artificial Sequence
  Synthetic
tatctaacgcgccttcttacatccgacgttcattcaacaagcaagaacttacaattatgcttggtacgcagagca

SEQ ID NO: 18210 - DNA, 75 bp, Artificial Sequence
  Synthetic
tctattcttaaaggggaggttatctgaatcaaattcaagtagtataagttgatttaactgttaagctgagtgata

SEQ ID NO: 18211 - DNA, 75 bp, Artificial Sequence
  Synthetic
gaatcaaattcaagtagtataagttgatttaactgttaagctgagtgataattagtctttagacactacttttga

SEQ ID NO: 18212 - DNA, 75 bp, Artificial Sequence
  Synthetic
attttgggactcatttaattgcagagtgaaattgtcatcttaggaaataatcaattccatgatttttattgaaca

SEQ ID NO: 18213 - DNA, 75 bp, Artificial Sequence
  Synthetic
tgatcaagcaatcatgtgggaaatttattatcacataacttctaatagttttaaatgacgaattaagaaaaaatg

SEQ ID NO: 18214 - DNA, 75 bp, Artificial Sequence
  Synthetic
taagaaaaaatgatatcaccatttgttgcttccacagacagtccccaaccgcgcctcattttaccatcaagaatt

SEQ ID NO: 18215 - DNA, 75 bp, Artificial Sequence
  Synthetic
ttgcttccacagacagtccccaaccgcgcctcattttaccatcaagaattgaggtagattaatacagagtgagat

SEQ ID NO: 18216 - DNA, 75 bp, Artificial Sequence
  Synthetic
aagattaatctccagtcatgggtgagcaactaattattattgataatttaaggggtctcttatttagaagaatct

SEQ ID NO: 18217 - DNA, 75 bp, Artificial Sequence
  Synthetic
gcaactaattattattgataatttaaggggtctcttatttagaagaatctacaaatgggttaattcttaacccct

SEQ ID NO: 18218 - DNA, 75 bp, Artificial Sequence
  Synthetic
aatcattaatcggttatactcaggtagtcaagaaattattctaggcaaatcaacttctagtctttatctctcgat

SEQ ID NO: 18219 - DNA, 75 bp, Artificial Sequence
  Synthetic
agtcaagaaattattctaggcaaatcaacttctagtctttatctctcgatcctgagagtgtgataggactaataa

SEQ ID NO: 18220 - DNA, 75 bp, Artificial Sequence
  Synthetic
caacccattaaatcatatctctcgacatcgggctcttgtaagtctattgtcacaactggtgtaaacaaaaatatg

SEQ ID NO: 18221 - DNA, 75 bp, Artificial Sequence
  Synthetic
catcgggctcttgtaagtctattgtcacaactggtgtaaacaaaaatatgattcaaattaacttaactctcgtaa

SEQ ID NO: 18222 - DNA, 75 bp, Artificial Sequence
  Synthetic
accaaacaaggaaaccatatgcttggggaatttacgagaacgcttataaaatcgtgagggggaagctggtggact

SEQ ID NO: 18223 - DNA, 75 bp, Artificial Sequence
  Synthetic
atcgtgagggggaagctggtggactccgggtccggagtcggtggacctgagtctagtagcttccctgctgtgcca

SEQ ID NO: 18224 - DNA, 75 bp, Artificial Sequence
  Synthetic
tgggatccctgtgtgtgtcctactctccgaggatcctgaagaacgatggagctttgtttgcttttgcatgaggtg

SEQ ID NO: 18225 - DNA, 75 bp, Artificial Sequence
  Synthetic
ggggcgattatctacttttctgcagccagtagttagtagactggaggtgttgtttgatctagtagattcattggc

SEQ ID NO: 18226 - DNA, 75 bp, Artificial Sequence
  Synthetic
ccagtagttagtagactggaggtgttgtttgatctagtagattcattggcaaaaaccttaggtgacacaatatac

SEQ ID NO: 18227 - DNA, 75 bp, Artificial Sequence
  Synthetic
gcaatgcgtgttggtgcaatgctatctatcctcagcgcacacgccagcaacatgcggagccatgtcgcacttgca

SEQ ID NO: 18228 - DNA, 75 bp, Artificial Sequence
  Synthetic
ccaccagaaccagaccattcgtttcactgggcgcagcaatgtgactgacgggagagcacgccagatgtatgcgat

SEQ ID NO: 18229 - DNA, 75 bp, Artificial Sequence
  Synthetic
ttatttggacacccaatgttaactgcaccggatgcagcagccaaagtaaggaaagcaatgtgtgctccaaaactt

SEQ ID NO: 18230 - DNA, 75 bp, Artificial Sequence
  Synthetic
gagacattgaggacaattacccgaccgacatgtctgagctgctcaacatggtttacagtgttgcaactcagatct

SEQ ID NO: 18231 - DNA, 75 bp, Artificial Sequence
  Synthetic
gggtggcagccatgaagagcatgactgctccagacacatcctcagagtctgaagggaggcggttggccaaataca

SEQ ID NO: 18232 - DNA, 75 bp, Artificial Sequence
  Synthetic
tacgattttagctcctgcaactcgcggtgaatgcacccggataatacggagctccctagtcatccgccactttct

SEQ ID NO: 18233 - DNA, 75 bp, Artificial Sequence
  Synthetic
agaattcaagaagagcatagactacgatcttcacgacgacttaagtactttcttaaaggatagagcaatttgccg

SEQ ID NO: 18234 - DNA, 75 bp, Artificial Sequence
  Synthetic
gccaaaatcccagtgggatgttatattccgtaagtctttacgcagatcccacacgcggtcccagtatatggacga

SEQ ID NO: 18235 - DNA, 75 bp, Artificial Sequence
  Synthetic
ttgggattggaaccaagtactccacacttgcagtttcagcactgtccgccgacatgaagaaactacagagcttga

SEQ ID NO: 18236 - DNA, 75 bp, Artificial Sequence
  Synthetic
gaagactccgaccttatgagcttcgcccctggaaactatccactcatgtattcatatgcaatgggagtagggtcc

SEQ ID NO: 18237 - DNA, 75 bp, Artificial Sequence
  Synthetic
taggcaactcaaaatctcagatcgcaaccagcaacccatctcggcatcactcaacaaccaatcagatgtcactct

SEQ ID NO: 18238 - DNA, 75 bp, Artificial Sequence
  Synthetic
aaccagcaacccatctcggcatcactcaacaaccaatcagatgtcactctcaaatcggaaaacggttgtagcaac

SEQ ID NO: 18239 - DNA, 75 bp, Artificial Sequence
  Synthetic
cacttgatgagaatctagcgaaggagctgcaactatccggggctgaacggagggctgtgcaggaacttgtgacca

SEQ ID NO: 18240 - DNA, 75 bp, Artificial Sequence
  Synthetic
gcctggacctagctggagaggccccagtgccccagcgtcaaccaacattcctcaatgaccaggagtatgaggatg

SEQ ID NO: 18241 - DNA, 75 bp, Artificial Sequence
  Synthetic
ctcaatgaccaggagtatgaggatgatccccccgctaggagacagagaattgaggacactccagacgatgatgga

SEQ ID NO: 18242 - DNA, 75 bp, Artificial Sequence
  Synthetic
gccagtcaagctccacccacaccgggagcaggtctcaccccatactctgataatgccagtggcctggacatctaa

SEQ ID NO: 18243 - DNA, 75 bp, Artificial Sequence
  Synthetic
tgatccttactcgcctcctgaagatccaacactagaggatatagataaagcaccaaatgacgatatcttcatagt

SEQ ID NO: 18244 - DNA, 75 bp, Artificial Sequence
  Synthetic
gagcaggtctcaccccatactctgataatgccagtggcctggacatctaaacgaccagtacttagtataacaatt

SEQ ID NO: 18245 - DNA, 75 bp, Artificial Sequence
  Synthetic
aatcacatgtagactttaagaaaaaacaagggtgagggggaagttcctggtgcgcgggctaggcccatagtgacc

SEQ ID NO: 18246 - DNA, 75 bp, Artificial Sequence
  Synthetic
aagtaatagctatcaccaaagaactattcagaggagagaaagcctgtgatgtcagagatgagttagacgagctcg

SEQ ID NO: 18247 - DNA, 75 bp, Artificial Sequence
  Synthetic
acaagggtgagggggaagttcctggtgcgcgggctaggcccatagtgacccggcctgcaccatggacttctccaa

SEQ ID NO: 18248 - DNA, 75 bp, Artificial Sequence
  Synthetic
gcatccaacatgccgagacccagccagcacacactgttggcaaatcagccattcggaaaggaaatacatccgaac

SEQ ID NO: 18249 - DNA, 75 bp, Artificial Sequence
  Synthetic
agcacacactgttggcaaatcagccattcggaaaggaaatacatccgaactgcgagcagcctgggaagccgagac

SEQ ID NO: 18250 - DNA, 75 bp, Artificial Sequence
  Synthetic
cccgggatcccgacagtaagggcaacacggaaaacttgcaaccacgatccaatgcagaagagacgccccaaccag

SEQ ID NO: 18251 - DNA, 75 bp, Artificial Sequence
  Synthetic
aacctagtctacatcatgactcaaattctttttgatgagcattactcgattgtatgcgatcacaatagtgtcaaa

SEQ ID NO: 18252 - DNA, 75 bp, Artificial Sequence
  Synthetic
cacggaaaacttgcaaccacgatccaatgcagaagagacgccccaaccagaaagccacgacaggcaagccgttgc

SEQ ID NO: 18253 - DNA, 75 bp, Artificial Sequence
  Synthetic
ctgctctaaaaaagctagaaaaacaagggaaaggtcccgggaaaggccaagtggatcgcaacacccctcagagag

SEQ ID NO: 18254 - DNA, 75 bp, Artificial Sequence
  Synthetic
gtggatcgcaacacccctcagagagatccaaccactgcctcgggttcaaaaaaggggaaagggggcgagctaagg

SEQ ID NO: 18255 - DNA, 75 bp, Artificial Sequence
  Synthetic
ctggcgcagcaagcatcacaggagataactcgccatgcgctgcaaccccaggactccggcggcatagaagggaat

SEQ ID NO: 18256 - DNA, 75 bp, Artificial Sequence
  Synthetic
ccagtctgtgcacctgtcacacctgaacccagagcattcaaatgcacttgcgggagatgccctcgagtatgcatc

SEQ ID NO: 18257 - DNA, 75 bp, Artificial Sequence
  Synthetic
aactatcattagaacatctctagtcaatctaccagtgtctaggaagaaatgcgaaaaaataatcaattattctct

SEQ ID NO: 18258 - DNA, 75 bp, Artificial Sequence
  Synthetic
cgggagatgccctcgagtatgcatcaactgtcgcaacgatagtggagactctgaaatttgtagtgagcaggttag

SEQ ID NO: 18259 - DNA, 75 bp, Artificial Sequence
  Synthetic
caattatattgctgagtgtcatgactccttacttagtcagatctgcttcagtgataataaggaatacttgtggtc

SEQ ID NO: 18260 - DNA, 75 bp, Artificial Sequence
  Synthetic
cagcaaatcaaagcagacatgcagattgtaaagacatcctgcgctgtcattgagggccaacttgccacagtgcaa

SEQ ID NO: 18261 - DNA, 75 bp, Artificial Sequence
  Synthetic
atactggagccgggccactcatcaattcgctcccttgaggaaatgaagcaatacaccaagccaggaattgtcgtc

SEQ ID NO: 18262 - DNA, 75 bp, Artificial Sequence
  Synthetic
cgtaaaagatgctcttgcccgcccagtcaatccggacaagtggtcagcaacaatcaatgctcaatcaacaacaac

SEQ ID NO: 18263 - DNA, 75 bp, Artificial Sequence
  Synthetic
caatcaatgctcaatcaacaacaacaaaggtaacccaggaagatataaagacagtgtatacactattggacaatt

SEQ ID NO: 18264 - DNA, 75 bp, Artificial Sequence
  Synthetic
caaaaacagaggagcgtaaaacagcttcaatggcagcaataaaaggaatgtcacatcacctgcgtgcagtcttaa

SEQ ID NO: 18265 - DNA, 75 bp, Artificial Sequence
  Synthetic
gtcagcgaccgggacgcactagtaaggattaagaaacgtgttatgaatgcataagcagacaaaagatcacaacaa

SEQ ID NO: 18266 - DNA, 75 bp, Artificial Sequence
  Synthetic
cagcattcttttctcctgatcacacccaacaaattgctttggacactcttgacgctgattaataaaaaagtgagg

SEQ ID NO: 18267 - DNA, 75 bp, Artificial Sequence
  Synthetic
caaacacccgccagttcctccgccgacacagcgcaccaccgactgtcccgacccagaccatggccacgtcagaac

SEQ ID NO: 18268 - DNA, 75 bp, Artificial Sequence
  Synthetic
actagacataagtttagtgaacccgccaagacatcagaccccggagctgactagcacaacaaccaacccgttcct

SEQ ID NO: 18269 - DNA, 75 bp, Artificial Sequence
  Synthetic
accccaggtgagattgctagcattccccatcatcatgaaacccaaagaaaatggggttagagagctgcaaccgca

SEQ ID NO: 18270 - DNA, 75 bp, Artificial Sequence
  Synthetic
ccaagacatcagaccccggagctgactagcacaacaaccaacccgttcctatatgatcagctcccactaaatcag

SEQ ID NO: 18271 - DNA, 75 bp, Artificial Sequence
  Synthetic
actgaggactcagtacctcggtgacattaccggagggaagaaaagcgcgatatttgtgaattgttatgggttcgt

SEQ ID NO: 18272 - DNA, 75 bp, Artificial Sequence
  Synthetic
tgaagatcacggggggcgagatagcggattctcacccatcagtgaagaatccaaaggatcgacagtcactgcagc

SEQ ID NO: 18273 - DNA, 75 bp, Artificial Sequence
  Synthetic
gcagaattgtcaacaccgggatccataaccagattaagggcccatatgtggcaacaacagatttcatagctgcaa

SEQ ID NO: 18274 - DNA, 75 bp, Artificial Sequence
  Synthetic
ctctcgtgttgtcagggcagggggctgtgtggttgcagcagagggtgcaatcaagtgccccgagaagatgacatc

SEQ ID NO: 18275 - DNA, 75 bp, Artificial Sequence
  Synthetic
caactttaagcgcacagacagacggggagtagaccgatcggtggagaacatcagaaacaaagtacgggccatggg

SEQ ID NO: 18276 - DNA, 75 bp, Artificial Sequence
  Synthetic
atcctaatatagatgcattggtttcaaatctctacttcaccaccagacgtgttttatcaaacctcagatcatgtg

SEQ ID NO: 18277 - DNA, 75 bp, Artificial Sequence
  Synthetic
tggggtcccacacttgtttgtgaagctacagggaagatgagcaagtacgcgctaggtttcttctcggagaccaag

SEQ ID NO: 18278 - DNA, 75 bp, Artificial Sequence
  Synthetic
tccataaattcctaactccggataacgcgcctggatcattgatcccattctctatttcaccaaattcgcttgcat

SEQ ID NO: 18279 - DNA, 75 bp, Artificial Sequence
  Synthetic
tcagcgaaggccatcatacaggcctcctctgctcgtgccctattgacatcagaggacatagaagccaagggagcc

SEQ ID NO: 18280 - DNA, 75 bp, Artificial Sequence
  Synthetic
cagtgtactcactggcatatgttcagctgtgccttccttgataatcactaaatcaatacgcagtgtgctctctga

SEQ ID NO: 18281 - DNA, 75 bp, Artificial Sequence
  Synthetic
aacttcctaactattccttccttagaagtcctgtcatattaatcaaaaaaatcagtttgctggtcaagtcgtaca

SEQ ID NO: 18282 - DNA, 75 bp, Artificial Sequence
  Synthetic
aattgtgatgtggaatttgaccgtggtatgccgattgaacgggttattcagggttacactcatatcttacttgtt

SEQ ID NO: 18283 - DNA, 75 bp, Artificial Sequence
  Synthetic
tactgcagcaggggatcatgagtgcgaccgagagagaaatcaaagtgtacacgaactccataaccggaagtattg

SEQ ID NO: 18284 - DNA, 75 bp, Artificial Sequence
  Synthetic
gaccgagagagaaatcaaagtgtacacgaactccataaccggaagtattgctgtgagattaattcccaacctacc

SEQ ID NO: 18285 - DNA, 75 bp, Artificial Sequence
  Synthetic
cccttaatcgaatttttacacctattaaggcgaaccttgagaggttactggccacaccaagtatgcttgaagaca

SEQ ID NO: 18286 - DNA, 75 bp, Artificial Sequence
  Synthetic
tctgattggagcaattataggcacagcagcactggggctagcaacagcagctcaggttacagctgctcttgccct

SEQ ID NO: 18287 - DNA, 75 bp, Artificial Sequence
  Synthetic
taacaaaaacaaacgaggctgtgcttgagcttaaagatgcaacagggcaaattgcaatagcgctagataagactc

SEQ ID NO: 18288 - DNA, 75 bp, Artificial Sequence
  Synthetic
tttcatggtcagatatgataacaatctctgaattttgcaagaaatccaagcggcctatatttattaaacgagtaa

SEQ ID NO: 18289 - DNA, 75 bp, Artificial Sequence
  Synthetic
cggcctatatttattaaacgagtaatagggaatcaacggctgaaatcattctttaatgaaagctcaagtattgtt

SEQ ID NO: 18290 - DNA, 75 bp, Artificial Sequence
  Synthetic
caagttgaaataatttctgtgttttttaaggggtatagtattctaagttgcacttgaagtaatatagcttgtaat

SEQ ID NO: 18291 - DNA, 75 bp, Artificial Sequence
  Synthetic
cattcgctaggggatagaataattcctataatctctgaatatatatctctaggttataacaaatatatacataat

SEQ ID NO: 18292 - DNA, 75 bp, Artificial Sequence
  Synthetic
aatattcttcttgccagatgattatggagggtctagcctaacttaaaacaatcgtattcgatagggaagaatgac

SEQ ID NO: 18293 - DNA, 75 bp, Artificial Sequence
  Synthetic
atcgtattcgatagggaagaatgacatataaagtaactaataaaaaattgtattagtgaaaattaccgtatttcc

SEQ ID NO: 18294 - DNA, 75 bp, Artificial Sequence
  Synthetic
tgctaattgtaaggccaccatctgccgatgtctagcccctgagatgataataactcaaaacaagggactccctct

SEQ ID NO: 18295 - DNA, 75 bp, Artificial Sequence
  Synthetic
ctctgcagatcgaagctcaagttagtgggtcgtattccaggaatataacggtcgggaacagccaaattgccccgt

SEQ ID NO: 18296 - DNA, 75 bp, Artificial Sequence
  Synthetic
ggagagcacgccagatgtatgcgattgcccaagatctgcctccctcctataacaatggcagcccttttgtaaata

SEQ ID NO: 18297 - DNA, 75 bp, Artificial Sequence
  Synthetic
agagcaatcagctcttaaatagggtgaatccaaacatagtaaacaacaccgcaatcatagtcacaatagtactgc

SEQ ID NO: 18298 - DNA, 75 bp, Artificial Sequence
  Synthetic
gtatcaaaacacgctgtgcggatgataaagacagttccgaatccgtatgtaatgcaagcaaagtcgccaggaagt

SEQ ID NO: 18299 - DNA, 75 bp, Artificial Sequence
  Synthetic
ggtcctaatgattaaaccacatacttgattacatgataaaaatatgttgagagatgacgttgatgagacccttta

SEQ ID NO: 18300 - DNA, 75 bp, Artificial Sequence
  Synthetic
tcctttgttttaatcaaaaaatgcagaataatctaacagcccaaccaaactacctggaaaaaaacgcccgagggg

SEQ ID NO: 18301 - DNA, 75 bp, Artificial Sequence
  Synthetic
ggaaggaggttgactgcgacctcaattgatcagaggttgcagcactaactctttacaaccctcaagatgagacca

SEQ ID NO: 18302 - DNA, 75 bp, Artificial Sequence
  Synthetic
cccgggatcccgacagcaagggcaacacgggaaattcgcaaccacgatccaatgcagaggagacaccccaaccag

SEQ ID NO: 18303 - DNA, 75 bp, Artificial Sequence
  Synthetic
tccacccccagacaccacaataggggtcaacgggaccaatgggcttgaagctgctctaaaaaagctagaaaaaca

SEQ ID NO: 18304 - DNA, 75 bp, Artificial Sequence
  Synthetic
ctcttatcatgtcgtttgcgctgacttgctcaataagtgggtgcgttcttagcctggttgcattatatccaagca

SEQ ID NO: 18305 - DNA, 75 bp, Artificial Sequence
  Synthetic
ttgctcaataagtgggtgcgttcttagcctggttgcattatatccaagcaagaacactgatggcactaacactca

SEQ ID NO: 18306 - DNA, 75 bp, Artificial Sequence
  Synthetic
cactcagaagccctctcatgccagactggcgcagcaagcatcacaggagataactcgccatgcgctgcaacccca

SEQ ID NO: 18307 - DNA, 75 bp, Artificial Sequence
  Synthetic
acacaaacaataggccagcgacccctcccccaccgtattatgtagcaatacaactcagcgctgagatgcaacccg

SEQ ID NO: 18308 - DNA, 75 bp, Artificial Sequence
  Synthetic
caactcagcgctgagatgcaacccgggtaccatccaggtgattgatccccctaacatgctggcagagtctacccc

SEQ ID NO: 18309 - DNA, 75 bp, Artificial Sequence
  Synthetic
tcaggcaactctatatgagggtgaccctaatagcaaaaggacatggaggaccgtgtaccgggttatcaccatatt

SEQ ID NO: 18310 - DNA, 75 bp, Artificial Sequence
  Synthetic
gtcagtgaccgggacgcactagtaaggattaagaaacgtgttatgaatgcataagcagccaaaagatcacaacaa

SEQ ID NO: 18311 - DNA, 75 bp, Artificial Sequence
  Synthetic
ccgtgtaccgggttatcaccatattgttggatataaccgtcctttgtgtcggcatagtggcagtagtcaggatgt

SEQ ID NO: 18312 - DNA, 75 bp, Artificial Sequence
  Synthetic
ggattaagaaacgtgttatgaatgcataagcagccaaaagatcacaacaattagtacagatggcctcccaatatc

SEQ ID NO: 18313 - DNA, 75 bp, Artificial Sequence
  Synthetic
tccctgagtgtcgattaccagccaatatggtcagatacccatcagaaagtcaacagtattttcaaggaagtcgga

SEQ ID NO: 18314 - DNA, 75 bp, Artificial Sequence
  Synthetic
tatggtcagatacccatcagaaagtcaacagtattttcaaggaagtcggaatcaccatccccgtcacactcgaca

SEQ ID NO: 18315 - DNA, 75 bp, Artificial Sequence
  Synthetic
gacactgattaataaaaaagtgagggggaactggtggtgtccggactgggcaatccagggtcacccggtccgaat

SEQ ID NO: 18316 - DNA, 75 bp, Artificial Sequence
  Synthetic
atggggttagagagctgcaaccgcaactgaggactcagtacctcggtgacattaccggaggaaagaaaagcgcga

SEQ ID NO: 18317 - DNA, 75 bp, Artificial Sequence
  Synthetic
aggcaactacaaggagtcaatgggtcagcaggatttagcattaccaattcaccagaatatagtggagggatagac

SEQ ID NO: 18318 - DNA, 75 bp, Artificial Sequence
  Synthetic
accagaatatagtggagggatagacacactgatatatcctcttaactcacttaacgggaaggctttagctgtatc

SEQ ID NO: 18319 - DNA, 75 bp, Artificial Sequence
  Synthetic
gttgcacccgcattcctacattccacctaggataccgtcattggtgttatagtcacaacacaatagaatctggtt

SEQ ID NO: 18320 - DNA, 75 bp, Artificial Sequence
  Synthetic
cctaggataccgtcattggtgttatagtcacaacacaatagaatctggttgtcacgatgcaggagaaagcattat

SEQ ID NO: 18321 - DNA, 75 bp, Artificial Sequence
  Synthetic
tccgctctaatagcagtacaggccgaagtgaagctgggattcgatctgccactagaccatccaatggcaaaatat

SEQ ID NO: 18322 - DNA, 75 bp, Artificial Sequence
  Synthetic
agatgatggaaagaacaggaaaagttgtagcatcatagcaaaccctaatgggtgtgatgtcttgtgtagcttggt

SEQ ID NO: 18323 - DNA, 75 bp, Artificial Sequence
  Synthetic
cacatacaccgagtctgaactcaaccctggcctattcaataatcattgggtcgctcaatatccagcagttggtag

SEQ ID NO: 18324 - DNA, 75 bp, Artificial Sequence
  Synthetic
ggcaaagtagtcatctgaatctcatcagtggacccactggcatatgttcagctgtgccttccttgataatcacta

SEQ ID NO: 18325 - DNA, 75 bp, Artificial Sequence
  Synthetic
caccgaagtcaaaactgttcaacgagcttaagtcatttgcttacttcacccataatgccgaattgaaatgtgaga

SEQ ID NO: 18326 - DNA, 75 bp, Artificial Sequence
  Synthetic
tggatcatttatactttgaagattgaacttcctaactattccttccttagaagtcctgtcatattaatcaaaaaa

SEQ ID NO: 18327 - DNA, 75 bp, Artificial Sequence
  Synthetic
aaaatagcaggatccctctgggctcaaggggttgtaacatgtaatctgaccaatctagctgattgtaaagttgca

SEQ ID NO: 18328 - DNA, 75 bp, Artificial Sequence
  Synthetic
ggagcccgactggggcccttagcaatggcacccggccggtatgtgatcattttcaatctcatccttctccatagg

SEQ ID NO: 18329 - DNA, 75 bp, Artificial Sequence
  Synthetic
atccacaatctaaatttccgaggcccacctggacaaagggcgtatgcgagaaaccggcaatatgccccgctgtgt

SEQ ID NO: 18330 - DNA, 75 bp, Artificial Sequence
  Synthetic
ttgggtagtcagtatagggtcccagagcaatgagactgttgtagttggcggatacttagatgctgcagcagcccg

SEQ ID NO: 18331 - DNA, 75 bp, Artificial Sequence
  Synthetic
gatacttagatgctgcagcagcccgtcaggatccatggattgcagcagctaaccagtataactggctggttaggc

SEQ ID NO: 18332 - DNA, 75 bp, Artificial Sequence
  Synthetic
tcaggatccatggattgcagcagctaaccagtataactggctggttaggcgtcgcctttttacatcccaaactga

SEQ ID NO: 18333 - DNA, 75 bp, Artificial Sequence
  Synthetic
tgttctgcctgactataatggaagttacagacaacctacttggagactggaggatcgccccgctgttatatgaga

SEQ ID NO: 18334 - DNA, 75 bp, Artificial Sequence
  Synthetic
tacagacaacctacttggagactggaggatcgccccgctgttatatgagattactgtggctgataagcaacaggg

SEQ ID NO: 18335 - DNA, 75 bp, Artificial Sequence
  Synthetic
cagtatgaccaagcaagccaaatcatggttattcaggtctctgtgcccagcatatcatcaatttcggggttgcga

SEQ ID NO: 18336 - DNA, 75 bp, Artificial Sequence
  Synthetic
attacacaccaggtgataaatatactcctcagcattgatgattcactgcagcttgtacacaacaattctcttact

SEQ ID NO: 18337 - DNA, 75 bp, Artificial Sequence
  Synthetic
gcttgtacacaacaattctcttacttcctctatttgcagggtaaatcagaagaatggcggtcagtgattgaccga

SEQ ID NO: 18338 - DNA, 75 bp, Artificial Sequence
  Synthetic
tcctctatttgcagggtaaatcagaagaatggcggtcagtgattgaccgagctcaattagatggtgacatatagc

SEQ ID NO: 18339 - DNA, 75 bp, Artificial Sequence
  Synthetic
tagtcgcacaatgtctccgaggggatgagtctagatgccaatatacgactggaataggtatgcttgaatctcgat

SEQ ID NO: 18340 - DNA, 75 bp, Artificial Sequence
  Synthetic
agtatcaacaagtcaattctgctcacagaggtcacctggaagggctgctgtgatggatccacaagtccaaataca

SEQ ID NO: 18341 - DNA, 75 bp, Artificial Sequence
  Synthetic
tgatggatccacaagtccaaatacatcacatcatcaagccagagtgccatctcaactcacctgtggtggagaaga

SEQ ID NO: 18342 - DNA, 75 bp, Artificial Sequence
  Synthetic
ctcaactcacctgtggtggagaagaaactgacgctgttatggaagctcacaggtttaccgttgccacctgacctt

SEQ ID NO: 18343 - DNA, 75 bp, Artificial Sequence
  Synthetic
aggtttaccgttgccacctgaccttaacagttgtgttacacacagggatgtgacgtgggatgaagtgctccggtt

SEQ ID NO: 18344 - DNA, 75 bp, Artificial Sequence
  Synthetic
tacccaggaaaaaacgcctgaggggggaaggaggttgactgcaacctcaattgatcagaggttgcagcactaact

SEQ ID NO: 18345 - DNA, 75 bp, Artificial Sequence
  Synthetic
atagaatgcatgaaagaggggagtttattgacacatacaagcctttatgccatccacgtacattaagttggttga

SEQ ID NO: 18346 - DNA, 75 bp, Artificial Sequence
  Synthetic
ctaatatcagcctgattaagagtgacaacattctagcaggccataagaaaatgctagtccggattggcagtatgt

SEQ ID NO: 18347 - DNA, 75 bp, Artificial Sequence
  Synthetic
ggaggctgcaatttgtggtcacccataagcgatccagccctggtcacaggtggtgaatatgccaactgtgtgtat

SEQ ID NO: 18348 - DNA, 75 bp, Artificial Sequence
  Synthetic
caactcagcgctgagatgcaacctgggtaccatccaggtgattgatcctcctaacatgctggcagagtctacccc

SEQ ID NO: 18349 - DNA, 75 bp, Artificial Sequence
  Synthetic
gcgtggtacttaatacgtcaaaccatgcggtacatggccctccagagaaagcaaacaagagtgcaatcacagcag

SEQ ID NO: 18350 - DNA, 75 bp, Artificial Sequence
  Synthetic
aatgtcctaattggatcagatacaatcgttggaatccatccagaactagtgataattactggaattagagacagg

SEQ ID NO: 18351 - DNA, 75 bp, Artificial Sequence
  Synthetic
ggaaggccgtgccatgacgaagttggtcgcactcaccgagccgacaatggtagaagtcattcagagagtcgaaaa

SEQ ID NO: 18352 - DNA, 75 bp, Artificial Sequence
  Synthetic
tgagataaggagtgagctagagaaccatttagatcctggtatggcatttagagtagttgagcaggtgcggttgtt

SEQ ID NO: 18353 - DNA, 75 bp, Artificial Sequence
  Synthetic
ttcttcccgctttacggagggatatcaccgaagtcaaaactgttcaacgagcttaagtcatttgcttacagcacc

SEQ ID NO: 18354 - DNA, 75 bp, Artificial Sequence
  Synthetic
cgctgtgaaggcggcaaagaaagtcagagaatcgatgtgtgcaccgaaattaacctctctagataccacactcaa

SEQ ID NO: 18355 - DNA, 75 bp, Artificial Sequence
  Synthetic
agagaatcgatgtgtgcaccgaaattaacctctctagataccacactcaaagtgttagcattctttattgcagat

SEQ ID NO: 18356 - DNA, 75 bp, Artificial Sequence
  Synthetic
acaagagtcacttgtgtccccattgctccagaacctctatagagaatccgccgagcttcaatacgcgattgtgct

SEQ ID NO: 18357 - DNA, 75 bp, Artificial Sequence
  Synthetic
ctccagaacctctatagagaatccgccgagcttcaatacgcgattgtgcttaagcactatagagaagtatccctt

SEQ ID NO: 18358 - DNA, 75 bp, Artificial Sequence
  Synthetic
gttccttaaggataaagccatctgtcgaccaaagagtaactggttagctgtattcaggaagtccctactccccgg

SEQ ID NO: 18359 - DNA, 75 bp, Artificial Sequence
  Synthetic
tgacccggctaaggagtttgagtatgtgacatcactggagtaccttcaggatccagagttctgcgcatcttattc

SEQ ID NO: 18360 - DNA, 75 bp, Artificial Sequence
  Synthetic
tcctctatttgcagagtaaatcagaagaatgacggtcggtgattgaccgaactcaattagatggtgacatatagc

SEQ ID NO: 18361 - DNA, 75 bp, Artificial Sequence
  Synthetic
ctagaaaaatgaggaactgtcaagtcttgctagagagtttgcttgcatgtcacgtatgcgattacttcaaagaga

SEQ ID NO: 18362 - DNA, 75 bp, Artificial Sequence
  Synthetic
acggagtagtgcaagagcaaatcagtttaacgaaatcactacttgcgatgtcgcaactcgctcctcgtgtgtctg

SEQ ID NO: 18363 - DNA, 75 bp, Artificial Sequence
  Synthetic
agattgacggggcaagacccgcggagacaacgaatgcagtgagggggaaggcaggctgggatcacgtcccagttg

SEQ ID NO: 18364 - DNA, 75 bp, Artificial Sequence
  Synthetic
tcgcaactcgctcctcgtgtgtctgagtatcaagggagagttctccgttcaactgataggtgcagtagagctaca

SEQ ID NO: 18365 - DNA, 75 bp, Artificial Sequence
  Synthetic
agtatcaagggagagttctccgttcaactgataggtgcagtagagctacagctacacctaggcaggacacaagcc

SEQ ID NO: 18366 - DNA, 75 bp, Artificial Sequence
  Synthetic
tttgggataccccacggttttgagtggattcacctccgcttgatgaatacgaccatgtttgtaggagacccacat

SEQ ID NO: 18367 - DNA, 75 bp, Artificial Sequence
  Synthetic
atagaatgcatgaaagaggggagtttattgacacatataaacctttatgccatccacgtacgttaaattggttga

SEQ ID NO: 18368 - DNA, 75 bp, Artificial Sequence
  Synthetic
tggaatatttattgtgtcacctcggggtggtatagaagggctatgccaaaaaatgtggaccatgatctccattgc

SEQ ID NO: 18369 - DNA, 75 bp, Artificial Sequence
  Synthetic
ggtggtatagaagggctatgccaaaaaatgtggaccatgatctccattgctgcaattcatctagcagccacagaa

SEQ ID NO: 18370 - DNA, 75 bp, Artificial Sequence
  Synthetic
tgcatgaaccaacagaccaattgtttgtcactcttggcaggaaattagcaggtgacccttgcttgttccatcaac

SEQ ID NO: 18371 - DNA, 75 bp, Artificial Sequence
  Synthetic
ggttaaaagaaatatctgagaggttttttagagtattcagagagataaacagaggtatagggcacaacttaaaag

SEQ ID NO: 18372 - DNA, 75 bp, Artificial Sequence
  Synthetic
aactacttaaaaatgcaagtaggttagtgttggtatctgagactgtgggtgagaactgtgtcggcaactgctcaa

SEQ ID NO: 18373 - DNA, 75 bp, Artificial Sequence
  Synthetic
gtcgcatgggggctcaatatcctaatgatcgtaaaacaaattctttttgacattgatttttccttggagcctgaa

SEQ ID NO: 18374 - DNA, 75 bp, Artificial Sequence
  Synthetic
tgatcgtaaaacaaattctttttgacattgatttttccttggagcctgaaccatctcaaggcttgattcatgcta

SEQ ID NO: 18375 - DNA, 75 bp, Artificial Sequence
  Synthetic
cattgatttttccttggagcctgaaccatctcaaggcttgattcatgctattcgccaagatcctaacaacataaa

SEQ ID NO: 18376 - DNA, 75 bp, Artificial Sequence
  Synthetic
tatctcggctatttacaaggaacataggagaccctgtctcgtcagccatggcagatatgaagttctacatacagg

SEQ ID NO: 18377 - DNA, 75 bp, Artificial Sequence
  Synthetic
aaggaatgcaatttttagagaacccggagatggaacatggacaacactgtgcgccgacccgtactcattgaacca

SEQ ID NO: 18378 - DNA, 75 bp, Artificial Sequence
  Synthetic
tacttaaaaaagcacacacaacgcatgctgctcactgcctcaacaaatcctttattgcaaggcacccgagtagag

SEQ ID NO: 18379 - DNA, 75 bp, Artificial Sequence
  Synthetic
tgctgctcactgcctcaacaaatcctttattgcaaggcacccgagtagagaatcagtacattgaagaagaaagac

SEQ ID NO: 18380 - DNA, 75 bp, Artificial Sequence
  Synthetic
acagtctttgagaccactgttgccgggagacgaaagcatctgcaaggattgattgacaccacaccgactattatt

SEQ ID NO: 18381 - DNA, 75 bp, Artificial Sequence
  Synthetic
aactactaaaaaatgcaagtaggttagtgttggtatctgagaccgtgggtgagaattgtgtcggcaattgctcaa

SEQ ID NO: 18382 - DNA, 75 bp, Artificial Sequence
  Synthetic
aaatatgcccttcatcaccaccctatttctttcaagaaaagtatgctgatatcatcctactcagctgactacatt

SEQ ID NO: 18383 - DNA, 75 bp, Artificial Sequence
  Synthetic
tttctttcaagaaaagtatgctgatatcatcctactcagctgactacattatgtcgttcattgatactatcgcaa

SEQ ID NO: 18384 - DNA, 75 bp, Artificial Sequence
  Synthetic
ataggtgtcgacacctgcgcagtcacacttgcagattacgcgagaacatattcgtggtgggagatcctaaaggga

SEQ ID NO: 18385 - DNA, 75 bp, Artificial Sequence
  Synthetic
gagcttaatagagcaaggtcatccatgtactcagtgcacaatgggtgatgaatccttttcatggttcttcctccc

SEQ ID NO: 18386 - DNA, 75 bp, Artificial Sequence
  Synthetic
tcgcttatgtcggctcaaaaacggaagaaaggcgggcagcttcactgacaacaatcaaagggatgtcaactcacc

SEQ ID NO: 18387 - DNA, 75 bp, Artificial Sequence
  Synthetic
agaaaggcgggcagcttcactgacaacaatcaaagggatgtcaactcaccttagggcggcattaagaggagcgag

SEQ ID NO: 18388 - DNA, 75 bp, Artificial Sequence
  Synthetic
ctgatacattagaactttgctctgggagcttaatagagcaaggccatccatgtgctcagtgcacaatgggtgatg

SEQ ID NO: 18389 - DNA, 75 bp, Artificial Sequence
  Synthetic
gagcttaatagagcaaggccatccatgtgctcagtgcacaatgggtgatgaatccttttcatggttcttcctccc

SEQ ID NO: 18390 - DNA, 75 bp, Artificial Sequence
  Synthetic
ccaagctcgctaacacaagatgtgtaatatctgaagaccatctacgtgccctttgcccaatcccaagttcagcaa

SEQ ID NO: 18391 - DNA, 75 bp, Artificial Sequence
  Synthetic
aatatctgaagaccatctacgtgccctttgcccaatcccaagttcagcaaacatacagcatagactgatggatgg

SEQ ID NO: 18392 - DNA, 75 bp, Artificial Sequence
  Synthetic
tcagagtagaattgacggtcaagtgatcgaatcaaatgtgattttccaacaggttatgctcctcggtctcggcat

SEQ ID NO: 18393 - DNA, 75 bp, Artificial Sequence
  Synthetic
caaaactacaggtatcttcattcaagtactgtgagatgggcctcgaagtgcttgacccaccaggacttgtaacct

SEQ ID NO: 18394 - DNA, 75 bp, Artificial Sequence
  Synthetic
cactccacttacacacagggtactcatgttgcataagagaagctgataatggtgatttcttagaatccccggcta

SEQ ID NO: 18395 - DNA, 75 bp, Artificial Sequence
  Synthetic
atgttgcataagagaagctgataatggtgatttcttagaatccccggctagtgtaccagacatgactatcacgac

SEQ ID NO: 18396 - DNA, 75 bp, Artificial Sequence
  Synthetic
caaaactacaggtatcttcgtttaagtactgtgagatgggcctcgaaatgcttgacccaccaggattagtaacct

SEQ ID NO: 18397 - DNA, 75 bp, Artificial Sequence
  Synthetic
ctgagagttaaagggcgacgggcaatccgggattatatccgtcaagccctctcgaggataccagggttacagctc

SEQ ID NO: 18398 - DNA, 75 bp, Artificial Sequence
  Synthetic
ctcgaggataccagggttacagctcgctaatatagccttgactatatctcatccgggaatttgggcaagactgag

SEQ ID NO: 18399 - DNA, 75 bp, Artificial Sequence
  Synthetic
attatcctgctgctgtgtgtgagctcatactatggggttacgaccaatatactgcacaactactagatggttatg

SEQ ID NO: 18400 - DNA, 75 bp, Artificial Sequence
  Synthetic
taaggatgatgacttgaacaggaaggttgaacatatactagcgagacgggcttgtctgctgagtctgctgtgtga

SEQ ID NO: 18401 - DNA, 75 bp, Artificial Sequence
  Synthetic
aaagaccttgaacctattgagaaatgcactgccctgtctgacctgaataaattgtggatggcgacagatcacaga

SEQ ID NO: 18402 - DNA, 75 bp, Artificial Sequence
  Synthetic
ggcttacgttgaaaacctttatgaagatattgacattgaactaacatctctcactgaggttgtacccttaggaga

SEQ ID NO: 18403 - DNA, 75 bp, Artificial Sequence
  Synthetic
agattattatttaataaaaaacctggaaagtcgacaaggatcatagtcaaaaagcttatgatttccttgtttggt

SEQ ID NO: 18404 - DNA, 75 bp, Artificial Sequence
  Synthetic
tatcttgctgagtcatcaggggccattatgactgtgatggagcatcttgtctgctctaataaaatctggtataac

SEQ ID NO: 18405 - DNA, 75 bp, Artificial Sequence
  Synthetic
ataaccctcgccttacattgcctaatgattagcggaaaattagtactaaagttgtatttctcacaaaatgcctta

SEQ ID NO: 18406 - DNA, 75 bp, Artificial Sequence
  Synthetic
tgattagcggaaaattagtactaaagttgtatttctcacaaaatgccttattacaccatgttctctccttgttac

SEQ ID NO: 18407 - DNA, 75 bp, Artificial Sequence
  Synthetic
gttgtatttctcacaaaatgccttattacaccatgttctctccttgttacttgtattaccatttcatgtgacaat

SEQ ID NO: 18408 - DNA, 75 bp, Artificial Sequence
  Synthetic
ccacaaggacaggggttgctctgggttcaaatgtgtcccaagtcctaggcagtgtgactgagatggtacggaaag

SEQ ID NO: 18409 - DNA, 75 bp, Artificial Sequence
  Synthetic
atcgtgtagcattccgcagtcggctaccgacatgttcctcattcaacttggagggaaggtgcagtcagattggaa

SEQ ID NO: 18410 - DNA, 75 bp, Artificial Sequence
  Synthetic
accgacatgttcctcattcaacttggagggaaggtgcagtcagattggaatacaaactctcgaggctatagagtg

SEQ ID NO: 18411 - DNA, 75 bp, Artificial Sequence
  Synthetic
tacaaactctcgaggctatagagtgggtgataccgaactcgtattacaggacattatatcaatattgagcacact

SEQ ID NO: 18412 - DNA, 75 bp, Artificial Sequence
  Synthetic
tgctgttgcttggggcatacaacctgcaagtatccggaaaagtaagaacaatggctgcggctgcaactagaaaca

SEQ ID NO: 18413 - DNA, 75 bp, Artificial Sequence
  Synthetic
gcaagtatccggaaaagtaagaacaatggctgcggctgcaactagaaacatattgcatctccatatagttagact

SEQ ID NO: 18414 - DNA, 75 bp, Artificial Sequence
  Synthetic
agggctttatagtaatatcagacatgtatagtgtgaaagatttcttgagaaaaactgagtcccccaagtacttct

SEQ ID NO: 18415 - DNA, 75 bp, Artificial Sequence
  Synthetic
tgcacagatatttgagatagagtccaagattattctgagcagggcagagatcaagaatattttgaaaatgatagg

SEQ ID NO: 18416 - DNA, 75 bp, Artificial Sequence
  Synthetic
tcaagaatattttgaaaatgatagggattgtcgcaaaacagcactcagagtaatctcttcaactttgcgccgctt

SEQ ID NO: 18417 - DNA, 75 bp, Artificial Sequence
  Synthetic
gattgtcgcaaaacagcactcagagtaatctcttcaactttgcgccgcttgaattctgaactgtggacgcgcatg

SEQ ID NO: 18418 - DNA, 75 bp, Artificial Sequence
  Synthetic
caccaatcatctggaacttacttacttcccgaaatcacccatagaccggtatcggtatcggagattattatttaa

SEQ ID NO: 18419 - DNA, 75 bp, Artificial Sequence
  Synthetic
atcggtatcggagattattatttaataaaaaacatggaaaatcgacaaggatcatagtaaaaaagcttatgattt

SEQ ID NO: 18420 - DNA, 75 bp, Artificial Sequence
  Synthetic
gtctagtagcttccctgctgtgccaagatgtcgtcagtgttcactgattacgctaagctgcaagatgcccttgtg

SEQ ID NO: 18421 - DNA, 75 bp, Artificial Sequence
  Synthetic
tgagggacaattagccaccgttcaaatattggagcctggccactcttccattagatcactcgacgagatgcgcca

SEQ ID NO: 18422 - DNA, 75 bp, Artificial Sequence
  Synthetic
tcggcatcaacgggcccaaaagagcaaagattgaggctgaattagcaaatgtgaaggaccgggactcactagttc

SEQ ID NO: 18423 - DNA, 75 bp, Artificial Sequence
  Synthetic
gaatcaagaaacgtatcatgaatgcgtaatcccgtgcttggttccaataagcgtcccccatcacggtcaccagaa

SEQ ID NO: 18424 - DNA, 75 bp, Artificial Sequence
  Synthetic
gagcaggtctcaccccgtactctgacaatgccagtggcctggacatctaaacgaccagtacctagtataacaatt

SEQ ID NO: 18425 - DNA, 75 bp, Artificial Sequence
  Synthetic
cccgggatcccgacagtaagggcaacacggaaaactcgcaaccacgacccaatgcagaagagacgccccaaccag

SEQ ID NO: 18426 - DNA, 75 bp, Artificial Sequence
  Synthetic
agggattcaacccgttcataaaatcagttaagtgatctgtgataattcactcccgggttgcaaccaatttgatgg

SEQ ID NO: 18427 - DNA, 75 bp, Artificial Sequence
  Synthetic
ctcactaatcaaccaatcagtgtgctcggtcagtgtggtatggtcaccgaagctaattgatcatgagtaaatcac

SEQ ID NO: 18428 - DNA, 75 bp, Artificial Sequence
  Synthetic
agctaattgatcatgagtaaatcacagctgctttaaaatttatcaaaaaatcccatgaacaattgatcaggggcc

SEQ ID NO: 18429 - DNA, 75 bp, Artificial Sequence
  Synthetic
gaaaatcgaggcggaattggctaatgtcagtgaccgggacgcactagtaaggattaagaaacgtgttatgaatgc

SEQ ID NO: 18430 - DNA, 75 bp, Artificial Sequence
  Synthetic
atgtttgtttcattgaccttcttacatcgcagcagccttttcaaagttagccgtacggtgctgtcaatgagaaat

SEQ ID NO: 18431 - DNA, 75 bp, Artificial Sequence
  Synthetic
agcaaagtagtcatctgaatctcatcagtgtacccactggcatatgttcagctgtgccttccttgataatcacta

SEQ ID NO: 18432 - DNA, 75 bp, Artificial Sequence
  Synthetic
cacactaaggaagcccagaaagaaggcagtaacaagctgaggggggaagagtgtacggtgcaacctctcttggtc

SEQ ID NO: 18433 - DNA, 75 bp, Artificial Sequence
  Synthetic
gcagtaacaagctgaggggggaagagtgtacggtgcaacctctcttggtcggaggttgtagtgctctatcacaga

SEQ ID NO: 18434 - DNA, 75 bp, Artificial Sequence
  Synthetic
accggcaattaataatctgacatgtgaagtagcaggtgctaaagtgggtgtggaactatcattatacttgaccga

SEQ ID NO: 18435 - DNA, 75 bp, Artificial Sequence
  Synthetic
tatccattcaagccctcatgtcactctgcggtaatgattttaattacctcctgaatctaatgggggccaaacact

SEQ ID NO: 18436 - DNA, 75 bp, Artificial Sequence
  Synthetic
ggcagtagtacctcagtttgttgtggaatctggccagcttcttgaagagattgacacccaggcatgcacactcac

SEQ ID NO: 18437 - DNA, 75 bp, Artificial Sequence
  Synthetic
tgttggccaccggcctagctatggtctccttagtgttctgcctgaaccaggtaatcatgcaggtgctaattaggg

SEQ ID NO: 18438 - DNA, 75 bp, Artificial Sequence
  Synthetic
ctccttagtgttctgcctgaaccaggtaatcatgcaggtgctaattagggacattggggacttgttgacatcctc

SEQ ID NO: 18439 - DNA, 75 bp, Artificial Sequence
  Synthetic
caactcagcgctgagatgcaacccgggtaccatcctggtgattgatccccataacatgctggcagagtctacccc

SEQ ID NO: 18440 - DNA, 75 bp, Artificial Sequence
  Synthetic
ttatataaaaacataatggctgagggggaagcctggtgtcaccgctggtgaccattccccagctggtggcaatgg

SEQ ID NO: 18441 - DNA, 75 bp, Artificial Sequence
  Synthetic
agacctactagaacatccgagcttcataccagcgcctaccacctctcatggttgcacccgcattcctacattcca

SEQ ID NO: 18442 - DNA, 75 bp, Artificial Sequence
  Synthetic
ttacgacaagtgcagcaacaatcctagatgatggaaggaacaggaaaagttgtagcatcatagcaaaccctaatg

SEQ ID NO: 18443 - DNA, 75 bp, Artificial Sequence
  Synthetic
tgtgcaagataggattgtcttctaccagagatcctcatcatggtggccggtcctaatatattatgatatccctat

SEQ ID NO: 18444 - DNA, 75 bp, Artificial Sequence
  Synthetic
tcctctatttgcagggtaaatcagaataatggcggtcagtgattgaccgaactcaattagatggtgacatatagc

SEQ ID NO: 18445 - DNA, 75 bp, Artificial Sequence
  Synthetic
tgtgcagcttccaacttcataccttaagaaacacactcagcgcatgttgctctcagcatcaacaaatcccctcct

SEQ ID NO: 18446 - DNA, 75 bp, Artificial Sequence
  Synthetic
aacgtcctaattggatcagatacaatcgtgggaatccacccagaactagtgataattactggaattagagacagg

SEQ ID NO: 18447 - DNA, 75 bp, Artificial Sequence
  Synthetic
gcaggtgaaatgttatgcattttacgtcactgggggcaccccttgctgtgcgctgtgaaggcggcaaagaaagtc

SEQ ID NO: 18448 - DNA, 75 bp, Artificial Sequence
  Synthetic
acatttgaaagataagctgcaatctgagggcccttctaaccggcttctgcttgattttttgcaatcaagcgaatt

SEQ ID NO: 18449 - DNA, 75 bp, Artificial Sequence
  Synthetic
actgacctacagaaatattgtctcaattggaggtacactgtagtcaaaccttttgcacagaggcttaaccagtta

SEQ ID NO: 18450 - DNA, 75 bp, Artificial Sequence
  Synthetic
tttgggataccccacggttttgagtggattcacctccgcttgatgaatacggccatgtttgtaggagacccacgt

SEQ ID NO: 18451 - DNA, 75 bp, Artificial Sequence
  Synthetic
aattactacagagatcgaagagggtgaggacgcatctgtagcatcaataaggttaaaagaaatatctgagaggtt

SEQ ID NO: 18452 - DNA, 75 bp, Artificial Sequence
  Synthetic
attctttgtgtactcgaaacggatcttctttgaggggaagatcctcagtcaactactaaaaaatgcaagtaggtt

SEQ ID NO: 18453 - DNA, 75 bp, Artificial Sequence
  Synthetic
cattgaaaatggattagataagagagtcgcatgggggctcaatatcctaatgatcgtaaaacaaattctttttga

SEQ ID NO: 18454 - DNA, 75 bp, Artificial Sequence
  Synthetic
ttccgattagagttgacggggcgacctagttggaattcgaccccggctccgaaacctctaattgtggttattggc

SEQ ID NO: 18455 - DNA, 75 bp, Artificial Sequence
  Synthetic
gaaacctctaattgtggttattggcagtctagtctacttctaacgatggcgtctatattcaatgaatatcaatca

SEQ ID NO: 18456 - DNA, 75 bp, Artificial Sequence
  Synthetic
agtctagtctacttctaacgatggcgtctatattcaatgaatatcaatcacttcaggatcagttggttaagccag

SEQ ID NO: 18457 - DNA, 75 bp, Artificial Sequence
  Synthetic
ccagtctgtgtcaccttatcgcaggatccaggtgaaagatggaatcttgcctgtctgaacctccgctggcttgta

SEQ ID NO: 18458 - DNA, 75 bp, Artificial Sequence
  Synthetic
atccaggtgaaagatggaatcttgcctgtctgaacctccgctggcttgtaagtgaatcgtctacaactcctatga

SEQ ID NO: 18459 - DNA, 75 bp, Artificial Sequence
  Synthetic
gctcatgcaactcttgcatccagagctgccgatgcctaccttaccatcctagaggtggatgaggtagatctccaa

SEQ ID NO: 18460 - DNA, 75 bp, Artificial Sequence
  Synthetic
ctgccgatgcctaccttaccatcctagaggtggatgaggtagatctccaatctggaatcctgagatttaacgcac

SEQ ID NO: 18461 - DNA, 75 bp, Artificial Sequence
  Synthetic
ttttgagacatttcaccccttgtctcacaggtttgtgactaaccccatgacactccacttacacacagggtactc

SEQ ID NO: 18462 - DNA, 75 bp, Artificial Sequence
  Synthetic
gacataccaaagtcttgtgctaatggacacccgtttatctcagatgacatcgaatccagggatcctttagacctg

SEQ ID NO: 18463 - DNA, 75 bp, Artificial Sequence
  Synthetic
gacacccgtttatctcagatgacatcgaatccagggatcctttagacctggcagaaacaatagacaggcttcagg

SEQ ID NO: 18464 - DNA, 75 bp, Artificial Sequence
  Synthetic
gacacagcagctgaatcggaagggaaaagaatagccaagtaccaacagcaaggaaggcttgtcaaacaggttatg

SEQ ID NO: 18465 - DNA, 75 bp, Artificial Sequence
  Synthetic
aaagaatagccaagtaccaacagcaaggaaggcttgtcaaacaggttatggtccactcatctgtccgtgcagaga

SEQ ID NO: 18466 - DNA, 75 bp, Artificial Sequence
  Synthetic
caatctttcttatcagctttactatctgagagttaaagggcgacgggcaatccgggattatatccgtcaagccct

SEQ ID NO: 18467 - DNA, 75 bp, Artificial Sequence
  Synthetic
gagtgtaagagagccacagccatgggtagtaacacatctcggtactatgctatggtaggtgacatcagcttatat

SEQ ID NO: 18468 - DNA, 75 bp, Artificial Sequence
  Synthetic
gtagtaacacatctcggtactatgctatggtaggtgacatcagcttatattttaagaatgcagggatgactgctt

SEQ ID NO: 18469 - DNA, 75 bp, Artificial Sequence
  Synthetic
atgagtgtcttctctggagaactaaagaagatggcatccctgatcagactctacaagaacaagggtgaaggtgca

SEQ ID NO: 18470 - DNA, 75 bp, Artificial Sequence
  Synthetic
agaagatggcatccctgatcagactctacaagaacaagggtgaaggtgcaccctatatggcatttcttgaagact

SEQ ID NO: 18471 - DNA, 75 bp, Artificial Sequence
  Synthetic
ctcagatatttgattcacccaaattaaatccgttcatcactaatctttacttcttgagtaggaagctgctcaacg

SEQ ID NO: 18472 - DNA, 75 bp, Artificial Sequence
  Synthetic
gccatggatatcggaactgttttggaagcatcagtagccaaatatcagttcgcaagagaattcaccagcgagact

SEQ ID NO: 18473 - DNA, 75 bp, Artificial Sequence
  Synthetic
aagcatcagtagccaaatatcagttcgcaagagaattcaccagcgagacttacttcagactaggtgtcgaaactg

SEQ ID NO: 18474 - DNA, 75 bp, Artificial Sequence
  Synthetic
atgccacagaaggtgcagagcgctacatccgaagaacggtcgggacagcctcaacatcttggtacaaagcagcag

SEQ ID NO: 18475 - DNA, 75 bp, Artificial Sequence
  Synthetic
cccaattcagtttgaagaaagtattgtgggcaaacacattgcagctgggattccttgcaaggcaggacacgtgca

SEQ ID NO: 18476 - DNA, 75 bp, Artificial Sequence
  Synthetic
ctcactgcagaagcacggagacaagtcaaagcattggttgggaatcttgacctcaatgccaacaccagctccgac

SEQ ID NO: 18477 - DNA, 75 bp, Artificial Sequence
  Synthetic
tcaaagcattggttgggaatcttgacctcaatgccaacaccagctccgaccaggcagctccagcattcatgtcgg

SEQ ID NO: 18478 - DNA, 75 bp, Artificial Sequence
  Synthetic
gtacaaagaaagacgcaggcgcccacccagccatcgggtggagacgatgacaaccccatgtcctggtaataaaat

SEQ ID NO: 18479 - DNA, 75 bp, Artificial Sequence
  Synthetic
cccagccatcgggtggagacgatgacaaccccatgtcctggtaataaaatgcacaaaaggatcatcaacaatcaa

SEQ ID NO: 18480 - DNA, 75 bp, Artificial Sequence
  Synthetic
tggatttaaatcttttattattgattaagaaaaaacttaggggcgaccctagatacaaaaaccccttggctgaca

SEQ ID NO: 18481 - DNA, 75 bp, Artificial Sequence
  Synthetic
taagaaaaaacttaggggcgaccctagatacaaaaaccccttggctgacacagtgcctccaattcaatctcaaac

SEQ ID NO: 18482 - DNA, 75 bp, Artificial Sequence
  Synthetic
ctcctctgtgatcaaggagattcagcgtgctgaagtcaaagggccacagacactggggcaaccacaagtggctcc

SEQ ID NO: 18483 - DNA, 75 bp, Artificial Sequence
  Synthetic
cgtgctgaagtcaaagggccacagacactggggcaaccacaagtggctcccggcaatacaagccatttgaaggag

SEQ ID NO: 18484 - DNA, 75 bp, Artificial Sequence
  Synthetic
cagtgatgagcacaatgcactgccggaggatgttcaagggccgcccaaaacgacagatgaacaggacaagggacc

SEQ ID NO: 18485 - DNA, 75 bp, Artificial Sequence
  Synthetic
accaaacaaagaaattgtaagatacgttaaagaccgaagtagcaactgacttcgtacgggtagaaggattgaatc

SEQ ID NO: 18486 - DNA, 75 bp, Artificial Sequence
  Synthetic
gaggatgttcaagggccgcccaaaacgacagatgaacaggacaagggaccaactgccagagccgaggcgtcagtc

SEQ ID NO: 18487 - DNA, 75 bp, Artificial Sequence
  Synthetic
ttcgtacgggtagaaggattgaatctcgagtgcgaacacgacgctgtgattcgaaggtccgtactaccatcatgt

SEQ ID NO: 18488 - DNA, 75 bp, Artificial Sequence
  Synthetic
tcgagtgcgaacacgacgctgtgattcgaaggtccgtactaccatcatgtcctctatattcaatgagtatgagag

SEQ ID NO: 18489 - DNA, 75 bp, Artificial Sequence
  Synthetic
agcgttgtcaaagctggaaaaaaagagagaagctgaactgaatgcagacaagtctcttaaaaagggcactggagg

SEQ ID NO: 18490 - DNA, 75 bp, Artificial Sequence
  Synthetic
agagaagctgaactgaatgcagacaagtctcttaaaaagggcactggaggagagctccgatatcaagagcaacca

SEQ ID NO: 18491 - DNA, 75 bp, Artificial Sequence
  Synthetic
aaggtgacactccaaaagtcgagatccctgtatttgtgctcaacagtgacaaccctgaagatcgctggaacttta

SEQ ID NO: 18492 - DNA, 75 bp, Artificial Sequence
  Synthetic
ccctgtatttgtgctcaacagtgacaaccctgaagatcgctggaactttactaccttctgtctcagagtcgctgt

SEQ ID NO: 18493 - DNA, 75 bp, Artificial Sequence
  Synthetic
tcagccggccgcaccaatgaagaacgatgcctccgaatcacgaccacaacagctcccggacacagaagggagtat

SEQ ID NO: 18494 - DNA, 75 bp, Artificial Sequence
  Synthetic
gatgcctccgaatcacgaccacaacagctcccggacacagaagggagtattccatcatcaatgagcatggatcaa

SEQ ID NO: 18495 - DNA, 75 bp, Artificial Sequence
  Synthetic
tttgcgctcattctcaggtgatgaagaatcatgtggccatagcaggaaagcaggatgaggctctgattgtagttc

SEQ ID NO: 18496 - DNA, 75 bp, Artificial Sequence
  Synthetic
gaatcatgtggccatagcaggaaagcaggatgaggctctgattgtagttctagagattgatactattaatgatgg

SEQ ID NO: 18497 - DNA, 75 bp, Artificial Sequence
  Synthetic
cccagaagagaaaaatgcatctgcaggaggtgcccaactacctgtatcctctgtagagatgataatgaccatgct

SEQ ID NO: 18498 - DNA, 75 bp, Artificial Sequence
  Synthetic
ggaggtgcccaactacctgtatcctctgtagagatgataatgaccatgctcaaagacatcgtgactagagtcagc

SEQ ID NO: 18499 - DNA, 75 bp, Artificial Sequence
  Synthetic
gtttcgctatgatagctcaagcattaccccgtgcttgtgcaaatgggacaccgttcaccgtccaagatgcagaag

SEQ ID NO: 18500 - DNA, 75 bp, Artificial Sequence
  Synthetic
accccgtgcttgtgcaaatgggacaccgttcaccgtccaagatgcagaagatgatccagtcgaagacataacaga

SEQ ID NO: 18501 - DNA, 75 bp, Artificial Sequence
  Synthetic
tctggtcagaaatgatatcaaccagttgaaggcaactactgctcttatgtccacccaattggcatcaatccaagt

SEQ ID NO: 18502 - DNA, 75 bp, Artificial Sequence
  Synthetic
ttgaaggcaactactgctcttatgtccacccaattggcatcaatccaagtcttagaccctgggaatgcaggctac

SEQ ID NO: 18503 - DNA, 75 bp, Artificial Sequence
  Synthetic
caaaatccatgacagcgtacgagactgcagatgaatcagaacagaagcgattgaccaagtatgttcagcaaggtc

SEQ ID NO: 18504 - DNA, 75 bp, Artificial Sequence
  Synthetic
tgcagatgaatcagaacagaagcgattgaccaagtatgttcagcaaggtcgagtgcagaagaaatgcatgatcta

SEQ ID NO: 18505 - DNA, 75 bp, Artificial Sequence
  Synthetic
ggccggatacggtgaccttgaatcagttccatacgaacaggggatcatggcaaaggatgaactggccagaccaat

SEQ ID NO: 18506 - DNA, 75 bp, Artificial Sequence
  Synthetic
gttccatacgaacaggggatcatggcaaaggatgaactggccagaccaatccccttacatcaaagacgagatgca

SEQ ID NO: 18507 - DNA, 75 bp, Artificial Sequence
  Synthetic
tccgacggttcattgtcagtgagctgaaacgagctcggaatacagcaggaggaacatccacgtattataacttcg

SEQ ID NO: 18508 - DNA, 75 bp, Artificial Sequence
  Synthetic
gaaacgagctcggaatacagcaggaggaacatccacgtattataacttcgttgctgatgtagattcctacattag

SEQ ID NO: 18509 - DNA, 75 bp, Artificial Sequence
  Synthetic
ggctctaattgagagtctaattgagaatgacaaaaagaaacagaaactgtataaccagcttgacaaaatccgtac

SEQ ID NO: 18510 - DNA, 75 bp, Artificial Sequence
  Synthetic
aatgacaaaaagaaacagaaactgtataaccagcttgacaaaatccgtacaaaatcagattacatgaggctcaaa

SEQ ID NO: 18511 - DNA, 75 bp, Artificial Sequence
  Synthetic
caaagacttctgtccttgcccttagcagcttggcaggcgatcttcaaactgtcaaacagttgatgcggctgtata

SEQ ID NO: 18512 - DNA, 75 bp, Artificial Sequence
  Synthetic
cagcttggcaggcgatcttcaaactgtcaaacagttgatgcggctgtataaagccaaaggagatgatgcaccata

SEQ ID NO: 18513 - DNA, 75 bp, Artificial Sequence
  Synthetic
cagcccgccatctctgcactcaatcaactagtgcaattgaacacaagccttcaatcaagccaccatcccctcccc

SEQ ID NO: 18514 - DNA, 75 bp, Artificial Sequence
  Synthetic
aactagtgcaattgaacacaagccttcaatcaagccaccatcccctcccccctcaacagtaggataataggtaat

SEQ ID NO: 18515 - DNA, 75 bp, Artificial Sequence
  Synthetic
acgcacagctatactcatacgctatgggaatggcatcagtcatagacaaagggacctcaaggtatcagtacgctc

SEQ ID NO: 18516 - DNA, 75 bp, Artificial Sequence
  Synthetic
gggaatggcatcagtcatagacaaagggacctcaaggtatcagtacgctcgtgacttcctaaaccccagcttctg

SEQ ID NO: 18517 - DNA, 75 bp, Artificial Sequence
  Synthetic
agacatcgcccagaagaactggagtccattcaccatggcctcaacatcaatcaagctgtataccgatccctcggc

SEQ ID NO: 18518 - DNA, 75 bp, Artificial Sequence
  Synthetic
ccattcaccatggcctcaacatcaatcaagctgtataccgatccctcggctaaggaccttgaattgctatccttt

SEQ ID NO: 18519 - DNA, 75 bp, Artificial Sequence
  Synthetic
agatggcatcagaactgaaactcagcccaatagctagaaggatgctgaccactgccgtcacaaaagtagcaaccg

SEQ ID NO: 18520 - DNA, 75 bp, Artificial Sequence
  Synthetic
cccaatagctagaaggatgctgaccactgccgtcacaaaagtagcaaccggagcgtctgattattcggtacctca

SEQ ID NO: 18521 - DNA, 75 bp, Artificial Sequence
  Synthetic
ggtgagatacgaccacattggtgactcaagaggcgggaaggaatcatcaatattcttaactgtctacgggttcat

SEQ ID NO: 18522 - DNA, 75 bp, Artificial Sequence
  Synthetic
tcaagaggcgggaaggaatcatcaatattcttaactgtctacgggttcataattgcgaatcctgggagaaacatg

SEQ ID NO: 18523 - DNA, 75 bp, Artificial Sequence
  Synthetic
ggtctcagaagctgcccacctcaattcagcaggatcagaatgatgatactgccatgttgaacttcatgagggccg

SEQ ID NO: 18524 - DNA, 75 bp, Artificial Sequence
  Synthetic
tcagcaggatcagaatgatgatactgccatgttgaacttcatgagggccgtagcacaaggaatgaaggagacacc

SEQ ID NO: 18525 - DNA, 75 bp, Artificial Sequence
  Synthetic
tgcagggttagttgtactcggagcggtcagacaagacaatgtaccagagaaaattgttgaggacgtgttcgccct

SEQ ID NO: 18526 - DNA, 75 bp, Artificial Sequence
  Synthetic
gtcagacaagacaatgtaccagagaaaattgttgaggacgtgttcgccctagacatctccattaagaagtcagca

SEQ ID NO: 18527 - DNA, 75 bp, Artificial Sequence
  Synthetic
acgatgactcgcgggatcaagcagactcctgggggctctaatgaaatacggaggttgactccagcccaaacgaac

SEQ ID NO: 18528 - DNA, 75 bp, Artificial Sequence
  Synthetic
ctcctgggggctctaatgaaatacggaggttgactccagcccaaacgaacctctagcaactcctaatccctcatc

SEQ ID NO: 18529 - DNA, 75 bp, Artificial Sequence
  Synthetic
acagagagtaatcacagtgaggtcaggcggtttcattacttcggcagaggattgcatcaagtgtcccagtaaact

SEQ ID NO: 18530 - DNA, 75 bp, Artificial Sequence
  Synthetic
ggcggtttcattacttcggcagaggattgcatcaagtgtcccagtaaactccaagctggagtcaattacggattc

SEQ ID NO: 18531 - DNA, 75 bp, Artificial Sequence
  Synthetic
gaagacaccatccatccccaactgtcccaacccgaagaacatcctcaacttagcccgctaatttcacgaaccatt

SEQ ID NO: 18532 - DNA, 75 bp, Artificial Sequence
  Synthetic
cccaacccgaagaacatcctcaacttagcccgctaatttcacgaaccattacaaaaaacttatcaacagaaaaaa

SEQ ID NO: 18533 - DNA, 75 bp, Artificial Sequence
  Synthetic
ggtcccacgcgcaatgtatgcaattcagtcaaatctcctatttaaagttcagctagaaattgagttcagactcca

SEQ ID NO: 18534 - DNA, 75 bp, Artificial Sequence
  Synthetic
cagtcaaatctcctatttaaagttcagctagaaattgagttcagactccaaattaatgctgaccatccgcaggca

SEQ ID NO: 18535 - DNA, 75 bp, Artificial Sequence
  Synthetic
tcagcactcatcgcagctctccatcacaccaattctagctcaggcacacgcctccagagagaaccatggcatcct

SEQ ID NO: 18536 - DNA, 75 bp, Artificial Sequence
  Synthetic
acaccaattctagctcaggcacacgcctccagagagaaccatggcatccttcacagacgacgagatatcagatct

SEQ ID NO: 18537 - DNA, 75 bp, Artificial Sequence
  Synthetic
tgcatggttccatctatgcaacttcaagaagacaaatgcaaagggagaagccaggacgcttgttaatctacaaga

SEQ ID NO: 18538 - DNA, 75 bp, Artificial Sequence
  Synthetic
aagaagacaaatgcaaagggagaagccaggacgcttgttaatctacaagaaaaagtaagggcaatggggataaaa

SEQ ID NO: 18539 - DNA, 75 bp, Artificial Sequence
  Synthetic
tgcctaaagagaccctagggcgaagtgcaatcccaccagggaaaactcaggccctaactgatgcctgggagaaac

SEQ ID NO: 18540 - DNA, 75 bp, Artificial Sequence
  Synthetic
tgcaatcccaccagggaaaactcaggccctaactgatgcctgggagaaacacaacaagtcacagagatccaatgc

SEQ ID NO: 18541 - DNA, 75 bp, Artificial Sequence
  Synthetic
gaagtccagcaaatatgcccaggggtttttctcatcttctggaacaagctgcctaccagtcagcaagtcctctcc

SEQ ID NO: 18542 - DNA, 75 bp, Artificial Sequence
  Synthetic
tttttctcatcttctggaacaagctgcctaccagtcagcaagtcctctcctgagcttgcaaaactaatgtggtcg

SEQ ID NO: 18543 - DNA, 75 bp, Artificial Sequence
  Synthetic
atgctgagccgccacaatccaccggcgatccctccgcatctccagaaatggacggcgacacaaccccactcccaa

SEQ ID NO: 18544 - DNA, 75 bp, Artificial Sequence
  Synthetic
cgatccctccgcatctccagaaatggacggcgacacaaccccactcccaaagcaggaaaccgccgaaaagcaccc

SEQ ID NO: 18545 - DNA, 75 bp, Artificial Sequence
  Synthetic
gagagagctattacgctctgaagatctggaagtaaagggagcagttgaagtcaacaagaaatcaatcccacatct

SEQ ID NO: 18546 - DNA, 75 bp, Artificial Sequence
  Synthetic
ctggaagtaaagggagcagttgaagtcaacaagaaatcaatcccacatctcaaccccttcaggaaatgaaagcac

SEQ ID NO: 18547 - DNA, 75 bp, Artificial Sequence
  Synthetic
ctgccaagcaggatagagctaaaaaagggctcaatccgagatcacaagacacgggcaccctgcactcaggccaat

SEQ ID NO: 18548 - DNA, 75 bp, Artificial Sequence
  Synthetic
agggctcaatccgagatcacaagacacgggcaccctgcactcaggccaattccctacgcagacgcaagacccgac

SEQ ID NO: 18549 - DNA, 75 bp, Artificial Sequence
  Synthetic
gtaattactaaccttccttagagagaaatctatgataacccagcgaagccgaccaacaatcgttctctatctctt

SEQ ID NO: 18550 - DNA, 75 bp, Artificial Sequence
  Synthetic
aaatctatgataacccagcgaagccgaccaacaatcgttctctatctcttaatgttatactataccctagttaaa

SEQ ID NO: 18551 - DNA, 75 bp, Artificial Sequence
  Synthetic
ccgcccagctgccaatcccgaggagagacgacagcccgcatcaggtaagaagagaggaggagggcatcgcagaga

SEQ ID NO: 18552 - DNA, 75 bp, Artificial Sequence
  Synthetic
agacgacagcccgcatcaggtaagaagagaggaggagggcatcgcagagaacacagcatggtctggaatgcaaac

SEQ ID NO: 18553 - DNA, 75 bp, Artificial Sequence
  Synthetic
tgtaaaaaataggggcgaccctaataaccctcctatggcccagatgcactacaagaaccaatcttcaaccatgac

SEQ ID NO: 18554 - DNA, 75 bp, Artificial Sequence
  Synthetic
aaccctcctatggcccagatgcactacaagaaccaatcttcaaccatgactcgtactcggttgctctttctcctc

SEQ ID NO: 18555 - DNA, 75 bp, Artificial Sequence
  Synthetic
cgaaccaagagaattcacatgttcatgcgggagctgccctacagaatgccgactttgtgcaggctctcataggga

SEQ ID NO: 18556 - DNA, 75 bp, Artificial Sequence
  Synthetic
tgcgggagctgccctacagaatgccgactttgtgcaggctctcatagggatattagaaagcattcagcagagagt

SEQ ID NO: 18557 - DNA, 75 bp, Artificial Sequence
  Synthetic
agctgggataataagcgcttcggagagacagattgctatatatactcaaactctgcagggaactattgcacttcg

SEQ ID NO: 18558 - DNA, 75 bp, Artificial Sequence
  Synthetic
agacagattgctatatatactcaaactctgcagggaactattgcacttcgatttatacctgtacttccgcagaac

SEQ ID NO: 18559 - DNA, 75 bp, Artificial Sequence
  Synthetic
tgccagccattcgaaatgacattcaacaagttaagaccgctatggcagtgcttgaggccaacattgggatgatga

SEQ ID NO: 18560 - DNA, 75 bp, Artificial Sequence
  Synthetic
acaagttaagaccgctatggcagtgcttgaggccaacattgggatgatgaaaatccttgaccctggatcagcaca

SEQ ID NO: 18561 - DNA, 75 bp, Artificial Sequence
  Synthetic
aaatcttttattgcctattgctgagaacctaaatgccttgttaaaagacgccgataagccatcccaacgaattat

SEQ ID NO: 18562 - DNA, 75 bp, Artificial Sequence
  Synthetic
aacctaaatgccttgttaaaagacgccgataagccatcccaacgaattattggggctatcataggatcagtagcg

SEQ ID NO: 18563 - DNA, 75 bp, Artificial Sequence
  Synthetic
ttgtagcaggccccggtgaccccaataaaacaattgctgatgataaaaccatcactgtcaatcggctctcccagc

SEQ ID NO: 18564 - DNA, 75 bp, Artificial Sequence
  Synthetic
taaaacaattgctgatgataaaaccatcactgtcaatcggctctcccagccggtaactgatcagcgcagcttggt

SEQ ID NO: 18565 - DNA, 75 bp, Artificial Sequence
  Synthetic
ggcacaacaaaatgcacgaaatatatggaagttgaaagagtctatcaaaaatacaaatcaagcagtattggaact

SEQ ID NO: 18566 - DNA, 75 bp, Artificial Sequence
  Synthetic
tggaagttgaaagagtctatcaaaaatacaaatcaagcagtattggaactaaaagacgggctacaacaatctgct

SEQ ID NO: 18567 - DNA, 75 bp, Artificial Sequence
  Synthetic
tcaaggcgttattagctgcgagaccactacatccatcggctgcaaaacgaatgtctgataggttagatgcagcca

SEQ ID NO: 18568 - DNA, 75 bp, Artificial Sequence
  Synthetic
actacatccatcggctgcaaaacgaatgtctgataggttagatgcagccaagacatgtgaagaattgaggaaggt

SEQ ID NO: 18569 - DNA, 75 bp, Artificial Sequence
  Synthetic
aataaatcagttaggatgcgaggttgcagcaaacaaattgggaatatttctatctctctacctaactgaaatcac

SEQ ID NO: 18570 - DNA, 75 bp, Artificial Sequence
  Synthetic
gcagcaaacaaattgggaatatttctatctctctacctaactgaaatcactacagtgttcaaaaatcaaatcacg

SEQ ID NO: 18571 - DNA, 75 bp, Artificial Sequence
  Synthetic
gatcaagcgtgatccgccttggacaacttttttgccgatcttaaggagagacaaatcaatttacaccgatctaaa

SEQ ID NO: 18572 - DNA, 75 bp, Artificial Sequence
  Synthetic
acttttttgccgatcttaaggagagacaaatcaatttacaccgatctaaaatatcatcagacaccctcaaatcaa

SEQ ID NO: 18573 - DNA, 75 bp, Artificial Sequence
  Synthetic
gggcaatatggctgctttaacaaaacaaataggaattaaagatacagaaattaactcattatatgaagcagaatt

SEQ ID NO: 18574 - DNA, 75 bp, Artificial Sequence
  Synthetic
caaataggaattaaagatacagaaattaactcattatatgaagcagaattgatcacaggacaagttatagggtat

SEQ ID NO: 18575 - DNA, 75 bp, Artificial Sequence
  Synthetic
caattgccctaaaataccacctgacataaataccagattatctctagacctccttggttgttaagaaaaaaaagt

SEQ ID NO: 18576 - DNA, 75 bp, Artificial Sequence
  Synthetic
ataaataccagattatctctagacctccttggttgttaagaaaaaaaagtaagtacgggtagaaacaggactcaa

SEQ ID NO: 18577 - DNA, 75 bp, Artificial Sequence
  Synthetic
aagggtccaaggggttagggcagtagaactcttgacagtcagtgtggcaacaccaaaaggtgaggggaaagcaat

SEQ ID NO: 18578 - DNA, 75 bp, Artificial Sequence
  Synthetic
gaactcttgacagtcagtgtggcaacaccaaaaggtgaggggaaagcaattgctccaagctttatagctcagagc

SEQ ID NO: 18579 - DNA, 75 bp, Artificial Sequence
  Synthetic
ccactagcagttctagttcaatactcgcattcccaatagtcatggaagccacaggagacggacgaaagcaaattt

SEQ ID NO: 18580 - DNA, 75 bp, Artificial Sequence
  Synthetic
cgcattcccaatagtcatggaagccacaggagacggacgaaagcaaatttcaccccaatatcgcattcagagatt

SEQ ID NO: 18581 - DNA, 75 bp, Artificial Sequence
  Synthetic
aacactctactgtagacaagttaacactaggacattaccagttagggtagcaaactgccttaaaggcaaatataa

SEQ ID NO: 18582 - DNA, 75 bp, Artificial Sequence
  Synthetic
actaggacattaccagttagggtagcaaactgccttaaaggcaaatataatgactgccaatataccacagaaata

SEQ ID NO: 18583 - DNA, 75 bp, Artificial Sequence
  Synthetic
ggtttatatttggataccctaaatcacgtgctgatcgaggccagcttaatgaagaaattaggcctgtgctgctct

SEQ ID NO: 18584 - DNA, 75 bp, Artificial Sequence
  Synthetic
acgtgctgatcgaggccagcttaatgaagaaattaggcctgtgctgctctctgctgcaacgctatgtctgggcag

SEQ ID NO: 18585 - DNA, 75 bp, Artificial Sequence
  Synthetic
ctgcagatctatcatctgtaggtgcctggacccggagggaatagttgcccaaaattctgacgcagcaatcactgt

SEQ ID NO: 18586 - DNA, 75 bp, Artificial Sequence
  Synthetic
ctggacccggagggaatagttgcccaaaattctgacgcagcaatcactgttattgataggtccacttgcaagttg

SEQ ID NO: 18587 - DNA, 75 bp, Artificial Sequence
  Synthetic
tacaaatatcttgcaaaaagagtgctactagtgaggagaaaatgatatttgcaatcacccaagctccgcagattt

SEQ ID NO: 18588 - DNA, 75 bp, Artificial Sequence
  Synthetic
tactagtgaggagaaaatgatatttgcaatcacccaagctccgcagattttacaatcatgtcgtgctgtttcgca

SEQ ID NO: 18589 - DNA, 75 bp, Artificial Sequence
  Synthetic
atactcaaagaatataaccattgatatatctcaagtaactacatctggttctttagatataagtagcgaattagg

SEQ ID NO: 18590 - DNA, 75 bp, Artificial Sequence
  Synthetic
atatctcaagtaactacatctggttctttagatataagtagcgaattaggctctattaataatactataaccaaa

SEQ ID NO: 18591 - DNA, 75 bp, Artificial Sequence
  Synthetic
tcgagggaggccagcagtatgactataaggtcaacttcgtgtctctcactatagtaccaaaagatgacgtatata

SEQ ID NO: 18592 - DNA, 75 bp, Artificial Sequence
  Synthetic
taaggtcaacttcgtgtctctcactatagtaccaaaagatgacgtatatagggtcccaaaacctgtcctatcagt

SEQ ID NO: 18593 - DNA, 75 bp, Artificial Sequence
  Synthetic
taccctaatatcgaatgacactatcattgccctctgtgtgattgctggtattgtcgttatctggttagttataat

SEQ ID NO: 18594 - DNA, 75 bp, Artificial Sequence
  Synthetic
attgccctctgtgtgattgctggtattgtcgttatctggttagttataatcacaatactatcgtattatatactc

SEQ ID NO: 18595 - DNA, 75 bp, Artificial Sequence
  Synthetic
acatcaatgccgacaatcctttgtctaagacgcttattaagaccgaaagcggctttgaagcaaatttgttcctgc

SEQ ID NO: 18596 - DNA, 75 bp, Artificial Sequence
  Synthetic
taagacgcttattaagaccgaaagcggctttgaagcaaatttgttcctgcatgtgggtattctctcaaacattga

SEQ ID NO: 18597 - DNA, 75 bp, Artificial Sequence
  Synthetic
aaacccgtatgttaacaacactaaattttgattgagcatgacacaaattaagcaacaagagataaggattagaga

SEQ ID NO: 18598 - DNA, 75 bp, Artificial Sequence
  Synthetic
ttttgattgagcatgacacaaattaagcaacaagagataaggattagagatctccagttaagcaaatcaaaataa

SEQ ID NO: 18599 - DNA, 75 bp, Artificial Sequence
  Synthetic
ggatggaactgactgcaggattaagtgatatgtttggtccgtccatcatcctgaaggccaaagggccgaggacaa

SEQ ID NO: 18600 - DNA, 75 bp, Artificial Sequence
  Synthetic
tgatatgtttggtccgtccatcatcctgaaggccaaagggccgaggacaaagttgatgtcagcattcttttctaa

SEQ ID NO: 18601 - DNA, 75 bp, Artificial Sequence
  Synthetic
aaaaacttaaatgaggagggctgtattgatcataagcgtcaagaaaactgagaaataggggcgacccattgtgac

SEQ ID NO: 18602 - DNA, 75 bp, Artificial Sequence
  Synthetic
ttgatcataagcgtcaagaaaactgagaaataggggcgacccattgtgacaatattgccgcagctcatagctgtc

SEQ ID NO: 18603 - DNA, 75 bp, Artificial Sequence
  Synthetic
agatcttgtggagccaaagcggacacctccaggaggttaagatacttgtacaatcgggaacctcgaaaatgattg

SEQ ID NO: 18604 - DNA, 75 bp, Artificial Sequence
  Synthetic
cctccaggaggttaagatacttgtacaatcgggaacctcgaaaatgattgcattaacagccgatcaagaaatcac

SEQ ID NO: 18605 - DNA, 75 bp, Artificial Sequence
  Synthetic
accagccagttggaatggactcatcacaaatgaatattttggatgctatggatagggaaagtagtaaaaggacat

SEQ ID NO: 18606 - DNA, 75 bp, Artificial Sequence
  Synthetic
acaaatgaatattttggatgctatggatagggaaagtagtaaaaggacatggaggggagtattccgagttactac

SEQ ID NO: 18607 - DNA, 75 bp, Artificial Sequence
  Synthetic
aaaagtaagttgcatggctcacgaatagctcaggtcttcttgccttaaaatcagccaatgaatatgtgataggat

SEQ ID NO: 18608 - DNA, 75 bp, Artificial Sequence
  Synthetic
tagctcaggtcttcttgccttaaaatcagccaatgaatatgtgataggatattcagtgtctcgaatcattaccga

SEQ ID NO: 18609 - DNA, 75 bp, Artificial Sequence
  Synthetic
aggttgcccatcctcaggggttcgacaccaatgagctgggtaatggcatcgtggatcgagtcagcgataaaataa

SEQ ID NO: 18610 - DNA, 75 bp, Artificial Sequence
  Synthetic
caccaatgagctgggtaatggcatcgtggatcgagtcagcgataaaataactgaggcgttaacagtgccaaacaa

SEQ ID NO: 18611 - DNA, 75 bp, Artificial Sequence
  Synthetic
caaatagcattaaaaaaaatccccaaaagaattaaaactaaaacacagcacgggtagaaagtgagctgtatatca

SEQ ID NO: 18612 - DNA, 75 bp, Artificial Sequence
  Synthetic
aaagaattaaaactaaaacacagcacgggtagaaagtgagctgtatatcactcaatccacaatctaccatagtga

SEQ ID NO: 18613 - DNA, 75 bp, Artificial Sequence
  Synthetic
tcagctcatcgcaacaggcaattgcaggacaaattggcatgcttgctgagagtatcaacagtatattaagccaaa

SEQ ID NO: 18614 - DNA, 75 bp, Artificial Sequence
  Synthetic
aggacaaattggcatgcttgctgagagtatcaacagtatattaagccaaaatggatctgcatcgaccattctatc

SEQ ID NO: 18615 - DNA, 75 bp, Artificial Sequence
  Synthetic
ctgcgcacctctgctataccacgacattggatggtagaaaactgcttggtgcaggcatagtgataacagaagaga

SEQ ID NO: 18616 - DNA, 75 bp, Artificial Sequence
  Synthetic
attggatggtagaaaactgcttggtgcaggcatagtgataacagaagagaagcaagttagggtgtacacagctgc

SEQ ID NO: 18617 - DNA, 75 bp, Artificial Sequence
  Synthetic
agttaacaaatggaactgtaataaaacccataaccttaattgaacaccctagtttcatcccgggcccaactacta

SEQ ID NO: 18618 - DNA, 75 bp, Artificial Sequence
  Synthetic
acccataaccttaattgaacaccctagtttcatcccgggcccaactactataggaggttgcactcggattcccac

SEQ ID NO: 18619 - DNA, 75 bp, Artificial Sequence
  Synthetic
gatactcgtgcatggaatccactattgagtcatataacaagactgtatataacatacttgcacctctgggcgatg

SEQ ID NO: 18620 - DNA, 75 bp, Artificial Sequence
  Synthetic
tgagtcatataacaagactgtatataacatacttgcacctctgggcgatgcaatccgccgaatacaggcaagtgg

SEQ ID NO: 18621 - DNA, 75 bp, Artificial Sequence
  Synthetic
aaggttgtaaggatagtgggatatcatccatgtatatatcattaggagtattacaagtattgaagaaaggaactc

SEQ ID NO: 18622 - DNA, 75 bp, Artificial Sequence
  Synthetic
atccatgtatatatcattaggagtattacaagtattgaagaaaggaactcctgtatttttggtaactgcaagcgc

SEQ ID NO: 18623 - DNA, 75 bp, Artificial Sequence
  Synthetic
ggggagttgccttaggtgtagccaccgcagcacagataacagctgcaattgctttgattcaggctaacgagaacg

SEQ ID NO: 18624 - DNA, 75 bp, Artificial Sequence
  Synthetic
cgcagcacagataacagctgcaattgctttgattcaggctaacgagaacgcaaaaaacatcctgcgtattaaaga

SEQ ID NO: 18625 - DNA, 75 bp, Artificial Sequence
  Synthetic
ggtttgggtgtgagatactatgcagccttgtaacagaagcagagtctgacgattacaaatctgatacgccaactg

SEQ ID NO: 18626 - DNA, 75 bp, Artificial Sequence
  Synthetic
ccttgtaacagaagcagagtctgacgattacaaatctgatacgccaactggaatggtgcacggcagattatattt

SEQ ID NO: 18627 - DNA, 75 bp, Artificial Sequence
  Synthetic
cgcagttaactatcgctgtaggtaaattacaggacttcgtcaataaggaattcaataagacaactgaggccatta

SEQ ID NO: 18628 - DNA, 75 bp, Artificial Sequence
  Synthetic
attacaggacttcgtcaataaggaattcaataagacaactgaggccattaattgtgtacaggcagctcaacaatt

SEQ ID NO: 18629 - DNA, 75 bp, Artificial Sequence
  Synthetic
acttttctgctaattatcccggggtcggatcaggggaaattgtagaggggcacatacattttcccatatacggag

SEQ ID NO: 18630 - DNA, 75 bp, Artificial Sequence
  Synthetic
cggatcaggggaaattgtagaggggcacatacattttcccatatacggaggagtgaagcagaatactggcctata

SEQ ID NO: 18631 - DNA, 75 bp, Artificial Sequence
  Synthetic
ctcagataacctctcctgctttaagcaaattgactatccaagcgctgtataatttggcgggcgtaagcttggatg

SEQ ID NO: 18632 - DNA, 75 bp, Artificial Sequence
  Synthetic
caaattgactatccaagcgctgtataatttggcgggcgtaagcttggatgtactactgggaaggctcggagcaga

SEQ ID NO: 18633 - DNA, 75 bp, Artificial Sequence
  Synthetic
gcaagttgccatatacaaatcaaacaatccagaactcgtataaacccccattcatccacggaagattttgggcac

SEQ ID NO: 18634 - DNA, 75 bp, Artificial Sequence
  Synthetic
aatccagaactcgtataaacccccattcatccacggaagattttgggcacaaggaatactatcatgtgaattaga

SEQ ID NO: 18635 - DNA, 75 bp, Artificial Sequence
  Synthetic
ccattctctacgactcggaatctcaaatattggcactgcaagtgtcactaccctccattagtgacttaaggggag

SEQ ID NO: 18636 - DNA, 75 bp, Artificial Sequence
  Synthetic
aatattggcactgcaagtgtcactaccctccattagtgacttaaggggagtgagagcgacatacttagacacgtt

SEQ ID NO: 18637 - DNA, 75 bp, Artificial Sequence
  Synthetic
tcatgatgggagcagaaagtcggttaatgcttgtggggtcaaaattgctaatgtatcagagggcatcgtcctggt

SEQ ID NO: 18638 - DNA, 75 bp, Artificial Sequence
  Synthetic
aatgcttgtggggtcaaaattgctaatgtatcagagggcatcgtcctggtggccgctggggattacacaggagat

SEQ ID NO: 18639 - DNA, 75 bp, Artificial Sequence
  Synthetic
taatccaatctaataatatagttgaagaattagatactacagcatgtatagcagcagaagctgacttatactgta

SEQ ID NO: 18640 - DNA, 75 bp, Artificial Sequence
  Synthetic
agaattagatactacagcatgtatagcagcagaagctgacttatactgtacgaggattactacattccccattgc

SEQ ID NO: 18641 - DNA, 75 bp, Artificial Sequence
  Synthetic
aacccatactgtcatcgaagttcccgcggccgtcctatcagccgaattattgcacgaagccaagtgtatgtcctg

SEQ ID NO: 18642 - DNA, 75 bp, Artificial Sequence
  Synthetic
gcggccgtcctatcagccgaattattgcacgaagccaagtgtatgtcctgcagtgtgtgtcacaggagtatacac

SEQ ID NO: 18643 - DNA, 75 bp, Artificial Sequence
  Synthetic
caaagactaatggcgtcttaaccactccatatgtagcagtaaaggggaaaattgtagccaattgtaagcatgtca

SEQ ID NO: 18644 - DNA, 75 bp, Artificial Sequence
  Synthetic
tccatatgtagcagtaaaggggaaaattgtagccaattgtaagcatgtcacatgtaggtgtgtagatcctacatc

SEQ ID NO: 18645 - DNA, 75 bp, Artificial Sequence
  Synthetic
ttagccattatttggatgcaccaacatcaagacaacagccgaggattgggattgcaaaccaatatttctggatcc

SEQ ID NO: 18646 - DNA, 75 bp, Artificial Sequence
  Synthetic
atcaagacaacagccgaggattgggattgcaaaccaatatttctggatccatcagacgactatatttccaaccaa

SEQ ID NO: 18647 - DNA, 75 bp, Artificial Sequence
  Synthetic
tatgcaaggtaatcaacttagatggtgtgtccatacagctgagcggcacatttgaatcgacttatgtgcgcaacg

SEQ ID NO: 18648 - DNA, 75 bp, Artificial Sequence
  Synthetic
tgtgtccatacagctgagcggcacatttgaatcgacttatgtgcgcaacgtctcgataagtgcaaacaaggtcat

SEQ ID NO: 18649 - DNA, 75 bp, Artificial Sequence
  Synthetic
gtaggatgttttgtttatccattgcagagtttgcagatggagtgtttggggaatttaggatcgtgcccttattat

SEQ ID NO: 18650 - DNA, 75 bp, Artificial Sequence
  Synthetic
agagtttgcagatggagtgtttggggaatttaggatcgtgcccttattatatgagttgagagtataagattcagc

SEQ ID NO: 18651 - DNA, 75 bp, Artificial Sequence
  Synthetic
ctttaagttcggctctggaaaaactggatgaaagtgacgctgcgctaagcaaagtaaatgttcacttaactagca

SEQ ID NO: 18652 - DNA, 75 bp, Artificial Sequence
  Synthetic
ggatgaaagtgacgctgcgctaagcaaagtaaatgttcacttaactagcacctcagctatggccacatacattgt

SEQ ID NO: 18653 - DNA, 75 bp, Artificial Sequence
  Synthetic
cttccaagttaaagcacaattagatggcactagcagacttcaatctgatttctatgttcttgatttataaccgtt

SEQ ID NO: 18654 - DNA, 75 bp, Artificial Sequence
  Synthetic
ggcactagcagacttcaatctgatttctatgttcttgatttataaccgttacctcaaaatcaaccataactcatt

SEQ ID NO: 18655 - DNA, 75 bp, Artificial Sequence
  Synthetic
gctttgctatgataaaagtaaagtctcaagcaaagacactactatggcttggtgcacatgctgaccgatcatata

SEQ ID NO: 18656 - DNA, 75 bp, Artificial Sequence
  Synthetic
tcaagcaaagacactactatggcttggtgcacatgctgaccgatcatatatactccagagtaagccggctcaatc

SEQ ID NO: 18657 - DNA, 75 bp, Artificial Sequence
  Synthetic
gtcgatctagaaaaaagacctttgcctccaattaagaaaaaattgagttgaggagagtagtcatactttccctaa

SEQ ID NO: 18658 - DNA, 75 bp, Artificial Sequence
  Synthetic
ctccaattaagaaaaaattgagttgaggagagtagtcatactttccctaattcccacgatgaatacttaggggcg

SEQ ID NO: 18659 - DNA, 75 bp, Artificial Sequence
  Synthetic
tcatttcttcttccgattataaaaaaataagaaacctaattaggccaatacgggtagaacaggcttccaccccgt

SEQ ID NO: 18660 - DNA, 75 bp, Artificial Sequence
  Synthetic
aataagaaacctaattaggccaatacgggtagaacaggcttccaccccgtatttcttcggctgtgatcctgtacc

SEQ ID NO: 18661 - DNA, 75 bp, Artificial Sequence
  Synthetic
gaagtccacttggattcaccactaattcgaaataaattgttactcctgtggaaattaataggcctcccgttaccg

SEQ ID NO: 18662 - DNA, 75 bp, Artificial Sequence
  Synthetic
ttcgaaataaattgttactcctgtggaaattaataggcctcccgttaccgcccgagttaaggagtgcagtcttga

SEQ ID NO: 18663 - DNA, 75 bp, Artificial Sequence
  Synthetic
aatcaggaatcagccaggcatctcttgtcaatgacaacatagaattaaggaatacgtggcgcacggccttccgtg

SEQ ID NO: 18664 - DNA, 75 bp, Artificial Sequence
  Synthetic
tgtcaatgacaacatagaattaaggaatacgtggcgcacggccttccgtgtggtctccttattactcggcttcac

SEQ ID NO: 18665 - DNA, 75 bp, Artificial Sequence
  Synthetic
acaaagcttattgtgataaggaatcatttactagagcatcttaagagaaggcaattagtctgccaacacctgacg

SEQ ID NO: 18666 - DNA, 75 bp, Artificial Sequence
  Synthetic
atttactagagcatcttaagagaaggcaattagtctgccaacacctgacgccggtgcttcatccaaaaactttag

SEQ ID NO: 18667 - DNA, 75 bp, Artificial Sequence
  Synthetic
cccctgcggatctctctagtatcccagtcgctgttgaccaaagtcatcatgaaattctacaaaccttgagtctga

SEQ ID NO: 18668 - DNA, 75 bp, Artificial Sequence
  Synthetic
agtcgctgttgaccaaagtcatcatgaaattctacaaaccttgagtctgatgagcgacattggcaataagattta

SEQ ID NO: 18669 - DNA, 75 bp, Artificial Sequence
  Synthetic
aagaacaaagttcttagaagagtaatagaagagaacacaccacggtatgaacacttattctcatccattagtcac

SEQ ID NO: 18670 - DNA, 75 bp, Artificial Sequence
  Synthetic
tagaagagaacacaccacggtatgaacacttattctcatccattagtcacaagttaactaataatagtttcttat

SEQ ID NO: 18671 - DNA, 75 bp, Artificial Sequence
  Synthetic
ccttaatgagcgcaattacatcactatcttatcagattaacaatgcagcgaataactcaggttgtggcgcccctg

SEQ ID NO: 18672 - DNA, 75 bp, Artificial Sequence
  Synthetic
atcttatcagattaacaatgcagcgaataactcaggttgtggcgcccctgtgcatgataaggattttatcaatgg

SEQ ID NO: 18673 - DNA, 75 bp, Artificial Sequence
  Synthetic
ggggctagagcaatattaaatgatcctgttaaggcaacccatactgcgtggacaaattcaaggtggtcatggctg

SEQ ID NO: 18674 - DNA, 75 bp, Artificial Sequence
  Synthetic
ctgttaaggcaacccatactgcgtggacaaattcaaggtggtcatggctgcatttgaaacaggtcatgaggtatc

SEQ ID NO: 18675 - DNA, 75 bp, Artificial Sequence
  Synthetic
gaccctccaggttccttgagcatctaaatttcatccccgcccctactacgggaaaaggttgcaccagaattccgt

SEQ ID NO: 18676 - DNA, 75 bp, Artificial Sequence
  Synthetic
aaatttcatccccgcccctactacgggaaaaggttgcaccagaattccgtcctttgatctagctgcaacacattg

SEQ ID NO: 18677 - DNA, 75 bp, Artificial Sequence
  Synthetic
agtgaagcatggggattcatagggatcactcccgatgtggtagttattgtcgactatggtactttgaagttcacg

SEQ ID NO: 18678 - DNA, 75 bp, Artificial Sequence
  Synthetic
tcactcccgatgtggtagttattgtcgactatggtactttgaagttcacgttgctgacgtttgaaatggttctaa

SEQ ID NO: 18679 - DNA, 75 bp, Artificial Sequence
  Synthetic
cttatcaatacatatccctcgggatactcaaggtgtcagccacgggaaacgtgttcttatctactctcagatcta

SEQ ID NO: 18680 - DNA, 75 bp, Artificial Sequence
  Synthetic
actcaaggtgtcagccacgggaaacgtgttcttatctactctcagatctatcaacctggatgatgatgaaaaccg

SEQ ID NO: 18681 - DNA, 75 bp, Artificial Sequence
  Synthetic
ctatcagtctctctgaacaaattaagcagcagactggaagacctattcttattggttgactccctagcaagtgac

SEQ ID NO: 18682 - DNA, 75 bp, Artificial Sequence
  Synthetic
gcagcagactggaagacctattcttattggttgactccctagcaagtgacataggggaaaggatttacgatctcg

SEQ ID NO: 18683 - DNA, 75 bp, Artificial Sequence
  Synthetic
ctaaagtcactgagagagaagaggcagattacaattcagatgcagcgacgagattagttcatggcaggttaggtt

SEQ ID NO: 18684 - DNA, 75 bp, Artificial Sequence
  Synthetic
agattacaattcagatgcagcgacgagattagttcatggcaggttaggttttgatggggtataccatgagcaggc

SEQ ID NO: 18685 - DNA, 75 bp, Artificial Sequence
  Synthetic
agtgaagtacaatcaggatcattctttgcattcaatatgagagaaataagagagcttcttagggagtgtatagac

SEQ ID NO: 18686 - DNA, 75 bp, Artificial Sequence
  Synthetic
ttgcattcaatatgagagaaataagagagcttcttagggagtgtatagacccaagacatgttggcagagtatgtg

SEQ ID NO: 18687 - DNA, 75 bp, Artificial Sequence
  Synthetic
tcggcggaggcagttactttgataatagggtatggtttggcgtgtatggggggatcagacctggctctcagactg

SEQ ID NO: 18688 - DNA, 75 bp, Artificial Sequence
  Synthetic
tagggtatggtttggcgtgtatggggggatcagacctggctctcagactgatctgctccagtctgagaagtacgc

SEQ ID NO: 18689 - DNA, 75 bp, Artificial Sequence
  Synthetic
ttactgtgtatcatgagattgttcggccaccccctacttattgctgatagtgcagcgaagaaagtcagagaatcc

SEQ ID NO: 18690 - DNA, 75 bp, Artificial Sequence
  Synthetic
gccaccccctacttattgctgatagtgcagcgaagaaagtcagagaatccatgtgtgcaccgaagatgattgaac

SEQ ID NO: 18691 - DNA, 75 bp, Artificial Sequence
  Synthetic
ttgagcgggccaaatcatcttatcgtccgcagcggtttggccagcggcttgtacaacaagcaattctatcaatta

SEQ ID NO: 18692 - DNA, 75 bp, Artificial Sequence
  Synthetic
tccgcagcggtttggccagcggcttgtacaacaagcaattctatcaattagagtggagccatctttgggtaatga

SEQ ID NO: 18693 - DNA, 75 bp, Artificial Sequence
  Synthetic
ggatataggagatcacactcaggtgtatggccagtaattgatgtttcatcaatccatgatgatgatctgaggcag

SEQ ID NO: 18694 - DNA, 75 bp, Artificial Sequence
  Synthetic
tatggccagtaattgatgtttcatcaatccatgatgatgatctgaggcagctatattacgagtcaagtgaaatat

SEQ ID NO: 18695 - DNA, 75 bp, Artificial Sequence
  Synthetic
caaggataatgacatttggccacgtggcattaatgtatcaaagagggtcatcatattttccttctgcactattat

SEQ ID NO: 18696 - DNA, 75 bp, Artificial Sequence
  Synthetic
ggcattaatgtatcaaagagggtcatcatattttccttctgcactattataccctctcagtttaacaaatggtag

SEQ ID NO: 18697 - DNA, 75 bp, Artificial Sequence
  Synthetic
aagaaaagtatagattatgatctctatgatgacttaagcacttttctaaaagataaggcaatatgccggcctaaa

SEQ ID NO: 18698 - DNA, 75 bp, Artificial Sequence
  Synthetic
atgatgacttaagcacttttctaaaagataaggcaatatgccggcctaaatcccaatggactgcagtcttcagga

SEQ ID NO: 18699 - DNA, 75 bp, Artificial Sequence
  Synthetic
gcccaccttgtcaggccactgcaagatgtccaaattcatgtgttactggtgtctacacagacgcatacccgttat

SEQ ID NO: 18700 - DNA, 75 bp, Artificial Sequence
  Synthetic
atgtccaaattcatgtgttactggtgtctacacagacgcatacccgttattttggtctgaagatcataaagtgaa

SEQ ID NO: 18701 - DNA, 75 bp, Artificial Sequence
  Synthetic
agcaaccgcttgctcatcgatttccttgagtcgtcagactttgatccggaagaagaattccggtatgtgacttca

SEQ ID NO: 18702 - DNA, 75 bp, Artificial Sequence
  Synthetic
ttgagtcgtcagactttgatccggaagaagaattccggtatgtgacttcactgtcatatctgtcggataatgagt

SEQ ID NO: 18703 - DNA, 75 bp, Artificial Sequence
  Synthetic
tagcagctatatttgataggtatggtaggagtagagtgactagggttagcagtagcagcacgaaggcagcttaca

SEQ ID NO: 18704 - DNA, 75 bp, Artificial Sequence
  Synthetic
taggagtagagtgactagggttagcagtagcagcacgaaggcagcttacactacaaatacatgctttaaggttgt

SEQ ID NO: 18705 - DNA, 75 bp, Artificial Sequence
  Synthetic
atctttgccaaaatgacccggaagatgagaagttgtcaggttattcttgaatcacttctttctcagcatgtgtgt

SEQ ID NO: 18706 - DNA, 75 bp, Artificial Sequence
  Synthetic
tgagaagttgtcaggttattcttgaatcacttctttctcagcatgtgtgtaaatattttaaagagaatggtgtct

SEQ ID NO: 18707 - DNA, 75 bp, Artificial Sequence
  Synthetic
tgtttggagaattcagaataacccctttactctccgagataatatttgacccaaaccttgaaccctcagacacga

SEQ ID NO: 18708 - DNA, 75 bp, Artificial Sequence
  Synthetic
tttactctccgagataatatttgacccaaaccttgaaccctcagacacgagccgtaactgaggaaaatccgttct

SEQ ID NO: 18709 - DNA, 75 bp, Artificial Sequence
  Synthetic
tcaccaagagttgccgccacgaagctagggcttaagagagcaactgaaaaggatcaagctgcagtctcaatggat

SEQ ID NO: 18710 - DNA, 75 bp, Artificial Sequence
  Synthetic
tagggcttaagagagcaactgaaaaggatcaagctgcagtctcaatggattacggtaatcacaacattgaactat

SEQ ID NO: 18711 - DNA, 75 bp, Artificial Sequence
  Synthetic
ctgcgtcgtccctatattcaaacaccacattagcggagtatacagatagtcggccatgatgaatcaaatgtcatg

SEQ ID NO: 18712 - DNA, 75 bp, Artificial Sequence
  Synthetic
cacattagcggagtatacagatagtcggccatgatgaatcaaatgtcatgcgatttgagcataaccgaagcagaa

SEQ ID NO: 18713 - DNA, 75 bp, Artificial Sequence
  Synthetic
actactgaccttcaaaagtattgcctaaattggaggtatgccagtatcaagctgtttgcccaagcacttaatcaa

SEQ ID NO: 18714 - DNA, 75 bp, Artificial Sequence
  Synthetic
taaattggaggtatgccagtatcaagctgtttgcccaagcacttaatcaactattcggcatctcgcatggatttg

SEQ ID NO: 18715 - DNA, 75 bp, Artificial Sequence
  Synthetic
aatcctcaataatcctaaaaactgcaggtaatacaaaaggatcagcctatagggagcttcaacaatcgttagaaa

SEQ ID NO: 18716 - DNA, 75 bp, Artificial Sequence
  Synthetic
aggtaatacaaaaggatcagcctatagggagcttcaacaatcgttagaaaaaaacgggtagaacatggataatcc

SEQ ID NO: 18717 - DNA, 75 bp, Artificial Sequence
  Synthetic
tactcacccccatcagacatggcctcaacaaatcttgatgatgcacctaacgatagtatatttatagtttcacct

SEQ ID NO: 18718 - DNA, 75 bp, Artificial Sequence
  Synthetic
caacaaatcttgatgatgcacctaacgatagtatatttatagtttcacctaggggaggaattgagggattgtgtc

SEQ ID NO: 18719 - DNA, 75 bp, Artificial Sequence
  Synthetic
cctcaccgatcgtaaggcataagttatattatttctggagactaacaggagtaccactaccccactcagcagaat

SEQ ID NO: 18720 - DNA, 75 bp, Artificial Sequence
  Synthetic
atattatttctggagactaacaggagtaccactaccccactcagcagaatttgatacgctagtcctatccagacc

SEQ ID NO: 18721 - DNA, 75 bp, Artificial Sequence
  Synthetic
aaagttgggactagggttgcagccatggtccaaggagacaatcaagtgatcggaatcactcgagaagttttccaa

SEQ ID NO: 18722 - DNA, 75 bp, Artificial Sequence
  Synthetic
tggtccaaggagacaatcaagtgatcggaatcactcgagaagttttccaaggggaaacacttgaaatcatccaac

SEQ ID NO: 18723 - DNA, 75 bp, Artificial Sequence
  Synthetic
ggctaggtgcgaacgtccacgcgactctagatcactctcgaccaataaaggctttgatccacccggagactttag

SEQ ID NO: 18724 - DNA, 75 bp, Artificial Sequence
  Synthetic
tctagatcactctcgaccaataaaggctttgatccacccggagactttagcatggctaactgatctgtctatagg

SEQ ID NO: 18725 - DNA, 75 bp, Artificial Sequence
  Synthetic
aattttggtatggggcataatctgaaaccaaacgagacaataaaaagtcagtcatttttcgtttactcgaaacgc

SEQ ID NO: 18726 - DNA, 75 bp, Artificial Sequence
  Synthetic
aaccaaacgagacaataaaaagtcagtcatttttcgtttactcgaaacgcgtgttttgggaagggaggatattga

SEQ ID NO: 18727 - DNA, 75 bp, Artificial Sequence
  Synthetic
tccatgacaatagagagaaattttgtacacttgtttctcagattcatgaaggattgttcggtggtgtaggagggg

SEQ ID NO: 18728 - DNA, 75 bp, Artificial Sequence
  Synthetic
tacacttgtttctcagattcatgaaggattgttcggtggtgtaggaggggttcggaataatctgtcaccagagtt

SEQ ID NO: 18729 - DNA, 75 bp, Artificial Sequence
  Synthetic
ggagagaactctgtatcatcatgcagcaatctgtcatctaccatcgcaagattagtagaaaatgggcttgagaaa

SEQ ID NO: 18730 - DNA, 75 bp, Artificial Sequence
  Synthetic
gcaatctgtcatctaccatcgcaagattagtagaaaatgggcttgagaaagatgttgcagtattacttaaccaag

SEQ ID NO: 18731 - DNA, 75 bp, Artificial Sequence
  Synthetic
acacaaaattcacttggcttcacattaaacaattgcagagacatcttatactcacagcgcgtatgagatctgggc

SEQ ID NO: 18732 - DNA, 75 bp, Artificial Sequence
  Synthetic
taaacaattgcagagacatcttatactcacagcgcgtatgagatctgggcagcaactttacatccaattaaagca

SEQ ID NO: 18733 - DNA, 75 bp, Artificial Sequence
  Synthetic
gattactcgaatgtgaagaagctcattggatcacagaattatagaaacctgcagtatgccactctactccctggg

SEQ ID NO: 18734 - DNA, 75 bp, Artificial Sequence
  Synthetic
ttggatcacagaattatagaaacctgcagtatgccactctactccctgggcaagtaggtgggttcaacttcttaa

SEQ ID NO: 18735 - DNA, 75 bp, Artificial Sequence
  Synthetic
acggaaaaaaccttgttacagcacttacacctgagatggtcttaatgtatagtgacatgctagaaggaagagata

SEQ ID NO: 18736 - DNA, 75 bp, Artificial Sequence
  Synthetic
tacacctgagatggtcttaatgtatagtgacatgctagaaggaagagatatggtcataagtgttgcacagcttgt

SEQ ID NO: 18737 - DNA, 75 bp, Artificial Sequence
  Synthetic
ctagcagatattaaatgctatataatggctggtctacttccgagacacattttaagaaatattatgctaagagag

SEQ ID NO: 18738 - DNA, 75 bp, Artificial Sequence
  Synthetic
tggctggtctacttccgagacacattttaagaaatattatgctaagagagccaagtgacgggggttgggtcacat

SEQ ID NO: 18739 - DNA, 75 bp, Artificial Sequence
  Synthetic
ttgaccaattggcgtgcttgataaaggatgctatatatgaaataattgggattttggagggtttagcttatgcag

SEQ ID NO: 18740 - DNA, 75 bp, Artificial Sequence
  Synthetic
ggatgctatatatgaaataattgggattttggagggtttagcttatgcagcagtccagctgctggagccgtccgg

SEQ ID NO: 18741 - DNA, 75 bp, Artificial Sequence
  Synthetic
acataccttaagaaacatacccagaggtcattattggctcactcaacaaacccgttactcctcggtgtccaaatt

SEQ ID NO: 18742 - DNA, 75 bp, Artificial Sequence
  Synthetic
ggtcattattggctcactcaacaaacccgttactcctcggtgtccaaattcaaacgcaacatgaggaggaagaag

SEQ ID NO: 18743 - DNA, 75 bp, Artificial Sequence
  Synthetic
tattgcgagaacacatagaccctgtgttagctaacagggtacttgagtctattacctggatttacagtggtctga

SEQ ID NO: 18744 - DNA, 75 bp, Artificial Sequence
  Synthetic
gttagctaacagggtacttgagtctattacctggatttacagtggtctgacagacaaccaagcagcagagatgct

SEQ ID NO: 18745 - DNA, 75 bp, Artificial Sequence
  Synthetic
catgttgtaatggagagttctatccttggtaagagaaaacaaattcaggggttgatagacacaactcctactatc

SEQ ID NO: 18746 - DNA, 75 bp, Artificial Sequence
  Synthetic
ttggtaagagaaaacaaattcaggggttgatagacacaactcctactatcattaagacagcacttatgagtcagc

SEQ ID NO: 18747 - DNA, 75 bp, Artificial Sequence
  Synthetic
cagctgcagtgcgaaagcaaatgtgcgcgccaaaactcattgacttcgacatgatccaacaagtattggctttct

SEQ ID NO: 18748 - DNA, 75 bp, Artificial Sequence
  Synthetic
cgcgccaaaactcattgacttcgacatgatccaacaagtattggctttctttaaagggacaatcatcaatggata

SEQ ID NO: 18749 - DNA, 75 bp, Artificial Sequence
  Synthetic
atctctgcatgtcatgatagtgtactctcaggagagtgcttgactacagagaagaggatgatatgggacacatcc

SEQ ID NO: 18750 - DNA, 75 bp, Artificial Sequence
  Synthetic
tctcaggagagtgcttgactacagagaagaggatgatatgggacacatcccttctttcggaagagacatgcagtg

SEQ ID NO: 18751 - DNA, 75 bp, Artificial Sequence
  Synthetic
atggatcaacactccaacagttgcatgctgactatgcagagatatcacacgaattaatgctgaaagaatacaagc

SEQ ID NO: 18752 - DNA, 75 bp, Artificial Sequence
  Synthetic
tgctgactatgcagagatatcacacgaattaatgctgaaagaatacaagcgtctagcaatgcttgagtttgagaa

SEQ ID NO: 18753 - DNA, 75 bp, Artificial Sequence
  Synthetic
ggaagaggagtggcaggggtaacatcaccagatactttagaactcatcacagggtcgctgataggggaaaattcg

SEQ ID NO: 18754 - DNA, 75 bp, Artificial Sequence
  Synthetic
caccagatactttagaactcatcacagggtcgctgataggggaaaattcgttttgcaggttatgtgaactagggg

SEQ ID NO: 18755 - DNA, 75 bp, Artificial Sequence
  Synthetic
aggctatagcacacacgcgaccaaattggctggcatcttttaaaagaactttgttatccgatagacagcagctct

SEQ ID NO: 18756 - DNA, 75 bp, Artificial Sequence
  Synthetic
ttggctggcatcttttaaaagaactttgttatccgatagacagcagctcttagcaaaggatgcaacttcgaccaa

SEQ ID NO: 18757 - DNA, 75 bp, Artificial Sequence
  Synthetic
ccttacctgaccaacacaaaaatgagagtaccatacttagggtctaaaacagaagagagaagggctgcatccgta

SEQ ID NO: 18758 - DNA, 75 bp, Artificial Sequence
  Synthetic
gagtaccatacttagggtctaaaacagaagagagaagggctgcatccgtagcaacagtcaaaggtatgtctcacc

SEQ ID NO: 18759 - DNA, 75 bp, Artificial Sequence
  Synthetic
agatgacctatttgacaagtcttgaatttcttagagataatgacgtggcagtatcatattcgttaaaggagaaag

SEQ ID NO: 18760 - DNA, 75 bp, Artificial Sequence
  Synthetic
atttcttagagataatgacgtggcagtatcatattcgttaaaggagaaagaagttaagcccaatggtagaatctt

SEQ ID NO: 18761 - DNA, 75 bp, Artificial Sequence
  Synthetic
gacattgaagtaaactgggagcaagcatgtattatcgcgaacacgagatgcaatatcaccatggaccagttgaaa

SEQ ID NO: 18762 - DNA, 75 bp, Artificial Sequence
  Synthetic
catgtattatcgcgaacacgagatgcaatatcaccatggaccagttgaaactcctaacaccgatacctagcagtt

SEQ ID NO: 18763 - DNA, 75 bp, Artificial Sequence
  Synthetic
tcctagcagacgaaattgcaccttttttccaagggaatggagtcattcaaagcagcatctctctgacgaaaagta

SEQ ID NO: 18764 - DNA, 75 bp, Artificial Sequence
  Synthetic
tttccaagggaatggagtcattcaaagcagcatctctctgacgaaaagtatgttagcaatgagtcaactgtcatt

SEQ ID NO: 18765 - DNA, 75 bp, Artificial Sequence
  Synthetic
cctgctagtttatccaaggtatcttcgtttgtccatatttgcaatgacttccaaaagcttgaaagagatgatacg

SEQ ID NO: 18766 - DNA, 75 bp, Artificial Sequence
  Synthetic
cgtttgtccatatttgcaatgacttccaaaagcttgaaagagatgatacggctgtcgactccaatttaatttacc

SEQ ID NO: 18767 - DNA, 75 bp, Artificial Sequence
  Synthetic
ataggacacgacaccgtgaacgaaagcgaagaaggcgagtagctacatatatcacaactgacctgcagaagtact

SEQ ID NO: 18768 - DNA, 75 bp, Artificial Sequence
  Synthetic
gcgaagaaggcgagtagctacatatatcacaactgacctgcagaagtactgtctcaattggaggtatcagaccat

SEQ ID NO: 18769 - DNA, 75 bp, Artificial Sequence
  Synthetic
gaagtggagtgggtggccaacaaccaaacactacatttgcatactggacaatcatgttgcccgagagagatagat

SEQ ID NO: 18770 - DNA, 75 bp, Artificial Sequence
  Synthetic
aaacactacatttgcatactggacaatcatgttgcccgagagagatagatgggagtatagttaatgaagcaaggc

SEQ ID NO: 18771 - DNA, 75 bp, Artificial Sequence
  Synthetic
ttgagtggatccaccttcgtctaatggataccactatgttcgttggagatccatacaacccaccctctgatccaa

SEQ ID NO: 18772 - DNA, 75 bp, Artificial Sequence
  Synthetic
ggataccactatgttcgttggagatccatacaacccaccctctgatccaacaattgaaaacctggatgatgcacc

SEQ ID NO: 18773 - DNA, 75 bp, Artificial Sequence
  Synthetic
aatgcgccgctgcctgaaactgcatcaatagagctctacatgaagaattttagattcacagaacttaatatcgat

SEQ ID NO: 18774 - DNA, 75 bp, Artificial Sequence
  Synthetic
caatagagctctacatgaagaattttagattcacagaacttaatatcgatgcaattacaggttatgcagcaatcg

SEQ ID NO: 18775 - DNA, 75 bp, Artificial Sequence
  Synthetic
gtcaaaagctttggactaccatatcaatatccgcaatacaattagcagccacccggtcaaagtgtagggtagcct

SEQ ID NO: 18776 - DNA, 75 bp, Artificial Sequence
  Synthetic
aatatccgcaatacaattagcagccacccggtcaaagtgtagggtagcctgtatggtgcaaggtgacaatcaggt

SEQ ID NO: 18777 - DNA, 75 bp, Artificial Sequence
  Synthetic
gagggaattggatcatccgttaaaaatgatgctctaatcacctttgacaactcaatcaattggatctcagagttt

SEQ ID NO: 18778 - DNA, 75 bp, Artificial Sequence
  Synthetic
atgatgctctaatcacctttgacaactcaatcaattggatctcagagtttctcatgtgtgatataaggcagttaa

SEQ ID NO: 18779 - DNA, 75 bp, Artificial Sequence
  Synthetic
tagatgaattacataaggccagcgacagattctttgaggaactcactcacgtgaatcatctgatcggacataacc

SEQ ID NO: 18780 - DNA, 75 bp, Artificial Sequence
  Synthetic
cagattctttgaggaactcactcacgtgaatcatctgatcggacataacctgaaagatagagagaccatacgctc

SEQ ID NO: 18781 - DNA, 75 bp, Artificial Sequence
  Synthetic
tatttgagggtaataggacagcagaacatcctattatatatcaaacaagcacttgagagagttcctgtcattcag

SEQ ID NO: 18782 - DNA, 75 bp, Artificial Sequence
  Synthetic
acatcctattatatatcaaacaagcacttgagagagttcctgtcattcagtttgccaatcttgcattgactatat

SEQ ID NO: 18783 - DNA, 75 bp, Artificial Sequence
  Synthetic
tttctcaggccctcaagaatgctgcaaagctcgtcttaatatctggggagattggggagaacactcctatgtcat

SEQ ID NO: 18784 - DNA, 75 bp, Artificial Sequence
  Synthetic
aaagctcgtcttaatatctggggagattggggagaacactcctatgtcatgcgggaatattgcttctacagtgtc

SEQ ID NO: 18785 - DNA, 75 bp, Artificial Sequence
  Synthetic
gcatcaggaccgtacgttgcaagtgttgattttattgcagctagtcgcgatcttattgaatacggatgcaagttg

SEQ ID NO: 18786 - DNA, 75 bp, Artificial Sequence
  Synthetic
ttgattttattgcagctagtcgcgatcttattgaatacggatgcaagttgtatattagtggcctacttgacaata

SEQ ID NO: 18787 - DNA, 75 bp, Artificial Sequence
  Synthetic
atatattaacctgtatacaatttttctttgacaatgagttttccattgtccccgcttctcagcgtggatccacag

SEQ ID NO: 18788 - DNA, 75 bp, Artificial Sequence
  Synthetic
ctttgacaatgagttttccattgtccccgcttctcagcgtggatccacagttgaatgggtggataacctttcatt

SEQ ID NO: 18789 - DNA, 75 bp, Artificial Sequence
  Synthetic
aagatggagcaattcttggcacggagatgctgcttacttgtcttgttgtcaggaactcaagtatcccttcctatc

SEQ ID NO: 18790 - DNA, 75 bp, Artificial Sequence
  Synthetic
gatgctgcttacttgtcttgttgtcaggaactcaagtatcccttcctatcattagggaacaaaatgcaatagaaa

SEQ ID NO: 18791 - DNA, 75 bp, Artificial Sequence
  Synthetic
tacaatattctagattgtttactcgcaatatcggggacccatgcactactgcacttgcagagattaagagattag

SEQ ID NO: 18792 - DNA, 75 bp, Artificial Sequence
  Synthetic
caatatcggggacccatgcactactgcacttgcagagattaagagattagagagagctcaactaataccagggaa

SEQ ID NO: 18793 - DNA, 75 bp, Artificial Sequence
  Synthetic
aatgtatcagatcgtgtgggaaatctcttaagtatatctatggcgcctaagttagaatcgttgatgacaaatctg

SEQ ID NO: 18794 - DNA, 75 bp, Artificial Sequence
  Synthetic
tcttaagtatatctatggcgcctaagttagaatcgttgatgacaaatctgtatttctccaccagacgagtactat

SEQ ID NO: 18795 - DNA, 75 bp, Artificial Sequence
  Synthetic
ctctttgtaatgatccttattcactcaatattgaaacagcaccaagcccaaatctcatcctcaagaaacatactc

SEQ ID NO: 18796 - DNA, 75 bp, Artificial Sequence
  Synthetic
caatattgaaacagcaccaagcccaaatctcatcctcaagaaacatactcagagagtactatttgaatcctgcac

SEQ ID NO: 18797 - DNA, 75 bp, Artificial Sequence
  Synthetic
agggaagacttggatagccttaatacacaaattgatgatgataacatttttttggaagatcctatattacagaga

SEQ ID NO: 18798 - DNA, 75 bp, Artificial Sequence
  Synthetic
cacaaattgatgatgataacatttttttggaagatcctatattacagagagggcttttcttttcattcgacatag

SEQ ID NO: 18799 - DNA, 75 bp, Artificial Sequence
  Synthetic
cagaattagcagaattcttgctcaatcaagaagctatacatccgcgcgtggcacacgttataatggaggccagcg

SEQ ID NO: 18800 - DNA, 75 bp, Artificial Sequence
  Synthetic
tcaagaagctatacatccgcgcgtggcacacgttataatggaggccagcgcagtcggtagaaagaagcaaattca

SEQ ID NO: 18801 - DNA, 75 bp, Artificial Sequence
  Synthetic
tcaagtggaccaaactgtgtggctattaaaagacaagacacctacattcagcatttactaaagacagtgggtcaa

SEQ ID NO: 18802 - DNA, 75 bp, Artificial Sequence
  Synthetic
ttaaaagacaagacacctacattcagcatttactaaagacagtgggtcaatgcagcactagttggtataagtatg

SEQ ID NO: 18803 - DNA, 75 bp, Artificial Sequence
  Synthetic
gtcctcttggtgcaaggaggttaaggaagataaacagttattcttctatgcacatgttgatcttcctggatgata

SEQ ID NO: 18804 - DNA, 75 bp, Artificial Sequence
  Synthetic
gaagataaacagttattcttctatgcacatgttgatcttcctggatgatatattcctacctaaccatcctccatc

SEQ ID NO: 18805 - DNA, 75 bp, Artificial Sequence
  Synthetic
ctgtatataggagagggaagcgggagtgtaatgacactgttggagtacctagagccatcacacactatcttttac

SEQ ID NO: 18806 - DNA, 75 bp, Artificial Sequence
  Synthetic
gtgtaatgacactgttggagtacctagagccatcacacactatcttttacaactcactgttttttaatgaaatga

SEQ ID NO: 18807 - DNA, 75 bp, Artificial Sequence
  Synthetic
gtcagattacctggttgcctctgacaaatggtaggaagatattaggtgtaaataatccagatacccttgagttag

SEQ ID NO: 18808 - DNA, 75 bp, Artificial Sequence
  Synthetic
aaatggtaggaagatattaggtgtaaataatccagatacccttgagttagtatcaggatcgatgctgaatctaaa

SEQ ID NO: 18809 - DNA, 75 bp, Artificial Sequence
  Synthetic
atagttatgaagaatataacatcaggggcaccatgtagcttagggttcatacagcaatttatacccttatggaga

SEQ ID NO: 18810 - DNA, 75 bp, Artificial Sequence
  Synthetic
gggcaccatgtagcttagggttcatacagcaatttatacccttatggagagaaattgatcaagaaacaaatatta

SEQ ID NO: 18811 - DNA, 75 bp, Artificial Sequence
  Synthetic
atctcccagcagatatagagctagcggacagttcatcatccaaccctccaatgcgtataccttatgtgggatcca

SEQ ID NO: 18812 - DNA, 75 bp, Artificial Sequence
  Synthetic
ggacagttcatcatccaaccctccaatgcgtataccttatgtgggatccaagacccaggaaaggagaaatgcatc

SEQ ID NO: 18813 - DNA, 75 bp, Artificial Sequence
  Synthetic
ctcaagagagttaattgtgacgtagaatttgatgaaggaatgccaatcgaaagaataatacaagggtatacccat

SEQ ID NO: 18814 - DNA, 75 bp, Artificial Sequence
  Synthetic
aatttgatgaaggaatgccaatcgaaagaataatacaagggtatacccatgttctaatgctggctgcgtatgggc

SEQ ID NO: 18815 - DNA, 75 bp, Artificial Sequence
  Synthetic
tggcgtctgtgaaggtaagggcttacggtgataatgagcataattggcaagttgcatggcagctagcaaatactc

SEQ ID NO: 18816 - DNA, 75 bp, Artificial Sequence
  Synthetic
cggtgataatgagcataattggcaagttgcatggcagctagcaaatactcgatgtgcgatatcccttgaacatct

SEQ ID NO: 18817 - DNA, 75 bp, Artificial Sequence
  Synthetic
gtgttccaattcgtgatttcatctcttttaatgatatttgggaaagtgacaattcatagaaatgcttacatgagc

SEQ ID NO: 18818 - DNA, 75 bp, Artificial Sequence
  Synthetic
ttttaatgatatttgggaaagtgacaattcatagaaatgcttacatgagcccaaatcatgaggagttcgtgctgg

SEQ ID NO: 18819 - DNA, 75 bp, Artificial Sequence
  Synthetic
atgatagcataacccagatgacctttactcccgcttctctctatcgggtggcaccttatatccacatctccaatg

SEQ ID NO: 18820 - DNA, 75 bp, Artificial Sequence
  Synthetic
tactcccgcttctctctatcgggtggcaccttatatccacatctccaatgactcacaaagaatgttttctgatga

SEQ ID NO: 18821 - DNA, 75 bp, Artificial Sequence
  Synthetic
acccgggtaaaacttcttgtggaccgggacctgaccattgtcacgccttgtcaagcactaaggattagacaggaa

SEQ ID NO: 18822 - DNA, 75 bp, Artificial Sequence
  Synthetic
gggacctgaccattgtcacgccttgtcaagcactaaggattagacaggaatgggaaagtctaagctcgaaggttg

SEQ ID NO: 18823 - DNA, 75 bp, Artificial Sequence
  Synthetic
tatcagctatcgaatcattgttccccttgaccactaatcatgtatatgaagaagtgacactacaccttcatactc

SEQ ID NO: 18824 - DNA, 75 bp, Artificial Sequence
  Synthetic
cttgaccactaatcatgtatatgaagaagtgacactacaccttcatactcaattcagctgctgcctgagagaggc

SEQ ID NO: 18825 - DNA, 75 bp, Artificial Sequence
  Synthetic
aagacagactctctcctactgcaactcggaggtaagattgtaacgttcggcggcatagatatccagtcattacta

SEQ ID NO: 18826 - DNA, 75 bp, Artificial Sequence
  Synthetic
tcggaggtaagattgtaacgttcggcggcatagatatccagtcattactagacctagaaatgaatgacgcgagaa

SEQ ID NO: 18827 - DNA, 75 bp, Artificial Sequence
  Synthetic
ctgctgaggggaaccaattcgtgtatgactcatccccacttttggaacctgaggctcttcaactcgatgtggcta

SEQ ID NO: 18828 - DNA, 75 bp, Artificial Sequence
  Synthetic
tgactcatccccacttttggaacctgaggctcttcaactcgatgtggctactttcaagaactatgagttggactt

SEQ ID NO: 18829 - DNA, 75 bp, Artificial Sequence
  Synthetic
tggtcagagaacgacgatgtggatctagcactgatgttagggccattcaacataaataaacatcgacgactgtat

SEQ ID NO: 18830 - DNA, 75 bp, Artificial Sequence
  Synthetic
tagcactgatgttagggccattcaacataaataaacatcgacgactgtatacggtagcccaggcatgtactcttg

SEQ ID NO: 18831 - DNA, 75 bp, Artificial Sequence
  Synthetic
gaaagctaataggtcagtcggtgatttcatacaatgaggacacttctataaagaatgatgcaattattgtatacg

SEQ ID NO: 18832 - DNA, 75 bp, Artificial Sequence
  Synthetic
ttcatacaatgaggacacttctataaagaatgatgcaattattgtatacgataatacccggaattggatcagtga

SEQ ID NO: 18833 - DNA, 75 bp, Artificial Sequence
  Synthetic
gtaacctacctagccactacagttctgagaggggtattttcttggtccacactgatggctcaaaaggaatatgag

SEQ ID NO: 18834 - DNA, 75 bp, Artificial Sequence
  Synthetic
tgagaggggtattttcttggtccacactgatggctcaaaaggaatatgagaagacaactaaacgacctagattcg

SEQ ID NO: 18835 - DNA, 75 bp, Artificial Sequence
  Synthetic
tcttgctggactgcgcattccaaatgtattatctaagggttcgcggatacaagaacatcctaatatacatggcag

SEQ ID NO: 18836 - DNA, 75 bp, Artificial Sequence
  Synthetic
gtattatctaagggttcgcggatacaagaacatcctaatatacatggcagacctaattcgtaatatgcccggtat

SEQ ID NO: 18837 - DNA, 75 bp, Artificial Sequence
  Synthetic
tcaaagattgtcttgacgcgacccgagtcaaagagattattgaaattgctgggcagtttgattaagacactgtaa

SEQ ID NO: 18838 - DNA, 75 bp, Artificial Sequence
  Synthetic
gactatacaatgcagggttgctggatcatgggagtgcgcaccaacttgcaagcattgattttattgaattatcag

SEQ ID NO: 18839 - DNA, 75 bp, Artificial Sequence
  Synthetic
ttcaacaatctgatcaaaatgtataaataccagtggagggataataagaaaagttgtataatatagtaagtgtaa

SEQ ID NO: 18840 - DNA, 75 bp, Artificial Sequence
  Synthetic
tcatgggagtgcgcaccaacttgcaagcattgattttattgaattatcagctaatttattggtaacatgtatagc

SEQ ID NO: 18841 - DNA, 75 bp, Artificial Sequence
  Synthetic
accttacagaatctctgtttggtacgttataaagagatgaaatatatgaatttgtacgggcagaacctgtgaatc

SEQ ID NO: 18842 - DNA, 75 bp, Artificial Sequence
  Synthetic
tttgtacgggcagaacctgtgaatctcgagttcgaccccgacggtctgagtctcgagattttggttcagccatgg

SEQ ID NO: 18843 - DNA, 75 bp, Artificial Sequence
  Synthetic
catccgttctagacgagaatttgacggagaaaatgtttcttctaatcgctcgatactgctctttgttagcgttgt

SEQ ID NO: 18844 - DNA, 75 bp, Artificial Sequence
  Synthetic
ggagaaaatgtttcttctaatcgctcgatactgctctttgttagcgttgttgtactcatctaaggttcctatacc

SEQ ID NO: 18845 - DNA, 75 bp, Artificial Sequence
  Synthetic
tcgagttcgaccccgacggtctgagtctcgagattttggttcagccatggcgtccgtttttgaagaatatgacaa

SEQ ID NO: 18846 - DNA, 75 bp, Artificial Sequence
  Synthetic
aaggaggaacacttaaggtggagctccctgtctttgtatgcaacagcaatgatgctgaaactcgatgggcatttg

SEQ ID NO: 18847 - DNA, 75 bp, Artificial Sequence
  Synthetic
atctcatgaaccttccatctgaatttcggctgaccgaaaatcaggtacgaaatgtactgcaaccagcactgacaa

SEQ ID NO: 18848 - DNA, 75 bp, Artificial Sequence
  Synthetic
tcggctgaccgaaaatcaggtacgaaatgtactgcaaccagcactgacaactttcccagcaaacctctattatat

SEQ ID NO: 18849 - DNA, 75 bp, Artificial Sequence
  Synthetic
ccctgtctttgtatgcaacagcaatgatgctgaaactcgatgggcatttgtctgcttcgccttgagactcgcagt

SEQ ID NO: 18850 - DNA, 75 bp, Artificial Sequence
  Synthetic
tctgtgcacattccgaaaccatgcgcactcacgtggcgatggcaggcaggaatggtgaaacatcaattgcacttc

SEQ ID NO: 18851 - DNA, 75 bp, Artificial Sequence
  Synthetic
tattcaaatgttgttccctgccggggatgaagctacaagcacggtggcagttaatttgggatacgaaagtaaatg

SEQ ID NO: 18852 - DNA, 75 bp, Artificial Sequence
  Synthetic
gatgaagctacaagcacggtggcagttaatttgggatacgaaagtaaatgaccccattgttaagtggcgacgcat

SEQ ID NO: 18853 - DNA, 75 bp, Artificial Sequence
  Synthetic
cactcacgtggcgatggcaggcaggaatggtgaaacatcaattgcacttctggagatcgatgcttttgtagacgg

SEQ ID NO: 18854 - DNA, 75 bp, Artificial Sequence
  Synthetic
gcttcagtatgattgcgggagatttgcctagatcctgttctaacaacacccctttcatcaatgctgatgcagaga

SEQ ID NO: 18855 - DNA, 75 bp, Artificial Sequence
  Synthetic
tactggatgaatgcatctctgatgttgataaaaacggacagggcatcctcgactttgtcccaatgactcgatacc

SEQ ID NO: 18856 - DNA, 75 bp, Artificial Sequence
  Synthetic
tgataaaaacggacagggcatcctcgactttgtcccaatgactcgatacctattcaggggtgtaggccaggcatc

SEQ ID NO: 18857 - DNA, 75 bp, Artificial Sequence
  Synthetic
gcctagatcctgttctaacaacacccctttcatcaatgctgatgcagagaatgatccccctgaggatataacaga

SEQ ID NO: 18858 - DNA, 75 bp, Artificial Sequence
  Synthetic
caaaggcgatgacctcttatgagacagcagaggagtccgaggtgaggaggataacaaaatatacacagcaaggga

SEQ ID NO: 18859 - DNA, 75 bp, Artificial Sequence
  Synthetic
aggcacgtttcggtaactcattgtacttagcagaaggtagcggtgcaataatgagtctgttagagctccacgtac

SEQ ID NO: 18860 - DNA, 75 bp, Artificial Sequence
  Synthetic
cttagcagaaggtagcggtgcaataatgagtctgttagagctccacgtaccacatgagaagatttactacaatac

SEQ ID NO: 18861 - DNA, 75 bp, Artificial Sequence
  Synthetic
agcagaggagtccgaggtgaggaggataacaaaatatacacagcaagggagagtaatcaagaagttcctattatt

SEQ ID NO: 18862 - DNA, 75 bp, Artificial Sequence
  Synthetic
tgagagcattcatggtgtccgagctaagacgtgcaaagaacacaccaagcggatctagtacgtattacagccttg

SEQ ID NO: 18863 - DNA, 75 bp, Artificial Sequence
  Synthetic
caactcaattccttgcatcggtcgtttacaagaaccttcaggcaggtatagtctgcaaagatgggtatgttcagg

SEQ ID NO: 18864 - DNA, 75 bp, Artificial Sequence
  Synthetic
ttacaagaaccttcaggcaggtatagtctgcaaagatgggtatgttcaggagttctgccctttatggagagacgt

SEQ ID NO: 18865 - DNA, 75 bp, Artificial Sequence
  Synthetic
aagacgtgcaaagaacacaccaagcggatctagtacgtattacagccttgtcggtgatatcaatgcatatgttca

SEQ ID NO: 18866 - DNA, 75 bp, Artificial Sequence
  Synthetic
ctcgcacgccagctctggcgcttagcagcctatctggagatatcaagaagctgggtaacctgatgagactctaca

SEQ ID NO: 18867 - DNA, 75 bp, Artificial Sequence
  Synthetic
cagaggtgcctggaggcactgtatctctactccattgtgacatagaaacaaccctggaaccaagctgggcttact

SEQ ID NO: 18868 - DNA, 75 bp, Artificial Sequence
  Synthetic
tctactccattgtgacatagaaacaaccctggaaccaagctgggcttacttggagcaattagccactaatatctc

SEQ ID NO: 18869 - DNA, 75 bp, Artificial Sequence
  Synthetic
cagcctatctggagatatcaagaagctgggtaacctgatgagactctacagagaaaaaggagacactgcgccgta

SEQ ID NO: 18870 - DNA, 75 bp, Artificial Sequence
  Synthetic
tcgccctgatgtattcatttgcgatgggcatggcgtcagtcctggataaagggactacaaaataccaatttgcca

SEQ ID NO: 18871 - DNA, 75 bp, Artificial Sequence
  Synthetic
tactatacacccagagtttcttttttcatctattgctggcaatcttagctccttgtagtaaaaggatacggatca

SEQ ID NO: 18872 - DNA, 75 bp, Artificial Sequence
  Synthetic
tcatctattgctggcaatcttagctccttgtagtaaaaggatacggatcatatccaatggatactcagtacgggg

SEQ ID NO: 18873 - DNA, 75 bp, Artificial Sequence
  Synthetic
gggcatggcgtcagtcctggataaagggactacaaaataccaatttgccagagacttcatgaatccagggtactg

SEQ ID NO: 18874 - DNA, 75 bp, Artificial Sequence
  Synthetic
ccatggcggctgagctccgcctgagtgggaacgcccgcaaggcgctagctaatgctgtatccagaatgactgaag

SEQ ID NO: 18875 - DNA, 75 bp, Artificial Sequence
  Synthetic
tcttcatgcaagaggtgatccgctctgccaaggcgttagttagagggggcggtagtatcatgacaaaacaagatg

SEQ ID NO: 18876 - DNA, 75 bp, Artificial Sequence
  Synthetic
tgccaaggcgttagttagagggggcggtagtatcatgacaaaacaagatgaacaacaattgaatcttgctttcca

SEQ ID NO: 18877 - DNA, 75 bp, Artificial Sequence
  Synthetic
tgggaacgcccgcaaggcgctagctaatgctgtatccagaatgactgaaggcgtaagccaggacttatttgaagg

SEQ ID NO: 18878 - DNA, 75 bp, Artificial Sequence
  Synthetic
catccaagccatcaagaggtgacgaagtcagaggacctgacggaattcccgctgatgaacagaggttcctagatc

SEQ ID NO: 18879 - DNA, 75 bp, Artificial Sequence
  Synthetic
tgatacgctacttgcagcatactattgatatggcattgattgaagcgggaggccaacctgtaagaccgagcaatg

SEQ ID NO: 18880 - DNA, 75 bp, Artificial Sequence
  Synthetic
tgatatggcattgattgaagcgggaggccaacctgtaagaccgagcaatgttggaatcaacaaggcactcgactt

SEQ ID NO: 18881 - DNA, 75 bp, Artificial Sequence
  Synthetic
agtcagaggacctgacggaattcccgctgatgaacagaggttcctagatctcatgaggagcattgcggggaatat

SEQ ID NO: 18882 - DNA, 75 bp, Artificial Sequence
  Synthetic
accgcgaggacgacaaccttgacggtgagcccagctcgcaatgggagctctaacatcactctgcccacacaccgg

SEQ ID NO: 18883 - DNA, 75 bp, Artificial Sequence
  Synthetic
ttaagacagcaatcttcctagaacaagaagaagaactggcagacacagtctttgtgttaacaccttataacctaa

SEQ ID NO: 18884 - DNA, 75 bp, Artificial Sequence
  Synthetic
agaagaagaactggcagacacagtctttgtgttaacaccttataacctaacggcaagaggaaaatgtaatacagt

SEQ ID NO: 18885 - DNA, 75 bp, Artificial Sequence
  Synthetic
tgagcccagctcgcaatgggagctctaacatcactctgcccacacaccggcggatcatcgcccgacccccacaac

SEQ ID NO: 18886 - DNA, 75 bp, Artificial Sequence
  Synthetic
ctcactgcccaacaactgaccaagctctactcaattgcacgattctgcatctattaagaaaaaaacaagcgtacg

SEQ ID NO: 18887 - DNA, 75 bp, Artificial Sequence
  Synthetic
cacgagacgacatggataagatagagaaattgttgtcccttatcttacaaggtcatatctcgcttcaggatctcc

SEQ ID NO: 18888 - DNA, 75 bp, Artificial Sequence
  Synthetic
gaaattgttgtcccttatcttacaaggtcatatctcgcttcaggatctcctgccactcaagtcatatcttaaacg

SEQ ID NO: 18889 - DNA, 75 bp, Artificial Sequence
  Synthetic
tctactcaattgcacgattctgcatctattaagaaaaaaacaagcgtacgggcagaactggtgtttcccgagtgg

SEQ ID NO: 18890 - DNA, 75 bp, Artificial Sequence
  Synthetic
caacccccatcccagtgatggcgaccttcacggatcaggaaatcgacgaaatattatcatctagtggtgctgtca

SEQ ID NO: 18891 - DNA, 75 bp, Artificial Sequence
  Synthetic
aagaggtatttgaacactcatcccgcatggtactaaccagaccgatgcaaaagatgtatctcaaatgtctcggaa

SEQ ID NO: 18892 - DNA, 75 bp, Artificial Sequence
  Synthetic
cttcacggatcaggaaatcgacgaaatattatcatctagtggtgctgtcatcgaagaaatcattactgcagaagg

SEQ ID NO: 18893 - DNA, 75 bp, Artificial Sequence
  Synthetic
agaaaaagataaaggcatgggagatccacaacacaaaagaccaaaagccagactccaccaccgccgcaagcaccg

SEQ ID NO: 18894 - DNA, 75 bp, Artificial Sequence
  Synthetic
atgacgcaatctcttttatacatcatactcgtaatcaatcatagttaccatcatttttaagaaaaacagtaacga

SEQ ID NO: 18895 - DNA, 75 bp, Artificial Sequence
  Synthetic
ccacaacacaaaagaccaaaagccagactccaccaccgccgcaagcaccgggaaagacgcacgcaacgaacagga

SEQ ID NO: 18896 - DNA, 75 bp, Artificial Sequence
  Synthetic
accaaacaaggactgcataagcagtgtaaaacttttaataaaaaataactttcgtgagggtgaatcgatcatcgc

SEQ ID NO: 18897 - DNA, 75 bp, Artificial Sequence
  Synthetic
tactcgtaatcaatcatagttaccatcatttttaagaaaaacagtaacgatttatggtgtcacgtatgttgccaa

SEQ ID NO: 18898 - DNA, 75 bp, Artificial Sequence
  Synthetic
ttcgtgagggtgaatcgatcatcgctcgaagccgatatcgactcacccaaattagctgcttgtataaggatccga

SEQ ID NO: 18899 - DNA, 75 bp, Artificial Sequence
  Synthetic
acaagacgccttcgaccgaccccggagacaacatccaggagcctgaccgcaacactgaccagatctctaccccat

SEQ ID NO: 18900 - DNA, 75 bp, Artificial Sequence
  Synthetic
tcgaagccgatatcgactcacccaaattagctgcttgtataaggatccgaatatcaattggaatcatgtcatcga

SEQ ID NO: 18901 - DNA, 75 bp, Artificial Sequence
  Synthetic
agacaacatccaggagcctgaccgcaacactgaccagatctctaccccatcagcaagtcttttgaccatgcttga

SEQ ID NO: 18902 - DNA, 75 bp, Artificial Sequence
  Synthetic
cggaaggttgataatgcttcaagtggcttgttgaaagttgagataccagtctgcgtcctgaattcacaggaccca

SEQ ID NO: 18903 - DNA, 75 bp, Artificial Sequence
  Synthetic
caaaccaaatcaacgtgacaccgactaaaaaagggatcatggcgggcaactcagctgcaaagaaagaaacagtgg

SEQ ID NO: 18904 - DNA, 75 bp, Artificial Sequence
  Synthetic
gcttgttgaaagttgagataccagtctgcgtcctgaattcacaggacccagttgagagacaccagttcgcagtat

SEQ ID NO: 18905 - DNA, 75 bp, Artificial Sequence
  Synthetic
taaaaaagggatcatggcgggcaactcagctgcaaagaaagaaacagtggaccaagctcttcatcaggggctgtc

SEQ ID NO: 18906 - DNA, 75 bp, Artificial Sequence
  Synthetic
ggtgccctgctttctcttctcagtttgcacacagaaaacatgcgagcgcatgttctattagcagcccggtcagga

SEQ ID NO: 18907 - DNA, 75 bp, Artificial Sequence
  Synthetic
ggagaaagagggcatcatatctctcggatggtgcaatccgatctgtgccccggtcactgcagaaccccgaaaatt

SEQ ID NO: 18908 - DNA, 75 bp, Artificial Sequence
  Synthetic
tgcacacagaaaacatgcgagcgcatgttctattagcagcccggtcaggagatgctaatataacaattctagaag

SEQ ID NO: 18909 - DNA, 75 bp, Artificial Sequence
  Synthetic
ggatggtgcaatccgatctgtgccccggtcactgcagaaccccgaaaattccagtgtagatgcggagagtgcccc

SEQ ID NO: 18910 - DNA, 75 bp, Artificial Sequence
  Synthetic
ggtgtctcatctgataaagctgatcggctgctggctgtcgcaatgaatcttattgcaggttgtcagaataactca

SEQ ID NO: 18911 - DNA, 75 bp, Artificial Sequence
  Synthetic
cgcagagaatggcaaagatagaatatagtcttgatttagtattgaagcatgcttctgctgtcccaataataaaga

SEQ ID NO: 18912 - DNA, 75 bp, Artificial Sequence
  Synthetic
ggctgctggctgtcgcaatgaatcttattgcaggttgtcagaataactcaccatttgtcgacccatcgattgagg

SEQ ID NO: 18913 - DNA, 75 bp, Artificial Sequence
  Synthetic
tagtcttgatttagtattgaagcatgcttctgctgtcccaataataaagaatgacctgcagcaaataaagacaac

SEQ ID NO: 18914 - DNA, 75 bp, Artificial Sequence
  Synthetic
gcggttcaagcatgggtagctgcaataaagagtatgacggcaccagatactgctgcggagagtgaggggcggcga

SEQ ID NO: 18915 - DNA, 75 bp, Artificial Sequence
  Synthetic
gtaatgccaccatctcgtcgcttaatgatttacgtgccacaactcagcttagacctgtcctagtggcaggccctg

SEQ ID NO: 18916 - DNA, 75 bp, Artificial Sequence
  Synthetic
taaagagtatgacggcaccagatactgctgcggagagtgaggggcggcgattagcaaaataccagcagcaaggtc

SEQ ID NO: 18917 - DNA, 75 bp, Artificial Sequence
  Synthetic
tgatttacgtgccacaactcagcttagacctgtcctagtggcaggccctggcgatcctgctccgtacatacaaaa

SEQ ID NO: 18918 - DNA, 75 bp, Artificial Sequence
  Synthetic
cggataatcaggggttctctggtagttcgacacttccttataggagaaatcagaagagcaggaagtatgggagaa

SEQ ID NO: 18919 - DNA, 75 bp, Artificial Sequence
  Synthetic
tcaacctggtgaaaagccttactcctccaggaccagatcttgcaactgaaaaagaaacagtgagagctctcatca

SEQ ID NO: 18920 - DNA, 75 bp, Artificial Sequence
  Synthetic
ttcgacacttccttataggagaaatcagaagagcaggaagtatgggagaacagacaacagcctattatgccatgg

SEQ ID NO: 18921 - DNA, 75 bp, Artificial Sequence
  Synthetic
tccaggaccagatcttgcaactgaaaaagaaacagtgagagctctcatcaattctcgtccaatgcatccaaattc

SEQ ID NO: 18922 - DNA, 75 bp, Artificial Sequence
  Synthetic
ctgacattacgatttggggtgggtaccaagtatcctccccttgcaatggctgcattttcaggagatctcactaaa

SEQ ID NO: 18923 - DNA, 75 bp, Artificial Sequence
  Synthetic
ttaagaaagtaaagcgtctggcactcaatggataaatgtgcagggcaacacagcccaggatccccggaaccgcaa

SEQ ID NO: 18924 - DNA, 75 bp, Artificial Sequence
  Synthetic
ccaagtatcctccccttgcaatggctgcattttcaggagatctcactaaactccagagcctgatcagactatatc

SEQ ID NO: 18925 - DNA, 75 bp, Artificial Sequence
  Synthetic
caatggataaatgtgcagggcaacacagcccaggatccccggaaccgcaagctcaaccgcccgcccccgcataca

SEQ ID NO: 18926 - DNA, 75 bp, Artificial Sequence
  Synthetic
atgggcaactttgctcctgcaaattacaccttgctctattcatatgcaatgggcattggttctgtattggaggct

SEQ ID NO: 18927 - DNA, 75 bp, Artificial Sequence
  Synthetic
caccttctcaaccctccactctactgattcgacctgggcacaatcccgtcctttatccataagattaagaaaaaa

SEQ ID NO: 18928 - DNA, 75 bp, Artificial Sequence
  Synthetic
acaccttgctctattcatatgcaatgggcattggttctgtattggaggctagtatcggtagataccagtatgcga

SEQ ID NO: 18929 - DNA, 75 bp, Artificial Sequence
  Synthetic
gattcgacctgggcacaatcccgtcctttatccataagattaagaaaaaatgtacgggcagaattggggttcgtc

SEQ ID NO: 18930 - DNA, 75 bp, Artificial Sequence
  Synthetic
cagcaacaaggagcactggatgagaaattggctaacgagatggggctatcagaccaggcaagggcagcagtttcc

SEQ ID NO: 18931 - DNA, 75 bp, Artificial Sequence
  Synthetic
tagcctgccctccagtgcactactggccttcccggttgttctccaggacatcggcgatgggaagaaagaaatcac

SEQ ID NO: 18932 - DNA, 75 bp, Artificial Sequence
  Synthetic
aattggctaacgagatggggctatcagaccaggcaagggcagcagtttccagattagttaatgagatggatatgg

SEQ ID NO: 18933 - DNA, 75 bp, Artificial Sequence
  Synthetic
gccttcccggttgttctccaggacatcggcgatgggaagaaagaaatcactcctcagttccgcacccaaaagatt

SEQ ID NO: 18934 - DNA, 75 bp, Artificial Sequence
  Synthetic
gcagccccacaggcaaatcctccagcccaaccaagacagaatgacacaccacagcagcctgctcctcttcagcag

SEQ ID NO: 18935 - DNA, 75 bp, Artificial Sequence
  Synthetic
tttcatctacggcccaaaaggaggagagcgcatctccggtcccatatctgcagggggcaacactgaagtcctgag

SEQ ID NO: 18936 - DNA, 75 bp, Artificial Sequence
  Synthetic
cccaaccaagacagaatgacacaccacagcagcctgctcctcttcagcagccaattcgaattgccatgcctcaaa

SEQ ID NO: 18937 - DNA, 75 bp, Artificial Sequence
  Synthetic
gagcgcatctccggtcccatatctgcagggggcaacactgaagtcctgagtgcagcaatgttgtgtctcggaagc

SEQ ID NO: 18938 - DNA, 75 bp, Artificial Sequence
  Synthetic
aacaattggcattaagatctaagctgaatgtatgagcacacgagtacccaagtatatttgttagcagttgcatga

SEQ ID NO: 18939 - DNA, 75 bp, Artificial Sequence
  Synthetic
cgtagtatcatgcaagaaaagcgctactgatactgaaagaattatatttactgtccatcaagcgtctcaactgct

SEQ ID NO: 18940 - DNA, 75 bp, Artificial Sequence
  Synthetic
gaatgtatgagcacacgagtacccaagtatatttgttagcagttgcatgaaatcattatccatattattgatttg

SEQ ID NO: 18941 - DNA, 75 bp, Artificial Sequence
  Synthetic
actgatactgaaagaattatatttactgtccatcaagcgtctcaactgctgcaggaggcaaaagtgatatcaaac

SEQ ID NO: 18942 - DNA, 75 bp, Artificial Sequence
  Synthetic
tccacaaaaattaaaaaaattgtgagggggaacacctttcagtcggtcaactgctgctaataacctgcaattatc

SEQ ID NO: 18943 - DNA, 75 bp, Artificial Sequence
  Synthetic
cacgagcggtatatccttggaatatcgagttacttttgtctctcttactgtagtccctcgtggagatgtgtataa

SEQ ID NO: 18944 - DNA, 75 bp, Artificial Sequence
  Synthetic
gggggaacacctttcagtcggtcaactgctgctaataacctgcaattatcacgtggattgaatatggaattcagt

SEQ ID NO: 18945 - DNA, 75 bp, Artificial Sequence
  Synthetic
cgagttacttttgtctctcttactgtagtccctcgtggagatgtgtataaagtgccacgtcctgtcctgcgcctc

SEQ ID NO: 18946 - DNA, 75 bp, Artificial Sequence
  Synthetic
gggcattcagcatgcaacaatggctgatccgggaacactagggaagtcagctattcctgcaggtaataccaaacg

SEQ ID NO: 18947 - DNA, 75 bp, Artificial Sequence
  Synthetic
agtgcagccaggtcaccctattgctaagaccctcatcaagcagagtgatgaatacttcgcagacttgtttgtgca

SEQ ID NO: 18948 - DNA, 75 bp, Artificial Sequence
  Synthetic
gatccgggaacactagggaagtcagctattcctgcaggtaataccaaacgcttagagaaattatgggagaaagaa

SEQ ID NO: 18949 - DNA, 75 bp, Artificial Sequence
  Synthetic
aagaccctcatcaagcagagtgatgaatacttcgcagacttgtttgtgcatgttggcatgatatcagccatagac

SEQ ID NO: 18950 - DNA, 75 bp, Artificial Sequence
  Synthetic
tataagcggggaactacctgaggaaaacgctaaaactgaaccaacagggactcaagaaatgccagaacaaattca

SEQ ID NO: 18951 - DNA, 75 bp, Artificial Sequence
  Synthetic
aatggacatgtcgataggactcctggatatattcggaccgagtatagcactcaaggtcagagggaagaggaccaa

SEQ ID NO: 18952 - DNA, 75 bp, Artificial Sequence
  Synthetic
aacgctaaaactgaaccaacagggactcaagaaatgccagaacaaattcaaaagaatgacaatctccaacctgca

SEQ ID NO: 18953 - DNA, 75 bp, Artificial Sequence
  Synthetic
gatatattcggaccgagtatagcactcaaggtcagagggaagaggaccaaagtcatgacaccctttttttcacct

SEQ ID NO: 18954 - DNA, 75 bp, Artificial Sequence
  Synthetic
taaaaaagggttagtgctatcgccccaatcactgaaaggtgtgtcccccttaatcaagaaccaggatctgaagaa

SEQ ID NO: 18955 - DNA, 75 bp, Artificial Sequence
  Synthetic
aattctgtggagcaacaccgggaccctcagagaagctagaataataatccagggcggaactaacaaagcaatagc

SEQ ID NO: 18956 - DNA, 75 bp, Artificial Sequence
  Synthetic
caatcactgaaaggtgtgtcccccttaatcaagaaccaggatctgaagaacaccatgcaggacctggaaaccaaa

SEQ ID NO: 18957 - DNA, 75 bp, Artificial Sequence
  Synthetic
ctcagagaagctagaataataatccagggcggaactaacaaagcaatagccacaactgatgatcattttgtaact

SEQ ID NO: 18958 - DNA, 75 bp, Artificial Sequence
  Synthetic
tggaagcctggtcatagacgagagtattcctttgcttggagtgcaggaacaaacaaatttattgtctcctcgtgg

SEQ ID NO: 18959 - DNA, 75 bp, Artificial Sequence
  Synthetic
gaaatgaactcacagcatcatcaatcccatcatttcttcatcataccagtcacgaggctaataaatcagcactaa

SEQ ID NO: 18960 - DNA, 75 bp, Artificial Sequence
  Synthetic
attcctttgcttggagtgcaggaacaaacaaatttattgtctcctcgtggtgtaacccaacttgcgccccaatca

SEQ ID NO: 18961 - DNA, 75 bp, Artificial Sequence
  Synthetic
cccatcatttcttcatcataccagtcacgaggctaataaatcagcactaatcattaaccgatgacagagtgaatc

SEQ ID NO: 18962 - DNA, 75 bp, Artificial Sequence
  Synthetic
tgccctggatgtcaatcagctctgggatgtaatcaatcagcaacacaagatgctgataaacctacaaaatcaagt

SEQ ID NO: 18963 - DNA, 75 bp, Artificial Sequence
  Synthetic
agaaaaaactgatactgccacgggcagaactgggattcagacgtacgtggccactccactgcaggaacaacatgg

SEQ ID NO: 18964 - DNA, 75 bp, Artificial Sequence
  Synthetic
gatgtaatcaatcagcaacacaagatgctgataaacctacaaaatcaagtaacaaagatcactgagctggttgct

SEQ ID NO: 18965 - DNA, 75 bp, Artificial Sequence
  Synthetic
agaactgggattcagacgtacgtggccactccactgcaggaacaacatggccatcccagtgccctcttcgaccgc

SEQ ID NO: 18966 - DNA, 75 bp, Artificial Sequence
  Synthetic
attattagaagcacagctagcatctataagaatactagatcctgggaacatcggggtatcttcattagatgatct

SEQ ID NO: 18967 - DNA, 75 bp, Artificial Sequence
  Synthetic
atggcagactgttgttaggagcaggtatcgtacctacgggagacagacaggtaaatgtgtatacttcatctcaaa

SEQ ID NO: 18968 - DNA, 75 bp, Artificial Sequence
  Synthetic
ataagaatactagatcctgggaacatcggggtatcttcattagatgatcttaaaacagcagggaaacaaagtgta

SEQ ID NO: 18969 - DNA, 75 bp, Artificial Sequence
  Synthetic
tatcgtacctacgggagacagacaggtaaatgtgtatacttcatctcaaaccggtataattgccttaaaattgct

SEQ ID NO: 18970 - DNA, 75 bp, Artificial Sequence
  Synthetic
aggattgattcttgatgaacttgctagacctactaaattagtcaatccaaagccacaacaatcttccaaaatatt

SEQ ID NO: 18971 - DNA, 75 bp, Artificial Sequence
  Synthetic
cctacaacgagactctgacccgcatcctcacccctctcgctcaatccatggcagccataaggggtaattcaacag

SEQ ID NO: 18972 - DNA, 75 bp, Artificial Sequence
  Synthetic
agacctactaaattagtcaatccaaagccacaacaatcttccaaaatattggatcaggcagaaattgaaagtgtc

SEQ ID NO: 18973 - DNA, 75 bp, Artificial Sequence
  Synthetic
cctcacccctctcgctcaatccatggcagccataaggggtaattcaacagtatcaactcgtggaagagagccaag

SEQ ID NO: 18974 - DNA, 75 bp, Artificial Sequence
  Synthetic
cttaactgcacttgacaaggtgacaacccaggatcagctaactcgcatcaagcagcaagtattaaatcaatagat

SEQ ID NO: 18975 - DNA, 75 bp, Artificial Sequence
  Synthetic
cacagatcacagcggcaacggcccttatccaagccaatcaaaatgcagagaacattgcaagacttgccaaaggtc

SEQ ID NO: 18976 - DNA, 75 bp, Artificial Sequence
  Synthetic
acccaggatcagctaactcgcatcaagcagcaagtattaaatcaatagatagacaattagcattcattcaagcta

SEQ ID NO: 18977 - DNA, 75 bp, Artificial Sequence
  Synthetic
tatccaagccaatcaaaatgcagagaacattgcaagacttgccaaaggtctagcagctaccaatgaggcagtgac

SEQ ID NO: 18978 - DNA, 75 bp, Artificial Sequence
  Synthetic
tagtcttacatgcaaaataacattaaaaattaattatgagcaatcttgatttttctaactcataatcaacctcct

SEQ ID NO: 18979 - DNA, 75 bp, Artificial Sequence
  Synthetic
aggattatgtaaatgagcaatttaataggacgggagaggcaatcgaatgtttgacgatcgaatctagagtaggtg

SEQ ID NO: 18980 - DNA, 75 bp, Artificial Sequence
  Synthetic
aaaattaattatgagcaatcttgatttttctaactcataatcaacctccttctctataaaggcatacttagtatt

SEQ ID NO: 18981 - DNA, 75 bp, Artificial Sequence
  Synthetic
taggacgggagaggcaatcgaatgtttgacgatcgaatctagagtaggtgtccagctcagtctctatctaacaga

SEQ ID NO: 18982 - DNA, 75 bp, Artificial Sequence
  Synthetic
cttgatagatctgtgatcggtctcataacctcaaattaaaatggaatctatatctctggggttatatgttgatga

SEQ ID NO: 18983 - DNA, 75 bp, Artificial Sequence
  Synthetic
tcagtattcaggcattatacaatctggctggagggaacttgaacgtcttgctgcagaagatgggtattgaaggga

SEQ ID NO: 18984 - DNA, 75 bp, Artificial Sequence
  Synthetic
taacctcaaattaaaatggaatctatatctctggggttatatgttgatgaaagtgatccagcatgctcattactt

SEQ ID NO: 18985 - DNA, 75 bp, Artificial Sequence
  Synthetic
ggctggagggaacttgaacgtcttgctgcagaagatgggtattgaagggacacagctaggctccttaatcaacag

SEQ ID NO: 18986 - DNA, 75 bp, Artificial Sequence
  Synthetic
accgcaagtcagaataaaccgtctagggagtatatcgatagaaggagttcgggcaatgttcataaatacatatgg

SEQ ID NO: 18987 - DNA, 75 bp, Artificial Sequence
  Synthetic
taggtatccaagtaactcttccatcagtgggtaggatcaatggcgcacgagcaactctacttgaggcaattgcgg

SEQ ID NO: 18988 - DNA, 75 bp, Artificial Sequence
  Synthetic
gggagtatatcgatagaaggagttcgggcaatgttcataaatacatatggcttcattgaggagaggcctacggaa

SEQ ID NO: 18989 - DNA, 75 bp, Artificial Sequence
  Synthetic
agtgggtaggatcaatggcgcacgagcaactctacttgaggcaattgcggtggctactcctaaagggaatgctag

SEQ ID NO: 18990 - DNA, 75 bp, Artificial Sequence
  Synthetic
agctggtatgctgacattgggccaaataaggaccaatatagacccggacgaaattggagaggcatgcttgagact

SEQ ID NO: 18991 - DNA, 75 bp, Artificial Sequence
  Synthetic
tagatatgactccatgcgtgctgactccaacagacatcttttgcaccaggatcttgtcttatccattaagtgatt

SEQ ID NO: 18992 - DNA, 75 bp, Artificial Sequence
  Synthetic
ataaggaccaatatagacccggacgaaattggagaggcatgcttgagactcaaagtgaatgctaaaaaatcagca

SEQ ID NO: 18993 - DNA, 75 bp, Artificial Sequence
  Synthetic
tccaacagacatcttttgcaccaggatcttgtcttatccattaagtgattctctcaccacttgtctcaaagggaa

SEQ ID NO: 18994 - DNA, 75 bp, Artificial Sequence
  Synthetic
gatgactgcacctgtagtacaagatgggggcttaattgctaaagcagaaggatcaatcaaatgcccaggtaagat

SEQ ID NO: 18995 - DNA, 75 bp, Artificial Sequence
  Synthetic
atgtttctgtgcatggtaagattgttgccaattgtaagtctgtggtttgccgatgtgtggagccacaacaaatca

SEQ ID NO: 18996 - DNA, 75 bp, Artificial Sequence
  Synthetic
gggggcttaattgctaaagcagaaggatcaatcaaatgcccaggtaagatgatgagtgaaattcactactcattt

SEQ ID NO: 18997 - DNA, 75 bp, Artificial Sequence
  Synthetic
tgccaattgtaagtctgtggtttgccgatgtgtggagccacaacaaatcatatcccaaaactatggggaggccct

SEQ ID NO: 18998 - DNA, 75 bp, Artificial Sequence
  Synthetic
agtaccaacagccatcagctcgttcaaaaataaagctctatattctattcagttagaggtattgctggaagttga

SEQ ID NO: 18999 - DNA, 75 bp, Artificial Sequence
  Synthetic
tccttaagatggacggacagttcacatcagaatacacaaaaaacataactatagatcctgtgcaggtcataatat

SEQ ID NO: 19000 - DNA, 75 bp, Artificial Sequence
  Synthetic
aaaaataaagctctatattctattcagttagaggtattgctggaagttgatgtgaagcctgagagcccccagtgt

SEQ ID NO: 19001 - DNA, 75 bp, Artificial Sequence
  Synthetic
atcagaatacacaaaaaacataactatagatcctgtgcaggtcataatatctggaccgatcgatatatcttctga

SEQ ID NO: 19002 - DNA, 75 bp, Artificial Sequence
  Synthetic
tctctgcaattctaaaaagacgaatgccagcgggaaaccgagatcattagaggatatgagaaagaaggtccgaga

SEQ ID NO: 19003 - DNA, 75 bp, Artificial Sequence
  Synthetic
agagcaattcatacctgtcaaaagtgaatgtgaagctgatcagctcctcggccatgatcacgtacattgtgataa

SEQ ID NO: 19004 - DNA, 75 bp, Artificial Sequence
  Synthetic
gccagcgggaaaccgagatcattagaggatatgagaaagaaggtccgagatatgggaatcaaagtgtctctggcc

SEQ ID NO: 19005 - DNA, 75 bp, Artificial Sequence
  Synthetic
gaatgtgaagctgatcagctcctcggccatgatcacgtacattgtgataactgtgatttgcctgattttgacttt

SEQ ID NO: 19006 - DNA, 75 bp, Artificial Sequence
  Synthetic
atatatgctaggatttttctctacctcagggacttcatgtcatccagtaacaaagagttcaccagatttggcaaa

SEQ ID NO: 19007 - DNA, 75 bp, Artificial Sequence
  Synthetic
agaagactctgatatggatgggtaataacattgcgaggtcaaaagaggggaaccggttttaagtgatggatgcat

SEQ ID NO: 19008 - DNA, 75 bp, Artificial Sequence
  Synthetic
tcagggacttcatgtcatccagtaacaaagagttcaccagatttggcaaaaatattatggtcatgctcaagcaca

SEQ ID NO: 19009 - DNA, 75 bp, Artificial Sequence
  Synthetic
taacattgcgaggtcaaaagaggggaaccggttttaagtgatggatgcatagccacacaaatcagaaatgatata

SEQ ID NO: 19010 - DNA, 75 bp, Artificial Sequence
  Synthetic
gaccctcgaagatatccaagtttccagtgctgcaaaaatcaacaaatcaggaatagggaagtttaatccatttaa

SEQ ID NO: 19011 - DNA, 75 bp, Artificial Sequence
  Synthetic
ctaatgataagacgatcatggaattaaaaagaaactaggaagggaataacaaaggaccagtacgggcagaacgag

SEQ ID NO: 19012 - DNA, 75 bp, Artificial Sequence
  Synthetic
agtgctgcaaaaatcaacaaatcaggaatagggaagtttaatccatttaagaaataaagtcatatgcagattaaa

SEQ ID NO: 19013 - DNA, 75 bp, Artificial Sequence
  Synthetic
aaaaagaaactaggaagggaataacaaaggaccagtacgggcagaacgagagagtctcgactcgccgtctgacga

SEQ ID NO: 19014 - DNA, 75 bp, Artificial Sequence
  Synthetic
cctcagtaaaatgctaatgaatcagtggatgatattgaattagcagattgaaaattaaagaaaaccttatgaggg

SEQ ID NO: 19015 - DNA, 75 bp, Artificial Sequence
  Synthetic
ccatggagagtgcaaccagccaagtgtcctttgaaaatgacaaaacctctgatcgtcggacttggcgagcagtat

SEQ ID NO: 19016 - DNA, 75 bp, Artificial Sequence
  Synthetic
tggatgatattgaattagcagattgaaaattaaagaaaaccttatgagggcgaatgagcttagatgatttaataa

SEQ ID NO: 19017 - DNA, 75 bp, Artificial Sequence
  Synthetic
gtcctttgaaaatgacaaaacctctgatcgtcggacttggcgagcagtatttagagtactgatgataatactcgc

SEQ ID NO: 19018 - DNA, 75 bp, Artificial Sequence
  Synthetic
agaaagggagcaatgagagtacgacctttaataataatcctggtgcttttagtgttgctgtggttaaatattcta

SEQ ID NO: 19019 - DNA, 75 bp, Artificial Sequence
  Synthetic
ccgcaatccctgggaacatcgatgcatctgaacaaaggatattatcatccgttgaggccgttcaggtgcccgtat

SEQ ID NO: 19020 - DNA, 75 bp, Artificial Sequence
  Synthetic
ctttaataataatcctggtgcttttagtgttgctgtggttaaatattctacccgtaattggcttagacaattcaa

SEQ ID NO: 19021 - DNA, 75 bp, Artificial Sequence
  Synthetic
atctgaacaaaggatattatcatccgttgaggccgttcaggtgcccgtatcaaggttagaagacaccagtcagaa

SEQ ID NO: 19022 - DNA, 75 bp, Artificial Sequence
  Synthetic
tattcacagagtaatgaggcttacattgcactgcgcactgtgccatatatacctccacacaatctctcttgtttc

SEQ ID NO: 19023 - DNA, 75 bp, Artificial Sequence
  Synthetic
agacgaatattctaaatgctattacatccctttcatatcaaattgatgcttcagccaactcttctggttgcggtg

SEQ ID NO: 19024 - DNA, 75 bp, Artificial Sequence
  Synthetic
ttgcactgcgcactgtgccatatatacctccacacaatctctcttgtttccaggatttaatcaacacatacaata

SEQ ID NO: 19025 - DNA, 75 bp, Artificial Sequence
  Synthetic
atccctttcatatcaaattgatgcttcagccaactcttctggttgcggtgcccctgtccatgactctgacttcac

SEQ ID NO: 19026 - DNA, 75 bp, Artificial Sequence
  Synthetic
acatcggcgtcaacgctcccctcatcaagatttgcaggattagtagtcggtgcaatcgctctcggagtagcgaca

SEQ ID NO: 19027 - DNA, 75 bp, Artificial Sequence
  Synthetic
taatcaggccctccaaattcttggagcacttaaacttcataccagccccgacaacagggaatggctgcacaagga

SEQ ID NO: 19028 - DNA, 75 bp, Artificial Sequence
  Synthetic
caagatttgcaggattagtagtcggtgcaatcgctctcggagtagcgacatctgcacaaataactgcagccgtgg

SEQ ID NO: 19029 - DNA, 75 bp, Artificial Sequence
  Synthetic
gcacttaaacttcataccagccccgacaacagggaatggctgcacaaggataccatcgtttgatctaggccaaac

SEQ ID NO: 19030 - DNA, 75 bp, Artificial Sequence
  Synthetic
tctatccaaaatactatcaatgctgtgaatgacataacagtagggttaagttcaataggagtagcactaagcaag

SEQ ID NO: 19031 - DNA, 75 bp, Artificial Sequence
  Synthetic
gccactcttttcaatatgttgcactaggcatactcaggacatcagctacagggtcagtattcttatcaacactcc

SEQ ID NO: 19032 - DNA, 75 bp, Artificial Sequence
  Synthetic
tgaatgacataacagtagggttaagttcaataggagtagcactaagcaaggtccaaaactacttgaatgatgtga

SEQ ID NO: 19033 - DNA, 75 bp, Artificial Sequence
  Synthetic
aggcatactcaggacatcagctacagggtcagtattcttatcaacactccgatctgtaaatttagacgacgaccg

SEQ ID NO: 19034 - DNA, 75 bp, Artificial Sequence
  Synthetic
gggatccaattaaatctttatttaaccgaaattacaactatctttggaccgcaaattacaaatccatcattgacc

SEQ ID NO: 19035 - DNA, 75 bp, Artificial Sequence
  Synthetic
tctgttctcttgtcacagagactgaagaaggagattatgatagcatcgacccgacccctatggtgcatggcaggt

SEQ ID NO: 19036 - DNA, 75 bp, Artificial Sequence
  Synthetic
ccgaaattacaactatctttggaccgcaaattacaaatccatcattgaccccattgtcaattcaggcattataca

SEQ ID NO: 19037 - DNA, 75 bp, Artificial Sequence
  Synthetic
agaaggagattatgatagcatcgacccgacccctatggtgcatggcaggttaggatttgatggcaaatataggga

SEQ ID NO: 19038 - DNA, 75 bp, Artificial Sequence
  Synthetic
gagacaagtgttagcagtattctcgagtcaggactaatatcagcacaaattgtatcttttgataaacagacaggc

SEQ ID NO: 19039 - DNA, 75 bp, Artificial Sequence
  Synthetic
ctgctgttggcggtggcgctttttttggtaatcgtgtatggttccctgtttatggaggtctgaaggaaggaaccc

SEQ ID NO: 19040 - DNA, 75 bp, Artificial Sequence
  Synthetic
agtcaggactaatatcagcacaaattgtatcttttgataaacagacaggcattgcaatattgtatgtcacattac

SEQ ID NO: 19041 - DNA, 75 bp, Artificial Sequence
  Synthetic
tggtaatcgtgtatggttccctgtttatggaggtctgaaggaaggaacccaaagtgagagagatgcagagaaagg

SEQ ID NO: 19042 - DNA, 75 bp, Artificial Sequence
  Synthetic
agtgtccaaactggagttggagagggttctgctattgtaccatcatacgttattcagcagggaacagtaatagaa

SEQ ID NO: 19043 - DNA, 75 bp, Artificial Sequence
  Synthetic
ctcaaatcgcgaatgctaaagcatcatatcggccatctcgatttggcggacgatttatccaacagggtatcctct

SEQ ID NO: 19044 - DNA, 75 bp, Artificial Sequence
  Synthetic
gttctgctattgtaccatcatacgttattcagcagggaacagtaatagaagaatttattcctgacagttgcatct

SEQ ID NO: 19045 - DNA, 75 bp, Artificial Sequence
  Synthetic
atatcggccatctcgatttggcggacgatttatccaacagggtatcctctcttttaaagttgaagggaacttagg

SEQ ID NO: 19046 - DNA, 75 bp, Artificial Sequence
  Synthetic
gatagcatattgcaatgcctccagggatcaatggcagattgccaatttactcgctcattgggttcatttgcaaac

SEQ ID NO: 19047 - DNA, 75 bp, Artificial Sequence
  Synthetic
ccgaggcacgtgtgatgaatattgagaataaactatacctctatcagagaggtacttcttggtttccatctgcct

SEQ ID NO: 19048 - DNA, 75 bp, Artificial Sequence
  Synthetic
gatcaatggcagattgccaatttactcgctcattgggttcatttgcaaacagattcatgaccgttgcaggtgggg

SEQ ID NO: 19049 - DNA, 75 bp, Artificial Sequence
  Synthetic
gaataaactatacctctatcagagaggtacttcttggtttccatctgccttagtataccccttggatgtagctaa

SEQ ID NO: 19050 - DNA, 75 bp, Artificial Sequence
  Synthetic
attattccccagaacaatggaattgctgtcactctgatagatggtagtttatgtaaagaacttgaattggagggg

SEQ ID NO: 19051 - DNA, 75 bp, Artificial Sequence
  Synthetic
ccggaggacatccatgcagcgccagttcacggtgccctaacgtatgcgtcacaggggtttatacggatgcctatc

SEQ ID NO: 19052 - DNA, 75 bp, Artificial Sequence
  Synthetic
ctgtcactctgatagatggtagtttatgtaaagaacttgaattggaggggataagactaacaatggcagacccag

SEQ ID NO: 19053 - DNA, 75 bp, Artificial Sequence
  Synthetic
ttcacggtgccctaacgtatgcgtcacaggggtttatacggatgcctatccacttgtattttcaaggagtcatga

SEQ ID NO: 19054 - DNA, 75 bp, Artificial Sequence
  Synthetic
ccgtctgatgctttagacattagtagcgaattaggtcaactgaataactcaattagctcagcaactgataattta

SEQ ID NO: 19055 - DNA, 75 bp, Artificial Sequence
  Synthetic
atcctcaggcagcaatatggtatgggaacgagatgagtacacctactaaagtaagtagctcaactactaaagctg

SEQ ID NO: 19056 - DNA, 75 bp, Artificial Sequence
  Synthetic
gcgaattaggtcaactgaataactcaattagctcagcaactgataatttacagaaggcacaggaatcattgaata

SEQ ID NO: 19057 - DNA, 75 bp, Artificial Sequence
  Synthetic
gaacgagatgagtacacctactaaagtaagtagctcaactactaaagctgcctatactacttccacatgttttaa

SEQ ID NO: 19058 - DNA, 75 bp, Artificial Sequence
  Synthetic
gtattagtatcaatctcattagtgataggatgtatctccatttattttatatataaacattcaaccacaaataga

SEQ ID NO: 19059 - DNA, 75 bp, Artificial Sequence
  Synthetic
acacactctttggcgagtttaggatagtgccactattaatcgaagtacaaaagactcctctcactaggagaagcg

SEQ ID NO: 19060 - DNA, 75 bp, Artificial Sequence
  Synthetic
taggatgtatctccatttattttatatataaacattcaaccacaaatagatcacgaaatctctcaagtgacatca

SEQ ID NO: 19061 - DNA, 75 bp, Artificial Sequence
  Synthetic
agtgccactattaatcgaagtacaaaagactcctctcactaggagaagcgagctccggcaacaaatgccccaacc

SEQ ID NO: 19062 - DNA, 75 bp, Artificial Sequence
  Synthetic
ataatttgatgttctaataggagaatgcaatatcaatatgtccattataatatacttgattgattgaaagatctg

SEQ ID NO: 19063 - DNA, 75 bp, Artificial Sequence
  Synthetic
tgagcagaaagaatgccattgacgagtatgccaattcatggccatagaattcgaaaagaaggaaataactatctg

SEQ ID NO: 19064 - DNA, 75 bp, Artificial Sequence
  Synthetic
tgcaatatcaatatgtccattataatatacttgattgattgaaagatctgataataatagtttataagacactaa

SEQ ID NO: 19065 - DNA, 75 bp, Artificial Sequence
  Synthetic
gtatgccaattcatggccatagaattcgaaaagaaggaaataactatctgtctccctgactgcgtttacctatac

SEQ ID NO: 19066 - DNA, 75 bp, Artificial Sequence
  Synthetic
gaccatactatatcatattagataattaataaaaaacgccctatcctgagggcgaaaggccgatcattagtgact

SEQ ID NO: 19067 - DNA, 75 bp, Artificial Sequence
  Synthetic
cttttgggacatgggtctctattaagaaaaaaataattaaagaataagcagacccactcttgaaagggagagtat

SEQ ID NO: 19068 - DNA, 75 bp, Artificial Sequence
  Synthetic
ttaataaaaaacgccctatcctgagggcgaaaggccgatcattagtgactttaaccgttgctctcccaatttaaa

SEQ ID NO: 19069 - DNA, 75 bp, Artificial Sequence
  Synthetic
gaaaaaaataattaaagaataagcagacccactcttgaaagggagagtatacgggcagaagatggggtcccaagg

SEQ ID NO: 19070 - DNA, 75 bp, Artificial Sequence
  Synthetic
agagtccttacgattctattagatgtagtgatcattattctctctgtgattgctctgatttcattgggtctgaag

SEQ ID NO: 19071 - DNA, 75 bp, Artificial Sequence
  Synthetic
caccgattgtaaaacacaagctactctattattggagattaactgggttgcccctcccgtctgatgaccagtatg

SEQ ID NO: 19072 - DNA, 75 bp, Artificial Sequence
  Synthetic
tagtgatcattattctctctgtgattgctctgatttcattgggtctgaagccaggtgagaggatcatcaatgaag

SEQ ID NO: 19073 - DNA, 75 bp, Artificial Sequence
  Synthetic
ctattattggagattaactgggttgcccctcccgtctgatgaccagtatgactcgctcattattacacgtgattg

SEQ ID NO: 19074 - DNA, 75 bp, Artificial Sequence
  Synthetic
gatattcaggcaaaagtcagcagcatatatcggagcaacttgctaagtatcccactacaacttgatcaaatcaac

SEQ ID NO: 19075 - DNA, 75 bp, Artificial Sequence
  Synthetic
taggccgtcagactcactcttatcttaatcataaattgcctgtgctctctgtaacacatccttctactttaaaat

SEQ ID NO: 19076 - DNA, 75 bp, Artificial Sequence
  Synthetic
tatatcggagcaacttgctaagtatcccactacaacttgatcaaatcaaccaggcaatatcatcatctgctaggc

SEQ ID NO: 19077 - DNA, 75 bp, Artificial Sequence
  Synthetic
taatcataaattgcctgtgctctctgtaacacatccttctactttaaaatggctcacttctatcaggtcaacaat

SEQ ID NO: 19078 - DNA, 75 bp, Artificial Sequence
  Synthetic
tttatttatacaaattcacctgagtttgcaaatggtttcaatagagcaatgttcccaaccctaaatcaaagctta

SEQ ID NO: 19079 - DNA, 75 bp, Artificial Sequence
  Synthetic
gagcatacggtgccagattttctgacctttctaatctagtcgagagaaagttatacggagagtcgtatttacctg

SEQ ID NO: 19080 - DNA, 75 bp, Artificial Sequence
  Synthetic
ttgcaaatggtttcaatagagcaatgttcccaaccctaaatcaaagcttaaatatgctaacacctggtaatctaa

SEQ ID NO: 19081 - DNA, 75 bp, Artificial Sequence
  Synthetic
cctttctaatctagtcgagagaaagttatacggagagtcgtatttacctggtcgatctcaggaattcaagaatct

SEQ ID NO: 19082 - DNA, 75 bp, Artificial Sequence
  Synthetic
agaataccatcattttcaatgtcatcaagtcactggtgttatacccataatatcattgctagtggatgtcaggat

SEQ ID NO: 19083 - DNA, 75 bp, Artificial Sequence
  Synthetic
acctttggctccatgtgaaacaactgcaacggcacttgattgtgaagtgtagggaacgaaagaatgatcagtcga

SEQ ID NO: 19084 - DNA, 75 bp, Artificial Sequence
  Synthetic
caagtcactggtgttatacccataatatcattgctagtggatgtcaggatcattcaaccagtagtgaatacatat

SEQ ID NO: 19085 - DNA, 75 bp, Artificial Sequence
  Synthetic
gcaacggcacttgattgtgaagtgtagggaacgaaagaatgatcagtcgattttcaccattgaagcaattgatgg

SEQ ID NO: 19086 - DNA, 75 bp, Artificial Sequence
  Synthetic
actctttctattacattagctgataatctaaacagaaagtcatgtagcattgcagcaactgggttcgggtgtgat

SEQ ID NO: 19087 - DNA, 75 bp, Artificial Sequence
  Synthetic
atcgattgacctgcctgactcaagaaatggttcttatgtatgctgatctcttggaagggcgaagcatgatcacac

SEQ ID NO: 19088 - DNA, 75 bp, Artificial Sequence
  Synthetic
atctaaacagaaagtcatgtagcattgcagcaactgggttcgggtgtgatatattatgtagtgttgtcactgaga

SEQ ID NO: 19089 - DNA, 75 bp, Artificial Sequence
  Synthetic
aatggttcttatgtatgctgatctcttggaagggcgaagcatgatcacactgcactgttccttactaccttacct

SEQ ID NO: 19090 - DNA, 75 bp, Artificial Sequence
  Synthetic
agattattttttaatggcacatattcagagatgtcattgaatgtgaaccaaatgttcgcagattgggttgcaaat

SEQ ID NO: 19091 - DNA, 75 bp, Artificial Sequence
  Synthetic
tatcgttgaccattaaaggagatatttatgagatagtagcaatcttggaagcaatggcatacagtgtggtccagt

SEQ ID NO: 19092 - DNA, 75 bp, Artificial Sequence
  Synthetic
cagagatgtcattgaatgtgaaccaaatgttcgcagattgggttgcaaattatccagcagttggatcaggagtag

SEQ ID NO: 19093 - DNA, 75 bp, Artificial Sequence
  Synthetic
ttatgagatagtagcaatcttggaagcaatggcatacagtgtggtccagttatttgaacctaatgagctgtttgc

SEQ ID NO: 19094 - DNA, 75 bp, Artificial Sequence
  Synthetic
tcaaccctaggagcatctttaagccagtattactatattcccaaggtgcccacagtcaattgctctgagacagat

SEQ ID NO: 19095 - DNA, 75 bp, Artificial Sequence
  Synthetic
ttcatttttctactcctattgcagactccattatccgcgctattagtgtgatttatagcggtatctcttgtgatc

SEQ ID NO: 19096 - DNA, 75 bp, Artificial Sequence
  Synthetic
agtattactatattcccaaggtgcccacagtcaattgctctgagacagatgcacaacaaatagagaaggcaaaag

SEQ ID NO: 19097 - DNA, 75 bp, Artificial Sequence
  Synthetic
ctccattatccgcgctattagtgtgatttatagcggtatctcttgtgatcaaggagcagagatgttgtgtgtatt

SEQ ID NO: 19098 - DNA, 75 bp, Artificial Sequence
  Synthetic
gttaggtgcaataaatctgttaatcttgcaaattcatgtgaaattctgacatttaacactagcactatgatgatg

SEQ ID NO: 19099 - DNA, 75 bp, Artificial Sequence
  Synthetic
taagaacccaaatgtgtgcccccaaaatcatagactatgatataacaatgcaggtgctgtcattctttaaaggta

SEQ ID NO: 19100 - DNA, 75 bp, Artificial Sequence
  Synthetic
ttgcaaattcatgtgaaattctgacatttaacactagcactatgatgatgggtgctgagggaagactcttgatga

SEQ ID NO: 19101 - DNA, 75 bp, Artificial Sequence
  Synthetic
aatcatagactatgatataacaatgcaggtgctgtcattctttaaaggtaccataataaacggttatcgaaagaa

SEQ ID NO: 19102 - DNA, 75 bp, Artificial Sequence
  Synthetic
ggaattatatataaattagatctacaagaattgacaacattttcatcaaatcaattgctgtcaacaataccaatt

SEQ ID NO: 19103 - DNA, 75 bp, Artificial Sequence
  Synthetic
tcatacatcaattgtacttagattctgcagagattagccatgcaataatgttacgcgaatacaaggccctttcgt

SEQ ID NO: 19104 - DNA, 75 bp, Artificial Sequence
  Synthetic
aagaattgacaacattttcatcaaatcaattgctgtcaacaataccaattccatttgagaaattccctagacctg

SEQ ID NO: 19105 - DNA, 75 bp, Artificial Sequence
  Synthetic
tgcagagattagccatgcaataatgttacgcgaatacaaggccctttcgttgttagagtttgctccatgcattga

SEQ ID NO: 19106 - DNA, 75 bp, Artificial Sequence
  Synthetic
cagactggtgtttatcaagatctctgggtactatatgatcttggcaaattagaaaataccacagcagtaggattg

SEQ ID NO: 19107 - DNA, 75 bp, Artificial Sequence
  Synthetic
caagaccttccagagagtggttgtcatctttcaagactaatttactaacctcggcagataggcccaaaaagaact

SEQ ID NO: 19108 - DNA, 75 bp, Artificial Sequence
  Synthetic
gggtactatatgatcttggcaaattagaaaataccacagcagtaggattgtatctaaactcagcagtaggccgaa

SEQ ID NO: 19109 - DNA, 75 bp, Artificial Sequence
  Synthetic
atctttcaagactaatttactaacctcggcagataggcccaaaaagaactcaagccaggcaagtaatcgattact

SEQ ID NO: 19110 - DNA, 75 bp, Artificial Sequence
  Synthetic
agattattcgcacagggtactccagcatcatattcaacaacgacctgcttcaaaaatactaagattgacacggca

SEQ ID NO: 19111 - DNA, 75 bp, Artificial Sequence
  Synthetic
atcttaactctcttgcttatctcgatgatgatgatgtgtcagtctcttactcactcaaggagaaagaagtcaaaa

SEQ ID NO: 19112 - DNA, 75 bp, Artificial Sequence
  Synthetic
catcatattcaacaacgacctgcttcaaaaatactaagattgacacggcatactgcttatcaatattagaattaa

SEQ ID NO: 19113 - DNA, 75 bp, Artificial Sequence
  Synthetic
tgatgatgatgtgtcagtctcttactcactcaaggagaaagaagtcaaaatcaacggtcggatttttgcaaagct

SEQ ID NO: 19114 - DNA, 75 bp, Artificial Sequence
  Synthetic
actttaagtattatgagctagatcctgttttaacattgaatcgtatgaacttataagactgaaggatgtctgttg

SEQ ID NO: 19115 - DNA, 75 bp, Artificial Sequence
  Synthetic
cggaaatagctcctttttttcaagggaatggagtgattcaggacagcatatccttatctaaaagcatgttggcaa

SEQ ID NO: 19116 - DNA, 75 bp, Artificial Sequence
  Synthetic
tgttttaacattgaatcgtatgaacttataagactgaaggatgtctgttggtattaagcatcataaaacacggtt

SEQ ID NO: 19117 - DNA, 75 bp, Artificial Sequence
  Synthetic
gaatggagtgattcaggacagcatatccttatctaaaagcatgttggcaatgagccagatgtcatttaactgcaa

SEQ ID NO: 19118 - DNA, 75 bp, Artificial Sequence
  Synthetic
taacagatttagatactattgatcatataggcatagatggtatatgggcaattagattgaactgagttaaatccg

SEQ ID NO: 19119 - DNA, 75 bp, Artificial Sequence
  Synthetic
cgtctaataatcaaaaagagaagattagattagccacattcttaacgacagatctctcaaaatattgcctaaatt

SEQ ID NO: 19120 - DNA, 75 bp, Artificial Sequence
  Synthetic
tataggcatagatggtatatgggcaattagattgaactgagttaaatccgattgatacttatcaaattaagatct

SEQ ID NO: 19121 - DNA, 75 bp, Artificial Sequence
  Synthetic
tagattagccacattcttaacgacagatctctcaaaatattgcctaaattggagataccagacaataaaaccatt

SEQ ID NO: 19122 - DNA, 75 bp, Artificial Sequence
  Synthetic
ggagttcagacaatctgatcaaataatacatcctgaagtgcatctagattcacctattattgggaataaaatact

SEQ ID NO: 19123 - DNA, 75 bp, Artificial Sequence
  Synthetic
tacatttgcgcctgatgaatactactatgtatgtaggagacccgtacaaccctcctcaggaagtagtgacagggg

SEQ ID NO: 19124 - DNA, 75 bp, Artificial Sequence
  Synthetic
atacatcctgaagtgcatctagattcacctattattgggaataaaatactctatttatggcgaattacaggctta

SEQ ID NO: 19125 - DNA, 75 bp, Artificial Sequence
  Synthetic
tatgtatgtaggagacccgtacaaccctcctcaggaagtagtgacaggggatattaacgatcagcctaatgatga

SEQ ID NO: 19126 - DNA, 75 bp, Artificial Sequence
  Synthetic
gacaaacttgaaagccaatgatcctagagtagcctttaaatgggacaaactaagaccacggttgctaacatgggc

SEQ ID NO: 19127 - DNA, 75 bp, Artificial Sequence
  Synthetic
tctggagtatgatctcaatatcagctatcaacctggcagctacgagagcagactgcagagtagcctgcatggtac

SEQ ID NO: 19128 - DNA, 75 bp, Artificial Sequence
  Synthetic
agagtagcctttaaatgggacaaactaagaccacggttgctaacatgggcagcacatcaagggatatcactatcg

SEQ ID NO: 19129 - DNA, 75 bp, Artificial Sequence
  Synthetic
tatcaacctggcagctacgagagcagactgcagagtagcctgcatggtacaaggggacaaccaagtaattgcatc

SEQ ID NO: 19130 - DNA, 75 bp, Artificial Sequence
  Synthetic
atcctgtcctaaaattgatgaaaattttgcgttaattaagaagtgccttcttagaacaagggactatacagcatc

SEQ ID NO: 19131 - DNA, 75 bp, Artificial Sequence
  Synthetic
tacacgaattaagcgaccgcttctttagagagctgattatcgtaaatcatggattagggcataacctcaaattga

SEQ ID NO: 19132 - DNA, 75 bp, Artificial Sequence
  Synthetic
tttgcgttaattaagaagtgccttcttagaacaagggactatacagcatcaggatttaagaatttattccaaatg

SEQ ID NO: 19133 - DNA, 75 bp, Artificial Sequence
  Synthetic
tagagagctgattatcgtaaatcatggattagggcataacctcaaattgagagaaacaatgagatccaacacatt

SEQ ID NO: 19134 - DNA, 75 bp, Artificial Sequence
  Synthetic
gacaactccccccatctccgacgaagcatcctgggcattaaagaatcctgagcactggtttaatacaccttggtc

SEQ ID NO: 19135 - DNA, 75 bp, Artificial Sequence
  Synthetic
tcctaaagaacgctgcaaaaatcacacttatctctggtgatctgggtgaagacacagtggcatctgcaagtgaca

SEQ ID NO: 19136 - DNA, 75 bp, Artificial Sequence
  Synthetic
gcatcctgggcattaaagaatcctgagcactggtttaatacaccttggtcatcttgttgtatgttttggttacat

SEQ ID NO: 19137 - DNA, 75 bp, Artificial Sequence
  Synthetic
acttatctctggtgatctgggtgaagacacagtggcatctgcaagtgacatttcaggtacaattgctcggatctg

SEQ ID NO: 19138 - DNA, 75 bp, Artificial Sequence
  Synthetic
atcacaaagcatatacagtatcacggttgataacttgtttgttggattgactcctgacttgtgtgtcatagctga

SEQ ID NO: 19139 - DNA, 75 bp, Artificial Sequence
  Synthetic
tatgtgttcaattttattttgaccaagaattctctattatcaatcgggcaggtcacgatattagaaagacatctc

SEQ ID NO: 19140 - DNA, 75 bp, Artificial Sequence
  Synthetic
gttgataacttgtttgttggattgactcctgacttgtgtgtcatagctgattctcaaagacaatcaattacagta

SEQ ID NO: 19141 - DNA, 75 bp, Artificial Sequence
  Synthetic
agaattctctattatcaatcgggcaggtcacgatattagaaagacatctcttggaaatattgaattagttcataa

SEQ ID NO: 19142 - DNA, 75 bp, Artificial Sequence
  Synthetic
caatgtttatgacctctgtcaattgtctcctgtgctaagtcctcttcaagatagaattttacttttactgagatt

SEQ ID NO: 19143 - DNA, 75 bp, Artificial Sequence
  Synthetic
tgaggttgtacaatagaaatataggggatccgggaaccacagcatttgcagagatgaaacgcctggtgagtgcac

SEQ ID NO: 19144 - DNA, 75 bp, Artificial Sequence
  Synthetic
tctcctgtgctaagtcctcttcaagatagaattttacttttactgagattaattgattctttagcatatgacatc

SEQ ID NO: 19145 - DNA, 75 bp, Artificial Sequence
  Synthetic
ggatccgggaaccacagcatttgcagagatgaaacgcctggtgagtgcacaattgttatcacgcagtgtgattga

SEQ ID NO: 19146 - DNA, 75 bp, Artificial Sequence
  Synthetic
agctattcagctatatgattacgacacagaggcagccggtgattttttctcatttaatttaagagaaatttccca

SEQ ID NO: 19147 - DNA, 75 bp, Artificial Sequence
  Synthetic
gcgatccttactcatttaacttcgatggaacccgcagcccgagcattgtccttaagaaacacactcaaaaagtat

SEQ ID NO: 19148 - DNA, 75 bp, Artificial Sequence
  Synthetic
acagaggcagccggtgattttttctcatttaatttaagagaaatttcccaggtcatagaagagagcaaatgtagg

SEQ ID NO: 19149 - DNA, 75 bp, Artificial Sequence
  Synthetic
tggaacccgcagcccgagcattgtccttaagaaacacactcaaaaagtattatttgagtcgtgttctaatccctt

SEQ ID NO: 19150 - DNA, 75 bp, Artificial Sequence
  Synthetic
caatcctgatcaagcagctgaaatgctgtgtatcatgagactgtggggtcacccattgctttatgcatccaaggc

SEQ ID NO: 19151 - DNA, 75 bp, Artificial Sequence
  Synthetic
ctagattcttgcttgatcaagaatacattcatcctagggtagcgcatgtgataatgcaggctagttccatcgggc

SEQ ID NO: 19152 - DNA, 75 bp, Artificial Sequence
  Synthetic
ctgtgtatcatgagactgtggggtcacccattgctttatgcatccaaggctgcatctaaggttcgcgagtcaatg

SEQ ID NO: 19153 - DNA, 75 bp, Artificial Sequence
  Synthetic
cattcatcctagggtagcgcatgtgataatgcaggctagttccatcgggcgaagaaaacagattcaagggttatt

SEQ ID NO: 19154 - DNA, 75 bp, Artificial Sequence
  Synthetic
ctttaagagaagcatcataaatggatatagacgaaagcatggtgggctatggccgaacatcatagttgagtcact

SEQ ID NO: 19155 - DNA, 75 bp, Artificial Sequence
  Synthetic
gtatcaagaagtcagagaggatacaaaattatccggccttgcatttccaactgtacgaagaggatgtctggagcc

SEQ ID NO: 19156 - DNA, 75 bp, Artificial Sequence
  Synthetic
tatagacgaaagcatggtgggctatggccgaacatcatagttgagtcacttctttctgcagaacttgtcgcggca

SEQ ID NO: 19157 - DNA, 75 bp, Artificial Sequence
  Synthetic
aaattatccggccttgcatttccaactgtacgaagaggatgtctggagcccgacccgcaggaattcaccactgat

SEQ ID NO: 19158 - DNA, 75 bp, Artificial Sequence
  Synthetic
agaagtagccatgattgacttcaaaaaatcattcgactacgatataggggatgacttaagtttatacctcaagga

SEQ ID NO: 19159 - DNA, 75 bp, Artificial Sequence
  Synthetic
gttggtctgtgcttaccggtggtcgtcctatactaggcgtatccaatccagattcccttgagttgatatctggtt

SEQ ID NO: 19160 - DNA, 75 bp, Artificial Sequence
  Synthetic
aaatcattcgactacgatataggggatgacttaagtttatacctcaaggataaagcaatttgtcgacagaaatca

SEQ ID NO: 19161 - DNA, 75 bp, Artificial Sequence
  Synthetic
tcctatactaggcgtatccaatccagattcccttgagttgatatctggttgcatagtttccgtgagtgggagctg

SEQ ID NO: 19162 - DNA, 75 bp, Artificial Sequence
  Synthetic
gaagcgaattcgtggaataggtgaaaaccgattactgttacatttcttgaattcagtcgattttgatcctgaaca

SEQ ID NO: 19163 - DNA, 75 bp, Artificial Sequence
  Synthetic
gtaatatcgaccttagtgatgatgcagtcgggaatccagctataagagttccttatctaggatcaaaaactcaag

SEQ ID NO: 19164 - DNA, 75 bp, Artificial Sequence
  Synthetic
aaccgattactgttacatttcttgaattcagtcgattttgatcctgaacaagaattcaaatacgtcactgatatg

SEQ ID NO: 19165 - DNA, 75 bp, Artificial Sequence
  Synthetic
agtcgggaatccagctataagagttccttatctaggatcaaaaactcaagaacgaagagtggcatctatggcgaa

SEQ ID NO: 19166 - DNA, 75 bp, Artificial Sequence
  Synthetic
agaagtgaaaagagatggaagaatattcgcaaaaatgacaccaaaaatgagaagctgtcaagttttattagaggc

SEQ ID NO: 19167 - DNA, 75 bp, Artificial Sequence
  Synthetic
tattgatctgggcgttcggagataatgagataaattgggaagctgcactggccatagctaatagcagatgtgcga

SEQ ID NO: 19168 - DNA, 75 bp, Artificial Sequence
  Synthetic
ttcgcaaaaatgacaccaaaaatgagaagctgtcaagttttattagaggcattgttagcaaaacatgtaagcgaa

SEQ ID NO: 19169 - DNA, 75 bp, Artificial Sequence
  Synthetic
tgagataaattgggaagctgcactggccatagctaatagcagatgtgcgattgacttagatcacctcaaagtgtt

SEQ ID NO: 19170 - DNA, 75 bp, Artificial Sequence
  Synthetic
attggtagccatgtcacaattagctccccgagtgaatatgagaggtgggagagcagctagatcaacagacgttaa

SEQ ID NO: 19171 - DNA, 75 bp, Artificial Sequence
  Synthetic
tatctcaggtagcttttacccctgcttcattgtacagagtctcatcctacgtgcaaatatccaatgactcacagc

SEQ ID NO: 19172 - DNA, 75 bp, Artificial Sequence
  Synthetic
ccccgagtgaatatgagaggtgggagagcagctagatcaacagacgttaaaatcaatcaacgaagggtcaagtca

SEQ ID NO: 19173 - DNA, 75 bp, Artificial Sequence
  Synthetic
ttcattgtacagagtctcatcctacgtgcaaatatccaatgactcacagcgactgattacagaagaaggtgtgcg

SEQ ID NO: 19174 - DNA, 75 bp, Artificial Sequence
  Synthetic
aattgcaggttatctgactactgatttacaaaaatactgcctcaattggagatatgaatcaataaaattatttgc

SEQ ID NO: 19175 - DNA, 75 bp, Artificial Sequence
  Synthetic
ttgaggcactcttcccgttaggaactaaatatgtcacagagagcctcacactccatcttcatagtgcccacagtt

SEQ ID NO: 19176 - DNA, 75 bp, Artificial Sequence
  Synthetic
ttacaaaaatactgcctcaattggagatatgaatcaataaaattatttgcaagagcacttaaccaattatttgga

SEQ ID NO: 19177 - DNA, 75 bp, Artificial Sequence
  Synthetic
taaatatgtcacagagagcctcacactccatcttcatagtgcccacagttgttgcttgagagaggcatccgtatc

SEQ ID NO: 19178 - DNA, 75 bp, Artificial Sequence
  Synthetic
gtttgttggggatccttacaatcctcctgcatcaatccaatctttggatctcgatgaacagcctaatgatgatat

SEQ ID NO: 19179 - DNA, 75 bp, Artificial Sequence
  Synthetic
agaacagatttatgtatgatcctaacccaatatctctcatagagatcccaaaattagatatcactgtttttagat

SEQ ID NO: 19180 - DNA, 75 bp, Artificial Sequence
  Synthetic
cctgcatcaatccaatctttggatctcgatgaacagcctaatgatgatatttttattgtctcgccacgtggtggg

SEQ ID NO: 19181 - DNA, 75 bp, Artificial Sequence
  Synthetic
cccaatatctctcatagagatcccaaaattagatatcactgtttttagatcgtatgagttgaaccttgactctta

SEQ ID NO: 19182 - DNA, 75 bp, Artificial Sequence
  Synthetic
tcaagctgcagctgcaaaaataggatgtcgggttacaagtatggtacagggagataatcaggttattgctatcac

SEQ ID NO: 19183 - DNA, 75 bp, Artificial Sequence
  Synthetic
tgggccagtcaataattagttatgatgaagagacatccatcaaaaatgatgcaatagtggttcatgacaattcca

SEQ ID NO: 19184 - DNA, 75 bp, Artificial Sequence
  Synthetic
tgtcgggttacaagtatggtacagggagataatcaggttattgctatcaccagagaagtgcgagtgggggaacct

SEQ ID NO: 19185 - DNA, 75 bp, Artificial Sequence
  Synthetic
tgaagagacatccatcaaaaatgatgcaatagtggttcatgacaattccagaaattggatcagcgagttccaaaa

SEQ ID NO: 19186 - DNA, 75 bp, Artificial Sequence
  Synthetic
tgaattcaaacaattaaactacggaatagggcacaatcttaaagcaaaagaaactatcaagagtcaatcgttttt

SEQ ID NO: 19187 - DNA, 75 bp, Artificial Sequence
  Synthetic
attgctcataccagatgtattacttgagagtgatcggctttgaaaatataatgctttacctatcagacaccatca

SEQ ID NO: 19188 - DNA, 75 bp, Artificial Sequence
  Synthetic
atagggcacaatcttaaagcaaaagaaactatcaagagtcaatcgttttttgtatatagcaagagagttttcttt

SEQ ID NO: 19189 - DNA, 75 bp, Artificial Sequence
  Synthetic
gagagtgatcggctttgaaaatataatgctttacctatcagacaccatcagggctatgcccggaatattgttatc

SEQ ID NO: 19190 - DNA, 75 bp, Artificial Sequence
  Synthetic
aatttctgactgtctggctgaaaatacagttgcttcatgtagcaatatttcttctactgtagcaaggctaataga

SEQ ID NO: 19191 - DNA, 75 bp, Artificial Sequence
  Synthetic
ggagcggaatggttagtacacaagggtctcaccaattggcatctattgacttcataagtctgtcatctcaagtcc

SEQ ID NO: 19192 - DNA, 75 bp, Artificial Sequence
  Synthetic
acagttgcttcatgtagcaatatttcttctactgtagcaaggctaatagagaatggccttgggaaagacgtagcc

SEQ ID NO: 19193 - DNA, 75 bp, Artificial Sequence
  Synthetic
gtctcaccaattggcatctattgacttcataagtctgtcatctcaagtcctaatgaaagctatcagaaggatgtt

SEQ ID NO: 19194 - DNA, 75 bp, Artificial Sequence
  Synthetic
atatacgatttcattgaactatagtacagcaagacggcaggtgggaagcgagaatcctcacgcattggctatagc

SEQ ID NO: 19195 - DNA, 75 bp, Artificial Sequence
  Synthetic
tagatgacaccataaatgataagttcttacaactaatagctagatactgctgcttagtgacgctcttattcgcta

SEQ ID NO: 19196 - DNA, 75 bp, Artificial Sequence
  Synthetic
acagcaagacggcaggtgggaagcgagaatcctcacgcattggctatagccgctttgattcctggtcaacttggg

SEQ ID NO: 19197 - DNA, 75 bp, Artificial Sequence
  Synthetic
cttacaactaatagctagatactgctgcttagtgacgctcttattcgctaaaaatgacaaggtaccaaaaatcag

SEQ ID NO: 19198 - DNA, 75 bp, Artificial Sequence
  Synthetic
tccaatcacttgctcattgagtgatatcaaatggtttgcaaaagttggattgatgcctgagtacatccttaaaaa

SEQ ID NO: 19199 - DNA, 75 bp, Artificial Sequence
  Synthetic
caccaagcactagtcggaattatccccatgttgacatgaatgaccttctcacaccaaagatagatacattccctg

SEQ ID NO: 19200 - DNA, 75 bp, Artificial Sequence
  Synthetic
atcaaatggtttgcaaaagttggattgatgcctgagtacatccttaaaaacattgttttgagggcaccaggttca

SEQ ID NO: 19201 - DNA, 75 bp, Artificial Sequence
  Synthetic
ccatgttgacatgaatgaccttctcacaccaaagatagatacattccctgcgaacttatattatatggctaggaa

SEQ ID NO: 19202 - DNA, 75 bp, Artificial Sequence
  Synthetic
cacaaaattgcctacgtcgtacctaaagaaacatacacagaggacattagttgctgattcccctaatccgttgct

SEQ ID NO: 19203 - DNA, 75 bp, Artificial Sequence
  Synthetic
tcatcttcccgatcccataccacgaagagctctcacatgaaaaagacccgttaacggaagtgaaggatccctttt

SEQ ID NO: 19204 - DNA, 75 bp, Artificial Sequence
  Synthetic
aagaaacatacacagaggacattagttgctgattcccctaatccgttgcttcagggggtgtttctattaaatcag

SEQ ID NO: 19205 - DNA, 75 bp, Artificial Sequence
  Synthetic
agagctctcacatgaaaaagacccgttaacggaagtgaaggatcccttttatacgggagagtgtgcattcctaat

SEQ ID NO: 19206 - DNA, 75 bp, Artificial Sequence
  Synthetic
gatgccacgagctgcccatgtaatctatgatcagtcagttctcggccggaggaaatatttacaagggcttgttga

SEQ ID NO: 19207 - DNA, 75 bp, Artificial Sequence
  Synthetic
tagagacagtgttaccagtgagtagattatccaaccaggcaacggcggacttacggaaataccttttcagaggga

SEQ ID NO: 19208 - DNA, 75 bp, Artificial Sequence
  Synthetic
tatgatcagtcagttctcggccggaggaaatatttacaagggcttgttgatactacacagacaatcataaggtat

SEQ ID NO: 19209 - DNA, 75 bp, Artificial Sequence
  Synthetic
attatccaaccaggcaacggcggacttacggaaataccttttcagagggattggacaggcatcttcatcatggta

SEQ ID NO: 19210 - DNA, 75 bp, Artificial Sequence
  Synthetic
ttacaatctcctctacatacaatcactttttgatgaggtcttgacacagaatgtcattcatagtggattggatac

SEQ ID NO: 19211 - DNA, 75 bp, Artificial Sequence
  Synthetic
cgaatgccttatacttgggtgaaggaagtggtgctctcatgtccttgactgagttatacctcccccatcgaatga

SEQ ID NO: 19212 - DNA, 75 bp, Artificial Sequence
  Synthetic
ctttttgatgaggtcttgacacagaatgtcattcatagtggattggatactatatggaaaagagatctaattagc

SEQ ID NO: 19213 - DNA, 75 bp, Artificial Sequence
  Synthetic
aagtggtgctctcatgtccttgactgagttatacctcccccatcgaatgatatactatcacacacagtttgataa

SEQ ID NO: 19214 - DNA, 75 bp, Artificial Sequence
  Synthetic
gtctaatattctacagggcaggcaaattgttggagttacaactccagacacgatagaattgtgtaccggttcttt

SEQ ID NO: 19215 - DNA, 75 bp, Artificial Sequence
  Synthetic
tagactcagtggtgtaccagaacatgcaagcagacattccatgtgcattaggattcatacaagagttcaaagtgt

SEQ ID NO: 19216 - DNA, 75 bp, Artificial Sequence
  Synthetic
attgttggagttacaactccagacacgatagaattgtgtaccggttctttgatttcttgcaacagtgcatgtgag

SEQ ID NO: 19217 - DNA, 75 bp, Artificial Sequence
  Synthetic
gcaagcagacattccatgtgcattaggattcatacaagagttcaaagtgttatggagagaggtggctgcagaaac

SEQ ID NO: 19218 - DNA, 75 bp, Artificial Sequence
  Synthetic
tatctcatttgatacaatgagccctggcaatctgattcaaagagtgccgtacctaggatcaaagactgatgaaca

SEQ ID NO: 19219 - DNA, 75 bp, Artificial Sequence
  Synthetic
gccagggaatcggattccttatggtagatgctgagttgccttctgattcccctgttagtgtgatagaggaattca

SEQ ID NO: 19220 - DNA, 75 bp, Artificial Sequence
  Synthetic
ggcaatctgattcaaagagtgccgtacctaggatcaaagactgatgaacagcgagctgcctctctaacaaccatc

SEQ ID NO: 19221 - DNA, 75 bp, Artificial Sequence
  Synthetic
agatgctgagttgccttctgattcccctgttagtgtgatagaggaattcataaccaatatcatgaccataggatt

SEQ ID NO: 19222 - DNA, 75 bp, Artificial Sequence
  Synthetic
tgtgtgggcatatggagagactgatcagaattggttagatgcgctgaagttagcaaacacccggtgcaatgtaac

SEQ ID NO: 19223 - DNA, 75 bp, Artificial Sequence
  Synthetic
ggactttagagttcaattttatggtgaactgcatgatgctggcagccgatcgagttatactcattagtaatggac

SEQ ID NO: 19224 - DNA, 75 bp, Artificial Sequence
  Synthetic
cagaattggttagatgcgctgaagttagcaaacacccggtgcaatgtaacattacaagctttgactgcactctgc

SEQ ID NO: 19225 - DNA, 75 bp, Artificial Sequence
  Synthetic
gaactgcatgatgctggcagccgatcgagttatactcattagtaatggacacatgtgtcggggggacggagaatg

SEQ ID NO: 19226 - DNA, 75 bp, Artificial Sequence
  Synthetic
tacagttaaattcacacctgcaagtttgtcacgaatagcagcttatattcacatttgtaatgaccaacaaaagca

SEQ ID NO: 19227 - DNA, 75 bp, Artificial Sequence
  Synthetic
gggttatccaaggagccaaacagaaggccaggagcggagtgtgccttttggacccctatcagactcaggaattag

SEQ ID NO: 19228 - DNA, 75 bp, Artificial Sequence
  Synthetic
ttgtcacgaatagcagcttatattcacatttgtaatgaccaacaaaagcatgataacctagggaatagttttgaa

SEQ ID NO: 19229 - DNA, 75 bp, Artificial Sequence
  Synthetic
ggccaggagcggagtgtgccttttggacccctatcagactcaggaattagtaaaattatttgtcgaccaacaggc

SEQ ID NO: 19230 - DNA, 75 bp, Artificial Sequence
  Synthetic
aacaattttcccactatcagttcaatatatccacgaggaacaaacacttcacttgcacactggattttcctgttg

SEQ ID NO: 19231 - DNA, 75 bp, Artificial Sequence
  Synthetic
tgactcacaatattgacacagctcttcttgctgcaggagggagaccaactcgtcctcatggatgtgacaatgcta

SEQ ID NO: 19232 - DNA, 75 bp, Artificial Sequence
  Synthetic
tatatccacgaggaacaaacacttcacttgcacactggattttcctgttgtgtcagggaagctgacacaatgatt

SEQ ID NO: 19233 - DNA, 75 bp, Artificial Sequence
  Synthetic
tcttgctgcaggagggagaccaactcgtcctcatggatgtgacaatgctatcataagccctgcggatgatatagc

SEQ ID NO: 19234 - DNA, 75 bp, Artificial Sequence
  Synthetic
taagtttttattcaaccctgaccctattcctgcagtgtgggcagataaaatattcacgactgaatttagattctt

SEQ ID NO: 19235 - DNA, 75 bp, Artificial Sequence
  Synthetic
tatacttttttgacgaagggtgccttgcagatactgtttttcttctgaccccctataatctgagcaacaggggga

SEQ ID NO: 19236 - DNA, 75 bp, Artificial Sequence
  Synthetic
attcctgcagtgtgggcagataaaatattcacgactgaatttagattcttcgagtacaatatagagaatcaagga

SEQ ID NO: 19237 - DNA, 75 bp, Artificial Sequence
  Synthetic
tgcagatactgtttttcttctgaccccctataatctgagcaacagggggaaggtttcaaccttagtccaccaaac

SEQ ID NO: 19238 - DNA, 75 bp, Artificial Sequence
  Synthetic
agaatcgctagttcaggatactttccatagttctgtcaaaaatgatgcaataattgcgtatgacaattcaattaa

SEQ ID NO: 19239 - DNA, 75 bp, Artificial Sequence
  Synthetic
tatttacgattgacagaatgatcactctagtaatgctcggacgcattaccctgaatgatatcattcactggaagg

SEQ ID NO: 19240 - DNA, 75 bp, Artificial Sequence
  Synthetic
catagttctgtcaaaaatgatgcaataattgcgtatgacaattcaattaattacatcagtgagctacaacaatgt

SEQ ID NO: 19241 - DNA, 75 bp, Artificial Sequence
  Synthetic
tctagtaatgctcggacgcattaccctgaatgatatcattcactggaaggaatacttgagacgctcttcttgtaa

SEQ ID NO: 19242 - DNA, 75 bp, Artificial Sequence
  Synthetic
agcttaccagctgtactaccttcgaattagatcgaaacgaggtataattagttacttgaaggtactgctgactcg

SEQ ID NO: 19243 - DNA, 75 bp, Artificial Sequence
  Synthetic
gctatgattctgaggtcgtattaaacaggtctactcagaaaatttacatgaaggtgattgggaatgcagttaaag

SEQ ID NO: 19244 - DNA, 75 bp, Artificial Sequence
  Synthetic
attagatcgaaacgaggtataattagttacttgaaggtactgctgactcggcttccaattattcagtttgcaccg

SEQ ID NO: 19245 - DNA, 75 bp, Artificial Sequence
  Synthetic
caggtctactcagaaaatttacatgaaggtgattgggaatgcagttaaagggtattacgggcaagattaatagag

SEQ ID NO: 19246 - DNA, 75 bp, Artificial Sequence
  Synthetic
gaggttggttatggaaccgttgcaaccttatttggcttcgatagattatgtcaaagccgcaagagagcttgtttt

SEQ ID NO: 19247 - DNA, 75 bp, Artificial Sequence
  Synthetic
gcatagtgtagatttagactttcgaagtcgtcttctaatcaattagaaaaaacatggaaagtaacccgagaagaa

SEQ ID NO: 19248 - DNA, 75 bp, Artificial Sequence
  Synthetic
ccttatttggcttcgatagattatgtcaaagccgcaagagagcttgttttgattggtgcttcttcttacctctca

SEQ ID NO: 19249 - DNA, 75 bp, Artificial Sequence
  Synthetic
agtcgtcttctaatcaattagaaaaaacatggaaagtaacccgagaagaaactactaaagacgtaatccaccaaa

SEQ ID NO: 19250 - DNA, 75 bp, Artificial Sequence
  Synthetic
cggggattcagagggcaagattgatcaggcgatggcaaggagactgtgcctaatcacattattagtgaatcctgg

SEQ ID NO: 19251 - DNA, 75 bp, Artificial Sequence
  Synthetic
caggcgatggcaaggagactgtgcctaatcacattattagtgaatcctggatatgcattacctgtgatcaaagga

SEQ ID NO: 19252 - DNA, 75 bp, Artificial Sequence
  Synthetic
ggtgccttaaagtgaacatccctatgcttgtcactgcatccgaagaccccaccacgcgttggcaactagcatgct

SEQ ID NO: 19253 - DNA, 75 bp, Artificial Sequence
  Synthetic
gcttgtcactgcatccgaagaccccaccacgcgttggcaactagcatgcttatctctgaggctcttgatttccaa

SEQ ID NO: 19254 - DNA, 75 bp, Artificial Sequence
  Synthetic
tatcatttctgtttctttatctgagcagattgcaacacttattctaacaccaaagattgaagtgcacccgacaaa

SEQ ID NO: 19255 - DNA, 75 bp, Artificial Sequence
  Synthetic
cagattgcaacacttattctaacaccaaagattgaagtgcacccgacaaatttatactatatgatgcggaagacc

SEQ ID NO: 19256 - DNA, 75 bp, Artificial Sequence
  Synthetic
tgccatcgcaaaacatgagagcaacagcagctattgctgggtccacgaatgcggctgttatcaacactatggaag

SEQ ID NO: 19257 - DNA, 75 bp, Artificial Sequence
  Synthetic
agcagctattgctgggtccacgaatgcggctgttatcaacactatggaagtcttaagtgtcaatgactggacccc

SEQ ID NO: 19258 - DNA, 75 bp, Artificial Sequence
  Synthetic
gtataatatagatcaagagtctgcgataatgagggttgaatcagaagaggacggccctgtagacaaaatgaatct

SEQ ID NO: 19259 - DNA, 75 bp, Artificial Sequence
  Synthetic
ataatgagggttgaatcagaagaggacggccctgtagacaaaatgaatcttgcacccatactaaggcttgtgcca

SEQ ID NO: 19260 - DNA, 75 bp, Artificial Sequence
  Synthetic
gagacatggcaagagatctgcctcctcagttcacttctggatcaccctttacatcagcattggcggaggggttta

SEQ ID NO: 19261 - DNA, 75 bp, Artificial Sequence
  Synthetic
tcagttcacttctggatcaccctttacatcagcattggcggaggggtttactcccgaggacactcatgacctgat

SEQ ID NO: 19262 - DNA, 75 bp, Artificial Sequence
  Synthetic
agaggtggaactgatgggtagcccagtttgcaaaatcactcagagattagataagtacatctatcgcacaattgg

SEQ ID NO: 19263 - DNA, 75 bp, Artificial Sequence
  Synthetic
gtttgcaaaatcactcagagattagataagtacatctatcgcacaattggcaccatatctactgcatggtataaa

SEQ ID NO: 19264 - DNA, 75 bp, Artificial Sequence
  Synthetic
ccatgaccaatattgatggatctggggaggctaacgaaagacgccttgcaaaatacatccaaaagggacagctca

SEQ ID NO: 19265 - DNA, 75 bp, Artificial Sequence
  Synthetic
ggaggctaacgaaagacgccttgcaaaatacatccaaaagggacagctcaatcgtcagtttgcaattggcaatcc

SEQ ID NO: 19266 - DNA, 75 bp, Artificial Sequence
  Synthetic
cagcttatatttatgtgagggaagtggtagtagtatgacatgtttggaatattgtttcccttcgaaaacaatctg

SEQ ID NO: 19267 - DNA, 75 bp, Artificial Sequence
  Synthetic
ggtagtagtatgacatgtttggaatattgtttcccttcgaaaacaatctggtataattcattcttctcaaatgag

SEQ ID NO: 19268 - DNA, 75 bp, Artificial Sequence
  Synthetic
ggttcttggtctctgagctccgcgcatcacgtggtgcagtaaaggagggttccccttactatgcagccgttgggg

SEQ ID NO: 19269 - DNA, 75 bp, Artificial Sequence
  Synthetic
atcacgtggtgcagtaaaggagggttccccttactatgcagccgttggggatatccacgcttacatcttcaatgc

SEQ ID NO: 19270 - DNA, 75 bp, Artificial Sequence
  Synthetic
aagcattgtctatcacaatttgaatgctgaagtcccgtgctctgcagggtttatccaagatttcaaagtactctg

SEQ ID NO: 19271 - DNA, 75 bp, Artificial Sequence
  Synthetic
gctgaagtcccgtgctctgcagggtttatccaagatttcaaagtactctgggccgacaaatcagtggagactgat

SEQ ID NO: 19272 - DNA, 75 bp, Artificial Sequence
  Synthetic
acgccgctgtcgcactcagtgtgtttgctgcagacattgcaaaattgaagagtctactcaccctgtatcaagaca

SEQ ID NO: 19273 - DNA, 75 bp, Artificial Sequence
  Synthetic
tgctgcagacattgcaaaattgaagagtctactcaccctgtatcaagacaaaggtgtagaagctggatacatggc

SEQ ID NO: 19274 - DNA, 75 bp, Artificial Sequence
  Synthetic
aacatgcaaattgatacatgcagaccttgatctacctattgagaccccaagatctgtctggatggcttgtgtcac

SEQ ID NO: 19275 - DNA, 75 bp, Artificial Sequence
  Synthetic
cttgatctacctattgagaccccaagatctgtctggatggcttgtgtcacaaatacattcattttgggaaatgcc

SEQ ID NO: 19276 - DNA, 75 bp, Artificial Sequence
  Synthetic
acatgtattcctatgcgatgggagtggcctcctatcacgaccctagcatgcgccaataccagtatgccaggaggt

SEQ ID NO: 19277 - DNA, 75 bp, Artificial Sequence
  Synthetic
ggcctcctatcacgaccctagcatgcgccaataccagtatgccaggaggtttctcagtcgtcccttctacctgct

SEQ ID NO: 19278 - DNA, 75 bp, Artificial Sequence
  Synthetic
gctcctcttttcatcttgcttaggattcgcatggtgccttatggacgatataaatatcctccgaaatggctactt

SEQ ID NO: 19279 - DNA, 75 bp, Artificial Sequence
  Synthetic
ttcgcatggtgccttatggacgatataaatatcctccgaaatggctacttcaatgacaaatcaaaggaatgctac

SEQ ID NO: 19280 - DNA, 75 bp, Artificial Sequence
  Synthetic
cgaaagaactgcaagtgtcagagagggaccgcgctgcactgtctgccgcgattcaatcagcaatggaggggggag

SEQ ID NO: 19281 - DNA, 75 bp, Artificial Sequence
  Synthetic
ggaccgcgctgcactgtctgccgcgattcaatcagcaatggaggggggagagtcagatgacttcccattgtcagg

SEQ ID NO: 19282 - DNA, 75 bp, Artificial Sequence
  Synthetic
ccagcagcaaataaataagattgctagtcaagggttaagtgtcatacctgaagctgtaattcatgacatttacaa

SEQ ID NO: 19283 - DNA, 75 bp, Artificial Sequence
  Synthetic
agtcaagggttaagtgtcatacctgaagctgtaattcatgacatttacaaccagcttgaggacagtattagatgt

SEQ ID NO: 19284 - DNA, 75 bp, Artificial Sequence
  Synthetic
aacagtcccagctctctcctcctcaatcatcaaacatgtcccaatcggcgcctaggaccccggactatcaacccg

SEQ ID NO: 19285 - DNA, 75 bp, Artificial Sequence
  Synthetic
atcatcaaacatgtcccaatcggcgcctaggaccccggactatcaacccgactttgagctgtagactatatccac

SEQ ID NO: 19286 - DNA, 75 bp, Artificial Sequence
  Synthetic
caattcgacagatctattactaataagacttggagggaaaccaattggggaatcactattagagttaacatccat

SEQ ID NO: 19287 - DNA, 75 bp, Artificial Sequence
  Synthetic
agacttggagggaaaccaattggggaatcactattagagttaacatccatacaaggcatggattatgatgattta

SEQ ID NO: 19288 - DNA, 75 bp, Artificial Sequence
  Synthetic
ggtcatccacaaagacccagtccaacatcccagcactattcccttttaattaaaaactggccgacagggtgggga

SEQ ID NO: 19289 - DNA, 75 bp, Artificial Sequence
  Synthetic
catcccagcactattcccttttaattaaaaactggccgacagggtggggaaggaggactgttagctgccaccaac

SEQ ID NO: 19290 - DNA, 75 bp, Artificial Sequence
  Synthetic
cctcaagtctgatacttcgagcttagatcttgtactgctaatgtctccttacaatctggcacttggagggaaaat

SEQ ID NO: 19291 - DNA, 75 bp, Artificial Sequence
  Synthetic
gatcttgtactgctaatgtctccttacaatctggcacttggagggaaaataagcacaattctgaaatctgttgtt

SEQ ID NO: 19292 - DNA, 75 bp, Artificial Sequence
  Synthetic
gagtcatcatcggcaattatagactccatacagcatggagggctgcaaccagcaggcactgttggcttatctcaa

SEQ ID NO: 19293 - DNA, 75 bp, Artificial Sequence
  Synthetic
ccatacagcatggagggctgcaaccagcaggcactgttggcttatctcaaattccaaaagggataaccagtgcac

SEQ ID NO: 19294 - DNA, 75 bp, Artificial Sequence
  Synthetic
accattaaaaggatggttgtctctgttgaatcaaggagtcatctcactatcttcattgatcccgttgcatgatta

SEQ ID NO: 19295 - DNA, 75 bp, Artificial Sequence
  Synthetic
ttgaatcaaggagtcatctcactatcttcattgatcccgttgcatgattatctgaggaagagtaagttgagaaaa

SEQ ID NO: 19296 - DNA, 75 bp, Artificial Sequence
  Synthetic
caacacaaacccgatgacccagaggaccaccaggctagggacacggagtccctggaagacacaggcaacgacccg

SEQ ID NO: 19297 - DNA, 75 bp, Artificial Sequence
  Synthetic
accaccaggctagggacacggagtccctggaagacacaggcaacgacccggccacacaggggactaacattgttg

SEQ ID NO: 19298 - DNA, 75 bp, Artificial Sequence
  Synthetic
caggtctcaacaaatgctgagtagaagtgagaccaagttgctaataaaagtgctgagtgctgcttggaagggatt

SEQ ID NO: 19299 - DNA, 75 bp, Artificial Sequence
  Synthetic
agtgagaccaagttgctaataaaagtgctgagtgctgcttggaagggattgttgtaaaattgtaaatatacactg

SEQ ID NO: 19300 - DNA, 75 bp, Artificial Sequence
  Synthetic
cccaaagcagggaaagacacccatggcaatccccccactcaacccgatcactttttaaaggggggcctcccgagt

SEQ ID NO: 19301 - DNA, 75 bp, Artificial Sequence
  Synthetic
gcaatccccccactcaacccgatcactttttaaaggggggcctcccgagtccacaaccgacagcaccgcggatgc

SEQ ID NO: 19302 - DNA, 75 bp, Artificial Sequence
  Synthetic
tttcatatggaatgcatatcaataaagataggcatttaaattatacaatgataacatattttaggttgacaacaa

SEQ ID NO: 19303 - DNA, 75 bp, Artificial Sequence
  Synthetic
agataggcatttaaattatacaatgataacatattttaggttgacaacaatcattgatataatcaccaatagtag

SEQ ID NO: 19304 - DNA, 75 bp, Artificial Sequence
  Synthetic
caaactcaggatcattcccccaccggagagaaatggcaattgtcaccgacaaagcaaccggagacatcgaactgg

SEQ ID NO: 19305 - DNA, 75 bp, Artificial Sequence
  Synthetic
gagagaaatggcaattgtcaccgacaaagcaaccggagacatcgaactggtggagtggtgcaacccagggtgtac

SEQ ID NO: 19306 - DNA, 75 bp, Artificial Sequence
  Synthetic
aaattagaattgctatattttatcgctatagtgggcctgtcggctgcgttagcggtaagacaaagaggacttgtc

SEQ ID NO: 19307 - DNA, 75 bp, Artificial Sequence
  Synthetic
ctatagtgggcctgtcggctgcgttagcggtaagacaaagaggacttgtcttttaaaaatttattaaaaaatcat

SEQ ID NO: 19308 - DNA, 75 bp, Artificial Sequence
  Synthetic
ccaccatctgcagtctctgcatgtatgacgactgatcaggtacagttgttgatgaaggaggttgctgacataaaa

SEQ ID NO: 19309 - DNA, 75 bp, Artificial Sequence
  Synthetic
tgacgactgatcaggtacagttgttgatgaaggaggttgctgacataaaatcactcctccaggcactagtaagga

SEQ ID NO: 19310 - DNA, 75 bp, Artificial Sequence
  Synthetic
gtctagtagcttccctgctgtgccaagatgtcgtcggtgttcactgactacgctaagctgcaagatgcccttgtg

SEQ ID NO: 19311 - DNA, 75 bp, Artificial Sequence
  Synthetic
tcacaggccatgatagaggggacactcaattcaattaagattcttgatcctggaaattatcaggaatcatcacta

SEQ ID NO: 19312 - DNA, 75 bp, Artificial Sequence
  Synthetic
tcaattcaattaagattcttgatcctggaaattatcaggaatcatcactaaacagttggttcaaacctcgccagg

SEQ ID NO: 19313 - DNA, 75 bp, Artificial Sequence
  Synthetic
ccagttcaggacagtaccatattcttagatgagctagcaagacctcatcctaatttggtcaatccgtctccgccc

SEQ ID NO: 19314 - DNA, 75 bp, Artificial Sequence
  Synthetic
tagatgagctagcaagacctcatcctaatttggtcaatccgtctccgcccgtcaccagcaccaatgttgaccttg

SEQ ID NO: 19315 - DNA, 75 bp, Artificial Sequence
  Synthetic
tgcccaagatctgcctccctcctataacaatggtagcccttttgtaaatagagacattgaggacaattatccgac

SEQ ID NO: 19316 - DNA, 75 bp, Artificial Sequence
  Synthetic
ccagggaaacgggaccagctttcaaggcttattgaacgggcggctaccttgagtgagatcaacaaggttaaaaga

SEQ ID NO: 19317 - DNA, 75 bp, Artificial Sequence
  Synthetic
ggcttattgaacgggcggctaccttgagtgagatcaacaaggttaaaagacaggctctcgggctctaaattaatc

SEQ ID NO: 19318 - DNA, 75 bp, Artificial Sequence
  Synthetic
atgaccaaatctgcataccactcacatcatccgcctatacccctcaccataaataccaccttagccgatttattt

SEQ ID NO: 19319 - DNA, 75 bp, Artificial Sequence
  Synthetic
atcatccgcctatacccctcaccataaataccaccttagccgatttatttaaaagaaatcattcatcacaacctg

SEQ ID NO: 19320 - DNA, 75 bp, Artificial Sequence
  Synthetic
gacatgaagaaactccagagcttgatccgagtataccagagcaaaggtgaggatggaccctatatggcatttctg

SEQ ID NO: 19321 - DNA, 75 bp, Artificial Sequence
  Synthetic
ctgtctccaggcacgcacccgtcaacccaccaataacacaatggcggacatggacacgatatacatcaacttgat

SEQ ID NO: 19322 - DNA, 75 bp, Artificial Sequence
  Synthetic
cccaccaataacacaatggcggacatggacacgatatacatcaacttgatggcagatgatccaacccatcaaaaa

SEQ ID NO: 19323 - DNA, 75 bp, Artificial Sequence
  Synthetic
cccctggaaactatccactcatgtattcatatgcaatgggagtagggtccattcttgaggcaagtattgctcgat

SEQ ID NO: 19324 - DNA, 75 bp, Artificial Sequence
  Synthetic
tgacacgttctatcgattgggtgttgaaactgcacaacgaaaccaaggttcacttgatgagaatctagcgaagga

SEQ ID NO: 19325 - DNA, 75 bp, Artificial Sequence
  Synthetic
agtgctccaacaccagatccggacccaatccttgctcacctcagacaaacaaacggagaggttcatctttctcaa

SEQ ID NO: 19326 - DNA, 75 bp, Artificial Sequence
  Synthetic
caatccttgctcacctcagacaaacaaacggagaggttcatctttctcaacacttacgggttcatctatgacaca

SEQ ID NO: 19327 - DNA, 75 bp, Artificial Sequence
  Synthetic
gaggacaatggtgagtgctgcgatgatgactattggtctggttcctgctacaatacccctgaatgaattgacggc

SEQ ID NO: 19328 - DNA, 75 bp, Artificial Sequence
  Synthetic
atgactattggtctggttcctgctacaatacccctgaatgaattgacggccactgtgtttaaccttaaagtaaga

SEQ ID NO: 19329 - DNA, 75 bp, Artificial Sequence
  Synthetic
cgtaccagctctgctcgcagccaccagatttggccgccaagggggtcttgagtcgagcaccggagtcagtgtaaa

SEQ ID NO: 19330 - DNA, 75 bp, Artificial Sequence
  Synthetic
aatccaatactccaatcgataacaagatcacatgtagactttaagaaaaaacaagggtgagggggaagttcctgg

SEQ ID NO: 19331 - DNA, 75 bp, Artificial Sequence
  Synthetic
agatttggccgccaagggggtcttgagtcgagcaccggagtcagtgtaaaggcacctgagaagattgattgtgag

SEQ ID NO: 19332 - DNA, 75 bp, Artificial Sequence
  Synthetic
tgaccaggagattgcagaattactcgagctgagttcggatgtgataaagagcatccaacatgccgagacccagcc

SEQ ID NO: 19333 - DNA, 75 bp, Artificial Sequence
  Synthetic
ttccaacctctttaaggtaccgaagatggttgccaatgcaaccaacagtcaattgtatcacctaaccatgcaggt

SEQ ID NO: 19334 - DNA, 75 bp, Artificial Sequence
  Synthetic
gagctgagttcggatgtgataaagagcatccaacatgccgagacccagccagcacacactgtcggcaaatctgcc

SEQ ID NO: 19335 - DNA, 75 bp, Artificial Sequence
  Synthetic
atggttgccaatgcaaccaacagtcaattgtatcacctaaccatgcaggtcacatttgcatttccgaaaaacatt

SEQ ID NO: 19336 - DNA, 75 bp, Artificial Sequence
  Synthetic
acaaccaacccaaacagaaaacaagtctgaggaacacccagagcaaactgcccgggatcccgacagcaagggcaa

SEQ ID NO: 19337 - DNA, 75 bp, Artificial Sequence
  Synthetic
taccgtggattgccattttgggaacatgctaaaaaaggataggaaagggaacatgaggactttgtctcaagcagc

SEQ ID NO: 19338 - DNA, 75 bp, Artificial Sequence
  Synthetic
tctgaggaacacccagagcaaactgcccgggatcccgacagcaagggcaacacaggaaattcgcaaccacgatcc

SEQ ID NO: 19339 - DNA, 75 bp, Artificial Sequence
  Synthetic
atgctaaaaaaggataggaaagggaacatgaggactttgtctcaagcagcagataaggtcagaagaatgaatatc

SEQ ID NO: 19340 - DNA, 75 bp, Artificial Sequence
  Synthetic
tgggaaattgacaaaagccctgttggggttcatgtccaccagccgaacagcaatcatccccatatcacaactcaa

SEQ ID NO: 19341 - DNA, 75 bp, Artificial Sequence
  Synthetic
gggttcatgtccaccagccgaacagcaatcatccccatatcacaactcaatcctatgctgagtcaactcatgtgg

SEQ ID NO: 19342 - DNA, 75 bp, Artificial Sequence
  Synthetic
acgtggcccgtgtgggggcgagcaggaatatgtgctggatcctaaattcacagttaagaaagaaaaggctcgact

SEQ ID NO: 19343 - DNA, 75 bp, Artificial Sequence
  Synthetic
gaatatgtgctggatcctaaattcacagttaagaaagaaaaggctcgactcaatccattcaagaaggcagcctaa

SEQ ID NO: 19344 - DNA, 75 bp, Artificial Sequence
  Synthetic
ggttgatagaaatgccactacacagctaatgattttccagaaaatcacttagaaaaccaaatccttattagggtg

SEQ ID NO: 19345 - DNA, 75 bp, Artificial Sequence
  Synthetic
ctaatgattttccagaaaatcacttagaaaaccaaatccttattagggtggggaagtagttgattgggtgtctaa

SEQ ID NO: 19346 - DNA, 75 bp, Artificial Sequence
  Synthetic
cattaaacacgcttttgaccgtgattcttatcatactcatcagctatttggtgattgttcattctagtgatgcgg

SEQ ID NO: 19347 - DNA, 75 bp, Artificial Sequence
  Synthetic
ttgtaaagacatcctgcgctgtcattgagggccaacttgccacagtgcaaatattggagccgggccactcatcga

SEQ ID NO: 19348 - DNA, 75 bp, Artificial Sequence
  Synthetic
tcttatcatactcatcagctatttggtgattgttcattctagtgatgcggttgagaggccaaggactgagggaat

SEQ ID NO: 19349 - DNA, 75 bp, Artificial Sequence
  Synthetic
atacaccaagccaggaattgtcgtccaaacagggatgactcaagacataagcgccgtcatgagggacggcacgat

SEQ ID NO: 19350 - DNA, 75 bp, Artificial Sequence
  Synthetic
aactgcaaatctatcagcagtcagggtaccacgaccttgtcataagattattaccccttttaccaacggaactca

SEQ ID NO: 19351 - DNA, 75 bp, Artificial Sequence
  Synthetic
gtaccacgaccttgtcataagattattaccccttttaccaacggaactcaatgattgccaaaaagaagtagtcac

SEQ ID NO: 19352 - DNA, 75 bp, Artificial Sequence
  Synthetic
gttaatccggacaagtggtcagcaacaatcaatgctcaatcaacaacaatgaaggtaacccaagaagatataaag

SEQ ID NO: 19353 - DNA, 75 bp, Artificial Sequence
  Synthetic
tggataccctattagcagatggtaatacgagggaagcggatatacagccgcggtttattggagcaataatagcca

SEQ ID NO: 19354 - DNA, 75 bp, Artificial Sequence
  Synthetic
tacgagggaagcggatatacagccgcggtttattggagcaataatagccacaggtgccttggcggtagcaacagt

SEQ ID NO: 19355 - DNA, 75 bp, Artificial Sequence
  Synthetic
ggattaagaaacgtgttatgaatgcataagcagccaaaaaatcacaacaattagtacagatggcctcccaatgtc

SEQ ID NO: 19356 - DNA, 75 bp, Artificial Sequence
  Synthetic
aaaatattctcaagctaagagatagtatccaggccaccaaccaagcggtctttgaaatttcacaagggcttgagg

SEQ ID NO: 19357 - DNA, 75 bp, Artificial Sequence
  Synthetic
tatccaggccaccaaccaagcggtctttgaaatttcacaagggcttgaggcaactgcaactgtgctatcgaaact

SEQ ID NO: 19358 - DNA, 75 bp, Artificial Sequence
  Synthetic
ccaacaatttgctttggacacccttgacactgattaataaaaaagtgagggggaactggtggtgtccggactggg

SEQ ID NO: 19359 - DNA, 75 bp, Artificial Sequence
  Synthetic
gacactgattaataaaaaagtgagggggaactggtggtgtccggactgggcaacccagggtcacccggtccgaac

SEQ ID NO: 19360 - DNA, 75 bp, Artificial Sequence
  Synthetic
gtgctgccatggggaatcgtcttggtgtatcactctcactctatttaactctaatgactaccctctttggggacc

SEQ ID NO: 19361 - DNA, 75 bp, Artificial Sequence
  Synthetic
tgtatcactctcactctatttaactctaatgactaccctctttggggaccaaattacgaacccagtgctgacacc

SEQ ID NO: 19362 - DNA, 75 bp, Artificial Sequence
  Synthetic
accccaaccatggccacgtcagaactcaacctctatatcgacaaggactcaccccaggtgagattgctagcattc

SEQ ID NO: 19363 - DNA, 75 bp, Artificial Sequence
  Synthetic
tgatgagtaaaatattagccggatcggtcacgagccagttgggggcagaacaattgattgctagtggcttaatac

SEQ ID NO: 19364 - DNA, 75 bp, Artificial Sequence
  Synthetic
ggtcacgagccagttgggggcagaacaattgattgctagtggcttaatacaatcacaggtggtaggctatgattc

SEQ ID NO: 19365 - DNA, 75 bp, Artificial Sequence
  Synthetic
tccagaataccagggttgtatcattaagaacgctagctgtcaatagagatggtggactttatagagcccaagttc

SEQ ID NO: 19366 - DNA, 75 bp, Artificial Sequence
  Synthetic
caaaggcctgctataatcttcaggtgtcagttaggatgtccgctgattcaactcagaaggttgtttacacaatca

SEQ ID NO: 19367 - DNA, 75 bp, Artificial Sequence
  Synthetic
aagaacgctagctgtcaatagagatggtggactttatagagcccaagttccacctgaggtagtcgaacgatccgg

SEQ ID NO: 19368 - DNA, 75 bp, Artificial Sequence
  Synthetic
tgtgtggttgcagcagagggtgcaatcaagtgccccgagaagatgacatccgatcgcctttacaagttccgcgta

SEQ ID NO: 19369 - DNA, 75 bp, Artificial Sequence
  Synthetic
atatttgctcatcaatcagatcctctcggcttaatccagaattagtcaagtgtctcagtggggcacttgattcat

SEQ ID NO: 19370 - DNA, 75 bp, Artificial Sequence
  Synthetic
tcggcttaatccagaattagtcaagtgtctcagtggggcacttgattcatgtacattcgagagggagagtgccct

SEQ ID NO: 19371 - DNA, 75 bp, Artificial Sequence
  Synthetic
aagcggcaacatgcagatgcaacaaaccaccgtcaattattgctcaatattctgcatcagctctagtaaccatca

SEQ ID NO: 19372 - DNA, 75 bp, Artificial Sequence
  Synthetic
accaccgtcaattattgctcaatattctgcatcagctctagtaaccatcaccactgacacctgtgccgatctcga

SEQ ID NO: 19373 - DNA, 75 bp, Artificial Sequence
  Synthetic
cacctaactttactgtctcaacctcacagatagtgtcagttgatccaatagacatatcctctgacatcgcaaaaa

SEQ ID NO: 19374 - DNA, 75 bp, Artificial Sequence
  Synthetic
gctaggtttcttctcggagaccaaggttggctgtcatccaatctggaaatgcaactcgactgtcgcgaagatcat

SEQ ID NO: 19375 - DNA, 75 bp, Artificial Sequence
  Synthetic
acagatagtgtcagttgatccaatagacatatcctctgacatcgcaaaaatcaacaattcgattgaggccgcacg

SEQ ID NO: 19376 - DNA, 75 bp, Artificial Sequence
  Synthetic
cctctgctcgtgccctgttgacatcagaggacatagaagccaagggagccatctccactgacaaaaagaaaacag

SEQ ID NO: 19377 - DNA, 75 bp, Artificial Sequence
  Synthetic
tcgtgaatgacgaatcactgatagctattatcgtgacaattgttgtgcttagtctccttgtagtcggtcttatca

SEQ ID NO: 19378 - DNA, 75 bp, Artificial Sequence
  Synthetic
tattatcgtgacaattgttgtgcttagtctccttgtagtcggtcttatcattgttctcggcgtgatgtataaaaa

SEQ ID NO: 19379 - DNA, 75 bp, Artificial Sequence
  Synthetic
gttcatcgcagcctgtaaccacaaaactggggacacccttctaggtgaataaatgcatcacctctttccttgatg

SEQ ID NO: 19380 - DNA, 75 bp, Artificial Sequence
  Synthetic
actggggacacccttctaggtgaataaatgcatcacctctttccttgatgagcgagatgtcttaatcattgataa

SEQ ID NO: 19381 - DNA, 75 bp, Artificial Sequence
  Synthetic
aacttcctaactattccttccttagaagtccagtcatattaatcaaaaaaatcagtttgctggtaaagtcgtata

SEQ ID NO: 19382 - DNA, 75 bp, Artificial Sequence
  Synthetic
taattaaaaacggttgaactgagggggagaatgtgcatggtagggtggggaaggtgtctgattcctacctatcgg

SEQ ID NO: 19383 - DNA, 75 bp, Artificial Sequence
  Synthetic
ggagaatgtgcatggtagggtggggaaggtgtctgattcctacctatcgggccaactgtaccagtagaagctaac

SEQ ID NO: 19384 - DNA, 75 bp, Artificial Sequence
  Synthetic
tggatgatgagttaaagacaacatggaggttagcttacagagttgtatctctcctattaatggtgagtgctttga

SEQ ID NO: 19385 - DNA, 75 bp, Artificial Sequence
  Synthetic
gaggttagcttacagagttgtatctctcctattaatggtgagtgctttgataatttctatagtaatcttgacgag

SEQ ID NO: 19386 - DNA, 75 bp, Artificial Sequence
  Synthetic
gaccgagagagaaattaaagtgtacacgaactccataaccggaagtattgctgtgagattaattcccaacttacc

SEQ ID NO: 19387 - DNA, 75 bp, Artificial Sequence
  Synthetic
actcaaagtggcaaacagggatagaggggaaaatcacctctatcatgactgatacgcttgatactaggaatgcag

SEQ ID NO: 19388 - DNA, 75 bp, Artificial Sequence
  Synthetic
ggggaaaatcacctctatcatgactgatacgcttgatactaggaatgcagctctcctccacattccactccaact

SEQ ID NO: 19389 - DNA, 75 bp, Artificial Sequence
  Synthetic
tctgattggagcaattataggcacagcagcactggggttggcaacagcagctcaggttacagctgcccttgccct

SEQ ID NO: 19390 - DNA, 75 bp, Artificial Sequence
  Synthetic
tcggccccggggatctagagcattgccgttatccagttcatgattctgcttacctgcatggagtcaaccgattac

SEQ ID NO: 19391 - DNA, 75 bp, Artificial Sequence
  Synthetic
ccgttatccagttcatgattctgcttacctgcatggagtcaaccgattacttatcaatcaaacggctgattatac

SEQ ID NO: 19392 - DNA, 75 bp, Artificial Sequence
  Synthetic
accggcgattaataatctgacatgtgaagtagcaggtgctaaagtaggtgtggaactgtcattatacttgaccga

SEQ ID NO: 19393 - DNA, 75 bp, Artificial Sequence
  Synthetic
ccactggatgcactaggataccatctttttccgtgtcctcatccatttggtgttatactcacaatgtgattgaaa

SEQ ID NO: 19394 - DNA, 75 bp, Artificial Sequence
  Synthetic
tttttccgtgtcctcatccatttggtgttatactcacaatgtgattgaaactggttttaatgatcactcaggcag

SEQ ID NO: 19395 - DNA, 75 bp, Artificial Sequence
  Synthetic
cttatttctcaaccgttgtgagtaagtatctgaccgacggattgaataggaaaagttgttctgtggctgctgggt

SEQ ID NO: 19396 - DNA, 75 bp, Artificial Sequence
  Synthetic
gtatctgaccgacggattgaataggaaaagttgttctgtggctgctgggtctgggcattgctatcttctctgcag

SEQ ID NO: 19397 - DNA, 75 bp, Artificial Sequence
  Synthetic
cgatgaggttaggggttctgacatgggatgggtcctatactgaacaggtggtgcctgaaaggatattcaaaaaca

SEQ ID NO: 19398 - DNA, 75 bp, Artificial Sequence
  Synthetic
ggatgggtcctatactgaacaggtggtgcctgaaaggatattcaaaaacatatggagtgcaaattaccctggggt

SEQ ID NO: 19399 - DNA, 75 bp, Artificial Sequence
  Synthetic
gagtgaggaatgggtcgacacctgaggttatgaataggggaaggtattactacattcaagatcctaatgattatt

SEQ ID NO: 19400 - DNA, 75 bp, Artificial Sequence
  Synthetic
ggttatgaataggggaaggtattactacattcaagatcctaatgattattgtcctgatccactgcaagaccaaat

SEQ ID NO: 19401 - DNA, 75 bp, Artificial Sequence
  Synthetic
tgatgcagggtgtcttagcgtgcccagtgtccaacaactcaacaattgccagccaatgccagtcctactatttca

SEQ ID NO: 19402 - DNA, 75 bp, Artificial Sequence
  Synthetic
ctctacagatcgaagctcaagttagtgggtcgtattccaggaatataacagtcgggaacagccaaattgccccat

SEQ ID NO: 19403 - DNA, 75 bp, Artificial Sequence
  Synthetic
agtgtccaacaactcaacaattgccagccaatgccagtcctactatttcaacaactcattagggttcattggggc

SEQ ID NO: 19404 - DNA, 75 bp, Artificial Sequence
  Synthetic
tctaatgtcgaagatctcattgaccagagcaatcagctcttaaatagggtgaatccaaacatagtaaacaacacc

SEQ ID NO: 19405 - DNA, 75 bp, Artificial Sequence
  Synthetic
gctcgagctggtggccccacccccagatttatctgcttgaccccagaattgcaagcccgggcactcagaacatcg

SEQ ID NO: 19406 - DNA, 75 bp, Artificial Sequence
  Synthetic
gatttatctgcttgaccccagaattgcaagcccgggcactcagaacatcgactcaggcattaatctcaagatgtt

SEQ ID NO: 19407 - DNA, 75 bp, Artificial Sequence
  Synthetic
taaagacagttccgaatccgtatgtaatgcaagcaaagtcgccgggaagtgccacacagttctaacaatatagct

SEQ ID NO: 19408 - DNA, 75 bp, Artificial Sequence
  Synthetic
caagatgccctaatgactgcttattcggggtctattcagacgtctggcctcttagcctaacctcagatagtatat

SEQ ID NO: 19409 - DNA, 75 bp, Artificial Sequence
  Synthetic
cggggtctattcagacgtctggcctcttagcctaacctcagatagtatattcgcattcacgatgtatttacaagg

SEQ ID NO: 19410 - DNA, 75 bp, Artificial Sequence
  Synthetic
gggatgacattgatgagaccccttattctctctcaaactaagacagtaatccatctagaatgcaatgatcctact

SEQ ID NO: 19411 - DNA, 75 bp, Artificial Sequence
  Synthetic
ttgggcatgaagctcgtctattcaacaaggaggtcagtgctgcttactccactaccacttgcttttcggacacca

SEQ ID NO: 19412 - DNA, 75 bp, Artificial Sequence
  Synthetic
caaggaggtcagtgctgcttactccactaccacttgcttttcggacaccatccaaaaccaggtgtattgcctgag

SEQ ID NO: 19413 - DNA, 75 bp, Artificial Sequence
  Synthetic
tacccagaaagaaacgcctgaggggggaaggaggttgactgcaacctcaattgatcagaggttgtagtattaatt

SEQ ID NO: 19414 - DNA, 75 bp, Artificial Sequence
  Synthetic
ggaaggaggttgactgcaacctcaattgatcagaggttgtagtattaattctccataaccctcaagatgagacca

SEQ ID NO: 19415 - DNA, 75 bp, Artificial Sequence
  Synthetic
tcctctaccgtgtcctataggtgcctgctcgatcgagaactccaaataatcgtggaattagtacttaatcttccc

SEQ ID NO: 19416 - DNA, 75 bp, Artificial Sequence
  Synthetic
tgctcgatcgagaactccaaataatcgtggaattagtacttaatcttccctatggatatctgccttaattactgt

SEQ ID NO: 19417 - DNA, 75 bp, Artificial Sequence
  Synthetic
aaaaatagaagattagacctggactcggggagggagaagaacctattagggtggggaaggattactttactccat

SEQ ID NO: 19418 - DNA, 75 bp, Artificial Sequence
  Synthetic
cggggagggagaagaacctattagggtggggaaggattactttactccatgactcacaatcgcacacacctgacc

SEQ ID NO: 19419 - DNA, 75 bp, Artificial Sequence
  Synthetic
ttgctcaataagtgggtgcgttcttagcctggttgcattatatccaagcaagaacattaatggcactaacactca

SEQ ID NO: 19420 - DNA, 75 bp, Artificial Sequence
  Synthetic
tcaagcagctgagattatactccctacctttcacctagagtcacccttaatcgagaacaaatgcttctactatat

SEQ ID NO: 19421 - DNA, 75 bp, Artificial Sequence
  Synthetic
acacaatcaataggccagcgacccctcccccaccgtattatgtagcaatacaactcagcgctgagatgcaacctg

SEQ ID NO: 19422 - DNA, 75 bp, Artificial Sequence
  Synthetic
acctttcacctagagtcacccttaatcgagaacaaatgcttctactatatgcaattacttggtcttatgttgccg

SEQ ID NO: 19423 - DNA, 75 bp, Artificial Sequence
  Synthetic
acaccttagaaaccgtaatcctcgcttgatggcccacatcgaccacactaaggataaactaagggctcatggtgt

SEQ ID NO: 19424 - DNA, 75 bp, Artificial Sequence
  Synthetic
accaagatctgttcttgtaccacttttttgatttaagaaaaaattgtgatttatataaaaacataatggctgagg

SEQ ID NO: 19425 - DNA, 75 bp, Artificial Sequence
  Synthetic
ttttgatttaagaaaaaattgtgatttatataaaaacataatggctgagggggaagcctggtgtcaccgctggtg

SEQ ID NO: 19426 - DNA, 75 bp, Artificial Sequence
  Synthetic
ttgatggcccacatcgaccacactaaggataaactaagggctcatggtgtcttaggtttccatcagacccaaaca

SEQ ID NO: 19427 - DNA, 75 bp, Artificial Sequence
  Synthetic
atcagcaatgggaggatgcataaaccaagtccccaaagcatggcggaacactctgaagtccatcgagcacagtgt

SEQ ID NO: 19428 - DNA, 75 bp, Artificial Sequence
  Synthetic
caagtccccaaagcatggcggaacactctgaagtccatcgagcacagtgtgaagcaggaggcaacacaactacaa

SEQ ID NO: 19429 - DNA, 75 bp, Artificial Sequence
  Synthetic
ttccaactgtaatcccgggaaaaccacaacaggcactatgcctgtattaagcgagatggcatcagagctcctatc

SEQ ID NO: 19430 - DNA, 75 bp, Artificial Sequence
  Synthetic
acaacaggcactatgcctgtattaagcgagatggcatcagagctcctatcaaatcccatctcccaattccaatca

SEQ ID NO: 19431 - DNA, 75 bp, Artificial Sequence
  Synthetic
gcttcaacagtatcaaagaaggacaggtaaagaggagaaggcgatcactgaggttcattttggttcagacacctg

SEQ ID NO: 19432 - DNA, 75 bp, Artificial Sequence
  Synthetic
ggtaaagaggagaaggcgatcactgaggttcattttggttcagacacctgtctcattaatgcagactacaccgtt

SEQ ID NO: 19433 - DNA, 75 bp, Artificial Sequence
  Synthetic
cctcatgatgcaagacctgctcgaatctcgacgaaatgtcctgttctgtgcccgctttatgtaccccagaagcca

SEQ ID NO: 19434 - DNA, 75 bp, Artificial Sequence
  Synthetic
agatgatggaaggaacaggaaaagttgtagcatcatagcaaaccctaatgggtgtgatgtcttgtgcagcttggt

SEQ ID NO: 19435 - DNA, 75 bp, Artificial Sequence
  Synthetic
tctcgacgaaatgtcctgttctgtgcccgctttatgtaccccagaagccaattgcatgagaggataagcatgata

SEQ ID NO: 19436 - DNA, 75 bp, Artificial Sequence
  Synthetic
tccacggtaggctccacttcaatggcacgtacaccgagtctgaactcaaccctggcctatttaataatcattggg

SEQ ID NO: 19437 - DNA, 75 bp, Artificial Sequence
  Synthetic
ctttgttgcaacccttgaatcatttgcatacgcagctgtccaacttcatgacaataaccctatctacggtgggac

SEQ ID NO: 19438 - DNA, 75 bp, Artificial Sequence
  Synthetic
cacgtacaccgagtctgaactcaaccctggcctatttaataatcattgggtcgctcaatatccagcagttggcag

SEQ ID NO: 19439 - DNA, 75 bp, Artificial Sequence
  Synthetic
gcatacgcagctgtccaacttcatgacaataaccctatctacggtgggactttctttgaattcaatatccaagaa

SEQ ID NO: 19440 - DNA, 75 bp, Artificial Sequence
  Synthetic
cattagtcaggttgtctcagcatacagtaacctccccccatctgaatcggcagaattgctatgcctgttacgcct

SEQ ID NO: 19441 - DNA, 75 bp, Artificial Sequence
  Synthetic
acctgacagagagacaaaaagaagatctatataacgcatataggcctgggaaaatagcaggatctctctgggctc

SEQ ID NO: 19442 - DNA, 75 bp, Artificial Sequence
  Synthetic
agtaacctccccccatctgaatcggcagaattgctatgcctgttacgcctatggggtcaccctttactaaatagc

SEQ ID NO: 19443 - DNA, 75 bp, Artificial Sequence
  Synthetic
tgactacaatgccattcgattagtcttgtctttttaccatacattattgatcaatggatatcggaagaaacacaa

SEQ ID NO: 19444 - DNA, 75 bp, Artificial Sequence
  Synthetic
tgtgcaagataggattgtcttctaccaaagatcctcatcatggtggccagtcctaatatattatgatatccctat

SEQ ID NO: 19445 - DNA, 75 bp, Artificial Sequence
  Synthetic
caaagatcctcatcatggtggccagtcctaatatattatgatatccctattagtgaccttatcagtgccgatcat

SEQ ID NO: 19446 - DNA, 75 bp, Artificial Sequence
  Synthetic
ttgtctttttaccatacattattgatcaatggatatcggaagaaacacaagggacgctggccaaatgtgaatcaa

SEQ ID NO: 19447 - DNA, 75 bp, Artificial Sequence
  Synthetic
gatcccacattctgtcgccctcgaacattacttagacatctcaatgatagaatttgagaaaacttttgaggttga

SEQ ID NO: 19448 - DNA, 75 bp, Artificial Sequence
  Synthetic
cattacttagacatctcaatgatagaatttgagaaaacttttgaggttgaactatctgacagcctaagcatcttt

SEQ ID NO: 19449 - DNA, 75 bp, Artificial Sequence
  Synthetic
tgtttcagaagtgaccccaaagcacttgcggatgtctcgtcatgaccgcaagtccaccaacaggctcctgctggc

SEQ ID NO: 19450 - DNA, 75 bp, Artificial Sequence
  Synthetic
ttgcggatgtctcgtcatgaccgcaagtccaccaacaggctcctgctggcctttatcaactcccctgaattcgat

SEQ ID NO: 19451 - DNA, 75 bp, Artificial Sequence
  Synthetic
ttcagaaacacgaagcaggatagagtgttctgcctgactataatggaagttacagacaacctactcggagactgg

SEQ ID NO: 19452 - DNA, 75 bp, Artificial Sequence
  Synthetic
aaatttcaacgtttcttactcacttaaagagaaggaagtaaagaaagaaggacgaatctttgcaaaaatgtcaca

SEQ ID NO: 19453 - DNA, 75 bp, Artificial Sequence
  Synthetic
tgttctgcctgactataatggaagttacagacaacctactcggagactggaggatcgccccgctgttatatgagg

SEQ ID NO: 19454 - DNA, 75 bp, Artificial Sequence
  Synthetic
aaagagaaggaagtaaagaaagaaggacgaatctttgcaaaaatgtcacaaaagatgagagcgtgccaggttatt

SEQ ID NO: 19455 - DNA, 75 bp, Artificial Sequence
  Synthetic
aggatggggacggataagttccaatattatacaccaggtgataaatatactcctcagcattgatgactcactgca

SEQ ID NO: 19456 - DNA, 75 bp, Artificial Sequence
  Synthetic
tgtcacacagtcggaactatctctgacaaaaaatctgctagctatcagtcagttgagttataactcaatggctgc

SEQ ID NO: 19457 - DNA, 75 bp, Artificial Sequence
  Synthetic
acaaaaaatctgctagctatcagtcagttgagttataactcaatggctgctaaggtgcggttgctgagaccaggg

SEQ ID NO: 19458 - DNA, 75 bp, Artificial Sequence
  Synthetic
gcttgtacataacaattctcttgcttcctctatttgcagagtaaatcagaagaatgacggtcggtgattgaccga

SEQ ID NO: 19459 - DNA, 75 bp, Artificial Sequence
  Synthetic
tcctctatttgcagagtaaatcagaagaatgacggtcggtgattgaccgaacttaattagatggtgacatacagc

SEQ ID NO: 19460 - DNA, 75 bp, Artificial Sequence
  Synthetic
ccttaattggcgtcaccagtcagtcaaactgtttgccagaagcctagatcgactgttcgggctagatcatgcttt

SEQ ID NO: 19461 - DNA, 75 bp, Artificial Sequence
  Synthetic
aaactgtttgccagaagcctagatcgactgttcgggctagatcatgctttttcttggatacatgtccgcctcacc

SEQ ID NO: 19462 - DNA, 75 bp, Artificial Sequence
  Synthetic
agactgacggggcaagacccgcggagacaaagaatgcagtgagggggaaggcaggctgggatcacgtcccagctg

SEQ ID NO: 19463 - DNA, 75 bp, Artificial Sequence
  Synthetic
atgcccaaacttagacgacaacaaaaacacgggaattttcatcataagtgcacgaggtgggatagaaggcctcca

SEQ ID NO: 19464 - DNA, 75 bp, Artificial Sequence
  Synthetic
cagaggtcatctgaaagggttgttgtgatggatccacaagtccaaatacaccacatcatcaagccagagtgccat

SEQ ID NO: 19465 - DNA, 75 bp, Artificial Sequence
  Synthetic
aacacgggaattttcatcataagtgcacgaggtgggatagaaggcctccaacaaaaactgtggaccggcatatca

SEQ ID NO: 19466 - DNA, 75 bp, Artificial Sequence
  Synthetic
tactttgcagggggacaaccaggttctagcgatcacgaaggaatttgtaaccccagtcccggaaggtgtcctcca

SEQ ID NO: 19467 - DNA, 75 bp, Artificial Sequence
  Synthetic
ctagcgatcacgaaggaatttgtaaccccagtcccggaaggtgtcctccatgagcaattatctgaggcgatgtcc

SEQ ID NO: 19468 - DNA, 75 bp, Artificial Sequence
  Synthetic
tgacgtgggatgaagtgctccggttggaggctaatttgacaaaggaattacggcaattggtgcgaggcctgacca

SEQ ID NO: 19469 - DNA, 75 bp, Artificial Sequence
  Synthetic
gaaagataaagagacaatccaatccagtgatttctttgtttactctaaaaggatattctttaatgggtccattct

SEQ ID NO: 19470 - DNA, 75 bp, Artificial Sequence
  Synthetic
tattgactcatataaacctttatgccatccacgtacgttaagttggttgactaatatcagcttgattaagagtga

SEQ ID NO: 19471 - DNA, 75 bp, Artificial Sequence
  Synthetic
agtgatttctttgtttactctaaaaggatattctttaatgggtccattctgagtcaatgtctcaaaaacttcagt

SEQ ID NO: 19472 - DNA, 75 bp, Artificial Sequence
  Synthetic
cagtgacatctcatcatgcatcgctcgttgtgtagaaaacgggttgccaaaggatgctgcatacatccagaacat

SEQ ID NO: 19473 - DNA, 75 bp, Artificial Sequence
  Synthetic
cgttgtgtagaaaacgggttgccaaaggatgctgcatacatccagaacatagtcatgactcgacttcaactgttg

SEQ ID NO: 19474 - DNA, 75 bp, Artificial Sequence
  Synthetic
gccgaccctaagtatttctgttcggaatgcaacctatttaccatctcagttgggcggttacaatcatctaaatat

SEQ ID NO: 19475 - DNA, 75 bp, Artificial Sequence
  Synthetic
gataattactggaattagagacaggacattcacctgtttgacttttgatatggtgctaatgtacgcagatgtggt

SEQ ID NO: 19476 - DNA, 75 bp, Artificial Sequence
  Synthetic
aatgcaacctatttaccatctcagttgggcggttacaatcatctaaatatgacccgactattttgccgcaacatc

SEQ ID NO: 19477 - DNA, 75 bp, Artificial Sequence
  Synthetic
tggcctgctcaatcgtaaattcctggagggaatattgtggcgacctccgggaagtgggacattctcaacacttat

SEQ ID NO: 19478 - DNA, 75 bp, Artificial Sequence
  Synthetic
acaatattgttgcatctctggagagcttggcatatggtgctgttcaactgtgggataaatcactggaacatgctg

SEQ ID NO: 19479 - DNA, 75 bp, Artificial Sequence
  Synthetic
gagggaatattgtggcgacctccgggaagtgggacattctcaacacttatgcttgacccgtttgcgctgaacatt

SEQ ID NO: 19480 - DNA, 75 bp, Artificial Sequence
  Synthetic
catttagatcctggtatggcatttagagtagttgagcaggtgcggttgctatatactggactgagtgtgaaccaa

SEQ ID NO: 19481 - DNA, 75 bp, Artificial Sequence
  Synthetic
cttgctgcaagattgccctaatcccctattagccggtgtggttgatccgaactacaaccaggaactggaactatt

SEQ ID NO: 19482 - DNA, 75 bp, Artificial Sequence
  Synthetic
ctattagccggtgtggttgatccgaactacaaccaggaactggaactattagcgcagttcttgctcgaccgagag

SEQ ID NO: 19483 - DNA, 75 bp, Artificial Sequence
  Synthetic
gaggaaaaaacatatacaagggttggtggacactacaaaaacgattatccagtgttcgctggaaagacaaccatt

SEQ ID NO: 19484 - DNA, 75 bp, Artificial Sequence
  Synthetic
gagggcccttctaaccggcttctgcttgattttttgcaatcaagcgaatttgacccggctaaggagttcgagtac

SEQ ID NO: 19485 - DNA, 75 bp, Artificial Sequence
  Synthetic
gtggacactacaaaaacgattatccagtgttcgctggaaagacaaccattgtcctggaggaaagttgagaacatt

SEQ ID NO: 19486 - DNA, 75 bp, Artificial Sequence
  Synthetic
cttaaaggaaagggaagtcaagactgatgggcgcatatttgcaaaaatgactagaaaaatgaggaactgtcaagt

SEQ ID NO: 19487 - DNA, 75 bp, Artificial Sequence
  Synthetic
agattcccctgaaaagcagtgggtgatgccaagcaacttcaagaagctcgtgtctcttgacgattgttcagtcac

SEQ ID NO: 19488 - DNA, 75 bp, Artificial Sequence
  Synthetic
gatgggcgcatatttgcaaaaatgactagaaaaatgaggaactgtcaagtcttgctagagagtttgctcgcatgc

SEQ ID NO: 19489 - DNA, 75 bp, Artificial Sequence
  Synthetic
ctagaaaaatgaggaactgtcaagtcttgctagagagtttgctcgcatgccacatatgcgattatttcaaagaga

SEQ ID NO: 19490 - DNA, 75 bp, Artificial Sequence
  Synthetic
atgccaagcaacttcaagaagctcgtgtctcttgacgattgttcagtcacattgtctactgtttcccggcgtata

SEQ ID NO: 19491 - DNA, 75 bp, Artificial Sequence
  Synthetic
agatgtgatagaaagtattgatgggcgccttgtgcaatcatccaatcagtgtggcctatgtaatcaaggattaag

SEQ ID NO: 19492 - DNA, 75 bp, Artificial Sequence
  Synthetic
cgccttgtgcaatcatccaatcagtgtggcctatgtaatcaaggattaagttcctactcctggttcttcctcccc

SEQ ID NO: 19493 - DNA, 75 bp, Artificial Sequence
  Synthetic
gctacacctgggcaggacacaagcccaggcgagggggtcaggcgacggaaaacgattatagcatcattcttgact

SEQ ID NO: 19494 - DNA, 75 bp, Artificial Sequence
  Synthetic
gccgtatgtgggatccaagacagatgagaggcagactgcgtcggtacaagctatacagggatccacatgtcacct

SEQ ID NO: 19495 - DNA, 75 bp, Artificial Sequence
  Synthetic
gagaggcagactgcgtcggtacaagctatacagggatccacatgtcaccttagagcagcattgagacttgtatca

SEQ ID NO: 19496 - DNA, 75 bp, Artificial Sequence
  Synthetic
ttttgcacagaggcttaaccagttatttgggataccccacggctttgagtggattcacctccgcttgatgaatac

SEQ ID NO: 19497 - DNA, 75 bp, Artificial Sequence
  Synthetic
ggattcacctccgcttgatgaatacgaccatgtttgtaggagacccacataatgtccctcagttttcatcaacac

SEQ ID NO: 19498 - DNA, 75 bp, Artificial Sequence
  Synthetic
gacactagcccaaacacggtgcaatatttcccttgatgatctgcgaatcctgagccctctaccttcctcggcaaa

SEQ ID NO: 19499 - DNA, 75 bp, Artificial Sequence
  Synthetic
atttcccttgatgatctgcgaatcctgagccctctaccttcctcggcaaatttacaccacagattaaatgacggg

SEQ ID NO: 19500 - DNA, 75 bp, Artificial Sequence
  Synthetic
ggcaattcatctagcagccacagaatcaggttgtcgggttgcatctatggtccaaggggacaatcaagcaattgc

SEQ ID NO: 19501 - DNA, 75 bp, Artificial Sequence
  Synthetic
tgtccagatttgcaatgacaaccagaatcttatccgtgatgatgggagtgtggattccaatatgatttatcagca

SEQ ID NO: 19502 - DNA, 75 bp, Artificial Sequence
  Synthetic
aatcttatccgtgatgatgggagtgtggattccaatatgatttatcagcaagtcatgatattaggacttggggaa

SEQ ID NO: 19503 - DNA, 75 bp, Artificial Sequence
  Synthetic
tcttcatctacactctgacaattcttgctgcctccgggagatgccaacaaccggctttgtgcctgctttgggatt

SEQ ID NO: 19504 - DNA, 75 bp, Artificial Sequence
  Synthetic
tgctgcctccgggagatgccaacaaccggctttgtgcctgctttgggattaaccccatgcttaactgtaccaaag

SEQ ID NO: 19505 - DNA, 75 bp, Artificial Sequence
  Synthetic
agtgttggtatccgagaccgtgggtgagaattgtgtcggcaattgctcaaatatcagttccacagttgctaggct

SEQ ID NO: 19506 - DNA, 75 bp, Artificial Sequence
  Synthetic
acggctcatccaaacaaagtttttcatgggttctgataatctagacaaccttgatatctatcagcaacgagcgtt

SEQ ID NO: 19507 - DNA, 75 bp, Artificial Sequence
  Synthetic
atgggttctgataatctagacaaccttgatatctatcagcaacgagcgttactaagtcggtgtgtggcttatgat

SEQ ID NO: 19508 - DNA, 75 bp, Artificial Sequence
  Synthetic
tgcaatcctccatactgactatcatgagaattggatctcagagttccgatggggtgaccctcggataattcaagt

SEQ ID NO: 19509 - DNA, 75 bp, Artificial Sequence
  Synthetic
ccatctcaaggcttgattcatgctattcgccaagatccaaacaacataaaaaacatctctatcactcctgctcaa

SEQ ID NO: 19510 - DNA, 75 bp, Artificial Sequence
  Synthetic
gagaattggatctcagagttccgatggggtgaccctcggataattcaagtgacagcaggttatgaattgatcttg

SEQ ID NO: 19511 - DNA, 75 bp, Artificial Sequence
  Synthetic
cctgtgctatattgataggatactgaataggatggtgtcatcaaatctaggcagccttatccagacactctccca

SEQ ID NO: 19512 - DNA, 75 bp, Artificial Sequence
  Synthetic
tcggattattatcccctcatctgctaaggaatgcaatttttagggaacccggagatggaacgtggacaacactgt

SEQ ID NO: 19513 - DNA, 75 bp, Artificial Sequence
  Synthetic
aataggatggtgtcatcaaatctaggcagccttatccagacactctcccatccggagattaggaggaggttttca

SEQ ID NO: 19514 - DNA, 75 bp, Artificial Sequence
  Synthetic
tttggtaaaacaagcagtcatgttcctaagggactcagtccgatgtgctttagcaactatcaaggcaggagtcga

SEQ ID NO: 19515 - DNA, 75 bp, Artificial Sequence
  Synthetic
ctaagggactcagtccgatgtgctttagcaactatcaaggcaggagtcgagccggagatctcccgaggtggctgt

SEQ ID NO: 19516 - DNA, 75 bp, Artificial Sequence
  Synthetic
ctgtataattgctctcatgcattcagaagcaaagaacttggtcaaggtcagaaatctcccagtagaggaaaaatc

SEQ ID NO: 19517 - DNA, 75 bp, Artificial Sequence
  Synthetic
aaatatgcccttcatcaccaccctatttctttcaagaaaagcatgctgatatcatcttactcagctgactacatt

SEQ ID NO: 19518 - DNA, 75 bp, Artificial Sequence
  Synthetic
gaagcaaagaacttggtcaaggtcagaaatctcccagtagaggaaaaatctgctttactataccagatgttggtc

SEQ ID NO: 19519 - DNA, 75 bp, Artificial Sequence
  Synthetic
catgaagctctggaacagaggactaataggtgtcgacacctgcgcggtcacacttgcggattacgcaagaacata

SEQ ID NO: 19520 - DNA, 75 bp, Artificial Sequence
  Synthetic
aatttcggcacctcagtgggatatccataccccagcactgtactttgtatcaaagaagatgctaggaatgctcaa

SEQ ID NO: 19521 - DNA, 75 bp, Artificial Sequence
  Synthetic
cataccccagcactgtactttgtatcaaagaagatgctaggaatgctcaaaaggtcaactacaccattggatgta

SEQ ID NO: 19522 - DNA, 75 bp, Artificial Sequence
  Synthetic
tcctggtcacatggcagagggatttccctgtctatttagtagttttaacgctacatatgaagacacaattgttta

SEQ ID NO: 19523 - DNA, 75 bp, Artificial Sequence
  Synthetic
ccctgtctatttagtagttttaacgctacatatgaagacacaattgtttataatccgatgactgaaaagcctgca

SEQ ID NO: 19524 - DNA, 75 bp, Artificial Sequence
  Synthetic
catcttgcggcccctcgggctttactcgtctgcatggtaccggtctgcagcactcttagcatcaggtgctctcaa

SEQ ID NO: 19525 - DNA, 75 bp, Artificial Sequence
  Synthetic
tcgtctgcatggtaccggtctgcagcactcttagcatcaggtgctctcaatgggttaccggagggatcaagccta

SEQ ID NO: 19526 - DNA, 75 bp, Artificial Sequence
  Synthetic
atattcatatttcaaatgaccggcatcagagtagaattgacggtcaagtgatcgaatcaaatgtgattttccaac

SEQ ID NO: 19527 - DNA, 75 bp, Artificial Sequence
  Synthetic
caagtcctcaactgtttattaccacacattgtttgacccgacccggaatccctcacagcggaattacaaaccaga

SEQ ID NO: 19528 - DNA, 75 bp, Artificial Sequence
  Synthetic
acattgtttgacccgacccggaatccctcacagcggaattacaaaccagagccgcgagtcttcactgattccatc

SEQ ID NO: 19529 - DNA, 75 bp, Artificial Sequence
  Synthetic
gggtgaagatgtgcgtcagagtgacgtcacacagaaagacacagttaatttcatattatcccggatcccacccaa

SEQ ID NO: 19530 - DNA, 75 bp, Artificial Sequence
  Synthetic
gtcacacagaaagacacagttaatttcatattatcccggatcccacccaaatcactcaaactgatccatgttgac

SEQ ID NO: 19531 - DNA, 75 bp, Artificial Sequence
  Synthetic
ccattgcgcattattggcctactggctattgcaacctggagggcgatttgcggttagggtcttcctgagtgacca

SEQ ID NO: 19532 - DNA, 75 bp, Artificial Sequence
  Synthetic
ctattgcaacctggagggcgatttgcggttagggtcttcctgagtgaccatctcttagtaaacttggtcactgct

SEQ ID NO: 19533 - DNA, 75 bp, Artificial Sequence
  Synthetic
agcgcgtacaactcgatacacaatgatgctattgtatcattcgacaattccatcaactggatatctgagtacacg

SEQ ID NO: 19534 - DNA, 75 bp, Artificial Sequence
  Synthetic
acacaaagatgatggggcaggttacatttgtgctaagaagcttgccaatgttgaggcatcaaggattgagcacta

SEQ ID NO: 19535 - DNA, 75 bp, Artificial Sequence
  Synthetic
atttgtgctaagaagcttgccaatgttgaggcatcaaggattgagcactacttaaggatggtccatggttgcgtt

SEQ ID NO: 19536 - DNA, 75 bp, Artificial Sequence
  Synthetic
tgaggtgtctcggctcacaaaaaaggcagatgaagaaataaattggcgattaggtgacccggttactagatcatt

SEQ ID NO: 19537 - DNA, 75 bp, Artificial Sequence
  Synthetic
gcagatgaagaaataaattggcgattaggtgacccggttactagatcatttgatccagtttccgagttaataatc

SEQ ID NO: 19538 - DNA, 75 bp, Artificial Sequence
  Synthetic
aattagaaatcatagtcccaaattataaggatgatgacttgaacaggaaagttgaacatatattagcaagacggg

SEQ ID NO: 19539 - DNA, 75 bp, Artificial Sequence
  Synthetic
caggtgttcaaacctggcagatacatataaacttttggcttcaatcgtggagaccaccttgatggagataagggt

SEQ ID NO: 19540 - DNA, 75 bp, Artificial Sequence
  Synthetic
tataaacttttggcttcaatcgtggagaccaccttgatggagataagggttgaacaagatcaattggaagacaac

SEQ ID NO: 19541 - DNA, 75 bp, Artificial Sequence
  Synthetic
actcgggaatgtttttcagggatatctcagatatttgattcacccaagttaaatccattcatcactaatctttac

SEQ ID NO: 19542 - DNA, 75 bp, Artificial Sequence
  Synthetic
gaggatccgtacattgattgagtgtgcccagctgcaggttatagatgtcatatgtgtaaacatagatcacctctt

SEQ ID NO: 19543 - DNA, 75 bp, Artificial Sequence
  Synthetic
gcccagctgcaggttatagatgtcatatgtgtaaacatagatcacctcttccccaaacatcgacatgttcttgtt

SEQ ID NO: 19544 - DNA, 75 bp, Artificial Sequence
  Synthetic
ggatgatcaaatgatcactgggcctctgcgctttgaccttgaactaaaagaactcaccccagattttactatcac

SEQ ID NO: 19545 - DNA, 75 bp, Artificial Sequence
  Synthetic
ccaaattaagatgtatctaagggccaggaagtggatccaacgtagaggactcaatgagacaattaaccatatcat

SEQ ID NO: 19546 - DNA, 75 bp, Artificial Sequence
  Synthetic
aggaagtggatccaacgtagaggactcaatgagacaattaaccatatcatcactggacagatatcacgaaataag

SEQ ID NO: 19547 - DNA, 75 bp, Artificial Sequence
  Synthetic
cggcggttggagttacctctcactttagttacttaggttgttgatcattgtgaaaaatcggagtcggaatcgcaa

SEQ ID NO: 19548 - DNA, 75 bp, Artificial Sequence
  Synthetic
tgaaaaatcggagtcggaatcgcaaataaaaacatacaaaattgcaaatttacaataatcgcattaatatttaat

SEQ ID NO: 19549 - DNA, 75 bp, Artificial Sequence
  Synthetic
actacatgcatcatgtgcagagatgataagtagaatgtttgtagaagttatatctaagcttgataaactcgagtc

SEQ ID NO: 19550 - DNA, 75 bp, Artificial Sequence
  Synthetic
ccatgagatgtgtgaattttatcatgtcgaaagttgaacagcactcgtgtcatattgtatgctgtgatttagaat

SEQ ID NO: 19551 - DNA, 75 bp, Artificial Sequence
  Synthetic
caaccttatcatacctacatcagataaggagtatgcaggaggaattggaaaccctgtatttactgtcgatgctgg

SEQ ID NO: 19552 - DNA, 75 bp, Artificial Sequence
  Synthetic
tcggtccttggcaaacggaaacaaatccaaggcttaattgatacaactccaactatcattagaacatctctagtt

SEQ ID NO: 19553 - DNA, 75 bp, Artificial Sequence
  Synthetic
ccacgaggacaggggttgctctgggttcaaatgtgtcccaggtactaggcagtgtgactgagatggtacggaaag

SEQ ID NO: 19554 - DNA, 75 bp, Artificial Sequence
  Synthetic
tcgatgacggaatcagcacgcagaaatttactcctgcaagccttgctcgaatcacatcctttgttcacatctgta

SEQ ID NO: 19555 - DNA, 75 bp, Artificial Sequence
  Synthetic
gatacaattagccaacattgcactcaccatttcacaccctgagatatttcgcagaattgtcaacaccgggatcca

SEQ ID NO: 19556 - DNA, 75 bp, Artificial Sequence
  Synthetic
aatttgaagtgcaatcatatttatgagaaaataattgctagaaaaattccattacaggtatcatcaactgattct

SEQ ID NO: 19557 - DNA, 75 bp, Artificial Sequence
  Synthetic
tcaactcggtgggctcaactgatcctagagaggttgcaacattatcttccattgagtgtatggactatgttgtct

SEQ ID NO: 19558 - DNA, 75 bp, Artificial Sequence
  Synthetic
ggcaaatattgtgatctcagagagtgctggtcttgacctcgctttaatgttaggcccattcaacttgaataagct

SEQ ID NO: 19559 - DNA, 75 bp, Artificial Sequence
  Synthetic
gattgtagcaaaacagcactcagagtaatctcttcaactttgcgccgcttgaatcctgaactgtggacgcgcacg

SEQ ID NO: 19560 - DNA, 75 bp, Artificial Sequence
  Synthetic
actaaacagaaagttaataagtgtttgtaacgtccgattaagtagccagattaataggagcggaagtcctaaatt

SEQ ID NO: 19561 - DNA, 75 bp, Artificial Sequence
  Synthetic
ttaataggagcggaagtcctaaattccgcgtccgactgcgaatttcaataactatggcaggtatcttcaatacat

SEQ ID NO: 19562 - DNA, 75 bp, Artificial Sequence
  Synthetic
ccgcgtccgactgcgaatttcaataactatggcaggtatcttcaatacatatgagttgttcgtcaaggaccaaac

SEQ ID NO: 19563 - DNA, 75 bp, Artificial Sequence
  Synthetic
gcaacatcccagtattcattaccaccagggatgacccggccgtgaggtggaatcttgtttgctttaatctaaggt

SEQ ID NO: 19564 - DNA, 75 bp, Artificial Sequence
  Synthetic
actaaacagaaaattaatacttgttagtagtcgccgattaatccgctaatatattaggagcggaagtcctacact

SEQ ID NO: 19565 - DNA, 75 bp, Artificial Sequence
  Synthetic
cagggatgacccggccgtgaggtggaatcttgtttgctttaatctaaggttaattgtcagtgagtcctcaacatc

SEQ ID NO: 19566 - DNA, 75 bp, Artificial Sequence
  Synthetic
atattaggagcggaagtcctacactccgcctccgaccacgaattgaaatcatcatggctggaatttttaatactt

SEQ ID NO: 19567 - DNA, 75 bp, Artificial Sequence
  Synthetic
ccgcctccgaccacgaattgaaatcatcatggctggaatttttaatacttatgagctctttgttaaggatcagac

SEQ ID NO: 19568 - DNA, 75 bp, Artificial Sequence
  Synthetic
acatgagggctttagcagcaatcgctggtcagacagatgagtcaatgattaatataattgaagttgttgatttca

SEQ ID NO: 19569 - DNA, 75 bp, Artificial Sequence
  Synthetic
tggtcagacagatgagtcaatgattaatataattgaagttgttgatttcaatgggttagagccacaatgtgatcc

SEQ ID NO: 19570 - DNA, 75 bp, Artificial Sequence
  Synthetic
gcaatataccagtcttcatcaccacaaaagatgatccagctgtccgatgggaccttgtatgttttaatctccgac

SEQ ID NO: 19571 - DNA, 75 bp, Artificial Sequence
  Synthetic
aaaagatgatccagctgtccgatgggaccttgtatgttttaatctccgacttgttgttagtgaatcatctacctc

SEQ ID NO: 19572 - DNA, 75 bp, Artificial Sequence
  Synthetic
gtgatatgccgaaggttctcggaagtggcacacctttccagaatgtaagtgcagagaccaacaatccagaggata

SEQ ID NO: 19573 - DNA, 75 bp, Artificial Sequence
  Synthetic
tggcacacctttccagaatgtaagtgcagagaccaacaatccagaggatacacacatgttcttacgctcagcaat

SEQ ID NO: 19574 - DNA, 75 bp, Artificial Sequence
  Synthetic
atatgagggctcttgcagcaattgctgggcagactgatgaatcgatgattaatattatagaagttgtggactttg

SEQ ID NO: 19575 - DNA, 75 bp, Artificial Sequence
  Synthetic
tgggcagactgatgaatcgatgattaatattatagaagttgtggactttgatggacttgagccccagtgtgacac

SEQ ID NO: 19576 - DNA, 75 bp, Artificial Sequence
  Synthetic
tcgaaggtagtcatgaggccagtgatagaaggcttgcgaaatacacccagcagaacagaattgaccggcgcttta

SEQ ID NO: 19577 - DNA, 75 bp, Artificial Sequence
  Synthetic
tagaaggcttgcgaaatacacccagcagaacagaattgaccggcgctttatgctggcccaagccactcggactgc

SEQ ID NO: 19578 - DNA, 75 bp, Artificial Sequence
  Synthetic
gtgatatgccgagggcactatccagcgggaccccgttccagcacggaaatgcggaagcgaatgggcctgaagaca

SEQ ID NO: 19579 - DNA, 75 bp, Artificial Sequence
  Synthetic
cgggaccccgttccagcacggaaatgcggaagcgaatgggcctgaagacacacacatgttcctccgatccgcaat

SEQ ID NO: 19580 - DNA, 75 bp, Artificial Sequence
  Synthetic
cggaacttcggaagtcgcgaggggctcttcatagtgggtcatcatattatgcaatggtaggagatatgcaagcat

SEQ ID NO: 19581 - DNA, 75 bp, Artificial Sequence
  Synthetic
tcttcatagtgggtcatcatattatgcaatggtaggagatatgcaagcatacatctttaatgctggacttactcc

SEQ ID NO: 19582 - DNA, 75 bp, Artificial Sequence
  Synthetic
ttgatggcagcaacgaggcaagcgatcgccgccttgccaagtatattcaacagaatagaattgacaggcgattca

SEQ ID NO: 19583 - DNA, 75 bp, Artificial Sequence
  Synthetic
tcgccgccttgccaagtatattcaacagaatagaattgacaggcgattcatgcttgctcaagctaccaggactgt

SEQ ID NO: 19584 - DNA, 75 bp, Artificial Sequence
  Synthetic
caatcagttctctgacgggagaccttaataagattaagggattgctaacactgtacaaggaaaaggggagtgacg

SEQ ID NO: 19585 - DNA, 75 bp, Artificial Sequence
  Synthetic
taataagattaagggattgctaacactgtacaaggaaaaggggagtgacgcagggtatatggcattattagagga

SEQ ID NO: 19586 - DNA, 75 bp, Artificial Sequence
  Synthetic
ctgagcttcgaaagtcgcggggggcattgcatagcgggtcatcttactatgctatgattggagacatgcaggcat

SEQ ID NO: 19587 - DNA, 75 bp, Artificial Sequence
  Synthetic
attgcatagcgggtcatcttactatgctatgattggagacatgcaggcatacatatttaatgcaggccttacacc

SEQ ID NO: 19588 - DNA, 75 bp, Artificial Sequence
  Synthetic
atgcaatgggagttgccagtgtccatgatgaaggcatgagaaactaccagtatgcaaggcggtttctgcacaaag

SEQ ID NO: 19589 - DNA, 75 bp, Artificial Sequence
  Synthetic
tgatgaaggcatgagaaactaccagtatgcaaggcggtttctgcacaaaggcatgtaccagtttggaagagacat

SEQ ID NO: 19590 - DNA, 75 bp, Artificial Sequence
  Synthetic
caattagctcacttgcaggtgacctgaataagattaaggggttactgactctatacaaagagaaagggagtgatg

SEQ ID NO: 19591 - DNA, 75 bp, Artificial Sequence
  Synthetic
gaataagattaaggggttactgactctatacaaagagaaagggagtgatgcgggctatatggcacttctagagga

SEQ ID NO: 19592 - DNA, 75 bp, Artificial Sequence
  Synthetic
gaatcaccgaggcggaccgggccaatctcaaagtaatgatggcaaatatcggtgaggcttcccattacagtgata

SEQ ID NO: 19593 - DNA, 75 bp, Artificial Sequence
  Synthetic
tctcaaagtaatgatggcaaatatcggtgaggcttcccattacagtgatattcccagtgcgggccccagtggcat

SEQ ID NO: 19594 - DNA, 75 bp, Artificial Sequence
  Synthetic
atgcgatgggagtagcaagtgtacatgatgaaggcatgaggaattaccaatacgcccggcgcttcctccataagg

SEQ ID NO: 19595 - DNA, 75 bp, Artificial Sequence
  Synthetic
tgatgaaggcatgaggaattaccaatacgcccggcgcttcctccataaggggatgtaccaatttggacgtgatat

SEQ ID NO: 19596 - DNA, 75 bp, Artificial Sequence
  Synthetic
ggaagttgcccgaagagcctcaagttgtagaactacaagaccgggatgacgatgagcaagatgaatatgatatgt

SEQ ID NO: 19597 - DNA, 75 bp, Artificial Sequence
  Synthetic
tgtagaactacaagaccgggatgacgatgagcaagatgaatatgatatgtaatccttcaggagaacacccccacc

SEQ ID NO: 19598 - DNA, 75 bp, Artificial Sequence
  Synthetic
gaatcacagaggctgacagggcaaatctcaaggtaatgatggcaaacattggggaagcatcaagcttcagtgata

SEQ ID NO: 19599 - DNA, 75 bp, Artificial Sequence
  Synthetic
tctcaaggtaatgatggcaaacattggggaagcatcaagcttcagtgatatgcctaatccaggagctagcggcat

SEQ ID NO: 19600 - DNA, 75 bp, Artificial Sequence
  Synthetic
accccacggccatcacccccccatcagcacccaatcccaagcgcagacaggccaccgcctccacccagaacccca

SEQ ID NO: 19601 - DNA, 75 bp, Artificial Sequence
  Synthetic
agcacccaatcccaagcgcagacaggccaccgcctccacccagaaccccaggacccaaatccccactatatcttt

SEQ ID NO: 19602 - DNA, 75 bp, Artificial Sequence
  Synthetic
gcaagccccctcaagatcagccgctgataaagctcccagatctcgaggaagaagagcaggacgaattcgacatgt

SEQ ID NO: 19603 - DNA, 75 bp, Artificial Sequence
  Synthetic
gataaagctcccagatctcgaggaagaagagcaggacgaattcgacatgtagagagccgcccaccacccagagcc

SEQ ID NO: 19604 - DNA, 75 bp, Artificial Sequence
  Synthetic
ggagaaaataggagcggaagtatccctcctaacaagatagacacaattatcatggatcttgaattcagcagtgag

SEQ ID NO: 19605 - DNA, 75 bp, Artificial Sequence
  Synthetic
ctcctaacaagatagacacaattatcatggatcttgaattcagcagtgaggaggcagttgcagctttgctcgacg

SEQ ID NO: 19606 - DNA, 75 bp, Artificial Sequence
  Synthetic
gcaacatcgaggaccccgggcagccgacaccgcagccgcaagacctccgcatcatgaacgaccagcatccaaaca

SEQ ID NO: 19607 - DNA, 75 bp, Artificial Sequence
  Synthetic
gacaccgcagccgcaagacctccgcatcatgaacgaccagcatccaaacatctgtcctccctattctatcagttt

SEQ ID NO: 19608 - DNA, 75 bp, Artificial Sequence
  Synthetic
ccgggattcctaaattcaccttcccagtcaagcagtccctcccctgaaccaagcacctctactaccggtgacttc

SEQ ID NO: 19609 - DNA, 75 bp, Artificial Sequence
  Synthetic
agtcaagcagtccctcccctgaaccaagcacctctactaccggtgacttcctctcacagctatcaggtgatatcc

SEQ ID NO: 19610 - DNA, 75 bp, Artificial Sequence
  Synthetic
gggggattcaacttaggagcggaagtatccctcctaacctgcacctgcatttcaatatggatcttgagtttagta

SEQ ID NO: 19611 - DNA, 75 bp, Artificial Sequence
  Synthetic
tatccctcctaacctgcacctgcatttcaatatggatcttgagtttagtagtgaggaagcagtcgcagccctctt

SEQ ID NO: 19612 - DNA, 75 bp, Artificial Sequence
  Synthetic
gacacctcgttggtacaacatattgaggagggactgccctcagacttctacatacccaaagtcaacaactatcat

SEQ ID NO: 19613 - DNA, 75 bp, Artificial Sequence
  Synthetic
aggagggactgccctcagacttctacatacccaaagtcaacaactatcattcgaacctttttaaagggggctcct

SEQ ID NO: 19614 - DNA, 75 bp, Artificial Sequence
  Synthetic
ctgaccctagctttctcacgtccacggaggcatccggtgagcaagttccagattcgaaggtcgccaatcacaaag

SEQ ID NO: 19615 - DNA, 75 bp, Artificial Sequence
  Synthetic
ggaggcatccggtgagcaagttccagattcgaaggtcgccaatcacaaagccagtgtcgataagaccccagatca

SEQ ID NO: 19616 - DNA, 75 bp, Artificial Sequence
  Synthetic
acgactacaccggagtccacaccggttatggcgaagaagaagaagaagcagaagcactgcaaagtgcccgcatct

SEQ ID NO: 19617 - DNA, 75 bp, Artificial Sequence
  Synthetic
ttatggcgaagaagaagaagaagcagaagcactgcaaagtgcccgcatcttcggcgtaccaacacatagacaatc

SEQ ID NO: 19618 - DNA, 75 bp, Artificial Sequence
  Synthetic
tcaatacaccatcttgcgaggacggtttaccccctaacttcttcatcccaagggtagagagttaccacactaacc

SEQ ID NO: 19619 - DNA, 75 bp, Artificial Sequence
  Synthetic
tttaccccctaacttcttcatcccaagggtagagagttaccacactaacctttttaaagggggcccccaattgga

SEQ ID NO: 19620 - DNA, 75 bp, Artificial Sequence
  Synthetic
tccaaaccgaaacatggtgtaaccccgcatgttccccagtcacagccctcccaaagcagtatagatgtgcttgcc

SEQ ID NO: 19621 - DNA, 75 bp, Artificial Sequence
  Synthetic
cgcatgttccccagtcacagccctcccaaagcagtatagatgtgcttgccgacaatgtcccaaattctgtgacct

SEQ ID NO: 19622 - DNA, 75 bp, Artificial Sequence
  Synthetic
cggacctctcccgagccgggatagcgagaaagaagaagaagcagaagcattgcaaagcgctcaacttttcggaat

SEQ ID NO: 19623 - DNA, 75 bp, Artificial Sequence
  Synthetic
gagaaagaagaagaagcagaagcattgcaaagcgctcaacttttcggaatccccactcacagacaatcaggccat

SEQ ID NO: 19624 - DNA, 75 bp, Artificial Sequence
  Synthetic
aagttatcggaccaagtctctcagatccagaaattggtgagcacacttccccaaattaagaccgacatagcatca

SEQ ID NO: 19625 - DNA, 75 bp, Artificial Sequence
  Synthetic
tccagaaattggtgagcacacttccccaaattaagaccgacatagcatcaatcaggaacatgcaggcggccctag

SEQ ID NO: 19626 - DNA, 75 bp, Artificial Sequence
  Synthetic
agagacctggtgcaacccagcctgctctccagtcaccgccttcccaaaacaatacaagtgtgcatgcagacagtg

SEQ ID NO: 19627 - DNA, 75 bp, Artificial Sequence
  Synthetic
tctccagtcaccgccttcccaaaacaatacaagtgtgcatgcagacagtgcccaagattctgcgatctctgtttc

SEQ ID NO: 19628 - DNA, 75 bp, Artificial Sequence
  Synthetic
tcatccctaaataccctccgcaactctggaaatcgggctccagtagtgatttgcggaccgggcgaccctcaccgc

SEQ ID NO: 19629 - DNA, 75 bp, Artificial Sequence
  Synthetic
ctggaaatcgggctccagtagtgatttgcggaccgggcgaccctcaccgcagtctgatcaaaagcgagaacccga

SEQ ID NO: 19630 - DNA, 75 bp, Artificial Sequence
  Synthetic
cggaccaagtctcgcagatacagaagttggtgagtacccttcctcaaattaagactgatattgcttcgattcgga

SEQ ID NO: 19631 - DNA, 75 bp, Artificial Sequence
  Synthetic
gttggtgagtacccttcctcaaattaagactgatattgcttcgattcggaacatgcaagcagctttggaaggaca

SEQ ID NO: 19632 - DNA, 75 bp, Artificial Sequence
  Synthetic
aaatctcaagataaccaaagggatctatccgctcaacgacacgcaatcacagctctgctagaaacccgcgttgca

SEQ ID NO: 19633 - DNA, 75 bp, Artificial Sequence
  Synthetic
tatccgctcaacgacacgcaatcacagctctgctagaaacccgcgttgcacccggacctaagagagatcgcctga

SEQ ID NO: 19634 - DNA, 75 bp, Artificial Sequence
  Synthetic
tcaatgcgctgagagggttcagtggtaaggcacctgttattgtgagtggtccaggaaatcccaatcaatgcatca

SEQ ID NO: 19635 - DNA, 75 bp, Artificial Sequence
  Synthetic
taaggcacctgttattgtgagtggtccaggaaatcccaatcaatgcatcagccaaggctcatccaccacaatttg

SEQ ID NO: 19636 - DNA, 75 bp, Artificial Sequence
  Synthetic
agaatggcaattcttggtcaataaaccgactcagcaccacattgtctgtgactctacacttgtgcggcaaaccaa

SEQ ID NO: 19637 - DNA, 75 bp, Artificial Sequence
  Synthetic
ccgactcagcaccacattgtctgtgactctacacttgtgcggcaaaccaacattgacctccaaacacttttctgc

SEQ ID NO: 19638 - DNA, 75 bp, Artificial Sequence
  Synthetic
aagatgatcagaaggacctatctgcacagcgacatgctgtcattgcattactcgaaaccagaatccccccgggac

SEQ ID NO: 19639 - DNA, 75 bp, Artificial Sequence
  Synthetic
acagcgacatgctgtcattgcattactcgaaaccagaatccccccgggaccaaaacgtgacaaattactgtcatt

SEQ ID NO: 19640 - DNA, 75 bp, Artificial Sequence
  Synthetic
ctcacaacccatctagctctcttattttatctattgctttataaaaaaccaaaatgattataactaaacaatctc

SEQ ID NO: 19641 - DNA, 75 bp, Artificial Sequence
  Synthetic
tttatctattgctttataaaaaaccaaaatgattataactaaacaatctcaacaatttgcaatgataacaacacc

SEQ ID NO: 19642 - DNA, 75 bp, Artificial Sequence
  Synthetic
cagtcctcggccagtgatatcaccctatggcaaccaggctacaaatgtaagcagtttccgatatgtaccgaatca

SEQ ID NO: 19643 - DNA, 75 bp, Artificial Sequence
  Synthetic
tatggcaaccaggctacaaatgtaagcagtttccgatatgtaccgaatcaataacacgaccccttccgcaaaagc

SEQ ID NO: 19644 - DNA, 75 bp, Artificial Sequence
  Synthetic
agtccaggccagacacaggcaacccatcagcacagagccaagcaaccaaaatggcagcacaccccaaccatgcca

SEQ ID NO: 19645 - DNA, 75 bp, Artificial Sequence
  Synthetic
atcagcacagagccaagcaaccaaaatggcagcacaccccaaccatgccaacccatcctcgtcaatcagcctcat

SEQ ID NO: 19646 - DNA, 75 bp, Artificial Sequence
  Synthetic
aggtgatctgaccatctggctttacttccgctttataaaaaactcctagatctaacatggaggcagaccgagcta

SEQ ID NO: 19647 - DNA, 75 bp, Artificial Sequence
  Synthetic
ttccgctttataaaaaactcctagatctaacatggaggcagaccgagctaatgcggagggagtacacaaggggaa

SEQ ID NO: 19648 - DNA, 75 bp, Artificial Sequence
  Synthetic
gtgaaaagaccgagacgggcactaccaaacttcaacctcaagtcagaatgcagtcatttctctcaactgacagcc

SEQ ID NO: 19649 - DNA, 75 bp, Artificial Sequence
  Synthetic
caaacttcaacctcaagtcagaatgcagtcatttctctcaactgacagccaaaagtaccacctggtattcataaa

SEQ ID NO: 19650 - DNA, 75 bp, Artificial Sequence
  Synthetic
cgcagcctcccccaacccgcggcccaggctccattcaaaaaccatggccgctgctctcgggaacatgcacccgtc

SEQ ID NO: 19651 - DNA, 75 bp, Artificial Sequence
  Synthetic
aggctccattcaaaaaccatggccgctgctctcgggaacatgcacccgtcatcgtcgattactcttatgcatgat

SEQ ID NO: 19652 - DNA, 75 bp, Artificial Sequence
  Synthetic
tcgttcctgcgttgtttcaaccgaaatctaaggtattgtcttcagcaatggttacccttggtgcagttcctgcag

SEQ ID NO: 19653 - DNA, 75 bp, Artificial Sequence
  Synthetic
atctaaggtattgtcttcagcaatggttacccttggtgcagttcctgcagatacagtcctgcaggacttacaaaa

SEQ ID NO: 19654 - DNA, 75 bp, Artificial Sequence
  Synthetic
gacagagacagggacgacaaagctgcagcctcaagtgagaatgcaatctttcctatcaaccgatagccagaagta

SEQ ID NO: 19655 - DNA, 75 bp, Artificial Sequence
  Synthetic
cagcctcaagtgagaatgcaatctttcctatcaaccgatagccagaagtatcatctggtctttatcaacacatat

SEQ ID NO: 19656 - DNA, 75 bp, Artificial Sequence
  Synthetic
aactcatactattctctactgataatattccagcaacacttacaggatcatctgtttggaaaaacaggggtgtta

SEQ ID NO: 19657 - DNA, 75 bp, Artificial Sequence
  Synthetic
tattccagcaacacttacaggatcatctgtttggaaaaacaggggtgttattgcagacaccgccacatccgtgaa

SEQ ID NO: 19658 - DNA, 75 bp, Artificial Sequence
  Synthetic
tgcactatttcaacccaagtctaaagtcttatcgtcagcgatggttacacttggggctgtccctgctgacactgt

SEQ ID NO: 19659 - DNA, 75 bp, Artificial Sequence
  Synthetic
gtcttatcgtcagcgatggttacacttggggctgtccctgctgacactgttctccaggacctacaacgggactta

SEQ ID NO: 19660 - DNA, 75 bp, Artificial Sequence
  Synthetic
tcatatcattctgtttcttccactcatctgccttattcaaggtgcccaagccactgcttaattttgagacagccg

SEQ ID NO: 19661 - DNA, 75 bp, Artificial Sequence
  Synthetic
atctgccttattcaaggtgcccaagccactgcttaattttgagacagccgttgcctattctctagtcctgcaggt

SEQ ID NO: 19662 - DNA, 75 bp, Artificial Sequence
  Synthetic
attattctccacagacaatgtccctgcaacattaacagggtcatcagtctggaagaataaaggagtaatagctga

SEQ ID NO: 19663 - DNA, 75 bp, Artificial Sequence
  Synthetic
gcaacattaacagggtcatcagtctggaagaataaaggagtaatagctgatacagcaactgcagttaaagcgccc

SEQ ID NO: 19664 - DNA, 75 bp, Artificial Sequence
  Synthetic
agaacaaggactctaaatggtactgtaccattgacatacacatagggaacctcctgaaaaggactgcaaaacaga

SEQ ID NO: 19665 - DNA, 75 bp, Artificial Sequence
  Synthetic
taccattgacatacacatagggaacctcctgaaaaggactgcaaaacagagaaggcgtacaccatctgaaatcac

SEQ ID NO: 19666 - DNA, 75 bp, Artificial Sequence
  Synthetic
tttttgcttcttccactcatctgctctttttaaggtgcccaagcctctgctgaatttcgagacggccatagcata

SEQ ID NO: 19667 - DNA, 75 bp, Artificial Sequence
  Synthetic
ctttttaaggtgcccaagcctctgctgaatttcgagacggccatagcatattcccttgtactccaggtcgagctt

SEQ ID NO: 19668 - DNA, 75 bp, Artificial Sequence
  Synthetic
gccctacaatagtggtcgaattaactggctcatcgagcaaatcgctccagggattcttctccagtgagagactgg

SEQ ID NO: 19669 - DNA, 75 bp, Artificial Sequence
  Synthetic
tggctcatcgagcaaatcgctccagggattcttctccagtgagagactggcttgccatcctatttcacaatacaa

SEQ ID NO: 19670 - DNA, 75 bp, Artificial Sequence
  Synthetic
agactcgaagtggtattgtacaattgacatccatattgggaatcttttaaagagaaccgccaagcaacgaaggag

SEQ ID NO: 19671 - DNA, 75 bp, Artificial Sequence
  Synthetic
gacatccatattgggaatcttttaaagagaaccgccaagcaacgaaggaggacaccttcagagataatgcagaaa

SEQ ID NO: 19672 - DNA, 75 bp, Artificial Sequence
  Synthetic
gtcatatgataatatctgaacttgagaaaaagaaagctttggccatggctgacctcactgtaagtgatgcagttg

SEQ ID NO: 19673 - DNA, 75 bp, Artificial Sequence
  Synthetic
gaaaaagaaagctttggccatggctgacctcactgtaagtgatgcagttgctatcaatactacaataaaggagtt

SEQ ID NO: 19674 - DNA, 75 bp, Artificial Sequence
  Synthetic
aattgtggttgaattaactgggtcctcaagtaagtccctacacggattcttctcgagtgagcggctggcctgcca

SEQ ID NO: 19675 - DNA, 75 bp, Artificial Sequence
  Synthetic
tcaagtaagtccctacacggattcttctcgagtgagcggctggcctgccacccggtatcacagtataatcctcat

SEQ ID NO: 19676 - DNA, 75 bp, Artificial Sequence
  Synthetic
ccactagtaacaaattacaaccatcacctataacctaacaaaccaaatgcatgcacctaaccttctgggttgaat

SEQ ID NO: 19677 - DNA, 75 bp, Artificial Sequence
  Synthetic
acctataacctaacaaaccaaatgcatgcacctaaccttctgggttgaatgagaagcttggattatattcatgat

SEQ ID NO: 19678 - DNA, 75 bp, Artificial Sequence
  Synthetic
gattatatctgaacttgagaaaaagaaggcacttgcaatggctgacctgaccgtgagtgatgcagtagctgtcaa

SEQ ID NO: 19679 - DNA, 75 bp, Artificial Sequence
  Synthetic
aaggcacttgcaatggctgacctgaccgtgagtgatgcagtagctgtcaacacgagcatcaagagcttatcgcct

SEQ ID NO: 19680 - DNA, 75 bp, Artificial Sequence
  Synthetic
atattccactaaccaaatttaattaaaaatattaataatcattagcaacatccgatcggaatcttcaggggcgga

SEQ ID NO: 19681 - DNA, 75 bp, Artificial Sequence
  Synthetic
aaaatattaataatcattagcaacatccgatcggaatcttcaggggcggaaggaccaccgccacaacaccccacc

SEQ ID NO: 19682 - DNA, 75 bp, Artificial Sequence
  Synthetic
ttataatttgcatattctagattataatcattaaccgcgtccaaatgatcagaccgcataattaacagctcagcc

SEQ ID NO: 19683 - DNA, 75 bp, Artificial Sequence
  Synthetic
aatcattaaccgcgtccaaatgatcagaccgcataattaacagctcagccaggactcgcaaatcctgcataggct

SEQ ID NO: 19684 - DNA, 75 bp, Artificial Sequence
  Synthetic
cccccccaaccccccacaccctccccgacagcccgacaaaaaacccccccaaaaaacagatcgcccacacacaga

SEQ ID NO: 19685 - DNA, 75 bp, Artificial Sequence
  Synthetic
cgacagcccgacaaaaaacccccccaaaaaacagatcgcccacacacagatcagaatggcctccccaatggtccc

SEQ ID NO: 19686 - DNA, 75 bp, Artificial Sequence
  Synthetic
aggaatcagaattgagacaatatctaggttatcagcgctactgccctgcaactcactatgtatgcttggcattaa

SEQ ID NO: 19687 - DNA, 75 bp, Artificial Sequence
  Synthetic
aggttatcagcgctactgccctgcaactcactatgtatgcttggcattaataaaaaacattgtgagaatgcaatt

SEQ ID NO: 19688 - DNA, 75 bp, Artificial Sequence
  Synthetic
atattgataagctcattcaagcagggattatcatgggctcagggaaggaactccacatttatcaagaatctggct

SEQ ID NO: 19689 - DNA, 75 bp, Artificial Sequence
  Synthetic
gattatcatgggctcagggaaggaactccacatttatcaagaatctggctctcttgatttgtatcttagactatt

SEQ ID NO: 19690 - DNA, 75 bp, Artificial Sequence
  Synthetic
cagccccccggcaccgcaccggaaggacgcacaacagccgaccgcccccaccagggcagaggccatgcaaccagg

SEQ ID NO: 19691 - DNA, 75 bp, Artificial Sequence
  Synthetic
gacgcacaacagccgaccgcccccaccagggcagaggccatgcaaccaggctcggcactccacctcccgcacctg

SEQ ID NO: 19692 - DNA, 75 bp, Artificial Sequence
  Synthetic
aatataactcgactgtaacgagactattatcaccaattgcaaaaaatctaaaccatttgctacaaccgagaccgt

SEQ ID NO: 19693 - DNA, 75 bp, Artificial Sequence
  Synthetic
attatcaccaattgcaaaaaatctaaaccatttgctacaaccgagaccgtctggcaggttatttggcgctgtaat

SEQ ID NO: 19694 - DNA, 75 bp, Artificial Sequence
  Synthetic
aattgataggctgatacaggcagggattgtcttgggtagtggaaaggagctccatatctcacaagattcagggac

SEQ ID NO: 19695 - DNA, 75 bp, Artificial Sequence
  Synthetic
attgtcttgggtagtggaaaggagctccatatctcacaagattcagggacactggatttattcgtgaggttgtta

SEQ ID NO: 19696 - DNA, 75 bp, Artificial Sequence
  Synthetic
tagcattggtccgtgctcaacagaatgcaaacgatatcctcgctcttaaagctgcaatacaatctagtaatgagg

SEQ ID NO: 19697 - DNA, 75 bp, Artificial Sequence
  Synthetic
tgcaaacgatatcctcgctcttaaagctgcaatacaatctagtaatgaggcaataaaacaacttacttatggcca

SEQ ID NO: 19698 - DNA, 75 bp, Artificial Sequence
  Synthetic
gtataataagacggtgactaggttattggccccaatagggaagaacctagaacaggtactacaagcgagaccgcg

SEQ ID NO: 19699 - DNA, 75 bp, Artificial Sequence
  Synthetic
ttggccccaatagggaagaacctagaacaggtactacaagcgagaccgcgtgggaggctgttcggtccaataata

SEQ ID NO: 19700 - DNA, 75 bp, Artificial Sequence
  Synthetic
aagtaatccctgcattgactgcacttgactgtgcagttcttggaaataaactagctgcacaactgaacctctacc

SEQ ID NO: 19701 - DNA, 75 bp, Artificial Sequence
  Synthetic
tgactgtgcagttcttggaaataaactagctgcacaactgaacctctacctcattgaaatgacgactatttttgg

SEQ ID NO: 19702 - DNA, 75 bp, Artificial Sequence
  Synthetic
tgcactcgtccgtgcacagcaaaatgctaatgatatattagcacttaaaaacgctctccaatccagcaatgaggc

SEQ ID NO: 19703 - DNA, 75 bp, Artificial Sequence
  Synthetic
gctaatgatatattagcacttaaaaacgctctccaatccagcaatgaggcaatccgtcaactcacgtatggccag

SEQ ID NO: 19704 - DNA, 75 bp, Artificial Sequence
  Synthetic
tgcggttgacaggctctgagttaaatgatgtattattacaacagactcgatcctctttgagcctaatccaccttg

SEQ ID NO: 19705 - DNA, 75 bp, Artificial Sequence
  Synthetic
tgatgtattattacaacagactcgatcctctttgagcctaatccaccttgtctctaaaggcttattaagtggtca

SEQ ID NO: 19706 - DNA, 75 bp, Artificial Sequence
  Synthetic
gatcctccctgcactcgatcagctggactgtgctgtccttggaaccaaactagctgtgcagcttaatctgtatct

SEQ ID NO: 19707 - DNA, 75 bp, Artificial Sequence
  Synthetic
gactgtgctgtccttggaaccaaactagctgtgcagcttaatctgtatctcattgagatgactaccattttcggc

SEQ ID NO: 19708 - DNA, 75 bp, Artificial Sequence
  Synthetic
tgatcaggactcaaagaatagatcggtcactagttttccaaccttacgtattaccaattactattagttctaaca

SEQ ID NO: 19709 - DNA, 75 bp, Artificial Sequence
  Synthetic
tgatcaggactcaaagaatagatcggtcactagttttcctaccttacgtattaccaattactattagttctaaca

SEQ ID NO: 19710 - DNA, 75 bp, Artificial Sequence
  Synthetic
tgatcaggactcaaagaatagatcggtcactagttttcccaccttacgtattaccaattactattagttctaaca

SEQ ID NO: 19711 - DNA, 75 bp, Artificial Sequence
  Synthetic
tgatcaggactcaaagaatagatcggtcactagttttccgaccttacgtattaccaattactattagttctaaca

SEQ ID NO: 19712 - DNA, 75 bp, Artificial Sequence
  Synthetic
gtcactagttttccaaccttacgtattaccaattactattagttctaacatagccacaccaattatacccgactg

SEQ ID NO: 19713 - DNA, 75 bp, Artificial Sequence
  Synthetic
gtcactagttttcctaccttacgtattaccaattactattagttctaacatagccacaccaattatacccgactg

SEQ ID NO: 19714 - DNA, 75 bp, Artificial Sequence
  Synthetic
gtcactagttttcccaccttacgtattaccaattactattagttctaacatagccacaccaattatacccgactg

SEQ ID NO: 19715 - DNA, 75 bp, Artificial Sequence
  Synthetic
gtcactagttttccgaccttacgtattaccaattactattagttctaacatagccacaccaattatacccgactg

SEQ ID NO: 19716 - DNA, 75 bp, Artificial Sequence
  Synthetic
acgcctgaccggtgcggagttgaacaacgtcctcatgaagcaagcccgatcgtccttaagccttgtacagttagt

SEQ ID NO: 19717 - DNA, 75 bp, Artificial Sequence
  Synthetic
aacgtcctcatgaagcaagcccgatcgtccttaagccttgtacagttagtttcaaaaggcttacttagtggacaa

SEQ ID NO: 19718 - DNA, 75 bp, Artificial Sequence
  Synthetic
tagaattggaacgagatataatttgcaagactatcaacacataccaaataactaaggaaactagagcatgcttac

SEQ ID NO: 19719 - DNA, 75 bp, Artificial Sequence
  Synthetic
caagactatcaacacataccaaataactaaggaaactagagcatgcttacaaggtaatataacaatgtgtaagta

SEQ ID NO: 19720 - DNA, 75 bp, Artificial Sequence
  Synthetic
gatgcgaacgcagaagatcgatagagcactagtttatcagccgtatgtattaccaatcactcttaactctaacat

SEQ ID NO: 19721 - DNA, 75 bp, Artificial Sequence
  Synthetic
gcactagtttatcagccgtatgtattaccaatcactcttaactctaacatagtaacaccaatagccccagaatgc

SEQ ID NO: 19722 - DNA, 75 bp, Artificial Sequence
  Synthetic
ttgtaattgcaaattgtgatttggtatcatgccgatgcataagaccccctatgattatcacacaagtaaaaggtt

SEQ ID NO: 19723 - DNA, 75 bp, Artificial Sequence
  Synthetic
atcatgccgatgcataagaccccctatgattatcacacaagtaaaaggttaccctctgacaattataaataggaa

SEQ ID NO: 19724 - DNA, 75 bp, Artificial Sequence
  Synthetic
agagttggagcaagacataatttgtaggacagttacgacatacacgcttgccagagacaccagattgtgtttaca

SEQ ID NO: 19725 - DNA, 75 bp, Artificial Sequence
  Synthetic
aggacagttacgacatacacgcttgccagagacaccagattgtgtttacaaggcaatatctcttcttgtaggtat

SEQ ID NO: 19726 - DNA, 75 bp, Artificial Sequence
  Synthetic
accataacttttcattaaaccctactattatagattcacaatcccggcttatagctactagtccattagaaatag

SEQ ID NO: 19727 - DNA, 75 bp, Artificial Sequence
  Synthetic
tattatagattcacaatcccggcttatagctactagtccattagaaatagatgcccttattcaagatgcgcaaca

SEQ ID NO: 19728 - DNA, 75 bp, Artificial Sequence
  Synthetic
agttatcgcaaactgtgatttagtctcttgtcggtgtctccgtcctcctatgattatcacccaagtaaaagggta

SEQ ID NO: 19729 - DNA, 75 bp, Artificial Sequence
  Synthetic
tcttgtcggtgtctccgtcctcctatgattatcacccaagtaaaagggtaccctcttaccataatcacaaggtcc

SEQ ID NO: 19730 - DNA, 75 bp, Artificial Sequence
  Synthetic
taagagttacagggctgggctcatcaagttggcacatcatacttatattaacattgcttgtatgcaccatagcat

SEQ ID NO: 19731 - DNA, 75 bp, Artificial Sequence
  Synthetic
aagttggcacatcatacttatattaacattgcttgtatgcaccatagcatggctcattggtttatctatttatgt

SEQ ID NO: 19732 - DNA, 75 bp, Artificial Sequence
  Synthetic
ccataatttctcccttaatccaacaattatcgaccctctaacaagagtaatagccactacaccgttagagataga

SEQ ID NO: 19733 - DNA, 75 bp, Artificial Sequence
  Synthetic
attatcgaccctctaacaagagtaatagccactacaccgttagagatagattccttaatccaagaggcacaagat

SEQ ID NO: 19734 - DNA, 75 bp, Artificial Sequence
  Synthetic
catcgaaccgcggcattggggttggatctatacaatatatgacataatgagccgcctgtatatcaagcccaagta

SEQ ID NO: 19735 - DNA, 75 bp, Artificial Sequence
  Synthetic
atctatacaatatatgacataatgagccgcctgtatatcaagcccaagtatcgacccctcccaccatcctcgacc

SEQ ID NO: 19736 - DNA, 75 bp, Artificial Sequence
  Synthetic
ggcagttactggcggtaattattcgaattggtatatcgttcttgtcatcgtcttactatttgggaatttgggctg

SEQ ID NO: 19737 - DNA, 75 bp, Artificial Sequence
  Synthetic
aattggtatatcgttcttgtcatcgtcttactatttgggaatttgggctggtcgctgttgttaacagtacttcta

SEQ ID NO: 19738 - DNA, 75 bp, Artificial Sequence
  Synthetic
ccatgttgagacacaccagtacaccctagtttctagtaaaacccccagttctattttctgcattccattaattta

SEQ ID NO: 19739 - DNA, 75 bp, Artificial Sequence
  Synthetic
ctagtttctagtaaaacccccagttctattttctgcattccattaatttataaaaaaatgccatgatactcgtgc

SEQ ID NO: 19740 - DNA, 75 bp, Artificial Sequence
  Synthetic
gtcagaaagaggtgttggggttgggaccatccagtatatgtcataagtggtgtcagacatcacaatccaagtcac

SEQ ID NO: 19741 - DNA, 75 bp, Artificial Sequence
  Synthetic
accatccagtatatgtcataagtggtgtcagacatcacaatccaagtcactcagttatctactccgctggctcgg

SEQ ID NO: 19742 - DNA, 75 bp, Artificial Sequence
  Synthetic
acccccccaacatggagccgacaggatcaaaagttgacattgtcccttcccaaggtaccaagagaacatgtcgaa

SEQ ID NO: 19743 - DNA, 75 bp, Artificial Sequence
  Synthetic
atcaaaagttgacattgtcccttcccaaggtaccaagagaacatgtcgaaccttttatcgcctcttaattcttat

SEQ ID NO: 19744 - DNA, 75 bp, Artificial Sequence
  Synthetic
atactaccagacagtggctccgcacgatggcagcagcccacaacgtcctgcatgtaaatatcattgcgttacttt

SEQ ID NO: 19745 - DNA, 75 bp, Artificial Sequence
  Synthetic
gatggcagcagcccacaacgtcctgcatgtaaatatcattgcgttactttaattaaaaaacctcaaggtgaccca

SEQ ID NO: 19746 - DNA, 75 bp, Artificial Sequence
  Synthetic
tctcaacagatcaacacaaattgtgcaataatgaggctgactcacttttacactcaatagtagaacccataacag

SEQ ID NO: 19747 - DNA, 75 bp, Artificial Sequence
  Synthetic
caataatgaggctgactcacttttacactcaatagtagaacccataacagtccccctaggaacagactcggatgt

SEQ ID NO: 19748 - DNA, 75 bp, Artificial Sequence
  Synthetic
attgtttccaacatggaatcccctccttctggcaaggatgcgccagccttccgcgagcctaagcgaacttgcaga

SEQ ID NO: 19749 - DNA, 75 bp, Artificial Sequence
  Synthetic
cttctggcaaggatgcgccagccttccgcgagcctaagcgaacttgcagactctgttacagggcgacgactctct

SEQ ID NO: 19750 - DNA, 75 bp, Artificial Sequence
  Synthetic
tccaaattgacaacacagagaacatcatattaactacattagcaagtatcaactctaacattgcacgccttcata

SEQ ID NO: 19751 - DNA, 75 bp, Artificial Sequence
  Synthetic
catattaactacattagcaagtatcaactctaacattgcacgccttcataacgccaccgatgaaagcccaacatg

SEQ ID NO: 19752 - DNA, 75 bp, Artificial Sequence
  Synthetic
actcaaactggggcaaacaactcttgtgtcaatcccacaatcgtaactcctgattatttaactggcagcacgaca

SEQ ID NO: 19753 - DNA, 75 bp, Artificial Sequence
  Synthetic
gtgtcaatcccacaatcgtaactcctgattatttaactggcagcacgacaggctcagttgaagatcttgctgact

SEQ ID NO: 19754 - DNA, 75 bp, Artificial Sequence
  Synthetic
ccaaagggtcgatgatatataggaatttcagcaatttgatagaacatgttaactttataccatctccaacgacat

SEQ ID NO: 19755 - DNA, 75 bp, Artificial Sequence
  Synthetic
tttcagcaatttgatagaacatgttaactttataccatctccaacgacattatcaggctgtacaagaattccatc

SEQ ID NO: 19756 - DNA, 75 bp, Artificial Sequence
  Synthetic
gttcagatcgataatacagaaaatctaatactgacaactctggcgagtatcaactcgaatttacgctttctgcaa

SEQ ID NO: 19757 - DNA, 75 bp, Artificial Sequence
  Synthetic
taatactgacaactctggcgagtatcaactcgaatttacgctttctgcaaaatgcaacaactgagagccagacct

SEQ ID NO: 19758 - DNA, 75 bp, Artificial Sequence
  Synthetic
ctggttgtcaagaccatgctgcgagttcacagtatatttccataggaatagtagatacaggattgaataatgagc

SEQ ID NO: 19759 - DNA, 75 bp, Artificial Sequence
  Synthetic
ttcacagtatatttccataggaatagtagatacaggattgaataatgagccctatttgcgtacaatgtcttcacg

SEQ ID NO: 19760 - DNA, 75 bp, Artificial Sequence
  Synthetic
ccagcagggtcgatggcatataatgacttcagcaacctcattgagcacgtaaatttcataccgtcgccgacaacg

SEQ ID NO: 19761 - DNA, 75 bp, Artificial Sequence
  Synthetic
acttcagcaacctcattgagcacgtaaatttcataccgtcgccgacaacgttgtcaggctgcaccaggataccat

SEQ ID NO: 19762 - DNA, 75 bp, Artificial Sequence
  Synthetic
ctggtgtctgttggctattgtgtagtgttgtaacagaaagtgaatcagctgactacagatcaagagcccccactg

SEQ ID NO: 19763 - DNA, 75 bp, Artificial Sequence
  Synthetic
tgttgtaacagaaagtgaatcagctgactacagatcaagagcccccactgcaatgattctcggaaggttcaattt

SEQ ID NO: 19764 - DNA, 75 bp, Artificial Sequence
  Synthetic
aacgggtgccttgaccatgctgcaagttcacaatacatctcaatagggatcgttgataccggcctaaataatgag

SEQ ID NO: 19765 - DNA, 75 bp, Artificial Sequence
  Synthetic
gttcacaatacatctcaatagggatcgttgataccggcctaaataatgagccctattttagaacaatgtcttcaa

SEQ ID NO: 19766 - DNA, 75 bp, Artificial Sequence
  Synthetic
gtttcactgctaattaccctggagttggctcaggaacccaattaaatgggaccctttattttccaatatatgggg

SEQ ID NO: 19767 - DNA, 75 bp, Artificial Sequence
  Synthetic
tggctcaggaacccaattaaatgggaccctttattttccaatatatgggggtgttgttaacgactctgatattga

SEQ ID NO: 19768 - DNA, 75 bp, Artificial Sequence
  Synthetic
gctaatgcatgttggttactctgtagcgtagtaacagaatacgaagctgcggactatcgatcacgaactcctact

SEQ ID NO: 19769 - DNA, 75 bp, Artificial Sequence
  Synthetic
gcgtagtaacagaatacgaagctgcggactatcgatcacgaactcctactgctatggttctggggcgattcgatt

SEQ ID NO: 19770 - DNA, 75 bp, Artificial Sequence
  Synthetic
gtccagatcctgaggtgacccaaagtcagagggctcaggcaagttactatccgacaaggtttggcaggctgctca

SEQ ID NO: 19771 - DNA, 75 bp, Artificial Sequence
  Synthetic
tcagagggctcaggcaagttactatccgacaaggtttggcaggctgctcatacaacaagcaatactagcttgtcg

SEQ ID NO: 19772 - DNA, 75 bp, Artificial Sequence
  Synthetic
cggtttgcatctaactatccaggtgtgggatcgggaactcaagtcaatggaacattatatttccctttatatgga

SEQ ID NO: 19773 - DNA, 75 bp, Artificial Sequence
  Synthetic
tgggatcgggaactcaagtcaatggaacattatatttccctttatatggaggggtccttaatgggtcagatatag

SEQ ID NO: 19774 - DNA, 75 bp, Artificial Sequence
  Synthetic
atcaagtcatgatgggtgcagaagcccgaatttattatttaaacaatcagatgtacttatatcaaagatcttcga

SEQ ID NO: 19775 - DNA, 75 bp, Artificial Sequence
  Synthetic
ccgaatttattatttaaacaatcagatgtacttatatcaaagatcttcgagttggtggccgcatccgctttttta

SEQ ID NO: 19776 - DNA, 75 bp, Artificial Sequence
  Synthetic
tgtccagactcggaggcgatccaaagctttagagcgcaagatagctattacccgacgagatttgggaaggtgctg

SEQ ID NO: 19777 - DNA, 75 bp, Artificial Sequence
  Synthetic
gctttagagcgcaagatagctattacccgacgagatttgggaaggtgctgatccaacaggcaatcattgcatgta

SEQ ID NO: 19778 - DNA, 75 bp, Artificial Sequence
  Synthetic
atacacacttaatattgacatatgctacctcacgccctggcacttcaatttgtacaggggcctcgcgatgtccta

SEQ ID NO: 19779 - DNA, 75 bp, Artificial Sequence
  Synthetic
tacctcacgccctggcacttcaatttgtacaggggcctcgcgatgtcctaataactgtgttgatggtgtctatac

SEQ ID NO: 19780 - DNA, 75 bp, Artificial Sequence
  Synthetic
aacagagtgatgatgggtgcagaggcacggctatattatcttaataaccaattatatctatatcaacgctcgtcg

SEQ ID NO: 19781 - DNA, 75 bp, Artificial Sequence
  Synthetic
cacggctatattatcttaataaccaattatatctatatcaacgctcgtcgagctggtggccgcatcctttgttct

SEQ ID NO: 19782 - DNA, 75 bp, Artificial Sequence
  Synthetic
acacagtattcctcaacagtcccaaccgcaggatcagtcctacaattagcatttacagctacaaccagaagatta

SEQ ID NO: 19783 - DNA, 75 bp, Artificial Sequence
  Synthetic
ccgcaggatcagtcctacaattagcatttacagctacaaccagaagattagctctcgtctggctgtaggaagtga

SEQ ID NO: 19784 - DNA, 75 bp, Artificial Sequence
  Synthetic
gaggcccatctgacactgacttacgccacgtcgaggccaggaatgtctatctgtacaggagcatcaaggtgtcca

SEQ ID NO: 19785 - DNA, 75 bp, Artificial Sequence
  Synthetic
ccacgtcgaggccaggaatgtctatctgtacaggagcatcaaggtgtccaaataattgcgtagacggtgtatata

SEQ ID NO: 19786 - DNA, 75 bp, Artificial Sequence
  Synthetic
gggcactatactgcatcactataatagaagctgtaaacacaatctttggacaataccgaatagtaccgatccttg

SEQ ID NO: 19787 - DNA, 75 bp, Artificial Sequence
  Synthetic
agaagctgtaaacacaatctttggacaataccgaatagtaccgatccttgttcaactaattagtgactaggaaat

SEQ ID NO: 19788 - DNA, 75 bp, Artificial Sequence
  Synthetic
tacactgtatacttaaataattcaactcggcggattagcccaaccataagtctatacacttatgaccgcaggatc

SEQ ID NO: 19789 - DNA, 75 bp, Artificial Sequence
  Synthetic
ctcggcggattagcccaaccataagtctatacacttatgaccgcaggatcaaatctaagctggcagtgggtagtg

SEQ ID NO: 19790 - DNA, 75 bp, Artificial Sequence
  Synthetic
aatgatatacatcgcttgtactataatcaagtaacgggcagcgggtgatccatattaaataatatatgcattaag

SEQ ID NO: 19791 - DNA, 75 bp, Artificial Sequence
  Synthetic
atcaagtaacgggcagcgggtgatccatattaaataatatatgcattaagcagatacaaatcttcactttgtcaa

SEQ ID NO: 19792 - DNA, 75 bp, Artificial Sequence
  Synthetic
ggggcggtttattgcttaactataatggagaccgttaacacaatatttggtcagtaccggatcgtgccaatatta

SEQ ID NO: 19793 - DNA, 75 bp, Artificial Sequence
  Synthetic
tggagaccgttaacacaatatttggtcagtaccggatcgtgccaatattacttagagtgacaagccggtaatgga

SEQ ID NO: 19794 - DNA, 75 bp, Artificial Sequence
  Synthetic
aaaaacttcactatcactctttgagtcgctgaagtgagatttcagaaaggtatgcatctaagaagtaggagcgga

SEQ ID NO: 19795 - DNA, 75 bp, Artificial Sequence
  Synthetic
tcgctgaagtgagatttcagaaaggtatgcatctaagaagtaggagcggaagtgctcttgttcataatgtcttcc

SEQ ID NO: 19796 - DNA, 75 bp, Artificial Sequence
  Synthetic
gatttatgctatgtaactaattttgctcaatcgggagggtgatcggccgggtatgtccacaatgacaatgactcc

SEQ ID NO: 19797 - DNA, 75 bp, Artificial Sequence
  Synthetic
ctcaatcgggagggtgatcggccgggtatgtccacaatgacaatgactcctattcccttgctagagctagcttcc

SEQ ID NO: 19798 - DNA, 75 bp, Artificial Sequence
  Synthetic
taaattaatgtattactgcaaattgctcaatgtattgcctgggcctgattctccttggtttgagaaaacaagagg

SEQ ID NO: 19799 - DNA, 75 bp, Artificial Sequence
  Synthetic
ctcaatgtattgcctgggcctgattctccttggtttgagaaaacaagaggatggactaattgctgtatccgtctt

SEQ ID NO: 19800 - DNA, 75 bp, Artificial Sequence
  Synthetic
tataagatccagacgaaggctatataagctaatagcttaggatggaaacgacaggagcggaacatatccctccta

SEQ ID NO: 19801 - DNA, 75 bp, Artificial Sequence
  Synthetic
aagctaatagcttaggatggaaacgacaggagcggaacatatccctcctaccatgtcttctcataatattatcct

SEQ ID NO: 19802 - DNA, 75 bp, Artificial Sequence
  Synthetic
attagcaacaatgggaatatattcaaagaatcaatcaacatgttttaaaacaattattcatccacaatccttgca

SEQ ID NO: 19803 - DNA, 75 bp, Artificial Sequence
  Synthetic
aagaatcaatcaacatgttttaaaacaattattcatccacaatccttgcaaccaattatgcatagtgcatcagaa

SEQ ID NO: 19804 - DNA, 75 bp, Artificial Sequence
  Synthetic
attgtaaactccttaatatattgcctgaccctaagtcgccatggtacgagaagattaagtcttggactaattgct

SEQ ID NO: 19805 - DNA, 75 bp, Artificial Sequence
  Synthetic
tgaccctaagtcgccatggtacgagaagattaagtcttggactaattgctgcatccgtgtgtcagacagcaatcg

SEQ ID NO: 19806 - DNA, 75 bp, Artificial Sequence
  Synthetic
cagtgtaacaacacaatcagcaaaatttggagacctattccaaggcatatctactgatctaacagggaagacaaa

SEQ ID NO: 19807 - DNA, 75 bp, Artificial Sequence
  Synthetic
tttggagacctattccaaggcatatctactgatctaacagggaagacaaatttgtttggcggattctgcgattta

SEQ ID NO: 19808 - DNA, 75 bp, Artificial Sequence
  Synthetic
gcgtatattcgaagaaccaccagcaatgttataccaccataatccatccccaatccctatcacccatcatgcaga

SEQ ID NO: 19809 - DNA, 75 bp, Artificial Sequence
  Synthetic
atgttataccaccataatccatccccaatccctatcacccatcatgcagactgtctctcaactgggacgctcaat

SEQ ID NO: 19810 - DNA, 75 bp, Artificial Sequence
  Synthetic
gtatctagagactagtgatgcttacgcttgccaatttttgttccacattaaaacttgtcaacgagagttgatctt

SEQ ID NO: 19811 - DNA, 75 bp, Artificial Sequence
  Synthetic
gcttgccaatttttgttccacattaaaacttgtcaacgagagttgatcttactcatgaggcaaaatgcaacagcc

SEQ ID NO: 19812 - DNA, 75 bp, Artificial Sequence
  Synthetic
aaacgaataaatttgaatccttattccacaacatctcaaaggacctgacagggaaaaccaacttgtttggcggat

SEQ ID NO: 19813 - DNA, 75 bp, Artificial Sequence
  Synthetic
ccacaacatctcaaaggacctgacagggaaaaccaacttgtttggcggattctgtgatttacatgggagcataag

SEQ ID NO: 19814 - DNA, 75 bp, Artificial Sequence
  Synthetic
tgaatattcagtttgggtcttccatgaaagcaaacaagtcactatccttacttttgattgccttttaatgtactg

SEQ ID NO: 19815 - DNA, 75 bp, Artificial Sequence
  Synthetic
gaaagcaaacaagtcactatccttacttttgattgccttttaatgtactgtgatctcgctgatgggcgtcacaat

SEQ ID NO: 19816 - DNA, 75 bp, Artificial Sequence
  Synthetic
ctgatgcccatgcatgtcaatttttgttccagcttaaaacctgtcaacgggaattgattctacttatgaggcaga

SEQ ID NO: 19817 - DNA, 75 bp, Artificial Sequence
  Synthetic
gttccagcttaaaacctgtcaacgggaattgattctacttatgaggcagaatgccacaacagagctgattagggt

SEQ ID NO: 19818 - DNA, 75 bp, Artificial Sequence
  Synthetic
gatccgagacctcttagggctaatagataatctcgggaagaatcatcccttgattgtgtatgatgttgttgctag

SEQ ID NO: 19819 - DNA, 75 bp, Artificial Sequence
  Synthetic
gataatctcgggaagaatcatcccttgattgtgtatgatgttgttgctagtttagaatcattggcatatggggcc

SEQ ID NO: 19820 - DNA, 75 bp, Artificial Sequence
  Synthetic
gggtttttacacggaccaaacaagttacattactaacattcgattgcttgttaatgtactgcgatctttcagacg

SEQ ID NO: 19821 - DNA, 75 bp, Artificial Sequence
  Synthetic
tacattactaacattcgattgcttgttaatgtactgcgatctttcagacggccggcacaacatcctattcacttg

SEQ ID NO: 19822 - DNA, 75 bp, Artificial Sequence
  Synthetic
cattctggctgagatatatgaatctttagagtcctctctaccaagtggaaatagtgaagcgattgttactcaaat

SEQ ID NO: 19823 - DNA, 75 bp, Artificial Sequence
  Synthetic
ttagagtcctctctaccaagtggaaatagtgaagcgattgttactcaaattaggaacatatatacagggttaaca

SEQ ID NO: 19824 - DNA, 75 bp, Artificial Sequence
  Synthetic
tggtgctaattgattcacttgccgagaaacaccccttaatagtttatgatgtagttgcaagtctggagtcgttat

SEQ ID NO: 19825 - DNA, 75 bp, Artificial Sequence
  Synthetic
gaaacaccccttaatagtttatgatgtagttgcaagtctggagtcgttatcatatggtgctatacagctacatga

SEQ ID NO: 19826 - DNA, 75 bp, Artificial Sequence
  Synthetic
tgcattaagcagtatagatgcagcaaataaggtgcggcaaagtatgtgcgcagggaaactgttaaaatttgatac

SEQ ID NO: 19827 - DNA, 75 bp, Artificial Sequence
  Synthetic
aataaggtgcggcaaagtatgtgcgcagggaaactgttaaaatttgatacgatccaactggtattagccttcttc

SEQ ID NO: 19828 - DNA, 75 bp, Artificial Sequence
  Synthetic
tacaggattccttagaaacagtgttggatcaaggtaatagtgaatctatcatatcccaaataaggaacatatact

SEQ ID NO: 19829 - DNA, 75 bp, Artificial Sequence
  Synthetic
ggatcaaggtaatagtgaatctatcatatcccaaataaggaacatatactcaggtctcacagtaaacgaggctgc

SEQ ID NO: 19830 - DNA, 75 bp, Artificial Sequence
  Synthetic
aaatgtggatagtaattcaatcttaggaacagatcttaagaggatgtattatgatcaatgtgaaatcccccatga

SEQ ID NO: 19831 - DNA, 75 bp, Artificial Sequence
  Synthetic
ggaacagatcttaagaggatgtattatgatcaatgtgaaatcccccatgagtttacacttaaacattatcatact

SEQ ID NO: 19832 - DNA, 75 bp, Artificial Sequence
  Synthetic
tagacgctgcaagcaaggtgagacagagtatgtgcgctggcaagctgcttaaatttgatacgatccagttagtcc

SEQ ID NO: 19833 - DNA, 75 bp, Artificial Sequence
  Synthetic
gagtatgtgcgctggcaagctgcttaaatttgatacgatccagttagtccttgcattcttcaatacactaataat

SEQ ID NO: 19834 - DNA, 75 bp, Artificial Sequence
  Synthetic
attaaacatatttcttaaagataaggcaattgcattccctaagtcaaagtggacatctccttttaaagccgatat

SEQ ID NO: 19835 - DNA, 75 bp, Artificial Sequence
  Synthetic
gcaattgcattccctaagtcaaagtggacatctccttttaaagccgatatcacacctaaacaattactcatccct

SEQ ID NO: 19836 - DNA, 75 bp, Artificial Sequence
  Synthetic
actctataattgggaatgaactcaagcggatgtattttgatcaatgtgagatcccccacgacttcacattaaaga

SEQ ID NO: 19837 - DNA, 75 bp, Artificial Sequence
  Synthetic
gcggatgtattttgatcaatgtgagatcccccacgacttcacattaaagaactaccgggaattaagtcttcttga

SEQ ID NO: 19838 - DNA, 75 bp, Artificial Sequence
  Synthetic
agatgagttttctatcgaatcagaattagaatatgttacaaccaaagcatatctcgaagatgatgagttcaatgt

SEQ ID NO: 19839 - DNA, 75 bp, Artificial Sequence
  Synthetic
ttagaatatgttacaaccaaagcatatctcgaagatgatgagttcaatgtatcatactctctcaaggagaaagaa

SEQ ID NO: 19840 - DNA, 75 bp, Artificial Sequence
  Synthetic
taaaagataaggcaatagcattcccgaagtccaggtggacatctcctttcaaagcagatatcacaccgcgccatt

SEQ ID NO: 19841 - DNA, 75 bp, Artificial Sequence
  Synthetic
gaagtccaggtggacatctcctttcaaagcagatatcacaccgcgccatttgctgcaagcgcctgagtttaaaac

SEQ ID NO: 19842 - DNA, 75 bp, Artificial Sequence
  Synthetic
ttgtcaagtaatctttgaagagctccttgccgaacatgtgtccccccttttcaaagacaacggtgtaactatggc

SEQ ID NO: 19843 - DNA, 75 bp, Artificial Sequence
  Synthetic
cttgccgaacatgtgtccccccttttcaaagacaacggtgtaactatggctgaattatcattgaccaaaagccta

SEQ ID NO: 19844 - DNA, 75 bp, Artificial Sequence
  Synthetic
tcgaatcagaactagaatatgtgactaccctggcttacctggatgatgatgagttcaacgtatcttactccctca

SEQ ID NO: 19845 - DNA, 75 bp, Artificial Sequence
  Synthetic
taccctggcttacctggatgatgatgagttcaacgtatcttactccctcaaagagaaggaggtaaagacagatgg

SEQ ID NO: 19846 - DNA, 75 bp, Artificial Sequence
  Synthetic
gggcgacagaaattcaagatttactcatgctcattttattacaactgacttacaaaagtactgtcttaattggag

SEQ ID NO: 19847 - DNA, 75 bp, Artificial Sequence
  Synthetic
catgctcattttattacaactgacttacaaaagtactgtcttaattggagatatcaaagcgtgaagctctttgca

SEQ ID NO: 19848 - DNA, 75 bp, Artificial Sequence
  Synthetic
tcgaagaattgctagcagagcatgtctctccattatttaaagacaacggcgttactatggccgaattgtcactta

SEQ ID NO: 19849 - DNA, 75 bp, Artificial Sequence
  Synthetic
ctctccattatttaaagacaacggcgttactatggccgaattgtcacttactaagagcctactcgctattagcaa

SEQ ID NO: 19850 - DNA, 75 bp, Artificial Sequence
  Synthetic
ttgtatcctcatgcagtccaccatgtatgtagctgatcccttcaatcctccaaacgggaacgcaagcccaaattt

SEQ ID NO: 19851 - DNA, 75 bp, Artificial Sequence
  Synthetic
tatgtagctgatcccttcaatcctccaaacgggaacgcaagcccaaatttagatgataacccaaataatgacatc

SEQ ID NO: 19852 - DNA, 75 bp, Artificial Sequence
  Synthetic
caagattcacgcatgcgcacttcataacaactgacctgcaaaagtactgtttaaactggaggtaccagagtgtaa

SEQ ID NO: 19853 - DNA, 75 bp, Artificial Sequence
  Synthetic
aacaactgacctgcaaaagtactgtttaaactggaggtaccagagtgtaaaactgttcgcacgtcaattgaaccg

SEQ ID NO: 19854 - DNA, 75 bp, Artificial Sequence
  Synthetic
gacaattatatcaatctcagcaattcatgcagctgcagctgtagcaggcctaagagtcgcatcaatggttcaagg

SEQ ID NO: 19855 - DNA, 75 bp, Artificial Sequence
  Synthetic
catgcagctgcagctgtagcaggcctaagagtcgcatcaatggttcaaggtgacaaccaggttatcggtgtcact

SEQ ID NO: 19856 - DNA, 75 bp, Artificial Sequence
  Synthetic
agtccactatgtatgtcgcagacccctttaaccctccacatagcaatgcacgtgaggcactcgatgacaacttaa

SEQ ID NO: 19857 - DNA, 75 bp, Artificial Sequence
  Synthetic
ctttaaccctccacatagcaatgcacgtgaggcactcgatgacaacttaaatagcgacatattcattgtatcacc

SEQ ID NO: 19858 - DNA, 75 bp, Artificial Sequence
  Synthetic
tgcatcattagaaaactttacacaaatattcaaggagataaattatgggcttggccataacctcaaattacggga

SEQ ID NO: 19859 - DNA, 75 bp, Artificial Sequence
  Synthetic
atattcaaggagataaattatgggcttggccataacctcaaattacgggaaacaattaagtctagtcacatgttc

SEQ ID NO: 19860 - DNA, 75 bp, Artificial Sequence
  Synthetic
tctcggcgatccatgcatccgctgctgtggctgggctacgggtggcatctatggtccaaggtgataaccaagtta

SEQ ID NO: 19861 - DNA, 75 bp, Artificial Sequence
  Synthetic
tgtggctgggctacgggtggcatctatggtccaaggtgataaccaagttattggggtaacacgcgagttcctagc

SEQ ID NO: 19862 - DNA, 75 bp, Artificial Sequence
  Synthetic
aaagaatataagtaaactaactttgtcggcaactacaacaggggagaattgcttaactagctgtggggacttatc

SEQ ID NO: 19863 - DNA, 75 bp, Artificial Sequence
  Synthetic
tcggcaactacaacaggggagaattgcttaactagctgtggggacttatcttcatgtattacccgctgtattgag

SEQ ID NO: 19864 - DNA, 75 bp, Artificial Sequence
  Synthetic
acttcactcagatattcaaggaagtcaactacgggctaggtcataatctcaagctgagggaaacaatcaagtcga

SEQ ID NO: 19865 - DNA, 75 bp, Artificial Sequence
  Synthetic
caactacgggctaggtcataatctcaagctgagggaaacaatcaagtcgagccacatgttcatctactcaaagag

SEQ ID NO: 19866 - DNA, 75 bp, Artificial Sequence
  Synthetic
gactcagatacttgcagaccatttttactcaatacttggtgggtgcttcactgggctaaatcaacatgatattcg

SEQ ID NO: 19867 - DNA, 75 bp, Artificial Sequence
  Synthetic
tactcaatacttggtgggtgcttcactgggctaaatcaacatgatattcgcttactgctctctgatggttctata

SEQ ID NO: 19868 - DNA, 75 bp, Artificial Sequence
  Synthetic
agttaaccctatcagctacaactacaggggagaactgtttaacgagttgcggggacctatcatcatgcatcacac

SEQ ID NO: 19869 - DNA, 75 bp, Artificial Sequence
  Synthetic
aggggagaactgtttaacgagttgcggggacctatcatcatgcatcacacgatgtatagagaatgggttccctaa

SEQ ID NO: 19870 - DNA, 75 bp, Artificial Sequence
  Synthetic
ctgtagaaatataggtgaccctctagtagcctcaattgcagatacaaaacgctatgtgaaatgcggccttttgac

SEQ ID NO: 19871 - DNA, 75 bp, Artificial Sequence
  Synthetic
gtagcctcaattgcagatacaaaacgctatgtgaaatgcggccttttgactccatctatacttgactcagtcgtc

SEQ ID NO: 19872 - DNA, 75 bp, Artificial Sequence
  Synthetic
ccgatcacttttattccatccttggaggatgtttctctgggttgaaccaggcggatatccgtctccttctatatg

SEQ ID NO: 19873 - DNA, 75 bp, Artificial Sequence
  Synthetic
aggatgtttctctgggttgaaccaggcggatatccgtctccttctatatgagggtgcaattttaccggcacaatt

SEQ ID NO: 19874 - DNA, 75 bp, Artificial Sequence
  Synthetic
ttcaatcaatctcgattatattcaacagccagaaacccgcttaaaacgtcatgtgcagaaagttctccttcaaga

SEQ ID NO: 19875 - DNA, 75 bp, Artificial Sequence
  Synthetic
cagccagaaacccgcttaaaacgtcatgtgcagaaagttctccttcaagaatcagtaaatcctctactgcagggc

SEQ ID NO: 19876 - DNA, 75 bp, Artificial Sequence
  Synthetic
gtgacccattagtcgcgtccatcgcagacaccaagagatttgtgaagtgccaactgctcgttcctcacattttag

SEQ ID NO: 19877 - DNA, 75 bp, Artificial Sequence
  Synthetic
agacaccaagagatttgtgaagtgccaactgctcgttcctcacattttagactctgtcgttgctattaccgatag

SEQ ID NO: 19878 - DNA, 75 bp, Artificial Sequence
  Synthetic
attagacagagatattgtgatgccccgtgtagctcacgcaatttttgaatgtacgagtctcggacgccgtagaca

SEQ ID NO: 19879 - DNA, 75 bp, Artificial Sequence
  Synthetic
cgtgtagctcacgcaatttttgaatgtacgagtctcggacgccgtagacacatacaggggctgattgatacaaca

SEQ ID NO: 19880 - DNA, 75 bp, Artificial Sequence
  Synthetic
attatatccagcaaccagagacacgattgaagcgacatgtgcaaaaggttttactacaagagtcagtgaatccgc

SEQ ID NO: 19881 - DNA, 75 bp, Artificial Sequence
  Synthetic
attgaagcgacatgtgcaaaaggttttactacaagagtcagtgaatccgctactccaaggggtcttcctagagtc

SEQ ID NO: 19882 - DNA, 75 bp, Artificial Sequence
  Synthetic
gcgtgagcaaatagttacgtataatgcaacctatatgaggtccttaacacaaatgcttaaattaagcagaactgt

SEQ ID NO: 19883 - DNA, 75 bp, Artificial Sequence
  Synthetic
gcaacctatatgaggtccttaacacaaatgcttaaattaagcagaactgttcataaggggatgaccaggatgctg

SEQ ID NO: 19884 - DNA, 75 bp, Artificial Sequence
  Synthetic
tcgtaatgccaagggttgcgcacgctatatttgagtgtaccagcttaggtaggcgccgacatatccagggcctca

SEQ ID NO: 19885 - DNA, 75 bp, Artificial Sequence
  Synthetic
tatatttgagtgtaccagcttaggtaggcgccgacatatccagggcctcatcgacacgacaaagaccattattgc

SEQ ID NO: 19886 - DNA, 75 bp, Artificial Sequence
  Synthetic
gcgtgcaagctgggctccgctgctaaattggcgcaccttggaagggcttgaggtccctgatccaattgaatccgt

SEQ ID NO: 19887 - DNA, 75 bp, Artificial Sequence
  Synthetic
aattggcgcaccttggaagggcttgaggtccctgatccaattgaatccgtgtctggataccttggtcttgactcc

SEQ ID NO: 19888 - DNA, 75 bp, Artificial Sequence
  Synthetic
tgacgtacaatgcaacttatatgaggtccttagcaagcatgctcagttcaagccataatcagacacgtcggtctg

SEQ ID NO: 19889 - DNA, 75 bp, Artificial Sequence
  Synthetic
gtccttagcaagcatgctcagttcaagccataatcagacacgtcggtctgtgattggtcacgcatccttcaatat

SEQ ID NO: 19890 - DNA, 75 bp, Artificial Sequence
  Synthetic
cctccccaaattgtgccattttgacgattcgagacaatcatactcaacccaacgtgtaccttatataggttcaaa

SEQ ID NO: 19891 - DNA, 75 bp, Artificial Sequence
  Synthetic
gattcgagacaatcatactcaacccaacgtgtaccttatataggttcaaaaacagatgagagacaaatgtctaca

SEQ ID NO: 19892 - DNA, 75 bp, Artificial Sequence
  Synthetic
cgcccttgctgaattggcggtcattagaaggcttagaagtacccgaccctattgagtcagtagccggctacctgg

SEQ ID NO: 19893 - DNA, 75 bp, Artificial Sequence
  Synthetic
agaaggcttagaagtacccgaccctattgagtcagtagccggctacctgggtttggattctaacaactgtttctt

SEQ ID NO: 19894 - DNA, 75 bp, Artificial Sequence
  Synthetic
agcgtcattatatatatgggcatatggtgattcggaagacagctgggatgcagtagaatcactatcaaatagccg

SEQ ID NO: 19895 - DNA, 75 bp, Artificial Sequence
  Synthetic
ggtgattcggaagacagctgggatgcagtagaatcactatcaaatagccgatgccaaattacacgagagcaattg

SEQ ID NO: 19896 - DNA, 75 bp, Artificial Sequence
  Synthetic
gccattttgatgattcgagacaatctaactccatacaaagggtaccttacattggttctaagactgacgagcgcc

SEQ ID NO: 19897 - DNA, 75 bp, Artificial Sequence
  Synthetic
taactccatacaaagggtaccttacattggttctaagactgacgagcgccagatgtctacgataaatctacttga

SEQ ID NO: 19898 - DNA, 75 bp, Artificial Sequence
  Synthetic
tgacggtattacccaagttaagttcatgccatcaacaaacagcagagtatccagatttgtacatatttctaatga

SEQ ID NO: 19899 - DNA, 75 bp, Artificial Sequence
  Synthetic
atgccatcaacaaacagcagagtatccagatttgtacatatttctaatgacaggcagaattacgtcctggacgac

SEQ ID NO: 19900 - DNA, 75 bp, Artificial Sequence
  Synthetic
tttgggcctttggggactcagacgatagttgggatgcagtcgagactctatctaacagtcgatgccagatcaccc

SEQ ID NO: 19901 - DNA, 75 bp, Artificial Sequence
  Synthetic
tagttgggatgcagtcgagactctatctaacagtcgatgccagatcacccgagagcacttgcaagctctgtgccc

SEQ ID NO: 19902 - DNA, 75 bp, Artificial Sequence
  Synthetic
gagcatattggagacatactttcgagaaccaacaactgtgaacttgtcgagtatcgtcctccatttgcatactga

SEQ ID NO: 19903 - DNA, 75 bp, Artificial Sequence
  Synthetic
gaaccaacaactgtgaacttgtcgagtatcgtcctccatttgcatactgacgtgtcctgttgtctccgtgaatgc

SEQ ID NO: 19904 - DNA, 75 bp, Artificial Sequence
  Synthetic
aagtgaagtttatgccatcgaccaatagcagggtctctcgatttgttcatatttccaatgaccggcagaattacg

SEQ ID NO: 19905 - DNA, 75 bp, Artificial Sequence
  Synthetic
tagcagggtctctcgatttgttcatatttccaatgaccggcagaattacgtattggatgactccgttactgacag

SEQ ID NO: 19906 - DNA, 75 bp, Artificial Sequence
  Synthetic
aacaatgacaaatccattcctttatgaccaagcacctatcagtgaagcagatctatgtcggctttcgaaggtagc

SEQ ID NO: 19907 - DNA, 75 bp, Artificial Sequence
  Synthetic
gaccaagcacctatcagtgaagcagatctatgtcggctttcgaaggtagccttccgtaaagcaggagacaattat

SEQ ID NO: 19908 - DNA, 75 bp, Artificial Sequence
  Synthetic
catatttcagagaacctacagcgacgaacttatcaagcttggtgctgcaccttcacactgatgtatcttgttgct

SEQ ID NO: 19909 - DNA, 75 bp, Artificial Sequence
  Synthetic
gaacttatcaagcttggtgctgcaccttcacactgatgtatcttgttgcttacgagaatgcccgatgacacaata

SEQ ID NO: 19910 - DNA, 75 bp, Artificial Sequence
  Synthetic
gaaggatgttgcggcaactatttttggaccacttgcggcagtatctgcaaaaaatgatgcaattgttactaatga

SEQ ID NO: 19911 - DNA, 75 bp, Artificial Sequence
  Synthetic
ggaccacttgcggcagtatctgcaaaaaatgatgcaattgttactaatgactacagtggtaactggatctcagag

SEQ ID NO: 19912 - DNA, 75 bp, Artificial Sequence
  Synthetic
ctttcttatttgatcaagaacctattagcgaagcagacctgtgtagactctcaaagatagcattccgtagagcag

SEQ ID NO: 19913 - DNA, 75 bp, Artificial Sequence
  Synthetic
tagcgaagcagacctgtgtagactctcaaagatagcattccgtagagcaggagacaactacgatgcatacgacca

SEQ ID NO: 19914 - DNA, 75 bp, Artificial Sequence
  Synthetic
tttactaatatttgcttaccaactctactatctaaggattaggtataagcaaaacatcatttgttacatggagtc

SEQ ID NO: 19915 - DNA, 75 bp, Artificial Sequence
  Synthetic
tactatctaaggattaggtataagcaaaacatcatttgttacatggagtctgtattccgccgttgccactcatta

SEQ ID NO: 19916 - DNA, 75 bp, Artificial Sequence
  Synthetic
caacaatctttggtcctctagctgcagtatcagcaaaaaatgatgcaatagtcacaaatgactatagcgggaatt

SEQ ID NO: 19917 - DNA, 75 bp, Artificial Sequence
  Synthetic
agtatcagcaaaaaatgatgcaatagtcacaaatgactatagcgggaattggatttccgagtttaggtatagtga

SEQ ID NO: 19918 - DNA, 75 bp, Artificial Sequence
  Synthetic
attaaatgctgcaggcttcaacttgatgttggataggagtgatttgaagaataaccaattgtctcgcctagccgt

SEQ ID NO: 19919 - DNA, 75 bp, Artificial Sequence
  Synthetic
atgttggataggagtgatttgaagaataaccaattgtctcgcctagccgtcaagtatctcacgctctgtgtccag

SEQ ID NO: 19920 - DNA, 75 bp, Artificial Sequence
  Synthetic
cgtatcaactttactacctacggatacggtaccggcaaaatattgtatgctatatggaatctgtattccgacgtt

SEQ ID NO: 19921 - DNA, 75 bp, Artificial Sequence
  Synthetic
acggtaccggcaaaatattgtatgctatatggaatctgtattccgacgttgtcattctttatgcttgggcgactt

SEQ ID NO: 19922 - DNA, 75 bp, Artificial Sequence
  Synthetic
aggtcaactcgatgatgacatctcgtttcaggtagcgcattttctatgtagaaggctttgcattctaagtcttgt

SEQ ID NO: 19923 - DNA, 75 bp, Artificial Sequence
  Synthetic
tttcaggtagcgcattttctatgtagaaggctttgcattctaagtcttgtacactcaaatttacagaatctcccc

SEQ ID NO: 19924 - DNA, 75 bp, Artificial Sequence
  Synthetic
gctttaatcttaccttggatcgaagtgatttgaaggagaatcaactctcgcggcttgctgtgaaatacctcacat

SEQ ID NO: 19925 - DNA, 75 bp, Artificial Sequence
  Synthetic
tgatttgaaggagaatcaactctcgcggcttgctgtgaaatacctcacattgtgtgtccagactgcaataagtaa

SEQ ID NO: 19926 - DNA, 75 bp, Artificial Sequence
  Synthetic
tctcaaactggttgctacaactttgaatgatcgagaccaatcgtatctgttaaagctgttaaataacccaaattt

SEQ ID NO: 19927 - DNA, 75 bp, Artificial Sequence
  Synthetic
aatgatcgagaccaatcgtatctgttaaagctgttaaataacccaaatttggaattacacacaccgcaagtctac

SEQ ID NO: 19928 - DNA, 75 bp, Artificial Sequence
  Synthetic
atgacatatcattccaagttgcccacttcctctgtcgacgactgtgcatcatcagcttggtccactcaaatgtac

SEQ ID NO: 19929 - DNA, 75 bp, Artificial Sequence
  Synthetic
cttcctctgtcgacgactgtgcatcatcagcttggtccactcaaatgtacagaacttacccccgattagggataa

SEQ ID NO: 19930 - DNA, 75 bp, Artificial Sequence
  Synthetic
atacaaacaaccttttccaacatcacctattgtaccattccctaatctgagtgggtctaagtggcaccttgaacg

SEQ ID NO: 19931 - DNA, 75 bp, Artificial Sequence
  Synthetic
cctattgtaccattccctaatctgagtgggtctaagtggcaccttgaacgtgttatagacagtattgaggcacca

SEQ ID NO: 19932 - DNA, 75 bp, Artificial Sequence
  Synthetic
ctaccacactcaataatagggaccagtcgtatctgctaacactactgaataagcctaacatcgagcttcatactc

SEQ ID NO: 19933 - DNA, 75 bp, Artificial Sequence
  Synthetic
gtcgtatctgctaacactactgaataagcctaacatcgagcttcatactccacaggtttacttcattatgaggaa

SEQ ID NO: 19934 - DNA, 75 bp, Artificial Sequence
  Synthetic
tgtatcccccaatccaagcagaattcttgacaaaatcaacttgtttagatcactgagccccagacactcagtttg

SEQ ID NO: 19935 - DNA, 75 bp, Artificial Sequence
  Synthetic
cttgacaaaatcaacttgtttagatcactgagccccagacactcagtttggtaccgtaatcgtcaatacaaactt

SEQ ID NO: 19936 - DNA, 75 bp, Artificial Sequence
  Synthetic
ttccaacctccccagtagtatcactaccaaataagtgcaaatcgaaatggaagcttgaggaggtaattgacagca

SEQ ID NO: 19937 - DNA, 75 bp, Artificial Sequence
  Synthetic
accaaataagtgcaaatcgaaatggaagcttgaggaggtaattgacagcattgagtcacctaagtcttttaactg

SEQ ID NO: 19938 - DNA, 75 bp, Artificial Sequence
  Synthetic
aggtgaaggagggggctcaactatcctcacaattgaaccccacattagaagtgacaaaatatactaccatacata

SEQ ID NO: 19939 - DNA, 75 bp, Artificial Sequence
  Synthetic
ctcacaattgaaccccacattagaagtgacaaaatatactaccatacatacttccctgccgatcagagtccggct

SEQ ID NO: 19940 - DNA, 75 bp, Artificial Sequence
  Synthetic
ctaacagggtcatcgataagataaacattctaagatctctgagcccgcgtcactcagtctggtaccgtaaccggc

SEQ ID NO: 19941 - DNA, 75 bp, Artificial Sequence
  Synthetic
cattctaagatctctgagcccgcgtcactcagtctggtaccgtaaccggcaataccggtacgtgttgagccagtt

SEQ ID NO: 19942 - DNA, 75 bp, Artificial Sequence
  Synthetic
tcactttgaactggaaccatcaggatgtgagtttgtaaattgctggtctgaggatgcaaacgccacaaatcttac

SEQ ID NO: 19943 - DNA, 75 bp, Artificial Sequence
  Synthetic
tgtgagtttgtaaattgctggtctgaggatgcaaacgccacaaatcttacagaacttaggtgtattaaccacatc

SEQ ID NO: 19944 - DNA, 75 bp, Artificial Sequence
  Synthetic
gctccacaatcttgaacatagagccaaaagtcaggagtgataagatatattatcatacctatttctctgcagaca

SEQ ID NO: 19945 - DNA, 75 bp, Artificial Sequence
  Synthetic
aaaagtcaggagtgataagatatattatcatacctatttctctgcagacaaaagccctgcacagcgcaatttcat

SEQ ID NO: 19946 - DNA, 75 bp, Artificial Sequence
  Synthetic
gctagctagagacacatcaatcaagtcgatagccacagtttatcttaatctaggaattctagctcatgcattgct

SEQ ID NO: 19947 - DNA, 75 bp, Artificial Sequence
  Synthetic
gctagctagagacacatcaatcaagtcgatagccactgtttatcttaatctaggaattctagctcatgcattgct

SEQ ID NO: 19948 - DNA, 75 bp, Artificial Sequence
  Synthetic
gctagctagagacacatcaatcaagtcgatagccaccgtttatcttaatctaggaattctagctcatgcattgct

SEQ ID NO: 19949 - DNA, 75 bp, Artificial Sequence
  Synthetic
gctagctagagacacatcaatcaagtcgatagccacggtttatcttaatctaggaattctagctcatgcattgct

SEQ ID NO: 19950 - DNA, 75 bp, Artificial Sequence
  Synthetic
gctagctagagacacatcaatcaagtcgatagcctcagtttatcttaatctaggaattctagctcatgcattgct

SEQ ID NO: 19951 - DNA, 75 bp, Artificial Sequence
  Synthetic
gctagctagagacacatcaatcaagtcgatagcctctgtttatcttaatctaggaattctagctcatgcattgct

SEQ ID NO: 19952 - DNA, 75 bp, Artificial Sequence
  Synthetic
gctagctagagacacatcaatcaagtcgatagcctccgtttatcttaatctaggaattctagctcatgcattgct

SEQ ID NO: 19953 - DNA, 75 bp, Artificial Sequence
  Synthetic
gctagctagagacacatcaatcaagtcgatagcctcggtttatcttaatctaggaattctagctcatgcattgct

SEQ ID NO: 19954 - DNA, 75 bp, Artificial Sequence
  Synthetic
gctagctagagacacatcaatcaagtcgatagccccagtttatcttaatctaggaattctagctcatgcattgct

SEQ ID NO: 19955 - DNA, 75 bp, Artificial Sequence
  Synthetic
gctagctagagacacatcaatcaagtcgatagcccctgtttatcttaatctaggaattctagctcatgcattgct

SEQ ID NO: 19956 - DNA, 75 bp, Artificial Sequence
  Synthetic
gctagctagagacacatcaatcaagtcgatagcccccgtttatcttaatctaggaattctagctcatgcattgct

SEQ ID NO: 19957 - DNA, 75 bp, Artificial Sequence
  Synthetic
gctagctagagacacatcaatcaagtcgatagccccggtttatcttaatctaggaattctagctcatgcattgct

SEQ ID NO: 19958 - DNA, 75 bp, Artificial Sequence
  Synthetic
gctagctagagacacatcaatcaagtcgatagccgcagtttatcttaatctaggaattctagctcatgcattgct

SEQ ID NO: 19959 - DNA, 75 bp, Artificial Sequence
  Synthetic
gctagctagagacacatcaatcaagtcgatagccgctgtttatcttaatctaggaattctagctcatgcattgct

SEQ ID NO: 19960 - DNA, 75 bp, Artificial Sequence
  Synthetic
gctagctagagacacatcaatcaagtcgatagccgccgtttatcttaatctaggaattctagctcatgcattgct

SEQ ID NO: 19961 - DNA, 75 bp, Artificial Sequence
  Synthetic
gctagctagagacacatcaatcaagtcgatagccgcggtttatcttaatctaggaattctagctcatgcattgct

SEQ ID NO: 19962 - DNA, 75 bp, Artificial Sequence
  Synthetic
tcgatagccacagtttatcttaatctaggaattctagctcatgcattgcttagtccagggggaatctgcatatgc

SEQ ID NO: 19963 - DNA, 75 bp, Artificial Sequence
  Synthetic
tcgatagccactgtttatcttaatctaggaattctagctcatgcattgcttagtccagggggaatctgcatatgc

SEQ ID NO: 19964 - DNA, 75 bp, Artificial Sequence
  Synthetic
tcgatagccaccgtttatcttaatctaggaattctagctcatgcattgcttagtccagggggaatctgcatatgc

SEQ ID NO: 19965 - DNA, 75 bp, Artificial Sequence
  Synthetic
tcgatagccacggtttatcttaatctaggaattctagctcatgcattgcttagtccagggggaatctgcatatgc

SEQ ID NO: 19966 - DNA, 75 bp, Artificial Sequence
  Synthetic
tcgatagcctcagtttatcttaatctaggaattctagctcatgcattgcttagtccagggggaatctgcatatgc

SEQ ID NO: 19967 - DNA, 75 bp, Artificial Sequence
  Synthetic
tcgatagcctctgtttatcttaatctaggaattctagctcatgcattgcttagtccagggggaatctgcatatgc

SEQ ID NO: 19968 - DNA, 75 bp, Artificial Sequence
  Synthetic
tcgatagcctccgtttatcttaatctaggaattctagctcatgcattgcttagtccagggggaatctgcatatgc

SEQ ID NO: 19969 - DNA, 75 bp, Artificial Sequence
  Synthetic
tcgatagcctcggtttatcttaatctaggaattctagctcatgcattgcttagtccagggggaatctgcatatgc

SEQ ID NO: 19970 - DNA, 75 bp, Artificial Sequence
  Synthetic
tcgatagccccagtttatcttaatctaggaattctagctcatgcattgcttagtccagggggaatctgcatatgc

SEQ ID NO: 19971 - DNA, 75 bp, Artificial Sequence
  Synthetic
tcgatagcccctgtttatcttaatctaggaattctagctcatgcattgcttagtccagggggaatctgcatatgc

SEQ ID NO: 19972 - DNA, 75 bp, Artificial Sequence
  Synthetic
tcgatagcccccgtttatcttaatctaggaattctagctcatgcattgcttagtccagggggaatctgcatatgc

SEQ ID NO: 19973 - DNA, 75 bp, Artificial Sequence
  Synthetic
tcgatagccccggtttatcttaatctaggaattctagctcatgcattgcttagtccagggggaatctgcatatgc

SEQ ID NO: 19974 - DNA, 75 bp, Artificial Sequence
  Synthetic
tcgatagccgcagtttatcttaatctaggaattctagctcatgcattgcttagtccagggggaatctgcatatgc

SEQ ID NO: 19975 - DNA, 75 bp, Artificial Sequence
  Synthetic
tcgatagccgctgtttatcttaatctaggaattctagctcatgcattgcttagtccagggggaatctgcatatgc

SEQ ID NO: 19976 - DNA, 75 bp, Artificial Sequence
  Synthetic
tcgatagccgccgtttatcttaatctaggaattctagctcatgcattgcttagtccagggggaatctgcatatgc

SEQ ID NO: 19977 - DNA, 75 bp, Artificial Sequence
  Synthetic
tcgatagccgcggtttatcttaatctaggaattctagctcatgcattgcttagtccagggggaatctgcatatgc

SEQ ID NO: 19978 - DNA, 75 bp, Artificial Sequence
  Synthetic
agccgtctggatgtgagttcatcaattgttggtccgaggatgtaaatgcaacgaatcttacggaactgcgttgca

SEQ ID NO: 19979 - DNA, 75 bp, Artificial Sequence
  Synthetic
ttgttggtccgaggatgtaaatgcaacgaatcttacggaactgcgttgcataaatcacatattaactgtgattcc

SEQ ID NO: 19980 - DNA, 75 bp, Artificial Sequence
  Synthetic
aaaaacattgtcaagcaagctggcaatttcattctctggatttagcggtgtgaatgatccttcttgtgtggttgg

SEQ ID NO: 19981 - DNA, 75 bp, Artificial Sequence
  Synthetic
atttcattctctggatttagcggtgtgaatgatccttcttgtgtggttggaactaccaaggaaagcactattagc

SEQ ID NO: 19982 - DNA, 75 bp, Artificial Sequence
  Synthetic
cgtcaatacaatcagtggccaccgcatacatgaacttaagcattcttgcacatgctctcctcaaccagggaggcg

SEQ ID NO: 19983 - DNA, 75 bp, Artificial Sequence
  Synthetic
atacatgaacttaagcattcttgcacatgctctcctcaaccagggaggcgtatgcatctgtaggtgccacctgtt

SEQ ID NO: 19984 - DNA, 75 bp, Artificial Sequence
  Synthetic
atacatgaacttaagcattcttgcacatgctctcctcaaccagggaggcgtttgcatctgtaggtgccacctgtt

SEQ ID NO: 19985 - DNA, 75 bp, Artificial Sequence
  Synthetic
atacatgaacttaagcattcttgcacatgctctcctcaaccagggaggcgtctgcatctgtaggtgccacctgtt

SEQ ID NO: 19986 - DNA, 75 bp, Artificial Sequence
  Synthetic
atacatgaacttaagcattcttgcacatgctctcctcaaccagggaggcgtgtgcatctgtaggtgccacctgtt

SEQ ID NO: 19987 - DNA, 75 bp, Artificial Sequence
  Synthetic
gaatgaagtaccgattccccaagaggtattgacattactatcttgttacacagagcagctagggaacttagggca

SEQ ID NO: 19988 - DNA, 75 bp, Artificial Sequence
  Synthetic
gtattgacattactatcttgttacacagagcagctagggaacttagggcaattgattgagaaaacctggatccgc

SEQ ID NO: 19989 - DNA, 75 bp, Artificial Sequence
  Synthetic
gccagctggcgatttcgttttcaggatattgtggaaccaatgacccatcttgtgtcataggagtcacgaaagagt

SEQ ID NO: 19990 - DNA, 75 bp, Artificial Sequence
  Synthetic
atattgtggaaccaatgacccatcttgtgtcataggagtcacgaaagagtgctccattagcctggatgtcttaag

SEQ ID NO: 19991 - DNA, 75 bp, Artificial Sequence
  Synthetic
tttgggaaatgatgcattgagtgacgtagacaatttcctgaactattacaacccatcatgctcatcagttccaga

SEQ ID NO: 19992 - DNA, 75 bp, Artificial Sequence
  Synthetic
gtagacaatttcctgaactattacaacccatcatgctcatcagttccagaactaattacacctacagttagttca

SEQ ID NO: 19993 - DNA, 75 bp, Artificial Sequence
  Synthetic
tccctcaatcattattaacgctactagggtgttatcaagaccagttagagagccttagtgcactcattgaaaaaa

SEQ ID NO: 19994 - DNA, 75 bp, Artificial Sequence
  Synthetic
agggtgttatcaagaccagttagagagccttagtgcactcattgaaaaaacatggatccaggagatccgggaggc

SEQ ID NO: 19995 - DNA, 75 bp, Artificial Sequence
  Synthetic
atctaattataaacgaacaattcaggtagggcaggcatataacattacagtttctggcaaagtaagcactatgat

SEQ ID NO: 19996 - DNA, 75 bp, Artificial Sequence
  Synthetic
gtagggcaggcatataacattacagtttctggcaaagtaagcactatgataaggacctgttgcgaacaatgcatt

SEQ ID NO: 19997 - DNA, 75 bp, Artificial Sequence
  Synthetic
cgctgggcgatgtcgacacatttatcagttatcgcaatgattcgtgtaattccatccctgatctactgacgccag

SEQ ID NO: 19998 - DNA, 75 bp, Artificial Sequence
  Synthetic
cagttatcgcaatgattcgtgtaattccatccctgatctactgacgccagctgtgagtgccctcttatttgaatt

SEQ ID NO: 19999 - DNA, 75 bp, Artificial Sequence
  Synthetic
tcttgttagaggcattcgcgatgggtcattcactctaggctcgatcataagccaaaaccaaatactaaaagcatc

SEQ ID NO: 20000 - DNA, 75 bp, Artificial Sequence
  Synthetic
tcattcactctaggctcgatcataagccaaaaccaaatactaaaagcatccagagcaccacgttacctcaaaaca

SEQ ID NO: 20001 - DNA, 75 bp, Artificial Sequence
  Synthetic
gtgtaatcagcattggccaagcttttaacctgactatttcgggaaaagttaatacgatgatcagatcatgctgtg

SEQ ID NO: 20002 - DNA, 75 bp, Artificial Sequence
  Synthetic
taacctgactatttcgggaaaagttaatacgatgatcagatcatgctgtgagcagtgcattaagttattagctgc

SEQ ID NO: 20003 - DNA, 75 bp, Artificial Sequence
  Synthetic
agtcttctcacgccattatagaaaggtcctcttacgatcaatccgccttttgtcactctacaagtatctccagga

SEQ ID NO: 20004 - DNA, 75 bp, Artificial Sequence
  Synthetic
gtcctcttacgatcaatccgccttttgtcactctacaagtatctccaggacaagacgaagtagataaccatttat

SEQ ID NO: 20005 - DNA, 75 bp, Artificial Sequence
  Synthetic
ttagagatggttcttttgctttggggttgttaatcacccagcgtcaaatactcaaggcatcgagagcaccaaagt

SEQ ID NO: 20006 - DNA, 75 bp, Artificial Sequence
  Synthetic
gttgttaatcacccagcgtcaaatactcaaggcatcgagagcaccaaagtacctcaaaacgcatcaggtccagaa

SEQ ID NO: 20007 - DNA, 75 bp, Artificial Sequence
  Synthetic
agaatcttggattccatccggggctgtgctgacataatatgtaaatatgtaatatattggttactggacataatc

SEQ ID NO: 20008 - DNA, 75 bp, Artificial Sequence
  Synthetic
gtgctgacataatatgtaaatatgtaatatattggttactggacataatcaatgaggcttctgtagtatttatcc

SEQ ID NO: 20009 - DNA, 75 bp, Artificial Sequence
  Synthetic
actaccggaaagtgctattgagaactctacggctgttatccctctacgggctcctgcagcagaaggaaagttgat

SEQ ID NO: 20010 - DNA, 75 bp, Artificial Sequence
  Synthetic
tctacggctgttatccctctacgggctcctgcagcagaaggaaagttgatcatgatagatgtctctctgatttcg

SEQ ID NO: 20011 - DNA, 75 bp, Artificial Sequence
  Synthetic
actaaaaatgataaccagttgaatctggaccgaactggcaattgcataaaaaataaaaaatttattaaaattaaa

SEQ ID NO: 20012 - DNA, 75 bp, Artificial Sequence
  Synthetic
tggaccgaactggcaattgcataaaaaataaaaaatttattaaaattaaaattgaaatcatataacaacacgttt

SEQ ID NO: 20013 - DNA, 75 bp, Artificial Sequence
  Synthetic
ataggctaacctcggtccggagtattgaggtaatggggagactcgtaattggagaaagaagaagaacggggcaga

SEQ ID NO: 20014 - DNA, 75 bp, Artificial Sequence
  Synthetic
tgaggtaatggggagactcgtaattggagaaagaagaagaacggggcagataccagaccccgggatacactacta

SEQ ID NO: 20015 - DNA, 75 bp, Artificial Sequence
  Synthetic
taaaacaaaaaataaaaataaaaatgggaataaaaataaaaataaaaataaagaaaaaaatgggagaaaagctcc

SEQ ID NO: 20016 - DNA, 75 bp, Artificial Sequence
  Synthetic
gggaataaaaataaaaataaaaataaagaaaaaaatgggagaaaagctccaattaacaaacaaatcaaaactaaa

SEQ ID NO: 20017 - DNA, 75 bp, Artificial Sequence
  Synthetic
aacaataacactgatagtgtaacactgaatattgtaaacagtctcagggattatttaattaaaaagacattgcgg

SEQ ID NO: 20018 - DNA, 75 bp, Artificial Sequence
  Synthetic
tgaatattgtaaacagtctcagggattatttaattaaaaagacattgcggatcatcatgtcaggcctgaaccaat

SEQ ID NO: 20019 - DNA, 75 bp, Artificial Sequence
  Synthetic
tagaatcgtaaataagaccggcagtcagtttagtatggaaaataagacccagattacttacacatcctgccttag

SEQ ID NO: 20020 - DNA, 75 bp, Artificial Sequence
  Synthetic
cagtttagtatggaaaataagacccagattacttacacatcctgccttagtttcccccttatttaattttaagtg

SEQ ID NO: 20021 - DNA, 75 bp, Artificial Sequence
  Synthetic
caagatgattagtactcttagatgttactaagtatcaggatttagcgtactagattaaacgtctttgaaagtcat

SEQ ID NO: 20022 - DNA, 75 bp, Artificial Sequence
  Synthetic
tactaagtatcaggatttagcgtactagattaaacgtctttgaaagtcattttaccctgcaaggtgcataagcat

SEQ ID NO: 20023 - DNA, 75 bp, Artificial Sequence
  Synthetic
atctcaatcttgatgtctccaatcaattaaaaccggttgtttaattaagttgttcctaatcaattcacctcagta

SEQ ID NO: 20024 - DNA, 75 bp, Artificial Sequence
  Synthetic
gccaccaactgagtgcactgggagtctgattgagctgaatcaacctaaagctcaagctttcctgtgatgtagcat

SEQ ID NO: 20025 - DNA, 75 bp, Artificial Sequence
  Synthetic
ctgattgagctgaatcaacctaaagctcaagctttcctgtgatgtagcatgcagtgtgctactgctgcatagagc

SEQ ID NO: 20026 - DNA, 75 bp, Artificial Sequence
  Synthetic
aaacgactgtaataggtcgaatgcggcctcgatcaacagagtaacaaacattacaaattacaaatcagagttgtt

SEQ ID NO: 20027 - DNA, 75 bp, Artificial Sequence
  Synthetic
gcctcgatcaacagagtaacaaacattacaaattacaaatcagagttgttaattaaaccatttatataacttttt

SEQ ID NO: 20028 - DNA, 75 bp, Artificial Sequence
  Synthetic
acgaaaaagaagaataaaaggcagaagccttttaaaaggaaccctgggctgtcgtaggtgtgggaaggttgtatt

SEQ ID NO: 20029 - DNA, 75 bp, Artificial Sequence
  Synthetic
agctcactgctacacccaccatgcaaatacaaggatatgtaggtccatcaccctgcttgctaatgtggtcggctc

SEQ ID NO: 20030 - DNA, 75 bp, Artificial Sequence
  Synthetic
aatacaaggatatgtaggtccatcaccctgcttgctaatgtggtcggctccaggaccatggccatagcgctatcc

SEQ ID NO: 20031 - DNA, 75 bp, Artificial Sequence
  Synthetic
aaggatcatcggtccctggcagggggatgccttaaagtcaacattcctatgcttgtcactgcatctgaagatccc

SEQ ID NO: 20032 - DNA, 75 bp, Artificial Sequence
  Synthetic
atgcacctgctcaatccaatgacaaactacaacaacacgagatcattatggggtcgattcccttgaatcagaaag

SEQ ID NO: 20033 - DNA, 75 bp, Artificial Sequence
  Synthetic
gtaaaaacggcagcggagatggagaataccagacctaatcggcaaagaacaaaaggttgaagactgatttaaaaa

SEQ ID NO: 20034 - DNA, 75 bp, Artificial Sequence
  Synthetic
ctcatcaaccagtgctatccgccagggggcaatactgactctcatgtcactaccatcacaaaatatgagagcaac

SEQ ID NO: 20035 - DNA, 75 bp, Artificial Sequence
  Synthetic
ggggcaatactgactctcatgtcactaccatcacaaaatatgagagcaacggcagctattgctggttccacaaat

SEQ ID NO: 20036 - DNA, 75 bp, Artificial Sequence
  Synthetic
atccttcgaccctaggagcggtctctctgaagaggatgctcaggttttcagagacatggcaaaggacctgccccc

SEQ ID NO: 20037 - DNA, 75 bp, Artificial Sequence
  Synthetic
tctgaagaggatgctcaggttttcagagacatggcaaaggacctgccccctcagttcacctccggatcacccttt

SEQ ID NO: 20038 - DNA, 75 bp, Artificial Sequence
  Synthetic
atcgccagtttgcaattggtaatcctgctcgtctgataatccaacagacgatcaaaagctccttaactgtccgca

SEQ ID NO: 20039 - DNA, 75 bp, Artificial Sequence
  Synthetic
tccccttactatgcagctgttggggacatccacgcttacatctttaacgcaggactgacaccattcttgactacc

SEQ ID NO: 20040 - DNA, 75 bp, Artificial Sequence
  Synthetic
aggactgacaccattcttgactaccttaagatatgggatcggcaccaagtatgctgcagttgcactcagtgtgtt

SEQ ID NO: 20041 - DNA, 75 bp, Artificial Sequence
  Synthetic
agggtgtggaggctggatacatggcactccttgaagatccagactccatgcactttgcacctggaaacttcccac

SEQ ID NO: 20042 - DNA, 75 bp, Artificial Sequence
  Synthetic
cactttgcacctggaaacttcccacacatgtactcctacgcgatgggggtggcttcttaccatgaccccagcatg

SEQ ID NO: 20043 - DNA, 75 bp, Artificial Sequence
  Synthetic
agggagggacatggccgccaagaacacaggcacgctggatgagcaactggcaaaggaactgcaagtgtcagaaag

SEQ ID NO: 20044 - DNA, 75 bp, Artificial Sequence
  Synthetic
aatctgacgacttcccactgtcgggatccatgccggctctctccgacaatgcgcaaccagttaccccaagaaccc

SEQ ID NO: 20045 - DNA, 75 bp, Artificial Sequence
  Synthetic
aacagtcccagccctcccctccccaatcatcaagcatgtctcaatcagcacccaagaccccggactaccagcctg

SEQ ID NO: 20046 - DNA, 75 bp, Artificial Sequence
  Synthetic
accctcctccccacacatcccacccaatcacccgctgagacccaatccaacaccccagcatccccctcatttaat

SEQ ID NO: 20047 - DNA, 75 bp, Artificial Sequence
  Synthetic
aatcacccgctgagacccaatccaacaccccagcatccccctcatttaattaaaaactgaccaatagggtgggga

SEQ ID NO: 20048 - DNA, 75 bp, Artificial Sequence
  Synthetic
tattgatgctgtcaactcattaattgaatcatcatcagcaatcatagattccatacagcatggagggctgcaacc

SEQ ID NO: 20049 - DNA, 75 bp, Artificial Sequence
  Synthetic
ccatacagcatggagggctgcaaccatcaggtactgttggcctatcgcaaatccccaaggggataaccagcgctt

SEQ ID NO: 20050 - DNA, 75 bp, Artificial Sequence
  Synthetic
cccaaggcagggagggacacccacgacaatccttctgcgcaacctgatcatcttttaaaggggggccccctgagc

SEQ ID NO: 20051 - DNA, 75 bp, Artificial Sequence
  Synthetic
caacacaaatctgacagtccggaggatcatcaggccaacgacacagactcccccgaagacacaggcaccaaccag

SEQ ID NO: 20052 - DNA, 75 bp, Artificial Sequence
  Synthetic
caaactcaggatcattccctcaccggagagagatggcaatcgtcaccgacaaagcaaccggagacatcgaactgg

SEQ ID NO: 20053 - DNA, 75 bp, Artificial Sequence
  Synthetic
ggcagccaaagccagactcaagaggcccaaggcagggaaggacacccacgacaatccccctgcgcaacccgatcc

SEQ ID NO: 20054 - DNA, 75 bp, Artificial Sequence
  Synthetic
cccaaggcagggaaggacacccacgacaatccccctgcgcaacccgatccccttttaaaggggggccccctgagc

SEQ ID NO: 20055 - DNA, 75 bp, Artificial Sequence
  Synthetic
cggcaccgccgatccccgcccatcacaaactcaggatcattccctcaccggagagagatggcaatcgtcaccgat

SEQ ID NO: 20056 - DNA, 75 bp, Artificial Sequence
  Synthetic
aaagcaaccggagacattgaactggtggaatggtgcaacccggggtgcacagcaatccgaactgaaccaaccaga

SEQ ID NO: 20057 - DNA, 75 bp, Artificial Sequence
  Synthetic
ctcgactgtgtatgcggatactgccccaccatctgcagcctctgcatgtatgacgactgatcaggtacaactatt

SEQ ID NO: 20058 - DNA, 75 bp, Artificial Sequence
  Synthetic
ttatatctcagcaaaatgcaaggatcaagggaaacgagatcagctctcaaagctcatcgagcgagcaaccacctt

SEQ ID NO: 20059 - DNA, 75 bp, Artificial Sequence
  Synthetic
tcaattcaatcaagattctcgaccctgggaattatcaagaatcatcactgaacagttggttcaaaccacgccaag

SEQ ID NO: 20060 - DNA, 75 bp, Artificial Sequence
  Synthetic
aataatcagaacctccctaaaccacatggccaacccagcacaccatccacaccacccattactatcctttgccag

SEQ ID NO: 20061 - DNA, 75 bp, Artificial Sequence
  Synthetic
ccaatccaagacaacaccatattcctggatgaactggcaagacctcatcctagtttggtcaatccgtccccgccc

SEQ ID NO: 20062 - DNA, 75 bp, Artificial Sequence
  Synthetic
caggcccttggcctctagaccactcgaccacccccagtaatgaacacaacaataatcagaacctccctaaaccac

SEQ ID NO: 20063 - DNA, 75 bp, Artificial Sequence
  Synthetic
aaactccgctgcagccgatttattcaaaagaagccacttgatatgacttatcaaccgcaaggtagggtggggaag

SEQ ID NO: 20064 - DNA, 75 bp, Artificial Sequence
  Synthetic
cccaccagtgacgcaatggcagacatggacactgtatatatcaatctgatggcagatgatccaacccaccaaaaa

SEQ ID NO: 20065 - DNA, 75 bp, Artificial Sequence
  Synthetic
ggaactccaacaccaggttcggactcaatccttgctcgcctcagacaagcaaactgagaggttcatcttcctcaa

SEQ ID NO: 20066 - DNA, 75 bp, Artificial Sequence
  Synthetic
caatccttgctcgcctcagacaagcaaactgagaggttcatcttcctcaacacttacgggtttatctatgacact

SEQ ID NO: 20067 - DNA, 75 bp, Artificial Sequence
  Synthetic
acatgaggacattgtcgcaggcggcagataaggtcagacggatgaacatccttgttggtatctttgacttgcatg

SEQ ID NO: 20068 - DNA, 75 bp, Artificial Sequence
  Synthetic
gagaacgatggtgagtgctgcaatgatgaccatcggcctggtccccgccaatatacccttgaacgaactaacagc

SEQ ID NO: 20069 - DNA, 75 bp, Artificial Sequence
  Synthetic
gtgaggaagagtgcgagatatcgagaggtggtctggtatcagtgcaaccctgtaccagccctgcttgcagccacc

SEQ ID NO: 20070 - DNA, 75 bp, Artificial Sequence
  Synthetic
ggcccccgagaagatagattgcgagaaggattatacttactacccttatttcctatctgtgtgctacatcgccac

SEQ ID NO: 20071 - DNA, 75 bp, Artificial Sequence
  Synthetic
aaggattatacttactacccttatttcctatctgtgtgctacatcgccacttctaacctgttcaaggtaccaaaa

SEQ ID NO: 20072 - DNA, 75 bp, Artificial Sequence
  Synthetic
tcctatctgtgtgctacatcgccacttctaacctgttcaaggtaccaaaaatggttgctaatgcgaccaacagtc

SEQ ID NO: 20073 - DNA, 75 bp, Artificial Sequence
  Synthetic
caaccctttcaagaaggcagcccaatgatcaaatctacaagatctcaggaatcagaccactctatactatccact

SEQ ID NO: 20074 - DNA, 75 bp, Artificial Sequence
  Synthetic
cccccagctaaccagaaactcctgacacaagtggatgaaggattcgagggcactgtggactgccattttgggaac

SEQ ID NO: 20075 - DNA, 75 bp, Artificial Sequence
  Synthetic
tatcacgcacaatcctgaccttgattctcggcacacttactggctatttaatgggtgcccactccaccaatgtga

SEQ ID NO: 20076 - DNA, 75 bp, Artificial Sequence
  Synthetic
cactgtggactgccattttgggaacatgctgaaaaaggatcggaaagggaatatgaggacattgtcgcaggcggc

SEQ ID NO: 20077 - DNA, 75 bp, Artificial Sequence
  Synthetic
atatgaggacattgtcgcaggcggcagataaggtccgacggatgaacatccttgttggtatctttgacttgcatg

SEQ ID NO: 20078 - DNA, 75 bp, Artificial Sequence
  Synthetic
gggttcatgtctaccagccgaacagcaatcatccccatatctcagctcaatcctatgctgagtcaactcatgtgg

SEQ ID NO: 20079 - DNA, 75 bp, Artificial Sequence
  Synthetic
agcagtgatgctcagatagtaaaattaagagtggtcataactacatccaaacgcggcccatgcgggggtgagcag

SEQ ID NO: 20080 - DNA, 75 bp, Artificial Sequence
  Synthetic
taagagtggtcataactacatccaaacgcggcccatgcgggggtgagcaggaatatgtgctggaccccaaattca

SEQ ID NO: 20081 - DNA, 75 bp, Artificial Sequence
  Synthetic
tgatcaaatctgcaggatctcaggaatcagaccactctatactatctactgatcaatagatatgtagctatacag

SEQ ID NO: 20082 - DNA, 75 bp, Artificial Sequence
  Synthetic
atcagaccactctatactatctactgatcaatagatatgtagctatacagttgatgaacctatgaagaatcaatt

SEQ ID NO: 20083 - DNA, 75 bp, Artificial Sequence
  Synthetic
acaaaagcacttctttgcacctactcaccacaaaacaatcataatgaggttatcacgaacaatcctggccctgat

SEQ ID NO: 20084 - DNA, 75 bp, Artificial Sequence
  Synthetic
caccacaaaacaatcataatgaggttatcacgaacaatcctggccctgattctcggcgcacttaccggctattta

SEQ ID NO: 20085 - DNA, 75 bp, Artificial Sequence
  Synthetic
taggggtgaccttataccaggtgcaggaatctttgtaactcaaatccggcaactacagatctaccaacaatctgg

SEQ ID NO: 20086 - DNA, 75 bp, Artificial Sequence
  Synthetic
aactacagatctaccaacaatctgggtatcatgaccttgtcatcaggttattacctcttttaccggcagaactca

SEQ ID NO: 20087 - DNA, 75 bp, Artificial Sequence
  Synthetic
ctgttgcagcctatcaaaactaacctggataccttattggctgatggtggcacaagggatgccgatatacagccg

SEQ ID NO: 20088 - DNA, 75 bp, Artificial Sequence
  Synthetic
agctgaggtgactgcagcccaagcactatctcagtcgaaaacgaacgctcaaaatattctcaagttgagagatag

SEQ ID NO: 20089 - DNA, 75 bp, Artificial Sequence
  Synthetic
aaaatattctcaagttgagagatagtattcaggccaccaaccaggcagtttttgaaatttcacaaggacttgagg

SEQ ID NO: 20090 - DNA, 75 bp, Artificial Sequence
  Synthetic
atcccaagtctgaacaacttgtcctgtgctgccatggggaatcgccttggtgtatcactatcactctacttgacc

SEQ ID NO: 20091 - DNA, 75 bp, Artificial Sequence
  Synthetic
gtgctgccatggggaatcgccttggtgtatcactatcactctacttgaccctaatgactaccctatttggggacc

SEQ ID NO: 20092 - DNA, 75 bp, Artificial Sequence
  Synthetic
atggcaggtggtcacattggcccggtgatgagtaaaatattagccggatctgtcacaagtcagttgggggcagaa

SEQ ID NO: 20093 - DNA, 75 bp, Artificial Sequence
  Synthetic
tgatgagtaaaatattagccggatctgtcacaagtcagttgggggcagaacagttgattgctagcggcttaatac

SEQ ID NO: 20094 - DNA, 75 bp, Artificial Sequence
  Synthetic
tgagagggggaaaatgtatggtagggtggggaaggtagccaattcctgcctaataggccgaccgtatcaaaagaa

SEQ ID NO: 20095 - DNA, 75 bp, Artificial Sequence
  Synthetic
cagttgattgctagcggcttaatacaatcacaggtagtaggttatgattcccaatatcaattattggttatcagg

SEQ ID NO: 20096 - DNA, 75 bp, Artificial Sequence
  Synthetic
gtgtcccttctattgatggtgagcgctttgataatctctatagtaatcctgacgagagataacagccaaagcata

SEQ ID NO: 20097 - DNA, 75 bp, Artificial Sequence
  Synthetic
ggtggactttatagagcccaggtgcctcccgaggtagtcgaacggtctggcattgcagagcgattttatgcagat

SEQ ID NO: 20098 - DNA, 75 bp, Artificial Sequence
  Synthetic
tgtctcagtggggcacttgattcatgcacatttgagagggaaagtgcattattgtcaacccctttctttgtatac

SEQ ID NO: 20099 - DNA, 75 bp, Artificial Sequence
  Synthetic
accgccgtctattattgcccaatactctgcatcagctctggtcaccatcaccaccgacacctgcgccgaccttga

SEQ ID NO: 20100 - DNA, 75 bp, Artificial Sequence
  Synthetic
cagactgaatccaactcatgggttgcaccaaacttcactgtctcgacttcacagattgtatcagttgatccaata

SEQ ID NO: 20101 - DNA, 75 bp, Artificial Sequence
  Synthetic
gacatctcctctgacattgctaaaatcaacagttccatcgaggctgcaagagagcagctggaactaagcaaccag

SEQ ID NO: 20102 - DNA, 75 bp, Artificial Sequence
  Synthetic
tattatcgtgacaattgttgtgcttagtctcctcgtaatcggtctgattgttgttctcggtgtgatgtataagaa

SEQ ID NO: 20103 - DNA, 75 bp, Artificial Sequence
  Synthetic
atagcaagccaatgtcaatcttactattttaataactcattagggttcattggggcagaatctagaatctattac

SEQ ID NO: 20104 - DNA, 75 bp, Artificial Sequence
  Synthetic
ttgttctcggtgtgatgtataagaatcttaaaaaagtccaacgagctcaagctgccatgatgatgcagcagatga

SEQ ID NO: 20105 - DNA, 75 bp, Artificial Sequence
  Synthetic
aatcatatcactctactcaatgatgagcaagacgtaccaatcatcaatgattgtgtcacaaggccggtagggaat

SEQ ID NO: 20106 - DNA, 75 bp, Artificial Sequence
  Synthetic
tgagaaggggaaaatgtttggtagggtggggaaggtagccaattcctgcctattaggccgaccgtatcaaaagaa

SEQ ID NO: 20107 - DNA, 75 bp, Artificial Sequence
  Synthetic
tattctaccaccacttgtttttcggacaccatccaaaatcaggtgtattgcctgagtatacttgaggtcaggagt

SEQ ID NO: 20108 - DNA, 75 bp, Artificial Sequence
  Synthetic
ttacagtggatgatgaattaaagacaacgtggaggttagcttatagagttgtgtcccttctattgatggtgagcg

SEQ ID NO: 20109 - DNA, 75 bp, Artificial Sequence
  Synthetic
tactgttctagacccatgattaggtacctttttaatcaatcatttggtttttaattaaaaatgaaaaaatgggcc

SEQ ID NO: 20110 - DNA, 75 bp, Artificial Sequence
  Synthetic
aatagaagggaaaatcacctccattatgactgatacgctcgataccaggaatgcagcccttctccacattccact

SEQ ID NO: 20111 - DNA, 75 bp, Artificial Sequence
  Synthetic
ctccttgactcacacccacgtacactcgatctcacttctgtaaagaaggaatccttctcaaactcgccccacaat

SEQ ID NO: 20112 - DNA, 75 bp, Artificial Sequence
  Synthetic
caggaattggccccggagatatagagcactgccgttaccctgttcatgacaccgcttacctgcatggagttaatc

SEQ ID NO: 20113 - DNA, 75 bp, Artificial Sequence
  Synthetic
catgtgaacttcattccagccccggttacgaccactggatgcacaaggataccatccttttccgtgtcatcgtcc

SEQ ID NO: 20114 - DNA, 75 bp, Artificial Sequence
  Synthetic
aggtagtaaccaatatatcagcatgggagtcattaagagagcgggcaacggcctaccttacttctcaacagttgt

SEQ ID NO: 20115 - DNA, 75 bp, Artificial Sequence
  Synthetic
ccggatctgggcattgctacctcctttgcagcttggtgtcggagcccgaatctgatgactatgtgtcacctgatc

SEQ ID NO: 20116 - DNA, 75 bp, Artificial Sequence
  Synthetic
caggtggtacccgaaagaatattcaagaacatatggagtgcaaactacccaggagtagggtcaggtgctatagta

SEQ ID NO: 20117 - DNA, 75 bp, Artificial Sequence
  Synthetic
agaacatatggagtgcaaactacccaggagtagggtcaggtgctatagtaggaaataaggtgttattcccatttt

SEQ ID NO: 20118 - DNA, 75 bp, Artificial Sequence
  Synthetic
cccggaggtgatgaataggggaagatattactacatccaggatccaaatgactattgccctgacccgctgcaaga

SEQ ID NO: 20119 - DNA, 75 bp, Artificial Sequence
  Synthetic
tattactacatccaggatccaaatgactattgccctgacccgctgcaagatcagatcttaagggcggaacaatcg

SEQ ID NO: 20120 - DNA, 75 bp, Artificial Sequence
  Synthetic
ggatggtgatgcaaggggtcctagcatgtccagtatccaacaattcaacaatagcaagccaatgtcaatcttact

SEQ ID NO: 20121 - DNA, 75 bp, Artificial Sequence
  Synthetic
agagaagctcgagctggtggcctcacccccagatttacctgcttgattctaggattgcaagtccgggtactcaga

SEQ ID NO: 20122 - DNA, 75 bp, Artificial Sequence
  Synthetic
cgaccatcatctggtttttgtaatagtcagtcacgatgccctaatgactgcttattcggggtctactcggatatc

SEQ ID NO: 20123 - DNA, 75 bp, Artificial Sequence
  Synthetic
tcacttaaagagaaggaagtaaagaaagaagggcgcattttcgcaaaaatgtcacaaaagatgagagcatgccag

SEQ ID NO: 20124 - DNA, 75 bp, Artificial Sequence
  Synthetic
ccaggggacaagttcactgctgcacactatatgaccacagacctaaagaagtactgtcttaattggcggcaccag

SEQ ID NO: 20125 - DNA, 75 bp, Artificial Sequence
  Synthetic
acaggggaagacaacacgtattgacccggcttgggcgctattctccaatcatgcgattgggcatgaggctcgtct

SEQ ID NO: 20126 - DNA, 75 bp, Artificial Sequence
  Synthetic
cctgagtatacttgaggtcaggagtgagctcttgggagcattcaaaatagtaccattcctctatcgcgtcttgta

SEQ ID NO: 20127 - DNA, 75 bp, Artificial Sequence
  Synthetic
gagctcttgggagcattcaaaatagtaccattcctctatcgcgtcttgtaggcatccattcagccagaaaacttg

SEQ ID NO: 20128 - DNA, 75 bp, Artificial Sequence
  Synthetic
aatccatgagcagctatctgaggcgatgtctcgatacaaaaggactttcacatacctcaattatttaatggggca

SEQ ID NO: 20129 - DNA, 75 bp, Artificial Sequence
  Synthetic
tactgttctagactcatgattaggtaccttcttaatcaatcatttggtttttaattaaaaatgaaaaaataggcc

SEQ ID NO: 20130 - DNA, 75 bp, Artificial Sequence
  Synthetic
ctccttgactcacacacacgtacactcgatcagactcctgtttaaaaggaatccttctcaaactcgccccacgat

SEQ ID NO: 20131 - DNA, 75 bp, Artificial Sequence
  Synthetic
ccttaatcgaaaataagtgcttctattatatgcaattacttggtctcgtgttgccacatgatcactggagatgga

SEQ ID NO: 20132 - DNA, 75 bp, Artificial Sequence
  Synthetic
ccccgcttgatggcccacatcgactacactaaggatagattaaggactcatggtgtcttaggtttccaccagact

SEQ ID NO: 20133 - DNA, 75 bp, Artificial Sequence
  Synthetic
ttggctatcagccatggggggatgcatcaatcaggttcctaaagcatggcggaacactctgaaatcgatcgagca

SEQ ID NO: 20134 - DNA, 75 bp, Artificial Sequence
  Synthetic
atcaatcaggttcctaaagcatggcggaacactctgaaatcgatcgagcacagtgtaaagcaggaggcacctcaa

SEQ ID NO: 20135 - DNA, 75 bp, Artificial Sequence
  Synthetic
acagatgagagacagactgcatcagtgcaagctatacagggatccacttgtcacctcagggcagcattgaggctt

SEQ ID NO: 20136 - DNA, 75 bp, Artificial Sequence
  Synthetic
cttgttctctaattgcaatcccgggaaaaccacagcaggtactatgcctgtcctaagtgagatggcatcggaact

SEQ ID NO: 20137 - DNA, 75 bp, Artificial Sequence
  Synthetic
tcacctcagggcagcattgaggcttgtatcactctacctatgggcctatggagattctgacatatcatggctaga

SEQ ID NO: 20138 - DNA, 75 bp, Artificial Sequence
  Synthetic
caatcaacatgggggtgtgctgcttcggggtggcaccatgtagtcagtatcatgaggctccaacaataccaaaga

SEQ ID NO: 20139 - DNA, 75 bp, Artificial Sequence
  Synthetic
cacctgtctcattaatgcagactacactgttgtgttttccacacagaaccgtatcataacagtcttgccttttga

SEQ ID NO: 20140 - DNA, 75 bp, Artificial Sequence
  Synthetic
tcatttgcatacgcggctgttcaacttcatgacaacaatcctacctacggtggggccttctttgaattcaatatc

SEQ ID NO: 20141 - DNA, 75 bp, Artificial Sequence
  Synthetic
ttcatgacaacaatcctacctacggtggggccttctttgaattcaatatccaagagttagaatccattctgtccc

SEQ ID NO: 20142 - DNA, 75 bp, Artificial Sequence
  Synthetic
ctgcacttagtaaggatcaggtcaacttctacataaatcaagttgtctcagcgtacagtaaccttcccccatctg

SEQ ID NO: 20143 - DNA, 75 bp, Artificial Sequence
  Synthetic
attatctcagagtgaggggtgaccgtgcaatcctgtgctatatcgacaggatactcaataggatggtatcttcca

SEQ ID NO: 20144 - DNA, 75 bp, Artificial Sequence
  Synthetic
tgcaatcctgtgctatatcgacaggatactcaataggatggtatcttccaatctaggtggtctcattcagacact

SEQ ID NO: 20145 - DNA, 75 bp, Artificial Sequence
  Synthetic
aacagccttgatgcagcaaagaaagtcagggagtctatgtgcgccgggaaggttctcgattacaacgccattcga

SEQ ID NO: 20146 - DNA, 75 bp, Artificial Sequence
  Synthetic
acacaagggtcgctggccaaatgtgaatcaacattcactcctcaacccgatagtgaggcagctttattttgatca

SEQ ID NO: 20147 - DNA, 75 bp, Artificial Sequence
  Synthetic
cttgagcactatttggacgtctcaatggtagaatttgaaaaaacttttgaagtggaattatctgacagcctaagc

SEQ ID NO: 20148 - DNA, 75 bp, Artificial Sequence
  Synthetic
tggttttgtctcagaagtgactccgaagcacctgcgaatgtcccgtcatgatcgcaagtctaccaataggctcct

SEQ ID NO: 20149 - DNA, 75 bp, Artificial Sequence
  Synthetic
tgatgttcctggtcacatggcagaagaatttccctgtttgtttagtagttataacgctacatatgaagacacaat

SEQ ID NO: 20150 - DNA, 75 bp, Artificial Sequence
  Synthetic
atcgcaagtctaccaataggctcctgttagccttcattaactcccctgaattcgatgttaaggaagagcttaaat

SEQ ID NO: 20151 - DNA, 75 bp, Artificial Sequence
  Synthetic
tcactacatcctgcggcctcttgggctttactcatccgcatggtaccggtctgcagcactactagcgtcaggggc

SEQ ID NO: 20152 - DNA, 75 bp, Artificial Sequence
  Synthetic
aagaggggcgcattttcgcaaaaatgtcacaaaagatgagagcatgccaggttatttgtgaagaattgctagcac

SEQ ID NO: 20153 - DNA, 75 bp, Artificial Sequence
  Synthetic
tactggctattgcaacctggagggcgatttgcagttagggtttttttaagtgaccatatcatagtaaacttggtc

SEQ ID NO: 20154 - DNA, 75 bp, Artificial Sequence
  Synthetic
attgacacacaaggatgatggggcaggttatatttgcgcaaaaaagcttgcaaatgttgaggcttcaaggattga

SEQ ID NO: 20155 - DNA, 75 bp, Artificial Sequence
  Synthetic
atatcaattgcaattgcccaagcggcagcggccctcgaaggcttacgaattgctgctactctgcagggggataac

SEQ ID NO: 20156 - DNA, 75 bp, Artificial Sequence
  Synthetic
ccaaaagaatcttcttcaatggatcaatcttaagtcaatgcctcaagaacttcagtaaactcactactaatgcca

SEQ ID NO: 20157 - DNA, 75 bp, Artificial Sequence
  Synthetic
ttcagtaaactcactactaatgccactacccttgctgagaatactgtggccggctgcagtgacatctcttcatgc

SEQ ID NO: 20158 - DNA, 75 bp, Artificial Sequence
  Synthetic
gaatataatcatgactcggcttcaattattgctagatcattactattcaatgcatggcggcataaactcagaatt

SEQ ID NO: 20159 - DNA, 75 bp, Artificial Sequence
  Synthetic
ttattgctagatcattactattcaatgcatggcggcataaactcagaattagagcagccaactttaagtatctct

SEQ ID NO: 20160 - DNA, 75 bp, Artificial Sequence
  Synthetic
aaatatgacccgactattctgccgcaatatcggcgacccgcttaccagttcttgggcggagtcaaaaagactaat

SEQ ID NO: 20161 - DNA, 75 bp, Artificial Sequence
  Synthetic
cttgggcggagtcaaaaagactaatggatgttggtctcctcagtcgtaagttcttggaggggatattatggagac

SEQ ID NO: 20162 - DNA, 75 bp, Artificial Sequence
  Synthetic
aacattgattacctgaggccgccagaaacaattatccgaaaacacacccaaaaagtcttgttgcaagattgccca

SEQ ID NO: 20163 - DNA, 75 bp, Artificial Sequence
  Synthetic
gctgttagctcagttcttgcttgatcgggagaccgttattcccagggctgcccatgccatctttgagttgtctgt

SEQ ID NO: 20164 - DNA, 75 bp, Artificial Sequence
  Synthetic
ttattcagtgctcattggaaagacagccattgtcctggaggaaagttgagaacattgttacctacaacgcgcagt

SEQ ID NO: 20165 - DNA, 75 bp, Artificial Sequence
  Synthetic
atttcctcggggccacccaacaggctgatactaatgtctcagaagggcagtgggtgatgccaggtaacttcaaga

SEQ ID NO: 20166 - DNA, 75 bp, Artificial Sequence
  Synthetic
cgcatatcgtgggccaatctactgaactggagagctatagatggtttggaaaccccggatgtgatagagagtatt

SEQ ID NO: 20167 - DNA, 75 bp, Artificial Sequence
  Synthetic
aaccccggatgtgatagagagtattgatggccgccttgtacaatcatcaaatcaatgtggcctatgtaatcaagg

SEQ ID NO: 20168 - DNA, 75 bp, Artificial Sequence
  Synthetic
ttgccctctgggtgtgtgttcgaccgtccacaagattcccgggtagttccaaagatgccatacgtggggtccaaa

SEQ ID NO: 20169 - DNA, 75 bp, Artificial Sequence
  Synthetic
gagattctgacatatcatggctagaagctgcgacactggctcaaacacggtgcaatgtttctcttgatgacttgc

SEQ ID NO: 20170 - DNA, 75 bp, Artificial Sequence
  Synthetic
gaatcttgagccctctcccttcttcggcgaatttacaccacagattaaatgacggggtaacacaggttaaattca

SEQ ID NO: 20171 - DNA, 75 bp, Artificial Sequence
  Synthetic
aaagttcgtccaaatttgcaatgacaaccaaaatcttatccgtgatgatgggagtgttgattccaatatgattta

SEQ ID NO: 20172 - DNA, 75 bp, Artificial Sequence
  Synthetic
acccaattgatacaaacccagaacaattgattcttcatctacactctgataattcttgctgtctccgggagatgc

SEQ ID NO: 20173 - DNA, 75 bp, Artificial Sequence
  Synthetic
aattcttgctgtctccgggagatgccaacgactggctttgtacctgctctaggactgaccccatgtttaactgtc

SEQ ID NO: 20174 - DNA, 75 bp, Artificial Sequence
  Synthetic
ggatcagaggctcattcagaccaaatttttcatgggttctgacaatttggataatcttgatatctaccaacagcg

SEQ ID NO: 20175 - DNA, 75 bp, Artificial Sequence
  Synthetic
cctgtgatgcaccagtctctcagaagaatgacgcaatccttcacactgactatcatgagaattggatctcagagt

SEQ ID NO: 20176 - DNA, 75 bp, Artificial Sequence
  Synthetic
gaatgacgcaatccttcacactgactatcatgagaattggatctcagagttccgatggggtgaccctcgtattat

SEQ ID NO: 20177 - DNA, 75 bp, Artificial Sequence
  Synthetic
attctgttccttgcataccagctttattatctcagagtgaggggtgaccgtgcaatcctgtgttatattgacagg

SEQ ID NO: 20178 - DNA, 75 bp, Artificial Sequence
  Synthetic
atctaggcagtctcatccagacactctctcatccagagattaggaggagattctcattgagtgatcaagggttcc

SEQ ID NO: 20179 - DNA, 75 bp, Artificial Sequence
  Synthetic
ctctcatccagagattaggaggagattctcattgagtgatcaagggttccttgttgaaagggaattagagccagg

SEQ ID NO: 20180 - DNA, 75 bp, Artificial Sequence
  Synthetic
gcgctttagcaactatcaaggcaggaattgagcctgagatctcccgaggtggctgtactcaggatgagctgagct

SEQ ID NO: 20181 - DNA, 75 bp, Artificial Sequence
  Synthetic
cattcagaagcaaagaacttggttaaagtcagaaaccttcctgtagaggagaaaaccgccttactgtaccaaatg

SEQ ID NO: 20182 - DNA, 75 bp, Artificial Sequence
  Synthetic
aaacctagtctcggcaccccagtgggacattcatacaccagcactgtattttgtgtcaaagaaaatgctagggat

SEQ ID NO: 20183 - DNA, 75 bp, Artificial Sequence
  Synthetic
gacattcatacaccagcactgtattttgtgtcaaagaaaatgctagggatgcttaagaggtcaaccacacccttg

SEQ ID NO: 20184 - DNA, 75 bp, Artificial Sequence
  Synthetic
tgatgttcctggtcacatggcagaagagtttccctgtttgtttagtagttataacgccacatatgaagacacaat

SEQ ID NO: 20185 - DNA, 75 bp, Artificial Sequence
  Synthetic
gagtttccctgtttgtttagtagttataacgccacatatgaagacacaattacttacaatccaacgactgaaaaa

SEQ ID NO: 20186 - DNA, 75 bp, Artificial Sequence
  Synthetic
agcctgtatctaggagaagggtacgggaccaccatgactctgcttgagcccgttgtcaagtcttcaactgtttac

SEQ ID NO: 20187 - DNA, 75 bp, Artificial Sequence
  Synthetic
gccagaaccacgggtattcacggattctatttggtacaaggatgatttcacacggccacctggtggtattatcaa

SEQ ID NO: 20188 - DNA, 75 bp, Artificial Sequence
  Synthetic
agtgatatcacacagaaagacacggtcaacttcatactatctcagatcccgccaaaatcacttaagttgatacac

SEQ ID NO: 20189 - DNA, 75 bp, Artificial Sequence
  Synthetic
ccgatgtacggacactactatctggctattctcattgtgcactattagcctactggctattgcaacctggagggc

SEQ ID NO: 20190 - DNA, 75 bp, Artificial Sequence
  Synthetic
tactggctattgcaacctggagggcgatttgcagttagggttttcttaagtgaccatatcatagtaaacttagtc

SEQ ID NO: 20191 - DNA, 75 bp, Artificial Sequence
  Synthetic
atcaattaggaatcattaaatgggccgagggtgaggtgtcccaacttaccagaaaggcggatgatgaaataaatt

SEQ ID NO: 20192 - DNA, 75 bp, Artificial Sequence
  Synthetic
atcatttgatccagtttctgagctaatcattgcacgaacaggggggtctgtattaatggaatacggggcttttac

SEQ ID NO: 20193 - DNA, 75 bp, Artificial Sequence
  Synthetic
gatacatacaagcttctggcttcaattgtagagaccaccctaatggaaataagggttgagcaagatcagttggaa

SEQ ID NO: 20194 - DNA, 75 bp, Artificial Sequence
  Synthetic
tgggggaaggatccgtacgctgattgagtgtgctcagctgcagattatagatgttatttgtgtaaacatagacca

SEQ ID NO: 20195 - DNA, 75 bp, Artificial Sequence
  Synthetic
gagtgtgctcagctgcagattatagatgttatttgtgtaaacatagaccacctctttcctaaacaccgacatgtt

SEQ ID NO: 20196 - DNA, 75 bp, Artificial Sequence
  Synthetic
aggcccccaaattaagacgtatctaagggccagaaagtggatccaacgtcagggactcaatgagacagttaacca

SEQ ID NO: 20197 - DNA, 75 bp, Artificial Sequence
  Synthetic
agggactcaatgagacagttaaccatatcatcactggacaagtgtcacggaataaagcaagggattttttcaaga

SEQ ID NO: 20198 - DNA, 75 bp, Artificial Sequence
  Synthetic
ttattatgaataatcggagtcggaatcgcaaataggaagccacaaagttgtggagaaacaatgattgcattagta

SEQ ID NO: 20199 - DNA, 75 bp, Artificial Sequence
  Synthetic
accaaacaaggaatgcaagaccaacgggaactttaaataaaacaatcgaattattgggggcgaagcaagtggatc

SEQ ID NO: 20200 - DNA, 75 bp, Artificial Sequence
  Synthetic
gggaactttaaataaaacaatcgaattattgggggcgaagcaagtggatctcgagctcgaggccgaaaccctgaa

SEQ ID NO: 20201 - DNA, 75 bp, Artificial Sequence
  Synthetic
tattcaatgagtatcaggcgcttcaagaacaacttgtaaagccggctgtcaggagacctgatgttgcctcaacgg

SEQ ID NO: 20202 - DNA, 75 bp, Artificial Sequence
  Synthetic
aggagacctgatgttgcctcaacgggtttactcagagcggaaatacctgtctgtgtcacattatctcaagacccc

SEQ ID NO: 20203 - DNA, 75 bp, Artificial Sequence
  Synthetic
ttcatcaaccacaccaatgaagcaaggagcaatattgtcactgctgagtctacattcagacaatatgcgagctca

SEQ ID NO: 20204 - DNA, 75 bp, Artificial Sequence
  Synthetic
tacattcagacaatatgcgagctcacgcaacattagcagcaaggtctgcagatgcttcactcaccatacttgagg

SEQ ID NO: 20205 - DNA, 75 bp, Artificial Sequence
  Synthetic
ggtgtatctgataaacgctcaaatcaattgcttgcaattgcggatgacatccccaaaagttgcagtaatgggcat

SEQ ID NO: 20206 - DNA, 75 bp, Artificial Sequence
  Synthetic
aattgcttgcaattgcggatgacatccccaaaagttgcagtaatgggcatccatttcttgacacagacattgaga

SEQ ID NO: 20207 - DNA, 75 bp, Artificial Sequence
  Synthetic
gcagctcagatatgggtgtcagccataaagagcatgacagcgcctgacaccgcatcagagtcagaaagtaagagg

SEQ ID NO: 20208 - DNA, 75 bp, Artificial Sequence
  Synthetic
taaagagcatgacagcgcctgacaccgcatcagagtcagaaagtaagaggctggccaaatatcaacaacaaggcc

SEQ ID NO: 20209 - DNA, 75 bp, Artificial Sequence
  Synthetic
agagttattcggggcagcttggtactgcgccagtttatggttagcgagtgcaagagggcttcagccatgggcgga

SEQ ID NO: 20210 - DNA, 75 bp, Artificial Sequence
  Synthetic
gaatgcaggattgactgcatttttcctcaccctgaagttcggagttggtacccagtatccaaccttagcaatgag

SEQ ID NO: 20211 - DNA, 75 bp, Artificial Sequence
  Synthetic
aaaccaagggagacaatgcaccatacatggcattcctggaggactccgatatgggaaattttgctccagcaaatt

SEQ ID NO: 20212 - DNA, 75 bp, Artificial Sequence
  Synthetic
catggcattcctggaggactccgatatgggaaattttgctccagcaaattatagcacaatgtactcttatgccat

SEQ ID NO: 20213 - DNA, 75 bp, Artificial Sequence
  Synthetic
gagactttaccagtgagaattatttccgtcttggagttgagacagcccaaagccagcagggagcatttgacgaga

SEQ ID NO: 20214 - DNA, 75 bp, Artificial Sequence
  Synthetic
ccgtcttggagttgagacagcccaaagccagcagggagcatttgacgagagaacagcccgagaaatgggcttgac

SEQ ID NO: 20215 - DNA, 75 bp, Artificial Sequence
  Synthetic
gtcccagttcagttcatgagccatctcgccctgcatttatcagtcaagaagaaaataggcagcctgcccagaact

SEQ ID NO: 20216 - DNA, 75 bp, Artificial Sequence
  Synthetic
cgtcagatactcagggtcagaccaagccagtcccgaagcagcccgcaccaagggccgactcagatgacattgatc

SEQ ID NO: 20217 - DNA, 75 bp, Artificial Sequence
  Synthetic
tatacaccaattctgtgacatattaacccaatcaaacatttcataaactatagtagtcattgatttaagaaaaaa

SEQ ID NO: 20218 - DNA, 75 bp, Artificial Sequence
  Synthetic
acccaatcaaacatttcataaactatagtagtcattgatttaagaaaaaattgggggcgacctcaattgtgaaac

SEQ ID NO: 20219 - DNA, 75 bp, Artificial Sequence
  Synthetic
cgccaatgatgaagaaattgcagaacttttgaatctcagcaccaatgtaatcaaggagattcagaaatccgaact

SEQ ID NO: 20220 - DNA, 75 bp, Artificial Sequence
  Synthetic
gaaatctaactgatctatgggaaaaagagactgcaagtcagaccaagacaccggcccaatctccacaaaccacac

SEQ ID NO: 20221 - DNA, 75 bp, Artificial Sequence
  Synthetic
agagactgcaagtcagaccaagacaccggcccaatctccacaaaccacacaagttcagtctgatgaaaatgagga

SEQ ID NO: 20222 - DNA, 75 bp, Artificial Sequence
  Synthetic
atcaatcagagcaagtcccagaacaaaaccagagcagatcttcaccaggtgatgatctcgacagagctctcaaca

SEQ ID NO: 20223 - DNA, 75 bp, Artificial Sequence
  Synthetic
aagggccctcgcatccagaatctccctgggtcccaggcggcaactcaacaggcgacccacccattggcaggggac

SEQ ID NO: 20224 - DNA, 75 bp, Artificial Sequence
  Synthetic
ggcaatcaatcctggcaaccaggacacaggagagagtattcatttaccaccttccatggcaccaccagagtcatt

SEQ ID NO: 20225 - DNA, 75 bp, Artificial Sequence
  Synthetic
cgaatgtagatgcggggagtgtccaactacatgcatcatgtgcagagatgataagtagaatgtttgtagaagtta

SEQ ID NO: 20226 - DNA, 75 bp, Artificial Sequence
  Synthetic
atgatattaaccaacttaaggccacaaccgcactgatgtccaaccaaattgcttccatacaaattcttgacccag

SEQ ID NO: 20227 - DNA, 75 bp, Artificial Sequence
  Synthetic
gctgctgttgtaattgcagggtttggagacgacccaactcaaattattgaagaaggcattatggccaaagatgct

SEQ ID NO: 20228 - DNA, 75 bp, Artificial Sequence
  Synthetic
ttcttccggtgtgagtaagggtgaaatagaaggattgattgcattggtggaaacattagttgacaatgacaagaa

SEQ ID NO: 20229 - DNA, 75 bp, Artificial Sequence
  Synthetic
acgcccgagtcaagcaggcaatatataatgcgtaatactgtaactatacaaacaatcaatactgctgtcggttgc

SEQ ID NO: 20230 - DNA, 75 bp, Artificial Sequence
  Synthetic
taatgcgtaatactgtaactatacaaacaatcaatactgctgtcggttgcacccacctcagcaaatcaataatct

SEQ ID NO: 20231 - DNA, 75 bp, Artificial Sequence
  Synthetic
caagttgggggcgaagacacgattgaccacagtcgctatctgtaaggctcctcaccaaaaatggcatatacaaca

SEQ ID NO: 20232 - DNA, 75 bp, Artificial Sequence
  Synthetic
cccgttggtactaaaagagacagacagaggcacaaaggagcttcaaccacaggtaagggtagattcaattggcga

SEQ ID NO: 20233 - DNA, 75 bp, Artificial Sequence
  Synthetic
aggtaagggtagattcaattggcgatgtgcagaacgccaaagagtcctcgatattcgtgactctatatggtttca

SEQ ID NO: 20234 - DNA, 75 bp, Artificial Sequence
  Synthetic
tccaagcaattaaggagagtacagatcgatcgaaattcttccatccaaaagatgacttcaaacctgagacagtca

SEQ ID NO: 20235 - DNA, 75 bp, Artificial Sequence
  Synthetic
accatctctaatgacgcactagcgctggagatcactgttaagaaatctgcaacttctcaagagaaaatgacggtg

SEQ ID NO: 20236 - DNA, 75 bp, Artificial Sequence
  Synthetic
aacttctcaagagaaaatgacggtgatgttccacaatagccccccttcattgagaactgcaataactatccgagc

SEQ ID NO: 20237 - DNA, 75 bp, Artificial Sequence
  Synthetic
tgactgcaggagtgcagtacatattccgcccaatgtttgtttcaatcactaaattacacaatggcaaactatata

SEQ ID NO: 20238 - DNA, 75 bp, Artificial Sequence
  Synthetic
gggtgcccaaaagcatccacagcatctcgtccactctactgtatagtgtgatgttggaggtaggattcaaagtgg

SEQ ID NO: 20239 - DNA, 75 bp, Artificial Sequence
  Synthetic
ggcgatgcagacacatactgggggtttgcatggttccacctgtgcaatttcaaaaagacatcctctaagggaaag

SEQ ID NO: 20240 - DNA, 75 bp, Artificial Sequence
  Synthetic
ttgcatggttccacctgtgcaatttcaaaaagacatcctctaagggaaagccaagaacgctagacgaactaaaga

SEQ ID NO: 20241 - DNA, 75 bp, Artificial Sequence
  Synthetic
ccgactattgtggtccaaatcactggcaagagcagcaaatatgctcaaggatttttttcctccaatggtacttgt

SEQ ID NO: 20242 - DNA, 75 bp, Artificial Sequence
  Synthetic
gcaagagcagcaaatatgctcaaggatttttttcctccaatggtacttgttgcctcccaatcagcagatctgcac

SEQ ID NO: 20243 - DNA, 75 bp, Artificial Sequence
  Synthetic
acagttgttatccagtcaagcgagaaaggggaactcctaaggtctgatgacctcgagatacgaggtgctgtggcc

SEQ ID NO: 20244 - DNA, 75 bp, Artificial Sequence
  Synthetic
aaggggaactcctaaggtctgatgacctcgagatacgaggtgctgtggcctccaagaaaggtagactgagctcat

SEQ ID NO: 20245 - DNA, 75 bp, Artificial Sequence
  Synthetic
cattagatgtgcgcaaaaaacataacctgcgatgaactgcccagactccactttaacctaggttgcagggaaata

SEQ ID NO: 20246 - DNA, 75 bp, Artificial Sequence
  Synthetic
cctgcgatgaactgcccagactccactttaacctaggttgcagggaaatagtacacgacatgcacaatactatca

SEQ ID NO: 20247 - DNA, 75 bp, Artificial Sequence
  Synthetic
taggataacaattattaatccaatttcctaattataaaaaattgctttaaaggttattgacgagtcgggggcgaa

SEQ ID NO: 20248 - DNA, 75 bp, Artificial Sequence
  Synthetic
tcttagaatctacatattgaactatgggtcaaatatcagtatatctaattaatagcgtgctattattgctggtat

SEQ ID NO: 20249 - DNA, 75 bp, Artificial Sequence
  Synthetic
agcgcaaatgaatggcagcttgctgcatatacaacatcactttcagggacaattgccgtgcgattcctacctgtg

SEQ ID NO: 20250 - DNA, 75 bp, Artificial Sequence
  Synthetic
catatacaacatcactttcagggacaattgccgtgcgattcctacctgtgctcccggataatatgactacctgtc

SEQ ID NO: 20251 - DNA, 75 bp, Artificial Sequence
  Synthetic
ccactcaaatccaatctggatgcactgctctcatctgagacttatccccagacaagattaattggggcagttata

SEQ ID NO: 20252 - DNA, 75 bp, Artificial Sequence
  Synthetic
catcggctcaaatcactgctgcagttgctctcaagcaagcgcaagacaatgcaaggaacatactagcactcaaag

SEQ ID NO: 20253 - DNA, 75 bp, Artificial Sequence
  Synthetic
caacaaacagctattgcacttggtaagatacagagttttgtgaatgaggaaattctgccatctatcaaccaactg

SEQ ID NO: 20254 - DNA, 75 bp, Artificial Sequence
  Synthetic
agatacagagttttgtgaatgaggaaattctgccatctatcaaccaactgagctgcgaggtgacagccaataaac

SEQ ID NO: 20255 - DNA, 75 bp, Artificial Sequence
  Synthetic
gcacagctgactaaccctgcattgacttcattatcatatcaagcgctgtacaacctgtgtggtggcaacatggca

SEQ ID NO: 20256 - DNA, 75 bp, Artificial Sequence
  Synthetic
cttcattatcatatcaagcgctgtacaacctgtgtggtggcaacatggcaatgcttactcagaagattggaatta

SEQ ID NO: 20257 - DNA, 75 bp, Artificial Sequence
  Synthetic
gtcattggttatgactctcagtaccagctgctggtcatccaggtcaattatccaagcatttctgaggtcactggt

SEQ ID NO: 20258 - DNA, 75 bp, Artificial Sequence
  Synthetic
agggaaagcaattgtaccccaatttgtagctgaaagtcgggtgactattgaagagcttgatgtagcatcttgtaa

SEQ ID NO: 20259 - DNA, 75 bp, Artificial Sequence
  Synthetic
gtagctgaaagtcgggtgactattgaagagcttgatgtagcatcttgtaaattcagcagcacgaccctatattgc

SEQ ID NO: 20260 - DNA, 75 bp, Artificial Sequence
  Synthetic
aggtaactatgatgattgtcaatataccacagagattggagcattatcatcccggtatataacactagatggggg

SEQ ID NO: 20261 - DNA, 75 bp, Artificial Sequence
  Synthetic
accacagagattggagcattatcatcccggtatataacactagatgggggggtcttagttaattgtaagtcaatt

SEQ ID NO: 20262 - DNA, 75 bp, Artificial Sequence
  Synthetic
tgcagtaacatatgttgatgccacaatctgcaaaacaattcaattggatgatatacaactccagctggaagggtc

SEQ ID NO: 20263 - DNA, 75 bp, Artificial Sequence
  Synthetic
ccacctccgggtctttagatatcagcagtgagataggaaacatcaataatacggtgaatcgtgtggaggatttaa

SEQ ID NO: 20264 - DNA, 75 bp, Artificial Sequence
  Synthetic
cagtgagataggaaacatcaataatacggtgaatcgtgtggaggatttaattcaccaatcagaggaatggctggc

SEQ ID NO: 20265 - DNA, 75 bp, Artificial Sequence
  Synthetic
tgttaagtgcgcttgctgtgatctggctggcagtattaacggctattataatatacttgagaacaaagttgaaga

SEQ ID NO: 20266 - DNA, 75 bp, Artificial Sequence
  Synthetic
gctggcagtattaacggctattataatatacttgagaacaaagttgaagactatatcggcattagctgtaaccaa

SEQ ID NO: 20267 - DNA, 75 bp, Artificial Sequence
  Synthetic
tttgatcattcaagccaaaacagaggatctaggctcgggttaataatagttcaatcaatgtttgatttattaggt

SEQ ID NO: 20268 - DNA, 75 bp, Artificial Sequence
  Synthetic
gatctaggctcgggttaataatagttcaatcaatgtttgatttattaggtttttcccactaattattaatatatt

SEQ ID NO: 20269 - DNA, 75 bp, Artificial Sequence
  Synthetic
acctgggggcgacccatttataggttagtatatattaggaagtccttatattgcactgtaatttcaaacaattat

SEQ ID NO: 20270 - DNA, 75 bp, Artificial Sequence
  Synthetic
tagtatatattaggaagtccttatattgcactgtaatttcaaacaattatattacctcatatctaccttgtctaa

SEQ ID NO: 20271 - DNA, 75 bp, Artificial Sequence
  Synthetic
atagtcgaaaaacaacttggagagccatctttagatggtccgttcttcttatcacaacaggatgcttagccttat

SEQ ID NO: 20272 - DNA, 75 bp, Artificial Sequence
  Synthetic
catctttagatggtccgttcttcttatcacaacaggatgcttagccttatccattattagcatagttcaaattgg

SEQ ID NO: 20273 - DNA, 75 bp, Artificial Sequence
  Synthetic
ccttgaaaaccactctgtctgatacactcaggaatccaattaaccagataaatgacatatttaggattgttgccc

SEQ ID NO: 20274 - DNA, 75 bp, Artificial Sequence
  Synthetic
aatgacatatttaggattgttgcccttgatattccattgcaagtgaccaatatccaaaaagaccttgcaagtcaa

SEQ ID NO: 20275 - DNA, 75 bp, Artificial Sequence
  Synthetic
agcttaatagaacatccgagctttattgctggacctacaacgacccgaggctgtacaagaatacccacttttcac

SEQ ID NO: 20276 - DNA, 75 bp, Artificial Sequence
  Synthetic
ttgctggacctacaacgacccgaggctgtacaagaatacccacttttcacatgtcagaaagtcattggtgctact

SEQ ID NO: 20277 - DNA, 75 bp, Artificial Sequence
  Synthetic
tatatctcaatgggagttctccatgtgtcctcatctggcactcccatttttcttactactgcaagtgagctgata

SEQ ID NO: 20278 - DNA, 75 bp, Artificial Sequence
  Synthetic
ctgtgacattttgtgcagtattgtcacagagaaggagggagatgattactggtctgatactccgactccaatgcg

SEQ ID NO: 20279 - DNA, 75 bp, Artificial Sequence
  Synthetic
tgtccagtatgttctcgtcattctctgccaactaccctgctgtgggatcaggcgaaattgtaaaagatagaatat

SEQ ID NO: 20280 - DNA, 75 bp, Artificial Sequence
  Synthetic
ggcgaaattgtaaaagatagaatattattcccaatttacggaggtataaagcagacttcaccagagtttaccgaa

SEQ ID NO: 20281 - DNA, 75 bp, Artificial Sequence
  Synthetic
tagctggacttatgaccaggtaaaagcagcgtataggccagattacatatcaggccggttctgggcacaagtgat

SEQ ID NO: 20282 - DNA, 75 bp, Artificial Sequence
  Synthetic
caggccggttctgggcacaagtgatactcagctgcgctcttgatgcagtcgacttatcaagttgtattgtaaaga

SEQ ID NO: 20283 - DNA, 75 bp, Artificial Sequence
  Synthetic
atagggattgattacttttactatcagcggtcatcttcttggtggccattggcatttgttacaaaactagacccg

SEQ ID NO: 20284 - DNA, 75 bp, Artificial Sequence
  Synthetic
tatggctgaccaattccataccaatcccgcaatcaaagttccctcggccttcatattcagaaaattattgcacaa

SEQ ID NO: 20285 - DNA, 75 bp, Artificial Sequence
  Synthetic
tcatattcagaaaattattgcacaaagccagcagtttgccctgctacttgtgtcactggtgtgtactctgatatt

SEQ ID NO: 20286 - DNA, 75 bp, Artificial Sequence
  Synthetic
tcccgagcataatttggatcggccagtaccttgatgctcctgttagaaggacttatcccagatttggaattgcaa

SEQ ID NO: 20287 - DNA, 75 bp, Artificial Sequence
  Synthetic
agtgcgtattcaaccactacatgttttaagaatactgccaggaatagagtgttctgcgtcaccattgccgaattt

SEQ ID NO: 20288 - DNA, 75 bp, Artificial Sequence
  Synthetic
ttaagaatactgccaggaatagagtgttctgcgtcaccattgccgaatttgcagatgggttgtttggagagtaca

SEQ ID NO: 20289 - DNA, 75 bp, Artificial Sequence
  Synthetic
attttgagactcattttgtcgcaaagtgaaattgtcatctttaaaaataatcaattctatgatttttattgaaca

SEQ ID NO: 20290 - DNA, 75 bp, Artificial Sequence
  Synthetic
tgattaagcaatcatgtgggaaatttattatctcataaattctaatagttgtaaatgacgaattaagaaaaaatg

SEQ ID NO: 20291 - DNA, 75 bp, Artificial Sequence
  Synthetic
acaacccgaggttcatctcgattcacccatcatattgaataaactggcactattatggcgcttgagtggtttacc

SEQ ID NO: 20292 - DNA, 75 bp, Artificial Sequence
  Synthetic
tccgtagtgatgcacatcccggaccacatcttagaaaaatcagaatatcggatcaagcaccgtctagggaaaatc

SEQ ID NO: 20293 - DNA, 75 bp, Artificial Sequence
  Synthetic
agtattttaatattaatttggcaaatcttgatccgataacccaccccaaaagtttgtattggttatccagactaa

SEQ ID NO: 20294 - DNA, 75 bp, Artificial Sequence
  Synthetic
agtttgtattggttatccagactaacaatagctagtgctggaacctttagacatatgaaagatagaatcttgtgt

SEQ ID NO: 20295 - DNA, 75 bp, Artificial Sequence
  Synthetic
gagccataaactagtaggtaacggtgatttatttaatcaaagtctctcaggtacacgtttgactgcgagtccgtt

SEQ ID NO: 20296 - DNA, 75 bp, Artificial Sequence
  Synthetic
tctgacatcaagtctgcagtcacgacaccctggtcagaagctcgttggtcttggcttcatatcaaacaaacaatg

SEQ ID NO: 20297 - DNA, 75 bp, Artificial Sequence
  Synthetic
aatcataaaagaggaatggggtttagtaggtattactccagatcttgtcattctttttgacagagtcaataatag

SEQ ID NO: 20298 - DNA, 75 bp, Artificial Sequence
  Synthetic
gtaggtattactccagatcttgtcattctttttgacagagtcaataatagtctgactgcattaacatttgagatg

SEQ ID NO: 20299 - DNA, 75 bp, Artificial Sequence
  Synthetic
ggggcgactatctacctttctacagccagtagttagtagactggaggtgttgtttgatctagtagattcattggc

SEQ ID NO: 20300 - DNA, 75 bp, Artificial Sequence
  Synthetic
ccagtagttagtagactggaggtgttgtttgatctagtagattcattggcaaaaatcttaggtgacacaatatat

SEQ ID NO: 20301 - DNA, 75 bp, Artificial Sequence
  Synthetic
tgatgcaagtcactctcatgcagggtcttttttttcatttaacatgaatgaacttgataacacactatcaaagag

SEQ ID NO: 20302 - DNA, 75 bp, Artificial Sequence
  Synthetic
tttctaatctagatgttgatcaagctgcagagatgctatgcctgatgagattattcggacacccaatgttaactg

SEQ ID NO: 20303 - DNA, 75 bp, Artificial Sequence
  Synthetic
ttattcggacacccaatgttaactgcaccggatgcagcagccaaagtgaggaaagcaatgtgtgctccaaaactt

SEQ ID NO: 20304 - DNA, 75 bp, Artificial Sequence
  Synthetic
tataaatgggtacagaagatcacactctggcctgtggcccaatgtagagccgtcttcaatttatgatgatgatct

SEQ ID NO: 20305 - DNA, 75 bp, Artificial Sequence
  Synthetic
gagatttcccatcatttcatgcttaaaaactacaagagtttgagcatgatagaattcaagaagagcatagactac

SEQ ID NO: 20306 - DNA, 75 bp, Artificial Sequence
  Synthetic
gccgaaatcccagtgggatgtcatatttcgtaaatctttacgcagatctcatacgcagtcccagtatctagacga

SEQ ID NO: 20307 - DNA, 75 bp, Artificial Sequence
  Synthetic
accctgaaaaagaatttgcatatgtaaccacaatggattatttgcacgataatgaattttgtgcttcatattctc

SEQ ID NO: 20308 - DNA, 75 bp, Artificial Sequence
  Synthetic
aatgaattttgtgcttcatattctctaaaggaaaaggagatcaaaactactgggaggatatttgcaaaaatgaca

SEQ ID NO: 20309 - DNA, 75 bp, Artificial Sequence
  Synthetic
tatatgcaagttcttcaaagagaatggcgtttcgatggagcaattgtcattgaccaagagtctacttgcaatgtc

SEQ ID NO: 20310 - DNA, 75 bp, Artificial Sequence
  Synthetic
taggcaactcaaaatctcagattgcaaccagcaacccatctcggcatcactcgacagccaatcagatgtcactct

SEQ ID NO: 20311 - DNA, 75 bp, Artificial Sequence
  Synthetic
aaccagcaacccatctcggcatcactcgacagccaatcagatgtcactctcaaatcgaaaaacggttgtagcaac

SEQ ID NO: 20312 - DNA, 75 bp, Artificial Sequence
  Synthetic
ctattaaattgtttgcacaagctctaaatcaactctttgggattgatcacggatttgaatggatacatttaagac

SEQ ID NO: 20313 - DNA, 75 bp, Artificial Sequence
  Synthetic
cgatccttactcgcctcctgaagatccaacactagaagatatagataaagcaccaaatgatgatatcttcatagt

SEQ ID NO: 20314 - DNA, 75 bp, Artificial Sequence
  Synthetic
tatcaattagtgctatacactgtgtagcagagaaaattggtgcacgagtggcagcaatggtgcagggtgataatc

SEQ ID NO: 20315 - DNA, 75 bp, Artificial Sequence
  Synthetic
aagtaatagctatcaccaaagaactattcagaggagaaaaagcttgtgatgtcagagatgagttagacgagcttg

SEQ ID NO: 20316 - DNA, 75 bp, Artificial Sequence
  Synthetic
aatcttaagctaaatgagacaatacaaagccaatccttttttgtatattccaaacgaatattctttgaagggcga

SEQ ID NO: 20317 - DNA, 75 bp, Artificial Sequence
  Synthetic
ttgcttagtcaagtcctcaaaaatgctgccaagttatgtatggttgctgaccatctaggtgaaaacactgtatct

SEQ ID NO: 20318 - DNA, 75 bp, Artificial Sequence
  Synthetic
tgagaaggacactgcttttgtgttgaacctagtctacatcatgactcagattctttttgatgagcattactcgat

SEQ ID NO: 20319 - DNA, 75 bp, Artificial Sequence
  Synthetic
aacctagtctacatcatgactcagattctttttgatgagcattactcgattgtatgcgatcaccatagtgtcaaa

SEQ ID NO: 20320 - DNA, 75 bp, Artificial Sequence
  Synthetic
accaggtcagctcggcggtttcaacttcctcaatataagtcggttgttcactaggaatataggtgacccagtaac

SEQ ID NO: 20321 - DNA, 75 bp, Artificial Sequence
  Synthetic
ttcctcaatataagtcggttgttcactaggaatataggtgacccagtaacatgtagtctgtctgatctcaaatgc

SEQ ID NO: 20322 - DNA, 75 bp, Artificial Sequence
  Synthetic
gcgtgagcctggtcctgggacatggttgacgttgtgctctgatccttacacccttaacataccatacacacagct

SEQ ID NO: 20323 - DNA, 75 bp, Artificial Sequence
  Synthetic
ttgacgttgtgctctgatccttacacccttaacataccatacacacagcttccaaccacatatctcaaaaagcac

SEQ ID NO: 20324 - DNA, 75 bp, Artificial Sequence
  Synthetic
acaagtgccaaatcagcatgaggaagaagaggtgttggctcgctttctccttgatcgtgaatatgtgatgccccg

SEQ ID NO: 20325 - DNA, 75 bp, Artificial Sequence
  Synthetic
caattatattgctgagtgtcatgactccttacttagccaggtctgcttcagtgataataaggaatacttgtggtc

SEQ ID NO: 20326 - DNA, 75 bp, Artificial Sequence
  Synthetic
tgagagctgtcagctggtctaatatattagggggaagaaacatatccggggtgactacacctgatactattgaat

SEQ ID NO: 20327 - DNA, 75 bp, Artificial Sequence
  Synthetic
attagggggaagaaacatatccggggtgactacacctgatactattgaattaattcaaggttgtttaataggtga

SEQ ID NO: 20328 - DNA, 75 bp, Artificial Sequence
  Synthetic
tgcacttgcctggcccactttacatccctgaaccatcagttactaactctaaaatgcgtgtgccatatctgggtt

SEQ ID NO: 20329 - DNA, 75 bp, Artificial Sequence
  Synthetic
cgaaaacagaggagcgtaaaacagcctcaatggcagcaataaaaggaatgtcacatcacctgcgtgcagtcttaa

SEQ ID NO: 20330 - DNA, 75 bp, Artificial Sequence
  Synthetic
gataatgcattgcagattgcccaatcacggtgtaacatcacattggatcaaatgagattacttacaccaattcct

SEQ ID NO: 20331 - DNA, 75 bp, Artificial Sequence
  Synthetic
atttaccagcaaattatgttacttggactcagcatctttgaaacaatgtactcaatggaccaaaagtgggtattc

SEQ ID NO: 20332 - DNA, 75 bp, Artificial Sequence
  Synthetic
actagacataagtttggtgaacccgccgagacatcagaccccggagctgactagcacaacaaccaacccgttcct

SEQ ID NO: 20333 - DNA, 75 bp, Artificial Sequence
  Synthetic
ccgagacatcagaccccggagctgactagcacaacaaccaacccgttcctatatgatcagctcccattaaatcaa

SEQ ID NO: 20334 - DNA, 75 bp, Artificial Sequence
  Synthetic
cattgatggtttagattttggtgaaggaatacaattattgagtcgttgtactgcaagattgatggcagaatgtat

SEQ ID NO: 20335 - DNA, 75 bp, Artificial Sequence
  Synthetic
ggaatacaattattgagtcgttgtactgcaagattgatggcagaatgtattctagaggagggaataggctcgtca

SEQ ID NO: 20336 - DNA, 75 bp, Artificial Sequence
  Synthetic
agagtgcctaatgtgtgatattcgctcactttgtgttaatttaggtcaagagatactatgtagcctggcatacca

SEQ ID NO: 20337 - DNA, 75 bp, Artificial Sequence
  Synthetic
tcactttgtgttaatttaggtcaagagatactatgtagcctggcataccaaatgtattacttgcgaatcaggggt

SEQ ID NO: 20338 - DNA, 75 bp, Artificial Sequence
  Synthetic
gcagaattgtcaacaccgggatccataaccagattaagggcccatatgtcgcaacaacggatttcatagctgcaa

SEQ ID NO: 20339 - DNA, 75 bp, Artificial Sequence
  Synthetic
agtgggcaggaagactgttacacattcttcaactgtcaagatggggatcttactccaaaaatggaacagtatctt

SEQ ID NO: 20340 - DNA, 75 bp, Artificial Sequence
  Synthetic
tcttcaactgtcaagatggggatcttactccaaaaatggaacagtatcttgcaaggagggcatgccttttaacat

SEQ ID NO: 20341 - DNA, 75 bp, Artificial Sequence
  Synthetic
atagagaagtgcaaggtgctcacagaatacaatcaacaaattgagtatgcagatcaagagtttagctctgtatta

SEQ ID NO: 20342 - DNA, 75 bp, Artificial Sequence
  Synthetic
atcctaagatagatgcattagtttcaaatctctacttcaccaccagacgtgttctatcaaacctcagatcatgtg

SEQ ID NO: 20343 - DNA, 75 bp, Artificial Sequence
  Synthetic
aaagaggatacagtacaatatgacatcatgacaacaaacgatatcatacttactcatggtctattcacacagatc

SEQ ID NO: 20344 - DNA, 75 bp, Artificial Sequence
  Synthetic
tccataagttccttactccggataacgcgcctggatctttgatcccattctctatttcaccaaattcacttgcat

SEQ ID NO: 20345 - DNA, 75 bp, Artificial Sequence
  Synthetic
tggtacaagtatgcaatcgcctatgcagtgtctgaaaagaggtcagctcgattaggagggagcttgtacattggt

SEQ ID NO: 20346 - DNA, 75 bp, Artificial Sequence
  Synthetic
cagtgtctgaaaagaggtcagctcgattaggagggagcttgtacattggtgaagggagcggaagtgtgatgactt

SEQ ID NO: 20347 - DNA, 75 bp, Artificial Sequence
  Synthetic
tcaaatggtatgaacccaccacaacgaaattatgggcttatgccactacaatttgtgaattcggtggtttataag

SEQ ID NO: 20348 - DNA, 75 bp, Artificial Sequence
  Synthetic
gaaattatgggcttatgccactacaatttgtgaattcggtggtttataagaacttaacggctaaatcagaatgta

SEQ ID NO: 20349 - DNA, 75 bp, Artificial Sequence
  Synthetic
gagactaatgttacagatccatcatttgtcaattttgcattgaatgaaatcccaatgcaatcattaaaacgagta

SEQ ID NO: 20350 - DNA, 75 bp, Artificial Sequence
  Synthetic
cccaatgcaatcattaaaacgagtaaattgtgttgtggaatttgaccgtggtatgccgattgaacgggttattca

SEQ ID NO: 20351 - DNA, 75 bp, Artificial Sequence
  Synthetic
aattgtgttgtggaatttgaccgtggtatgccgattgaacgggttattcagggttatacccatatcttacttgtt

SEQ ID NO: 20352 - DNA, 75 bp, Artificial Sequence
  Synthetic
gacatctgaaaaagtatttcaattcttactgagtgccatgatcatgatctttggttatgtcaaaatccacaggaa

SEQ ID NO: 20353 - DNA, 75 bp, Artificial Sequence
  Synthetic
gagtacatattgatgtctgactgcaaggaacctgtaaactatacagctgtccctaacattcttacacgtgtaagt

SEQ ID NO: 20354 - DNA, 75 bp, Artificial Sequence
  Synthetic
ccctaacattcttacacgtgtaagtgatttagtgtcgaagaatctgagtcttatccatccagaagacctcagaaa

SEQ ID NO: 20355 - DNA, 75 bp, Artificial Sequence
  Synthetic
taggcccattcaacttgaataagcttaagaaaattgatacaatccttaagtcaagcacctatcagctaatcccgt

SEQ ID NO: 20356 - DNA, 75 bp, Artificial Sequence
  Synthetic
tcaagcacctatcagctaatcccgtactggttgcgctatgagtactctattaatccgagatctttgtcatttcta

SEQ ID NO: 20357 - DNA, 75 bp, Artificial Sequence
  Synthetic
tttcatggtcagatatgatcacgatttctgaatttcgtaagaaatccaagcggcctatatttatcaaacgagtaa

SEQ ID NO: 20358 - DNA, 75 bp, Artificial Sequence
  Synthetic
ttctgaatttcgtaagaaatccaagcggcctatatttatcaaacgagtaatagggaatcaacagctaaaatcatt

SEQ ID NO: 20359 - DNA, 75 bp, Artificial Sequence
  Synthetic
gtataaagttcctcggtgcaatcatcaagttgaaataatttctgcgattttaaaggggtgtaatgttctaatttg

SEQ ID NO: 20360 - DNA, 75 bp, Artificial Sequence
  Synthetic
caagttgaaataatttctgcgattttaaaggggtgtaatgttctaatttgcacttggagtaatatagcttgtaat

SEQ ID NO: 20361 - DNA, 75 bp, Artificial Sequence
  Synthetic
agagtataacaaatatatacataataaaaatgattttaagaaaaaatccgacactcaaagaaaattggtgcctgt

SEQ ID NO: 20362 - DNA, 75 bp, Artificial Sequence
  Synthetic
atcgtattcgatagggaagaatggtatataaaataactaataaaaaaatgtattagtaaaaattaccgtatttcc

SEQ ID NO: 20363 - DNA, 75 bp, Artificial Sequence
  Synthetic
gtcgtaggtgtgggaaggttgtattccgagtgcgcctccgaggcatctactctacacctatcacaatggctggtg

SEQ ID NO: 20364 - DNA, 75 bp, Artificial Sequence
  Synthetic
ccgagtgcgcctccgaggcatctactctacacctatcacaatggctggtgtcttctcccagtatgagaggtttgt

SEQ ID NO: 20365 - DNA, 75 bp, Artificial Sequence
  Synthetic
gatgccttaaagttaacatccctatgcttgtcactgcatctgaagaccccaccactcgttggcaactagcatgct

SEQ ID NO: 20366 - DNA, 75 bp, Artificial Sequence
  Synthetic
gcttgtcactgcatctgaagaccccaccactcgttggcaactagcatgcttatctctaaggctcctgatctccaa

SEQ ID NO: 20367 - DNA, 75 bp, Artificial Sequence
  Synthetic
taccatcacaaaacatgagagcaacagcagctattgctggttccacaaatgcagctgttatcaacaccatggaag

SEQ ID NO: 20368 - DNA, 75 bp, Artificial Sequence
  Synthetic
tctgaggaagatgctcaagttttcagagacatggcaagagatctgccccctcagttcacctctggatcacccttc

SEQ ID NO: 20369 - DNA, 75 bp, Artificial Sequence
  Synthetic
cagatctggatcctggtggctaaggccatgaccaacattgacggctctggggaggccaatgaaagacgtcttgca

SEQ ID NO: 20370 - DNA, 75 bp, Artificial Sequence
  Synthetic
tgcccgtctgataatccaacagacaatcaaaagctccttaactgtccgtaggttcttggtctctgagcttcgtgc

SEQ ID NO: 20371 - DNA, 75 bp, Artificial Sequence
  Synthetic
atcaaaagctccttaactgtccgtaggttcttggtctctgagcttcgtgcgtcacgaggtgcagtaaaagaagga

SEQ ID NO: 20372 - DNA, 75 bp, Artificial Sequence
  Synthetic
gggattgacaccattcttgaccaccttaagatacgggataggcaccaagtacgccgctgttgcactcagtgtgtt

SEQ ID NO: 20373 - DNA, 75 bp, Artificial Sequence
  Synthetic
ttaagatacgggataggcaccaagtacgccgctgttgcactcagtgtgttcgctgcagatattgcaaagttgaag

SEQ ID NO: 20374 - DNA, 75 bp, Artificial Sequence
  Synthetic
actccttgaggatccagactccatgcactttgcacctggaaacttcccacacatgtactcctatgcaatgggggt

SEQ ID NO: 20375 - DNA, 75 bp, Artificial Sequence
  Synthetic
cactttgcacctggaaacttcccacacatgtactcctatgcaatgggggtagcttcttaccatgatcctagcatg

SEQ ID NO: 20376 - DNA, 75 bp, Artificial Sequence
  Synthetic
aggaagggacatggccgccaagaacacaggcacgctggatgagcaactggcgaaggaactgcaagtatcagagag

SEQ ID NO: 20377 - DNA, 75 bp, Artificial Sequence
  Synthetic
acaggcacgctggatgagcaactggcgaaggaactgcaagtatcagagagagatcgcgccgcattatccgctgcg

SEQ ID NO: 20378 - DNA, 75 bp, Artificial Sequence
  Synthetic
atccatgccggctctctctgagaatgcgcaaccagttacccccagacctcaacagtcccagctctctccccccca

SEQ ID NO: 20379 - DNA, 75 bp, Artificial Sequence
  Synthetic
gcgcaaccagttacccccagacctcaacagtcccagctctctcccccccaatcatcaaacatgccccaatcagca

SEQ ID NO: 20380 - DNA, 75 bp, Artificial Sequence
  Synthetic
gcaccaacaacagcccaagaagaccacccctccccccacacatctcacccagccacccataaagactcagtccca

SEQ ID NO: 20381 - DNA, 75 bp, Artificial Sequence
  Synthetic
acccctccccccacacatctcacccagccacccataaagactcagtcccacgccccagcatctccttcatttaat

SEQ ID NO: 20382 - DNA, 75 bp, Artificial Sequence
  Synthetic
tgtgtgcagcaatggattttactgacattgatgctgtcaactcattgatcgaatcatcatcggcaatcatagact

SEQ ID NO: 20383 - DNA, 75 bp, Artificial Sequence
  Synthetic
cattgatgctgtcaactcattgatcgaatcatcatcggcaatcatagactccatacagcatggagggctgcaacc

SEQ ID NO: 20384 - DNA, 75 bp, Artificial Sequence
  Synthetic
taaccaaggcctgggaggctgaggcggcaactgccggtaatggggacacccaacacaaatctgacagtccggagg

SEQ ID NO: 20385 - DNA, 75 bp, Artificial Sequence
  Synthetic
ggcaactgccggtaatggggacacccaacacaaatctgacagtccggaggatcatcaggccaacgacacagattc

SEQ ID NO: 20386 - DNA, 75 bp, Artificial Sequence
  Synthetic
agacaccccaccccgaggtgctgtcagcagccaaagccagactcaagaggcccaaagcagggagggacacccgcg

SEQ ID NO: 20387 - DNA, 75 bp, Artificial Sequence
  Synthetic
agcagccaaagccagactcaagaggcccaaagcagggagggacacccgcgacaactcccctgcgcaacccgatca

SEQ ID NO: 20388 - DNA, 75 bp, Artificial Sequence
  Synthetic
aaaatccacccagtcatggaggtcccggcaccgccgatccccgcccatcacaaactcaggatcattcccccaccg

SEQ ID NO: 20389 - DNA, 75 bp, Artificial Sequence
  Synthetic
cggcaccgccgatccccgcccatcacaaactcaggatcattcccccaccggagagaaatggcgattgtcaccgac

SEQ ID NO: 20390 - DNA, 75 bp, Artificial Sequence
  Synthetic
agcagtccgaattgaacccaccagactcgactgtgtatgcggacactgccccaccatctgtagcctctgcatgta

SEQ ID NO: 20391 - DNA, 75 bp, Artificial Sequence
  Synthetic
ctcgactgtgtatgcggacactgccccaccatctgtagcctctgcatgtatgacgactgatcaggtacaactact

SEQ ID NO: 20392 - DNA, 75 bp, Artificial Sequence
  Synthetic
acctcgctgtcttgccccaattgaggaatgaggttgcagcaatcagaacatcacaggccatgatagaggggacac

SEQ ID NO: 20393 - DNA, 75 bp, Artificial Sequence
  Synthetic
gaatgaggttgcagcaatcagaacatcacaggccatgatagaggggacactcaattcgatcaagattcttgaccc

SEQ ID NO: 20394 - DNA, 75 bp, Artificial Sequence
  Synthetic
atcacactgttgttgtgtctggaccagggaatccattggccatgccaaccccagtccaagacaacaccatattcc

SEQ ID NO: 20395 - DNA, 75 bp, Artificial Sequence
  Synthetic
agggaatccattggccatgccaaccccagtccaagacaacaccatattcctggacgagctagccagacctcatcc

SEQ ID NO: 20396 - DNA, 75 bp, Artificial Sequence
  Synthetic
gcccacagaagcaggctgcaatagcctatatctccgctaaatgcaaggatccggggaaacgagatcagctatcaa

SEQ ID NO: 20397 - DNA, 75 bp, Artificial Sequence
  Synthetic
ctatatctccgctaaatgcaaggatccggggaaacgagatcagctatcaaggctcattgagcgagcaaccacccc

SEQ ID NO: 20398 - DNA, 75 bp, Artificial Sequence
  Synthetic
gatcacccctcatggtgatcacaacaataatcagaacccttccgaaccacatgaccaacccagcccaccgcccac

SEQ ID NO: 20399 - DNA, 75 bp, Artificial Sequence
  Synthetic
aataatcagaacccttccgaaccacatgaccaacccagcccaccgcccacaccgtccatcgacatcccttgccaa

SEQ ID NO: 20400 - DNA, 75 bp, Artificial Sequence
  Synthetic
gtaatcataaaatagggtggggaaggtgctttgcctgtaagggggctccctcatcttcagacacgtgcccgccat

SEQ ID NO: 20401 - DNA, 75 bp, Artificial Sequence
  Synthetic
gtgctttgcctgtaagggggctccctcatcttcagacacgtgcccgccatctcaccaacagtgcaatggcagaca

SEQ ID NO: 20402 - DNA, 75 bp, Artificial Sequence
  Synthetic
gaactgctgtcctttcctctcatccctgtgaccggtcctgacgggaagaaggaactccaacaccagatccggacc

SEQ ID NO: 20403 - DNA, 75 bp, Artificial Sequence
  Synthetic
ctgtgaccggtcctgacgggaagaaggaactccaacaccagatccggacccaatccttgctcgcctcagacaaac

SEQ ID NO: 20404 - DNA, 75 bp, Artificial Sequence
  Synthetic
acaccggacaagacaactttttccaccccagagcatattaatcagcctaagaggacgacggtgagtgccgcgatg

SEQ ID NO: 20405 - DNA, 75 bp, Artificial Sequence
  Synthetic
ccccagagcatattaatcagcctaagaggacgacggtgagtgccgcgatgatgaccattggcctggttcccgcca

SEQ ID NO: 20406 - DNA, 75 bp, Artificial Sequence
  Synthetic
gtgaggaaaagtgcgaggtatcgggaagtggtctggtatcaatgcaatccagtaccggccctgcttgcagccacc

SEQ ID NO: 20407 - DNA, 75 bp, Artificial Sequence
  Synthetic
aagtggtctggtatcaatgcaatccagtaccggccctgcttgcagccaccaggtttggtcgccaaggaggtctcg

SEQ ID NO: 20408 - DNA, 75 bp, Artificial Sequence
  Synthetic
aaggattatacctactacccttatttcttatctgtgtgctacatcgccacctccaacctgttcaaggtaccgagg

SEQ ID NO: 20409 - DNA, 75 bp, Artificial Sequence
  Synthetic
tcttatctgtgtgctacatcgccacctccaacctgttcaaggtaccgaggatggttgctaatgcaaccaacagtc

SEQ ID NO: 20410 - DNA, 75 bp, Artificial Sequence
  Synthetic
cctccagccaaccagaaactcctgacacaggtggatgagggattcgagggcactgtggattgccattttgggaac

SEQ ID NO: 20411 - DNA, 75 bp, Artificial Sequence
  Synthetic
cacaggtggatgagggattcgagggcactgtggattgccattttgggaacatgctgaaaaaggatcggaaaggga

SEQ ID NO: 20412 - DNA, 75 bp, Artificial Sequence
  Synthetic
cttgttggtatctttgacttgcatgggccaacgctcttcctggagtataccgggaaactgacaaaggctctgcta

SEQ ID NO: 20413 - DNA, 75 bp, Artificial Sequence
  Synthetic
ggccaacgctcttcctggagtataccgggaaactgacaaaggctctgctagggttcatgtccaccagccgaacag

SEQ ID NO: 20414 - DNA, 75 bp, Artificial Sequence
  Synthetic
agcagtgatgcccagatagtaaagttaagggttgtcataactacatccaaacgcggcccgtgcgggggtgagcag

SEQ ID NO: 20415 - DNA, 75 bp, Artificial Sequence
  Synthetic
taagggttgtcataactacatccaaacgcggcccgtgcgggggtgagcaggagtatgtgctggatcccaaattca

SEQ ID NO: 20416 - DNA, 75 bp, Artificial Sequence
  Synthetic
tgatttaatccgcaagatcccagaaatcagaccactctatactatccactgatcactggaaatgtaattgtacag

SEQ ID NO: 20417 - DNA, 75 bp, Artificial Sequence
  Synthetic
atcagaccactctatactatccactgatcactggaaatgtaattgtacagttgatgaatctgtgaagaatcaatt

SEQ ID NO: 20418 - DNA, 75 bp, Artificial Sequence
  Synthetic
acaaaagcatttcttcacacctccccgccacgaaacaaccacaatgaggctatcaaacacaatcttgaccttgat

SEQ ID NO: 20419 - DNA, 75 bp, Artificial Sequence
  Synthetic
cgccacgaaacaaccacaatgaggctatcaaacacaatcttgaccttgattctcatcatacttaccggctatttg

SEQ ID NO: 20420 - DNA, 75 bp, Artificial Sequence
  Synthetic
taggggtgatcttacaccaggtgcgggtattttcgtaactcaagtccgacagctccagatctaccaacagtctgg

SEQ ID NO: 20421 - DNA, 75 bp, Artificial Sequence
  Synthetic
ggtattttcgtaactcaagtccgacagctccagatctaccaacagtctgggtaccatgatcttgtcatcagattg

SEQ ID NO: 20422 - DNA, 75 bp, Artificial Sequence
  Synthetic
agagtacaataacactgtatcacagctgttgcagcctatcaaaaccaacctggatactttgttggcagatggtag

SEQ ID NO: 20423 - DNA, 75 bp, Artificial Sequence
  Synthetic
ctgttgcagcctatcaaaaccaacctggatactttgttggcagatggtagcacaagggatgttgatatacagccg

SEQ ID NO: 20424 - DNA, 75 bp, Artificial Sequence
  Synthetic
agctgaggtaactgcagctcaagcactatctcagtcaaaaacgaatgctcaaaatattctcaagttgagagatag

SEQ ID NO: 20425 - DNA, 75 bp, Artificial Sequence
  Synthetic
ctatctcagtcaaaaacgaatgctcaaaatattctcaagttgagagatagtattcaggccaccaaccaagcagtt

SEQ ID NO: 20426 - DNA, 75 bp, Artificial Sequence
  Synthetic
gcaaactgagctcaatgagaatatcatcccaagtctgaacaacttgtcctgtgctgccatggggaatcgccttgg

SEQ ID NO: 20427 - DNA, 75 bp, Artificial Sequence
  Synthetic
atcccaagtctgaacaacttgtcctgtgctgccatggggaatcgccttggtgtatcactctcactctatttgacc

SEQ ID NO: 20428 - DNA, 75 bp, Artificial Sequence
  Synthetic
aatctcttacagcaccctatcggcaatggcgggtggtcacattggtccagtgatgagtaagatattagccggatc

SEQ ID NO: 20429 - DNA, 75 bp, Artificial Sequence
  Synthetic
atggcgggtggtcacattggtccagtgatgagtaagatattagccggatctgtcacaagtcagttgggggcagaa

SEQ ID NO: 20430 - DNA, 75 bp, Artificial Sequence
  Synthetic
ccagtatcagctgttggttatcagggtcaaccttgtacggattcaggaagtccagaatactagggttgtatcact

SEQ ID NO: 20431 - DNA, 75 bp, Artificial Sequence
  Synthetic
ggtggactttacagagcccaggtgccacccgaggtagttgagcgatctggcattgcagagcggttttatgcagat

SEQ ID NO: 20432 - DNA, 75 bp, Artificial Sequence
  Synthetic
tcggcttaatccagagttagtcaagtgtctcagtggggcacttgattcatgcacatttgagagggaaagtgcatt

SEQ ID NO: 20433 - DNA, 75 bp, Artificial Sequence
  Synthetic
tgtctcagtggggcacttgattcatgcacatttgagagggaaagtgcattactgtcaactcccttctttgtatac

SEQ ID NO: 20434 - DNA, 75 bp, Artificial Sequence
  Synthetic
accgccatctatcattgcccaatactctgcatcagctctagtaaccatcaccaccgacacttgtgctgaccttga

SEQ ID NO: 20435 - DNA, 75 bp, Artificial Sequence
  Synthetic
tctgcatcagctctagtaaccatcaccaccgacacttgtgctgaccttgaaattgagggttatcgtttcaacata

SEQ ID NO: 20436 - DNA, 75 bp, Artificial Sequence
  Synthetic
acaaatagtatcggttgatccaatagacatatcctctgacattgccaaaattaacaattctatcgaggctgcgcg

SEQ ID NO: 20437 - DNA, 75 bp, Artificial Sequence
  Synthetic
gacatatcctctgacattgccaaaattaacaattctatcgaggctgcgcgagagcagctggaactgagcaaccag

SEQ ID NO: 20438 - DNA, 75 bp, Artificial Sequence
  Synthetic
tattatcgtgacaattgttgtgcttagtctccttgtaattggtcttattattgttctcggtgtgatgtacaagaa

SEQ ID NO: 20439 - DNA, 75 bp, Artificial Sequence
  Synthetic
agtctccttgtaattggtcttattattgttctcggtgtgatgtacaagaatcttaagaaagtccaacgagctcaa

SEQ ID NO: 20440 - DNA, 75 bp, Artificial Sequence
  Synthetic
attggggacacccttctaggtgaataatcatatcaatccattcaataatgagcgggacataccaatcaccaacga

SEQ ID NO: 20441 - DNA, 75 bp, Artificial Sequence
  Synthetic
aatcatatcaatccattcaataatgagcgggacataccaatcaccaacgactgtgtcacaaggccggttaggaat

SEQ ID NO: 20442 - DNA, 75 bp, Artificial Sequence
  Synthetic
tgagggggggggtgtgcatggtagggtggggaaggtagccaattcctgcccattgggccgaccgtaccaagagaa

SEQ ID NO: 20443 - DNA, 75 bp, Artificial Sequence
  Synthetic
gtggggaaggtagccaattcctgcccattgggccgaccgtaccaagagaagtcaacagaagtatagatgcagggc

SEQ ID NO: 20444 - DNA, 75 bp, Artificial Sequence
  Synthetic
aacatggaggttagcttatagagttgtatccctcctattgatggtgagtgccttgataatctctatagtaatcct

SEQ ID NO: 20445 - DNA, 75 bp, Artificial Sequence
  Synthetic
gtatccctcctattgatggtgagtgccttgataatctctatagtaatcctgacgagagataacagccaaagcata

SEQ ID NO: 20446 - DNA, 75 bp, Artificial Sequence
  Synthetic
gatagaagggaaaatcacctcaatcatgactgatacgctcgataccaggaatgcagctcttctccacattccact

SEQ ID NO: 20447 - DNA, 75 bp, Artificial Sequence
  Synthetic
atgactgatacgctcgataccaggaatgcagctcttctccacattccactccagctcaatacacttgaggcaaac

SEQ ID NO: 20448 - DNA, 75 bp, Artificial Sequence
  Synthetic
gcactgtcgttatccggttcatgactccgcttacctgcatggagtcaatcgattactcatcaatcaaacagctga

SEQ ID NO: 20449 - DNA, 75 bp, Artificial Sequence
  Synthetic
tccgcttacctgcatggagtcaatcgattactcatcaatcaaacagctgactacacagcagaaggccccctggat

SEQ ID NO: 20450 - DNA, 75 bp, Artificial Sequence
  Synthetic
cccatccttttctgtatcatcatccatttggtgctatacacacaatgtgattgaaacaggttgcaatgaccactc

SEQ ID NO: 20451 - DNA, 75 bp, Artificial Sequence
  Synthetic
atttggtgctatacacacaatgtgattgaaacaggttgcaatgaccactcaggtagtaatcaatatatcagtatg

SEQ ID NO: 20452 - DNA, 75 bp, Artificial Sequence
  Synthetic
gagtaagtatctgaccgatgggttgaatagaaaaagctgttccgtagctgcgggatccgggcattgttacctcct

SEQ ID NO: 20453 - DNA, 75 bp, Artificial Sequence
  Synthetic
aatagaaaaagctgttccgtagctgcgggatccgggcattgttacctcctttgtagcctagtgtcagagcccgaa

SEQ ID NO: 20454 - DNA, 75 bp, Artificial Sequence
  Synthetic
aacaagggatgggtcttacactgaacaggtggtacccgaaagaatatttaagaacatatggagcgcaaactaccc

SEQ ID NO: 20455 - DNA, 75 bp, Artificial Sequence
  Synthetic
caggtggtacccgaaagaatatttaagaacatatggagcgcaaactaccctggggtagggtcaggtgctatagca

SEQ ID NO: 20456 - DNA, 75 bp, Artificial Sequence
  Synthetic
actattgccctgacccgctgcaagatcagatcttaagggcagaacaatcgtattatcctactcgatttggtagga

SEQ ID NO: 20457 - DNA, 75 bp, Artificial Sequence
  Synthetic
atagccagccaatgccaatcttactatttcaacaactcattaggattcatcggggcggaatctaggatctattac

SEQ ID NO: 20458 - DNA, 75 bp, Artificial Sequence
  Synthetic
atttcaacaactcattaggattcatcggggcggaatctaggatctattacctcaatggtaacatttacctttatc

SEQ ID NO: 20459 - DNA, 75 bp, Artificial Sequence
  Synthetic
aggattgcaagtccgggtacgcagaacattgactcaggcgttaacctcaagatgttaaatgttactgtcattaca

SEQ ID NO: 20460 - DNA, 75 bp, Artificial Sequence
  Synthetic
acattgactcaggcgttaacctcaagatgttaaatgttactgtcattacacgaccatcatctggcttttgtaata

SEQ ID NO: 20461 - DNA, 75 bp, Artificial Sequence
  Synthetic
tggcctcttagccttacctcagacagcatatttgcatttacaatgtacttacaagggaagacgacacgtattgac

SEQ ID NO: 20462 - DNA, 75 bp, Artificial Sequence
  Synthetic
gcatatttgcatttacaatgtacttacaagggaagacgacacgtattgacccagcttgggcgctattctccaatc

SEQ ID NO: 20463 - DNA, 75 bp, Artificial Sequence
  Synthetic
tattctaccaccacttgtttttcggacaccatccaaaaccaggtgtattgtctgagtatacttgaagtcagaagt

SEQ ID NO: 20464 - DNA, 75 bp, Artificial Sequence
  Synthetic
acaccatccaaaaccaggtgtattgtctgagtatacttgaagtcagaagtgagctcttgggggcattcaagatag

SEQ ID NO: 20465 - DNA, 75 bp, Artificial Sequence
  Synthetic
agcagccataaaattaacacttgatcttccttaaaaacacctatctaaattactgtctgagatccctgattagtt

SEQ ID NO: 20466 - DNA, 75 bp, Artificial Sequence
  Synthetic
cttccttaaaaacacctatctaaattactgtctgagatccctgattagttaccctttcaatcaatcaattaattt

SEQ ID NO: 20467 - DNA, 75 bp, Artificial Sequence
  Synthetic
attagggtggggaaggattactttgttccttgactcgcacccacgtacacccaatcccattcctgtcaagaagga

SEQ ID NO: 20468 - DNA, 75 bp, Artificial Sequence
  Synthetic
ttccttgactcgcacccacgtacacccaatcccattcctgtcaagaaggaacccttcccaaactcaccttgcaat

SEQ ID NO: 20469 - DNA, 75 bp, Artificial Sequence
  Synthetic
ccttgatcgagaataagtgcttctactacatgcaattacttggtctcgtgttaccacatgatcactggagatgga

SEQ ID NO: 20470 - DNA, 75 bp, Artificial Sequence
  Synthetic
ctacatgcaattacttggtctcgtgttaccacatgatcactggagatggagggcattcgtcaattttacagtgga

SEQ ID NO: 20471 - DNA, 75 bp, Artificial Sequence
  Synthetic
acactaaggatagactaagggctcatggtgtcttgggtttccaccagactcagacaagtgagagccgtttccgtg

SEQ ID NO: 20472 - DNA, 75 bp, Artificial Sequence
  Synthetic
tggtgtcttgggtttccaccagactcagacaagtgagagccgtttccgtgtcttgctccatcctgaaactttacc

SEQ ID NO: 20473 - DNA, 75 bp, Artificial Sequence
  Synthetic
ggaacactctgaaatctatcgagcacagtgtgaagcaggaggcgactcaactgaagttactcatggaaaaaacct

SEQ ID NO: 20474 - DNA, 75 bp, Artificial Sequence
  Synthetic
cagtgtgaagcaggaggcgactcaactgaagttactcatggaaaaaacctcactaaagctaacaggagtatctta

SEQ ID NO: 20475 - DNA, 75 bp, Artificial Sequence
  Synthetic
tactaagtgagatggcatcagaactcttgtcaaatcccatctcccaattccaatcaacatgggggtgtgctgctt

SEQ ID NO: 20476 - DNA, 75 bp, Artificial Sequence
  Synthetic
cttgtcaaatcccatctcccaattccaatcaacatgggggtgtgctgcttcagggtggcaccatgtagtcagcat

SEQ ID NO: 20477 - DNA, 75 bp, Artificial Sequence
  Synthetic
tcactgaagttcagtatggctcggacacctgtctcattaatgcagactacaccgtcgttttttccgcacaggacc

SEQ ID NO: 20478 - DNA, 75 bp, Artificial Sequence
  Synthetic
cacctgtctcattaatgcagactacaccgtcgttttttccgcacaggaccgtgtcatagcagtcttgcctttcga

SEQ ID NO: 20479 - DNA, 75 bp, Artificial Sequence
  Synthetic
tctgtgcccgctttatgtatcccagaagccaactacatgagaggataagtacaatactggcccttggagaccaac

SEQ ID NO: 20480 - DNA, 75 bp, Artificial Sequence
  Synthetic
aagccaactacatgagaggataagtacaatactggcccttggagaccaactcgggagaaaagcaccccaagtcct

SEQ ID NO: 20481 - DNA, 75 bp, Artificial Sequence
  Synthetic
ttcatgacaacaaccctatctacggtggggctttctttgagttcaatatccaagaactggaagctattttgtccc

SEQ ID NO: 20482 - DNA, 75 bp, Artificial Sequence
  Synthetic
tggggctttctttgagttcaatatccaagaactggaagctattttgtcccctgcacttaataaggatcaagtcaa

SEQ ID NO: 20483 - DNA, 75 bp, Artificial Sequence
  Synthetic
aatcagcagaattgctatgcttactacgcctgtggggtcatcccttgctaaacagtcttgatgcagcaaagaaag

SEQ ID NO: 20484 - DNA, 75 bp, Artificial Sequence
  Synthetic
acgcctgtggggtcatcccttgctaaacagtcttgatgcagcaaagaaagtcagagaatctatgtgtgctgggaa

SEQ ID NO: 20485 - DNA, 75 bp, Artificial Sequence
  Synthetic
tattaatcaatgggtatcggaagaaacataagggtcgctggccaaatgtgaatcaacattcactactcaacccga

SEQ ID NO: 20486 - DNA, 75 bp, Artificial Sequence
  Synthetic
acataagggtcgctggccaaatgtgaatcaacattcactactcaacccgatagtgaagcagctttactttgatca

SEQ ID NO: 20487 - DNA, 75 bp, Artificial Sequence
  Synthetic
tgatagaatttgagaagacttttgaagtggaactatctgatagtctaagcatctttctgaaggataagtcgatag

SEQ ID NO: 20488 - DNA, 75 bp, Artificial Sequence
  Synthetic
agtggaactatctgatagtctaagcatctttctgaaggataagtcgatagctttggataaacaagaatggcacag

SEQ ID NO: 20489 - DNA, 75 bp, Artificial Sequence
  Synthetic
atcgcaagtctaccaataggctattgttagcctttattaactcccctgaattcgatgttaaggaagagcttaaat

SEQ ID NO: 20490 - DNA, 75 bp, Artificial Sequence
  Synthetic
tcactgaaagagaaggaagttaagaaagaagggcgcattttcgcaaagatgtcacagaaaatgagagcatgccag

SEQ ID NO: 20491 - DNA, 75 bp, Artificial Sequence
  Synthetic
aagaagggcgcattttcgcaaagatgtcacagaaaatgagagcatgccaggttatttgtgaagagttactagcac

SEQ ID NO: 20492 - DNA, 75 bp, Artificial Sequence
  Synthetic
ttagccaactgagttacaactcgatggccgctaaggtgcgattgctgaggccaggggacaagttcaccgctgcac

SEQ ID NO: 20493 - DNA, 75 bp, Artificial Sequence
  Synthetic
tcagtcaaattgttcgccagaagcctggatcgactatttgggttagaccatgctttttcttggatacacgtccgt

SEQ ID NO: 20494 - DNA, 75 bp, Artificial Sequence
  Synthetic
tggatcgactatttgggttagaccatgctttttcttggatacacgtccgtctcaccaatagcactatgtacgttg

SEQ ID NO: 20495 - DNA, 75 bp, Artificial Sequence
  Synthetic
aataagaacactgggatttttattataagtgctcgaggtggtatagaaggccttcaacagaaactatggactggc

SEQ ID NO: 20496 - DNA, 75 bp, Artificial Sequence
  Synthetic
taagtgctcgaggtggtatagaaggccttcaacagaaactatggactggcatatcaattgcaatcgcccaggcgg

SEQ ID NO: 20497 - DNA, 75 bp, Artificial Sequence
  Synthetic
caggttttagcgattacgaaagaattcatgaccccagtctcggaggatgtaatccacgagcagctatctgaagcg

SEQ ID NO: 20498 - DNA, 75 bp, Artificial Sequence
  Synthetic
tcatgaccccagtctcggaggatgtaatccacgagcagctatctgaagcgatgtcgcgatacaagaggactttca

SEQ ID NO: 20499 - DNA, 75 bp, Artificial Sequence
  Synthetic
caatccagtgacttcttcgtttactccaaaaggatcttcttcaatgggtcaatcctaagtcaatgcctcaagaac

SEQ ID NO: 20500 - DNA, 75 bp, Artificial Sequence
  Synthetic
ccaaaaggatcttcttcaatgggtcaatcctaagtcaatgcctcaagaacttcagtaaactcactaccaatgcca

SEQ ID NO: 20501 - DNA, 75 bp, Artificial Sequence
  Synthetic
atagcccgttgtgtggaaaacgggttgcctaaggatgctgcatatgttcagaatataatcatgactcggcttcaa

SEQ ID NO: 20502 - DNA, 75 bp, Artificial Sequence
  Synthetic
tgcctaaggatgctgcatatgttcagaatataatcatgactcggcttcaactgttgctagatcactactattcta

SEQ ID NO: 20503 - DNA, 75 bp, Artificial Sequence
  Synthetic
gtccgaaacgcaacctatttaccatctcaattaggcggttacaatcatttgaatatgacccgactattctgtcgc

SEQ ID NO: 20504 - DNA, 75 bp, Artificial Sequence
  Synthetic
ctcaattaggcggttacaatcatttgaatatgacccgactattctgtcgcaatatcggtgacccgcttactagtt

SEQ ID NO: 20505 - DNA, 75 bp, Artificial Sequence
  Synthetic
ttcttagaggggatattatggagacccccgggaagtgggacattttcaacactcatgcttgatccgttcgcactt

SEQ ID NO: 20506 - DNA, 75 bp, Artificial Sequence
  Synthetic
ccccgggaagtgggacattttcaacactcatgcttgatccgttcgcacttaacattgattacttaaggccaccag

SEQ ID NO: 20507 - DNA, 75 bp, Artificial Sequence
  Synthetic
aatcctctattagcaggtgtagttgacccgaactacaaccaggaattagaattattagctcagttcctgcttgat

SEQ ID NO: 20508 - DNA, 75 bp, Artificial Sequence
  Synthetic
acccgaactacaaccaggaattagaattattagctcagttcctgcttgatcgggaaaccgttattcccagggctg

SEQ ID NO: 20509 - DNA, 75 bp, Artificial Sequence
  Synthetic
ggattggttgatactacaaaaacaattattcagtgctcattagaaagacagccactgtcctggaggaaagttgag

SEQ ID NO: 20510 - DNA, 75 bp, Artificial Sequence
  Synthetic
ttattcagtgctcattagaaagacagccactgtcctggaggaaagttgagaacattgtaacctacaatgcgcagt

SEQ ID NO: 20511 - DNA, 75 bp, Artificial Sequence
  Synthetic
tgggtgatgccaggtaatttcaagaagcttgtatctcttgacgattgctcagtcacgttgtccactgtgtcacgg

SEQ ID NO: 20512 - DNA, 75 bp, Artificial Sequence
  Synthetic
agcttgtatctcttgacgattgctcagtcacgttgtccactgtgtcacggcgcatttcttgggccaatctactta

SEQ ID NO: 20513 - DNA, 75 bp, Artificial Sequence
  Synthetic
gatggccgccttgtgcaatcatccaatcaatgcggcctatgtaatcaaggattgggctcctactcctggttcttc

SEQ ID NO: 20514 - DNA, 75 bp, Artificial Sequence
  Synthetic
atcaatgcggcctatgtaatcaaggattgggctcctactcctggttcttcttgccctccgggtgtgtgttcgacc

SEQ ID NO: 20515 - DNA, 75 bp, Artificial Sequence
  Synthetic
acggatgagagacagactgcgtcagtgcaggctatacagggatccacatgtcaccttagagcagcattgagactt

SEQ ID NO: 20516 - DNA, 75 bp, Artificial Sequence
  Synthetic
agccgcgacattggctcaaacacggtgcaatatttctcttgatgacctgcggatcctgagccctcttccttcctc

SEQ ID NO: 20517 - DNA, 75 bp, Artificial Sequence
  Synthetic
tgcaatatttctcttgatgacctgcggatcctgagccctcttccttcctcggcaaatttacaccacagattgaat

SEQ ID NO: 20518 - DNA, 75 bp, Artificial Sequence
  Synthetic
aaccagaatcttatccgtgatgatgggagtgttgattccaatatgatttatcagcaggttatgatattagggctt

SEQ ID NO: 20519 - DNA, 75 bp, Artificial Sequence
  Synthetic
actgattcttcacctacactctgataattcttgctgtctccgggagatgccaacgaccggttttgtacctgcttt

SEQ ID NO: 20520 - DNA, 75 bp, Artificial Sequence
  Synthetic
aattcttgctgtctccgggagatgccaacgaccggttttgtacctgctttaggattgaccccatgcttaactgtc

SEQ ID NO: 20521 - DNA, 75 bp, Artificial Sequence
  Synthetic
ggatcagaggctcattcaaaccaaattctttatgggttctgacaatctagataatcttgatatctaccagcagcg

SEQ ID NO: 20522 - DNA, 75 bp, Artificial Sequence
  Synthetic
cttgcgatgcaccagtatctcagaagaatgatgcaatccttcacactgactaccatgaaaattggatctcagagt

SEQ ID NO: 20523 - DNA, 75 bp, Artificial Sequence
  Synthetic
ctctcatccggagattaggaggagattttcattgagtgatcaagggttccttgtcgaaagggagctagagccagg

SEQ ID NO: 20524 - DNA, 75 bp, Artificial Sequence
  Synthetic
aattgagcctgagatctcccgaggtggctgtacccaggatgagctgagctttacccttaagcacttactatgtcg

SEQ ID NO: 20525 - DNA, 75 bp, Artificial Sequence
  Synthetic
aagttagaaaccttccagtagaggaaaaaaccgccttactataccagatgttgatcactgaggccaatgccagga

SEQ ID NO: 20526 - DNA, 75 bp, Artificial Sequence
  Synthetic
aaaaaccgccttactataccagatgttgatcactgaggccaatgccaggagatcagggtctgctagtatcatcat

SEQ ID NO: 20527 - DNA, 75 bp, Artificial Sequence
  Synthetic
ttgtatcaaagaaaatgctggggatgctcaaaaggtcaaccacacccttggatataagtgacctttctgagagcc

SEQ ID NO: 20528 - DNA, 75 bp, Artificial Sequence
  Synthetic
gctcaaaaggtcaaccacacccttggatataagtgacctttctgagagccagaacctcacaccaacagaattgaa

SEQ ID NO: 20529 - DNA, 75 bp, Artificial Sequence
  Synthetic
ataacgctacatatgaagacacaattacttacaatccaatgactgaaaaactcgcagtgcacttggacaatggtt

SEQ ID NO: 20530 - DNA, 75 bp, Artificial Sequence
  Synthetic
tacttacaatccaatgactgaaaaactcgcagtgcacttggacaatggttccaccccttccagagcgcttggtcg

SEQ ID NO: 20531 - DNA, 75 bp, Artificial Sequence
  Synthetic
ctgcagcactattagcgtcaggggccctcagtgggttgcctgaggggtcaagcctgtacttgggagaggggtatg

SEQ ID NO: 20532 - DNA, 75 bp, Artificial Sequence
  Synthetic
cctcagtgggttgcctgaggggtcaagcctgtacttgggagaggggtatgggaccaccatgactctacttgagcc

SEQ ID NO: 20533 - DNA, 75 bp, Artificial Sequence
  Synthetic
ggaatccttcacagcggaactacaaaccagaaccgcgggtattcactgattccatttggtacaaggatgatttca

SEQ ID NO: 20534 - DNA, 75 bp, Artificial Sequence
  Synthetic
accagaaccgcgggtattcactgattccatttggtacaaggatgatttcacacgaccacctggtggcattgtaaa

SEQ ID NO: 20535 - DNA, 75 bp, Artificial Sequence
  Synthetic
ttaatttcatattatctcgggtcccgccaaaatcactcaaattgatacacgttgatattgagttctccccagact

SEQ ID NO: 20536 - DNA, 75 bp, Artificial Sequence
  Synthetic
gccaaaatcactcaaattgatacacgttgatattgagttctccccagactctgatgtacggacgctactatctgg

SEQ ID NO: 20537 - DNA, 75 bp, Artificial Sequence
  Synthetic
gatttgcggttagagttttcttaagtgaccatatcatagtcaacttggtcactgccattctgtccgcttttgact

SEQ ID NO: 20538 - DNA, 75 bp, Artificial Sequence
  Synthetic
tgaccatatcatagtcaacttggtcactgccattctgtccgcttttgactctaatctggtgtgcattgcgtcagg

SEQ ID NO: 20539 - DNA, 75 bp, Artificial Sequence
  Synthetic
caaatgttgaggcttcaagaattgagtattacttgaggatggtccacggctgtgttgactcattaaaaattcctc

SEQ ID NO: 20540 - DNA, 75 bp, Artificial Sequence
  Synthetic
gtattacttgaggatggtccacggctgtgttgactcattaaaaattcctcatcaattaggaatcattaaatgggc

SEQ ID NO: 20541 - DNA, 75 bp, Artificial Sequence
  Synthetic
ggcggttaggtgatccagttaccagatcatttgatccggtttctgagctaataattgcgcgaacagggggatcag

SEQ ID NO: 20542 - DNA, 75 bp, Artificial Sequence
  Synthetic
atcatttgatccggtttctgagctaataattgcgcgaacagggggatcagtattaatggaatacgggacttttac

SEQ ID NO: 20543 - DNA, 75 bp, Artificial Sequence
  Synthetic
ttgtagagaccaccttaatggaaataagggttgagcaagatcagttggaagatgattcgaggagacaaatccagg

SEQ ID NO: 20544 - DNA, 75 bp, Artificial Sequence
  Synthetic
aagggttgagcaagatcagttggaagatgattcgaggagacaaatccaggtagtccctgcttttaatacaagatc

SEQ ID NO: 20545 - DNA, 75 bp, Artificial Sequence
  Synthetic
atgttatctgtgtgaacatagatcacctctttcccaaacaccgacatgctcttgtcacacaacttacttaccagt

SEQ ID NO: 20546 - DNA, 75 bp, Artificial Sequence
  Synthetic
cctctttcccaaacaccgacatgctcttgtcacacaacttacttaccagtcagtgtgccttggggacttgattga

SEQ ID NO: 20547 - DNA, 75 bp, Artificial Sequence
  Synthetic
ggggactcaatgagacaattaaccatatcatcactggacaagtgtcgcggaataaggcaagggattttttcaaga

SEQ ID NO: 20548 - DNA, 75 bp, Artificial Sequence
  Synthetic
tatcatcactggacaagtgtcgcggaataaggcaagggattttttcaagaggcgcctgaagttggttggcttttc

SEQ ID NO: 20549 - DNA, 75 bp, Artificial Sequence
  Synthetic
ttattatgaataatcggagtcgaaatcgtaaatagaaagacataaaattgcaaataagcaatgatcgtattaata

SEQ ID NO: 20550 - DNA, 75 bp, Artificial Sequence
  Synthetic
attatgccacagtcggggatgctgcagcttacttcaagaacgcgggtatggctgcattcttcttaactctgcggt

SEQ ID NO: 20551 - DNA, 75 bp, Artificial Sequence
  Synthetic
ccaaaggatcgacagtcactgcagcctgcatcacccttggcagcatcgagtatgatagtgacatcaaggaagtgg

SEQ ID NO: 20552 - DNA, 75 bp, Artificial Sequence
  Synthetic
tatgatagtgacatcaaggaagtggcaaaggcctgctataatcttcaggtgtcagttaggatgtctgctgattca

SEQ ID NO: 20553 - DNA, 75 bp, Artificial Sequence
  Synthetic
tccacggtaggctccacttcaatggcacatacaccgagtctgaactcaatcctggcctattcaataatcattggg

SEQ ID NO: 20554 - DNA, 75 bp, Artificial Sequence
  Synthetic
agattgacaaggcaaggcctgcggagacaaaaaatgcagtgagggggaaggcaggctgggatcacatcccagctg

SEQ ID NO: 20555 - DNA, 75 bp, Artificial Sequence
  Synthetic
aaaactgtatcaagctctttaggcaggcttaggggtgagctctattcaccatcgtgtagcattccgcagtcggct

SEQ ID NO: 20556 - DNA, 75 bp, Artificial Sequence
  Synthetic
gatgccttaaagtcaacatccctatgcttgtcactgcatctgaagatcccaccactcgttggcaactagcatgtt

SEQ ID NO: 20557 - DNA, 75 bp, Artificial Sequence
  Synthetic
ggaggccttgaccagtgtgctgatacagatctggatcctggtggctaaggccatgaccaacattgatggctctgg

SEQ ID NO: 20558 - DNA, 75 bp, Artificial Sequence
  Synthetic
aggactgacaccattcttgactaccttaagatatgggataggcaccaagtatgctgctgttgcactcagtgtgtt

SEQ ID NO: 20559 - DNA, 75 bp, Artificial Sequence
  Synthetic
agcctacttaccctgtaccaagacaagggtgtggaggccggatacatggcactccttgaagatccagattccatg

SEQ ID NO: 20560 - DNA, 75 bp, Artificial Sequence
  Synthetic
cactttgcacccggaaatttcccacacatgtactcctatgcgatgggggtggcttcttaccatgaccccagcatg

SEQ ID NO: 20561 - DNA, 75 bp, Artificial Sequence
  Synthetic
atcatcaagcatgtctcaatcagcgcccaggaccccggactaccagcctgattttgaactgtaggctgcatccac

SEQ ID NO: 20562 - DNA, 75 bp, Artificial Sequence
  Synthetic
actcacccgccgagatccaatccaacaccccagcatccccatcatttaattaaaaactgaccaatagggtgggga

SEQ ID NO: 20563 - DNA, 75 bp, Artificial Sequence
  Synthetic
atcccaaaggggataaccagcgctttaactaaggcctgggaggctgaggcagcaactgctggcaatggggacacc

SEQ ID NO: 20564 - DNA, 75 bp, Artificial Sequence
  Synthetic
ccccgaagacacaggcaccaaccagaccatccaggaagccaatatcgttgaaacaccccaccccgaagtgctatc

SEQ ID NO: 20565 - DNA, 75 bp, Artificial Sequence
  Synthetic
ggcagccaaagccagactcaagaggcccaaggcagggagggacacccacgacaatccctctgcgcaacctgatca

SEQ ID NO: 20566 - DNA, 75 bp, Artificial Sequence
  Synthetic
cccaaggcagggagggacacccacgacaatccctctgcgcaacctgatcattttttaaaggggggccccctgagc

SEQ ID NO: 20567 - DNA, 75 bp, Artificial Sequence
  Synthetic
cggcaccgtcgatccccgcccatcacaaactcaggatcattccctcaccggagagaaatggcaatcgtcaccgac

SEQ ID NO: 20568 - DNA, 75 bp, Artificial Sequence
  Synthetic
acctagctgtcctgcctcaactaaggaacgaggttgcagcaatcaggacatcacaggccatgatagaggggacac

SEQ ID NO: 20569 - DNA, 75 bp, Artificial Sequence
  Synthetic
tcaattcaatcaagattctcgatcctgggaattatcaagaatcatcactaaacagctggttcaaaccacgccaag

SEQ ID NO: 20570 - DNA, 75 bp, Artificial Sequence
  Synthetic
gaccacccccagtaatgaatacaacaataatcagaacccccctaaaacacatggtcaacccaacacaccacccgc

SEQ ID NO: 20571 - DNA, 75 bp, Artificial Sequence
  Synthetic
aataatcagaacccccctaaaacacatggtcaacccaacacaccacccgcaccacccgctactatcctttgccag

SEQ ID NO: 20572 - DNA, 75 bp, Artificial Sequence
  Synthetic
gcaaccgcaagatagggtggggaaggtgctttgcctgcaagagggctccctcatcttcagacacgtacccgccaa

SEQ ID NO: 20573 - DNA, 75 bp, Artificial Sequence
  Synthetic
ccccagagcacatcaatcagcccaagagaacgatggtgagtgctgcgatgatgaccattggcctggtccccgcca

SEQ ID NO: 20574 - DNA, 75 bp, Artificial Sequence
  Synthetic
ggccgacactcttcctggagtatactgggaaactaacaaaagctctgttagggttcatgtctactagccgaacag

SEQ ID NO: 20575 - DNA, 75 bp, Artificial Sequence
  Synthetic
gagtatgtgctggatcccaaattcacagttaaaaaagagaaagcccgactcaaccctttcaagaaggcagcccaa

SEQ ID NO: 20576 - DNA, 75 bp, Artificial Sequence
  Synthetic
caaccctttcaagaaggcagcccaatgatcaaatctgcaggatctcaagaatcagaccactctatactattcacc

SEQ ID NO: 20577 - DNA, 75 bp, Artificial Sequence
  Synthetic
agcaaaccgaatccttactagggtggggaaggagttgattgggtgtctaaacaaaagcattcctttacacctcct

SEQ ID NO: 20578 - DNA, 75 bp, Artificial Sequence
  Synthetic
tatcacgcacaatcctgactttgattctcagcacacttaccggctatttaatgaatgcccactccaccaatgtga

SEQ ID NO: 20579 - DNA, 75 bp, Artificial Sequence
  Synthetic
ggtatttttgtaactcaagtccgacaactacagatctaccaacagtctgggtatcatgaccttgtcatcaggtta

SEQ ID NO: 20580 - DNA, 75 bp, Artificial Sequence
  Synthetic
aactacagatctaccaacagtctgggtatcatgaccttgtcatcaggttattacctcttctaccggcagaactta

SEQ ID NO: 20581 - DNA, 75 bp, Artificial Sequence
  Synthetic
agagtacaacaacacggtatcacagctgttgcagcctatcaaaaccaacctggataccttattggctgatggtag

SEQ ID NO: 20582 - DNA, 75 bp, Artificial Sequence
  Synthetic
ctgttgcagcctatcaaaaccaacctggataccttattggctgatggtagcacaagggatgccgatatacagcca

SEQ ID NO: 20583 - DNA, 75 bp, Artificial Sequence
  Synthetic
ttcgaaatttcacaaggactcgaggcaactgcaactgtgctatcaaaactgcaaactgagctcaatgagaacatt

SEQ ID NO: 20584 - DNA, 75 bp, Artificial Sequence
  Synthetic
gtgctgccatggggaatcgccttggtgtatcactatcactctacttgaccttaatgaccactctatttggggacc

SEQ ID NO: 20585 - DNA, 75 bp, Artificial Sequence
  Synthetic
tgtatcactatcactctacttgaccttaatgaccactctatttggggaccagatcacaaacccagtgctgacacc

SEQ ID NO: 20586 - DNA, 75 bp, Artificial Sequence
  Synthetic
aagaacactagcggtcaatagggatggtggactttatagagcccaggtgcctcccgaggtagttgaacggtctgg

SEQ ID NO: 20587 - DNA, 75 bp, Artificial Sequence
  Synthetic
aagcagcaacatgtagatgtaataaaccgccatctattattgcccaatactctgcatcagctctagtcaccatca

SEQ ID NO: 20588 - DNA, 75 bp, Artificial Sequence
  Synthetic
gacatctcctctgacattgccaaaatcaacagttccatcgaggctgcgagagagcagctggaactgagcaaccag

SEQ ID NO: 20589 - DNA, 75 bp, Artificial Sequence
  Synthetic
gctcatcacagcctgtgaccactaaattagggacgcctttctaggagaataatcatatcactctactcaatgatg

SEQ ID NO: 20590 - DNA, 75 bp, Artificial Sequence
  Synthetic
attagggacgcctttctaggagaataatcatatcactctactcaatgatgagcaaaacgtaccaatcgtcaatga

SEQ ID NO: 20591 - DNA, 75 bp, Artificial Sequence
  Synthetic
taattaaaaacatttgaagtgagggtgagagggggggagtgtatggtagggtggggaaggtagccaattcctgcc

SEQ ID NO: 20592 - DNA, 75 bp, Artificial Sequence
  Synthetic
tgagagggggggagtgtatggtagggtggggaaggtagccaattcctgcctattgggccgaccgtatcaaaagaa

SEQ ID NO: 20593 - DNA, 75 bp, Artificial Sequence
  Synthetic
caggaattggtcccggggatctagatcactgccgttaccctgttcatgactccgcttacctgcatggagttaatc

SEQ ID NO: 20594 - DNA, 75 bp, Artificial Sequence
  Synthetic
ccggatccgggcattgctacctcctttgcagcttagtgtcggaacccgaacctgatgactatgtgtcacctgatc

SEQ ID NO: 20595 - DNA, 75 bp, Artificial Sequence
  Synthetic
tactactacatccaggatccaaatgactattgtcctgacccgctacaagatcagatcttaagggcggaacaatcg

SEQ ID NO: 20596 - DNA, 75 bp, Artificial Sequence
  Synthetic
agagaagctcgagctggtggcctcatccccagatttacctgcttgattccaggattgcaagtccgggtactcaga

SEQ ID NO: 20597 - DNA, 75 bp, Artificial Sequence
  Synthetic
taccgttctagatccatgattaggtacctttccaatcaatcatttggtttttaattaaaaacgaaagaatgggcc

SEQ ID NO: 20598 - DNA, 75 bp, Artificial Sequence
  Synthetic
ctccttgactcacacctgcgtacactcgatctcacttctataaagaaggaatccttctcaaattcgccccacaat

SEQ ID NO: 20599 - DNA, 75 bp, Artificial Sequence
  Synthetic
ccccgcttaatggcccacatcgaccacactaaagatagattaaggactcatggtgtcttaggtttccaccagact

SEQ ID NO: 20600 - DNA, 75 bp, Artificial Sequence
  Synthetic
cacctgtctcattaacgcagactacaccgttgttttttccacacagaaccgtgttataacggtcttgcctttcga

SEQ ID NO: 20601 - DNA, 75 bp, Artificial Sequence
  Synthetic
tctgtgcccgctttatgtatcccagaagccaacttcatgagaggataagtacaatattagcccttggagaccaac

SEQ ID NO: 20602 - DNA, 75 bp, Artificial Sequence
  Synthetic
gcgtacagtaaccttcctccatctgaatcggcagaattgctgtgcctgctacgcctgtggggtcatcccttgcta

SEQ ID NO: 20603 - DNA, 75 bp, Artificial Sequence
  Synthetic
aacagccttgatgcagcaaagaaagtcagggaatctatgtgtgccgggaaggttctcgattacaacgccattcga

SEQ ID NO: 20604 - DNA, 75 bp, Artificial Sequence
  Synthetic
cttgagcactatttggatgtctcaatgatagaatttgagaaaacttttgaagtggaactatctgacagcctaagc

SEQ ID NO: 20605 - DNA, 75 bp, Artificial Sequence
  Synthetic
tccctgacaaaaaatttgttggctattagccaactgagttacaactcgatggccgctaaggtgcgattgctgagg

SEQ ID NO: 20606 - DNA, 75 bp, Artificial Sequence
  Synthetic
tgctttttcttggatacatgtccgtctcaccaacagcactatgtacgttgctgaccccttcaatccaccagactc

SEQ ID NO: 20607 - DNA, 75 bp, Artificial Sequence
  Synthetic
aataagaacaccgggatttttattataagtgcacgaggtggtatagaaggcctccaacaaaaactatggactggc

SEQ ID NO: 20608 - DNA, 75 bp, Artificial Sequence
  Synthetic
atatcaatcgcaattgcccaagcagcagcagccctcgaaggcttacgaattgctgctactctgcagggggataac

SEQ ID NO: 20609 - DNA, 75 bp, Artificial Sequence
  Synthetic
aatcccctattagcaggtgtcgttgacccgaactacaaccaagaattagagctattagctcagttcttgcttgat

SEQ ID NO: 20610 - DNA, 75 bp, Artificial Sequence
  Synthetic
cttgggaaggaaaaaacatatacaaggattggtagatactacaaaaacaattattcagtgctcattggaaagaca

SEQ ID NO: 20611 - DNA, 75 bp, Artificial Sequence
  Synthetic
attgattcttcatctacactctgataattcttgctgtctccgggagatgccaacgaccggctttgtacctgctct

SEQ ID NO: 20612 - DNA, 75 bp, Artificial Sequence
  Synthetic
aattcttgctgtctccgggagatgccaacgaccggctttgtacctgctctaggactaaccccatgtttaactgtc

SEQ ID NO: 20613 - DNA, 75 bp, Artificial Sequence
  Synthetic
atgatagcccaatacccggtgatttggaccagaggctcatccagaccaaatttttcatgggttctgacaatttgg

SEQ ID NO: 20614 - DNA, 75 bp, Artificial Sequence
  Synthetic
ggaccagaggctcatccagaccaaatttttcatgggttctgacaatttggataatcttgatatctaccaacagcg

SEQ ID NO: 20615 - DNA, 75 bp, Artificial Sequence
  Synthetic
ttgttgaaagggagctagagccaggtaagcccttggttaaacaagcggttatgttcttgagggactcggtccgct

SEQ ID NO: 20616 - DNA, 75 bp, Artificial Sequence
  Synthetic
cattcagaagcaaagaacttggttaaagttagaaaccttcctgtagaagagaaaaccgccttactgtaccagatg

SEQ ID NO: 20617 - DNA, 75 bp, Artificial Sequence
  Synthetic
aagttagaaaccttcctgtagaagagaaaaccgccttactgtaccagatgttggtcactgaggccaatgctagga

SEQ ID NO: 20618 - DNA, 75 bp, Artificial Sequence
  Synthetic
gacattcatacaccagcattgtattttgtatcaaagaaaatgctagggatgcttaaaaggtcaaccacacccttg

SEQ ID NO: 20619 - DNA, 75 bp, Artificial Sequence
  Synthetic
tgatgttcccggtcacatggcagaagaatttccctgtttgtttagtagttataacgccacatatgaagacacaat

SEQ ID NO: 20620 - DNA, 75 bp, Artificial Sequence
  Synthetic
ccaccccatccagagcacttggtcgtcactacatcctgcggcctcttgggctctactcatccgcatggtaccggt

SEQ ID NO: 20621 - DNA, 75 bp, Artificial Sequence
  Synthetic
tactggctattgcaacctggagggcgatttgcagttagagttttcttaagtgaccatatcatagtaaacttggtc

SEQ ID NO: 20622 - DNA, 75 bp, Artificial Sequence
  Synthetic
tattaatggaatacggggcttttactaacctcaggtgtgcgaacttggcagatacatacaaacttctggcttcaa

SEQ ID NO: 20623 - DNA, 75 bp, Artificial Sequence
  Synthetic
gatacatacaaacttctggcttcaattgtagagaccaccctaatggaaataagggttgagcaagatcaattagaa

SEQ ID NO: 20624 - DNA, 75 bp, Artificial Sequence
  Synthetic
actctgcggtggttggagctacctctcactttagctgttcaggttgttgattattatgaataatcggagtcggaa

SEQ ID NO: 20625 - DNA, 75 bp, Artificial Sequence
  Synthetic
ttattatgaataatcggagtcggaatcgtaaataggaagtcacaaagttgtgaataaacaatgattgcattagta

SEQ ID NO: 20626 - DNA, 75 bp, Artificial Sequence
  Synthetic
accaaacaaggaaaccatatgcatgggtaaattacgggcacatatctaaagtcgtgagggggaagctggtggact

SEQ ID NO: 20627 - DNA, 75 bp, Artificial Sequence
  Synthetic
gtcgtgagggggaagctggtggactccgggtccggagtcggtggacctgagtctagtagcttctccactgcagca

SEQ ID NO: 20628 - DNA, 75 bp, Artificial Sequence
  Synthetic
ccgggtccggagtcggtggacctgagtctagtagcttctccactgcagcaagatgtcatcagtgttcactgacta

SEQ ID NO: 20629 - DNA, 75 bp, Artificial Sequence
  Synthetic
gtgccccgagtggcctacttagagtgggcataccggtctgtgtgctcctttcagaggaccctgaagagaggtgga

SEQ ID NO: 20630 - DNA, 75 bp, Artificial Sequence
  Synthetic
gggcataccggtctgtgtgctcctttcagaggaccctgaagagaggtggagttttgtctgcttttgtatgcggtg

SEQ ID NO: 20631 - DNA, 75 bp, Artificial Sequence
  Synthetic
cggtactcagcgcacacgccagcaatatgagaagtcatgtagcgcttgctgccagatgtggtgatgctgacatca

SEQ ID NO: 20632 - DNA, 75 bp, Artificial Sequence
  Synthetic
tatgagaagtcatgtagcgcttgctgccagatgtggtgatgctgacatcaacatccttgaggtcgagtcaattga

SEQ ID NO: 20633 - DNA, 75 bp, Artificial Sequence
  Synthetic
gacgtgctcggcagatgtatgcgattgcacaagacctccctccttcattcagtaatggtagcccgttctctaata

SEQ ID NO: 20634 - DNA, 75 bp, Artificial Sequence
  Synthetic
tgcacaagacctccctccttcattcagtaatggtagcccgttctctaatagggatattgaggataactacccgac

SEQ ID NO: 20635 - DNA, 75 bp, Artificial Sequence
  Synthetic
gggttgcggctatgaaaagcatgacagcacctgacacgtcatcagaatcggagggtcggaggttggcgaagtata

SEQ ID NO: 20636 - DNA, 75 bp, Artificial Sequence
  Synthetic
agcacctgacacgtcatcagaatcggagggtcggaggttggcgaagtatattcagcaaaatagagttgtgagaag

SEQ ID NO: 20637 - DNA, 75 bp, Artificial Sequence
  Synthetic
gctctttagtgctacgccatttcctaatcactgagatcaaacgtgctacttcaatgggctccaacaccactaggt

SEQ ID NO: 20638 - DNA, 75 bp, Artificial Sequence
  Synthetic
aatcactgagatcaaacgtgctacttcaatgggctccaacaccactaggtactatgcaactgtgggtgatgctgc

SEQ ID NO: 20639 - DNA, 75 bp, Artificial Sequence
  Synthetic
ttgggataggcacgaagtactccactcttgctgtctctgcgttgtctgctgacatgaagaagcttcaaagtttga

SEQ ID NO: 20640 - DNA, 75 bp, Artificial Sequence
  Synthetic
tcttgctgtctctgcgttgtctgctgacatgaagaagcttcaaagtttgatcagggtttaccaaagtaagggaga

SEQ ID NO: 20641 - DNA, 75 bp, Artificial Sequence
  Synthetic
ccccaggcaattacccgctcatgtattcttatgcaatgggagtgggatcaattcttgaggccagcattgccagat

SEQ ID NO: 20642 - DNA, 75 bp, Artificial Sequence
  Synthetic
tgacactttctaccgcttaggtgtcgagacagcccagagaaatcaggggtctcttgatgaaacactggcaaagga

SEQ ID NO: 20643 - DNA, 75 bp, Artificial Sequence
  Synthetic
gcctggacctagcaggagaagcacctacaactcaaaggcaaccaacattcctcagtgaccaagattatgaagatg

SEQ ID NO: 20644 - DNA, 75 bp, Artificial Sequence
  Synthetic
agcagccagcccccacccactccaggagccggcctgacaccatactcagatgatgcaagtggcctagatatttaa

SEQ ID NO: 20645 - DNA, 75 bp, Artificial Sequence
  Synthetic
gagccggcctgacaccatactcagatgatgcaagtggcctagatatttaatccagataaatcaatgaaggaaaag

SEQ ID NO: 20646 - DNA, 75 bp, Artificial Sequence
  Synthetic
tgatgcaagtggcctagatatttaatccagataaatcaatgaaggaaaaggatcggatcagcttacacatattac

SEQ ID NO: 20647 - DNA, 75 bp, Artificial Sequence
  Synthetic
aagaaggtgagggggaagttcctggtgcacgagttgagcaccaacgagctcaactagcaccatggacttttccaa

SEQ ID NO: 20648 - DNA, 75 bp, Artificial Sequence
  Synthetic
caactagcaccatggacttttccaatgatcaggagatagcagatcttctcgagctaagctcagatgtgattagga

SEQ ID NO: 20649 - DNA, 75 bp, Artificial Sequence
  Synthetic
atacggaagggcaatacatccgaactgaggacagcatgggaggcagagacccacccacaagccaaggacagcaac

SEQ ID NO: 20650 - DNA, 75 bp, Artificial Sequence
  Synthetic
aaacagcacaagcaaccaaccgcccgaccagccagaggaccaatcccatgacctcccaggcacaaacacccccca

SEQ ID NO: 20651 - DNA, 75 bp, Artificial Sequence
  Synthetic
cagcactccgcaagctggaaaagcaaggcaaaagttccggcaagacaacagcagacagcagcccaggtcgcgatc

SEQ ID NO: 20652 - DNA, 75 bp, Artificial Sequence
  Synthetic
gcagacagcagcccaggtcgcgatccatctccttcaaaaaagggcgagagggacatagtggggaagaggcaacac

SEQ ID NO: 20653 - DNA, 75 bp, Artificial Sequence
  Synthetic
ccccccaaggccgtcacatgctcgactggcccaacaagctgctcaaaacgtcatccaccaagcagcggcgcccca

SEQ ID NO: 20654 - DNA, 75 bp, Artificial Sequence
  Synthetic
ctggcccaacaagctgctcaaaacgtcatccaccaagcagcggcgccccagggaataggcggcacagaagggaat

SEQ ID NO: 20655 - DNA, 75 bp, Artificial Sequence
  Synthetic
ccaatttgtgccccaatcactgcagaacccagggtcttcaagtgcacatgcgggagatgcccccgagtatgcatt

SEQ ID NO: 20656 - DNA, 75 bp, Artificial Sequence
  Synthetic
aacccagggtcttcaagtgcacatgcgggagatgcccccgagtatgcattaactgtcgcaacgatggtggagaca

SEQ ID NO: 20657 - DNA, 75 bp, Artificial Sequence
  Synthetic
gttaactaagtttgtgtcccctattcagcaagtcaaagctgatgtacaaattataaaaacatcttgtgcagtcat

SEQ ID NO: 20658 - DNA, 75 bp, Artificial Sequence
  Synthetic
tgagggacaattagccactgttcaaatattggagcccggccattcttccattagatcactcgacgagatgcgcca

SEQ ID NO: 20659 - DNA, 75 bp, Artificial Sequence
  Synthetic
atcatgtcatacgagatggtatgattgttaaggatccacttgctcgcccagttcacccagacaaatggcagtcca

SEQ ID NO: 20660 - DNA, 75 bp, Artificial Sequence
  Synthetic
tgttaaggatccacttgctcgcccagttcacccagacaaatggcagtccactgtcactgcccctgtggccaccac

SEQ ID NO: 20661 - DNA, 75 bp, Artificial Sequence
  Synthetic
tcggcatcagcgggcccaaaagagcaaagattgaggctgagttagcaaatgtgaaggaccgggactcactagttc

SEQ ID NO: 20662 - DNA, 75 bp, Artificial Sequence
  Synthetic
gaatcaagaaacgtattatgaatgcgtaatcccgtgcttggttccaacaagcgtcccccatcacggtcaccagaa

SEQ ID NO: 20663 - DNA, 75 bp, Artificial Sequence
  Synthetic
ccggatcgaactgatcaccccgttatgcacaaattaataaaaaattgagggggaactggtggtgcccgaactggg

SEQ ID NO: 20664 - DNA, 75 bp, Artificial Sequence
  Synthetic
tgcacaaattaataaaaaattgagggggaactggtggtgcccgaactgggccgcaacccgtgacccagcgagagc

SEQ ID NO: 20665 - DNA, 75 bp, Artificial Sequence
  Synthetic
cgccaagacatggcaacgtcagagctgaatctctacattgaccgggaatcaccccaggtcaggttacttgccttc

SEQ ID NO: 20666 - DNA, 75 bp, Artificial Sequence
  Synthetic
tgaatctctacattgaccgggaatcaccccaggtcaggttacttgccttccccataatcatgaagccaaaagatg

SEQ ID NO: 20667 - DNA, 75 bp, Artificial Sequence
  Synthetic
gtgactggcggaaagaagagcgccatatttgttaactgttatggcttcgtagaagatcacggagggaaagatagt

SEQ ID NO: 20668 - DNA, 75 bp, Artificial Sequence
  Synthetic
tatttgttaactgttatggcttcgtagaagatcacggagggaaagatagtggattctcccccatcagtgaagagg

SEQ ID NO: 20669 - DNA, 75 bp, Artificial Sequence
  Synthetic
tatgagaatgatgtaagagaggtagcaaaagcatgctataacctccaggtatccgtgagaatgtctgctgacacc

SEQ ID NO: 20670 - DNA, 75 bp, Artificial Sequence
  Synthetic
caaaagcatgctataacctccaggtatccgtgagaatgtctgctgacaccactcagaaggtagtctacacgataa

SEQ ID NO: 20671 - DNA, 75 bp, Artificial Sequence
  Synthetic
tgtgttgtggcagcagaaggcgcaatcaaatgccccgagaagatgacttcagagcgagtctataagtttaaagtg

SEQ ID NO: 20672 - DNA, 75 bp, Artificial Sequence
  Synthetic
tcaaatgccccgagaagatgacttcagagcgagtctataagtttaaagtgatgtttgtctccctcacatttctcc

SEQ ID NO: 20673 - DNA, 75 bp, Artificial Sequence
  Synthetic
gctgccctaattgcaatccaggctgaaataaaattgggatttgatctgccaattgaccatccgatggctaagtat

SEQ ID NO: 20674 - DNA, 75 bp, Artificial Sequence
  Synthetic
tcgcaacagtgtgggtccacctctgcaattttaaacgcaccgataggcggggagctgatcgctcagttgagaata

SEQ ID NO: 20675 - DNA, 75 bp, Artificial Sequence
  Synthetic
ggagctgatcgctcagttgagaatattaggaataaagtgagagcaatgggcctcaagctcactctgtgtgacctg

SEQ ID NO: 20676 - DNA, 75 bp, Artificial Sequence
  Synthetic
ttaggaataaagtgagagcaatgggcctcaagctcactctgtgtgacctgtgggggcccacaatagtctgtgagg

SEQ ID NO: 20677 - DNA, 75 bp, Artificial Sequence
  Synthetic
gtgggttgccaccccatatggaaatgtaattctactgtggcgaaaatcatgtggtcctgcactacttggatcgag

SEQ ID NO: 20678 - DNA, 75 bp, Artificial Sequence
  Synthetic
gtaattctactgtggcgaaaatcatgtggtcctgcactacttggatcgagtcggccaaagccataattcaggcat

SEQ ID NO: 20679 - DNA, 75 bp, Artificial Sequence
  Synthetic
atctcaactgacaagaagaaagcagagggattcaacccgttcataaaatcagttaagtgatctgtgataattcac

SEQ ID NO: 20680 - DNA, 75 bp, Artificial Sequence
  Synthetic
agggattcaacccgttcataaaatcagttaagtgatctgtgataattcactcccgggctgcaaccaatccgatgg

SEQ ID NO: 20681 - DNA, 75 bp, Artificial Sequence
  Synthetic
ctcactaatcaaccaattagtgtgctcgatcagtgtgatatggtcaccggagctaactgatcatgagtaaatcac

SEQ ID NO: 20682 - DNA, 75 bp, Artificial Sequence
  Synthetic
agctaactgatcatgagtaaatcacagctgtttgaaaatttatcaaaaaatctcatgagcaattgatcaggggcc

SEQ ID NO: 20683 - DNA, 75 bp, Artificial Sequence
  Synthetic
ggagcccgactgggccacacaggaaacatgcccagtctgagtgtacgccttatcttgctcctactcccccatatt

SEQ ID NO: 20684 - DNA, 75 bp, Artificial Sequence
  Synthetic
tatcttgctcctactcccccatattatcctgacattggataactcgaggttgcttcaacaaggaatcatgagtgc

SEQ ID NO: 20685 - DNA, 75 bp, Artificial Sequence
  Synthetic
cagttagattaatccccaatcttccacaggctgtccaggcatgctcagttcaacaaattaagtcatacaacgaca

SEQ ID NO: 20686 - DNA, 75 bp, Artificial Sequence
  Synthetic
acaggctgtccaggcatgctcagttcaacaaattaagtcatacaacgacacattgaaccgcatattcacaccgat

SEQ ID NO: 20687 - DNA, 75 bp, Artificial Sequence
  Synthetic
cacctcactccatacgtgagccgaggctagtaggagctatcattggcaccgctgcattggggttggccacggctg

SEQ ID NO: 20688 - DNA, 75 bp, Artificial Sequence
  Synthetic
gctgcattggggttggccacggctgcacaagtcactgcagctcttgctcttaatcaagcccaggataacgccaga

SEQ ID NO: 20689 - DNA, 75 bp, Artificial Sequence
  Synthetic
tccgaaagacaaatgaagcagtcttagagcttaaagaggccacaggacagattgctgtcgcactagacaagactc

SEQ ID NO: 20690 - DNA, 75 bp, Artificial Sequence
  Synthetic
agagcttaaagaggccacaggacagattgctgtcgcactagacaagactcaacggtttattaacgacaacatctt

SEQ ID NO: 20691 - DNA, 75 bp, Artificial Sequence
  Synthetic
ttgagttatcactgtatttgacagagttgagcaccgtctttggttcccaaattactaaccctgcgctgtcaacct

SEQ ID NO: 20692 - DNA, 75 bp, Artificial Sequence
  Synthetic
tatcacttcaagcgttgatgtcgctttgtggtaacgacttcaattacctattaaatctgatgggtgctaagcata

SEQ ID NO: 20693 - DNA, 75 bp, Artificial Sequence
  Synthetic
cagtatgatcaagcaaaccagataatggtcattcaagtctcagtgcccagcatctcatctgtgtctggcctcagg

SEQ ID NO: 20694 - DNA, 75 bp, Artificial Sequence
  Synthetic
tggtcattcaagtctcagtgcccagcatctcatctgtgtctggcctcaggcttaccgagctttttactttaagca

SEQ ID NO: 20695 - DNA, 75 bp, Artificial Sequence
  Synthetic
gagtccggccaattgattgaagagattgacacccaagcttgcacaatgactgacactactgcatactgcactata

SEQ ID NO: 20696 - DNA, 75 bp, Artificial Sequence
  Synthetic
tgacactactgcatactgcactatagttaggacaaaacccctaccagacctagtcgtgggctgtctgaaaggtga

SEQ ID NO: 20697 - DNA, 75 bp, Artificial Sequence
  Synthetic
tcggggtatttgatggtctcattatagcgaactgtaaagccacgatttgtcgatgcctgaagccggagatgataa

SEQ ID NO: 20698 - DNA, 75 bp, Artificial Sequence
  Synthetic
agcgaactgtaaagccacgatttgtcgatgcctgaagccggagatgataattccccaaaatagaggctctccgat

SEQ ID NO: 20699 - DNA, 75 bp, Artificial Sequence
  Synthetic
cgttgcaagttgaggctcaagtgagcggatcatactctcgaaatatcactgtgggctcaagccaaatagctccat

SEQ ID NO: 20700 - DNA, 75 bp, Artificial Sequence
  Synthetic
cggatcatactctcgaaatatcactgtgggctcaagccaaatagctccatcagggcctcttgacatctcaagcga

SEQ ID NO: 20701 - DNA, 75 bp, Artificial Sequence
  Synthetic
agagcaatcaaattctaaacagagtaaacccagaactagtcaatgataccgccattatagtgactattgtgctgc

SEQ ID NO: 20702 - DNA, 75 bp, Artificial Sequence
  Synthetic
aaacccagaactagtcaatgataccgccattatagtgactattgtgctgctagtgctccttgtactatggtgcct

SEQ ID NO: 20703 - DNA, 75 bp, Artificial Sequence
  Synthetic
ttaagacattaccaaacccatatgtcatgcaggcaaagtccccgagcggcacgacacaattctaagtcacagaac

SEQ ID NO: 20704 - DNA, 75 bp, Artificial Sequence
  Synthetic
ctggtttcaacaaatgaaccccatgcaacttactaatactgtcttgattgctggcctagacacttcagttgatta

SEQ ID NO: 20705 - DNA, 75 bp, Artificial Sequence
  Synthetic
cacactaagggagcccaggaagaaggcagtaacaagctgaggggggaagagtgcacggtgcaacctctcttggtc

SEQ ID NO: 20706 - DNA, 75 bp, Artificial Sequence
  Synthetic
gcagtaacaagctgaggggggaagagtgcacggtgcaacctctcttggtcggaggctgtagtgctctatcacaga

SEQ ID NO: 20707 - DNA, 75 bp, Artificial Sequence
  Synthetic
ccactggactagctatgacatctctagttttttgcctgaatcaagtcctaatacagatcctccggcgtgatcttg

SEQ ID NO: 20708 - DNA, 75 bp, Artificial Sequence
  Synthetic
agttttttgcctgaatcaagtcctaatacagatcctccggcgtgatcttgaaagggcgttatcagcagcggggat

SEQ ID NO: 20709 - DNA, 75 bp, Artificial Sequence
  Synthetic
tattggctttcactatgacctgctctatcagtggctgtgtcctcagtttggtagccctgtatccagcacagcagg

SEQ ID NO: 20710 - DNA, 75 bp, Artificial Sequence
  Synthetic
tatcagtggctgtgtcctcagtttggtagccctgtatccagcacagcaggataacagaacccagagtaacaatgt

SEQ ID NO: 20711 - DNA, 75 bp, Artificial Sequence
  Synthetic
acacccggcctgctactcctcccccaccctattttcttgcgatacaattgagtgcagatatgcagccaagtcaat

SEQ ID NO: 20712 - DNA, 75 bp, Artificial Sequence
  Synthetic
accctattttcttgcgatacaattgagtgcagatatgcagccaagtcaatcatcctctgaatagcatacttaaaa

SEQ ID NO: 20713 - DNA, 75 bp, Artificial Sequence
  Synthetic
tttaagaaaaaattgagactgggctccacagagggcagtcgagggggaagcctggtgtcaccgctggtgaccaat

SEQ ID NO: 20714 - DNA, 75 bp, Artificial Sequence
  Synthetic
caagtgagctgagtaggagccaggcaactctgtatgagggtgaccccaatagtaaaagaacatggagaacagtat

SEQ ID NO: 20715 - DNA, 75 bp, Artificial Sequence
  Synthetic
agtaaaagaacatggagaacagtataccgtgcatccacccttattcttgaccttgctattttgtgtgtaagtata

SEQ ID NO: 20716 - DNA, 75 bp, Artificial Sequence
  Synthetic
accgtgcatccacccttattcttgaccttgctattttgtgtgtaagtatagttgcaattgtcaggatgtccactc

SEQ ID NO: 20717 - DNA, 75 bp, Artificial Sequence
  Synthetic
agtgacacatatcaatctgtgtggtccgatacacatcaaaaagtgaatagcatctttaaagaagttggaatatca

SEQ ID NO: 20718 - DNA, 75 bp, Artificial Sequence
  Synthetic
ccgatacacatcaaaaagtgaatagcatctttaaagaagttggaatatcaataccggtgacccttgataaaatgc

SEQ ID NO: 20719 - DNA, 75 bp, Artificial Sequence
  Synthetic
ttacagggggttaatggatctgctggcttcagtatcacaaactcgccggagtatagtggcggtatagatgccctt

SEQ ID NO: 20720 - DNA, 75 bp, Artificial Sequence
  Synthetic
gcttcagtatcacaaactcgccggagtatagtggcggtatagatgcccttatctatcctcagaagtctcttaatg

SEQ ID NO: 20721 - DNA, 75 bp, Artificial Sequence
  Synthetic
gctccaacaacttcacatgggtgcacacgcataccgacattccacctcgggtaccggcattggtgctatagtcac

SEQ ID NO: 20722 - DNA, 75 bp, Artificial Sequence
  Synthetic
cacgcataccgacattccacctcgggtaccggcattggtgctatagtcacaacactattgaatcaggctgtcacg

SEQ ID NO: 20723 - DNA, 75 bp, Artificial Sequence
  Synthetic
caccaaggtaagccggtgttcactacaagtgcagcagttatattagatgatgggaagaatcggaaaagctgtagt

SEQ ID NO: 20724 - DNA, 75 bp, Artificial Sequence
  Synthetic
caagtgcagcagttatattagatgatgggaagaatcggaaaagctgtagtgttgtcgccaatccaaatgggtgcg

SEQ ID NO: 20725 - DNA, 75 bp, Artificial Sequence
  Synthetic
cctacacccacacctatgatccatggcagactgcacttcaatgggacatatactgaatccgtgttggatcaaagt

SEQ ID NO: 20726 - DNA, 75 bp, Artificial Sequence
  Synthetic
agtaccctgcagtcgggagcgggtcagtaagtcatggtaggctattcttcccactatatggtggtatttcgaaaa

SEQ ID NO: 20727 - DNA, 75 bp, Artificial Sequence
  Synthetic
gaggagctggagtgtaagaacctaactagtaagcagagagaggacctgttcaacgcatacatgcccgggaaaatc

SEQ ID NO: 20728 - DNA, 75 bp, Artificial Sequence
  Synthetic
ttgtcatatgcaacctcaccacactagcagactgcaagattgcagtagctaacactagtacgatgatgatggcgg

SEQ ID NO: 20729 - DNA, 75 bp, Artificial Sequence
  Synthetic
tcctcatcatggtggcctgtcttaatctactacgatattctagtgagtgagttagtaaatgcacgccatctcgat

SEQ ID NO: 20730 - DNA, 75 bp, Artificial Sequence
  Synthetic
tctactacgatattctagtgagtgagttagtaaatgcacgccatctcgatatcgtcaattgggtaccctaccctc

SEQ ID NO: 20731 - DNA, 75 bp, Artificial Sequence
  Synthetic
tcaatttgcccagctgtctgtgtcacaggagtctatcaggatgtctgggtggttagtgtgggggatttcagcaat

SEQ ID NO: 20732 - DNA, 75 bp, Artificial Sequence
  Synthetic
cccctggattgcagccgcaaatcagtataactggctgactaggagacaactgttcacagcacaaacagaggccgc

SEQ ID NO: 20733 - DNA, 75 bp, Artificial Sequence
  Synthetic
gccttaccataatggaggtgacagataatctgcttggtgattggaggatcgcaccattgctctatgaggtcactg

SEQ ID NO: 20734 - DNA, 75 bp, Artificial Sequence
  Synthetic
taatctgcttggtgattggaggatcgcaccattgctctatgaggtcactgtggtggacaggcaacaatcctccag

SEQ ID NO: 20735 - DNA, 75 bp, Artificial Sequence
  Synthetic
caccagagaacaaattcactccacagcactaatctaaattcctggtcgttccccgggaaatgtaagatcaatatt

SEQ ID NO: 20736 - DNA, 75 bp, Artificial Sequence
  Synthetic
aattaatccggagcactacaattttcccagatggtttctgcatcatactctgtcactaatttaataaaaaatagc

SEQ ID NO: 20737 - DNA, 75 bp, Artificial Sequence
  Synthetic
tgtcactaatttaataaaaaatagcactttattgccccaactaaacgatacagggtcaggggcaactttacgggg

SEQ ID NO: 20738 - DNA, 75 bp, Artificial Sequence
  Synthetic
actttattgccccaactaaacgatacagggtcaggggcaactttacgggggccaaatcagagggggaaggctggt

SEQ ID NO: 20739 - DNA, 75 bp, Artificial Sequence
  Synthetic
cagtgtgaggcattcaaccattgctgaattaaagcttaaactaaacatggaaccacaagttcaaattcatcacat

SEQ ID NO: 20740 - DNA, 75 bp, Artificial Sequence
  Synthetic
aattaagccagagtgccacttaaattccccagtggtagaaaagaaactgactctactttggaaactcacaggtct

SEQ ID NO: 20741 - DNA, 75 bp, Artificial Sequence
  Synthetic
gggaagatgtacaacagtccgaggtgaacctgatgaaagagttgcgacttttagtgagaagaatgtcaagtagct

SEQ ID NO: 20742 - DNA, 75 bp, Artificial Sequence
  Synthetic
gaacctgatgaaagagttgcgacttttagtgagaagaatgtcaagtagcttgcacgcaaaaggagaattcatcga

SEQ ID NO: 20743 - DNA, 75 bp, Artificial Sequence
  Synthetic
tctctctgagcaagggtgacgccatactcgaaagccataagaaaatgttgacgagagtgggtggtatgatcagag

SEQ ID NO: 20744 - DNA, 75 bp, Artificial Sequence
  Synthetic
acgagagtgggtggtatgatcagaggcccggctgagcagttgtttttactgctagggaagaaattggccggtgac

SEQ ID NO: 20745 - DNA, 75 bp, Artificial Sequence
  Synthetic
acttgcctgactgccccattaatgctaggtttgagcaacaagactttggagaaagactatggtcacccactattg

SEQ ID NO: 20746 - DNA, 75 bp, Artificial Sequence
  Synthetic
taggtttgagcaacaagactttggagaaagactatggtcacccactattgacccctcacgggtgaccggtggtga

SEQ ID NO: 20747 - DNA, 75 bp, Artificial Sequence
  Synthetic
atatggtactccaaaggaagcaggcacagctccagacaccacacagtcttttacatggatcttcaatactaatag

SEQ ID NO: 20748 - DNA, 75 bp, Artificial Sequence
  Synthetic
acagctccagacaccacacagtcttttacatggatcttcaatactaataggggtacatccggatttggtcatcat

SEQ ID NO: 20749 - DNA, 75 bp, Artificial Sequence
  Synthetic
ttatgtacacggatgtcacagaagggcgggcaatgactaaattgattgcctcatctgagccaactatgctagagg

SEQ ID NO: 20750 - DNA, 75 bp, Artificial Sequence
  Synthetic
gcgggcaatgactaaattgattgcctcatctgagccaactatgctagaggtcattcacagagtggaggggttatg

SEQ ID NO: 20751 - DNA, 75 bp, Artificial Sequence
  Synthetic
tggtggcttcccttgagagtctcgcatatggatcagtccaactctgggataagtcacctgagcatgcaggggagt

SEQ ID NO: 20752 - DNA, 75 bp, Artificial Sequence
  Synthetic
atatggatcagtccaactctgggataagtcacctgagcatgcaggggagtttttttcattcaatcttaaagaaat

SEQ ID NO: 20753 - DNA, 75 bp, Artificial Sequence
  Synthetic
tcgagcagatcagattgttatacacgggcctaagtgtcaatcaagcaggagaaatgctttgtatcctacgccatt

SEQ ID NO: 20754 - DNA, 75 bp, Artificial Sequence
  Synthetic
gggcctaagtgtcaatcaagcaggagaaatgctttgtatcctacgccattggggtcatcctctactatgtgctac

SEQ ID NO: 20755 - DNA, 75 bp, Artificial Sequence
  Synthetic
ctcttgatacgacactcaaggtattagcattctttattgcggacatcataaatggccacaggaggtcacattcag

SEQ ID NO: 20756 - DNA, 75 bp, Artificial Sequence
  Synthetic
aatggccacaggaggtcacattcagggctgtggcccaacgtaaagcctgaatctttagtttcaccattagtccag

SEQ ID NO: 20757 - DNA, 75 bp, Artificial Sequence
  Synthetic
ttacaaagagatatcactgatagaatttcagaaaagcattgattatgatctagttgaggacctgagtgtgttttt

SEQ ID NO: 20758 - DNA, 75 bp, Artificial Sequence
  Synthetic
aagagcaattggctctcggtgtttcgaaaatcattattacccgggcacttgaaggacaagttgcaaaccgagggg

SEQ ID NO: 20759 - DNA, 75 bp, Artificial Sequence
  Synthetic
tgtccgtgagttcgagtatgtgacttctttgaattatctcagtgatccagagttctgtgcctcttactcactcaa

SEQ ID NO: 20760 - DNA, 75 bp, Artificial Sequence
  Synthetic
ggagagagaagtaaagactgatgggcgcatatttgcaaaaatgactagaaagatgaggaactgccaagtgttgtt

SEQ ID NO: 20761 - DNA, 75 bp, Artificial Sequence
  Synthetic
ttgtacaagagcagatcagtttaaccaaatcactactcgcaatgtctcaattagcacctcgggtctcagaatatc

SEQ ID NO: 20762 - DNA, 75 bp, Artificial Sequence
  Synthetic
caaatcactactcgcaatgtctcaattagcacctcgggtctcagaatatcaagggcgggtcctccgatcaacaga

SEQ ID NO: 20763 - DNA, 75 bp, Artificial Sequence
  Synthetic
gagaaaacaaaaggcggaagaccatcatagcatcattcttaaccactgacttacagaagtattgcctcaattgga

SEQ ID NO: 20764 - DNA, 75 bp, Artificial Sequence
  Synthetic
catagcatcattcttaaccactgacttacagaagtattgcctcaattggagatatactgtggtaaaaccatttgc

SEQ ID NO: 20765 - DNA, 75 bp, Artificial Sequence
  Synthetic
atctccgacttatgaacacaaccatgtttgttggagatccgcacaatgtcccccagttttcaactaacaaggacc

SEQ ID NO: 20766 - DNA, 75 bp, Artificial Sequence
  Synthetic
cttcatagtgtcccctcgtggaggaattgaagggttatgccaaaaaatgtggactatgatatctattgctgcaat

SEQ ID NO: 20767 - DNA, 75 bp, Artificial Sequence
  Synthetic
ggactatgatatctattgctgcaattcacctagctgccactgaatcaggatgccgggttgcttctatggtgcaag

SEQ ID NO: 20768 - DNA, 75 bp, Artificial Sequence
  Synthetic
tcacctagctgccactgaatcaggatgccgggttgcttctatggtgcaaggagataatcaagcaatcgcgataac

SEQ ID NO: 20769 - DNA, 75 bp, Artificial Sequence
  Synthetic
ccacgatatccaaaaggttctttaatacattcagagagatcaaccgaggcatcgggcacaaccttaaagtgcaag

SEQ ID NO: 20770 - DNA, 75 bp, Artificial Sequence
  Synthetic
tacattcagagagatcaaccgaggcatcgggcacaaccttaaagtgcaagaaactatccacagtgagtctttctt

SEQ ID NO: 20771 - DNA, 75 bp, Artificial Sequence
  Synthetic
tgaaaaatgctagcaggctggtcttagtgtcagaaactgtcggagagaattgtgttggaaattgttccaatatcg

SEQ ID NO: 20772 - DNA, 75 bp, Artificial Sequence
  Synthetic
agtgtcagaaactgtcggagagaattgtgttggaaattgttccaatatcggatcaactattgcaaggctaattga

SEQ ID NO: 20773 - DNA, 75 bp, Artificial Sequence
  Synthetic
taaagcaaattctgtttgacatcgatttctcactagaaccagagccatcaaaaggcctcatccattcaattcgtc

SEQ ID NO: 20774 - DNA, 75 bp, Artificial Sequence
  Synthetic
aaaggcctcatccattcaattcgtcacgaccctaacaatctgaagaacatatcagtcactccagcacaattgggt

SEQ ID NO: 20775 - DNA, 75 bp, Artificial Sequence
  Synthetic
tccggtatcaactgcgatggcggatatgaagttttacacacaggttgagttaacacccccccatctgttgagaaa

SEQ ID NO: 20776 - DNA, 75 bp, Artificial Sequence
  Synthetic
ggatcatggacaaccttatgcgctgacccgtactccctgaaccagccgtatgtgcagcttccgacttcatacctt

SEQ ID NO: 20777 - DNA, 75 bp, Artificial Sequence
  Synthetic
tgtgcagcttccgacttcataccttaaaaaacacactcagcgcatgttgctctcagcatcaacaaatcccctcct

SEQ ID NO: 20778 - DNA, 75 bp, Artificial Sequence
  Synthetic
agttcctattagatcgtgagtttgtgatgccacgagtggcacatacagtttttgagaccactgttgcaggcagga

SEQ ID NO: 20779 - DNA, 75 bp, Artificial Sequence
  Synthetic
gatgccacgagtggcacatacagtttttgagaccactgttgcaggcaggaggaaacacctacaaggattgattga

SEQ ID NO: 20780 - DNA, 75 bp, Artificial Sequence
  Synthetic
tcaaaaagagcatgttgatatcttcttacacagcggactatattatgtctttcattgacactatagcgacagcag

SEQ ID NO: 20781 - DNA, 75 bp, Artificial Sequence
  Synthetic
actctgggagaggggaatgatcaatgcaacaacttgtgctgtcacccttgctgattatgctaggacctattcctg

SEQ ID NO: 20782 - DNA, 75 bp, Artificial Sequence
  Synthetic
ccttggaactatgctcagggagtctaattgagcaaggcaacccttgctcgcagtgtgtaatgggtgatgagtctt

SEQ ID NO: 20783 - DNA, 75 bp, Artificial Sequence
  Synthetic
aattgagcaaggcaacccttgctcgcagtgtgtaatgggtgatgagtctttttcttggttttttcttccaggtaa

SEQ ID NO: 20784 - DNA, 75 bp, Artificial Sequence
  Synthetic
atgtgggttcaaagaccgaggagagacgggctgcatctctaaccacaattaagggaatgtctacgcacctcaggg

SEQ ID NO: 20785 - DNA, 75 bp, Artificial Sequence
  Synthetic
acgggctgcatctctaaccacaattaagggaatgtctacgcacctcagggctgcactgagaggtgcaagcgtata

SEQ ID NO: 20786 - DNA, 75 bp, Artificial Sequence
  Synthetic
tcgctaacacacgatgtgtcatatcggaagaacacttgcgagccctgtgtcctattccaagttcggctaacatcc

SEQ ID NO: 20787 - DNA, 75 bp, Artificial Sequence
  Synthetic
aacatagactaatggacggaattagcgtaactaaatttactccagcatctctggcacgagtctcatcatacgtcc

SEQ ID NO: 20788 - DNA, 75 bp, Artificial Sequence
  Synthetic
tcaaatgtcattttccaacaagttatgttattgggtctaggcatctttgagacatttcaccctctatttcacagg

SEQ ID NO: 20789 - DNA, 75 bp, Artificial Sequence
  Synthetic
tgttattgggtctaggcatctttgagacatttcaccctctatttcacaggtacatcaacagtccaatgaccctgc

SEQ ID NO: 20790 - DNA, 75 bp, Artificial Sequence
  Synthetic
ttcatggagactactgtagatgtaccaagcatgactataacaacaagtaacaaattcctatttgatccagagcca

SEQ ID NO: 20791 - DNA, 75 bp, Artificial Sequence
  Synthetic
caagcatgactataacaacaagtaacaaattcctatttgatccagagccaatccagggtgatgatgaggcaaaac

SEQ ID NO: 20792 - DNA, 75 bp, Artificial Sequence
  Synthetic
ccaccaggactcgtggcactactttcactcgtaactgcgaggatatcaatagatacttcaataggagagagtgct

SEQ ID NO: 20793 - DNA, 75 bp, Artificial Sequence
  Synthetic
cactcgtaactgcgaggatatcaatagatacttcaataggagagagtgcttataattccatccataacgatgcca

SEQ ID NO: 20794 - DNA, 75 bp, Artificial Sequence
  Synthetic
gacttgcgactactagccgtggcaatggcaagggaattttgtgataacttgtcctaccaattatattacctccga

SEQ ID NO: 20795 - DNA, 75 bp, Artificial Sequence
  Synthetic
tggcaagggaattttgtgataacttgtcctaccaattatattacctccgagttaaaggacgacatgccatccgag

SEQ ID NO: 20796 - DNA, 75 bp, Artificial Sequence
  Synthetic
attgcattgactatatcgcatcctggtgtttgggctaggcttaggctgataggagcagtaagcgcaggcagtagt

SEQ ID NO: 20797 - DNA, 75 bp, Artificial Sequence
  Synthetic
gtgtttgggctaggcttaggctgataggagcagtaagcgcaggcagtagtccaattagtgcaaccgtgaattact

SEQ ID NO: 20798 - DNA, 75 bp, Artificial Sequence
  Synthetic
cagttactcgagggttacgaaccagagatcattgtaccgaactacaaagatgacgacttgaataggaaagttgag

SEQ ID NO: 20799 - DNA, 75 bp, Artificial Sequence
  Synthetic
agatcattgtaccgaactacaaagatgacgacttgaataggaaagttgagcatatcttagcacggcgggcatgtc

SEQ ID NO: 20800 - DNA, 75 bp, Artificial Sequence
  Synthetic
ttagaaccaatagaaaaatgcactgccctttctgacctcaacaaattgtggacagctactgaccagcgcacaaga

SEQ ID NO: 20801 - DNA, 75 bp, Artificial Sequence
  Synthetic
ccctttctgacctcaacaaattgtggacagctactgaccagcgcacaagagaatgtttctctggaatatcacaga

SEQ ID NO: 20802 - DNA, 75 bp, Artificial Sequence
  Synthetic
agccgaaaactgctaaatgcaattaggggaagcacagattgcaaggcgtacgttgagaatctctatgaagacatc

SEQ ID NO: 20803 - DNA, 75 bp, Artificial Sequence
  Synthetic
ggggaagcacagattgcaaggcgtacgttgagaatctctatgaagacatcgacattgaattaacatcgctgactg

SEQ ID NO: 20804 - DNA, 75 bp, Artificial Sequence
  Synthetic
tatgacattgagttaaaagaactcactccgaacttcactgtcacctggtgctgttttgattcaactactgcactt

SEQ ID NO: 20805 - DNA, 75 bp, Artificial Sequence
  Synthetic
ctccgaacttcactgtcacctggtgctgttttgattcaactactgcacttaaatccaggtgtgtgaaccatgcta

SEQ ID NO: 20806 - DNA, 75 bp, Artificial Sequence
  Synthetic
tcatggtacaaggcagcaggtgtattaacaatacctggtttcctcaatctgccgaatggcaacggcctatatctt

SEQ ID NO: 20807 - DNA, 75 bp, Artificial Sequence
  Synthetic
gccgaatggcaacggcctatatcttgctgaatcatcaggagctatcatgactgttatggaacacctagtctgctc

SEQ ID NO: 20808 - DNA, 75 bp, Artificial Sequence
  Synthetic
ttcagtaatgagttgaatccgcctcaacgaaacttcggccccaacccgatccagtttgaagaaagcattgttgga

SEQ ID NO: 20809 - DNA, 75 bp, Artificial Sequence
  Synthetic
aacgaaacttcggccccaacccgatccagtttgaagaaagcattgttggaaagcacataacggcaggcatcccgt

SEQ ID NO: 20810 - DNA, 75 bp, Artificial Sequence
  Synthetic
gaggagaccgatttgacctccatgaaatgtgtgaacttcattgtgtccagggtggaccaacattcctgccacatt

SEQ ID NO: 20811 - DNA, 75 bp, Artificial Sequence
  Synthetic
aatgtgtgaacttcattgtgtccagggtggaccaacattcctgccacattgtgtgttgcgatttggaactagcac

SEQ ID NO: 20812 - DNA, 75 bp, Artificial Sequence
  Synthetic
ctcgccctacatagtctaatgattgggggcaaactggtacttaagatgtatttcacgcaaaatgcgctattacat

SEQ ID NO: 20813 - DNA, 75 bp, Artificial Sequence
  Synthetic
ggggcaaactggtacttaagatgtatttcacgcaaaatgcgctattacatcatgtgctgtcactacttttagtcc

SEQ ID NO: 20814 - DNA, 75 bp, Artificial Sequence
  Synthetic
tctgagggtttcctggtcgcaactaggacagggatagccctgagttcaaatgtctcacagatcctcagtaatgtc

SEQ ID NO: 20815 - DNA, 75 bp, Artificial Sequence
  Synthetic
ggacagggatagccctgagttcaaatgtctcacagatcctcagtaatgtcactgagatgataagaaagggccaga

SEQ ID NO: 20816 - DNA, 75 bp, Artificial Sequence
  Synthetic
gtttcaagcgcattagatgaattgcgaagagaactgtacttaccctcgtgtcacattcctcagtcagcaaccgat

SEQ ID NO: 20817 - DNA, 75 bp, Artificial Sequence
  Synthetic
gaagagaactgtacttaccctcgtgtcacattcctcagtcagcaaccgatatgttcctgatccagatcggaggaa

SEQ ID NO: 20818 - DNA, 75 bp, Artificial Sequence
  Synthetic
acggacccaatgctctatgacattgttgcgattttaagtacacttcttaaggaaatcattcatgtaagagaatct

SEQ ID NO: 20819 - DNA, 75 bp, Artificial Sequence
  Synthetic
ttgcgattttaagtacacttcttaaggaaatcattcatgtaagagaatctagggagtctgtggacaaagtcttgt

SEQ ID NO: 20820 - DNA, 75 bp, Artificial Sequence
  Synthetic
atggcagccactagaagtgtgctgcatctacatataacccgtattgttggaaatgcagtgtcaaatattcgtaga

SEQ ID NO: 20821 - DNA, 75 bp, Artificial Sequence
  Synthetic
atctacatataacccgtattgttggaaatgcagtgtcaaatattcgtagattgctaccgctactcgacaaaggtt

SEQ ID NO: 20822 - DNA, 75 bp, Artificial Sequence
  Synthetic
gattctccaaaatatttcttgaacaaattggggagaagtgagatttcgcaaatattcgatattgagtctaaaatg

SEQ ID NO: 20823 - DNA, 75 bp, Artificial Sequence
  Synthetic
tgcaaagcaacattcagagtgatgagcactctgtatgatttgagaacataccaaatggctttttttggaaataag

SEQ ID NO: 20824 - DNA, 75 bp, Artificial Sequence
  Synthetic
cccattcactttctcagtcagatagtaaatctatgtccatcgacatcgatcccgtataaattccattaataaaaa

SEQ ID NO: 20825 - DNA, 75 bp, Artificial Sequence
  Synthetic
taaatctatgtccatcgacatcgatcccgtataaattccattaataaaaaattatcgagtgaactgtatggaaca

SEQ ID NO: 20826 - DNA, 75 bp, Artificial Sequence
  Synthetic
accaaacaaggaaaccatatgcttggggactttacgagagcgcttgtaaaaccgtgagggggaagctggtggact

SEQ ID NO: 20827 - DNA, 75 bp, Artificial Sequence
  Synthetic
agatgtcgtcagtgttcactgattacgctaagctgcaagatgcccttgtggccccttcgaagaggaaggtagata

SEQ ID NO: 20828 - DNA, 75 bp, Artificial Sequence
  Synthetic
tccgaagatcccgaagagcgatggagcttcgtttgcttttgcatgagatgggtggtgagcgattcagccacagaa

SEQ ID NO: 20829 - DNA, 75 bp, Artificial Sequence
  Synthetic
gcttcgtttgcttttgcatgagatgggtggtgagcgattcagccacagaagcgatgcgtgttggtgcaatgctat

SEQ ID NO: 20830 - DNA, 75 bp, Artificial Sequence
  Synthetic
gcgaggtgtggtgacgccgacatcaacatacttgaggttgaggcaattgaccaccagaaccagaccattcgcttc

SEQ ID NO: 20831 - DNA, 75 bp, Artificial Sequence
  Synthetic
acatacttgaggttgaggcaattgaccaccagaaccagaccattcgcttcactgggcgcagcaatgtgactgacg

SEQ ID NO: 20832 - DNA, 75 bp, Artificial Sequence
  Synthetic
aacaatggcagcccttttgtaaatagagacattgaggacaattatccaactgacatgtctgagctgctcaatatg

SEQ ID NO: 20833 - DNA, 75 bp, Artificial Sequence
  Synthetic
gagacattgaggacaattatccaactgacatgtctgagctgctcaatatggtttacagtgtcgcaactcaaatct

SEQ ID NO: 20834 - DNA, 75 bp, Artificial Sequence
  Synthetic
gaggggaggcggctggccaaatacatccagcaaaacagagtaattcggagcacgattctagctcccgcaacccgc

SEQ ID NO: 20835 - DNA, 75 bp, Artificial Sequence
  Synthetic
tccagcaaaacagagtaattcggagcacgattctagctcccgcaacccgcggtgaatgcacccgaataatacgga

SEQ ID NO: 20836 - DNA, 75 bp, Artificial Sequence
  Synthetic
tcaatgggttccaacacgacacgatattatgccacagttggggatgccgcagcttacttcaagaatgcgggtatg

SEQ ID NO: 20837 - DNA, 75 bp, Artificial Sequence
  Synthetic
attatgccacagttggggatgccgcagcttacttcaagaatgcgggtatggctgcattcttcttaactctgaggt

SEQ ID NO: 20838 - DNA, 75 bp, Artificial Sequence
  Synthetic
tccgagtataccagagcaaaggtgaggatggaccctacatggcatttctggaagactccgaccttatgagcttcg

SEQ ID NO: 20839 - DNA, 75 bp, Artificial Sequence
  Synthetic
gaaactgcacaacgaaaccaaggttcacttgatgagaatttagcaaaggagctgcaactatccggggctgaacga

SEQ ID NO: 20840 - DNA, 75 bp, Artificial Sequence
  Synthetic
gcctggatctagcaggagaggccccagtgccccagcgccaaccaacattcctcaatgaccaggagtatgaggatg

SEQ ID NO: 20841 - DNA, 75 bp, Artificial Sequence
  Synthetic
gagcaggtctcaccccatactctgataatgccagtggcctggacatctaaatgaccactactcaatatgacaagt

SEQ ID NO: 20842 - DNA, 75 bp, Artificial Sequence
  Synthetic
aatcacatgtagactttaagaaaaaacaagggtgagggggaagttcctggtgcgcgggttgggcccctagtgact

SEQ ID NO: 20843 - DNA, 75 bp, Artificial Sequence
  Synthetic
acaagggtgagggggaagttcctggtgcgcgggttgggcccctagtgactcagccagcaccatggacttctccaa

SEQ ID NO: 20844 - DNA, 75 bp, Artificial Sequence
  Synthetic
gcatccaacacgccgagacccagccagcgcacactgtcggcaaatctgccattcggaaaggaaacacatccgagc

SEQ ID NO: 20845 - DNA, 75 bp, Artificial Sequence
  Synthetic
agcgcacactgtcggcaaatctgccattcggaaaggaaacacatccgagctgcgagcagcctgggaagccgagac

SEQ ID NO: 20846 - DNA, 75 bp, Artificial Sequence
  Synthetic
cccgggatctcgacagcaagggcaacacggaaagcccacaactacgatccaatgcagatgagacaccccaaccag

SEQ ID NO: 20847 - DNA, 75 bp, Artificial Sequence
  Synthetic
cacggaaagcccacaactacgatccaatgcagatgagacaccccaaccagaaagccacgacaggcaagccactgc

SEQ ID NO: 20848 - DNA, 75 bp, Artificial Sequence
  Synthetic
ctgctctaaaaaagctagaaaaacaagggaaaggtcctgggaaaggccaagtggatcgcaacactcctcagagag

SEQ ID NO: 20849 - DNA, 75 bp, Artificial Sequence
  Synthetic
gtggatcgcaacactcctcagagagatccaaccactgcttcgggttcaaaaaaggggaaagggggcgagccaagg

SEQ ID NO: 20850 - DNA, 75 bp, Artificial Sequence
  Synthetic
ctggcgcagcaagcatcacaggagataactcgccatgcactgcaaccccaggattccggcggcatagaagggaat

SEQ ID NO: 20851 - DNA, 75 bp, Artificial Sequence
  Synthetic
ccagtctgcgcacccgtcacacctgaacccagaacattcaaatgcatttgcgggagatgccctcgggtatgcatc

SEQ ID NO: 20852 - DNA, 75 bp, Artificial Sequence
  Synthetic
cgggagatgccctcgggtatgcatcaactgtcgcaatgatagtggagactctgaaatttgtagttagcaggttag

SEQ ID NO: 20853 - DNA, 75 bp, Artificial Sequence
  Synthetic
caaacagggacgactcaagacatgggcgccgtcatgagggacggcacgatcgtgaaagatgctcttgcccgccca

SEQ ID NO: 20854 - DNA, 75 bp, Artificial Sequence
  Synthetic
gcgccgtcatgagggacggcacgatcgtgaaagatgctcttgcccgcccagtcaatccggacaggtggtcagcaa

SEQ ID NO: 20855 - DNA, 75 bp, Artificial Sequence
  Synthetic
acagtgtatacactattggacaattttggcatcaccggcccgaaaagagcgaaaatcgaggcagaactggctaat

SEQ ID NO: 20856 - DNA, 75 bp, Artificial Sequence
  Synthetic
ttggcatcaccggcccgaaaagagcgaaaatcgaggcagaactggctaatgtcagtgaccgggacgcactagtaa

SEQ ID NO: 20857 - DNA, 75 bp, Artificial Sequence
  Synthetic
tcagtacagatgacatcccaatatcagatcatgattctattgccaaatcacagcatttttttctcctgatcacac

SEQ ID NO: 20858 - DNA, 75 bp, Artificial Sequence
  Synthetic
gggaactggtggtgtccggactgggccatccagagtcacccagtccgaaccaaacacccgccagttcctccgccg

SEQ ID NO: 20859 - DNA, 75 bp, Artificial Sequence
  Synthetic
ccatccagagtcacccagtccgaaccaaacacccgccagttcctccgccggcacagcgcgccaccaactgcccca

SEQ ID NO: 20860 - DNA, 75 bp, Artificial Sequence
  Synthetic
cccatcatcatgaaacccaaagaaagtggggttagagagctgcaaccgcaattgaggacccagtacctcggtgac

SEQ ID NO: 20861 - DNA, 75 bp, Artificial Sequence
  Synthetic
ggaagatcacggggggcgagacagcggattctcacccatcagcgaggaatccaaaggatcgacagtcactgcagc

SEQ ID NO: 20862 - DNA, 75 bp, Artificial Sequence
  Synthetic
ggattctcacccatcagcgaggaatccaaaggatcgacagtcactgcagcttgcatcactctcggcagcatcgag

SEQ ID NO: 20863 - DNA, 75 bp, Artificial Sequence
  Synthetic
gtcagtcaggatgtccgctgattcaactcagaaggtagtttacacaatcaatgccaaacctgcactgttgttctc

SEQ ID NO: 20864 - DNA, 75 bp, Artificial Sequence
  Synthetic
actcagaaggtagtttacacaatcaatgccaaacctgcactgttgttctcctcccgtgttgtcagggctgggggt

SEQ ID NO: 20865 - DNA, 75 bp, Artificial Sequence
  Synthetic
tgatcgcctctacaaattccgcgtaatgtttgtgtcattgaccttcctacatcgcagcagcctttttaaagttag

SEQ ID NO: 20866 - DNA, 75 bp, Artificial Sequence
  Synthetic
atgtttgtgtcattgaccttcctacatcgcagcagcctttttaaagttagccgtacagtgctgtcaatgaggaat

SEQ ID NO: 20867 - DNA, 75 bp, Artificial Sequence
  Synthetic
actggaccatccgatggcaaaatatttgagcaaagaggatggacagctatttgcaactgtgtgggtacacttgtg

SEQ ID NO: 20868 - DNA, 75 bp, Artificial Sequence
  Synthetic
ttgagcaaagaggatggacagctatttgcaactgtgtgggtacacttgtgcaactttaagcgcacagacagacgc

SEQ ID NO: 20869 - DNA, 75 bp, Artificial Sequence
  Synthetic
gctgaagctcaccttgtgtgatctatggggtcccacacttgtttgtgaagccacggggaagatgagcaagtacgc

SEQ ID NO: 20870 - DNA, 75 bp, Artificial Sequence
  Synthetic
tggggtcccacacttgtttgtgaagccacggggaagatgagcaagtacgcgctaggtttcttctcggagactaag

SEQ ID NO: 20871 - DNA, 75 bp, Artificial Sequence
  Synthetic
gtggtcatgcacaacttggatcgcatcagcaaaggccatcatacaggcctcctctgctcgtaccttgttgacatc

SEQ ID NO: 20872 - DNA, 75 bp, Artificial Sequence
  Synthetic
tcagcaaaggccatcatacaggcctcctctgctcgtaccttgttgacatcagaggacatagaagccaagggggcc

SEQ ID NO: 20873 - DNA, 75 bp, Artificial Sequence
  Synthetic
agcaaagtagtcatctggatttcatcaatgaacccactggcctatgttcagctgtaccttccttgataatcacta

SEQ ID NO: 20874 - DNA, 75 bp, Artificial Sequence
  Synthetic
caatgaacccactggcctatgttcagctgtaccttccttgataatcactaaatcaatacacagagtgccatttga

SEQ ID NO: 20875 - DNA, 75 bp, Artificial Sequence
  Synthetic
accttcctagctgttcctcccttagaagtcctgtcatattaatcaaaaaaatcagtttgctggtaaaatagtatg

SEQ ID NO: 20876 - DNA, 75 bp, Artificial Sequence
  Synthetic
aagtcctgtcatattaatcaaaaaaatcagtttgctggtaaaatagtatgctgcaggatccaatacctcccacca

SEQ ID NO: 20877 - DNA, 75 bp, Artificial Sequence
  Synthetic
tggcacccggccggtatgtgattattttcaacctcatccttctccacaaggttgtgtcactagacaattcaagat

SEQ ID NO: 20878 - DNA, 75 bp, Artificial Sequence
  Synthetic
tttcaacctcatccttctccacaaggttgtgtcactagacaattcaagattactacagcaggggattatgagtgc

SEQ ID NO: 20879 - DNA, 75 bp, Artificial Sequence
  Synthetic
ctgtgagattgattcccaacctacctcaagaagtgcttaaatgttctgctgggcagatcaaatcatacaatgaca

SEQ ID NO: 20880 - DNA, 75 bp, Artificial Sequence
  Synthetic
tcaagaagtgcttaaatgttctgctgggcagatcaaatcatacaatgacacccttaatcgaattttcacacctat

SEQ ID NO: 20881 - DNA, 75 bp, Artificial Sequence
  Synthetic
accagaaccctgccccagaacctcgcctgattggagcaattataggcacagcagcactggggctggcaacagcag

SEQ ID NO: 20882 - DNA, 75 bp, Artificial Sequence
  Synthetic
cctgattggagcaattataggcacagcagcactggggctggcaacagcagctcaggttacagctgcactcgccct

SEQ ID NO: 20883 - DNA, 75 bp, Artificial Sequence
  Synthetic
taacaaaaacaaatgaagctgtgcttgagcttaaggatgcaacagggcaaattgcgatagcgctagataagactc

SEQ ID NO: 20884 - DNA, 75 bp, Artificial Sequence
  Synthetic
accggcaatcaataatctgacatgtgaagtagcaggtgctaaagtaggtgtggaactatcattatacttgaccga

SEQ ID NO: 20885 - DNA, 75 bp, Artificial Sequence
  Synthetic
ctgcggtaatgattttaattacctcctgaacctaatgggggccaaacactccgatctgggtgcactttatgaggc

SEQ ID NO: 20886 - DNA, 75 bp, Artificial Sequence
  Synthetic
tggttatccaggtctccgtgcctagcatatcatcgatttcggggttgcgactgacagaattgtttactctgagca

SEQ ID NO: 20887 - DNA, 75 bp, Artificial Sequence
  Synthetic
ggcagtggtacctcagtttgttgtagaatctggccagcttcttgaagagatcgacacccaggcatgcacactcac

SEQ ID NO: 20888 - DNA, 75 bp, Artificial Sequence
  Synthetic
cgatgtctagcccctgagatgataataactcaaaacaagggactcccccttacagtcatatcacaagaaacttgc

SEQ ID NO: 20889 - DNA, 75 bp, Artificial Sequence
  Synthetic
cggatcgtattccaggaatataacggtcgggaacagccaaattgccccatctggaccccttgacatctcaagcga

SEQ ID NO: 20890 - DNA, 75 bp, Artificial Sequence
  Synthetic
agagcaatcagctcttgaatagggtgaatccaaacatagtaaacaacaccgcaattatagtcacaatagtattgc

SEQ ID NO: 20891 - DNA, 75 bp, Artificial Sequence
  Synthetic
gaatccaaacatagtaaacaacaccgcaattatagtcacaatagtattgctagttatcctggtattatggtgttt

SEQ ID NO: 20892 - DNA, 75 bp, Artificial Sequence
  Synthetic
aatgcaagcaaagtcgccgggaagtgccacacagttctaacagtatagctagtcctaatgattaaaccatatact

SEQ ID NO: 20893 - DNA, 75 bp, Artificial Sequence
  Synthetic
ttctctctcaaaccgagacagtgatccatcaagaatgcaacgatcctaccttctctgctttaatcaaaaaatgca

SEQ ID NO: 20894 - DNA, 75 bp, Artificial Sequence
  Synthetic
ccatcaagaatgcaacgatcctaccttctctgctttaatcaaaaaatgcagaataatctaacagcccaaccaaac

SEQ ID NO: 20895 - DNA, 75 bp, Artificial Sequence
  Synthetic
ctgatcagaggttgtagtatcaattcttaacaacccccaagatgagaccacaagtggcaatttggggcttgcgct

SEQ ID NO: 20896 - DNA, 75 bp, Artificial Sequence
  Synthetic
cttaacaacccccaagatgagaccacaagtggcaatttggggcttgcgcttattggctaccggcctagctatggt

SEQ ID NO: 20897 - DNA, 75 bp, Artificial Sequence
  Synthetic
acattagaggcttgttgacatcctcggacatcaagactacacatgaggcgctgcgtgagcatctctcatctatta

SEQ ID NO: 20898 - DNA, 75 bp, Artificial Sequence
  Synthetic
ggacatcaagactacacatgaggcgctgcgtgagcatctctcatctattactcttttcatgtcgtttgcgttgac

SEQ ID NO: 20899 - DNA, 75 bp, Artificial Sequence
  Synthetic
agaatactagcggcactaatcctcagccgcaagtagaggaggctagatcggaaaacctgtctcactcttccatgc

SEQ ID NO: 20900 - DNA, 75 bp, Artificial Sequence
  Synthetic
gccgcaagtagaggaggctagatcggaaaacctgtctcactcttccatgcacacgatcaataggccagcaacccc

SEQ ID NO: 20901 - DNA, 75 bp, Artificial Sequence
  Synthetic
ggtaccattcaagtgattgatccccttgacgcactggcagagtctaccccaccaagatccgttcttgtcctactt

SEQ ID NO: 20902 - DNA, 75 bp, Artificial Sequence
  Synthetic
ttgacgcactggcagagtctaccccaccaagatccgttcttgtcctacttgtttgatttaagaaaaaattgtaat

SEQ ID NO: 20903 - DNA, 75 bp, Artificial Sequence
  Synthetic
accattccccagccggtggcaatggcttcctcaggcgatatgagacagagtcaggcaactctatatgagggtgac

SEQ ID NO: 20904 - DNA, 75 bp, Artificial Sequence
  Synthetic
cttcctcaggcgatatgagacagagtcaggcaactctatatgagggtgaccctaacagcaaaaggacatggagga

SEQ ID NO: 20905 - DNA, 75 bp, Artificial Sequence
  Synthetic
ggcatagtggcaatagttaggatgtcaaccattacaacaaaagatattgataacagtatctcatcatctattaca

SEQ ID NO: 20906 - DNA, 75 bp, Artificial Sequence
  Synthetic
caaccattacaacaaaagatattgataacagtatctcatcatctattacatccctgagtgccgattaccagccaa

SEQ ID NO: 20907 - DNA, 75 bp, Artificial Sequence
  Synthetic
atcactatccctgtcacactcgacaagatgcaagtagaaatgggaacagcggttaacataatcactgatgctgta

SEQ ID NO: 20908 - DNA, 75 bp, Artificial Sequence
  Synthetic
agatgcaagtagaaatgggaacagcggttaacataatcactgatgctgtaagacaactacaaggagtcaatgggt

SEQ ID NO: 20909 - DNA, 75 bp, Artificial Sequence
  Synthetic
acactgatataccctcttaattcacttaatggaaaggctctagctgtatcagacttactagaacacccgagcttc

SEQ ID NO: 20910 - DNA, 75 bp, Artificial Sequence
  Synthetic
cctagggtaccgtcattggtgttatagtcacaacacgatagagtctggttgtcacgatgcaggagaaagcattat

SEQ ID NO: 20911 - DNA, 75 bp, Artificial Sequence
  Synthetic
tccacggtaggctccacttcaatggcacatacactgagtctgaacttgaccctggcctatttaataaccattggg

SEQ ID NO: 20912 - DNA, 75 bp, Artificial Sequence
  Synthetic
cacatacactgagtctgaacttgaccctggcctatttaataaccattgggtcgctcaatatccagcagttggtag

SEQ ID NO: 20913 - DNA, 75 bp, Artificial Sequence
  Synthetic
caccgaagtcaaaactgttcaatgagctcaagtcatttgcttactttactcataatgctgaattgaaatgtgaga

SEQ ID NO: 20914 - DNA, 75 bp, Artificial Sequence
  Synthetic
aaaatagcaggatctctctgggctcaaggggttgtaacatgtaatctgaccaatttagctgattgcaaagttgca

SEQ ID NO: 20915 - DNA, 75 bp, Artificial Sequence
  Synthetic
cacctggacaaagggcgtatgtgagaaaccggcgatatgccccgctgtatgtgtaacgggtgtttaccaagatgt

SEQ ID NO: 20916 - DNA, 75 bp, Artificial Sequence
  Synthetic
ggtacttagatgctgcagcagcccgtcaggatccatggattgcagcagctaaccagtacaactggctggttaggc

SEQ ID NO: 20917 - DNA, 75 bp, Artificial Sequence
  Synthetic
tgttctgcctgactataatggaagtcacagacaacctactcggagactggaggatcgccccgctgttgtatgaag

SEQ ID NO: 20918 - DNA, 75 bp, Artificial Sequence
  Synthetic
agggtggggacagataagttccaatattataccccaggtgacagatatactcctcagcattgatgactcactgca

SEQ ID NO: 20919 - DNA, 75 bp, Artificial Sequence
  Synthetic
attataccccaggtgacagatatactcctcagcattgatgactcactgcagcttatacataacaattttctcatt

SEQ ID NO: 20920 - DNA, 75 bp, Artificial Sequence
  Synthetic
gctcaattagataatgaagtgcagcccgcaattgtcttgatttaataaaaaattgaggggctgttataacatagc

SEQ ID NO: 20921 - DNA, 75 bp, Artificial Sequence
  Synthetic
ccgcaattgtcttgatttaataaaaaattgaggggctgttataacatagcagactgacggggcaagacccgctga

SEQ ID NO: 20922 - DNA, 75 bp, Artificial Sequence
  Synthetic
tagccttccccgattcaatttacttagtattaacaagtcaattctgctcacagaggtcatctctaagggccgctg

SEQ ID NO: 20923 - DNA, 75 bp, Artificial Sequence
  Synthetic
agtattaacaagtcaattctgctcacagaggtcatctctaagggccgctgtgatggatccacaagtccaaataca

SEQ ID NO: 20924 - DNA, 75 bp, Artificial Sequence
  Synthetic
aactgacattattatggaagctcacaggtttaccgttgccacccgaccttaacggttgcgtcacacacaaagacg

SEQ ID NO: 20925 - DNA, 75 bp, Artificial Sequence
  Synthetic
aggtttaccgttgccacccgaccttaacggttgcgtcacacacaaagacgtgacgtgggatgaagtgctccggtt

SEQ ID NO: 20926 - DNA, 75 bp, Artificial Sequence
  Synthetic
atagaatgcatgaaaagggggagttcattgacacatataaacctttatgtcatccacggacattaagttggttga

SEQ ID NO: 20927 - DNA, 75 bp, Artificial Sequence
  Synthetic
cattgacacatataaacctttatgtcatccacggacattaagttggttgaccaatatcaacttgatcaagagtga

SEQ ID NO: 20928 - DNA, 75 bp, Artificial Sequence
  Synthetic
tgcatgaaccaacagaccaatcgtttgtcactcttggcaggaaattagcaggcgacccttgcttgttccatcaac

SEQ ID NO: 20929 - DNA, 75 bp, Artificial Sequence
  Synthetic
taggccatctacctggatgcccacctaattccagatttgaagaacaggtaggagactgcagtttgtggtcaccca

SEQ ID NO: 20930 - DNA, 75 bp, Artificial Sequence
  Synthetic
tgcggtacatggccctccagagaaagcaaacaagagtgcaatcacagcagaatgttctaattggatcagatacta

SEQ ID NO: 20931 - DNA, 75 bp, Artificial Sequence
  Synthetic
gtattcacctgtttgacttttgatatggtgctaatgtatgcagatgtggtggaaggtcgtgccatgacaaagttg

SEQ ID NO: 20932 - DNA, 75 bp, Artificial Sequence
  Synthetic
ggaaggtcgtgccatgacaaagttggttgcactcactgagccaacaatggtagaagtcattcagagagtcgaaaa

SEQ ID NO: 20933 - DNA, 75 bp, Artificial Sequence
  Synthetic
cttggcatatggtactgttcaactgtgggataaatcactggaacatgctggtgagttcttttcattcaatcttac

SEQ ID NO: 20934 - DNA, 75 bp, Artificial Sequence
  Synthetic
gagtagtcgagcaggtgcggttgctatatactggactaagtgtgaaccaagcaggtgagatgttatgcattttac

SEQ ID NO: 20935 - DNA, 75 bp, Artificial Sequence
  Synthetic
atatactggactaagtgtgaaccaagcaggtgagatgttatgcattttacgtcactgggggcatcccttactatg

SEQ ID NO: 20936 - DNA, 75 bp, Artificial Sequence
  Synthetic
taacctctctagacaccacactcaaggtgttagcattctttattgcagatatcatcaatggacatagacgatcac

SEQ ID NO: 20937 - DNA, 75 bp, Artificial Sequence
  Synthetic
ggtgttagcattctttattgcagatatcatcaatggacatagacgatcacattcagggttatggccaagcgtcag

SEQ ID NO: 20938 - DNA, 75 bp, Artificial Sequence
  Synthetic
ccgagcttcaatacgcagttgtgcttaagcactatagagaagtatcccttatagaattccaaaaaagtattgatt

SEQ ID NO: 20939 - DNA, 75 bp, Artificial Sequence
  Synthetic
taagcactatagagaagtatcccttatagaattccaaaaaagtattgattttgacttagttgaagatctaagtgt

SEQ ID NO: 20940 - DNA, 75 bp, Artificial Sequence
  Synthetic
tattcaggaaatccctactccctggacatttgaaagataaactgcaatctgagggcccttctaaccggcttctgc

SEQ ID NO: 20941 - DNA, 75 bp, Artificial Sequence
  Synthetic
acatttgaaagataaactgcaatctgagggcccttctaaccggcttctgcttgactttttgcaatcaagcgaatt

SEQ ID NO: 20942 - DNA, 75 bp, Artificial Sequence
  Synthetic
atccagagttctgcgcatcttattccttaaaagagcgggaagtcaaaactgatgggcgcatatttgcaaaaatga

SEQ ID NO: 20943 - DNA, 75 bp, Artificial Sequence
  Synthetic
cttaaaagagcgggaagtcaaaactgatgggcgcatatttgcaaaaatgactagaaaaatgaggaactgccaagt

SEQ ID NO: 20944 - DNA, 75 bp, Artificial Sequence
  Synthetic
acggagtagtacaagagcaaatcagtttaacaaaatcactgcttgcaatgtcgcaacttgctcctcgtgtgtctg

SEQ ID NO: 20945 - DNA, 75 bp, Artificial Sequence
  Synthetic
tttaacaaaatcactgcttgcaatgtcgcaacttgctcctcgtgtgtctgagtatcaagggagagttctccgctc

SEQ ID NO: 20946 - DNA, 75 bp, Artificial Sequence
  Synthetic
caggcgagggggtcaggcgacggaaaacaattatagcatcattcttgactactgacctacagaagtattgtctca

SEQ ID NO: 20947 - DNA, 75 bp, Artificial Sequence
  Synthetic
tttgggataccccacggctttgagtggattcacctccgcttgatgaacacaactatgtttgtaggagacccacat

SEQ ID NO: 20948 - DNA, 75 bp, Artificial Sequence
  Synthetic
aaatgtggaccatgatctccattgcggcaattcatctagcagccacagaatcgggttgtcgggttgcatccatgg

SEQ ID NO: 20949 - DNA, 75 bp, Artificial Sequence
  Synthetic
gaggacgcgtctgtagcatcaataaggttgaaagagatatctgagaggttctttagggtgttcagagagatcaac

SEQ ID NO: 20950 - DNA, 75 bp, Artificial Sequence
  Synthetic
ggttgaaagagatatctgagaggttctttagggtgttcagagagatcaacaggggtataggacacaacttaaaag

SEQ ID NO: 20951 - DNA, 75 bp, Artificial Sequence
  Synthetic
ttctttgaggggaagatcctcagccagctactgaaaaatgcaagcaggttggtgttggtatccgagactgtgggt

SEQ ID NO: 20952 - DNA, 75 bp, Artificial Sequence
  Synthetic
tgatcgtaaaacaaattctttttgacattgatttttccttggagcctgaaccatctcagggcttgagtcatgcta

SEQ ID NO: 20953 - DNA, 75 bp, Artificial Sequence
  Synthetic
ttaggtggattaaattttctggccctatctcggctatttacaaggaacataggagaccccgtctcatcagccatg

SEQ ID NO: 20954 - DNA, 75 bp, Artificial Sequence
  Synthetic
tatctcggctatttacaaggaacataggagaccccgtctcatcagccatggcagatatgaagttctatatacagg

SEQ ID NO: 20955 - DNA, 75 bp, Artificial Sequence
  Synthetic
ggagatggaacatggacaacactgtgtgccgacccgtactcattaaaccaaccatatgtgcaattaccaacgtca

SEQ ID NO: 20956 - DNA, 75 bp, Artificial Sequence
  Synthetic
gtgccgacccgtactcattaaaccaaccatatgtgcaattaccaacgtcatacttaaaaaagcacacacaacgta

SEQ ID NO: 20957 - DNA, 75 bp, Artificial Sequence
  Synthetic
aatcaatacactgaggaagaaagactagcaaagttccttctggaccgagaattggttatgccacgtgtggcacat

SEQ ID NO: 20958 - DNA, 75 bp, Artificial Sequence
  Synthetic
tagcaaagttccttctggaccgagaattggttatgccacgtgtggcacatacagtctttgagaccactgttgccg

SEQ ID NO: 20959 - DNA, 75 bp, Artificial Sequence
  Synthetic
catgcagctctggaacagaggactaattggtgtcgacacttgcgcggtcacacttgcggattacgcaagaacata

SEQ ID NO: 20960 - DNA, 75 bp, Artificial Sequence
  Synthetic
tcgcttatgtcggctcaaaaacggaagaaaggcgggcagcttcgttgacgacaatcaaagggatgtcaactcacc

SEQ ID NO: 20961 - DNA, 75 bp, Artificial Sequence
  Synthetic
agaaaggcgggcagcttcgttgacgacaatcaaagggatgtcaactcaccttagggcggcactaagaggggcgag

SEQ ID NO: 20962 - DNA, 75 bp, Artificial Sequence
  Synthetic
caaagcttgctaacacaagatgtgtaatatctgaagaccatctgcgtgccctttgcccaatcccgagttcagcaa

SEQ ID NO: 20963 - DNA, 75 bp, Artificial Sequence
  Synthetic
aatatctgaagaccatctgcgtgccctttgcccaatcccgagttcagcaaacatacagcataggctgatggatgg

SEQ ID NO: 20964 - DNA, 75 bp, Artificial Sequence
  Synthetic
gtgttgcataagggaagctgataatggtgatttcttagaatccccggctagtgtaccagacatgactatcacgac

SEQ ID NO: 20965 - DNA, 75 bp, Artificial Sequence
  Synthetic
gtactgtgagatgggcctcgaagtgcttgacccaccaggacttgtaaccctactatctctagtgactgcacgtat

SEQ ID NO: 20966 - DNA, 75 bp, Artificial Sequence
  Synthetic
atgctattgtctcattcgacaattccatcaattggatatctgagtacacatactgtgatcttagactactggcag

SEQ ID NO: 20967 - DNA, 75 bp, Artificial Sequence
  Synthetic
catcaattggatatctgagtacacatactgtgatcttagactactggcagtagcaatggctcgggagttttgtga

SEQ ID NO: 20968 - DNA, 75 bp, Artificial Sequence
  Synthetic
tccgggattatatccgccaagccctctcgaggataccagggttacaacttgctaatatagccttgactatatctc

SEQ ID NO: 20969 - DNA, 75 bp, Artificial Sequence
  Synthetic
ctcgaggataccagggttacaacttgctaatatagccttgactatatctcatccgggaatttgggcaagactgag

SEQ ID NO: 20970 - DNA, 75 bp, Artificial Sequence
  Synthetic
attatcctgctgctgtgtgtgagctcatattatggggttacgaacaatatactgcacaactactagatggttacg

SEQ ID NO: 20971 - DNA, 75 bp, Artificial Sequence
  Synthetic
agttagaaattatagtcccgaattataaggatgatgacctgaacaggaaggttgaacatatactagcaagacggg

SEQ ID NO: 20972 - DNA, 75 bp, Artificial Sequence
  Synthetic
aaatccgttcatcactaatctttacttcttgagtagaaagctgctcaacgcgattataagcagcacggactgtag

SEQ ID NO: 20973 - DNA, 75 bp, Artificial Sequence
  Synthetic
ttcttgagtagaaagctgctcaacgcgattataagcagcacggactgtagggcctacgttgagaacctttatgaa

SEQ ID NO: 20974 - DNA, 75 bp, Artificial Sequence
  Synthetic
ctgcgctttgaccttgaactaaaagaactcaccccggattttactatcacttggtgttgttttgactctacagca

SEQ ID NO: 20975 - DNA, 75 bp, Artificial Sequence
  Synthetic
catccgaagaacggttgggacagcttcaacatcttggtataaagcagcaggaatattaactacacctggctttct

SEQ ID NO: 20976 - DNA, 75 bp, Artificial Sequence
  Synthetic
tcaacatcttggtataaagcagcaggaatattaactacacctggctttctcaacctccctaaaggcaatggctta

SEQ ID NO: 20977 - DNA, 75 bp, Artificial Sequence
  Synthetic
ctgctctaataaaatatggtataacaccttgtttagcaatgagctcaacccacctcagaggaattttggtcccaa

SEQ ID NO: 20978 - DNA, 75 bp, Artificial Sequence
  Synthetic
cccaattcaatttgaagaaagtatcgtgggtaaacatattgcagccgggattccttgcaaggcaggacatgtgca

SEQ ID NO: 20979 - DNA, 75 bp, Artificial Sequence
  Synthetic
gtcgaaagttgaacagcactcgtgtcatattgtatgctgtgacttagaattggctatggggactcccttagaagt

SEQ ID NO: 20980 - DNA, 75 bp, Artificial Sequence
  Synthetic
tgattagcggaaaattagtactaaagttgtatttctcacaaaatgccctcttacaccatgttctctctttattgc

SEQ ID NO: 20981 - DNA, 75 bp, Artificial Sequence
  Synthetic
gttgtatttctcacaaaatgccctcttacaccatgttctctctttattgcttgtattgccattccatgtaacaat

SEQ ID NO: 20982 - DNA, 75 bp, Artificial Sequence
  Synthetic
ccacgagaacaggagttgctctgggttcaaatgtgtcccaagtactaggtggtgtgactgagatggtacggaaag

SEQ ID NO: 20983 - DNA, 75 bp, Artificial Sequence
  Synthetic
ggtgtgactgagatggtacggaaaggtcagacccttgtccctgtaaaggtacttacagcgatctccaatgggttc

SEQ ID NO: 20984 - DNA, 75 bp, Artificial Sequence
  Synthetic
acttaaagaaataatacacgtaagggaatccagggagtcagtggacagggttctgttgctcggggcatacaacct

SEQ ID NO: 20985 - DNA, 75 bp, Artificial Sequence
  Synthetic
acaggtgtctggaaaagtaagaacaatggccgcggctgcaacaaggaacatattgcatctacatatagttagact

SEQ ID NO: 20986 - DNA, 75 bp, Artificial Sequence
  Synthetic
gtatagtgtgaaagatttcttgagaaaaactgagtcccctaagtacttcttaaacaagctaggcaagagcgagat

SEQ ID NO: 20987 - DNA, 75 bp, Artificial Sequence
  Synthetic
tcaagaatattttgaagacaatagggattgtggctaaacagcactcagagtgatctctccaaccttgcaccattt

SEQ ID NO: 20988 - DNA, 75 bp, Artificial Sequence
  Synthetic
cctaagcgcaccaacttgccgtgacgattgatgtaatccttgatatgaactactaatcatttggaatttatttac

SEQ ID NO: 20989 - DNA, 75 bp, Artificial Sequence
  Synthetic
accaaaccaggatcacactggcgacgtgagatgtagaaaaaattatcgaagtagtgcgggcgaagtaggggaagt

SEQ ID NO: 20990 - DNA, 75 bp, Artificial Sequence
  Synthetic
gtagtgcgggcgaagtaggggaagttcgagtccgatatcggagacaagctcttcttttacttcgcttgctcagat

SEQ ID NO: 20991 - DNA, 75 bp, Artificial Sequence
  Synthetic
tcgagtccgatatcggagacaagctcttcttttacttcgcttgctcagattgtctgcctctaataatggctcaag

SEQ ID NO: 20992 - DNA, 75 bp, Artificial Sequence
  Synthetic
agacgacaagatgctggttcttccgcacttttgagagtcgagatcccagtttgtgtcaccatgtccaatgaacct

SEQ ID NO: 20993 - DNA, 75 bp, Artificial Sequence
  Synthetic
cacttttgagagtcgagatcccagtttgtgtcaccatgtccaatgaacctgaagagaggtggaattttgtttgta

SEQ ID NO: 20994 - DNA, 75 bp, Artificial Sequence
  Synthetic
ggagccattctctcgatcttgagcgtacacacagagaacatgagggcacatgcagcacttgcagccagagctgct

SEQ ID NO: 20995 - DNA, 75 bp, Artificial Sequence
  Synthetic
tacacacagagaacatgagggcacatgcagcacttgcagccagagctgctgacgcttctttagtgttcttagagg

SEQ ID NO: 20996 - DNA, 75 bp, Artificial Sequence
  Synthetic
ggaatcaccgaacagcgtgcagaccggctaagacggcaggcagtagatttagctgcagtctatcctaatcggaac

SEQ ID NO: 20997 - DNA, 75 bp, Artificial Sequence
  Synthetic
ggctaagacggcaggcagtagatttagctgcagtctatcctaatcggaacccatttttagatcctcacattgaaa

SEQ ID NO: 20998 - DNA, 75 bp, Artificial Sequence
  Synthetic
gccgtgcaaatatgggtcgctgtaatcaagagcatgactgcacctgagaccgcagctgaatctgaaaacaagcgt

SEQ ID NO: 20999 - DNA, 75 bp, Artificial Sequence
  Synthetic
tcaagagcatgactgcacctgagaccgcagctgaatctgaaaacaagcgtctggcaaaataccagcaacaaggac

SEQ ID NO: 21000 - DNA, 75 bp, Artificial Sequence
  Synthetic
cgtgtgattcgaggcagcctagtattgcggcatttcatgatagcagagataaagagggctaatgggatgggagat

SEQ ID NO: 21001 - DNA, 75 bp, Artificial Sequence
  Synthetic
tgcggcatttcatgatagcagagataaagagggctaatgggatgggagataatacaactaggtattatgcaatgg

SEQ ID NO: 21002 - DNA, 75 bp, Artificial Sequence
  Synthetic
ctgaccctgaggtttggattagggactaagtatcctgctctggctatgagtgcattagcgggagatttgagaaag

SEQ ID NO: 21003 - DNA, 75 bp, Artificial Sequence
  Synthetic
ctaagtatcctgctctggctatgagtgcattagcgggagatttgagaaagatatcttctctaatcagggtctata

SEQ ID NO: 21004 - DNA, 75 bp, Artificial Sequence
  Synthetic
atgggaaattttgcaccatcaaactactcattactatattcatatgcaatgggtgtcgggaatgtattggaggca

SEQ ID NO: 21005 - DNA, 75 bp, Artificial Sequence
  Synthetic
actcattactatattcatatgcaatgggtgtcgggaatgtattggaggcaagtgtgacacgctatcaatttgctc

SEQ ID NO: 21006 - DNA, 75 bp, Artificial Sequence
  Synthetic
cagcagcagggtgcactagatgaagatatggcgaaagaaatgcaattgacagaagaggctcgcaggcaggtcaga

SEQ ID NO: 21007 - DNA, 75 bp, Artificial Sequence
  Synthetic
atatggcgaaagaaatgcaattgacagaagaggctcgcaggcaggtcagagagctcgtgagcaatctcgaaggag

SEQ ID NO: 21008 - DNA, 75 bp, Artificial Sequence
  Synthetic
ggcaacaacaatcctaatggacaagccgaccagctgccccagggagatgacaatgatgatatgccaccgcttgaa

SEQ ID NO: 21009 - DNA, 75 bp, Artificial Sequence
  Synthetic
ccgaccagctgccccagggagatgacaatgatgatatgccaccgcttgaacgtgatgatgatgatccaaacctag

SEQ ID NO: 21010 - DNA, 75 bp, Artificial Sequence
  Synthetic
aatttaatatatatatctggtgagaagttcaatgaattcataaatactacatttgagctggatctgtaataagta

SEQ ID NO: 21011 - DNA, 75 bp, Artificial Sequence
  Synthetic
agttcaatgaattcataaatactacatttgagctggatctgtaataagtaactcatctttgtaagtctactggaa

SEQ ID NO: 21012 - DNA, 75 bp, Artificial Sequence
  Synthetic
ctaataataacctgtatataagacagatgagcttgaaacaaccaataattagtttgtaatcatatctacctcata

SEQ ID NO: 21013 - DNA, 75 bp, Artificial Sequence
  Synthetic
gatgagcttgaaacaaccaataattagtttgtaatcatatctacctcataatagctggaataattataataactc

SEQ ID NO: 21014 - DNA, 75 bp, Artificial Sequence
  Synthetic
cgggcgaaagggattggttcacgtgacccacccaggcattggcatttcatcatggattttactaatgatgaagag

SEQ ID NO: 21015 - DNA, 75 bp, Artificial Sequence
  Synthetic
acccacccaggcattggcatttcatcatggattttactaatgatgaagagatttcagatctcctaaatcaaagtg

SEQ ID NO: 21016 - DNA, 75 bp, Artificial Sequence
  Synthetic
gtcggcaaatctgcgattccccgtggaaatacctccaatttaactcaggcatgggaatcagaatcatccagcact

SEQ ID NO: 21017 - DNA, 75 bp, Artificial Sequence
  Synthetic
gaaatacctccaatttaactcaggcatgggaatcagaatcatccagcactgccgaaatgggaccgatcagctcac

SEQ ID NO: 21018 - DNA, 75 bp, Artificial Sequence
  Synthetic
gcacaaccagagggacatcaaagtcagaatccatcatctctccctcatatagacgacaccatcacaaaagaacaa

SEQ ID NO: 21019 - DNA, 75 bp, Artificial Sequence
  Synthetic
agaatccatcatctctccctcatatagacgacaccatcacaaaagaacaacccattgatgagtcagttatcaaat

SEQ ID NO: 21020 - DNA, 75 bp, Artificial Sequence
  Synthetic
aaaactgcttcacgaatgaaagcagaatcaggttttaagaagggggtcgatcagtactcaacggaatcaggagaa

SEQ ID NO: 21021 - DNA, 75 bp, Artificial Sequence
  Synthetic
aatcaggttttaagaagggggtcgatcagtactcaacggaatcaggagaagagcagatcgaacctgacaccgatg

SEQ ID NO: 21022 - DNA, 75 bp, Artificial Sequence
  Synthetic
caataccgtacaccagtctggactatcaatcaacacgactcaatcattaaatcactccccggaattggaagagtg

SEQ ID NO: 21023 - DNA, 75 bp, Artificial Sequence
  Synthetic
tcaatcaacacgactcaatcattaaatcactccccggaattggaagagtggggcatcggagagaatatatcctcc

SEQ ID NO: 21024 - DNA, 75 bp, Artificial Sequence
  Synthetic
gcacccatcagggcaaacccaattagagaacaatgcaggtgtggttactgccccagagcatgtaccatgtgttac

SEQ ID NO: 21025 - DNA, 75 bp, Artificial Sequence
  Synthetic
gagaacaatgcaggtgtggttactgccccagagcatgtaccatgtgttacccctgatcatgatcttcttctaacg

SEQ ID NO: 21026 - DNA, 75 bp, Artificial Sequence
  Synthetic
gctgacagcacaaataccaggtattaaaaatgatgtgatgcagttaaaggcaactactggtctactcagcacaca

SEQ ID NO: 21027 - DNA, 75 bp, Artificial Sequence
  Synthetic
aaaaatgatgtgatgcagttaaaggcaactactggtctactcagcacacaaatggcctccatcatggttcttgac

SEQ ID NO: 21028 - DNA, 75 bp, Artificial Sequence
  Synthetic
gcctagggtagtcgtccaaacagggataggcgacccatccccttatgtgagtgatcagggagtggctcgtttaga

SEQ ID NO: 21029 - DNA, 75 bp, Artificial Sequence
  Synthetic
ataggcgacccatccccttatgtgagtgatcagggagtggctcgtttagatgaacttgcacgtccaatgagggac

SEQ ID NO: 21030 - DNA, 75 bp, Artificial Sequence
  Synthetic
tgataaagaagcagttcgggcactcattgacacagtagggttgcctgacaacaagagagataggttcataaaact

SEQ ID NO: 21031 - DNA, 75 bp, Artificial Sequence
  Synthetic
attgacacagtagggttgcctgacaacaagagagataggttcataaaactgttagaaaagaccactaccaaggaa

SEQ ID NO: 21032 - DNA, 75 bp, Artificial Sequence
  Synthetic
attaactgttatatccgtacctgatctaacccctaaatataaatgagattttctgatttgatgatatccacttaa

SEQ ID NO: 21033 - DNA, 75 bp, Artificial Sequence
  Synthetic
ctaacccctaaatataaatgagattttctgatttgatgatatccacttaacggggaataaaatttataaaaatat

SEQ ID NO: 21034 - DNA, 75 bp, Artificial Sequence
  Synthetic
taatggtaagctatatagaagttatgagcaatgttagatctagcaaatagaatgtcaatcgttttagcaggctat

SEQ ID NO: 21035 - DNA, 75 bp, Artificial Sequence
  Synthetic
gagcaatgttagatctagcaaatagaatgtcaatcgttttagcaggctatttggaagagatactactgttagaga

SEQ ID NO: 21036 - DNA, 75 bp, Artificial Sequence
  Synthetic
tataatgaccctactatattctagatagttataagtctgattctaggtgaagataagcaaattcagttagaataa

SEQ ID NO: 21037 - DNA, 75 bp, Artificial Sequence
  Synthetic
tagttataagtctgattctaggtgaagataagcaaattcagttagaataattatgacactattaatgattagagt

SEQ ID NO: 21038 - DNA, 75 bp, Artificial Sequence
  Synthetic
taataaaaaacaaagtgcgggcgaagttcggtgttaatcactgagcagccctatcctgcaattcactgcaattac

SEQ ID NO: 21039 - DNA, 75 bp, Artificial Sequence
  Synthetic
gttcggtgttaatcactgagcagccctatcctgcaattcactgcaattacctaccttaacacccgcttcactcaa

SEQ ID NO: 21040 - DNA, 75 bp, Artificial Sequence
  Synthetic
atcatcccactgagaaaataaatctcccaatcccaacaggacaccccgatcttgagttgctagcattcccgataa

SEQ ID NO: 21041 - DNA, 75 bp, Artificial Sequence
  Synthetic
cccaatcccaacaggacaccccgatcttgagttgctagcattcccgataatagtggaaagaggtcaagatggaca

SEQ ID NO: 21042 - DNA, 75 bp, Artificial Sequence
  Synthetic
gaagcaaagagacaggattatttttaacttgttatggcttcattgaggaatcatacacaagtacaatccaaggga

SEQ ID NO: 21043 - DNA, 75 bp, Artificial Sequence
  Synthetic
aacttgttatggcttcattgaggaatcatacacaagtacaatccaagggaaatctcgattcttctctgagcatca

SEQ ID NO: 21044 - DNA, 75 bp, Artificial Sequence
  Synthetic
tcaatccaagggaagatatcgacaggctcattgaggattcatatacacttaaagtcctcatctctaagaatgttg

SEQ ID NO: 21045 - DNA, 75 bp, Artificial Sequence
  Synthetic
gctcattgaggattcatatacacttaaagtcctcatctctaagaatgttgatagcaaggagagagttgtgttcaa

SEQ ID NO: 21046 - DNA, 75 bp, Artificial Sequence
  Synthetic
gaggagtaatcctggatgctgaggcttttgtcaaatgtcctagtaagcttacaacaaatatggaatactcattca

SEQ ID NO: 21047 - DNA, 75 bp, Artificial Sequence
  Synthetic
ttttgtcaaatgtcctagtaagcttacaacaaatatggaatactcattcagagtagtatttgtaagtgtcactag

SEQ ID NO: 21048 - DNA, 75 bp, Artificial Sequence
  Synthetic
gaaatccccacctgatagctgtcaacctagaagttaaaattctcttgcatctaaccccagataatcctcaactca

SEQ ID NO: 21049 - DNA, 75 bp, Artificial Sequence
  Synthetic
cctagaagttaaaattctcttgcatctaaccccagataatcctcaactcaaatttcttattaagcatgagaaagg

SEQ ID NO: 21050 - DNA, 75 bp, Artificial Sequence
  Synthetic
tgaaagggacactcaggagtatccaggatgtgacagaaaaggttaagagaatggcattagctgtttctctagaag

SEQ ID NO: 21051 - DNA, 75 bp, Artificial Sequence
  Synthetic
ggatgtgacagaaaaggttaagagaatggcattagctgtttctctagaagacttatggggccccactgttatagt

SEQ ID NO: 21052 - DNA, 75 bp, Artificial Sequence
  Synthetic
gcaagactgcatgtcacccaatctacaagctagctcctgagattgcaaagattatgtggagttgttctagtgaga

SEQ ID NO: 21053 - DNA, 75 bp, Artificial Sequence
  Synthetic
caagctagctcctgagattgcaaagattatgtggagttgttctagtgagataattgaggcaaacatcattgttca

SEQ ID NO: 21054 - DNA, 75 bp, Artificial Sequence
  Synthetic
ccacttctaagatcgtgaacagtgggcataaacagttcttctcattcaaaaagtaattacactagtcattcatac

SEQ ID NO: 21055 - DNA, 75 bp, Artificial Sequence
  Synthetic
gcataaacagttcttctcattcaaaaagtaattacactagtcattcatacatacgaattaatgtgtctctatatt

SEQ ID NO: 21056 - DNA, 75 bp, Artificial Sequence
  Synthetic
aatccaatcccttctcttcttgtatatcactcagtcatgtgggtgttagtttaaattcacttcatcatctcaggc

SEQ ID NO: 21057 - DNA, 75 bp, Artificial Sequence
  Synthetic
atcactcagtcatgtgggtgttagtttaaattcacttcatcatctcaggcctcaaaacagattcaactaagcatg

SEQ ID NO: 21058 - DNA, 75 bp, Artificial Sequence
  Synthetic
gatgatcattatattataatacctaactatatgattaattgattataacaaccagggaatcactccactctttca

SEQ ID NO: 21059 - DNA, 75 bp, Artificial Sequence
  Synthetic
actatatgattaattgattataacaaccagggaatcactccactctttcaatattatttcaaagaagtataaaac

SEQ ID NO: 21060 - DNA, 75 bp, Artificial Sequence
  Synthetic
aaaactcgattaatatgcgggcgaagaagtgagtagtgactccacttgcactaccactgttcatgcccaaagctt

SEQ ID NO: 21061 - DNA, 75 bp, Artificial Sequence
  Synthetic
gaagtgagtagtgactccacttgcactaccactgttcatgcccaaagcttcatctagatcaccacatccatccca

SEQ ID NO: 21062 - DNA, 75 bp, Artificial Sequence
  Synthetic
cgactgcatacaccctgttgacacgcaaccatgggcacatgcctaaacaaccgtctgtcgactattccctctatc

SEQ ID NO: 21063 - DNA, 75 bp, Artificial Sequence
  Synthetic
caaccatgggcacatgcctaaacaaccgtctgtcgactattccctctatcaaaactgtacaatgtattttgatta

SEQ ID NO: 21064 - DNA, 75 bp, Artificial Sequence
  Synthetic
cggtcattactgcgcgccggaattgtacccatatattctaagagtctcagcgtatacactaattcaatctcaggt

SEQ ID NO: 21065 - DNA, 75 bp, Artificial Sequence
  Synthetic
tacccatatattctaagagtctcagcgtatacactaattcaatctcaggttatctgacagtgcgcatgttacccc

SEQ ID NO: 21066 - DNA, 75 bp, Artificial Sequence
  Synthetic
aataaaacaattacaagaatgtttcaacctatatctgataatctaatgcgaattcaagaggggacagatagtggg

SEQ ID NO: 21067 - DNA, 75 bp, Artificial Sequence
  Synthetic
aacctatatctgataatctaatgcgaattcaagaggggacagatagtgggacaaaaagatttgtgggtgccgtga

SEQ ID NO: 21068 - DNA, 75 bp, Artificial Sequence
  Synthetic
ttggcgatggtacaggctcaggataatgcaaaagccatctggaaactcaaggaagcgatttcttcaacaaatcag

SEQ ID NO: 21069 - DNA, 75 bp, Artificial Sequence
  Synthetic
atgcaaaagccatctggaaactcaaggaagcgatttcttcaacaaatcaggctgtattagagttaaaggagggcg

SEQ ID NO: 21070 - DNA, 75 bp, Artificial Sequence
  Synthetic
gaaatactcccctcattgtcagagctagagtgtcgagttaatgcaaataagttggcctctcagttaaatctatat

SEQ ID NO: 21071 - DNA, 75 bp, Artificial Sequence
  Synthetic
tagagtgtcgagttaatgcaaataagttggcctctcagttaaatctatatttgattgagttaaccactatatttg

SEQ ID NO: 21072 - DNA, 75 bp, Artificial Sequence
  Synthetic
tatactcttgcaggagacacaatgggaagcttcttacaatatattggtgcacaggataacgaaattgagtcacta

SEQ ID NO: 21073 - DNA, 75 bp, Artificial Sequence
  Synthetic
gaagcttcttacaatatattggtgcacaggataacgaaattgagtcactatatgatagtggattaattaatgggc

SEQ ID NO: 21074 - DNA, 75 bp, Artificial Sequence
  Synthetic
attccatccatatcatctctctcacgattttctattatgaggctggcaacagttagctcatcagttggaggtttt

SEQ ID NO: 21075 - DNA, 75 bp, Artificial Sequence
  Synthetic
gattttctattatgaggctggcaacagttagctcatcagttggaggttttgagaaaactcccttggtgcctgagt

SEQ ID NO: 21076 - DNA, 75 bp, Artificial Sequence
  Synthetic
aaagagtcatcagatattttttattgccctcaaattttgtcaatgccaatatcaactgccactgtagaatgcctc

SEQ ID NO: 21077 - DNA, 75 bp, Artificial Sequence
  Synthetic
gccctcaaattttgtcaatgccaatatcaactgccactgtagaatgcctcaagggtagaattgatcagtgcatat

SEQ ID NO: 21078 - DNA, 75 bp, Artificial Sequence
  Synthetic
gtcgttgttgccaattgttttgcagaattatgtagatgtactaatcctagttacataattagacaagaccgggat

SEQ ID NO: 21079 - DNA, 75 bp, Artificial Sequence
  Synthetic
aattatgtagatgtactaatcctagttacataattagacaagaccgggatgttgctgtcacagtaattgataaag

SEQ ID NO: 21080 - DNA, 75 bp, Artificial Sequence
  Synthetic
tctattgctaatgaatacaaggttaactttactgtatcagaggaccaacttgcgccctctacccctatcgatatc

SEQ ID NO: 21081 - DNA, 75 bp, Artificial Sequence
  Synthetic
actttactgtatcagaggaccaacttgcgccctctacccctatcgatatcagtaatgaattaaattcattgaatc

SEQ ID NO: 21082 - DNA, 75 bp, Artificial Sequence
  Synthetic
gcatcactgaacccaaaattggtgaacaatacatctattattgtattaattgtaatgggagtggtgctaatttta

SEQ ID NO: 21083 - DNA, 75 bp, Artificial Sequence
  Synthetic
acaatacatctattattgtattaattgtaatgggagtggtgctaattttatggctgttggctcttaccatctact

SEQ ID NO: 21084 - DNA, 75 bp, Artificial Sequence
  Synthetic
gcatatgcatcttatgtagctgataaaaatgtatataaaaacgaatcaactagctctagcagtatttaggcgttg

SEQ ID NO: 21085 - DNA, 75 bp, Artificial Sequence
  Synthetic
aaaatgtatataaaaacgaatcaactagctctagcagtatttaggcgttgcaattttcaaagttgtcatgtcaaa

SEQ ID NO: 21086 - DNA, 75 bp, Artificial Sequence
  Synthetic
atttactgaatgcgatcaaggatcaaagtattttctggttagattcatatacttaaacaatgaccaatttaattc

SEQ ID NO: 21087 - DNA, 75 bp, Artificial Sequence
  Synthetic
aagtattttctggttagattcatatacttaaacaatgaccaatttaattcaactatctcattttgattgcaatta

SEQ ID NO: 21088 - DNA, 75 bp, Artificial Sequence
  Synthetic
cttccctgaatgcgggcgaacgggggattgtatcctcaggtccctctagccctgtcaatcattggggaatcctga

SEQ ID NO: 21089 - DNA, 75 bp, Artificial Sequence
  Synthetic
gattgtatcctcaggtccctctagccctgtcaatcattggggaatcctgattggacactacgacccaaagcatag

SEQ ID NO: 21090 - DNA, 75 bp, Artificial Sequence
  Synthetic
atcaaaaatacatggcgacagttcttcagagtggtccttattatactccaaattaccatgctgtgtatcagcatt

SEQ ID NO: 21091 - DNA, 75 bp, Artificial Sequence
  Synthetic
tcagagtggtccttattatactccaaattaccatgctgtgtatcagcatttctgcactggctattacaattcaag

SEQ ID NO: 21092 - DNA, 75 bp, Artificial Sequence
  Synthetic
tcatcacttatatcaagtgaactcaacccgctgctatcctatcttcctggtataaatagagaagttcagttgaat

SEQ ID NO: 21093 - DNA, 75 bp, Artificial Sequence
  Synthetic
acccgctgctatcctatcttcctggtataaatagagaagttcagttgaatatacctattcaattagataaaattc

SEQ ID NO: 21094 - DNA, 75 bp, Artificial Sequence
  Synthetic
atggcatttggcactctttcacctggactcctgctaaagaactcaaaggattatgtaggaggtattaataagccg

SEQ ID NO: 21095 - DNA, 75 bp, Artificial Sequence
  Synthetic
gactcctgctaaagaactcaaaggattatgtaggaggtattaataagccgcttattccttctgacaaactcaatt

SEQ ID NO: 21096 - DNA, 75 bp, Artificial Sequence
  Synthetic
atggcggggaatttgaagaagaaatctgccaaacccaaggcccaaaggagaccacctcagggccgaggagggcag

SEQ ID NO: 21097 - DNA, 75 bp, Artificial Sequence
  Synthetic
gtcaaacaaaaacccggtgctgctattgtgggagtcatgcattacgtgacccaccaggcgctgggcatgaagtta

SEQ ID NO: 21098 - DNA, 75 bp, Artificial Sequence
  Synthetic
agtgggagacttaagaagttctggaggaatacaccgccaggtcgcctcttgaaagcagcgatggtcatacttaac

SEQ ID NO: 21099 - DNA, 75 bp, Artificial Sequence
  Synthetic
atcctgaagaacttggtgatggggcttttggcaaaaaagaagggagggaggagaggtggaaagtctgttccattc

SEQ ID NO: 21100 - DNA, 75 bp, Artificial Sequence
  Synthetic
ttcttgatgcttgtccccattgctctgtcagcagttgtgatgaacgacggcggttggatctttcttaaacctaca

SEQ ID NO: 21101 - DNA, 75 bp, Artificial Sequence
  Synthetic
gtggctgacatagggaaaacaatcacagtaagaaatggtacatgtgtgttctcctctctagacattgggaatgaa

SEQ ID NO: 21102 - DNA, 75 bp, Artificial Sequence
  Synthetic
tgtgaagaaaccatgacttatccctgtataacactggccgcaacagaagaaccagttgatctggactgcttctgc

SEQ ID NO: 21103 - DNA, 75 bp, Artificial Sequence
  Synthetic
agagatgtcaaaaatgtgatggtgacttatcccacgtgtaagaggaacaccaggaccagacgggatgtcacaatc

SEQ ID NO: 21104 - DNA, 75 bp, Artificial Sequence
  Synthetic
caagaccatccaccgtctgtcacactcaccaaaccatctcttctcaagcatgtgggaggggctgaggagcatctt

SEQ ID NO: 21105 - DNA, 75 bp, Artificial Sequence
  Synthetic
caaaaggttgaaaattggatcttaatgaacagctggaaagttgtattggtgaccgtggccttgctctatggattt

SEQ ID NO: 21106 - DNA, 75 bp, Artificial Sequence
  Synthetic
gggaacaagctacaaacgtggattctcataattgtgaccttgattgtggctccagcttatgctagcacctgtgtt

SEQ ID NO: 21107 - DNA, 75 bp, Artificial Sequence
  Synthetic
agtgtggccaaaagggatatgatccgtggtgacctcggaacaacctgggttgatgcattccttgagaaaggatcg

SEQ ID NO: 21108 - DNA, 75 bp, Artificial Sequence
  Synthetic
tgcagtacactcatggttgaggacaaacctgctgtagatgtctggcttgatgaagtgtcccagtcctctgtcatt

SEQ ID NO: 21109 - DNA, 75 bp, Artificial Sequence
  Synthetic
gctagccatgaatattgcatggaagtcgccggaagcaatgtgaagagctcaggctcttgtcctacacagggagag

SEQ ID NO: 21110 - DNA, 75 bp, Artificial Sequence
  Synthetic
gcgcatctggcagaagaggcaaactctgactacgtgtgtaagcgaggtttcagtgacagaggttggggcaatgga

SEQ ID NO: 21111 - DNA, 75 bp, Artificial Sequence
  Synthetic
tgcggcttatttgggaaagggagcatagtggcatgcatcaagactacatgcaagaatgatgctaacatcataaag

SEQ ID NO: 21112 - DNA, 75 bp, Artificial Sequence
  Synthetic
agctatgtctatgatgctccaaaaatccagttcactgttggcattgaggtgcacaaaggcaatttacttggacct

SEQ ID NO: 21113 - DNA, 75 bp, Artificial Sequence
  Synthetic
tctgacaacaacaggattgtaaaagccactttttcagctgaagctgggaaacactctgtcgagctcactgggtat

SEQ ID NO: 21114 - DNA, 75 bp, Artificial Sequence
  Synthetic
ggtgtcctggaattcagttgtagggtggtagcaagcacggatctatcagacatacggctgattgagatagacaac

SEQ ID NO: 21115 - DNA, 75 bp, Artificial Sequence
  Synthetic
cacttttacaatgttcatgaggactggctgagagatctgccccttccctggaggttacccaaagggaaatggaaa

SEQ ID NO: 21116 - DNA, 75 bp, Artificial Sequence
  Synthetic
gacatggaacgtatggttgtctttaaggatccccatgctgtgaaatggactgtccagacttatggcaaccaaaga

SEQ ID NO: 21117 - DNA, 75 bp, Artificial Sequence
  Synthetic
actgctatcttcaaagctttggtgaaagccaatgaaatctccaagtccaacaataagtacattctggatggagga

SEQ ID NO: 21118 - DNA, 75 bp, Artificial Sequence
  Synthetic
cacttgagttgcaggatcggagtcaatggactgaagatggttggggctacctattctcaatgcacaaaacctttc

SEQ ID NO: 21119 - DNA, 75 bp, Artificial Sequence
  Synthetic
gaatggatcaagaaaccagtcctaactcaacatggcacagtggtcatggaagtgaagtacacaggtgaaggagcc

SEQ ID NO: 21120 - DNA, 75 bp, Artificial Sequence
  Synthetic
ccatgccgtataccattcagagttgaacgagtggacaagcctatggaaaatgttggcaatctggtcacaggaaac

SEQ ID NO: 21121 - DNA, 75 bp, Artificial Sequence
  Synthetic
ccatatgcctcacaaaaggacgctgtggtgttccttgaggcagaagtccctcccggcatcagtatcatcaaaatt

SEQ ID NO: 21122 - DNA, 75 bp, Artificial Sequence
  Synthetic
ggtgacattgatgtgcaatggaatcagccgggaatgactgtggggaagaccatagaacttgtcaagagaggctta

SEQ ID NO: 21123 - DNA, 75 bp, Artificial Sequence
  Synthetic
gagagaacactgatttcaagcagtgccttttggaactcagatgaaccattccacttttcaaatcttatctccatt

SEQ ID NO: 21124 - DNA, 75 bp, Artificial Sequence
  Synthetic
atcaagattccttttgattttgtgtttggtagcctgagttttattacacggctgatcctgtcagtggtactgata

SEQ ID NO: 21125 - DNA, 75 bp, Artificial Sequence
  Synthetic
tggatatgcttgaacacaaggaatggtaccatggcagctgcaacaggtgtggttggattcaccctactagcattg

SEQ ID NO: 21126 - DNA, 75 bp, Artificial Sequence
  Synthetic
acaactggggttgttggagagataggatgtatgattgatgtgggaaggagagagctgacttgtggggatggagtt

SEQ ID NO: 21127 - DNA, 75 bp, Artificial Sequence
  Synthetic
gtggtctggaaccaactggatgattggtgggaaaagtaccaatattatccagatgaacctgctgttttcttgggt

SEQ ID NO: 21128 - DNA, 75 bp, Artificial Sequence
  Synthetic
tccctcatggaagacaaagagaagcattgcggctacatgccagctaatcctctagaatggaggatgtggaggaaa

SEQ ID NO: 21129 - DNA, 75 bp, Artificial Sequence
  Synthetic
ttgcaagggcaaataaacaaagccctggaggacgccgacctagagtggaggattgaggtttctgaagaacatcat

SEQ ID NO: 21130 - DNA, 75 bp, Artificial Sequence
  Synthetic
tatttccagagagctccccatgaatggcagaggaagaaaggtgatgttgaacttagttggaagaactggttaaag

SEQ ID NO: 21131 - DNA, 75 bp, Artificial Sequence
  Synthetic
gacaatagactttatgactggttagctccaatgaacaagacagggaggactaagtacttcatcggtgatgttgga

SEQ ID NO: 21132 - DNA, 75 bp, Artificial Sequence
  Synthetic
atggaagaatgtccactggaccagcgttcatggaatgcttttaggatggctgaatttggcgagggcgtcttccag

SEQ ID NO: 21133 - DNA, 75 bp, Artificial Sequence
  Synthetic
acttacgtttacctggatgttgcaaggaacagatccatcctgtgtgaccggggtttgttggctcccgtggccaag

SEQ ID NO: 21134 - DNA, 75 bp, Artificial Sequence
  Synthetic
gacgataacgccatccatagctcaaattggatgtggatggagagtaacatcactgaggggaaagcccaattgcaa

SEQ ID NO: 21135 - DNA, 75 bp, Artificial Sequence
  Synthetic
tccatcactctgcaagctgtagttgagtgtgaatggcctaagacacacaccctgggattctcaacttccactgaa

SEQ ID NO: 21136 - DNA, 75 bp, Artificial Sequence
  Synthetic
caagaccttatcctaccattgaggtatggaggacctctgactgaattcaacaccatccctggctatggacaacag

SEQ ID NO: 21137 - DNA, 75 bp, Artificial Sequence
  Synthetic
tccaagggaccctggagccatggagttgtgcgagtggaacgtggagaatgtcctggcacaaaagttgaggttgat

SEQ ID NO: 21138 - DNA, 75 bp, Artificial Sequence
  Synthetic
tctgattgtgcgggccgaggagcatcagttcgatcaacgagagaaggaggaagcctgattgaggattggtgttgc

SEQ ID NO: 21139 - DNA, 75 bp, Artificial Sequence
  Synthetic
cgcacctgtacccttccacccctgcatttcaggactgaagagcactgctggtatgccatggaaattcggccatta

SEQ ID NO: 21140 - DNA, 75 bp, Artificial Sequence
  Synthetic
aagacagtgggaggacttgtcatggcttttgatgaagaaccagtgtggaagccatggggtattatgggattgata

SEQ ID NO: 21141 - DNA, 75 bp, Artificial Sequence
  Synthetic
gtcctgttgtacatgggcttctttccttctctgggcaatggaaaattttcaatgggttttggcatggctgtgttc

SEQ ID NO: 21142 - DNA, 75 bp, Artificial Sequence
  Synthetic
ctgttgtgcgtgactggaatgctctcattaacagagctagcaaagtacaccatgttgctcatggctgtgtatgct

SEQ ID NO: 21143 - DNA, 75 bp, Artificial Sequence
  Synthetic
gagagatttgatgaaccctgtctatgggctatgactgtctccacagttttcgatctgagaccaggtgctatacta

SEQ ID NO: 21144 - DNA, 75 bp, Artificial Sequence
  Synthetic
ctccttgtgtttacatggccttggcactttcagagagtggttgctgcagcttctgtgacaaacgtcctctcgctg

SEQ ID NO: 21145 - DNA, 75 bp, Artificial Sequence
  Synthetic
atgattaccgagggagtgtgggccattttggatggagtggggctggtactgtactgctacctcctaaccaggtca

SEQ ID NO: 21146 - DNA, 75 bp, Artificial Sequence
  Synthetic
ggaaagaaatccatgtggggactgctttttgtttcagcaagcagactcatcacagagggtagcttacaagtggct

SEQ ID NO: 21147 - DNA, 75 bp, Artificial Sequence
  Synthetic
tggattctcgttggcgcattgaccatgttatgctcatcaagacactttttggaaggagattgggtccagaaagca

SEQ ID NO: 21148 - DNA, 75 bp, Artificial Sequence
  Synthetic
ggatacctgtgcgcgggataccaccaagttgtgtccagtccatggagagtgataccaatgctgtggaatgagatg

SEQ ID NO: 21149 - DNA, 75 bp, Artificial Sequence
  Synthetic
gcctcacggaaacggagtggccaacgctcggtagacccaatagccattgtcgtgacgttgatggctttgggggct

SEQ ID NO: 21150 - DNA, 75 bp, Artificial Sequence
  Synthetic
gctgtggccaaggatggcactgccgttcagcctctaacactgggactcttttctgcagtcatcttgttcctattg

SEQ ID NO: 21151 - DNA, 75 bp, Artificial Sequence
  Synthetic
cttcagctgacgggtgggcccctcatagctgaatgggcagggtacgcggattggaaatccaatgccttgcgctac

SEQ ID NO: 21152 - DNA, 75 bp, Artificial Sequence
  Synthetic
tctggtcatctggacttagaagtcaagaagttgagcgatgggagactggtcaacacagctaaggaaaataccacc

SEQ ID NO: 21153 - DNA, 75 bp, Artificial Sequence
  Synthetic
accactgatggactcatactaggggctggaatgctagcttctggctttagctgggtagctgtgcctgtgactttt

SEQ ID NO: 21154 - DNA, 75 bp, Artificial Sequence
  Synthetic
gccatcttagccctcagacagtggaacagaagcatccagaagagcaacacttcattctcattgatcactgatatt

SEQ ID NO: 21155 - DNA, 75 bp, Artificial Sequence
  Synthetic
cttgaaagcgatgatcatgaatcgccaaatgaaggaatttacaggatcttcgcaagtggagtgttgggaaagaag

SEQ ID NO: 21156 - DNA, 75 bp, Artificial Sequence
  Synthetic
caagtgggcgttggcatctggaaacagggtgtctttcacacaatgtggcacgtgactagaggatcagttttgtca

SEQ ID NO: 21157 - DNA, 75 bp, Artificial Sequence
  Synthetic
atcaatgggagaaggtttcagccggagtgggctagtgtgagagatgatctaatttcttacaatggaccatggcgg

SEQ ID NO: 21158 - DNA, 75 bp, Artificial Sequence
  Synthetic
ctgccagcaaaatgggaaggtggtgaggtgcagttgcacggatacacaccagacggaaaagtgcaggtgacccaa

SEQ ID NO: 21159 - DNA, 75 bp, Artificial Sequence
  Synthetic
ctacttcccgggaggatggtgacagatggtggtgaagagctgggacttattccaattgatcatccgccaggaacc

SEQ ID NO: 21160 - DNA, 75 bp, Artificial Sequence
  Synthetic
tcgggctctccaatcattactaaagacgggcacgttgtcggtctctacggcaacggagtagtccatggtgagact

SEQ ID NO: 21161 - DNA, 75 bp, Artificial Sequence
  Synthetic
tactgtagctcaatagctcaggccaatgtgccagcagaaaccgaacctgaagtgctgaaaaccaactggacatca

SEQ ID NO: 21162 - DNA, 75 bp, Artificial Sequence
  Synthetic
aagggaaaactcaccgtcattgacgctcatccagggagtgggaaaacaaagaaaatattgccacgccttgttgat

SEQ ID NO: 21163 - DNA, 75 bp, Artificial Sequence
  Synthetic
gaagctgttggaagaaagcttcgcacactagtccttgctccaacaagggttgttgtgaaggagatggagcaggca

SEQ ID NO: 21164 - DNA, 75 bp, Artificial Sequence
  Synthetic
ctcagaggcaagcctgttagttttcattcttcagcagcgagtaagaaggtgccaggagcactggtggatgttatg

SEQ ID NO: 21165 - DNA, 75 bp, Artificial Sequence
  Synthetic
tgtcatgcaacttatgtccagcgacggatgatgcctattcctcagaagaactatgagcttgtcatcatggatgaa

SEQ ID NO: 21166 - DNA, 75 bp, Artificial Sequence
  Synthetic
gcacattggacagacccctctagcattgcggcccgaggattccttgattctcagcggaaggaaaatcacctttca

SEQ ID NO: 21167 - DNA, 75 bp, Artificial Sequence
  Synthetic
ctggtgctcatgactgccacaccacctggaactgatgatccctggcctcaaagcaacgctccaataaacgacaac

SEQ ID NO: 21168 - DNA, 75 bp, Artificial Sequence
  Synthetic
gagaaaatcattcctgagggtgattggaagactggacatgattggataacagagtttgaagggaaaacagtctgg

SEQ ID NO: 21169 - DNA, 75 bp, Artificial Sequence
  Synthetic
tttgtcccatcactaaaagctggagccaccattgccaaaacgctgagaggatttggaaagagcacagctgttctg

SEQ ID NO: 21170 - DNA, 75 bp, Artificial Sequence
  Synthetic
agcagcaaaaccttttctgaagtgtacccaaccctcagagatagcaagcctgactttattttgactacagacatc

SEQ ID NO: 21171 - DNA, 75 bp, Artificial Sequence
  Synthetic
tcagagatgggggctaactttgatgtggaccgtgtgatcgactcaaggacaactctcaagccaattgaagtcggc

SEQ ID NO: 21172 - DNA, 75 bp, Artificial Sequence
  Synthetic
aattgtgttgacatctctggtgaaagagcggtaactcccgcctcagctgctcaaaggagaggaagagtggggcgt

SEQ ID NO: 21173 - DNA, 75 bp, Artificial Sequence
  Synthetic
gaggagggacgtcaagctgagtacgtctatcagggcgaagttgaccccgatgacggagacttggtgtgctggaaa

SEQ ID NO: 21174 - DNA, 75 bp, Artificial Sequence
  Synthetic
gaggcccagatactcctggataacatggaaggacgattcaaaacggccagtgtcttctatgagcctgagatcacc

SEQ ID NO: 21175 - DNA, 75 bp, Artificial Sequence
  Synthetic
aaaatgcctgacacacctggctattttaagctaccagttgagaagaagaagtattttcgtcacttaatatcgaat

SEQ ID NO: 21176 - DNA, 75 bp, Artificial Sequence
  Synthetic
tgtgacttcaccccttggctagcttggaaagttgcttcagaaacaaaaggtgtggaagacagaggttgggtatct

SEQ ID NO: 21177 - DNA, 75 bp, Artificial Sequence
  Synthetic
ctagggccgaaagagcatgaaatcgctgaccatgaaggagagttgattaagttcaaaagccctagtggaagagaa

SEQ ID NO: 21178 - DNA, 75 bp, Artificial Sequence
  Synthetic
aacatcctacgacctgtgtggcttgacaatagaatgatcagagagaaaagagacctggaagccctcattgattat

SEQ ID NO: 21179 - DNA, 75 bp, Artificial Sequence
  Synthetic
gctaagggcaaacgttcaggaatgaccattcttcagcttctctatgaagggctacagcatgatctggacgtggtg

SEQ ID NO: 21180 - DNA, 75 bp, Artificial Sequence
  Synthetic
tacacctacatgagagccaacaaagaatcaagagcgtggaaaatggcaaacgaagatcttccagaagctctggtt

SEQ ID NO: 21181 - DNA, 75 bp, Artificial Sequence
  Synthetic
ggcttgggacagagtgttctctccattgtgggggtgattttcctggtctggttgctcttaaggcagagcaaagtt

SEQ ID NO: 21182 - DNA, 75 bp, Artificial Sequence
  Synthetic
gacagggtcaccctgggggctctgttgctaactgctggctcagcggttctttggatgggtggagcagccccttgt

SEQ ID NO: 21183 - DNA, 75 bp, Artificial Sequence
  Synthetic
gtcgtgggtgggagcctgatatgtgggtttgttttactagtagcattgtcaccagaggagggaatgcaacgcact

SEQ ID NO: 21184 - DNA, 75 bp, Artificial Sequence
  Synthetic
caagttgactcaactctggctatgtttgtgttgacactctacaccttgatagccgctgttgtcgctaatgaaatg

SEQ ID NO: 21185 - DNA, 75 bp, Artificial Sequence
  Synthetic
gggttcttggaacgaacaaagaaggacttccgagagttttttaggaaagaagtgaacatggacggtgagccaacc

SEQ ID NO: 21186 - DNA, 75 bp, Artificial Sequence
  Synthetic
cagtggagaatttttgacctcgacatctgcccaatggtaagttggagcttgtatgttctgttggtgacgggttta

SEQ ID NO: 21187 - DNA, 75 bp, Artificial Sequence
  Synthetic
aggcccgtatgcctgcatggattgcaaatgatgacacagcgtgtagtcactggggccattagtggaagaagtgat

SEQ ID NO: 21188 - DNA, 75 bp, Artificial Sequence
  Synthetic
ttgctcggccagttgagagaaggtatggggaatgtctctattggactccctgaacttgctcttgggatgagcgtt

SEQ ID NO: 21189 - DNA, 75 bp, Artificial Sequence
  Synthetic
gtgcgtgggatgacaccagtcaccctagtgttgggtggtctggcaggagtggcacactggtgctggttttaccca

SEQ ID NO: 21190 - DNA, 75 bp, Artificial Sequence
  Synthetic
attcatgaggctgcactcaccatgaaagcgaacaaaatcgtggcacagtctatggcaaaaaacacgcaagtggat

SEQ ID NO: 21191 - DNA, 75 bp, Artificial Sequence
  Synthetic
ggcgaggtgatttaccagcttgaagaaaagattgctaagaccgaagaccatgaaaagaagttctcatatggagtg

SEQ ID NO: 21192 - DNA, 75 bp, Artificial Sequence
  Synthetic
gctgtcattcttaacttaatcaacctggccttgaatcaaaatctgtggagcttgcttgagtgtgcaatggctatc

SEQ ID NO: 21193 - DNA, 75 bp, Artificial Sequence
  Synthetic
ctagctgctctctgctacattagaggtcaaccaacactctgcacactgccagttgtagccggattgggcaagata

SEQ ID NO: 21194 - DNA, 75 bp, Artificial Sequence
  Synthetic
ctgcgaggtgactacttgggtatcttgcccgtcgcattgcacgcttggcggagcacgagcgagaacagacgagga

SEQ ID NO: 21195 - DNA, 75 bp, Artificial Sequence
  Synthetic
gtgagttcaagttacatcacttatggagagcagtggaagagagagctgaacaaattgaatgcccaggcattcttc

SEQ ID NO: 21196 - DNA, 75 bp, Artificial Sequence
  Synthetic
ctctacaagagtagactcgtccacgaaattgacagagccgaagcagtttctaacctcagtaaaggacggaccaac

SEQ ID NO: 21197 - DNA, 75 bp, Artificial Sequence
  Synthetic
acaggacacgcagtgtcgagggggacaagcaagcttgcttggatgcatgagcgcggttacgttccactcaaggga

SEQ ID NO: 21198 - DNA, 75 bp, Artificial Sequence
  Synthetic
gttgtggtcgacttgggaagtgggcgaggaggctggagctattatgctgcagcccaagagagagttcggaaagtc

SEQ ID NO: 21199 - DNA, 75 bp, Artificial Sequence
  Synthetic
aatgcttacactttggctaccaccaagggacatgaacaacctcgtctcgtgcagtcctatggctggaacctggtg

SEQ ID NO: 21200 - DNA, 75 bp, Artificial Sequence
  Synthetic
actttcaagaaggctgacgtgaggactatagaaccttaccctgtggacacgcttttgtgtgacatcggagagtcc

SEQ ID NO: 21201 - DNA, 75 bp, Artificial Sequence
  Synthetic
agttcatcctcatcgattgaagccaagcggacgctgcaaataatggatgttgttgggaagtggctggaaatttct

SEQ ID NO: 21202 - DNA, 75 bp, Artificial Sequence
  Synthetic
ccaggagcttccttttgcataaagatcttgtgtccttataatccggaagtcattgagcacttgagcaggtggcaa

SEQ ID NO: 21203 - DNA, 75 bp, Artificial Sequence
  Synthetic
caccagtttggaggaggattggtccgtgtcccgcactcgaggaactccactcatgaaatgtattttgttagtgga

SEQ ID NO: 21204 - DNA, 75 bp, Artificial Sequence
  Synthetic
ggaggaggaaatttgatgtcatcgatcacagcggttacaacccaacttatgcgcagattcacccttgaggctggg

SEQ ID NO: 21205 - DNA, 75 bp, Artificial Sequence
  Synthetic
cctaggcatgtgtttgacatcaatcttggagtgggaacccggtccaatctcatggagaaatcggaagcagacaag

SEQ ID NO: 21206 - DNA, 75 bp, Artificial Sequence
  Synthetic
agcctgattgcagacagaatcaccatcatccagaatgagaacaaggcttcttggcatcaggatcccaaccagcct

SEQ ID NO: 21207 - DNA, 75 bp, Artificial Sequence
  Synthetic
tacagaacttggacttatcatggcagttacagcataagggatgttggcacctcagctagtgccccaaatcatgtt

SEQ ID NO: 21208 - DNA, 75 bp, Artificial Sequence
  Synthetic
gtcaagcttctggcatggccttggttgaaaatagagaaagtcgtgttaatggccatgacggatacaactgccttt

SEQ ID NO: 21209 - DNA, 75 bp, Artificial Sequence
  Synthetic
ggacagcagagagtgtttaaagagaaagttgacaccaaagcacccgaacctcccaaagaggtcaagaaagttatg

SEQ ID NO: 21210 - DNA, 75 bp, Artificial Sequence
  Synthetic
cgcctggtgtttaggtggcttcttaatcacataaaatccaagggagcagtggttagaagatgcaccaaggaagaa

SEQ ID NO: 21211 - DNA, 75 bp, Artificial Sequence
  Synthetic
ttcattaacaaagtgaattcaaacgcttccataggcgcctacctcagggaaatgggagaatggagtagtgccaaa

SEQ ID NO: 21212 - DNA, 75 bp, Artificial Sequence
  Synthetic
gaagccgtaagtgacccaaaattttggaacatggttgataaagagcggcaattgcatctcaagggcaaatgccac

SEQ ID NO: 21213 - DNA, 75 bp, Artificial Sequence
  Synthetic
aactgtgtctataacctgatgggcaaacgagagaaaaaacccggtgagtttggagtcgccaagggatcacgcacc

SEQ ID NO: 21214 - DNA, 75 bp, Artificial Sequence
  Synthetic
atctggtacatgtggttggggagcagattcctggagtttgaggcccttggatttctaaatgaggaaagatgggcc

SEQ ID NO: 21215 - DNA, 75 bp, Artificial Sequence
  Synthetic
tctagagacatctccggaggaggcgtggaagggatcggaattaactatctagggtatcatcttgagaaaatggct

SEQ ID NO: 21216 - DNA, 75 bp, Artificial Sequence
  Synthetic
cggaaagtgggagtgctctatgcagacgataccgccggatgggacacccgagtaactcaagcagatcttgaggat

SEQ ID NO: 21217 - DNA, 75 bp, Artificial Sequence
  Synthetic
gagagagagctcctgcattttatggagggagaacataaaaggctagcagaggcaatttttaaacttacctatgag

SEQ ID NO: 21218 - DNA, 75 bp, Artificial Sequence
  Synthetic
aataaagttgcattgtgcccacggccaggttcaaagggaggcactgtgatggatgtgatatcaaggaaggaccag

SEQ ID NO: 21219 - DNA, 75 bp, Artificial Sequence
  Synthetic
cgaggttcaggccaagtcgtgacttatgcactaaacaccctaacaaatatcaaggtgcaattagtgcgcatggct

SEQ ID NO: 21220 - DNA, 75 bp, Artificial Sequence
  Synthetic
gaatctgaaggaatcttgacccccgaactagaagatcttggaatagaacaatggttgaaacaaaatggagaggat

SEQ ID NO: 21221 - DNA, 75 bp, Artificial Sequence
  Synthetic
cgactctcaaggctccttgtcagtggagatgactgcgttgtcaacgctttggatgagaggtttggcaaagctctg

SEQ ID NO: 21222 - DNA, 75 bp, Artificial Sequence
  Synthetic
acatggcttaacaccatggaaaaaacccgtaaagacatagaagcatggaaaccatcacgggcttatagaacctgg

SEQ ID NO: 21223 - DNA, 75 bp, Artificial Sequence
  Synthetic
caggaagtcgagttttgctcacaccacttccatgagctttttctccgagacggaaggaagctgatcgtcccgtgc

SEQ ID NO: 21224 - DNA, 75 bp, Artificial Sequence
  Synthetic
cgggaccagcatgaattggttggacggtcaatggtctcgcagggtgggagctctggagtggcagggacagcttgt

SEQ ID NO: 21225 - DNA, 75 bp, Artificial Sequence
  Synthetic
ctggccaaagcatacgcccagatgtggctgatgagctatttccataggagagacctcagaactcttggattcgct

SEQ ID NO: 21226 - DNA, 75 bp, Artificial Sequence
  Synthetic
atcatgagctcagtgcccaaggactggtttcccactggtagaacgacttggtctgtgcatgccaatcatgagtgg

SEQ ID NO: 21227 - DNA, 75 bp, Artificial Sequence
  Synthetic
ctcagcaacgagaacattcttgagatttggaacagggtttggatcgaggaaaatcccttcatggaagacaagacc

SEQ ID NO: 21228 - DNA, 75 bp, Artificial Sequence
  Synthetic
acagtagccgagtggaaaaacataccatacctccaaaggaaccaggatttgtcatgctccagcctgatagacaac

SEQ ID NO: 21229 - DNA, 75 bp, Artificial Sequence
  Synthetic
ccaaccagagcgcagtgggcaaaactactcaaaggggctgtcatgaaagtgagagagatgataggccgagagcat

SEQ ID NO: 21230 - DNA, 75 bp, Artificial Sequence
  Synthetic
cgagagcattactctgactacttgagcaatatgggtaggtaccaagaagggacggaagagttccacatgtggtaa

SEQ ID NO: 21231 - DNA, 75 bp, Artificial Sequence
  Synthetic
acgcttaacgacaaaaacagaaaaggaatagacataatcgcctgcagaatagaaatgtaacacccctacaatgga

SEQ ID NO: 21232 - DNA, 75 bp, Artificial Sequence
  Synthetic
ttctgacaagattgtcttcaaggtccataaccagttggtttcagtgaagcctgaggtgattactgatcagtatga

SEQ ID NO: 21233 - DNA, 75 bp, Artificial Sequence
  Synthetic
gtataagtatcctgccattgggaatcagaaaaaacccagcataactctcggcaaggctccagacttaaacaaggc

SEQ ID NO: 21234 - DNA, 75 bp, Artificial Sequence
  Synthetic
ttacaagtctattctgtctggaatgaatgccgcaaagctggaccctgatgacgtctgttcttatcttgctgctgc

SEQ ID NO: 21235 - DNA, 75 bp, Artificial Sequence
  Synthetic
catggagctgtttgaaggagtgtgccctgatgattgggcaagttatggaattcttattgctaagaagggagacaa

SEQ ID NO: 21236 - DNA, 75 bp, Artificial Sequence
  Synthetic
aatcactccgaccaccttggtggacattatccgaacggatgtggaagggaattgggcacaaactggaggtcaaga

SEQ ID NO: 21237 - DNA, 75 bp, Artificial Sequence
  Synthetic
tttgactagggatccgacaactgccgagcatgcatcattggtaggacttcttctttgtctttaccgattgagcaa

SEQ ID NO: 21238 - DNA, 75 bp, Artificial Sequence
  Synthetic
gattgttggacaaaacacgggaaattacaagacaaacgttgctgatcggatggagcaaatctttgagacagctcc

SEQ ID NO: 21239 - DNA, 75 bp, Artificial Sequence
  Synthetic
cttcgtcaaggtggttgaacatcacacattgatgaccactcacaagatgtgtgcaaattggagcacgataccaaa

SEQ ID NO: 21240 - DNA, 75 bp, Artificial Sequence
  Synthetic
tttcaggttcctggcaggaacatatgacatgttcttctcgaggatagaacacttgtactcagctatcagagtagg

SEQ ID NO: 21241 - DNA, 75 bp, Artificial Sequence
  Synthetic
gactgttgtaactgcatatgaggattgctctggattggtttcattcactggattcatcaaacagatcaatttgac

SEQ ID NO: 21242 - DNA, 75 bp, Artificial Sequence
  Synthetic
agccagagaggccatattgtatttctttcacaaaaactttgaggaggagatcaaacggatgtttgaaccgggaca

SEQ ID NO: 21243 - DNA, 75 bp, Artificial Sequence
  Synthetic
ggaaactgcagttcctcattcctacttcatacatttcagatccttgggtctgagcggcaaatctccgtactcatc

SEQ ID NO: 21244 - DNA, 75 bp, Artificial Sequence
  Synthetic
caatgcagttggtcatgtattcaatctcattcactttgtaggttgctacatgggtcaaatcaggtcactaaatgc

SEQ ID NO: 21245 - DNA, 75 bp, Artificial Sequence
  Synthetic
tactgttatttctagttgtgcacctcatgagatgtctgtcttagggggctatttgggggaggagttctttggaaa

SEQ ID NO: 21246 - DNA, 75 bp, Artificial Sequence
  Synthetic
agggacgtttgagaggaggttctttagagatgagaaggagctgcaggattatgaattagcagaggccacaaagac

SEQ ID NO: 21247 - DNA, 75 bp, Artificial Sequence
  Synthetic
agatttagcgttagctgacgacgggactgtcaattcagatgatgaagacttcttttctggggagaccaggagtcc

SEQ ID NO: 21248 - DNA, 75 bp, Artificial Sequence
  Synthetic
tgaggctgtatacactagaattatgatgaacggagggaggctgaagaagtctcacataaggagatatgtctcggt

SEQ ID NO: 21249 - DNA, 75 bp, Artificial Sequence
  Synthetic
cagctccaaccatcaggccagacccaactcgtttgccgaattccttaataagacctactcgggtgatcagagata

SEQ ID NO: 21250 - DNA, 75 bp, Artificial Sequence
  Synthetic
aagggtgaacaatgtctcgtcccaccatttgttttacaattgagcatgaaaaaaactaacacccctccatcaact

SEQ ID NO: 21251 - DNA, 75 bp, Artificial Sequence
  Synthetic
ccatccccatcatgagcaagatctttgtcaatcctagtgcaattagggctggtcttgctgatctggaaatggcag

SEQ ID NO: 21252 - DNA, 75 bp, Artificial Sequence
  Synthetic
aggagacggtggacctggtcaacaagaacgtggaggagagccaagctcatcttcaggcagagccaatagaggtgg

SEQ ID NO: 21253 - DNA, 75 bp, Artificial Sequence
  Synthetic
atgcactccctgaggacatgaaaaggctccaaattagcgagcccaagccgtgtcagttgcctgatggtacctgca

SEQ ID NO: 21254 - DNA, 75 bp, Artificial Sequence
  Synthetic
tgaaggaagaaggaggtgatgaagacttttacatggctgaaagtggggatccttatatccccttacaatcatacc

SEQ ID NO: 21255 - DNA, 75 bp, Artificial Sequence
  Synthetic
tggacaccatggggatccaaattgtgagaaagatgaagaccggtgagaggtttttcaaaatctggtctcaatcgg

SEQ ID NO: 21256 - DNA, 75 bp, Artificial Sequence
  Synthetic
ttgaggagatcatctcatatgtggccgtcaacttcccagttccgccggggaaatctctagcagataagtctactc

SEQ ID NO: 21257 - DNA, 75 bp, Artificial Sequence
  Synthetic
aaacatctgtagagaaatcaaaacctgcatctcagccaacccagcccaagaaggaggaccaactgtccaaggtca

SEQ ID NO: 21258 - DNA, 75 bp, Artificial Sequence
  Synthetic
acattgattcccaagaatcatccgggcctcctgcattggattgggctgccaccaatgatgatgatgatgcttccg

SEQ ID NO: 21259 - DNA, 75 bp, Artificial Sequence
  Synthetic
tggaagcggagatagcacatcagatagccgagagcttttccaaaaagtataagttcccctcaagatcctccggaa

SEQ ID NO: 21260 - DNA, 75 bp, Artificial Sequence
  Synthetic
tattcctatacaattttgagcaactgaaaatgaatctcgatgacatagtgcgggaagcgaaggggattcctggtg

SEQ ID NO: 21261 - DNA, 75 bp, Artificial Sequence
  Synthetic
tgactcgacgggcaggtgatggagtcagactccctctcagatgtatactgggatgggtcgcctccactcactcta

SEQ ID NO: 21262 - DNA, 75 bp, Artificial Sequence
  Synthetic
gaaggtttcagttgcttgtgaactctgacaaattgaacaaagtcatgcaagatgacatcaacagatatctggctt

SEQ ID NO: 21263 - DNA, 75 bp, Artificial Sequence
  Synthetic
actaatttcagaccaaaagattcccgagaaattcaggtctcaattccttctacaagatccataaaaaaaacatgt

SEQ ID NO: 21264 - DNA, 75 bp, Artificial Sequence
  Synthetic
aacaccactgacgagatgaatattctccgcaagatcgtgaagagctgcaaggatgaggaggatcagaagcctgcc

SEQ ID NO: 21265 - DNA, 75 bp, Artificial Sequence
  Synthetic
ttggtttctgctcctcctgatgacgatgacctgtggctccccccacctgagtatgtgcctctgacagaaattaca

SEQ ID NO: 21266 - DNA, 75 bp, Artificial Sequence
  Synthetic
ggtaagaagaacatgaggaatttttgtgtcaacggggaaattaagatatgcagccccaatggttattctttccga

SEQ ID NO: 21267 - DNA, 75 bp, Artificial Sequence
  Synthetic
atcctgagacacattttgaagtcttttgatggggtttactctgggaaccgtaggatgatcggtctggtgaaagtt

SEQ ID NO: 21268 - DNA, 75 bp, Artificial Sequence
  Synthetic
gtgataggtcttgctctgtcaggagcccctgtccccgagggaatgaactgggtctataagatcaggcgcacgctg

SEQ ID NO: 21269 - DNA, 75 bp, Artificial Sequence
  Synthetic
gtgtttcaatgggctgaatcacgcggtccactagatggtgaagaactggaatattctcaggagataacctgggat

SEQ ID NO: 21270 - DNA, 75 bp, Artificial Sequence
  Synthetic
gatgactctgagtttataggactgcaaataagggtgagtgcgagacaatgccatatccaggggagagtttggtgc

SEQ ID NO: 21271 - DNA, 75 bp, Artificial Sequence
  Synthetic
atcaacatgaattctcgagcatgccaactatggtctgacatgtctctcaaaactcaacagtctgatgaggacaaa

SEQ ID NO: 21272 - DNA, 75 bp, Artificial Sequence
  Synthetic
aacacctccctgctgttggaatgatcttccccactagccgccattcacttgtttacctctgcacaaggatacaca

SEQ ID NO: 21273 - DNA, 75 bp, Artificial Sequence
  Synthetic
caaactttatcctcgaccttttgcgagcaatagaacaacatatgttatggtgccacacaacagctgcatattatt

SEQ ID NO: 21274 - DNA, 75 bp, Artificial Sequence
  Synthetic
gagatacctgattgaacactttcacacgtgaatcctctgcaatgtgaaaaaaacatttaacacctctcaggaaac

SEQ ID NO: 21275 - DNA, 75 bp, Artificial Sequence
  Synthetic
caaagagccatgccccttcaggcaattccactcttctccctcattcttcccgttttagtggcagggaagttcccc

SEQ ID NO: 21276 - DNA, 75 bp, Artificial Sequence
  Synthetic
atatatactatccctgacaagatcggtccttggagtcccatcgacatcaaccacctcagttgcccaaacaatctg

SEQ ID NO: 21277 - DNA, 75 bp, Artificial Sequence
  Synthetic
gttgtagaagacgaaggatgtacaactctcactgcgttctcttatatggagttgaaagtggggtatatcaccact

SEQ ID NO: 21278 - DNA, 75 bp, Artificial Sequence
  Synthetic
ataaaagtgagtgggtttacatgtactggggtcgttacagaggctgagacttacaccaacttcgtgggatatgtt

SEQ ID NO: 21279 - DNA, 75 bp, Artificial Sequence
  Synthetic
acaaccacctttcggcgcaagcatttcaggccgaccgcaagtgcctgcagagaggcgtacaactggaaagctaca

SEQ ID NO: 21280 - DNA, 75 bp, Artificial Sequence
  Synthetic
ggtgatcccagatacgaggagtctctgcataacccttaccccgactcccactggttaagaacagtcaagaccaca

SEQ ID NO: 21281 - DNA, 75 bp, Artificial Sequence
  Synthetic
aaggaatcactcctaattatatctccgagtgtggcagatatggacgcatatgacaaagcactctactctaagata

SEQ ID NO: 21282 - DNA, 75 bp, Artificial Sequence
  Synthetic
ttccccaacggaaaatgcttaggagtgtccttgagctcccctttctgctcgaccaatcacgattacaccctttgg

SEQ ID NO: 21283 - DNA, 75 bp, Artificial Sequence
  Synthetic
atgcctgagaatccgaaaccaggtgtatcatgtgacatcttcaccacaagcaaggggaagaaggcaacgaaggac

SEQ ID NO: 21284 - DNA, 75 bp, Artificial Sequence
  Synthetic
ggcaagctgtgcgggttcgtcgacgagagaggactttataaatcattgaaaggggcatgtaaactgaaactctgc

SEQ ID NO: 21285 - DNA, 75 bp, Artificial Sequence
  Synthetic
ggggtcatgggattgaggctgatggatgggtcctgggtgtctctccaaaagacagaggagtctgaatggtgttct

SEQ ID NO: 21286 - DNA, 75 bp, Artificial Sequence
  Synthetic
ccgaatcaactgattaacattcatgacttccactcagatgagattgaacacatggtggtggaggagttagttaag

SEQ ID NO: 21287 - DNA, 75 bp, Artificial Sequence
  Synthetic
aaaagggaggaatgcttagatgccttggagtcaatcatgacaacaaagtccataagttttagacgcctcagccat

SEQ ID NO: 21288 - DNA, 75 bp, Artificial Sequence
  Synthetic
cttcggaagttggtccctggatttgggaaggcatacactctgatcaacaaaaccctcatggaggccgatgctcac

SEQ ID NO: 21289 - DNA, 75 bp, Artificial Sequence
  Synthetic
tacaagtcagtcagggaatggacagaggtgatcccctccaaagggtgtttaaaagccgggggaggatgttatccc

SEQ ID NO: 21290 - DNA, 75 bp, Artificial Sequence
  Synthetic
cattataacagggtgtttttcaacgggatcatcctgagtcctgatggacatgtgctaattccagaaatgcaatct

SEQ ID NO: 21291 - DNA, 75 bp, Artificial Sequence
  Synthetic
gctttactccagcaacatattgagctgttggaatcttctgtcatacccctcagacaccccttggcggatccatct

SEQ ID NO: 21292 - DNA, 75 bp, Artificial Sequence
  Synthetic
actgttttcaaaggggatgatgaggcggaggagttcgtagaggtccatcttccggacacgcaaaagcagatctcg

SEQ ID NO: 21293 - DNA, 75 bp, Artificial Sequence
  Synthetic
gggattgacctaggccttccagagtggaaaagatactttctaatggggatgtctgccatcggatttcttgctttg

SEQ ID NO: 21294 - DNA, 75 bp, Artificial Sequence
  Synthetic
acgataatcctagcggtgtgctgtcggaggatcaagagacgaaagcagtctaaacccaacccagttgagctgatt

SEQ ID NO: 21295 - DNA, 75 bp, Artificial Sequence
  Synthetic
agaaaggtttctgtcacctctcaaagtgggagagcgattccatcatgggagtcttacaaggtcaagactggggat

SEQ ID NO: 21296 - DNA, 75 bp, Artificial Sequence
  Synthetic
caacctcaagtctagatagtttatctgatgggtgaagctagggaccaactgaatccgtatacaccagagacctct

SEQ ID NO: 21297 - DNA, 75 bp, Artificial Sequence
  Synthetic
aaattcatcagtcccccaacagaccatctaaataaactataagagagaatctgtgggatatcgacacatcacccc

SEQ ID NO: 21298 - DNA, 75 bp, Artificial Sequence
  Synthetic
ctgtcgccagacacagatgattcaggtataacagtgtctatggtattgcaatagttacattaattattggtgctt

SEQ ID NO: 21299 - DNA, 75 bp, Artificial Sequence
  Synthetic
tagctaatctgggatgcattcaataaactgattatgttgaagggagggcaatagatctaatcaatcatctaccga

SEQ ID NO: 21300 - DNA, 75 bp, Artificial Sequence
  Synthetic
ctaagagaacattaacataccatccagagtctttcactccaaagaggcttagagggtgtctgatttccttgtaca

SEQ ID NO: 21301 - DNA, 75 bp, Artificial Sequence
  Synthetic
gttaacacagataatgcaaacagatgaagctcagctatgttattaacaagatgtatataaagacaatgagtcaaa

SEQ ID NO: 21302 - DNA, 75 bp, Artificial Sequence
  Synthetic
tcatcccgaatatatattcatgaaaaaaacatcataatgatgaaggggcaacacctctattccggaagaactcca

SEQ ID NO: 21303 - DNA, 75 bp, Artificial Sequence
  Synthetic
caaaatgatcgaccctctggaggtctatgatgatcctgtggatccggtggagccagaggctgaatttaggggcaa

SEQ ID NO: 21304 - DNA, 75 bp, Artificial Sequence
  Synthetic
ctcagtggtgccgaacattctcaggaattctgattacaacctcaattctcccctgatagaggatccgtcaaggct

SEQ ID NO: 21305 - DNA, 75 bp, Artificial Sequence
  Synthetic
catgcttgagtggctaactacaggaaacaaacccaatcggatgactttcactgacaactccttgagatcttataa

SEQ ID NO: 21306 - DNA, 75 bp, Artificial Sequence
  Synthetic
agtcttgaaaagctatttcaaaaagatagatgttgggtccctgagggttggaagctctggtgcacaagctatgat

SEQ ID NO: 21307 - DNA, 75 bp, Artificial Sequence
  Synthetic
atctctgtggatacatggatctcactcagagtcgaatcgtagtcgaaaatgccttactgatctctctaattttta

SEQ ID NO: 21308 - DNA, 75 bp, Artificial Sequence
  Synthetic
ccaaaaatcatctcctattgagaaactactcaactatactttagaaaataggggacttaagattccacgtgaggg

SEQ ID NO: 21309 - DNA, 75 bp, Artificial Sequence
  Synthetic
agttctctctagtctaagaaaagtaaattatgaccatgcatttggacgttacctagggaacacttatgcttctta

SEQ ID NO: 21310 - DNA, 75 bp, Artificial Sequence
  Synthetic
cctgtttttccacattataattctatatatgaatgctctagattgggatgaagagaaaactatcctggctttgtg

SEQ ID NO: 21311 - DNA, 75 bp, Artificial Sequence
  Synthetic
gaaagaactcaactctgtggatgtagggaaggatcaggtcaagttccgtgatcaaatttgggggtctcttgtggt

SEQ ID NO: 21312 - DNA, 75 bp, Artificial Sequence
  Synthetic
aacgaaggactttgtttactcccagagtgccaacagcttgtttgataggaactataccctgatgttgaaagatct

SEQ ID NO: 21313 - DNA, 75 bp, Artificial Sequence
  Synthetic
gtttttgtcccggttcaactccctcttgattttgctttcccctccagagcctcggtactcagatgatctggtttc

SEQ ID NO: 21314 - DNA, 75 bp, Artificial Sequence
  Synthetic
tcagctatgtcagctttatatcgcgggagataacatcttgtcaatttgtggaaattcagggtatgatgtgataaa

SEQ ID NO: 21315 - DNA, 75 bp, Artificial Sequence
  Synthetic
gatgttagagccatatgtggtgaacagcttagtgcagaaggctgaggagttcaggcctttgatccactccctagg

SEQ ID NO: 21316 - DNA, 75 bp, Artificial Sequence
  Synthetic
agactttcctatcttcatcaaagacaaagttggccaactagaggggacctttggaccaagtgccaggaagttttt

SEQ ID NO: 21317 - DNA, 75 bp, Artificial Sequence
  Synthetic
tagagtgttagaccaattggataacattcatgatcttgtgtttgtttatgggtgttataggcactgggggcaccc

SEQ ID NO: 21318 - DNA, 75 bp, Artificial Sequence
  Synthetic
ctatatagattaccggaaagggttatctaagttgtatgaccaggttcacgtgaagaaggtgattgatggggacta

SEQ ID NO: 21319 - DNA, 75 bp, Artificial Sequence
  Synthetic
ccaagaatgtctagcaagtgatttggctaagagaatcctacggtgggggtttgacaaatactccaaatggtatct

SEQ ID NO: 21320 - DNA, 75 bp, Artificial Sequence
  Synthetic
agatgctaaactactcacaaaggatcatcccctaaccccttacatcaagacacaaacgtggcctccaaaacatgt

SEQ ID NO: 21321 - DNA, 75 bp, Artificial Sequence
  Synthetic
agtcgacatcgttggtaacacctggcacaagctccctataacccaaatatttgagatacccgaatcaatggaccc

SEQ ID NO: 21322 - DNA, 75 bp, Artificial Sequence
  Synthetic
atcagaaattctggacgacaagtctcattcattcactaggacaaaactggcatcgtggctctcagagaatagagg

SEQ ID NO: 21323 - DNA, 75 bp, Artificial Sequence
  Synthetic
gggccccgtccctagtgagaaggtgataataactgcactgtctagaccccccgtaaaccccagggagttcctgag

SEQ ID NO: 21324 - DNA, 75 bp, Artificial Sequence
  Synthetic
atccatagatattggggggttgccagatgatgatctcatcataggcctgaagccaaaagagagagagttgaagat

SEQ ID NO: 21325 - DNA, 75 bp, Artificial Sequence
  Synthetic
agagggacgtttttttgccctaatgtcctggaacttgaggctttactttgtaatcacggagaaattattagcaaa

SEQ ID NO: 21326 - DNA, 75 bp, Artificial Sequence
  Synthetic
ttacatattgcctctgtttgatgctctgaccatgacagacaaccttaataaagtattcaagaagttgatagacag

SEQ ID NO: 21327 - DNA, 75 bp, Artificial Sequence
  Synthetic
agtgacagggcagggtcttttagattactcaagggtaacatatgcattccatcttgattacgaaaaatggaataa

SEQ ID NO: 21328 - DNA, 75 bp, Artificial Sequence
  Synthetic
tcaccagagattggaatcaaccaaggatgttttctcagtcctggactatgtttttggtttgaaaagggtcttttc

SEQ ID NO: 21329 - DNA, 75 bp, Artificial Sequence
  Synthetic
aagaacccatgagttcttccagaagtcttgggtatattactctgacagatcagacttgattggcctgtgggaaga

SEQ ID NO: 21330 - DNA, 75 bp, Artificial Sequence
  Synthetic
tcagatctactgtcttgacatgaccaacggaccaacctgctggaatggccaggacggtggattagagggactgag

SEQ ID NO: 21331 - DNA, 75 bp, Artificial Sequence
  Synthetic
acaaaaagggtggagcttggtgagtcttctgatgatagacagggaatcacaaacaaggaacacaagaacaaagat

SEQ ID NO: 21332 - DNA, 75 bp, Artificial Sequence
  Synthetic
cttggcacaaggagacaaccaggttttgtgtcctacctatatgctgtcttccgggctaacacaggaaggactctt

SEQ ID NO: 21333 - DNA, 75 bp, Artificial Sequence
  Synthetic
gtatgagttggacagcatatcaagaaatgctctgtctatctatagggccatagaggacggagcatccaaactggg

SEQ ID NO: 21334 - DNA, 75 bp, Artificial Sequence
  Synthetic
gctgattatcaaaaaggaggaaacaatgtgtagttatgactttctcatctatgggaagacacctctatttagagg

SEQ ID NO: 21335 - DNA, 75 bp, Artificial Sequence
  Synthetic
aaacatattagtcccggaatccaaacggtgggcaagggtgtcttgcatttctaatgaccagattgtaaatctagc

SEQ ID NO: 21336 - DNA, 75 bp, Artificial Sequence
  Synthetic
caacatcatgtccactgtatcaaccaatgcccttacagtggcgcagcattctcaatccctaataaagcccatgag

SEQ ID NO: 21337 - DNA, 75 bp, Artificial Sequence
  Synthetic
agattttctgctcatgtctgtacaagctgtgttccattatttacttttcagtcctatcctcaaagatcgagttta

SEQ ID NO: 21338 - DNA, 75 bp, Artificial Sequence
  Synthetic
taaaatcctaagtgcagacggggatgagttcttgctggccatgtcaaggattatttatcttgatccgtctctagg

SEQ ID NO: 21339 - DNA, 75 bp, Artificial Sequence
  Synthetic
aggggtgtctggaatgtccctgggtcgtttccatatccgtcaattctcagatcctgtatcagaagggttgtcttt

SEQ ID NO: 21340 - DNA, 75 bp, Artificial Sequence
  Synthetic
ttggaaggagatttggtcgagctcatcagagccatggattcagtccctgtgtcaagaagcaggaaatccagatct

SEQ ID NO: 21341 - DNA, 75 bp, Artificial Sequence
  Synthetic
gggagatagaagtctggaaagtttcacccgtctacttgaggaccccaccaccttgaatataagaggaggggctag

SEQ ID NO: 21342 - DNA, 75 bp, Artificial Sequence
  Synthetic
tccgaccatccttttaaaggaggccataaggaaggccttgtatgacgaggttgacaaggtcgagaactctgagtt

SEQ ID NO: 21343 - DNA, 75 bp, Artificial Sequence
  Synthetic
tagggaggctatcttactttcgaagactcatagagacaattttatactgttcttgaagtcagtagaacctctgtt

SEQ ID NO: 21344 - DNA, 75 bp, Artificial Sequence
  Synthetic
tcccaggttcctcagtgagctcttcagttcttcttttcttgggataccagagtcaatcatagggttgattcagaa

SEQ ID NO: 21345 - DNA, 75 bp, Artificial Sequence
  Synthetic
ctccaggacaatcaggcgacagttccgcagaagtttatcccggactttagaggagtctttcttcaactcagaggt

SEQ ID NO: 21346 - DNA, 75 bp, Artificial Sequence
  Synthetic
ccatgggatcaacagaatgacacagattcctcaaaggatagggcgggtatgggactgctctgcagagagagccga

SEQ ID NO: 21347 - DNA, 75 bp, Artificial Sequence
  Synthetic
ccaactaagagagatttcttggggtcggaaggttgtgggcaccaccgttccccatcccgctgagatgttagctct

SEQ ID NO: 21348 - DNA, 75 bp, Artificial Sequence
  Synthetic
attgccgaagtcatcaatctcttgcacctgtggacagaccggagagaacagtcctaggatatctgtttccgtctt

SEQ ID NO: 21349 - DNA, 75 bp, Artificial Sequence
  Synthetic
gccgtcgtttgatcagtcattcttctcaagaggtcctttgaaggggtatttaggatcctctacctctatgtcaac

SEQ ID NO: 21350 - DNA, 75 bp, Artificial Sequence
  Synthetic
ccaactgttccatgcttgggagaaagtgaccaatgtccatgtagtcaaacgagcattgtcactcaaagaatctat

SEQ ID NO: 21351 - DNA, 75 bp, Artificial Sequence
  Synthetic
caactggttcatagttagagactcaaacctagcccaaaccttgatcaaaaatataatttctctgacaggaccctc

SEQ ID NO: 21352 - DNA, 75 bp, Artificial Sequence
  Synthetic
ttttcccctagaagagacaccagtgtttaagcggactggctcggctcttcatagattcaagtctgccagatatag

SEQ ID NO: 21353 - DNA, 75 bp, Artificial Sequence
  Synthetic
tgagggaggttactcctcaatctgccccaacctgctctctcacatctctgtaagtactgacacgatgtccgatct

SEQ ID NO: 21354 - DNA, 75 bp, Artificial Sequence
  Synthetic
gacacaggacggaaccaatttcgacttcatgttccagcccctcatgctctatgcccagacttggacttcggagtt

SEQ ID NO: 21355 - DNA, 75 bp, Artificial Sequence
  Synthetic
ggtacaaaaggatgaccggttgaaagattccaccttccactggcatctcaggtgtccaaaatgtattcgacctat

SEQ ID NO: 21356 - DNA, 75 bp, Artificial Sequence
  Synthetic
agatgacatcaatctagaggctcctcaggtcttcatgtttccagatgtttctaaaaggatatccaggatggtatc

SEQ ID NO: 21357 - DNA, 75 bp, Artificial Sequence
  Synthetic
aggggctgtgcctcacttccaaaaacttccagagataaatttgaagccgggcaagtttgaactcctgagtggtaa

SEQ ID NO: 21358 - DNA, 75 bp, Artificial Sequence
  Synthetic
ggacaaatctcgacatattgggactgcccaaggattgttgtactcagttctggttgccactcatgattccggata

SEQ ID NO: 21359 - DNA, 75 bp, Artificial Sequence
  Synthetic
caacgacgggaccatatttccagtaaatatatatgggagagtttctcccagggattatctaagggggttggccag

SEQ ID NO: 21360 - DNA, 75 bp, Artificial Sequence
  Synthetic
gggtgttctaataggatcatccatctgcttcttgaccagaatgaccaatataaacatcaaccgtcccctggaact

SEQ ID NO: 21361 - DNA, 75 bp, Artificial Sequence
  Synthetic
gatatccggagttatctcttatatattactgaggctcgataatcacccttctctatatgtcatgcttaaggagcc

SEQ ID NO: 21362 - DNA, 75 bp, Artificial Sequence
  Synthetic
ttctctcagatccgagatcttttcaatccctcagaagatacctgcagcttacccgaccacgatgaaagagggtaa

SEQ ID NO: 21363 - DNA, 75 bp, Artificial Sequence
  Synthetic
cagatctgttctgtgttatttgcaacatgtgcttcgttatgagagagatgcaataacggcatctccagacaatga

SEQ ID NO: 21364 - DNA, 75 bp, Artificial Sequence
  Synthetic
ctggctttggatattctctgacttcagaagcaccaagatgacctatttgacgttggtgacttatcagtcacacat

SEQ ID NO: 21365 - DNA, 75 bp, Artificial Sequence
  Synthetic
tctgctacaaaagattgagaaaaacctatcgaagcagatgagaatcagactgagacaactcagctccttgatgag

SEQ ID NO: 21366 - DNA, 75 bp, Artificial Sequence
  Synthetic
aagggtcttaggaggccacggggaagagactttggactctgaggaagatattcagggacttctaagggatgctct

SEQ ID NO: 21367 - DNA, 75 bp, Artificial Sequence
  Synthetic
ccaaagaacacgatgggtggatcaagaagtccgccatgctgctaaaaccatgtctggagatcacagccccagcaa

SEQ ID NO: 21368 - DNA, 75 bp, Artificial Sequence
  Synthetic
gaggatatctaggaaggctggatgctcggagtggatctgctctgcccaacaagtggctatttctacttcatccaa

SEQ ID NO: 21369 - DNA, 75 bp, Artificial Sequence
  Synthetic
cccagctccgacctcggaacttgatgtgagggcattatcccgaagatttcagaatcctttgatatccgggctaag

SEQ ID NO: 21370 - DNA, 75 bp, Artificial Sequence
  Synthetic
agttgtccagtgggctactggtgctcattacaagttgaaaccaatattggatgacattgatgtttatccagctct

SEQ ID NO: 21371 - DNA, 75 bp, Artificial Sequence
  Synthetic
ttgcctagttgtaggggacggctctggagggatttcaagagttgtattgagtatgtttccggatgccaagctggt

SEQ ID NO: 21372 - DNA, 75 bp, Artificial Sequence
  Synthetic
cttcaacagccttttggaagtgagtgacctcatggcatctgggacccaccctctgcccccttcagctatcgtgag

SEQ ID NO: 21373 - DNA, 75 bp, Artificial Sequence
  Synthetic
cggaggcgacgatattgtgtcgcgggtgatagattttgactcaatctgggagaaaccgtcagacctaagaaaccc

SEQ ID NO: 21374 - DNA, 75 bp, Artificial Sequence
  Synthetic
atctacttggaagtattttcaaacggtccaatgcagccacaacatgtcttacgaactgattatttgcgatgcaga

SEQ ID NO: 21375 - DNA, 75 bp, Artificial Sequence
  Synthetic
ggtgaccgatataccttcggtgaataagataactctactgatgtctgattttgccctttctatcaatgggcctct

SEQ ID NO: 21376 - DNA, 75 bp, Artificial Sequence
  Synthetic
cactttagtattcaaaacttacgggaccatgctggtgaatcctgattacaaggcaatccagcatttgtcgagagc

SEQ ID NO: 21377 - DNA, 75 bp, Artificial Sequence
  Synthetic
attcccttcagtgacgggttatataactcaaatgacgtcatccttttcctctgagctgtacttaaagttctcgaa

SEQ ID NO: 21378 - DNA, 75 bp, Artificial Sequence
  Synthetic
aagaggcaagttcttcagggatgcagagtatttaacatcctccaccttgagggagatgagcctggtgctctttaa

SEQ ID NO: 21379 - DNA, 75 bp, Artificial Sequence
  Synthetic
ctgcagcagccccaagagtgagatgcaaagggctcgatccttgaattatcaagaccttgtgagaggattcccaga

SEQ ID NO: 21380 - DNA, 75 bp, Artificial Sequence
  Synthetic
ggagatcatctcaaacccttacaacgaaatgatcataactctgatagacagtgaggtcgagtcctttcttgttca

SEQ ID NO: 21381 - DNA, 75 bp, Artificial Sequence
  Synthetic
caagatggtcgacgatttggagttgcaaagaggagcactctctaaaatatccattgttattgccatcatgatggt

SEQ ID NO: 21382 - DNA, 75 bp, Artificial Sequence
  Synthetic
gttctccaacagagttttcaatgtgtctaagccactgaacgaccctaaattttaccccccctctgatcccaaaat

SEQ ID NO: 21383 - DNA, 75 bp, Artificial Sequence
  Synthetic
cttgaggcatttcaacatttgctgtagcactttaatgtatttatcaactgctatgggggatgttctgagcttcgc

SEQ ID NO: 21384 - DNA, 75 bp, Artificial Sequence
  Synthetic
gagactccacgaactgtacaatggtcctataacgtattacttcaagaagcaaataattggagggagtatatatct

SEQ ID NO: 21385 - DNA, 75 bp, Artificial Sequence
  Synthetic
gtcctggagttggtcagacaactcttctatattcaagagggtagcttgcaattcaaatttaagcttatcatccca

SEQ ID NO: 21386 - DNA, 75 bp, Artificial Sequence
  Synthetic
ttggataagactgatctacaagatagtcagaacaactcgctttgtgggaagtgctaaagatctatctaaggaggt

SEQ ID NO: 21387 - DNA, 75 bp, Artificial Sequence
  Synthetic
tgaaagacacttgagaggatataacagatggatcaatttcaatgacataagatcacggtcatctttgttagatta

SEQ ID NO: 21388 - DNA, 75 bp, Artificial Sequence
  Synthetic
cagttgcttgtgagaagggctattcgagggctattctaattcgcttcatgacaatcagtaaaacatgaaaaaaac

SEQ ID NO: 21389 - DNA, 75 bp, Artificial Sequence
  Synthetic
aaaaaacggactttaaaaccagatctcctgttgtcttggcaggtttttcttcttattgttttttttgttaagcgt

SEQ ID NO: 21390 - DNA, 75 bp, Artificial Sequence
  Synthetic
agtatatcttccgcgtgaagatttggaaaccgatttttcaaaacgagtttattaacgcggtgagataggttgttt

SEQ ID NO: 21391 - DNA, 75 bp, Artificial Sequence
  Synthetic
agacaaaacaaggagtagaaactttccgaatgtctaaaaaaccaggaaggtccggcaatagccggatcgtcagta

SEQ ID NO: 21392 - DNA, 75 bp, Artificial Sequence
  Synthetic
tgttgaaacgcgggccgtcccgtgttccgaatccagtggatttggtaaagaggacggttggaaaactgatcaatg

SEQ ID NO: 21393 - DNA, 75 bp, Artificial Sequence
  Synthetic
gcgttggtccgcttagacttgtcttagccatgctaacgttcttcagattttccgccttaaaaccaacagcaggac

SEQ ID NO: 21394 - DNA, 75 bp, Artificial Sequence
  Synthetic
tggtcaaacgatggacaaagatgaaaccggcccctgctgtaaaaattttgcaaaacttcaggaaacaacttggct

SEQ ID NO: 21395 - DNA, 75 bp, Artificial Sequence
  Synthetic
cgatgatccagaccctttcaaacaggaagaagaaacgtggactgcacggactaggactgctagttctggtgccca

SEQ ID NO: 21396 - DNA, 75 bp, Artificial Sequence
  Synthetic
tcacattgtgtttccaaaccggaaactataatgggaaggtgatgatcacggtggacaagcatgaggtcggcgttc

SEQ ID NO: 21397 - DNA, 75 bp, Artificial Sequence
  Synthetic
catttgttatccctcagcatggtgtcaaaaacacctgcgtggtgaaagctctggatgtcggataccaatgtgaca

SEQ ID NO: 21398 - DNA, 75 bp, Artificial Sequence
  Synthetic
acagcgtgacatatgaatgtccagtcctggaatcccagtatgatcctgaagatattgattgctggtgcagccaca

SEQ ID NO: 21399 - DNA, 75 bp, Artificial Sequence
  Synthetic
agccgatttacatcaactatggcagatgcctaaaaggaagagagaaccgcagatcaaaaagggagacccacctac

SEQ ID NO: 21400 - DNA, 75 bp, Artificial Sequence
  Synthetic
cccaacattcagaggcgacgttgacgtcgagaaaagaaacatggctggaaggacagaatgtgatgaaatacatga

SEQ ID NO: 21401 - DNA, 75 bp, Artificial Sequence
  Synthetic
tgagagtagaaagctgggctctgaggaacccagggttcgccctggttgcctgtgtgattggatggtccttgggat

SEQ ID NO: 21402 - DNA, 75 bp, Artificial Sequence
  Synthetic
ccaccacaagccaaaaaatcatttacatcatgctgctactgatggtggcaccggcgtacagcctaagatgcattg

SEQ ID NO: 21403 - DNA, 75 bp, Artificial Sequence
  Synthetic
gggttgaaaatcgagacttcattgaaggcatttccggtggcacatgggtcgacctcgtgctggagcatggagggt

SEQ ID NO: 21404 - DNA, 75 bp, Artificial Sequence
  Synthetic
gcgtcaccgtcagagctgaagggaaacccactctggacattgaactcacgaactcatttgctacaggaatggcag

SEQ ID NO: 21405 - DNA, 75 bp, Artificial Sequence
  Synthetic
aaacgagaaagtactgttatgaatgtgaggtgtcaaagataaccacagtcaatcactgcccccaaatgggggaag

SEQ ID NO: 21406 - DNA, 75 bp, Artificial Sequence
  Synthetic
ctcacaactcagcatcctcagacccaaagcaagtttgcaagaaagggtacagtgacagaggatggaacaacgggt

SEQ ID NO: 21407 - DNA, 75 bp, Artificial Sequence
  Synthetic
gcggtctctttggaaaaggaagcttggagacctgcgcagaattcgcctgcaagaaagaagctccagggcatgtca

SEQ ID NO: 21408 - DNA, 75 bp, Artificial Sequence
  Synthetic
tacggaaagagaatctggaatacaacgtgatggtcgcagtccatggcagtgtcccaagtgagaatgctggaaatg

SEQ ID NO: 21409 - DNA, 75 bp, Artificial Sequence
  Synthetic
acacatcgcacgctgtgaagttgtcattcacaacagcgtccccagtcgccacagggaaactaggagactttggag

SEQ ID NO: 21410 - DNA, 75 bp, Artificial Sequence
  Synthetic
aggtgtcaatggaatgcgaacctcggtcaggactcgacttcgaacaatattacatgttcacaattgacaaaaaca

SEQ ID NO: 21411 - DNA, 75 bp, Artificial Sequence
  Synthetic
gctggctcgtagacagaagctggttccatgatctcaacctcccatggaaggggggatcagctggtgactggcaga

SEQ ID NO: 21412 - DNA, 75 bp, Artificial Sequence
  Synthetic
acaagcagtccatggttgaatttgcggagccgcatgccacgaaacaagatgtgctggctttgggttcacaagaag

SEQ ID NO: 21413 - DNA, 75 bp, Artificial Sequence
  Synthetic
gagcactgcactcagccttaggaggagccattcctatgaagggcacctccagcaaagtggacataactgcaggac

SEQ ID NO: 21414 - DNA, 75 bp, Artificial Sequence
  Synthetic
acctcaagtgcaggctgaagatggacaagttactgatcaagggcaccacgtatcacatgtgtgccaaagcattca

SEQ ID NO: 21415 - DNA, 75 bp, Artificial Sequence
  Synthetic
ccatgaaaaaagaccccacagacacgggccatggcacggttgttatggaacttacctacaaagggattgatgtcc

SEQ ID NO: 21416 - DNA, 75 bp, Artificial Sequence
  Synthetic
cgtgcagggttcccatcaccattgcgcgatcgcccaacgacggggaaatggtcggaagaatggtgtcggttaacc

SEQ ID NO: 21417 - DNA, 75 bp, Artificial Sequence
  Synthetic
ccctcgccatgacaacgtcatcagtcttcatggttgaggttgaacctccatacggagatagtaacatcattgttg

SEQ ID NO: 21418 - DNA, 75 bp, Artificial Sequence
  Synthetic
gaagttatgacaacgtactaaagcaccattggttcaagcctggaagttccatcggaggagcctttaaaaccacct

SEQ ID NO: 21419 - DNA, 75 bp, Artificial Sequence
  Synthetic
ggaagggagtgaagagactgacggttctaggagattctgcttgggacttccgctcagtggggggtgtcatcacct

SEQ ID NO: 21420 - DNA, 75 bp, Artificial Sequence
  Synthetic
cgatgggaaaggctattcatcaggtttttggcgggatcttctcagccattttcggaggcgtgagttggttcacga

SEQ ID NO: 21421 - DNA, 75 bp, Artificial Sequence
  Synthetic
atatcttcattggagccctctgcgtctggctgggaatcagtgctagagatcgctcgatagcattgacgttcctct

SEQ ID NO: 21422 - DNA, 75 bp, Artificial Sequence
  Synthetic
cagttggagctattctgctattcctatctttgggagtaggggccgattctggctgcgggattgacatcgccagga

SEQ ID NO: 21423 - DNA, 75 bp, Artificial Sequence
  Synthetic
tggagctgaaatgtggcagtggaatcttcgtcttcaatgacgtggaaacctggactgaacagtaccagtaccatc

SEQ ID NO: 21424 - DNA, 75 bp, Artificial Sequence
  Synthetic
cctcaacaccgggagcactggctgctgcaatccagaaaggatacaaagagggaatctgcggagcgagaagcacaa

SEQ ID NO: 21425 - DNA, 75 bp, Artificial Sequence
  Synthetic
cccggcttgaacacaagatgtgggagcaagtggcgaatgaaatcaacgccgtcttcgaaagcaatgacataaatt

SEQ ID NO: 21426 - DNA, 75 bp, Artificial Sequence
  Synthetic
tgtcagtggtagtgaaagctgaggtcaaccccaaagtgcgagggaagaaacgactaaaaccagcagactcggctc

SEQ ID NO: 21427 - DNA, 75 bp, Artificial Sequence
  Synthetic
tgcccataggatggaaatcgtgggggaaaaaacacatcttgactgtcgagctgtccaacaacacattcatcgtgg

SEQ ID NO: 21428 - DNA, 75 bp, Artificial Sequence
  Synthetic
atggagcggaaaagaaggaatgctctgactcgaacagaacttggaacaccttccaagtagaggacttcgggtttg

SEQ ID NO: 21429 - DNA, 75 bp, Artificial Sequence
  Synthetic
gagtgacaaaaacacaggtattccttgacgtcagagaggacaacactgatgagtgcgacactgctgtgatagggt

SEQ ID NO: 21430 - DNA, 75 bp, Artificial Sequence
  Synthetic
cagcaatcaaaggtgaaagagcggtgcacagtgacatgggatactggattgaaagtggaaacagtgacacatggc

SEQ ID NO: 21431 - DNA, 75 bp, Artificial Sequence
  Synthetic
gtctagagagggcttttctgatcgagacaaaaacatgtgaatggccgaacactcacacgctgtggagcgacgggg

SEQ ID NO: 21432 - DNA, 75 bp, Artificial Sequence
  Synthetic
tggaagacagcaaacttatcattccaagatctctagctggaccccgttcacatcacaacacaagaaaaggctatg

SEQ ID NO: 21433 - DNA, 75 bp, Artificial Sequence
  Synthetic
caacacagataaaaggcccatggaaccacgttcctctggagatcaagtttgagaattgcccaggcacaactgtca

SEQ ID NO: 21434 - DNA, 75 bp, Artificial Sequence
  Synthetic
ctattgatagaaactgtggtgacagaggagcctcagccgggtcaaccacggctagtggcaagacaatacctgatt

SEQ ID NO: 21435 - DNA, 75 bp, Artificial Sequence
  Synthetic
ggtgctgcaggtcatgcactcttcctcctttgtcttatcacactagtgatggatgctggtacggaatggagatca

SEQ ID NO: 21436 - DNA, 75 bp, Artificial Sequence
  Synthetic
gacccaaagaccggaaaaagaggatgtgcttggtcaagtcaaaagtctcagccggaaaggggagcccccctgact

SEQ ID NO: 21437 - DNA, 75 bp, Artificial Sequence
  Synthetic
cgttttcgctcgggcttcttgtatccatgatcatggtacaggaagggttgagaaagcgatggggagccagacact

SEQ ID NO: 21438 - DNA, 75 bp, Artificial Sequence
  Synthetic
tcttgacggccggagcattcctacttgcggcaatgatattgggagagatatcatatcttgatctggcacactact

SEQ ID NO: 21439 - DNA, 75 bp, Artificial Sequence
  Synthetic
ttgtaatgcttgaagcaacgttcacacaaatcaacgatggaggggacgttctgcaccttgctttggtggccgtgt

SEQ ID NO: 21440 - DNA, 75 bp, Artificial Sequence
  Synthetic
tcaaagttcagccagcattcttggttggatttctggtcaggaatgcgtggactccacgagagtccgtgctactgg

SEQ ID NO: 21441 - DNA, 75 bp, Artificial Sequence
  Synthetic
ccttgggtgccacactcatccagttgacatcaggcaacatccctacagatgtaatgatggtactcaacactttgg

SEQ ID NO: 21442 - DNA, 75 bp, Artificial Sequence
  Synthetic
caacagcttggttgggactacgagcgctggtggtgggcactaccccatcagtgattcttccgatcttggctgtca

SEQ ID NO: 21443 - DNA, 75 bp, Artificial Sequence
  Synthetic
tggccccagcattgccaatatcaccactaggagcataccaggccatggtagcccaccttttggttctgaccctga

SEQ ID NO: 21444 - DNA, 75 bp, Artificial Sequence
  Synthetic
tgatgagcaccaagagaacatctctgaagaagcatggacctcccttgctagcgttgattggcaccttcacaggtt

SEQ ID NO: 21445 - DNA, 75 bp, Artificial Sequence
  Synthetic
ggttcaatccactgtcatgtgcgacaatcgacatgatggtgagcaacttaaaaaagaggagctggccggctagtg

SEQ ID NO: 21446 - DNA, 75 bp, Artificial Sequence
  Synthetic
aggcgatgactgccgtaggggtggtgtgtgccctagttggcggaatagccaacctcggagacactcccttggctg

SEQ ID NO: 21447 - DNA, 75 bp, Artificial Sequence
  Synthetic
gacccatggcagcgtgtggactcctcgtcatggcctacgtggtgagtgggaagagcacagacctctacatcgaga

SEQ ID NO: 21448 - DNA, 75 bp, Artificial Sequence
  Synthetic
aagcctgtcaggtcgagtggagccacgaggcagaagtgactggatccagtccccgactggatgtggccattgatg

SEQ ID NO: 21449 - DNA, 75 bp, Artificial Sequence
  Synthetic
aaaatggagacatctcgctgatagaaggagaatacaactctatggagcaaacactggtctatgttgggctactcg

SEQ ID NO: 21450 - DNA, 75 bp, Artificial Sequence
  Synthetic
ccctagtagggttttttccattggctatcccctttgctgctgccggatggtacttgtacctgaaaagtggtagga

SEQ ID NO: 21451 - DNA, 75 bp, Artificial Sequence
  Synthetic
gagctggggccttatgggacattccatcgccaacagtgaagaagcctgcctctaccgaaccgggcgtttaccgaa

SEQ ID NO: 21452 - DNA, 75 bp, Artificial Sequence
  Synthetic
tcatggctgccagactcatcgggtcatcacaaattggagtgggtgtcatgtacgagggggtgttccacaccatgt

SEQ ID NO: 21453 - DNA, 75 bp, Artificial Sequence
  Synthetic
ggcacgtcacaagaggagccgccctacgttgtggggcgggccgtcttgatccaacatggggtgacgtaaaaggag

SEQ ID NO: 21454 - DNA, 75 bp, Artificial Sequence
  Synthetic
atgtcatttcatacggaggaccatggaagttaacagagaaatgggatggaaccagtgaagtacagctggtagcag

SEQ ID NO: 21455 - DNA, 75 bp, Artificial Sequence
  Synthetic
tggcaccaggaaaacggagccaaaatgtgcaaattacaccagggattttcaatacaacaaaaggtccagtggggg

SEQ ID NO: 21456 - DNA, 75 bp, Artificial Sequence
  Synthetic
cagtgattcttgactacccaccagggacttcaggctctcccatcatcaacaaagatggaaagaccatcgggctct

SEQ ID NO: 21457 - DNA, 75 bp, Artificial Sequence
  Synthetic
atggcaacggagtcgtactggccggaggtacttatgttagtatgataacacagccggaagcaccaaccccagaag

SEQ ID NO: 21458 - DNA, 75 bp, Artificial Sequence
  Synthetic
ctcctgactgcataacagacaacatgttcaagaagaaacaattaattgtcctagacccacatccaggagcaggga

SEQ ID NO: 21459 - DNA, 75 bp, Artificial Sequence
  Synthetic
agaccagaaaggtcctgccagaattcatcagacaagcagttgaaagacgattgtggactttggcgttggctccca

SEQ ID NO: 21460 - DNA, 75 bp, Artificial Sequence
  Synthetic
ctagagtggtggctgccgaaatggccgaggctttaaatggactaccagtcagatatctgacgccagcagtgattc

SEQ ID NO: 21461 - DNA, 75 bp, Artificial Sequence
  Synthetic
aacaacacacagggaaagagatcgtggacctcatgtgccacgccacgttcaccatgaggctcttgtcgggagggc

SEQ ID NO: 21462 - DNA, 75 bp, Artificial Sequence
  Synthetic
gtgttccaaactacaacatgttcataatggatgaggctcacttcactgatcccagcagcattgctgccagaggct

SEQ ID NO: 21463 - DNA, 75 bp, Artificial Sequence
  Synthetic
acatctccacgaaagtggacatgggagaagcttcggctgtcttcatgacggccacgccccccggcagccgggaac

SEQ ID NO: 21464 - DNA, 75 bp, Artificial Sequence
  Synthetic
cattcccagattccaatgctccaatcattgatgaaccgatgaccgtgccagacaaagcatggagcacagggtatg

SEQ ID NO: 21465 - DNA, 75 bp, Artificial Sequence
  Synthetic
agtgggtcacagactttgagggaaaaacagtttggtttgttcctagcatccgaaatgggcaggaaattgccaact

SEQ ID NO: 21466 - DNA, 75 bp, Artificial Sequence
  Synthetic
gtttgatgaaagctggcaagaaagtcatccagctcaacagaaaaaccttcgactctgagtacaaaaagaccaaac

SEQ ID NO: 21467 - DNA, 75 bp, Artificial Sequence
  Synthetic
aggacgactgggatttcgtcatcacaactgacatttcagagatgggggccaattttcaagcaacaagggtcattg

SEQ ID NO: 21468 - DNA, 75 bp, Artificial Sequence
  Synthetic
attgccgaaagtcaatcaaaccagtggtcatcacagacggggaagagagaatcgtcatgaatggaccagccctca

SEQ ID NO: 21469 - DNA, 75 bp, Artificial Sequence
  Synthetic
taacttcagccagtgcggctcaaaggagaggaagagtgggccgtaatcccaaccaaccgggagacatgtacttgt

SEQ ID NO: 21470 - DNA, 75 bp, Artificial Sequence
  Synthetic
acggtggtggagtggatgactcagacacaaataacgtgtgctggacggaagcaagaatgcttctggacaacatca

SEQ ID NO: 21471 - DNA, 75 bp, Artificial Sequence
  Synthetic
acatccccggaggactggtggcaactttttaccttccagagagagacaagtcagcagcgatagacggagaataca

SEQ ID NO: 21472 - DNA, 75 bp, Artificial Sequence
  Synthetic
gactcagagagacaaacaggaaactgttcacagaatatctcaaggcagacttgccagtctggctagcctatcagg

SEQ ID NO: 21473 - DNA, 75 bp, Artificial Sequence
  Synthetic
tagccctgcatggaaacgcctatcaagacagaagttggtgtttcatgggatcgactcagaacgtggtgctcgaag

SEQ ID NO: 21474 - DNA, 75 bp, Artificial Sequence
  Synthetic
acggaaacccagtggagatatggacaagagctggggaacggaagactctaaagccaaaatggagtgatgccagaa

SEQ ID NO: 21475 - DNA, 75 bp, Artificial Sequence
  Synthetic
tgttctcagaccatctgtccttgaaagcattcaaagagttcgcctcaggaaggcgttcaggagtgccgagcatct

SEQ ID NO: 21476 - DNA, 75 bp, Artificial Sequence
  Synthetic
tggatgtggtaggaatgctcccaagacacttctctgaaaaggggacagacgccttggacaatctgaagattctaa

SEQ ID NO: 21477 - DNA, 75 bp, Artificial Sequence
  Synthetic
tgacaagtgacccaaatggaagagcgtatcgccatgcggtttcggaactgccggagacactggaaacgatcttac

SEQ ID NO: 21478 - DNA, 75 bp, Artificial Sequence
  Synthetic
tcatctcaatgttgacagtggcctctctcagtgtcttcttgcttctcatgaggcagaaaggcattggaaagatgg

SEQ ID NO: 21479 - DNA, 75 bp, Artificial Sequence
  Synthetic
ggctgggcttcattgtgttggtcgccactggtggcttgctgatgatggctgacgtggctcctgcaaagatcgctg

SEQ ID NO: 21480 - DNA, 75 bp, Artificial Sequence
  Synthetic
gagttattatcctagtgttccttttgatggtcgtgctgattcccgagcccgaaaaacagagaaccatccaggaca

SEQ ID NO: 21481 - DNA, 75 bp, Artificial Sequence
  Synthetic
accagctcgctatcatcgtgcttctggtgttaagcctggggctcgctgttgcagccaatgagatggggtatctgg

SEQ ID NO: 21482 - DNA, 75 bp, Artificial Sequence
  Synthetic
aaaagacaaaaaatgacatcataagtctttggggacggtcaagagagcagaattccaccctgcaggaatggttca

SEQ ID NO: 21483 - DNA, 75 bp, Artificial Sequence
  Synthetic
taatggacattaagccagccacagcatggacactctacgctgtcaccaccaccattctaactccgttcatccaac

SEQ ID NO: 21484 - DNA, 75 bp, Artificial Sequence
  Synthetic
accacatcaccacacactatgccaatgtttcactatcagccatagcggctcaagcaggaaatctcttcatgatga

SEQ ID NO: 21485 - DNA, 75 bp, Artificial Sequence
  Synthetic
aaaatggtcatccattcacgcaattggactgggcggttccattgttggcattggggtgttggagcacgatgactc

SEQ ID NO: 21486 - DNA, 75 bp, Artificial Sequence
  Synthetic
cactggctctagtagcggcaacactgcttctgctggtgcactacgcgtacatgattccagggtggcaggccatgg

SEQ ID NO: 21487 - DNA, 75 bp, Artificial Sequence
  Synthetic
gggcacgttctgcccaggcacgcacagctgcagggatcatgaaaaatccagtagtagacggagtcacagtgacag

SEQ ID NO: 21488 - DNA, 75 bp, Artificial Sequence
  Synthetic
acatccctgagctggaagtcccagatcccgccattgagaagaagcttggccaggtcctgctaataagcatagccc

SEQ ID NO: 21489 - DNA, 75 bp, Artificial Sequence
  Synthetic
tggcagcggccttcatgcgacaagacattataggatggagagaatgcgggatactggcttcagcaggcattggca

SEQ ID NO: 21490 - DNA, 75 bp, Artificial Sequence
  Synthetic
cgctgtgggaaggaactccaagcaagttctggaacgcttcaattgccagttcactctgcaacatcattagaggaa

SEQ ID NO: 21491 - DNA, 75 bp, Artificial Sequence
  Synthetic
gtcacttagcggccctcccattcctgttcactttgattaggaacatgacaaaaccaaataagagaggaggagctg

SEQ ID NO: 21492 - DNA, 75 bp, Artificial Sequence
  Synthetic
acggagaaactctaggtgacaaatggaaagcccgcctgaatgccatggaaaaaaccactttttcaaagtacaagg

SEQ ID NO: 21493 - DNA, 75 bp, Artificial Sequence
  Synthetic
tctcgggaataacagaagttgacagagaacccgcaaggaaagccctcagggaaggcaacctccactcggggcacg

SEQ ID NO: 21494 - DNA, 75 bp, Artificial Sequence
  Synthetic
cagtgtcaagagggacggcaaaactccgctggatggtggaaagaggaatggtaaacccccagggaaaggtgatag

SEQ ID NO: 21495 - DNA, 75 bp, Artificial Sequence
  Synthetic
acctcggatgtggcagaggcggatggagctactacgcggctacactgcccagggtgatggaagtcaaaggctaca

SEQ ID NO: 21496 - DNA, 75 bp, Artificial Sequence
  Synthetic
caaaaggggggctaggccacgaagaacccaggatggtccagtcgtacggctggaacctcgtaaccttaaaaagcg

SEQ ID NO: 21497 - DNA, 75 bp, Artificial Sequence
  Synthetic
gagtggatgtgcacatgaaagccgtggagagaacgaacaccctgttctgtgacataggagaatcgtcggcaagcc

SEQ ID NO: 21498 - DNA, 75 bp, Artificial Sequence
  Synthetic
cggaggttgaagagagcagaaccctcaaagtgctggaacttgtggagcattggatggccgtcggagttgacgctt

SEQ ID NO: 21499 - DNA, 75 bp, Artificial Sequence
  Synthetic
tcgccgtcaaggtgctgtgcccatacagacccaaggtcatcgaaaagctcgagggattacaaagacggtttggag

SEQ ID NO: 21500 - DNA, 75 bp, Artificial Sequence
  Synthetic
gaggtctggtcaggatcccactgtcaagaaacagcacccacgaaatgtactgggtggatggagtgaagacgaaca

SEQ ID NO: 21501 - DNA, 75 bp, Artificial Sequence
  Synthetic
tagtgggggctgtgaacaccaccagcaaacttttgctatctagaatggacaagaggttcactggaccaaagtttg

SEQ ID NO: 21502 - DNA, 75 bp, Artificial Sequence
  Synthetic
aagaagacgccaatctttcatcaggaacgagggctgccactcttaaaaggaaggctgccgacatggaaaagatcg

SEQ ID NO: 21503 - DNA, 75 bp, Artificial Sequence
  Synthetic
ctggcaggataaagagactcaaagaggagcattcttcaagttggttcgtggacccgaacaatctataccggacct

SEQ ID NO: 21504 - DNA, 75 bp, Artificial Sequence
  Synthetic
ggaaataccatggtagttatgagaccaagccaacaggatcagcttcatcaatggtcaacgcggtggtaaaactaa

SEQ ID NO: 21505 - DNA, 75 bp, Artificial Sequence
  Synthetic
tgtcaaagccctgggatgtgatatcaacagtgacacaaatgtccatgacagacaccacaccgtttggacaacaaa

SEQ ID NO: 21506 - DNA, 75 bp, Artificial Sequence
  Synthetic
gggtgttcaaggaaaaagttgacaccaaagctccggagcctgagcaaggggcagcagatataatggagacagtgg

SEQ ID NO: 21507 - DNA, 75 bp, Artificial Sequence
  Synthetic
cccgatggtatcggaaggaactctgcaaaagaaagaaaccacgcatctgtaccagggaggagttcatcaagaagg

SEQ ID NO: 21508 - DNA, 75 bp, Artificial Sequence
  Synthetic
tgaacagtcatgcagcccttggctcaatgttcgaagagcagcaactatggagcagtgcaaaggaagccgtggaag

SEQ ID NO: 21509 - DNA, 75 bp, Artificial Sequence
  Synthetic
acccggaattctggaggcaggtggacgaggagagagaaaagcataaaaaaggagaatgcgccacctgcatttaca

SEQ ID NO: 21510 - DNA, 75 bp, Artificial Sequence
  Synthetic
acatgatggggaaaagagaaaagaaactcggagaatttgggaaagccaaaggcagccgggccatctggtacatgt

SEQ ID NO: 21511 - DNA, 75 bp, Artificial Sequence
  Synthetic
ggctgggggctcggttcttggaatttgaagcccttggcttcctcaacgaggaccactggcttagccgtgagaact

SEQ ID NO: 21512 - DNA, 75 bp, Artificial Sequence
  Synthetic
caggggccggggttgaaggcattgggctccagaggctgggatatgtcttgagagacatgggaaaagccggaggga

SEQ ID NO: 21513 - DNA, 75 bp, Artificial Sequence
  Synthetic
gactctacgccgacgacacagcaggctgggacactcttattacagaaaaagacctggacaatgaaatgatcatca

SEQ ID NO: 21514 - DNA, 75 bp, Artificial Sequence
  Synthetic
tggagcacatggaaccacaacacaggaaattggcttcagcaatcttcaacctgacctaccggcacaaggtggtga

SEQ ID NO: 21515 - DNA, 75 bp, Artificial Sequence
  Synthetic
aggtcatgagacctggcccaaatgggaagacatacatggatgtcatttccagagaagaccaaagaggcagcggac

SEQ ID NO: 21516 - DNA, 75 bp, Artificial Sequence
  Synthetic
aggtggtgacctatgcactgaacacttttacaaatgcagtggtccaactggtacggagcgcagaggctgaaggag

SEQ ID NO: 21517 - DNA, 75 bp, Artificial Sequence
  Synthetic
tgatatcgtccttctcaatcgaggaagtctcagaccgagtcctggaagaactaactaggtggctggaagagtttg

SEQ ID NO: 21518 - DNA, 75 bp, Artificial Sequence
  Synthetic
ggtgggacaggctgaggctcatggccatcagtggagacgattgcgtggtgcgagcttgcgatgagagatttgcca

SEQ ID NO: 21519 - DNA, 75 bp, Artificial Sequence
  Synthetic
ctgcactccattttctcaacgccatgtcaaaggtgagaaaggacattcccgaatggaaaccatcaacagggtgga

SEQ ID NO: 21520 - DNA, 75 bp, Artificial Sequence
  Synthetic
gtgactggcaacaggttccattctgttcacaccacttcgtggaaatcagaatgaaggatggcagagagttggtcg

SEQ ID NO: 21521 - DNA, 75 bp, Artificial Sequence
  Synthetic
tgccctgcagacaccaagacgaactggtaggaagggctagagtgtcaccaggtgccacatggaccatccgagagt

SEQ ID NO: 21522 - DNA, 75 bp, Artificial Sequence
  Synthetic
ctgcctgcatggccaaagcctatgcccagatgtggatgttaatgtatttccataggagagatctccgcatcatgg

SEQ ID NO: 21523 - DNA, 75 bp, Artificial Sequence
  Synthetic
ccaatgccatctgctcggccgtcccggttgactgggttccgactggaagaacgacatggtcaattcacggaaaag

SEQ ID NO: 21524 - DNA, 75 bp, Artificial Sequence
  Synthetic
gagaatggatgaccactgaggacatgctggacgtgtggaacagggtgtggatagaagagaatccccacatggagg

SEQ ID NO: 21525 - DNA, 75 bp, Artificial Sequence
  Synthetic
acaaaaccccggtgagagactggaaggaagtgccctacattggaaaacgggaggaccaatggtgcggaagcctta

SEQ ID NO: 21526 - DNA, 75 bp, Artificial Sequence
  Synthetic
ttggttaccgacccagggcgacttgggctgagaacatctgggtggctgtccaccaagtcagaagcatgatcggaa

SEQ ID NO: 21527 - DNA, 75 bp, Artificial Sequence
  Synthetic
aggaaaaatacgctgactatctcaaagcccaagggagatacagaaaagaggagactgaagggtttacaggtgttc

SEQ ID NO: 21528 - DNA, 75 bp, Artificial Sequence
  Synthetic
tgtaaactccttttagtctaagaaaaaagaaaagatgtcaggccggaaacgccaccggatggtcgtaaacggtgc

SEQ ID NO: 21529 - DNA, 75 bp, Artificial Sequence
  Synthetic
ggcctgtgacgacccccgggcggaccgggtgaacaaaggacccaggcaggagacgcaaagccctgagggaatcag

SEQ ID NO: 21530 - DNA, 75 bp, Artificial Sequence
  Synthetic
gtccctggcggtcgaaaccctgggtcccccccctggagcggggaaagctccacagtcaggccgaaagccaccaca

SEQ ID NO: 21531 - DNA, 75 bp, Artificial Sequence
  Synthetic
agcggtacagtggtgctgcctgcattaaccgccccaggtggactgggataacaaaggaggaaactccccccacgg

SEQ ID NO: 21532 - DNA, 75 bp, Artificial Sequence
  Synthetic
ccagaatcagagtggcgcgactgaggaagggactagaggttagaggagacccgtggaaacaaaatagaaggaggc

SEQ ID NO: 21533 - DNA, 75 bp, Artificial Sequence
  Synthetic
ccatcctaggctgaagctgtaggcctaggggaaggactagaggtttgaggagacccctctttcgaagaagacgcc

SEQ ID NO: 21534 - DNA, 75 bp, Artificial Sequence
  Synthetic
aaaccttttcacagcaaacatactgacacctgggaaagaccggagagtttgctgctccagactccgtggcactcg

SEQ ID NO: 21535 - DNA, 75 bp, Artificial Sequence
  Synthetic
tttgctgctccagactccgtggcactcggcaccgaacgccgatatggtgccgcgggatctgaaacatcaaactct

SEQ ID NO: 21536 - DNA, 75 bp, Artificial Sequence
  Synthetic
atgtctaaaaaaccaggaagatccggcggaagccggatcgtcagtatgttgaaacgcggtccgtcccgcgttcca

SEQ ID NO: 21537 - DNA, 75 bp, Artificial Sequence
  Synthetic
aatccagtggatttggtgaagaggacggtgggaagactgatgaacggaatcggaccactgcgactagtattggct

SEQ ID NO: 21538 - DNA, 75 bp, Artificial Sequence
  Synthetic
atgatgacgtttttcagattttccgcattaaaaccaaaaacaggaatggttaagagatggatgaaacttcagccc

SEQ ID NO: 21539 - DNA, 75 bp, Artificial Sequence
  Synthetic
gcgcccgccattaagattctacagaacttcaggaaacagatcggatcgatgattcaaaccttgtcgaacagaaag

SEQ ID NO: 21540 - DNA, 75 bp, Artificial Sequence
  Synthetic
aaaaagagaggactcggcggcctgggtgtgttgactctgatcccattggccctttgcctgcaaacaggaacatac

SEQ ID NO: 21541 - DNA, 75 bp, Artificial Sequence
  Synthetic
aatggaaaagtcatggtgactattgacaagcacgaagtaggagttccatttgttgtcccgttgcatggagccaac

SEQ ID NO: 21542 - DNA, 75 bp, Artificial Sequence
  Synthetic
aacacttgcgtggtgaaagctttagacgtagggtaccagtgtgacaatagtgtgacatacgaatgcccagtgttg

SEQ ID NO: 21543 - DNA, 75 bp, Artificial Sequence
  Synthetic
gaggaaaggtatgacccagaggacatcgactgttggtgtagccataaagcgatctacatcaattatggaagatgt

SEQ ID NO: 21544 - DNA, 75 bp, Artificial Sequence
  Synthetic
ttgaaaggacgtgagacgcgccgctcaaaaagagagacacaccttccacagcacactgaagccaccttgacatcg

SEQ ID NO: 21545 - DNA, 75 bp, Artificial Sequence
  Synthetic
cgaaaagaaacgtggttagaggggcaaaacatcatgaagtacctaatgagggtggagagctggacccttagaaac

SEQ ID NO: 21546 - DNA, 75 bp, Artificial Sequence
  Synthetic
ccaggaattgcactggttgcagccatcattgggtggagtctgggaacaaccacgagccagaaagtcatctatgtt

SEQ ID NO: 21547 - DNA, 75 bp, Artificial Sequence
  Synthetic
ctgttgctcttgatggtagctccagcctatggacttcggtgcataggagtggagaacagagacttcattgaaggc

SEQ ID NO: 21548 - DNA, 75 bp, Artificial Sequence
  Synthetic
atcgcaggaggaacctgggtggatctagtactggaacacggcggatgtgtcactgtacgagccgaagggaaaccc

SEQ ID NO: 21549 - DNA, 75 bp, Artificial Sequence
  Synthetic
actctagatatagaactcgtgaactcgtatgctcaaggcatggcagaaacaagaaagtactgctatgaatgcgag

SEQ ID NO: 21550 - DNA, 75 bp, Artificial Sequence
  Synthetic
gtgtcaaaaataacaactgtgaatcattgtcctcagatgggggaagcccataactcagcttcttccgatcccaag

SEQ ID NO: 21551 - DNA, 75 bp, Artificial Sequence
  Synthetic
caggtgtgcaagaaagggtacagcgacaggggctggaataatggttgcgggttatttgggaaaggaagtttggaa

SEQ ID NO: 21552 - DNA, 75 bp, Artificial Sequence
  Synthetic
acatgcgccgaattcacatgtaaaaaacaggctccaggctacatcattaagagagagaatctggaatacaacgtg

SEQ ID NO: 21553 - DNA, 75 bp, Artificial Sequence
  Synthetic
atggtagcggtgcatggaagtgtccctagtgaaaattcaggaaatgacaccacacattcagtaaaactgtcattc

SEQ ID NO: 21554 - DNA, 75 bp, Artificial Sequence
  Synthetic
accactgccgctcctacagctacgggtaagctcggagacttcggcgaagtctcaatggaatgcgagccacgatca

SEQ ID NO: 21555 - DNA, 75 bp, Artificial Sequence
  Synthetic
ggactagattttgaccagtactatatgttcaccatagacaaaaatagttggctcgtggataggagctggttccat

SEQ ID NO: 21556 - DNA, 75 bp, Artificial Sequence
  Synthetic
gacttgaatcttccatggaaagggggttcagttggtgattggcaaaacaaacactccatggtggagttcgctgaa

SEQ ID NO: 21557 - DNA, 75 bp, Artificial Sequence
  Synthetic
cctcatgccacaaaacaagatgtgttagcactgggttcccaagaaggggctttgcattcagccctcggaggagcc

SEQ ID NO: 21558 - DNA, 75 bp, Artificial Sequence
  Synthetic
attcccatgcaaggaacttccagcaaggttgacataacagcaggacacttgaaatgtcgattgaaaatggacaag

SEQ ID NO: 21559 - DNA, 75 bp, Artificial Sequence
  Synthetic
ctaatgatcaaaggcacaacctaccacatgtgtgcaaagagttttgctttgaaaaaagatttggctgacacagga

SEQ ID NO: 21560 - DNA, 75 bp, Artificial Sequence
  Synthetic
cacggaactgtggtcatggaactcacctacaagggatctgacgtcccgtgcagagtaccaataaccatatcgaga

SEQ ID NO: 21561 - DNA, 75 bp, Artificial Sequence
  Synthetic
tctccgagtgatggagagatggttggaaggatggtgtcagtcaatccattggcaatgactgcctcttctgtcttc

SEQ ID NO: 21562 - DNA, 75 bp, Artificial Sequence
  Synthetic
atggttgaagtggaaccaccgtatggagatagctacatcataattggaagcaccgacaataaattgaaacagcat

SEQ ID NO: 21563 - DNA, 75 bp, Artificial Sequence
  Synthetic
tggttcaaaccaggaagctccataggaggagccttcaaaacaacatggaagggagtcaaacgtctgacaatactg

SEQ ID NO: 21564 - DNA, 75 bp, Artificial Sequence
  Synthetic
ggagatgctgcctgggactttggttcggtgggtggaatcacaaactccgtggggaaagcaattcaccaagtgttt

SEQ ID NO: 21565 - DNA, 75 bp, Artificial Sequence
  Synthetic
ggaagcgtcttttctgccgtgtttggggggatgaactggttcacaaaaatccttatcggggcactttgtatctgg

SEQ ID NO: 21566 - DNA, 75 bp, Artificial Sequence
  Synthetic
ctaggaataagtgctcgtgaccgttcaattgccctaacattcctgtctgtgggagccatactattgtttctctca

SEQ ID NO: 21567 - DNA, 75 bp, Artificial Sequence
  Synthetic
ctcggagtgggggcagactcaggatgtgggatcgacctggcacggatggaactaaagtgtgggagtggagtattc

SEQ ID NO: 21568 - DNA, 75 bp, Artificial Sequence
  Synthetic
gtgttcaatgatgtggaaacttggaccgaacagtaccagtaccacccatcgactcctggaggtctggcagctgct

SEQ ID NO: 21569 - DNA, 75 bp, Artificial Sequence
  Synthetic
atccaaaaaggtttcaaagagggcatttgtggagcccgcagcaccactaggcttgagcacagaatgtgggaacaa

SEQ ID NO: 21570 - DNA, 75 bp, Artificial Sequence
  Synthetic
gtggccaatgaagtgaacgccgttttcgaaagcaatgacattgacctctcagtggtggtaaaatcggaggtcaat

SEQ ID NO: 21571 - DNA, 75 bp, Artificial Sequence
  Synthetic
ccaaaagtcaagggctccaggagactcaaacctgcggaatcggcactgcccatagggtggaaatcatggggcaag

SEQ ID NO: 21572 - DNA, 75 bp, Artificial Sequence
  Synthetic
aaacacgtcttcagtgtagaaatttctaacaacacattcatagtagacggagcagagaaaaaagaatgctcagac

SEQ ID NO: 21573 - DNA, 75 bp, Artificial Sequence
  Synthetic
tacaacaggacttggaacacttttagagtcgaggatttcggatttggaattacgaaaacacaagttttccttgaa

SEQ ID NO: 21574 - DNA, 75 bp, Artificial Sequence
  Synthetic
attagagaagaagaaagcaatgaatgtgacacagcagtcataggatcagccgtgaaaggaaacagagccgtccat

SEQ ID NO: 21575 - DNA, 75 bp, Artificial Sequence
  Synthetic
agtgacctaggctactggatcgaaagtgggaacaatgagacgtggagactggagagagcgttcctcattgaaacc

SEQ ID NO: 21576 - DNA, 75 bp, Artificial Sequence
  Synthetic
aaaacatgtgaatggcccaacactcacaccttgtggagcgatggagtggaagacagcaaactcatcattcccagg

SEQ ID NO: 21577 - DNA, 75 bp, Artificial Sequence
  Synthetic
agcctggcaggacctagaagccaccacaacacaagacaaggatatgcaacacagataaaaggaccctggaaccac

SEQ ID NO: 21578 - DNA, 75 bp, Artificial Sequence
  Synthetic
gtgccattggaaatacggtttgaaaactgtcctggcaccaccgtgtccatcgacaaaagttgtggagacagggga

SEQ ID NO: 21579 - DNA, 75 bp, Artificial Sequence
  Synthetic
gcgtcagccagatccaccacggcaagtggaaagacaataaccgagtggtgttgccgctcttgcactctgccccct

SEQ ID NO: 21580 - DNA, 75 bp, Artificial Sequence
  Synthetic
ctttcataccacactccagacggatgttggtacgggatggaaatacggccaaaagatgggaaagaggaagtgctg

SEQ ID NO: 21581 - DNA, 75 bp, Artificial Sequence
  Synthetic
atcaaatccaaagtttcagccggaaatggtgcctctcctgattcattttcactgggtctattggttgccatggtt

SEQ ID NO: 21582 - DNA, 75 bp, Artificial Sequence
  Synthetic
atggtacaggaaggtctgcggaaaagatggggagctcgccacataataactgcaggagcatttctcttagcggca

SEQ ID NO: 21583 - DNA, 75 bp, Artificial Sequence
  Synthetic
atgataatgggggaaatcacatatcttgatttggctagatactgtgtcatgcttggtgccacgtttacacaaata

SEQ ID NO: 21584 - DNA, 75 bp, Artificial Sequence
  Synthetic
aacaatggaggggatgtcctacacctggctctggtagctgtgttcaagattcagccgggtttcctactgggatac

SEQ ID NO: 21585 - DNA, 75 bp, Artificial Sequence
  Synthetic
atgttgaagaacaggtggacgcctagagaatctgtactgttggcattgggggctacgttcctacagttgtcaacg

SEQ ID NO: 21586 - DNA, 75 bp, Artificial Sequence
  Synthetic
actggattaccatgggaattcatgatggctctgaacactctggccacggcttggctaggtttgagagctttggta

SEQ ID NO: 21587 - DNA, 75 bp, Artificial Sequence
  Synthetic
gttggaacaaccccagcagtgatactgccagtcttagctctcatgactccagctttgccaatatcacccttggga

SEQ ID NO: 21588 - DNA, 75 bp, Artificial Sequence
  Synthetic
gcgtaccaagcaatggttgcccacctcatggtgttgaatttgatgatgagtacaaggaagaactccctgaagaaa

SEQ ID NO: 21589 - DNA, 75 bp, Artificial Sequence
  Synthetic
cacggaccgcccttggtggcattgttgggctcgttcataggctggttcaacccattgtcctgcgcagccattgac

SEQ ID NO: 21590 - DNA, 75 bp, Artificial Sequence
  Synthetic
atggtggttagcaatgtaaaaaggaggagctggccagccagtgaggccatgacagcagtaggggttgtgtgtgct

SEQ ID NO: 21591 - DNA, 75 bp, Artificial Sequence
  Synthetic
ttggtgggtggggtagctgagttgggagaaacccctctggctggaccaatggctgcttgcggcctcctcataatg

SEQ ID NO: 21592 - DNA, 75 bp, Artificial Sequence
  Synthetic
gcctatgtccttagtgggaaaagcactgacctgtacatcgaaaaggcctgcaatgtggagtggagtaacgatgct

SEQ ID NO: 21593 - DNA, 75 bp, Artificial Sequence
  Synthetic
gaggttactggctccagcccacgactagacgtagccattgatgaaaatggggacatttcgcttctagaaggagag

SEQ ID NO: 21594 - DNA, 75 bp, Artificial Sequence
  Synthetic
gagaactccatggaacacaccctggtaaaaatcgggcttcttgcggtggtagggttttttcccctggcaattccc

SEQ ID NO: 21595 - DNA, 75 bp, Artificial Sequence
  Synthetic
tttgcggcggctggatggtacatgtacttgaagagtggacgaagggcaggggccctctgggacattccatcgccg

SEQ ID NO: 21596 - DNA, 75 bp, Artificial Sequence
  Synthetic
ccagtgaaaaaaccagcttccaccgaaaccggagtgtaccggataatggcatcaagactcattggatcttcacaa

SEQ ID NO: 21597 - DNA, 75 bp, Artificial Sequence
  Synthetic
attggagttggcgtcatgcatgaaggggtcttccacacaatgtggcacgtcactagaggagcagccttaaggtgt

SEQ ID NO: 21598 - DNA, 75 bp, Artificial Sequence
  Synthetic
ggggaaggaagacttgaccccacgtggggggacgtgaaaggcgatgtgatctcatacggaggaccttggaaactc

SEQ ID NO: 21599 - DNA, 75 bp, Artificial Sequence
  Synthetic
tcagaaaaatgggacggtgtgagtgaagtccaaatggtggccgtcgctccaggaaaaaggagtcaaaacgtgcag

SEQ ID NO: 21600 - DNA, 75 bp, Artificial Sequence
  Synthetic
acagtgccgggaattttcaacacaattgcaggaccagtgggagctgtcactctcgactttcctccgggcacttca

SEQ ID NO: 21601 - DNA, 75 bp, Artificial Sequence
  Synthetic
ggatcacccataatcaacaaagatggcaagatcattggtctgtatgggaatggggtagtactggccgggggaact

SEQ ID NO: 21602 - DNA, 75 bp, Artificial Sequence
  Synthetic
tatgccagtatgatttcacagcccgacattccaattccagaagcgccagactgtgtgacagagaacatgtttaag

SEQ ID NO: 21603 - DNA, 75 bp, Artificial Sequence
  Synthetic
aagaaacagctcacagttctggatttgcaccctggagccggaaagacgagaaaagtgctccctgagctcataaag

SEQ ID NO: 21604 - DNA, 75 bp, Artificial Sequence
  Synthetic
caagtggtggaaaagagattgcgcaccctggtcctggcacccacgcgagtggtagcagcagaaatggcggaagct

SEQ ID NO: 21605 - DNA, 75 bp, Artificial Sequence
  Synthetic
ctcaagggaatgccagtgagatatctgaccccagcagtaacacaacagcacactggaaaagaaatagttgacttg

SEQ ID NO: 21606 - DNA, 75 bp, Artificial Sequence
  Synthetic
atgtgccatgcaactttcaccatgagactgctagccggggggagggtccctaactacaacatgttcataatggat

SEQ ID NO: 21607 - DNA, 75 bp, Artificial Sequence
  Synthetic
gaagcgcatttcacagacccaagcagcatagcggcccgggggtatatagccacaaaggtagaaatgggcgaagct

SEQ ID NO: 21608 - DNA, 75 bp, Artificial Sequence
  Synthetic
gcggctgtgttcatgaccgcgacccccccaggaagcagggagccattcccagattcaaacgctccaattgtcgac

SEQ ID NO: 21609 - DNA, 75 bp, Artificial Sequence
  Synthetic
gaaccaattacggtgccagacaaagcctggagcacaggctatgagtgggtcactgattttgagggaaaaaccgtg

SEQ ID NO: 21610 - DNA, 75 bp, Artificial Sequence
  Synthetic
tggttcgttccgagcatcagaaatggccaggagattgccaactgcctaataaaagcagggaaaagagtgatccag

SEQ ID NO: 21611 - DNA, 75 bp, Artificial Sequence
  Synthetic
ctgaacaggaaaacatttgacacggagtacaagaaaacaaagcaggacgactgggattttgtcatcaccacagat

SEQ ID NO: 21612 - DNA, 75 bp, Artificial Sequence
  Synthetic
atctccgagatgggagcaaacttccatgcttcaagggtgatagacagccgcaaggcgataaaaccagtagttgtg

SEQ ID NO: 21613 - DNA, 75 bp, Artificial Sequence
  Synthetic
acagatggagaggagcgggtgataatgaatggtcctgcgctggtaacttcagcaagtgcagctcagagacgcggc

SEQ ID NO: 21614 - DNA, 75 bp, Artificial Sequence
  Synthetic
agaatcggaaggaacccaaaccaaccaggagacacctacctctatggcggaggggttgatgactcagacacgaac

SEQ ID NO: 21615 - DNA, 75 bp, Artificial Sequence
  Synthetic
aacgtctgctggacagaagctagaatgctacttgacaacatcaacattccgggagggcttattgccagcttctac

SEQ ID NO: 21616 - DNA, 75 bp, Artificial Sequence
  Synthetic
caaccagagagagacaaatcagctgccatagatggtgaattcagactaaaagacacaaacaggaagctcttcacg

SEQ ID NO: 21617 - DNA, 75 bp, Artificial Sequence
  Synthetic
gagtatttaaaggctgaccttccggtgtggctggcctatcaggtagctcagcacgggaacgcttaccaagaccgt

SEQ ID NO: 21618 - DNA, 75 bp, Artificial Sequence
  Synthetic
agctggtgctttcttggttcaagtcaaaacacagtcctggaagatggaaatcccgttgaaatctggacgaaatca

SEQ ID NO: 21619 - DNA, 75 bp, Artificial Sequence
  Synthetic
ggcgaacgcaaagtgctcaaaccgaaatggagcgacgcgcgaatgttctcagaccatctctcactcaaagcattc

SEQ ID NO: 21620 - DNA, 75 bp, Artificial Sequence
  Synthetic
aaagaatttgcatctggaaggaggtcaagtgtgcctagtttgctggaagtggtcgggatgttgcccaggcacttt

SEQ ID NO: 21621 - DNA, 75 bp, Artificial Sequence
  Synthetic
tccgagaaagggacagacgccttggacaatttgaagatcctgatgactagtgaccccaatggtagagcttataaa

SEQ ID NO: 21622 - DNA, 75 bp, Artificial Sequence
  Synthetic
catgcagtggccgagctcccagaaacacttgaaacaatcttgctgataacaatgctaacggtggcctcactgagt

SEQ ID NO: 21623 - DNA, 75 bp, Artificial Sequence
  Synthetic
gtcttcctactactgatgagacagaaagggatagggaaaatggggcttggtctggttgtattagtggcaacaggg

SEQ ID NO: 21624 - DNA, 75 bp, Artificial Sequence
  Synthetic
gggttgctaatgatggccgaggtggctccagccaagattgccggcgtcattatcctagttttccttctaatggtg

SEQ ID NO: 21625 - DNA, 75 bp, Artificial Sequence
  Synthetic
gtgctaattcccgaaccagaaaaacagagaaccatacaggacaaccagttggctatcattgtgttgctggtgctt

SEQ ID NO: 21626 - DNA, 75 bp, Artificial Sequence
  Synthetic
agcacagggctggcagtggcagcgaatgaaatggggtatctagaaaggacaaaaagtgacatcgccagtctatgg

SEQ ID NO: 21627 - DNA, 75 bp, Artificial Sequence
  Synthetic
gggaacaaagggagtgctagcccgtcaatcaatgactggttcaccatggatttgaaacccgctacagcctggacc

SEQ ID NO: 21628 - DNA, 75 bp, Artificial Sequence
  Synthetic
ctttatgccgtggccacaacaattctcacacctttcatacaacaccacatcaacacacactatgccaatgtttcc

SEQ ID NO: 21629 - DNA, 75 bp, Artificial Sequence
  Synthetic
ctgtcagccattgcagcccaggcaggaagcctattcatgatgaagaacggacatcctttcactcaacttgactgg

SEQ ID NO: 21630 - DNA, 75 bp, Artificial Sequence
  Synthetic
gctgtgccgctcttggccttggggtgttggagcaccatgactcccttatccctgttggcggcatccctgttgctc

SEQ ID NO: 21631 - DNA, 75 bp, Artificial Sequence
  Synthetic
ttcatccattacgcctacatgatcccaggttggcaggctatgggtgctcgagcggctcaggcaagaacagctgcc

SEQ ID NO: 21632 - DNA, 75 bp, Artificial Sequence
  Synthetic
ggcataatgaaaaatcccgtggtagatggagtaactgtgacagacattcctgagcttgagcttccagatccagca

SEQ ID NO: 21633 - DNA, 75 bp, Artificial Sequence
  Synthetic
attgaaaagaagctgggacaggtgctcctcgtttgcgttgcactagcctcagctttcctccggcaagatatggtg

SEQ ID NO: 21634 - DNA, 75 bp, Artificial Sequence
  Synthetic
gggtggagagagtgcggcattctagcctcagctggtattggcacgttgtgggaaggaagtcccagcaagttctgg

SEQ ID NO: 21635 - DNA, 75 bp, Artificial Sequence
  Synthetic
aacgcctccattgcaagttccttgtgtaacatcataagaggtagccatctggctgcagttccatttttgttcaca

SEQ ID NO: 21636 - DNA, 75 bp, Artificial Sequence
  Synthetic
ctgataagaaacatgacaaaaccaaacaagagagggggagctgacggtgaaactctgggagacaagtggaaagcc

SEQ ID NO: 21637 - DNA, 75 bp, Artificial Sequence
  Synthetic
aggctgaattcaatggaaaagaatgcgttctccaagtacaaagtgtcagggatcatagaagtggacagggaaccg

SEQ ID NO: 21638 - DNA, 75 bp, Artificial Sequence
  Synthetic
gcaagaaaagccttgagggaaggaaatgtccattcaggacacgcagtgtcaagaggcacggcaaaactcagatgg

SEQ ID NO: 21639 - DNA, 75 bp, Artificial Sequence
  Synthetic
atggttgagagaggaatggtgaacccacaagggaaagtcgttgaccttgggtgcggaagaggcggatggtcctac

SEQ ID NO: 21640 - DNA, 75 bp, Artificial Sequence
  Synthetic
tatgccgcaacgctccccagagtcatggaagtgaaagggttcaccaaaggaggccttggacatgaggagccacgg

SEQ ID NO: 21641 - DNA, 75 bp, Artificial Sequence
  Synthetic
atggtacaatcctatggatggaatttggtcaccttgaaaagtggagttgatgttcacatgaaagcagtggaaaga

SEQ ID NO: 21642 - DNA, 75 bp, Artificial Sequence
  Synthetic
acgaacactctcttttgtgacataggagagtcctcagccagcgcagaagtagaagagagcagaactctaagggtt

SEQ ID NO: 21643 - DNA, 75 bp, Artificial Sequence
  Synthetic
ttggaactggttgagcactggatggctccgggtgtggatgcctttgccgtaaaagtcttgtgtccttacaggcca

SEQ ID NO: 21644 - DNA, 75 bp, Artificial Sequence
  Synthetic
aaggtcatagaaaagattgaaagcctgcagagaaagtttggtggtggacttgtgagagttccactgtcaagaaac

SEQ ID NO: 21645 - DNA, 75 bp, Artificial Sequence
  Synthetic
agcacacatgagatgtactgggtggacggggtgaaaaccaacgtggttggagcaataaatacaacgagcaagctc

SEQ ID NO: 21646 - DNA, 75 bp, Artificial Sequence
  Synthetic
ctattgtcaagaatggacagaagcttcacaagtcccagattcgaggaagacgccaatctctcctcaggaaccaga

SEQ ID NO: 21647 - DNA, 75 bp, Artificial Sequence
  Synthetic
gctgtcatgttaaaaaggaaagcagctgacatggaaaagattgccggccgcataaaacggttgaaagaagagcac

SEQ ID NO: 21648 - DNA, 75 bp, Artificial Sequence
  Synthetic
tcaagcagttggttcgttgaccaaaacaatccttatagaacctggaactaccacggaagttatgaaacaaaaccc

SEQ ID NO: 21649 - DNA, 75 bp, Artificial Sequence
  Synthetic
tctggatcagcctcatcgatggtgaattctgtggtaaaacttatgtcgaaaccatgggatgtaatctcaacggtc

SEQ ID NO: 21650 - DNA, 75 bp, Artificial Sequence
  Synthetic
acgcagatgtccatgacagacacaacgccatttgggcaacagagggtcttcaaggagaaagtagacacaaaggcc

SEQ ID NO: 21651 - DNA, 75 bp, Artificial Sequence
  Synthetic
ccagaaccggagcagggggtggctgacataatggaaactgtggctaggtggtattggaaggagctgtgcaagaag

SEQ ID NO: 21652 - DNA, 75 bp, Artificial Sequence
  Synthetic
aggaaaccaagactgtgcacaaaagaagagttcatcaagaaagtgaacagcaacgccgctctaggctccatgttt

SEQ ID NO: 21653 - DNA, 75 bp, Artificial Sequence
  Synthetic
gaggaacagcagatctggagcaatgcaaaagaggcagttgaagacccagaattctggcgccaagttgatgaggag

SEQ ID NO: 21654 - DNA, 75 bp, Artificial Sequence
  Synthetic
agagaaaagcacaagagaggagaatgctcaacctgcatctataacatgatgggcaagcgagagaagaaactagga

SEQ ID NO: 21655 - DNA, 75 bp, Artificial Sequence
  Synthetic
gagtttggaaaagcgaaaggaagccgagcaatatggtacatgtggctaggcgcacgcttcctggaatttgaagcc

SEQ ID NO: 21656 - DNA, 75 bp, Artificial Sequence
  Synthetic
ctagggttcctaaatgaagatcactggttgagcagagagaattcaggtgcaggagttgaaggcataggtctgcag

SEQ ID NO: 21657 - DNA, 75 bp, Artificial Sequence
  Synthetic
aggctcggctacgtccttagggacatggggagaggaggaggaaaaatctatgccgacgatgtggcaggctgggac

SEQ ID NO: 21658 - DNA, 75 bp, Artificial Sequence
  Synthetic
acgagaatcacggaaaaagaccttgataacgagatgatagtccttgaacacatggaaccagcgcacaaaaagctt

SEQ ID NO: 21659 - DNA, 75 bp, Artificial Sequence
  Synthetic
gcgcacgccatcttcactctgacttacaggcacaaagtggttagagtcatgagaccaggacccaatgggaaaacc

SEQ ID NO: 21660 - DNA, 75 bp, Artificial Sequence
  Synthetic
tacatggatgtgatctccagagaggaccaacgaggcagtggccaagtagtgacatatgctctgaacactttcaca

SEQ ID NO: 21661 - DNA, 75 bp, Artificial Sequence
  Synthetic
aacgctatcgtccagctgattcgcagcgccgaagctgaaggaataatcacagccttttcgattgaggaagtgtcg

SEQ ID NO: 21662 - DNA, 75 bp, Artificial Sequence
  Synthetic
gaatctgtcctggatgaactattgagatggctggaagactttggttgggaaaggttgaagatgatggccatcagt

SEQ ID NO: 21663 - DNA, 75 bp, Artificial Sequence
  Synthetic
ggagatgactgtgcagtgaaagcgtgcgatgaaaggttcgcaacggccctgaacttcttaaacgccatgtctaag

SEQ ID NO: 21664 - DNA, 75 bp, Artificial Sequence
  Synthetic
gtgaggaaagacattccagagtggaaaccgtcctcagggtggagtgactggcaacaggttccattctgctcgcac

SEQ ID NO: 21665 - DNA, 75 bp, Artificial Sequence
  Synthetic
cattttgtggaaatcagaatgaaagatgggagagaactggtagttccatgcagacaccaagacgagctcgttggg

SEQ ID NO: 21666 - DNA, 75 bp, Artificial Sequence
  Synthetic
agagctcgcgtgtctccgggagcaacttggacaatcagggagtcagcatgcatggcaaaagcctacgcccaaatg

SEQ ID NO: 21667 - DNA, 75 bp, Artificial Sequence
  Synthetic
tggatgttgatgtattttcacagaagagacctgagaatcatggcaaacgccatctgctcggcagtgccagttgac

SEQ ID NO: 21668 - DNA, 75 bp, Artificial Sequence
  Synthetic
tgggttcctacaggaagaaccacctggtcaatccatggaaagggagaatggatgaccactgaagacatgctcgat

SEQ ID NO: 21669 - DNA, 75 bp, Artificial Sequence
  Synthetic
gtgtggaacagagtgtggattgaggagaatccccacatgaccgacaagacccctgttagcagttggagagatgtt

SEQ ID NO: 21670 - DNA, 75 bp, Artificial Sequence
  Synthetic
cctttcattggaaaaagagaggaccagtggtgcggaagcttgattggctacagaccacgcgccacatgggcagag

SEQ ID NO: 21671 - DNA, 75 bp, Artificial Sequence
  Synthetic
aacatctgggtcgcagtccaccaagtgagaaacatgattgggaaagaaaaatatgtggattatttaaaaactcaa

SEQ ID NO: 21672 - DNA, 75 bp, Artificial Sequence
  Synthetic
aaatatgtggattatttaaaaactcaaggtagatacaaaaaagaagaggtgggctcattcacaggagtcctgtaa

SEQ ID NO: 21673 - DNA, 75 bp, Artificial Sequence
  Synthetic
agtatttcttctgcgtgagaccattgcgacagttcgtaccggtgagttttgacttaacgcagtgagaaaagtttt

SEQ ID NO: 21674 - DNA, 75 bp, Artificial Sequence
  Synthetic
cgaggaaagacgagaagcgaattctctgaatggctagaaaaccaggaagacccggaggaaaccgggtcgtcaata

SEQ ID NO: 21675 - DNA, 75 bp, Artificial Sequence
  Synthetic
tgctaaagcgtacggcggccaacgcagccagccccttggggctggcaaaaaggctgcttggagacgcgtttgctg

SEQ ID NO: 21676 - DNA, 75 bp, Artificial Sequence
  Synthetic
gtaggggacccttaagggttatcctagcagtggtcgcgttcttcagatttacagcaatcaaaatgtcccccgctt

SEQ ID NO: 21677 - DNA, 75 bp, Artificial Sequence
  Synthetic
tactcaaaaagtgggggacggttgaaaaaggggcggcaatagccataatgaaaagtttcaaaaaggagattggaa

SEQ ID NO: 21678 - DNA, 75 bp, Artificial Sequence
  Synthetic
gcatgctggatgttgttgcccgcagaaagacaaaaaataaaggaaaacgctccgttgagagcagtgcgttgctgg

SEQ ID NO: 21679 - DNA, 75 bp, Artificial Sequence
  Synthetic
tgctgttgaccgcttgtctggccttgggcttcaaagtggttacaggacctgaagggcccataatggacgtcacaa

SEQ ID NO: 21680 - DNA, 75 bp, Artificial Sequence
  Synthetic
agaaagatgtggggaaggctctggagattccttttcagaacttcaacaacacatgctgggtcatggcaatggacg

SEQ ID NO: 21681 - DNA, 75 bp, Artificial Sequence
  Synthetic
ttggacatccgtgtgaagacacaattgagtatgaatgcccctctttggacattggagctgaacctaatgacattg

SEQ ID NO: 21682 - DNA, 75 bp, Artificial Sequence
  Synthetic
actgttggtgtgacaccatgcccatgcgggtacgatatgggagatgcacaaaagggtcaatacccaagcgatcaa

SEQ ID NO: 21683 - DNA, 75 bp, Artificial Sequence
  Synthetic
gacggaatgctgtgtttccccagcacactgaaaatgtcctcgcaacccgacaagaaacatggatgaacacagatg

SEQ ID NO: 21684 - DNA, 75 bp, Artificial Sequence
  Synthetic
tcataatgaaacacctcatcaaggtagagacttgggccttgagaaatccgggctttgccctggtggccatcaccc

SEQ ID NO: 21685 - DNA, 75 bp, Artificial Sequence
  Synthetic
ttggttggatgctcgggagcaacagaagtcaaaaaatcatcttcacaatattactcctattggtggctccagctt

SEQ ID NO: 21686 - DNA, 75 bp, Artificial Sequence
  Synthetic
ataatatgaggtgcattggagttgaaaaccgtgattttgttgaaggcttgagcggcggaacctgggttgatgtgg

SEQ ID NO: 21687 - DNA, 75 bp, Artificial Sequence
  Synthetic
tgctggagcatggaggctgcgtcacagtacgggttgaagggaaacccacactagactttgaattggtacaaacaa

SEQ ID NO: 21688 - DNA, 75 bp, Artificial Sequence
  Synthetic
aggccacgggactagcggctgtgagggcttattgttaccaggcaaaggtcagtgatatccaaatctcagcggcat

SEQ ID NO: 21689 - DNA, 75 bp, Artificial Sequence
  Synthetic
gtccagcggtacagctgacggagaactcaaaggccaccgattcaaattatctgtgcagaagaggggtaaccaata

SEQ ID NO: 21690 - DNA, 75 bp, Artificial Sequence
  Synthetic
gaggctggaacaatggctgtggtctgtttgggaaaggagacattcatacttgtgtgaaatttaagtgtgagaaaa

SEQ ID NO: 21691 - DNA, 75 bp, Artificial Sequence
  Synthetic
aagctgctggattttccatcggaaaggagaacctagagtatgaggttagagctagtgttcacaattcaattggag

SEQ ID NO: 21692 - DNA, 75 bp, Artificial Sequence
  Synthetic
ctgacaagttcagcaatgagttagctgacggagaaccccacacgcaaaaaatgaagttctcccctctttccccat

SEQ ID NO: 21693 - DNA, 75 bp, Artificial Sequence
  Synthetic
cggcagaaaaaagctttggagattacggcacactgggaatggattgtgaaccacagtcaggacttgattttggac

SEQ ID NO: 21694 - DNA, 75 bp, Artificial Sequence
  Synthetic
aattgtaccttatgacaatcgagtccaagtcttggctagtgaatagggactggtatcatgacctacaccttcctt

SEQ ID NO: 21695 - DNA, 75 bp, Artificial Sequence
  Synthetic
acaccgtgggctcaggctcacaatggaacaacagagaggccctagttgaatttcaggaaccacatgccacaaaac

SEQ ID NO: 21696 - DNA, 75 bp, Artificial Sequence
  Synthetic
aagaagtgctggctttgggatcgcaagaaggtgctcttcactcagctctggcgggcgctatcatggccaaccgag

SEQ ID NO: 21697 - DNA, 75 bp, Artificial Sequence
  Synthetic
agacttcaagccctcatgctctgctgctgacagccggacacttaaagtgcaggatcaagatggacaaaatggtaa

SEQ ID NO: 21698 - DNA, 75 bp, Artificial Sequence
  Synthetic
taaaaggcatcacctatggacaatgcagtgggacatttaagatggaaaaacaccccgcagacacgggccacggaa

SEQ ID NO: 21699 - DNA, 75 bp, Artificial Sequence
  Synthetic
ctgtggttttggacgtcagttatcaaggagatgatgcgccctgcaagatccccattgttataacatcaaatctgg

SEQ ID NO: 21700 - DNA, 75 bp, Artificial Sequence
  Synthetic
cagaagtggaaccagtggggaggttggtttcggcccacccagtcataacggcaaagaatgtgaggaccatgcttg

SEQ ID NO: 21701 - DNA, 75 bp, Artificial Sequence
  Synthetic
aggtggaacccccttacggagacagctacatcgtcattggggtcggagacggaaggctcaagcagcattggttca

SEQ ID NO: 21702 - DNA, 75 bp, Artificial Sequence
  Synthetic
agaaagggagtgtaattggaggagctttcagcaccaccatgaaaggggcgaaacgcctagcagttttgggagacg

SEQ ID NO: 21703 - DNA, 75 bp, Artificial Sequence
  Synthetic
cggcatgggacttcggttctgtgggaggagtatttaactccttgggaaaagccgtccatcagctgtttgggggaa

SEQ ID NO: 21704 - DNA, 75 bp, Artificial Sequence
  Synthetic
ttttccggaccctctttggaggaatgtcatggttgtcgcgtcttatgattggggcattgtgcttgtggattggga

SEQ ID NO: 21705 - DNA, 75 bp, Artificial Sequence
  Synthetic
taaatgccagagaccactcgatagccgtaactatgctttcagtaggaggcatcctaattttcctttcaatcaacg

SEQ ID NO: 21706 - DNA, 75 bp, Artificial Sequence
  Synthetic
tcagcgcggatactggatgtgttgtggacattgaaagaaaggaactgaaatgtggctcaggaatttttatcatga

SEQ ID NO: 21707 - DNA, 75 bp, Artificial Sequence
  Synthetic
atgacattgaggcttggagagatgagtacgctttccaccccagtggtcctaaggccttggcagcgtctgtagtag

SEQ ID NO: 21708 - DNA, 75 bp, Artificial Sequence
  Synthetic
aggcgttttcccaaggggtgtgcggtgtgagaagtgtgaacagactggagcacaagatgtgggagtccatagcgg

SEQ ID NO: 21709 - DNA, 75 bp, Artificial Sequence
  Synthetic
atgagctgaatgccatcttggaagagaatgagcgcgagataaccatcgttgtgaaggacatggaaaatcccgctc

SEQ ID NO: 21710 - DNA, 75 bp, Artificial Sequence
  Synthetic
aaaagggcaaaatgcgtttaagaccagtggagaaagagctaaagtatggatggaagaagtggggagcttcgtttt

SEQ ID NO: 21711 - DNA, 75 bp, Artificial Sequence
  Synthetic
ttaaacgagcatccaggaaaaatgctacattcttggttgacggacctagcggggaagagtgtcctaacagtaaca

SEQ ID NO: 21712 - DNA, 75 bp, Artificial Sequence
  Synthetic
gagcttggaactctttctttatagaagattttggctttggagtattcaaaacatctgtgtggttagggctaaatg

SEQ ID NO: 21713 - DNA, 75 bp, Artificial Sequence
  Synthetic
agcaaatgacagaggtatgtgacacaaaaatgattggcacgggagtaaaaaatgacagagccgtgcacagtgact

SEQ ID NO: 21714 - DNA, 75 bp, Artificial Sequence
  Synthetic
taggctattggatcgagagtaggaaaaatctcacatgggagatctcaagggctaggttgattgagacaaaagcgt

SEQ ID NO: 21715 - DNA, 75 bp, Artificial Sequence
  Synthetic
gcatttggccacggtcgcacactctctggagtgatggaattgaggaaacacagctgatcatccccaagtcattgg

SEQ ID NO: 21716 - DNA, 75 bp, Artificial Sequence
  Synthetic
gaggccccagatcgagacacaacatgcggagtggttacaagacgcagatcaatggtccctgggatcaaatccctt

SEQ ID NO: 21717 - DNA, 75 bp, Artificial Sequence
  Synthetic
tggacataaagtttgaagaatgccctggaacaagtgtcacggtcacaccaaattgtggaggaaggggaccatcgg

SEQ ID NO: 21718 - DNA, 75 bp, Artificial Sequence
  Synthetic
cccggagcacgacggctagtggaaaagtgatagccgattggtgctgcagggattgcatactaccaccactaacct

SEQ ID NO: 21719 - DNA, 75 bp, Artificial Sequence
  Synthetic
tcagatcaggagagacatgctggtacgccatggaaatcaggcctgtgagtgagagagaagaaaccctgataaggt

SEQ ID NO: 21720 - DNA, 75 bp, Artificial Sequence
  Synthetic
caaaagtctccgctggagacgggaatgagatagacaccttctcactaggactactggttgcaatgttggtgacac

SEQ ID NO: 21721 - DNA, 75 bp, Artificial Sequence
  Synthetic
aggaaggcctgaggaaacgctgggctactcgccatatcatggtggcttcactgacaatgctggcagcaatggtca

SEQ ID NO: 21722 - DNA, 75 bp, Artificial Sequence
  Synthetic
caggacacatcacatatcgtgatttactccggtacgtggtactgctgggagctacctttgcacaaatcaatgacg

SEQ ID NO: 21723 - DNA, 75 bp, Artificial Sequence
  Synthetic
gaggtgatgtgatgcacttggcattagtggcagtcttcaaagttcaacctggcttcctacttggtttcttgttga

SEQ ID NO: 21724 - DNA, 75 bp, Artificial Sequence
  Synthetic
ggcggcgctggacgccacgagagtcaatgctactggccatatcggcttgtttcttacacctcgtgttttcagagc

SEQ ID NO: 21725 - DNA, 75 bp, Artificial Sequence
  Synthetic
taagtactgacatcacaacgctggctcataatttttccctagccttgctgatactacgagccatcatccaaacag

SEQ ID NO: 21726 - DNA, 75 bp, Artificial Sequence
  Synthetic
acgtcagctctgtgacacttccagtgttgtctatgatggctccttcattccagctctcagtcctaggaactttca

SEQ ID NO: 21727 - DNA, 75 bp, Artificial Sequence
  Synthetic
gaatggcagtggcagtttatgttatcgtcaatctgatgatgtcaaaacggaatgatgccgtaaagaaagcggccc

SEQ ID NO: 21728 - DNA, 75 bp, Artificial Sequence
  Synthetic
ccagcgtggtggcagcagctctgggacaattcggaatggtgaatgcaacggcagccttagggacgctatatgtgc

SEQ ID NO: 21729 - DNA, 75 bp, Artificial Sequence
  Synthetic
tcgaaaaacatggaaaacgcagctggcctccaagtgagatattttcagcagtaggagtgttgtgcgcgttagtag

SEQ ID NO: 21730 - DNA, 75 bp, Artificial Sequence
  Synthetic
gagccctagggaatgtgcaaagtaccccactagcaggccctatggcggcgtgtggcctcctgatagcagcctatg

SEQ ID NO: 21731 - DNA, 75 bp, Artificial Sequence
  Synthetic
tggtgacaggaaagagtactgacatagaaattgaaagagctgggttgatctcatggagtgaagacgcggaagtca

SEQ ID NO: 21732 - DNA, 75 bp, Artificial Sequence
  Synthetic
gcggaagtagccccagggttgacgttgccttggatgagaatggtgatttttcactcattgacggacagggcccct

SEQ ID NO: 21733 - DNA, 75 bp, Artificial Sequence
  Synthetic
cgctggaatcagtgatcctgaagacagctctggtagctttcagcggactgtttcccgtgtccatacccttttgtg

SEQ ID NO: 21734 - DNA, 75 bp, Artificial Sequence
  Synthetic
ctgctgcttggtatctccacgggaagtcagggagaagagctggagcgctgtgggacattccagctccacgagaag

SEQ ID NO: 21735 - DNA, 75 bp, Artificial Sequence
  Synthetic
taaaaaaggggagtaccgaaaatggagtgtacagaatcttggccaacagactctttggaaaaactcaggtaggag

SEQ ID NO: 21736 - DNA, 75 bp, Artificial Sequence
  Synthetic
tcggagtgatgcatgaaggggtgtttcacaccatgtggcacgtcactagaggggccgctttgaaaagcggagaag

SEQ ID NO: 21737 - DNA, 75 bp, Artificial Sequence
  Synthetic
gaagattagacccttactggggagacgtgaagaaggacctgatttcatatggagggccatggaagttggaaggac

SEQ ID NO: 21738 - DNA, 75 bp, Artificial Sequence
  Synthetic
gttgggatggcgtgtcagaagtgcaactgatagcggtaccgccaaaagaaaaagcaaaaaacgtccagaccacgc

SEQ ID NO: 21739 - DNA, 75 bp, Artificial Sequence
  Synthetic
ctggagttttcaaaactccgcatggggagataggggctattgttcttgacttccctgctggatcttctggctctc

SEQ ID NO: 21740 - DNA, 75 bp, Artificial Sequence
  Synthetic
cgatcatcaacaagctaggggaagtgattggcctttatggaaatgggctgatgatgggagacgcgtatgcaagtt

SEQ ID NO: 21741 - DNA, 75 bp, Artificial Sequence
  Synthetic
ccattgcccaggctgaagtggaagatgagccagacaccccaaactgcctccctcccgacgtaacgcacaagaaaa

SEQ ID NO: 21742 - DNA, 75 bp, Artificial Sequence
  Synthetic
agctgacggtactagacctccatccaggagctggcaaaaccaggaaagtcttgcccaagctcctgcaggaagcct

SEQ ID NO: 21743 - DNA, 75 bp, Artificial Sequence
  Synthetic
tggaaaaaagactgagaacggtagtgctagctcccactagagtcgtggcagcggaaatggctgaggctctgaaag

SEQ ID NO: 21744 - DNA, 75 bp, Artificial Sequence
  Synthetic
ggatgcccattaggtaccagacagctgccgttacttcttcccactcaggaaatgaaatcatcgatctgatgtgcc

SEQ ID NO: 21745 - DNA, 75 bp, Artificial Sequence
  Synthetic
atgcaaccttcacttcaaggctcatgcaacctcatagagttccaaattacaatctgtacataatggatgaggcgc

SEQ ID NO: 21746 - DNA, 75 bp, Artificial Sequence
  Synthetic
atttcacagatccagccagcattgctgcacgagggtttattgcaacaaaggtcagcctgggagaggcagcggctg

SEQ ID NO: 21747 - DNA, 75 bp, Artificial Sequence
  Synthetic
tcttcatgacagccacaccgcctggcagcgacaatccctttccagcttccaacgcccccataacagacacagaag

SEQ ID NO: 21748 - DNA, 75 bp, Artificial Sequence
  Synthetic
ctcagattcctgacaaggcctggagcacaggcttcgattggatcacagaatatggaggaaagacagtctggttcg

SEQ ID NO: 21749 - DNA, 75 bp, Artificial Sequence
  Synthetic
ttcctagtgtccgcatgggaaacgagattgccgcttgcttgacgaaagcaaagaagaaggtgatacagctcagca

SEQ ID NO: 21750 - DNA, 75 bp, Artificial Sequence
  Synthetic
ggagaactttcaacacagagtatcccaaatgcaagcaaggggactgggatttcgtggtcacaaccgacatctcgg

SEQ ID NO: 21751 - DNA, 75 bp, Artificial Sequence
  Synthetic
aaatgggagcgaacttcaaggccacaagggtcattgacagcaggagggctatcaaaccaagcatcatgcaagacc

SEQ ID NO: 21752 - DNA, 75 bp, Artificial Sequence
  Synthetic
aggaagagagagtagtcctgagtggaccaacgccaatctctccggccagcgcagcccaaagaaggggaagggttg

SEQ ID NO: 21753 - DNA, 75 bp, Artificial Sequence
  Synthetic
gcaggaaccccaaccaacttggagatgaatatgtgttctccgggttgacccaggcaaacgatgaggggaatgcgt

SEQ ID NO: 21754 - DNA, 75 bp, Artificial Sequence
  Synthetic
gttggactgaagcccgcatgctccttgataacatccatatgcaaaatggtctcatagctcaattgtatggccctg

SEQ ID NO: 21755 - DNA, 75 bp, Artificial Sequence
  Synthetic
aacaagacaaatgtttcgccactgatggagaatttaaattgagagagaaggaaagagccactttcctggagttcc

SEQ ID NO: 21756 - DNA, 75 bp, Artificial Sequence
  Synthetic
tgaaggcggacttgccagtgtggctgtcatttaaggcagctagttctggggttcagtaccatgacaggaaatggt

SEQ ID NO: 21757 - DNA, 75 bp, Artificial Sequence
  Synthetic
gctttgatggaccagacaacaatttggtcttggaagacaatgttccagttgagatctggacgaagtcaggggaaa

SEQ ID NO: 21758 - DNA, 75 bp, Artificial Sequence
  Synthetic
ggaagaagctaaaacccagatggagtgacgccaggacgtattgtgaccatggtgctctcaccgctttcaaagagt

SEQ ID NO: 21759 - DNA, 75 bp, Artificial Sequence
  Synthetic
ttgctgggggaagaaggagtgtgacgacaggccttctagaaggagttgggagactgccagaacatcttggccaac

SEQ ID NO: 21760 - DNA, 75 bp, Artificial Sequence
  Synthetic
gcctgaaagaatccattgacaccctgtacttagctttcacagctgaagttggctcgcgcccccatcgagaggcta

SEQ ID NO: 21761 - DNA, 75 bp, Artificial Sequence
  Synthetic
tgcaagaaatgccggctgctctggaaactgtccttgtgttttttctactaatgattatgacaggttgcacattct

SEQ ID NO: 21762 - DNA, 75 bp, Artificial Sequence
  Synthetic
ttctcttgatgcgacacaaaggcattaataaaatgggttatgggatggtggtcatgtcagccgttggaggtctgt

SEQ ID NO: 21763 - DNA, 75 bp, Artificial Sequence
  Synthetic
tatggtacggaaatgtgccagccccaaaaattgcaggcatcctacttttgacatttctgctgatggtggtcttga

SEQ ID NO: 21764 - DNA, 75 bp, Artificial Sequence
  Synthetic
taccaaacccagaaaaacagcggtccatccaggacaaccagctagccctagtggtactaggttgcttaatgtttc

SEQ ID NO: 21765 - DNA, 75 bp, Artificial Sequence
  Synthetic
tgggggggatagcggccaatgaaatggggatgctggaaaggaccaagcaggacttagccggagtctttcacaaga

SEQ ID NO: 21766 - DNA, 75 bp, Artificial Sequence
  Synthetic
ccgagaggaaatccacagaattcacactcctgactcctccggatttaaggccagccacggcatggagcatatatg

SEQ ID NO: 21767 - DNA, 75 bp, Artificial Sequence
  Synthetic
ccattggaaccaccctcatcactccactgatccaccacatgattactactcactatgcaaacttctctttgatgg

SEQ ID NO: 21768 - DNA, 75 bp, Artificial Sequence
  Synthetic
ccatggcaaatcaagcaggcagtctcttcggcatgcagacaggagctccattctcaaaaatggactgggcagtgc

SEQ ID NO: 21769 - DNA, 75 bp, Artificial Sequence
  Synthetic
cggccattgtggtcggatgctggcaacaactaactcctgccacactgatgacggctttggtcttgctagctgtcc

SEQ ID NO: 21770 - DNA, 75 bp, Artificial Sequence
  Synthetic
actatatctacatgattccgggatggcaggctggagctgccagggccgctcagcgtaggacggcagccgggatca

SEQ ID NO: 21771 - DNA, 75 bp, Artificial Sequence
  Synthetic
tgaagaaccctgtggtagatggtcttgtggtgacagacataccaactctggaagaggttgacccactcgttgaga

SEQ ID NO: 21772 - DNA, 75 bp, Artificial Sequence
  Synthetic
aaaaattgggacaatacattctgttggccgtggcgatagcagcggctgtgctgcgacaagaccttcaaagttgga

SEQ ID NO: 21773 - DNA, 75 bp, Artificial Sequence
  Synthetic
gtgagtgcgccaccctatcagccgctgcagccgccacgctttgggaaggatccccaggaaagatttggaatgcgt

SEQ ID NO: 21774 - DNA, 75 bp, Artificial Sequence
  Synthetic
caacggcttgttcactggtgaacatcttcagaggccacacgctagcagccgtacctttcatgttcaccatactgc

SEQ ID NO: 21775 - DNA, 75 bp, Artificial Sequence
  Synthetic
ggaacactggaaatacagggaaaagaggaggtgttgagggggaaactctaggggagaaatggaaacaccttctca

SEQ ID NO: 21776 - DNA, 75 bp, Artificial Sequence
  Synthetic
atgccatggacaagtatgagttctccaggtacaaggtaaatggcatctttgaggtggatcgtgaaccagcccgta

SEQ ID NO: 21777 - DNA, 75 bp, Artificial Sequence
  Synthetic
tggccctggccaacggtcttgtgacgagtggccatgcagtttccagaggaagcgcaaaattgcgttggatggttg

SEQ ID NO: 21778 - DNA, 75 bp, Artificial Sequence
  Synthetic
aaagagctgcagtccgccctactgggagagtcattgatctggggtgtggaagaggtggttggagttactactgtg

SEQ ID NO: 21779 - DNA, 75 bp, Artificial Sequence
  Synthetic
ccaccctaaaacaggttcaagaagtacgaggctacacaaaaggaggccccggtcatgaggagccacggatggtgc

SEQ ID NO: 21780 - DNA, 75 bp, Artificial Sequence
  Synthetic
agagctatggctggaacattgtcaccttgaaaagcggagtggacgtgttccacagaccagccgaggtgggcgata

SEQ ID NO: 21781 - DNA, 75 bp, Artificial Sequence
  Synthetic
ccatcctttgtgatataggagagtcttcagcaacgccagaagtggaagaagccaggactttgaaggtcttggaga

SEQ ID NO: 21782 - DNA, 75 bp, Artificial Sequence
  Synthetic
tggtggagccgtggcttaagaacaaacctgaattctgcataaaagtgttgtgcccgtacagaccaaaagtcattg

SEQ ID NO: 21783 - DNA, 75 bp, Artificial Sequence
  Synthetic
agcgcctaagcgccttgcagagaacctatggagggggactcgtaagggtcccgctttcaaggaacagcacacatg

SEQ ID NO: 21784 - DNA, 75 bp, Artificial Sequence
  Synthetic
aaatgtactggacttctgggacggcaggaaacatcataaatgcggtcaatttgacaagcaaggtcctcctacata

SEQ ID NO: 21785 - DNA, 75 bp, Artificial Sequence
  Synthetic
gaatggaaaagaaatggataggccctaggtatgagaaggacgtcaaccttggcagtggaactagggctgtgattg

SEQ ID NO: 21786 - DNA, 75 bp, Artificial Sequence
  Synthetic
tgaaaagaaaagccccggatatggacaagatagggaacagagtgaagaggctaaaagaagagcacatagctacat

SEQ ID NO: 21787 - DNA, 75 bp, Artificial Sequence
  Synthetic
ggtgctatgatgacatgaatccctaccgcacatggaattaccatggaagctacgaggtaaaaccaactggaagcg

SEQ ID NO: 21788 - DNA, 75 bp, Artificial Sequence
  Synthetic
cctcatcaatgataaaccatgtggtgaaaatgctctcgaagccatgggataccctgaacagtgtcacttccattt

SEQ ID NO: 21789 - DNA, 75 bp, Artificial Sequence
  Synthetic
caatgacagacacaacccctttcggacaacagagagtgttcaaggaaaaggtggacacaaaagctcccgaaccac

SEQ ID NO: 21790 - DNA, 75 bp, Artificial Sequence
  Synthetic
ccaccggggtggctgaggtcatggacataatctctgattggacgtggaggctattatcaaggcagaagaaaccaa

SEQ ID NO: 21791 - DNA, 75 bp, Artificial Sequence
  Synthetic
ggctttgcaccagggatgaattcaaggcaaaggtgaacaaccatgcagcaatgggttccatctttgaggaggagc

SEQ ID NO: 21792 - DNA, 75 bp, Artificial Sequence
  Synthetic
atcaatggcagacggccaaggaagcagtggaagatccagggttctgggctctggttgacagagagagagaagctc

SEQ ID NO: 21793 - DNA, 75 bp, Artificial Sequence
  Synthetic
atttggctggacggtgtgaaacctgtgtctacaacatgatgggaaaacgggaaaagaagcttggagaatttggaa

SEQ ID NO: 21794 - DNA, 75 bp, Artificial Sequence
  Synthetic
aagcgaagggaagccgagctatctggtacatgtggctgggggccaggttccttgaattcgaagctttgggttttc

SEQ ID NO: 21795 - DNA, 75 bp, Artificial Sequence
  Synthetic
tgaatgaagatcactggctctccagggaaaacagctacgcaggagttgaggggctagggctgcagagattgggtt

SEQ ID NO: 21796 - DNA, 75 bp, Artificial Sequence
  Synthetic
acgtcttgagagacatatccagaaggcctggaggaaagatgtacgctgatgacacagccggctgggatacccgca

SEQ ID NO: 21797 - DNA, 75 bp, Artificial Sequence
  Synthetic
taacagaaaaagacttggacaatgaggcaaaaattatagaccagatggaaggtgaacacaagcagttggccaagg

SEQ ID NO: 21798 - DNA, 75 bp, Artificial Sequence
  Synthetic
ccatcatggaactcacgtacaggcacaaagtggtgaaagtcatgcgcccaggccctgggggaaaaacatacatgg

SEQ ID NO: 21799 - DNA, 75 bp, Artificial Sequence
  Synthetic
acatcatttcccgggaggaccagagaggtagtgggcaagtggtcacatatgctttgaacaccttcacaaatatga

SEQ ID NO: 21800 - DNA, 75 bp, Artificial Sequence
  Synthetic
ttgtgcaactcactcgatgtgcagaggcagaaggtgtcctgatcccgtcaatgagagaaaggaaattgacgccag

SEQ ID NO: 21801 - DNA, 75 bp, Artificial Sequence
  Synthetic
cggagcatagagctcttctcctatggttggatactgaaggagtgaaaagactgaaaaagatggccatcagtggag

SEQ ID NO: 21802 - DNA, 75 bp, Artificial Sequence
  Synthetic
atgattgtgtggtgaagggagaggatgaaagattcgccactgcactgtacttcctcaatgccatggcaaaagtga

SEQ ID NO: 21803 - DNA, 75 bp, Artificial Sequence
  Synthetic
gaaaagacattcaggaatggaaaccctccagtggttgggcagattggcaggaggtgcccttttgctcccaccact

SEQ ID NO: 21804 - DNA, 75 bp, Artificial Sequence
  Synthetic
tcaaagaactccagctgaaagatggcaggacgatagtcgtcccctgccgacaccaagatgagctagtgggaagag

SEQ ID NO: 21805 - DNA, 75 bp, Artificial Sequence
  Synthetic
ctagggtatctcctggagccgcatggaccgtcagagaatcggctgggctggccaaagcttatgcgcaaatgtgga

SEQ ID NO: 21806 - DNA, 75 bp, Artificial Sequence
  Synthetic
agttgatgtacttccacagacgcgacttacggctcatggccaatgcaatctgctcggccgtccccaaagactggg

SEQ ID NO: 21807 - DNA, 75 bp, Artificial Sequence
  Synthetic
tccccacgggcagaaccacgtggtcaatacatggaaaaggagaatggatgaccaatgaagatatgcttgaagtct

SEQ ID NO: 21808 - DNA, 75 bp, Artificial Sequence
  Synthetic
ggaacagagtgtggatcagggagaatcctcatgttgaagacaagacagaagtggcagattggaaggacgtgccat

SEQ ID NO: 21809 - DNA, 75 bp, Artificial Sequence
  Synthetic
atttgggaaaaagggaagaccaatggtgtggctccttgattggaagcagaaccagagctacttgggctgaaaaca

SEQ ID NO: 21810 - DNA, 75 bp, Artificial Sequence
  Synthetic
tctgggtggccgtaaaccaagtgagagccaaaattggaaaagaagaatattctgatcatttgagttctcagcaaa

SEQ ID NO: 21811 - DNA, 75 bp, Artificial Sequence
  Synthetic
gatttgaaaattggggagaagtgaggttctcaggagtcctgtaagctaagataaaagagaaaaagagggtttgag

SEQ ID NO: 21812 - DNA, 75 bp, Artificial Sequence
  Synthetic
tcaggccagaaatgccaccggataaaggtagacggtgctgcctgcaacctttctgcggaaggaataaccgcagtc

SEQ ID NO: 21813 - DNA, 75 bp, Artificial Sequence
  Synthetic
aataaaaccaaaaagagggagttgagaaccctttgggccgcccaggcctgggattgaaccgttgatcccaggcga

SEQ ID NO: 21814 - DNA, 75 bp, Artificial Sequence
  Synthetic
agggactagaggttagaggagacccagcctttctcaccaacccaaggcccaaccttgctgaacctttaggcaggt

SEQ ID NO: 21815 - DNA, 75 bp, Artificial Sequence
  Synthetic
aaaaggactagaggttagaggagaccccttggcaaaacagttaacgcaccaaaagaaacagcatattgacacctg

SEQ ID NO: 21816 - DNA, 75 bp, Artificial Sequence
  Synthetic
ggatagaccggagaatttgctgcctcgcaacacctcccacccggcacagaacgccgacatggtgggaggggtcgt

SEQ ID NO: 21817 - DNA, 75 bp, Artificial Sequence
  Synthetic
tttgctgcctcgcaacacctcccacccggcacagaacgccgacatggtgggaggggtcgtaagacaccagattct

SEQ ID NO: 21818 - DNA, 75 bp, Artificial Sequence
  Synthetic
atggctagaaaaccaggaaaacccggcgtaggccgggttgtcaatatgctaaagcgtactgcgaccaacgcagcc

SEQ ID NO: 21819 - DNA, 75 bp, Artificial Sequence
  Synthetic
agcccagtgaggctggcgaaaaggttgcttggagaggcattctcaggcaggggccccttgcgggtaatcctggct

SEQ ID NO: 21820 - DNA, 75 bp, Artificial Sequence
  Synthetic
gtgattgcattcttcagatttacagcaataaaaatgtctcccgctttgctcaagaagtgggggactgtggaaaaa

SEQ ID NO: 21821 - DNA, 75 bp, Artificial Sequence
  Synthetic
ggagcggcactggcaatcatgaaaagtttcaagaaagaaatcggtaacatgcttgacacagtgtcccgacggaag

SEQ ID NO: 21822 - DNA, 75 bp, Artificial Sequence
  Synthetic
acaaaaggaaaaaagaaaaggtcctctgaaagctctgccatgctgatccttatggtagcatctatggcaatggga

SEQ ID NO: 21823 - DNA, 75 bp, Artificial Sequence
  Synthetic
ctcaaggttataacaggaccagatggccccataatggcagtcaccaaacaggatgtcggaaaagctcttgaaatc

SEQ ID NO: 21824 - DNA, 75 bp, Artificial Sequence
  Synthetic
cccttccaaaacttcaataacacatgctgggtcatggccatggatgttgggcacccatgtgatgacacaatcgag

SEQ ID NO: 21825 - DNA, 75 bp, Artificial Sequence
  Synthetic
tacgaatgcccatccctagatattggagctgacccaagcgacattgactgctggtgtgatacagttcccatcaga

SEQ ID NO: 21826 - DNA, 75 bp, Artificial Sequence
  Synthetic
gtgagatatgggcgatgcaccaaaggagcttcgccgagaagatcgcggcgtagcacagcatttccccaacacacg

SEQ ID NO: 21827 - DNA, 75 bp, Artificial Sequence
  Synthetic
gaaagcactctggccaccagaagagagtcctggctcaacaccgacgttgctatgaaacatctagtgaaggttgag

SEQ ID NO: 21828 - DNA, 75 bp, Artificial Sequence
  Synthetic
acatgggcattaaggaacccaggttttgcttttgtagcgataactttgggatggatgctgggaaactcaacaagc

SEQ ID NO: 21829 - DNA, 75 bp, Artificial Sequence
  Synthetic
caaaagataattttcacactcctactcctgctggtggcgccagcctacagcatgaggtgcataggggttgagaac

SEQ ID NO: 21830 - DNA, 75 bp, Artificial Sequence
  Synthetic
agggattttgttgaaggccttagtggaggaacttgggtggatgtagtcttggaacatgggggctgtgtgacagtc

SEQ ID NO: 21831 - DNA, 75 bp, Artificial Sequence
  Synthetic
agggtggatggaaaacctactctagactttgagttggtgcaaaccaaggccacgggattggccacagtgcggtca

SEQ ID NO: 21832 - DNA, 75 bp, Artificial Sequence
  Synthetic
tactgctacctggctaaggtgagtgacatccaaatttcaacagcttgccccactgtgcaactcacagagaattcc

SEQ ID NO: 21833 - DNA, 75 bp, Artificial Sequence
  Synthetic
aaagctactgactctaattacttatgcaagaggggtgttaccaacagaggctggaacaacggatgtggattgttc

SEQ ID NO: 21834 - DNA, 75 bp, Artificial Sequence
  Synthetic
gggaagggtgatatacacacatgtgccaagtttgagtgtgaaaagaaaatcaaaggctcttcaattggacatgaa

SEQ ID NO: 21835 - DNA, 75 bp, Artificial Sequence
  Synthetic
aacctggaatatgaagtgcgagccagtatccacaattcaattggatctgacaaattcagcaatgagacggcagca

SEQ ID NO: 21836 - DNA, 75 bp, Artificial Sequence
  Synthetic
gatgaagaaccgcacacacagaagttcaagttcactccactctctccatctctggaaaagagtttcggagactat

SEQ ID NO: 21837 - DNA, 75 bp, Artificial Sequence
  Synthetic
ggaacattgggcattgattgtgagcccagatcggggctcgatttcagtcaattgtacctgataacgatggatact

SEQ ID NO: 21838 - DNA, 75 bp, Artificial Sequence
  Synthetic
aaatcttggctggtaaacagggactggtaccacgacctgcacctaccctacaccgtaggtgatggaggattgtgg

SEQ ID NO: 21839 - DNA, 75 bp, Artificial Sequence
  Synthetic
aataacagggaagctctagtggaattcatggaaccccacgccacaaaacaggaagtgctagccttagggtcacag

SEQ ID NO: 21840 - DNA, 75 bp, Artificial Sequence
  Synthetic
gaaggggctattcattcagccctagctggagccatgatcgcgaccagagagacagcaagtcctcatggtttgcta

SEQ ID NO: 21841 - DNA, 75 bp, Artificial Sequence
  Synthetic
ctgacagctggacatctcaagtgcaggatcagaatggacaagatggtcattaagggggtgacatatgcacaatgc

SEQ ID NO: 21842 - DNA, 75 bp, Artificial Sequence
  Synthetic
acagggagcttcaagatggaaaagagtccagcagacacaggacacggaacagttgtgctggacatcagttaccag

SEQ ID NO: 21843 - DNA, 75 bp, Artificial Sequence
  Synthetic
gggagcgaagctccgtgtaaagtgccaatagtcataaccccaaatcttgcagagatagaacctgttggacggctg

SEQ ID NO: 21844 - DNA, 75 bp, Artificial Sequence
  Synthetic
gtgtcagcacatccggtggtgacaggaaagaatgtgaggaccatgattgaagtggaaccaccatatggcgacagc

SEQ ID NO: 21845 - DNA, 75 bp, Artificial Sequence
  Synthetic
tatatcatcattggaacaggagacggaaagctcaaacagcactggtataagaaagggagtgtcattggaggtgcc

SEQ ID NO: 21846 - DNA, 75 bp, Artificial Sequence
  Synthetic
ttcagcacaaccatgaaaggggcgaagcggctagccatattgggagacgcggcctgggatttcggatcaattggc

SEQ ID NO: 21847 - DNA, 75 bp, Artificial Sequence
  Synthetic
ggtgtttttaactcaatgggtaaagccgtccaccaactctttggaggcgtgttcagaactctgtttggaggaatg

SEQ ID NO: 21848 - DNA, 75 bp, Artificial Sequence
  Synthetic
tcatggttatcaagaatattcatcggagttctttgcgtctggattggcatcaacgctagagaccacacgatagca

SEQ ID NO: 21849 - DNA, 75 bp, Artificial Sequence
  Synthetic
gtgtctatgctggctgtcggaggggtgttgctgtttctctcagttagtgtaaacgctgacatgggatgtgctgtg

SEQ ID NO: 21850 - DNA, 75 bp, Artificial Sequence
  Synthetic
gacatagaaagaagagagctgaaatgcggaacaggcatcttcatcatggacgacgtcgaatcctggcgggatgag

SEQ ID NO: 21851 - DNA, 75 bp, Artificial Sequence
  Synthetic
tattcattccatccaagtagcccaaagaagctcgcggcatccatagtggaagctgtggaaagcggaacatgcggt

SEQ ID NO: 21852 - DNA, 75 bp, Artificial Sequence
  Synthetic
attaggacagtcaatcgcatggagcacaaaatgtgggaaagcatagaaaatgaactcaatgcaattctggaagaa

SEQ ID NO: 21853 - DNA, 75 bp, Artificial Sequence
  Synthetic
aatgagcaagatattacagtggtagtgaaagacttggaaaacccagcaccaaaaggattcaagagactaccgcta

SEQ ID NO: 21854 - DNA, 75 bp, Artificial Sequence
  Synthetic
gtggaaaaggaactaaaatacggctggaagaagtggggggccacattcttcaaacaccctgagaggaaaaacacc

SEQ ID NO: 21855 - DNA, 75 bp, Artificial Sequence
  Synthetic
accttccttgttgatgggccatcaggaccagagtgccccaattctcaaagagcgtggaactcctttcatgttgag

SEQ ID NO: 21856 - DNA, 75 bp, Artificial Sequence
  Synthetic
gactttggctttggagtattcaaaacatcagtctggatggaactgaatgatcaggtcacagaagtctgtgataca

SEQ ID NO: 21857 - DNA, 75 bp, Artificial Sequence
  Synthetic
aagatgattggcacaggaataaagaacaataaggctgtccacagtgatcttggatactggatagaaagcaggaaa

SEQ ID NO: 21858 - DNA, 75 bp, Artificial Sequence
  Synthetic
aatcactcttgggaaatctcgagggcaagattgattgaaacaaagtcatgcatttggcctcgctcacatactctt

SEQ ID NO: 21859 - DNA, 75 bp, Artificial Sequence
  Synthetic
tggagtgatggagtggaagagactcagctgatcatcccaaaatctctgggaggaccacgctcaagacacaacatg

SEQ ID NO: 21860 - DNA, 75 bp, Artificial Sequence
  Synthetic
agaaacgggtataagactcaggtaaatggtccctggaacctcattcccctagatataaaattcgaggagtgcccc

SEQ ID NO: 21861 - DNA, 75 bp, Artificial Sequence
  Synthetic
gggacatcagtgacagtgacccaaaattgcggagggagaggaccgtcagctaggagcaccacagccagtggcaaa

SEQ ID NO: 21862 - DNA, 75 bp, Artificial Sequence
  Synthetic
atcattgcagaatggtgctgcaaggactgtgtccttccgccactgacctttaggcatggtgagacttgctggtac

SEQ ID NO: 21863 - DNA, 75 bp, Artificial Sequence
  Synthetic
ggaatggaaatcagacccatgaaagaaaaagaggaaaacctagtaaaatcgaaagtctcggctggcgatggatct

SEQ ID NO: 21864 - DNA, 75 bp, Artificial Sequence
  Synthetic
gggatcgacacattttctcttgggttgttggtggcaatgctggtcacccaggaaggactgaggaagaggtgggcc

SEQ ID NO: 21865 - DNA, 75 bp, Artificial Sequence
  Synthetic
accaggcacatagtagtggcgtccttggcaatgcttgccgcaatgattacaggcaacatcacatacatggatcta

SEQ ID NO: 21866 - DNA, 75 bp, Artificial Sequence
  Synthetic
ggcaggtatatcatcttattgggagcaacctttgcagagatgaacagcggaggcgacatcatgcacctcgctttg

SEQ ID NO: 21867 - DNA, 75 bp, Artificial Sequence
  Synthetic
gtggctgtgttcaaggtacagccaggatttctagtgggctttctcctaaagcggcgatggactccgcgagagtca

SEQ ID NO: 21868 - DNA, 75 bp, Artificial Sequence
  Synthetic
atgctcctggcgatctctgcttgctttatgcacttagtgttttcagatttccaaacagacttgacctccttggcc

SEQ ID NO: 21869 - DNA, 75 bp, Artificial Sequence
  Synthetic
cataatttctctttggcccttctggtattgcgagcagtcatacaaactgatgtaagctcagtgaccctgcctgtg

SEQ ID NO: 21870 - DNA, 75 bp, Artificial Sequence
  Synthetic
ctctccatgatggccccggcgtttcaattctccgtcctgggaaccttcagaatggctgttgccatctatgtggtg

SEQ ID NO: 21871 - DNA, 75 bp, Artificial Sequence
  Synthetic
gcaaatttgatgctgtccaggaaaaacgacgcggtaaagaaagcggctcctagcctaacagccgcaggcctttgt

SEQ ID NO: 21872 - DNA, 75 bp, Artificial Sequence
  Synthetic
catttgggcatagtaaatcccatggcagccttgggaagcctctacttgctagagagaaacaaccggagaagctgg

SEQ ID NO: 21873 - DNA, 75 bp, Artificial Sequence
  Synthetic
ccccctagtgaaatattttcagccgtaggcgttctttgcgccttggtgggtgcgctagggaatgtgcaggcgact

SEQ ID NO: 21874 - DNA, 75 bp, Artificial Sequence
  Synthetic
ccactcgctggaccaatggccgcatgtggacttcttatagccgcatacgtggtcactggaaagagcacagacatt

SEQ ID NO: 21875 - DNA, 75 bp, Artificial Sequence
  Synthetic
actattgagagagcaggcctcatttcatggagtgacgaagctgaaatcagcgggagcagccctcgagtggacgtg

SEQ ID NO: 21876 - DNA, 75 bp, Artificial Sequence
  Synthetic
gcccttgatgagaatggagatttctctttgattgacagtccaggaccttctacagaaacggtactgctaaaaact

SEQ ID NO: 21877 - DNA, 75 bp, Artificial Sequence
  Synthetic
gctttagtggctataagtggcctctttcctgtttctattccattttgcgccgccgcgtggtacttgtacaacaag

SEQ ID NO: 21878 - DNA, 75 bp, Artificial Sequence
  Synthetic
tctggaaagcgtgctggagcgctgtgggacatcccggctccaaaagaggctaagaaagggagtaccgaaaatggg

SEQ ID NO: 21879 - DNA, 75 bp, Artificial Sequence
  Synthetic
gtgtaccggatctttgcaaacagactttttggaagggtgcaagtgggagtcggagtcatgcaggatggtgtcttc

SEQ ID NO: 21880 - DNA, 75 bp, Artificial Sequence
  Synthetic
cacactatgtggcatgtcacgagaggggcggctctgagaagtggagatgggaggctggatccatattggggagat

SEQ ID NO: 21881 - DNA, 75 bp, Artificial Sequence
  Synthetic
gtacgcaaagacctcatttcctacggcggcccatggaagcttgagggaaaatgggatggaacctcagaagtgcaa

SEQ ID NO: 21882 - DNA, 75 bp, Artificial Sequence
  Synthetic
ttggtggcggtagctcccaaagagaaagtgaaaaatgtgcaaaccaccccaggagtgttcaagacaccaaatgga

SEQ ID NO: 21883 - DNA, 75 bp, Artificial Sequence
  Synthetic
gaggtgggagccatcacgctggattttccggccgggtcgtcaggatctcctatcatcaataaaaatggagaggtg

SEQ ID NO: 21884 - DNA, 75 bp, Artificial Sequence
  Synthetic
attggactttacgggaatggactgatgatgggagacgcttatgccagtgccattgcacaagctgaagtggaagac

SEQ ID NO: 21885 - DNA, 75 bp, Artificial Sequence
  Synthetic
gagcctgatacaccaaactgtctccctccagatgtaacccataagaagaaattgacagtacttgatctgcaccca

SEQ ID NO: 21886 - DNA, 75 bp, Artificial Sequence
  Synthetic
ggggcaggaaagacgaggaaagtgctgccaagactactgcaagaggccttggagaagagactccgaacagtcgtg

SEQ ID NO: 21887 - DNA, 75 bp, Artificial Sequence
  Synthetic
ctagcccctacgcgagttgtggctgcagaaatggcagaagctctgaaaggaatgcccatccgataccaaacctca

SEQ ID NO: 21888 - DNA, 75 bp, Artificial Sequence
  Synthetic
gcagtgacagccagccaccagggaaatgaaataatagatctcatgtgccatgcaactttcacctcacgtctcatg

SEQ ID NO: 21889 - DNA, 75 bp, Artificial Sequence
  Synthetic
caaccacataaggtgcctaattacaacctttacataatggatgaagctcattttacagatccagcgagcatagca

SEQ ID NO: 21890 - DNA, 75 bp, Artificial Sequence
  Synthetic
gctcgaggtttcatctcaactaaagtgagtctaggggaagccgctgcagtattcatgactgcgacgcccccagga

SEQ ID NO: 21891 - DNA, 75 bp, Artificial Sequence
  Synthetic
agtgacaaccccttcccagcatcaaatgctcccataacggacaccgaagcccagattccggacaaagcttggagc

SEQ ID NO: 21892 - DNA, 75 bp, Artificial Sequence
  Synthetic
agtggttttgactggatcaccgagtatgaaggaaagacagtgtggtttgttccaagtgtccggatgggaaatgag

SEQ ID NO: 21893 - DNA, 75 bp, Artificial Sequence
  Synthetic
atagccgcttgcctcggcaaggcaaaaaagaaagtgattcagctgagcaggaggaccttcaacacagaatatcca

SEQ ID NO: 21894 - DNA, 75 bp, Artificial Sequence
  Synthetic
aaatgcaaacaaggggactgggactttgttgtcacaacagacatctcagagatgggagccaatttcaaagccact

SEQ ID NO: 21895 - DNA, 75 bp, Artificial Sequence
  Synthetic
agggtgattgacagccggagagcaataaaaccatcaattatgagtgatcaggaggaaagagtggttctgagtggt

SEQ ID NO: 21896 - DNA, 75 bp, Artificial Sequence
  Synthetic
ccactgccaatatcacctgccagcgcagcccagcgaagggggagaattggacggaatccaaaccaactcggggat

SEQ ID NO: 21897 - DNA, 75 bp, Artificial Sequence
  Synthetic
gaatatgtgttctcaggcttgacacagagcaatgatgagggaaatgcctgctggactgaagctagaatgctcctt

SEQ ID NO: 21898 - DNA, 75 bp, Artificial Sequence
  Synthetic
gacaacatacacatgcagaatggcctcatagcgcaactctacggccctgaacaagacaaatgttttgccacggat

SEQ ID NO: 21899 - DNA, 75 bp, Artificial Sequence
  Synthetic
ggtgagttcaagctgagagaaaaggagagggcgagtttccttgagtacctaaaagcagacctacctgtgtggttg

SEQ ID NO: 21900 - DNA, 75 bp, Artificial Sequence
  Synthetic
tcatacaaagtggctagctcagggctcccataccatgacaggagatggtgctttgacggaccagataacaaccta

SEQ ID NO: 21901 - DNA, 75 bp, Artificial Sequence
  Synthetic
gtgctagaggacaatgtgccagttgaaatttggaccaggtccggagagaggaaaaaactgagaccaaggtggagt

SEQ ID NO: 21902 - DNA, 75 bp, Artificial Sequence
  Synthetic
gatgcccggatgtatgcggatcatggagccctaaattccttcaaagaatttgcggctgggaggagaacggtggca

SEQ ID NO: 21903 - DNA, 75 bp, Artificial Sequence
  Synthetic
actggcattttggaaggggttggaaaacttccggaacacctaggcgccagactcaaagattctatcgatgttctt

SEQ ID NO: 21904 - DNA, 75 bp, Artificial Sequence
  Synthetic
tatttggctttcacagctgaggcaggctctaggccacacagagaggctatgcatgagttgcccgctgccctggaa

SEQ ID NO: 21905 - DNA, 75 bp, Artificial Sequence
  Synthetic
acaatcctagtgttcgcactattgatggccttgactggaacgacttttttcttactaatgaggcacaaaggcata

SEQ ID NO: 21906 - DNA, 75 bp, Artificial Sequence
  Synthetic
aacaaaatggggtatggcatgatcgtgatgacagctgtgggtggtctcttgtggtatggaaatatccaagcacca

SEQ ID NO: 21907 - DNA, 75 bp, Artificial Sequence
  Synthetic
aagattgcaggcatcctcctgctcacctttctgctcatggtggtgctgattccagagcctgaaaaacaacgctct

SEQ ID NO: 21908 - DNA, 75 bp, Artificial Sequence
  Synthetic
atccaagacaatcagctggctttggccgtgctagggtgcctggtgtttctgggcactgtagctgcaaatgaaatg

SEQ ID NO: 21909 - DNA, 75 bp, Artificial Sequence
  Synthetic
ggatggcttgagcgcacaaaaagagacatcggaagtctcttccggaaagaagagacgaccgcccagttccaaatg

SEQ ID NO: 21910 - DNA, 75 bp, Artificial Sequence
  Synthetic
ctgtctccccctgatctcaggccagccacagcctggagtctatatgccatatcaactaccttgctaacacctctc

SEQ ID NO: 21911 - DNA, 75 bp, Artificial Sequence
  Synthetic
atacaccacatgataacaactcactatgcaaacttttccctcatggcaatggccaaccaagctggaagcttattt

SEQ ID NO: 21912 - DNA, 75 bp, Artificial Sequence
  Synthetic
ggcatgcagacaggagctcctttttcaaaagtggactgggcagtgccagccatagttgtgggatgttggcaacaa

SEQ ID NO: 21913 - DNA, 75 bp, Artificial Sequence
  Synthetic
ctaactccaacgacattactggctgcagttgttctggtggttctccactatgtctacatgataccaggttggcag

SEQ ID NO: 21914 - DNA, 75 bp, Artificial Sequence
  Synthetic
gcgggggctgctagagctgctcaacgacgaaccgcggctggcataatgaaaaatcctgtggttgacggaatagtt

SEQ ID NO: 21915 - DNA, 75 bp, Artificial Sequence
  Synthetic
gtgacagacattccccacttggaagacgtggacccactggtagaaaagaagcttggccagtacattcttctactg

SEQ ID NO: 21916 - DNA, 75 bp, Artificial Sequence
  Synthetic
atagccttcgcagctgcaatcctcaaacaagacctacagagttggagtgaatgcgccacattgtcggcggctgca

SEQ ID NO: 21917 - DNA, 75 bp, Artificial Sequence
  Synthetic
gctgccacattatgggaaggaactccggggaaaatttggaacgcctccacagcatgctccctagttaacatcttt

SEQ ID NO: 21918 - DNA, 75 bp, Artificial Sequence
  Synthetic
agaggacacacgctagcggcggtccccttcatgtacactatactaaggaacacatcaactgcaggaaagagagga

SEQ ID NO: 21919 - DNA, 75 bp, Artificial Sequence
  Synthetic
ggagtggaaggagagaccctaggagaaaaatggaaacacatgcttaattccatggacaagtatgaattctcgcgg

SEQ ID NO: 21920 - DNA, 75 bp, Artificial Sequence
  Synthetic
tacaaggtcaacggcatctttgaagttgacagagaaccagcgagaatggctttggcgaatggacttgtgacagga

SEQ ID NO: 21921 - DNA, 75 bp, Artificial Sequence
  Synthetic
gggcatgctgtgtccagaggaagtgcaaaactgcggtggatggtagagagaggcgcagtcagacctacagggaga

SEQ ID NO: 21922 - DNA, 75 bp, Artificial Sequence
  Synthetic
gtcattgaccttgggtgtgggagaggtggttggagctattactgtgccacactgaaacaggtccaggaagtgaga

SEQ ID NO: 21923 - DNA, 75 bp, Artificial Sequence
  Synthetic
gggttcacaaaaggaggtgaagggcatgaagaacctaaaatggtgcaaagctatggctggaatatcgtcactctt

SEQ ID NO: 21924 - DNA, 75 bp, Artificial Sequence
  Synthetic
aagagtggagtagacgtcttccacagaccagcagaaatgggggacacaatcctctgtgacataggggagtcatca

SEQ ID NO: 21925 - DNA, 75 bp, Artificial Sequence
  Synthetic
gcgacccccgaaatagaggaggcacgcactctgagagttctggacatgatcgaaccctggctaaagaacaagcct

SEQ ID NO: 21926 - DNA, 75 bp, Artificial Sequence
  Synthetic
gaattctgcatcaaggtcctgtgcccctacagacccaaggtgatcgaaaagctcagtgccctgcaaaggcagtat

SEQ ID NO: 21927 - DNA, 75 bp, Artificial Sequence
  Synthetic
ggggggggtttgctcagagtcccactctcaagaaacagcacgcatgaaatgtactggacatcaggaacagctgga

SEQ ID NO: 21928 - DNA, 75 bp, Artificial Sequence
  Synthetic
aacataatcaatgcagtgaacctcacaagcaaggtgctgatccacagaatggagaagaagtgggttggtcccagg

SEQ ID NO: 21929 - DNA, 75 bp, Artificial Sequence
  Synthetic
tatgagaaagacgtaaacctagggagcggcaccagagcagtcacggtaaagaggaaggccccagacatggaaaaa

SEQ ID NO: 21930 - DNA, 75 bp, Artificial Sequence
  Synthetic
ataggtcccaggataaagaaattgagagaagaacattcgtcatcttggtgttatgatgagatgaacccatatagg

SEQ ID NO: 21931 - DNA, 75 bp, Artificial Sequence
  Synthetic
acttggaactatcatggaagctatgaagtgaaaccaacgggaagtgcctcatccatgataaaccaagtggttaag

SEQ ID NO: 21932 - DNA, 75 bp, Artificial Sequence
  Synthetic
atggtctccaaaccatgggacgccctcaacagcgtgacatccatctccatgactgacaccaccccttttgggcag

SEQ ID NO: 21933 - DNA, 75 bp, Artificial Sequence
  Synthetic
cagagagtattcaaagagaaagtggacacaaaagctccagaaccacctcggggagtagctgaagccatggacatg

SEQ ID NO: 21934 - DNA, 75 bp, Artificial Sequence
  Synthetic
gtggctgattgggtgtggatgatattgtccaggaaaaagaaacccagactttgcactagagaagaattcaaggca

SEQ ID NO: 21935 - DNA, 75 bp, Artificial Sequence
  Synthetic
aaggtcaatggtcacgcagctatgggtgccgtttttgaggaagaacagcagtggcagacggccagagaggctgtg

SEQ ID NO: 21936 - DNA, 75 bp, Artificial Sequence
  Synthetic
gaagaccctgaattctgggacctagtggacaaggagagagcgttacacctggaggggcgctgtgagacttgcgtt

SEQ ID NO: 21937 - DNA, 75 bp, Artificial Sequence
  Synthetic
tacaacatgatgggaaagagagagaaaaaactgggtgagtttggaaaggcaaaaggcagccgtgccatttggtac

SEQ ID NO: 21938 - DNA, 75 bp, Artificial Sequence
  Synthetic
atgtggttgggggccagattcttggaatttgaagctcttgggtttctaaatgaggaccactggctgtccagggag

SEQ ID NO: 21939 - DNA, 75 bp, Artificial Sequence
  Synthetic
aacagctatgctggagtagagggcttgggtctccaaagattgggttatgtgctgagggacatctcataccgacct

SEQ ID NO: 21940 - DNA, 75 bp, Artificial Sequence
  Synthetic
ggaggaaagatgtacgctgacgacacagctggctgggacaccaggattacagaaaaggacctggagaatgaggca

SEQ ID NO: 21941 - DNA, 75 bp, Artificial Sequence
  Synthetic
aaaatcacagaaaaaatggaaggagagcacaaaaaactagccaaggccattattgaactgacctataaacacaaa

SEQ ID NO: 21942 - DNA, 75 bp, Artificial Sequence
  Synthetic
gtggtcaaggtcatgaggcctgggcctgggggaaaaaccttcatggatgtgatctctcgcgaagaccagagggga

SEQ ID NO: 21943 - DNA, 75 bp, Artificial Sequence
  Synthetic
agtggtcaagtagttacctatgctctcaacacctacaccaacatggtggcacagctcattaggtgcgctgaggct

SEQ ID NO: 21944 - DNA, 75 bp, Artificial Sequence
  Synthetic
gaaggtgtgctcacaccggatatgcgtgaaagatccctcacaaagcaggaaagatacgccctaaccctttggttg

SEQ ID NO: 21945 - DNA, 75 bp, Artificial Sequence
  Synthetic
gacatggagggagtcaaacgcctcaagaagatggccatcagtggagatgattgtgtggtgaagagtgaggatgag

SEQ ID NO: 21946 - DNA, 75 bp, Artificial Sequence
  Synthetic
agatttgccacagccctgtatttcctcaacgcaatggccaaggtaaggaaggatattcaggaatggaaaccatcc

SEQ ID NO: 21947 - DNA, 75 bp, Artificial Sequence
  Synthetic
agtggctggctagattggcaggaagtccccttttgttcccatcacttcaaagagctgcagctgaaagatgggcgg

SEQ ID NO: 21948 - DNA, 75 bp, Artificial Sequence
  Synthetic
agcatcgtggtgccttgtagacaccaagatgagttggtcgggagagccagagtgtcaccaggagctgcttgggga

SEQ ID NO: 21949 - DNA, 75 bp, Artificial Sequence
  Synthetic
gtgagggaatcggcaggcttggcaaaggcttatgcacaaatgtggaaactaatgtacttccacagaagagacttg

SEQ ID NO: 21950 - DNA, 75 bp, Artificial Sequence
  Synthetic
agactaatggccaacgccatctgttcagccgtcccaaaagactgggttccgaccggaaggacgacctggtccata

SEQ ID NO: 21951 - DNA, 75 bp, Artificial Sequence
  Synthetic
catggcaagggagagtggatgacaaatgaggacatgctggaagtgtggaacagagtgtggatcagagagaatccg

SEQ ID NO: 21952 - DNA, 75 bp, Artificial Sequence
  Synthetic
tacatgacagacaagacagaagtccatgactggaaagaaattccctatctcggaaagcgggaagaccagtggtgt

SEQ ID NO: 21953 - DNA, 75 bp, Artificial Sequence
  Synthetic
ggttccttgattgggagtagagcaagagctacctgggctgaaaacatatgggtagcggtcaaccaagtaagagcc

SEQ ID NO: 21954 - DNA, 75 bp, Artificial Sequence
  Synthetic
aagatagggaaagaagaatacttggattacctcagctcacagcagcgctatgaggtttggcgtgagccaagcttt

SEQ ID NO: 21955 - DNA, 75 bp, Artificial Sequence
  Synthetic
gaatacttggattacctcagctcacagcagcgctatgaggtttggcgtgagccaagcttttcaggagtgctgtaa

SEQ ID NO: 21956 - DNA, 75 bp, Artificial Sequence
  Synthetic
acacaaagacggctctgtgagatgcatcagataactgttgttagtggacccactgaagtaagtacttgtttcgga

SEQ ID NO: 21957 - DNA, 75 bp, Artificial Sequence
  Synthetic
tctttgcatccgtttcaaagcctaaagcctgtcatggctaacgcactaggagtattagaggggaagatgttctgt

SEQ ID NO: 21958 - DNA, 75 bp, Artificial Sequence
  Synthetic
tctattgggggcagatcattagaagaggatgatgaaggggtccttgctgttgtgcagggcctccaagacagtcag

SEQ ID NO: 21959 - DNA, 75 bp, Artificial Sequence
  Synthetic
caagaggaggagataagctgtcatggcactcccaaaggaaagctagtgaagtataaaagacatcctaggaaagct

SEQ ID NO: 21960 - DNA, 75 bp, Artificial Sequence
  Synthetic
tcaggtaaaaaaggagcagtggactgtgtgtcaggaaaagaactgaaacctcaaaaaaagaggggagatttagca

SEQ ID NO: 21961 - DNA, 75 bp, Artificial Sequence
  Synthetic
cacatttcggaacacttccaagctgatgaagtgaggagctctagtgtgaatatttcaactacactgaaaactata

SEQ ID NO: 21962 - DNA, 75 bp, Artificial Sequence
  Synthetic
ttggtggctgcactcttaacttctgctttggttaatggagacccgcacattgataataggccaggaaaaggtgat

SEQ ID NO: 21963 - DNA, 75 bp, Artificial Sequence
  Synthetic
tatgcgagggatgcttctagatcaggaaataactgctctccccttaagtatggtgcagcttgcaaggcatggact

SEQ ID NO: 21964 - DNA, 75 bp, Artificial Sequence
  Synthetic
tatcagaaggatgtgtccacgtatcctttcttcaacaccttcccttacaagtattccttgatagaagccctctca

SEQ ID NO: 21965 - DNA, 75 bp, Artificial Sequence
  Synthetic
gaagggttcattcagatggatgaacaaaatacatgcaagttgacaacaacaagcccagtgactagtgagagctgc

SEQ ID NO: 21966 - DNA, 75 bp, Artificial Sequence
  Synthetic
ctaaagtcattgcggggaataaagcacacatgcccaccaggatttagatcagccctatttgcacattcaactggg

SEQ ID NO: 21967 - DNA, 75 bp, Artificial Sequence
  Synthetic
aaagttagagggatcatctgtgacaatcagtatcaagtgactccagactgcaagttctgtcagtcaacagagaac

SEQ ID NO: 21968 - DNA, 75 bp, Artificial Sequence
  Synthetic
aatgcagaggttaaaaatgaaattgtgattcaagacattgtatgtcaacaaaatggaactgaatacaatggacct

SEQ ID NO: 21969 - DNA, 75 bp, Artificial Sequence
  Synthetic
atcatcaaaatccctggttactgtggcattgaagatgtcaagtacagagattgctctgacaaagatgtaagcttt

SEQ ID NO: 21970 - DNA, 75 bp, Artificial Sequence
  Synthetic
gagaaagtggcttttgccctaatgaagaacaagaaattgtatttaccatccatggtgctaaagtatgtagataca

SEQ ID NO: 21971 - DNA, 75 bp, Artificial Sequence
  Synthetic
gtttcagctgatcactttagatgttttagacacaagaaagctcatggagtaacaggcagcaacacagatgcgact

SEQ ID NO: 21972 - DNA, 75 bp, Artificial Sequence
  Synthetic
gattatgtcagagttaaaccgagggagtgcaagcagttagactctagtaagacaaccaaatgtacaggagatgaa

SEQ ID NO: 21973 - DNA, 75 bp, Artificial Sequence
  Synthetic
gtcttttgcagttattataattgtgataaagaacgttctgatgctttctgctttcatgcaaatggctctggaata

SEQ ID NO: 21974 - DNA, 75 bp, Artificial Sequence
  Synthetic
attcaagtccagtatgggggaagctggctgcagccctcatgtgtagggtttgaaactgtcatggtaactaagccc

SEQ ID NO: 21975 - DNA, 75 bp, Artificial Sequence
  Synthetic
agattgtcgcttccattatctgcaaatttgaactgcccttcttgtgttgcgaagtgtcatcagaattccttggaa

SEQ ID NO: 21976 - DNA, 75 bp, Artificial Sequence
  Synthetic
ataaactccaatggatttctgatcacatcagctattgcttgttctcatggagagtgcaagacaaaaactcaaaaa

SEQ ID NO: 21977 - DNA, 75 bp, Artificial Sequence
  Synthetic
ccaagacacagcattataatgcagaagccatcctctttgaagatatctggaggagaagtaggagtacatttgtct

SEQ ID NO: 21978 - DNA, 75 bp, Artificial Sequence
  Synthetic
acagaaggagaagagccctcatataagctgagcattcactgtgacccaatcaatcaatgtgatgcatattcctgc

SEQ ID NO: 21979 - DNA, 75 bp, Artificial Sequence
  Synthetic
actttctgctgggagaatgttctcaacttccactgccataccctaatatctagttttgtgttggctttgatgata

SEQ ID NO: 21980 - DNA, 75 bp, Artificial Sequence
  Synthetic
ggctcagtggcctcctgtgccttggctataatggtcaaaatatcaaagggcaccaaaagtgtaattctaaagagc

SEQ ID NO: 21981 - DNA, 75 bp, Artificial Sequence
  Synthetic
agaaatcctgtactgtgggtcattaagctggttaaatggctctggctccagatctggaaagccttaaacaaagga

SEQ ID NO: 21982 - DNA, 75 bp, Artificial Sequence
  Synthetic
atgacgaccctatcaaggaaaataaatgatcaaacagatttagaagttggctccaatcaaagtttcaagaatggc

SEQ ID NO: 21983 - DNA, 75 bp, Artificial Sequence
  Synthetic
ataccactgagagaagtggtcgttcagaaaagaactggaggaacacgaattaagccagtgaactactatctctac

SEQ ID NO: 21984 - DNA, 75 bp, Artificial Sequence
  Synthetic
ggatcaacaattgtcctaggcttgattacaggttcatttagctgcacagaaaatctgattgcttcctctaaaata

SEQ ID NO: 21985 - DNA, 75 bp, Artificial Sequence
  Synthetic
agttcttgctttattgagtcagggcgacatgtgtgtaaactgtctggggtggttaatttgagagtaggaacaata

SEQ ID NO: 21986 - DNA, 75 bp, Artificial Sequence
  Synthetic
gggtctgagtcatgcttaattgtgaaaggacccctagatggtcaaacacaagcactcaagattaggactaaatct

SEQ ID NO: 21987 - DNA, 75 bp, Artificial Sequence
  Synthetic
agtgaactagtctgtcaagaggggcaatctttctggactaatcattttacaccaaagtgttactcttcaagaaga

SEQ ID NO: 21988 - DNA, 75 bp, Artificial Sequence
  Synthetic
tgtcatctggttggagaatgccaagcctcaaactgcttagagtggaatgcttccactgtgtctcaagagtttaga

SEQ ID NO: 21989 - DNA, 75 bp, Artificial Sequence
  Synthetic
tcacagtatgagcctggcatgattgttgaaaatgtctgctttgaacaatgcggaggcattggttgctcttgtttc

SEQ ID NO: 21990 - DNA, 75 bp, Artificial Sequence
  Synthetic
aatgtgaacccctcctgcctatttgggatgactattctcaaacccacttatgacaaggctataaaagtttttcag

SEQ ID NO: 21991 - DNA, 75 bp, Artificial Sequence
  Synthetic
tgtgcctcctggactcacagaattactttggagtttgaaggacctggaatcacggcaaaacaagtgtctctaact

SEQ ID NO: 21992 - DNA, 75 bp, Artificial Sequence
  Synthetic
tctatgtcaacacaagtagctgaatggggaagcataactctatctgttgatgctgattccactatagataaccca

SEQ ID NO: 21993 - DNA, 75 bp, Artificial Sequence
  Synthetic
aacattagcttcttgaaaacaagagaaggggagtatgctcttatagaagagtcaataaccacttcaccacaaaaa

SEQ ID NO: 21994 - DNA, 75 bp, Artificial Sequence
  Synthetic
ggaagactgggagaaattcgctgccagacagaacaacaagccgcaattggttctccctcttgcctacaggcagat

SEQ ID NO: 21995 - DNA, 75 bp, Artificial Sequence
  Synthetic
aagctagttgattatagacctcaatatgatacactggagtgtatatctaagctaattgatcccagagcaatacta

SEQ ID NO: 21996 - DNA, 75 bp, Artificial Sequence
  Synthetic
aagcgaaatgggcttccacagtctagagggaagtatctctataccccatccttaggctcagatacagttcaagct

SEQ ID NO: 21997 - DNA, 75 bp, Artificial Sequence
  Synthetic
gtatctagaaacaccattgaagcaactatgaccttaaccctagacaactatgaggtgtctttcttgtctgaaaaa

SEQ ID NO: 21998 - DNA, 75 bp, Artificial Sequence
  Synthetic
acagaatgcctagcatcctttgttaacatatcaggctgctactcctgtcatagcggagctagtatttgctttaaa

SEQ ID NO: 21999 - DNA, 75 bp, Artificial Sequence
  Synthetic
gtaaccagcaagactcctgcatccatctacatcagagatgagaaagaaactaagattataagcaagagtatcaca

SEQ ID NO: 22000 - DNA, 75 bp, Artificial Sequence
  Synthetic
gcaggagagaaagttatttgctcagtgttgcactattctaagcccattgttgatgaaatttttgaatacacctgt

SEQ ID NO: 22001 - DNA, 75 bp, Artificial Sequence
  Synthetic
ggttcagaatggaagaagattcaagtccatggaagtttgatcttactgtcattgatagatgatcataaagaaggt

SEQ ID NO: 22002 - DNA, 75 bp, Artificial Sequence
  Synthetic
ggttctaccattgttgttggtccctcttcctctagtttctcagttggagactggaccacaggtcttttgtcctgg

SEQ ID NO: 22003 - DNA, 75 bp, Artificial Sequence
  Synthetic
tttggtgggcctatcaaaactctaaccctcttaataatttatgttgttgcaacaattattgtaatagccttggtt

SEQ ID NO: 22004 - DNA, 75 bp, Artificial Sequence
  Synthetic
gtggcgttaatcaagcttgcattgaagactatgattttaaagaaaaatgtttaatgtgccacaacctagacaaaa

SEQ ID NO: 22005 - DNA, 75 bp, Artificial Sequence
  Synthetic
tctactcaatcaatccgctaagtctcaacatgtgatgaaataaatccactcaatcagacaactggactaatcaag

SEQ ID NO: 22006 - DNA, 75 bp, Artificial Sequence
  Synthetic
tgattagaaagattagaaaataggagaataaaatataaaataataataaaataaacaaaaatgatcactaaataa

SEQ ID NO: 22007 - DNA, 75 bp, Artificial Sequence
  Synthetic
aattcttgtaatgcaaattgatgaattcaaacctaaattataaatattcaaaaacccaataaaataaagcataaa

SEQ ID NO: 22008 - DNA, 75 bp, Artificial Sequence
  Synthetic
attattataatccattttaactaaatctggtagctctggctaccaggcagctgcaaccttattgtagaagactct

SEQ ID NO: 22009 - DNA, 75 bp, Artificial Sequence
  Synthetic
catgtctagccttagacattaccaaaccatttctatctcctcttgatatataaagaagcttatggttttcatgat

SEQ ID NO: 22010 - DNA, 75 bp, Artificial Sequence
  Synthetic
cctcttgatatataaagaagcttatggttttcatgattgttattaagggtttgaaatcagagccggtctttgtgt

SEQ ID NO: 22011 - DNA, 75 bp, Artificial Sequence
  Synthetic
acacaaagaccccctgaggaaatactaaatcagaaagttttaaatatggcttctccatataattacattcatgat

SEQ ID NO: 22012 - DNA, 75 bp, Artificial Sequence
  Synthetic
ttagtgaccccaaactacaatggaccaatacctggagaggttgttgtttcatttgagcctgttaactcatatgtg

SEQ ID NO: 22013 - DNA, 75 bp, Artificial Sequence
  Synthetic
aacaatcctgtctgtgtatatgaggaccttgagtttgagatatcaggcatgggtctgtgcactatgacctctgaa

SEQ ID NO: 22014 - DNA, 75 bp, Artificial Sequence
  Synthetic
tcactttatgactttttggactcaggattgatgccctggagatggggcaaaggcatgtttgaatcaaggctaact

SEQ ID NO: 22015 - DNA, 75 bp, Artificial Sequence
  Synthetic
gcaatggagactcctttgtttgattctttcttgaagcagattccaatgattccaaccacccagctcttctctgtt

SEQ ID NO: 22016 - DNA, 75 bp, Artificial Sequence
  Synthetic
ggaagagaccctttaagagcagcactgtcttggccaacaggcagatgctcactgagattcttcagacagcaatgg

SEQ ID NO: 22017 - DNA, 75 bp, Artificial Sequence
  Synthetic
ggctcagacgctatgtcttaccaatccaatagaaaactgagagctagattgctgttccagtctactcagtcatct

SEQ ID NO: 22018 - DNA, 75 bp, Artificial Sequence
  Synthetic
gacttggaaactgcaattataactctagctaaagacataagaggcatgtcttccattcttgattttcctctaaat

SEQ ID NO: 22019 - DNA, 75 bp, Artificial Sequence
  Synthetic
ctgattcctggatttgatctactgaaatgtgtgtccattttgcagtttataagggctctgagaagctatccagag

SEQ ID NO: 22020 - DNA, 75 bp, Artificial Sequence
  Synthetic
acagaagctgagagacagtccaatggcctcagggatgatctggatatattccttggttctgctcgagaagcactc

SEQ ID NO: 22021 - DNA, 75 bp, Artificial Sequence
  Synthetic
tctagagacttccctgctttgataccagctattacccctgaaagtgatgactctctttgggactctgggtcctct

SEQ ID NO: 22022 - DNA, 75 bp, Artificial Sequence
  Synthetic
tgtgaggatgatgttgatgtgtaagattgccactgccccacccctcctcccgccctaatttaatacttacaatat

SEQ ID NO: 22023 - DNA, 75 bp, Artificial Sequence
  Synthetic
gattatgaaacttatcctaaatgattagtaaacttaaaatcaaacttatcttaatcctaaaaccccaaacccaaa

SEQ ID NO: 22024 - DNA, 75 bp, Artificial Sequence
  Synthetic
ccctcccttaaccctaaccctcaccccaccccaagggcagcaatgatgttgacattgctctcacatggagttgta

SEQ ID NO: 22025 - DNA, 75 bp, Artificial Sequence
  Synthetic
gatacctgcagcatcaagaactgccttagtaggctgaagattcatgtcaatcaagcccattgtttgcaaaatctg

SEQ ID NO: 22026 - DNA, 75 bp, Artificial Sequence
  Synthetic
cctcttctgtgctggagagaaaaagttgctagagtatgcagcttggagagcagaagagaaagactgagccacctc

SEQ ID NO: 22027 - DNA, 75 bp, Artificial Sequence
  Synthetic
ttgcttgctctttgatctcagaggaggatttattaatcttgagaaggtgtcaagatagaggctgtgtgcctggag

SEQ ID NO: 22028 - DNA, 75 bp, Artificial Sequence
  Synthetic
gagagctccaaagcaagcatcacctagacctgggtctaggattcctcctgcagcagagtgcatcagggcgcgtgg

SEQ ID NO: 22029 - DNA, 75 bp, Artificial Sequence
  Synthetic
atagttgtgagacagtgaatccatggtggcaccagtgactgggagcttgttttcaagaactctgagtgcctgaac

SEQ ID NO: 22030 - DNA, 75 bp, Artificial Sequence
  Synthetic
tgtccagggggctagaactgcagccactcttgagagtgtcagatctcgcgctcctgggctggcttctttgagctt

SEQ ID NO: 22031 - DNA, 75 bp, Artificial Sequence
  Synthetic
gtatttatcaacaaggtacttgagctttgtctttccctcttctcccatacggtccatcatttttttaattttgtt

SEQ ID NO: 22032 - DNA, 75 bp, Artificial Sequence
  Synthetic
gccacgagtgataccaatgacaatcatcattttggcatcttccttccagttgttgcctcctctctcaataatcag

SEQ ID NO: 22033 - DNA, 75 bp, Artificial Sequence
  Synthetic
cttcataattgcatttggatcaaatccattgaagctgaactcctcagctagagctatcagctcagatgcatcaat

SEQ ID NO: 22034 - DNA, 75 bp, Artificial Sequence
  Synthetic
attgcatctccagcaaagtcaatagcaatcttggcgtagttatccattttttaactctttcaggggtctttgtgt

SEQ ID NO: 22035 - DNA, 75 bp, Artificial Sequence
  Synthetic
acacaaaggcgccaagaatgaatcaattgctatcaaaacaaacctcaccaagagtgggttttttctgtaaagcta

SEQ ID NO: 22036 - DNA, 75 bp, Artificial Sequence
  Synthetic
taggacaccatgactattttgtgggaaatgttgtcctacccaatttccaagtcaggagagtgatggatgggatag

SEQ ID NO: 22037 - DNA, 75 bp, Artificial Sequence
  Synthetic
agattgatttgaatctagatgacttggacacagcatctgatctgggctcttccttaaggccttctttaacagtga

SEQ ID NO: 22038 - DNA, 75 bp, Artificial Sequence
  Synthetic
ggtctaacaatgtcccaaatttcatacatgactttacatttggtcatttggcagacaccactgatagagcctttt

SEQ ID NO: 22039 - DNA, 75 bp, Artificial Sequence
  Synthetic
cttctgtgttccaagttgtgaatgatggctttgatgatctgacaccagatgttattgttaaaactccttccggca

SEQ ID NO: 22040 - DNA, 75 bp, Artificial Sequence
  Synthetic
gcttccatgttgtggagtttacaacctttagaggacgacaagaggaagctagatttgccactcaaaacaaaataa

SEQ ID NO: 22041 - DNA, 75 bp, Artificial Sequence
  Synthetic
caaaatatgaattagcttgtagaaacagatcagttcaaggcccagtgtcattgcacactattggggtgcatagag

SEQ ID NO: 22042 - DNA, 75 bp, Artificial Sequence
  Synthetic
gaggcctatggaccaacatgaaaattgaccaaaaagaggttgaagagctttgctttagatttagactatcgctag

SEQ ID NO: 22043 - DNA, 75 bp, Artificial Sequence
  Synthetic
ctattgaagcagaaattaaattgatctgccctgatttaagggaggttgacgaagagtattcaaaattggagaggg

SEQ ID NO: 22044 - DNA, 75 bp, Artificial Sequence
  Synthetic
aaatattagggattgtttcagggattaaaattgactgggatgtaactcagtcagttttcccttcattcaagagag

SEQ ID NO: 22045 - DNA, 75 bp, Artificial Sequence
  Synthetic
aattgtttagaagattctaccaatctgagcctgatcaagagtatcttcaatccataattgataaagtcactagaa

SEQ ID NO: 22046 - DNA, 75 bp, Artificial Sequence
  Synthetic
agtctcaagatgatctcctaaaatcatctttcattaatctaaccaacactctacctgagaggttgatgagcaacc

SEQ ID NO: 22047 - DNA, 75 bp, Artificial Sequence
  Synthetic
tccaagaatgcgagaatgcaattactgactttattgacaatcatgaatcaagagataatttaaggccagcaaact

SEQ ID NO: 22048 - DNA, 75 bp, Artificial Sequence
  Synthetic
ggaggaaggggactgtcctgtttcccccttgggtgtttagagaatcagatgaaggaaagagcttaactcctctaa

SEQ ID NO: 22049 - DNA, 75 bp, Artificial Sequence
  Synthetic
aggatctaaatgtagaaggagaccatcctatgtgtagaatatgggaaagagtcaggctatcagctcaattagaag

SEQ ID NO: 22050 - DNA, 75 bp, Artificial Sequence
  Synthetic
aaattgaaagaatggatgatgatcctgagagtgaattagaatttgcactatctggagagagaactagagatgatg

SEQ ID NO: 22051 - DNA, 75 bp, Artificial Sequence
  Synthetic
agaggagcaagtatcatagagtgagggttgatttggacttggaagaaaaggagtttgtggctatgcttggtatta

SEQ ID NO: 22052 - DNA, 75 bp, Artificial Sequence
  Synthetic
atgggaaagcctataaggactggtcttctattaaggataatagagaaaagagtaaattaatattttcaatttacc

SEQ ID NO: 22053 - DNA, 75 bp, Artificial Sequence
  Synthetic
atgatacaacaccggttgaagaatttttatacacagattcatctttagacatgactccagaagatgatttatacg

SEQ ID NO: 22054 - DNA, 75 bp, Artificial Sequence
  Synthetic
ggccttaccttgaggatattgagctgagattacaagctcaaaagattcaccagccaactctatctaggaaaggct

SEQ ID NO: 22055 - DNA, 75 bp, Artificial Sequence
  Synthetic
taaacgagtttgtagaatgtcatcaagggattctgaaaactcccttaggatcttggtgtcaatttgtgaatgttg

SEQ ID NO: 22056 - DNA, 75 bp, Artificial Sequence
  Synthetic
taggctcggaattatcagcctcagttaaacaacatgtcaagcctagtagttttgtggtgaaaaggttgttaaatt

SEQ ID NO: 22057 - DNA, 75 bp, Artificial Sequence
  Synthetic
ctcctgtgtaccttttaattaaaccaacctcttccaaaggtcacatatttgtgtcctttgccatagacaggagtt

SEQ ID NO: 22058 - DNA, 75 bp, Artificial Sequence
  Synthetic
actatataagagatctgctgggaagttcatgttttcggacctactatgatgcaggagatttacttgtcactgatt

SEQ ID NO: 22059 - DNA, 75 bp, Artificial Sequence
  Synthetic
ttgtatctttcaaactaagtaagttgacaaatttgtgtaaaacatcagctttgtatgaatcagctctctgctttt

SEQ ID NO: 22060 - DNA, 75 bp, Artificial Sequence
  Synthetic
ggaatgagtgttatggtaagaaggtctggctatctcatgacccttctcatataacaacaaacacaaacaaggaca

SEQ ID NO: 22061 - DNA, 75 bp, Artificial Sequence
  Synthetic
ttcagtacatggtaaaattgtctctcttaactttgatggaagacaaagctacaactgaagagttgcagactctat

SEQ ID NO: 22062 - DNA, 75 bp, Artificial Sequence
  Synthetic
ctagatatatagttatggagggctttgtctctcaaccagaactgccaaaacctcaaaaaatgctctcaaagttgc

SEQ ID NO: 22063 - DNA, 75 bp, Artificial Sequence
  Synthetic
ccacaaaattaaggtcagagttgcaggttttcctcataaatagactcttctccgcaatgaagagaattagtcaga

SEQ ID NO: 22064 - DNA, 75 bp, Artificial Sequence
  Synthetic
gtccttttaatcttaagaggggtgaaaactctttatcctggtctggtctcttcaatccactgtctgggagagata

SEQ ID NO: 22065 - DNA, 75 bp, Artificial Sequence
  Synthetic
caacagaaattcaacccataattaatgcatgttataatggttatttcaaaaataaagaagaagagacagagcctt

SEQ ID NO: 22066 - DNA, 75 bp, Artificial Sequence
  Synthetic
ctgctttatcaggcatgtataagaaaataatagagcttgagcatttaagaccagagacagacagatatctgggct

SEQ ID NO: 22067 - DNA, 75 bp, Artificial Sequence
  Synthetic
gggatgatccacaagatcctaaaatgcatgaatttagtagaagttatctaaaagaagtctgtaatcatggaaaga

SEQ ID NO: 22068 - DNA, 75 bp, Artificial Sequence
  Synthetic
atttgctccaaaaactatatggaaagaatgtattagaacaaatagaccaagatattagaagagaagtcggatctt

SEQ ID NO: 22069 - DNA, 75 bp, Artificial Sequence
  Synthetic
tgacccttgagaggctggcaacacttaaagcaaccagcaacttctcagaggattggtacatttacaaggatgtta

SEQ ID NO: 22070 - DNA, 75 bp, Artificial Sequence
  Synthetic
aggataagaattatactcgtgataaagttctagttaaaatgacagagtatgctaagagaggcaagactttagcta

SEQ ID NO: 22071 - DNA, 75 bp, Artificial Sequence
  Synthetic
ttgaaatgtttgatgaatgtatgagtagcatagaagagaagggctgtatgcatatctgtctattcaagaagcagc

SEQ ID NO: 22072 - DNA, 75 bp, Artificial Sequence
  Synthetic
aacatggtggtttgagggagatttatgtcatggctgcagaagaaagaatagttcaatctatagtagagtccatct

SEQ ID NO: 22073 - DNA, 75 bp, Artificial Sequence
  Synthetic
ccaaatgcattggcagattcttcccttcagacactttgtgcaatcctagtaataagacaaaaattccagagagtc

SEQ ID NO: 22074 - DNA, 75 bp, Artificial Sequence
  Synthetic
atggtattagagcaagaaagcactgcaaaggctcagtttggacaactgcaacatcagatgatgcacggaagtgga

SEQ ID NO: 22075 - DNA, 75 bp, Artificial Sequence
  Synthetic
atcaaggtcactttgtcacaaagtttgctctaatgctatgcgaattcacaaattcaatgtggtggccgataatta

SEQ ID NO: 22076 - DNA, 75 bp, Artificial Sequence
  Synthetic
tacgaggttgctctatgtttactaagaaaagaatgatgatgaatttagatttcatgaatataatagacagcaaaa

SEQ ID NO: 22077 - DNA, 75 bp, Artificial Sequence
  Synthetic
gggagttagaattggaagatgattttgttatgacactatacaatgcttatcatggaaatcttacagttccatggc

SEQ ID NO: 22078 - DNA, 75 bp, Artificial Sequence
  Synthetic
tagaagctggtaagacttatctagaaacttccactggaatgatgcagggcatacttcacttcacctcatccctac

SEQ ID NO: 22079 - DNA, 75 bp, Artificial Sequence
  Synthetic
tacattctttgcatcaagaatatattcgatctctatctttcaaagtcttcaattccaaagttaatcctgaaatga

SEQ ID NO: 22080 - DNA, 75 bp, Artificial Sequence
  Synthetic
gtctatctgttgtttgtgacatgatgcaaggatcagatgatagcagtatgctgataagcttcccaagctcatcag

SEQ ID NO: 22081 - DNA, 75 bp, Artificial Sequence
  Synthetic
aagagattgtagtaaaatgtaaagttgcttctgcaatatgttttaggattaagaaaaatcttggctattatttag

SEQ ID NO: 22082 - DNA, 75 bp, Artificial Sequence
  Synthetic
gcatttacccttcagagaaatcaactgctaatactgattttgtgatggaatataactcagagttttacttccata

SEQ ID NO: 22083 - DNA, 75 bp, Artificial Sequence
  Synthetic
atcagcacatacggcctactataagatggattgctgccagtaataacttatcagaggcagaaacattagttgcta

SEQ ID NO: 22084 - DNA, 75 bp, Artificial Sequence
  Synthetic
gacaagaagaagcatccaaccttgtcacacctgtttgtgagggaggaggatctttttcattgacagcaatgattc

SEQ ID NO: 22085 - DNA, 75 bp, Artificial Sequence
  Synthetic
agcaatctcaatgcacaacacattatgctctgatgggaatgggagtatctagcttatttcgagaatacaaaaaag

SEQ ID NO: 22086 - DNA, 75 bp, Artificial Sequence
  Synthetic
caattcttaagtggtgtgatcctggacttggttttttcttactagacaaccctagagcagctggcttgggaggat

SEQ ID NO: 22087 - DNA, 75 bp, Artificial Sequence
  Synthetic
tcaggtacaacttgtataaggcaataactagaacacaactctcaaaaatctatagcttcttcatgaagaaggtta

SEQ ID NO: 22088 - DNA, 75 bp, Artificial Sequence
  Synthetic
gaattggagcctcaccagatgatccaaatgagattcctgaaacatgcagtgttagcccaggtggtgcattaatct

SEQ ID NO: 22089 - DNA, 75 bp, Artificial Sequence
  Synthetic
taagttcttctctcaaatgggggtcaaggaaaaagttccagaaactaagagctaggctaggaatagcagatgact

SEQ ID NO: 22090 - DNA, 75 bp, Artificial Sequence
  Synthetic
gggtagatcagataaacaggaatccacatatactctatagagctcctagaacaggagaagaaattttattaagaa

SEQ ID NO: 22091 - DNA, 75 bp, Artificial Sequence
  Synthetic
ttgcagaaaaggttcatagtccaggtgtagtctcctctctatcaactggtaatgctgtagctaaggtgatggcat

SEQ ID NO: 22092 - DNA, 75 bp, Artificial Sequence
  Synthetic
cttctgtttactttttgtcagccactatctttgaggatgcaggaagaccagagttttcatttattgaagattcaa

SEQ ID NO: 22093 - DNA, 75 bp, Artificial Sequence
  Synthetic
agtattcccttctgtataagcttgcatcatatgaaggctactctgattttgatgaaattgatcctgaagatgttc

SEQ ID NO: 22094 - DNA, 75 bp, Artificial Sequence
  Synthetic
tttttcttttccctaatttagaggaattctattctttagatcaattgatttttgacagaggggaggtagaaatca

SEQ ID NO: 22095 - DNA, 75 bp, Artificial Sequence
  Synthetic
tactgcgatcaaacatgagagaagcaacacagaccagagtcactgtttttgaccattctgctaatgataaatgct

SEQ ID NO: 22096 - DNA, 75 bp, Artificial Sequence
  Synthetic
ctcctgagaaattagtatctgataagtggtttggcacccagaaatgtagaataggaaggactgggatgaatagag

SEQ ID NO: 22097 - DNA, 75 bp, Artificial Sequence
  Synthetic
agtgggaaagactcaaacttacaattaggtggttaaaagactctcctgaggagactttggaatcttcaccacttc

SEQ ID NO: 22098 - DNA, 75 bp, Artificial Sequence
  Synthetic
acaatcatattcaaatccgaaatttctttgccagaatggaaggcaaggcaagaacaataagaataacaggggctc

SEQ ID NO: 22099 - DNA, 75 bp, Artificial Sequence
  Synthetic
cagttaagaaaagatctggtctaagcaaactctcaatggtagtgagagataactttacgaaagtgggaatactag

SEQ ID NO: 22100 - DNA, 75 bp, Artificial Sequence
  Synthetic
gaggaattgaagatgatcttgctatcacaagatcagtatctgttgatatagcaaaacacacattattctccattt

SEQ ID NO: 22101 - DNA, 75 bp, Artificial Sequence
  Synthetic
taaatggtccttattcagacgagacaaaagccagattttgccagaagagcttggaggtgttgcctcagatagctc

SEQ ID NO: 22102 - DNA, 75 bp, Artificial Sequence
  Synthetic
taaacatgtcagataggaaaacaagatccaatgtggtggccttattccaagagtactgcaaagattatactggga

SEQ ID NO: 22103 - DNA, 75 bp, Artificial Sequence
  Synthetic
taataaagaaattagagacccttggggctgggacaataggagcttatataaaacctcaaaagtcaaaaaaggtcg

SEQ ID NO: 22104 - DNA, 75 bp, Artificial Sequence
  Synthetic
ataatagagttcaatattttggagaaggcatctggagaggagtgatggatggctatagtgtgcagatctcagttg

SEQ ID NO: 22105 - DNA, 75 bp, Artificial Sequence
  Synthetic
attgtaaggaggggcaaatgcctcaaatcacatctgtctgggttagcaaatgcaaagagatatgggtgctgtcaa

SEQ ID NO: 22106 - DNA, 75 bp, Artificial Sequence
  Synthetic
aatctattagagcttggtgtgacgacatgggagtaaggaatgaccaaaactttaagccaacctatggaacttctc

SEQ ID NO: 22107 - DNA, 75 bp, Artificial Sequence
  Synthetic
ctaatggctggatcttcaacttccaaatttatggatctggacataggtatggtgctccaatttattctctcagag

SEQ ID NO: 22108 - DNA, 75 bp, Artificial Sequence
  Synthetic
aggaaatggataatatccatgacatacaagatgatcaaataggcctcaaagtgacaaacaatgtccttcgtttgt

SEQ ID NO: 22109 - DNA, 75 bp, Artificial Sequence
  Synthetic
atgtgaacctgcccaaaatcaaaagagacctgcacatcttaacatatactgctactgataatgacatcagctcta

SEQ ID NO: 22110 - DNA, 75 bp, Artificial Sequence
  Synthetic
ctagtataatggagttgtcagcttataatataatggaaatgattccagagttcagtaaacaacccagcaaaagct

SEQ ID NO: 22111 - DNA, 75 bp, Artificial Sequence
  Synthetic
ggttgctatgtgatagtttgcccataaaattcttaaagcctgttctagatataacagaaggggtaagagttgttg

SEQ ID NO: 22112 - DNA, 75 bp, Artificial Sequence
  Synthetic
agggcattagacctgacttgctaaaagagctgataaaaaattgtactgaatcttctattagatcaaaagtcggaa

SEQ ID NO: 22113 - DNA, 75 bp, Artificial Sequence
  Synthetic
ctgtgttttcaatggttcaaaccagccaaacatcaggcccagaaatagacacaagtgagatgatagatttaattc

SEQ ID NO: 22114 - DNA, 75 bp, Artificial Sequence
  Synthetic
tgtctgaaatggatgacataagttttgacgctgcagtaacaagtgtaaacgaatgtttagatttaagtaatgtct

SEQ ID NO: 22115 - DNA, 75 bp, Artificial Sequence
  Synthetic
tatatgatgaggaatttggatctgttgatgttggcttattcgggccagcatatcacagagagattagaaatctaa

SEQ ID NO: 22116 - DNA, 75 bp, Artificial Sequence
  Synthetic
tgacaatatcccaccccttaatggatacccttatagacacatctctatcacagatggggaggaatgggatccgaa

SEQ ID NO: 22117 - DNA, 75 bp, Artificial Sequence
  Synthetic
gattagtagaaacaggaaagtgctgccaacgagacttaggcttgtctgaattgatctacagagctttaggaaggg

SEQ ID NO: 22118 - DNA, 75 bp, Artificial Sequence
  Synthetic
atccttctaatataagagtagatatggtactagctgatgtcatggatacagtggatgatgatgaattaggttaac

SEQ ID NO: 22119 - DNA, 75 bp, Artificial Sequence
  Synthetic
tgaaatcttggcagtggtatggcaggcttctcattttgggaagccaaagcagtatgattcttggcggtctttgtg

SEQ ID NO: 22120 - DNA, 75 bp, Artificial Sequence
  Synthetic
gaaatcttggcagtggtatggcaggcttctcattttgggaagccaaagcagtatgattcttggcggtctttgtgt

SEQ ID NO: 22121 - DNA, 75 bp, Artificial Sequence
  Synthetic
accaaacaagaaggaaggcagagtttgtaaaactataacaaatatagttgtacttaggatcaaagtgatagtcag

SEQ ID NO: 22122 - DNA, 75 bp, Artificial Sequence
  Synthetic
gcagttgctaagtccatagagcaagggtactcccccgtcgttggatacttctttcaggtttacaaagtattccaa

SEQ ID NO: 22123 - DNA, 75 bp, Artificial Sequence
  Synthetic
tttggaactgtgtctgcatcccaaacgcacaatcacaatccccatcaatcatggccgggatattcgagagcgtga

SEQ ID NO: 22124 - DNA, 75 bp, Artificial Sequence
  Synthetic
cagttgatgatatccttgggcttctctgtcaatcccacactcaccaaatctgtcacaggtcccttgatacgttct

SEQ ID NO: 22125 - DNA, 75 bp, Artificial Sequence
  Synthetic
aggatctagagaatcacaagataaggctggaagcaccaagagggggatccagattattggtgggaaagaaagatt

SEQ ID NO: 22126 - DNA, 75 bp, Artificial Sequence
  Synthetic
actgaatggttgacagtagcagcctttgttcctgcatctgtaggaggattcaactatatggcgatggccagatgt

SEQ ID NO: 22127 - DNA, 75 bp, Artificial Sequence
  Synthetic
caactcctatctgtattccgaattttgatgaccaggaaggagcgagtgctgtggccttcatgctcagaatgctga

SEQ ID NO: 22128 - DNA, 75 bp, Artificial Sequence
  Synthetic
tttgtaaggaacataggggatccggcgactgcggccatggcagacataaagagaatgatagaagtggacattctc

SEQ ID NO: 22129 - DNA, 75 bp, Artificial Sequence
  Synthetic
ccatctgtataacatccacagttaacatgacggtaagaggggcagctctgatcagcgctatgttgtctaactctg

SEQ ID NO: 22130 - DNA, 75 bp, Artificial Sequence
  Synthetic
acaactgaggtactcaataaattgctggagcaggaacctggcgattctacattcctagactggggttcagatcct

SEQ ID NO: 22131 - DNA, 75 bp, Artificial Sequence
  Synthetic
aacaaccctcagtgatgatgaccaactacgctctagatcaggacaaaacgtatgtgcagtattttgtcacatcca

SEQ ID NO: 22132 - DNA, 75 bp, Artificial Sequence
  Synthetic
tattcatgtaatctaccatactctcagagtatatctgctgtgataaagaatgtgactgcgagatccgtattggtg

SEQ ID NO: 22133 - DNA, 75 bp, Artificial Sequence
  Synthetic
tgctcagcgaattcccattcatggagataacgaacagaggaatcaagctggaaaacatgatgacctggtatggta

SEQ ID NO: 22134 - DNA, 75 bp, Artificial Sequence
  Synthetic
gactcacccaaccctctattgcaaggtctatttgatatagacaaccaggaggaagacgaggacctcgctatgttt

SEQ ID NO: 22135 - DNA, 75 bp, Artificial Sequence
  Synthetic
agatggtcacagaaaacgactacgaccagttgttcccctcttctcagaacgatgcgtgttccctagtaagcgcag

SEQ ID NO: 22136 - DNA, 75 bp, Artificial Sequence
  Synthetic
ttgatggatagaggtgtgataatgccccgggtgtgtcatgaaatcttggacaactctctgacaggagtgagagaa

SEQ ID NO: 22137 - DNA, 75 bp, Artificial Sequence
  Synthetic
agctcaaaaattccgggttaaacatggtcctagggacattgtttatccagatctggatctgcctgaccaaagcag

SEQ ID NO: 22138 - DNA, 75 bp, Artificial Sequence
  Synthetic
tccatagcaggtatgctcgataccacaaaaaccctgatcagagcaggggtcagatcaggctgtttgtcactcacg

SEQ ID NO: 22139 - DNA, 75 bp, Artificial Sequence
  Synthetic
taacaaaccctgatgtcggagaggttgccttcaacaagaggatgacaaagttgatccagcagaagagagtctgcc

SEQ ID NO: 22140 - DNA, 75 bp, Artificial Sequence
  Synthetic
atgatgcgaaggttggtcaaccatgatctactgcaattcgaaaccttcacaaaaattatgaagcaaaaagttaaa

SEQ ID NO: 22141 - DNA, 75 bp, Artificial Sequence
  Synthetic
ctaaactagtcatgtcacaatctgcactcaaggccatacgggaggttttggcaagacagcaaaatgtccgagcct

SEQ ID NO: 22142 - DNA, 75 bp, Artificial Sequence
  Synthetic
gacaaggatgatttttctacttattgctcagtggacctggccaagatcatcaggacaaaactttggtgcagctta

SEQ ID NO: 22143 - DNA, 75 bp, Artificial Sequence
  Synthetic
ttatggtaaacttcctgattgatcttcaggggtcagggactacctcctcatcaacggagcggatggtaattgaca

SEQ ID NO: 22144 - DNA, 75 bp, Artificial Sequence
  Synthetic
tcatctggtagacacattgcaggacttgaaactccagaccctcttgaggtgatcaatggtcagataatcaaaggg

SEQ ID NO: 22145 - DNA, 75 bp, Artificial Sequence
  Synthetic
tcgggacatatatctctgaagcgggcatggcagggttcatgaatacgatagaatatggactcaagactaggtatc

SEQ ID NO: 22146 - DNA, 75 bp, Artificial Sequence
  Synthetic
catgaaatgtgttctttatgtgagtcagagggtgaagataaacgatacagttggttctttatcccaaaggacatc

SEQ ID NO: 22147 - DNA, 75 bp, Artificial Sequence
  Synthetic
cggccctggccacagcagagctccgcccatcattggaaaagatggagtccctgataacactttataaaagcaagg

SEQ ID NO: 22148 - DNA, 75 bp, Artificial Sequence
  Synthetic
aatctggaagacttgtcaaaggccacagagtccataagagtgccttacttcggctccacgacagaagaacgatct

SEQ ID NO: 22149 - DNA, 75 bp, Artificial Sequence
  Synthetic
cggctccacgacagaagaacgatctgagattcgattgggtacgccaagacctgtcaaagccggcgaaggctgcat

SEQ ID NO: 22150 - DNA, 75 bp, Artificial Sequence
  Synthetic
gaccgctagggccctatatgaacatcttagaagacccagatgctgtcaaattcgcacctggggcctacccattgc

SEQ ID NO: 22151 - DNA, 75 bp, Artificial Sequence
  Synthetic
ccgcatcgccatggtttatacatgggcgttcggtgatgatgagatatcctgggaggaagcatccacaatagccaa

SEQ ID NO: 22152 - DNA, 75 bp, Artificial Sequence
  Synthetic
tctggagctatgcgatgggtgtggcagtggccacaaacaaggacatgactggtctggttgttgaaaggagcttcc

SEQ ID NO: 22153 - DNA, 75 bp, Artificial Sequence
  Synthetic
aacaagagcaaactttacaactgaggaactaaagctactgacacctgcgtccacctcgacaaatctctctcatcg

SEQ ID NO: 22154 - DNA, 75 bp, Artificial Sequence
  Synthetic
tctctgggagatggtttagagctggacaagacatcgtcagaagtcaagccctgaggtacaacaaagacatgatcc

SEQ ID NO: 22155 - DNA, 75 bp, Artificial Sequence
  Synthetic
gctgagagattcatccacacaaatgaaatttgcggggacttctctgttacgggttagcagatatgtcacaatatc

SEQ ID NO: 22156 - DNA, 75 bp, Artificial Sequence
  Synthetic
agcaattgagcctagatgattcagacattgacgagctgaacatggtcataaacggagaacacagcaagaccggag

SEQ ID NO: 22157 - DNA, 75 bp, Artificial Sequence
  Synthetic
taatgaccagatggtgatgaaagaagcaggagagtcgaaagacacaaatctggtataccaacaggtgatgttaat

SEQ ID NO: 22158 - DNA, 75 bp, Artificial Sequence
  Synthetic
aattcatcaaagccaaagggacgcatgccggtgtagaaggagaggacgacattgagggagaggaaggtcgagagg

SEQ ID NO: 22159 - DNA, 75 bp, Artificial Sequence
  Synthetic
cggtctaagcttcctagagtaccttagcaggcatgaatccacaaccggcgacgaaaacacactgctacacttaca

SEQ ID NO: 22160 - DNA, 75 bp, Artificial Sequence
  Synthetic
tcctgagaagggaggaatcggagttcgtagacatgcctgctggatcatcaatcaggggatacgccagtggttacg

SEQ ID NO: 22161 - DNA, 75 bp, Artificial Sequence
  Synthetic
tttaaatcccggatgttgcatcgtaactaatgaggatgaggaaaagaacccgtcaactgtagaggtagagataaa

SEQ ID NO: 22162 - DNA, 75 bp, Artificial Sequence
  Synthetic
gcaaggagattgatagagccagtgttgggaattcacaccctcaagctgtctttaggtttggggaccgttcccagc

SEQ ID NO: 22163 - DNA, 75 bp, Artificial Sequence
  Synthetic
gacaagaacagatgccaatgtgatgatctatgatccagaacctgtcagcaaagatgacttgaaaaagctacagat

SEQ ID NO: 22164 - DNA, 75 bp, Artificial Sequence
  Synthetic
acaaaacagtcagcgatcctgccagaagagatcagctgaaagacattctcaaacgaaagctggctgaggagatgg

SEQ ID NO: 22165 - DNA, 75 bp, Artificial Sequence
  Synthetic
gatcaaaaccgaaatccacgaggtggacttttcgctatgggataacagctctattctaggggcgcttaatattgc

SEQ ID NO: 22166 - DNA, 75 bp, Artificial Sequence
  Synthetic
gggaaccagtaccggaaaacctagatgcggacgccagcagtgatgcaatgctgctgaagggcatctagaccgacc

SEQ ID NO: 22167 - DNA, 75 bp, Artificial Sequence
  Synthetic
aacagcccaaacagtagtggacacaatatctcagattgatagggatgatcttaaagaagtggttgcaatagccag

SEQ ID NO: 22168 - DNA, 75 bp, Artificial Sequence
  Synthetic
taggatagtccctccactggagacctcaacacacataatccgtcaagcatcacaccgaggaggtctccaggaaca

SEQ ID NO: 22169 - DNA, 75 bp, Artificial Sequence
  Synthetic
tgatgactcgatcaatagtctcatcacagagttcttactgatagacatcaacaacttctgtattgcattgggagg

SEQ ID NO: 22170 - DNA, 75 bp, Artificial Sequence
  Synthetic
cccagactatatgaacagctgatccacatgtctcgttctctgctctgtcacattttcttataaataaaatatatc

SEQ ID NO: 22171 - DNA, 75 bp, Artificial Sequence
  Synthetic
actcttagtcaaccagtttgcatacgaaatctacactctgggtgttgagggaagacacttaatctatgaccatgt

SEQ ID NO: 22172 - DNA, 75 bp, Artificial Sequence
  Synthetic
tactgtagttctatacttgaattatttagcaacaactatctcatcagaggcttattcttagcgggtctagatatt

SEQ ID NO: 22173 - DNA, 75 bp, Artificial Sequence
  Synthetic
gttcaatcgtttgagaatcacctctagtgctgtgttcaaggtattgaccaatgcagtctcgcacccgagaatctt

SEQ ID NO: 22174 - DNA, 75 bp, Artificial Sequence
  Synthetic
tgtgtgtttattggaaattgggtcagggttttagtagaacactcgcgaaaagcctctgagagcctatctctaaaa

SEQ ID NO: 22175 - DNA, 75 bp, Artificial Sequence
  Synthetic
caagcggttctgggattttggtgtagtcaagccgaacagaggagcgaatctcaaagcgcaggactttaagctaca

SEQ ID NO: 22176 - DNA, 75 bp, Artificial Sequence
  Synthetic
gaacgtggaacaaagccagcaatctccagaaggcacacgtgcaatgtccattccaagcttgtaattgctcaggaa

SEQ ID NO: 22177 - DNA, 75 bp, Artificial Sequence
  Synthetic
cgctttagacatctgcatgcatgcggtggagtatttcatgaaccagtgggactgtggaacaccactcgaagtcta

SEQ ID NO: 22178 - DNA, 75 bp, Artificial Sequence
  Synthetic
tcgtaaagcatacatgaatcagtccatgagtgtcaggacatcaggtgatctctgtgttgatatatctgtcggttg

SEQ ID NO: 22179 - DNA, 75 bp, Artificial Sequence
  Synthetic
cctatgtgaaagtgacctcgacgtggtcgacgagaggcgggagacctttacggcgaggcacctggccttcttgtg

SEQ ID NO: 22180 - DNA, 75 bp, Artificial Sequence
  Synthetic
tacttaaattggtgaccttcaacgaacacttaaagacccggatatttagtgactttgcacattcactaacgggta

SEQ ID NO: 22181 - DNA, 75 bp, Artificial Sequence
  Synthetic
ctcattttacggattatcttcccgaggacccaagctccagggattggactcccttcagaggtacagtgccatcag

SEQ ID NO: 22182 - DNA, 75 bp, Artificial Sequence
  Synthetic
actcaagccagtatataaaggtcttactggaaaatagttgtatgataactcgcacttatcatgtattgtctaaag

SEQ ID NO: 22183 - DNA, 75 bp, Artificial Sequence
  Synthetic
ggattatctagaggtccaagtgactaaagaccacacctcgagattctggcagttgacaggcctaatcataagagc

SEQ ID NO: 22184 - DNA, 75 bp, Artificial Sequence
  Synthetic
ccgttatagattacgaaattatttcggatatgtttgttagttttttgtctttatagattgagatatcgttgcatc

SEQ ID NO: 22185 - DNA, 75 bp, Artificial Sequence
  Synthetic
cgtgccctctacagtgtcctatttgatgcaaagtgcagtgaagcagttcaggctgagagggcttggtgttcctac

SEQ ID NO: 22186 - DNA, 75 bp, Artificial Sequence
  Synthetic
tcgtttatgtcacttgtcaatggattaaagaaaacttaggatcaaagcaattgatatctactctagttgataccg

SEQ ID NO: 22187 - DNA, 75 bp, Artificial Sequence
  Synthetic
cgtcctagagacctggaacccaacgttcaatgaccttctatgtgacacagtagaagcggagaaggacaaaaacat

SEQ ID NO: 22188 - DNA, 75 bp, Artificial Sequence
  Synthetic
actactttgatctttttcccatattagcaaatgagctctatcttagacaaaatcaaaagatggcagaacaaaagg

SEQ ID NO: 22189 - DNA, 75 bp, Artificial Sequence
  Synthetic
gaaagggacatccgagtacccgagggattactgggggatagaaatcccaaggtccaatatattcccatgtcatgg

SEQ ID NO: 22190 - DNA, 75 bp, Artificial Sequence
  Synthetic
gctacccaaacatcaagctcaatgatgagttccttaacgaaggtctcaacatcctcgggtgtttcctcagaggaa

SEQ ID NO: 22191 - DNA, 75 bp, Artificial Sequence
  Synthetic
actggtcccgagcttgacgagagatgaagagaaatatgacacatcaatcgaactgcctctcggtccatcttatct

SEQ ID NO: 22192 - DNA, 75 bp, Artificial Sequence
  Synthetic
atgcccaaactgccccaacccaagaagcacagggacacaagggtggtgaaaatgataccggtgcctctcaaaagg

SEQ ID NO: 22193 - DNA, 75 bp, Artificial Sequence
  Synthetic
atcccatcagctcaggatagtgggagtaaacagcacgagttgtctaaaggccttggagcttacttctcatctgag

SEQ ID NO: 22194 - DNA, 75 bp, Artificial Sequence
  Synthetic
ccccaactcccaccaggagaaggaacagtcttagtggtccatccgatagggaaatgcgatcccagagagaagcgg

SEQ ID NO: 22195 - DNA, 75 bp, Artificial Sequence
  Synthetic
tcaagtagcaaacctgacaggaaacagactatttgtcggagaaggagctggcgcaatgctggccctttacgactc

SEQ ID NO: 22196 - DNA, 75 bp, Artificial Sequence
  Synthetic
atgtcgacaagtgggatcatagtggcgtatatagccacggactccggggccaactcgataagagcacttgtgaag

SEQ ID NO: 22197 - DNA, 75 bp, Artificial Sequence
  Synthetic
tgtcttaggcccagtcacaaactggtacaactcagggatatcgcccagagatctaactggccaacgagagctaaa

SEQ ID NO: 22198 - DNA, 75 bp, Artificial Sequence
  Synthetic
agtttggaagaggtcaagatggaaacaccggaggactcaatctttgtggaccagatgttgtgctcaaccagggtc

SEQ ID NO: 22199 - DNA, 75 bp, Artificial Sequence
  Synthetic
catttaccccagtgaggtagcactcacagacaacaatcagaagggagtcaacgatctaatgtctagaaccaaggt

SEQ ID NO: 22200 - DNA, 75 bp, Artificial Sequence
  Synthetic
ctcctcataaggatagagcattgggtggaattgctgacccggggaagaagacccacctggaacctgctgatctcg

SEQ ID NO: 22201 - DNA, 75 bp, Artificial Sequence
  Synthetic
gctattcaacggaagacctgaggtcacctggataggttcggatacttgtgaacgatttataaccgattcattgtg

SEQ ID NO: 22202 - DNA, 75 bp, Artificial Sequence
  Synthetic
aggatggcgctgatgaagagagtctcccaagggaaaccggtggaagagctcctgctggacgaagcatggaaggtg

SEQ ID NO: 22203 - DNA, 75 bp, Artificial Sequence
  Synthetic
cgacgatagggtgtccatagtccactcagacatggaaggcggttcaggtaaagacgaggatgccgtcatgattga

SEQ ID NO: 22204 - DNA, 75 bp, Artificial Sequence
  Synthetic
gttttaccctggatagaaggggaagtccgtgcaagcctgcccgcaaagcagatttcagagaagggacagacaacc

SEQ ID NO: 22205 - DNA, 75 bp, Artificial Sequence
  Synthetic
gcaatacagtgtgacgaggatagcctacagggttgggtcagatgatgtaactcttgttaccaaactcgcacccag

SEQ ID NO: 22206 - DNA, 75 bp, Artificial Sequence
  Synthetic
ccgacacctggtcagacccaggaacgacttttatgagaaaggccagagcaatgaaccctcagtctagtgcttccc

SEQ ID NO: 22207 - DNA, 75 bp, Artificial Sequence
  Synthetic
actgggttctgcgtggcacagagttttggtcatgctgatcaagtactggggggttgtgcagatgatttctctacg

SEQ ID NO: 22208 - DNA, 75 bp, Artificial Sequence
  Synthetic
cttatctggaggaacaactcaaagccgagaaggcccagctcttgtatcaggcagaggacaacaacgaggacaaat

SEQ ID NO: 22209 - DNA, 75 bp, Artificial Sequence
  Synthetic
aacatccaatccatcgtcaatggaggtctatgtggtgtgttcagggaaaaatcaaagagtgttattgtctggatc

SEQ ID NO: 22210 - DNA, 75 bp, Artificial Sequence
  Synthetic
cagaaggatcggcacccgaggcagaagaggatcaagaagaagaggaggaggaagacgagatagttgaggatccag

SEQ ID NO: 22211 - DNA, 75 bp, Artificial Sequence
  Synthetic
tgaagtcctctcggagacaatgccactgagtgtagagagtgctgcagacattgaggattggctgattaacactaa

SEQ ID NO: 22212 - DNA, 75 bp, Artificial Sequence
  Synthetic
acagtgacggtggagagacatcgggacttctggatgcgcacaatgcaagggctgtagacgcagggaacaggataa

SEQ ID NO: 22213 - DNA, 75 bp, Artificial Sequence
  Synthetic
gacacagagctggaagtggcttgcaagagagattgacgtgggtgatgggaaagggaaggggttgcgttcctacca

SEQ ID NO: 22214 - DNA, 75 bp, Artificial Sequence
  Synthetic
gggaccaaatttatgatgtgaaaacaagggaggaggaagaagcacgacaggttggtaaaaaaggcatagacgaga

SEQ ID NO: 22215 - DNA, 75 bp, Artificial Sequence
  Synthetic
cagagggttgataactttcgggttttctaccaacatggaaaccatatctagtcagtttttaggtgtgggtgacct

SEQ ID NO: 22216 - DNA, 75 bp, Artificial Sequence
  Synthetic
gatctgcatctacacctacaagggagttatctactccgagtcttggtgcaatccacagtgtgcgcctatcagacg

SEQ ID NO: 22217 - DNA, 75 bp, Artificial Sequence
  Synthetic
gacagacttggaaagagtcacaacgctgttctgcagcaccatggaacaaacattcagatcaatggaggacaggtc

SEQ ID NO: 22218 - DNA, 75 bp, Artificial Sequence
  Synthetic
cacaccttaccgggaggtttgccgttgcggagggtgccccgaagaatgcccagactgttctctggaatgagtacc

SEQ ID NO: 22219 - DNA, 75 bp, Artificial Sequence
  Synthetic
tgagaacctctctggagccttgatgatggggaagttcgatgtataccctgtgagagatgaaggaaagaggagaga

SEQ ID NO: 22220 - DNA, 75 bp, Artificial Sequence
  Synthetic
tcctgccttatctgcaggacagattcaactacatagacaccaaactacaaacattggagaatagcatcatagcag

SEQ ID NO: 22221 - DNA, 75 bp, Artificial Sequence
  Synthetic
aagaatcaagaatctgattctcaagtggattgcattgaacttatcaacattctttgtccatcgcaggtttacggt

SEQ ID NO: 22222 - DNA, 75 bp, Artificial Sequence
  Synthetic
aatcaggtaagaacgaaaagttacaggcgaaattcacaaacacaactaatcgtgtctcagcccaagtgtcagaga

SEQ ID NO: 22223 - DNA, 75 bp, Artificial Sequence
  Synthetic
cgggtcatttgagaaacaatgcagtgtcggctgcatcaatatggacattgatacagtttacaaatctggattgtt

SEQ ID NO: 22224 - DNA, 75 bp, Artificial Sequence
  Synthetic
tcaaggcaatgttttctgagttgttggttgttacgaagcacggagggaagtcagcgacaaagggtgacgagaagt

SEQ ID NO: 22225 - DNA, 75 bp, Artificial Sequence
  Synthetic
gaccaagtctatgtacaagagattcaacaaggtcctgcggagatgtgcttacacgtttccgactcgggacattaa

SEQ ID NO: 22226 - DNA, 75 bp, Artificial Sequence
  Synthetic
cagagaaagggcctaagatcagaagtgttctctcagtggagcaaccaaaggagatgatctcctatgatgctctct

SEQ ID NO: 22227 - DNA, 75 bp, Artificial Sequence
  Synthetic
gaagctcatgaagctggtggggtcagtgaagttcatgggggctacatgaaccatgaaagtaggtctagaacggga

SEQ ID NO: 22228 - DNA, 75 bp, Artificial Sequence
  Synthetic
ctgcttccgtatacaattattccagtgagggattcggtgcaaagaaatcgaaggattgggaaatcgttgacccca

SEQ ID NO: 22229 - DNA, 75 bp, Artificial Sequence
  Synthetic
gatactaaaacctagatctttgtgctatatgaatgttaagaaaatataaccactacagatacaattaagtaacag

SEQ ID NO: 22230 - DNA, 75 bp, Artificial Sequence
  Synthetic
ctatcgggaagacccctcctgcaacgacaacagccgaaaaggtccgcccaaataactcaattgggtataaagaga

SEQ ID NO: 22231 - DNA, 75 bp, Artificial Sequence
  Synthetic
taagtaacagaataaagaaaacttttaaaattataataaaaaatttaaaaaccctcacctcacttcttgtttggt

SEQ ID NO: 22232 - DNA, 75 bp, Artificial Sequence
  Synthetic
ccataaaagagcttgttagaagggctgactatacagaagaggagaaggtatttctggtagaatacatagatgatg

SEQ ID NO: 22233 - DNA, 75 bp, Artificial Sequence
  Synthetic
gaccgtggaacccgtcgaatttgcaacggacaaagatggagttgccgtaccgaccatcaggatgaccagcgccgg

SEQ ID NO: 22234 - DNA, 75 bp, Artificial Sequence
  Synthetic
aatcagatcccgaatccctccaggatataagggcaaacgccatcgagagggccagaacctgaatccacccgctac

SEQ ID NO: 22235 - DNA, 75 bp, Artificial Sequence
  Synthetic
ccgcaggtggaggagaaaaagcagtcttcggtgtttctggggtgacctctccactaatgccctggaagaatgcct

SEQ ID NO: 22236 - DNA, 75 bp, Artificial Sequence
  Synthetic
ccctgactctggaggacacatactaagtgaccatgtgattttgctgatactttatgatcaactatagaactgcat

SEQ ID NO: 22237 - DNA, 75 bp, Artificial Sequence
  Synthetic
gagattcgattggggtacgccaagaacctgtcaaagccggcgaaggctgcaatccgcatcgccatggtttataca

SEQ ID NO: 22238 - DNA, 75 bp, Artificial Sequence
  Synthetic
tatttgacacgacattgagctgagattttgcttgtgacctgatataagcttctttttctttttcttttaaatttt

SEQ ID NO: 22239 - DNA, 75 bp, Artificial Sequence
  Synthetic
ttccatccactctaatgatatataacttgtgagatttctgagagagttcgtcaaactatcagcggcaatagactg

SEQ ID NO: 22240 - DNA, 75 bp, Artificial Sequence
  Synthetic
caaaatcaacaagccgcacgagccaccagcctgataaaagaaattattcatctgatctgaatatactctactaca

SEQ ID NO: 22241 - DNA, 75 bp, Artificial Sequence
  Synthetic
aacgtatgtaacctaaaagaaaatcaatcatactgtgattaaagaaaacttaggatcaaagcacgtttgaccaaa

SEQ ID NO: 22242 - DNA, 75 bp, Artificial Sequence
  Synthetic
tctcgccccacacagcggccgagcaaaaatggaggggacatccgagttcagcaggaagacctgggaggaaaatgg

SEQ ID NO: 22243 - DNA, 75 bp, Artificial Sequence
  Synthetic
gcaggaagacctgggaggaaaatgggaccgtggaacccgtcgaatttgcaacggacaaagatggagttgccgtac

SEQ ID NO: 22244 - DNA, 75 bp, Artificial Sequence
  Synthetic
gaccgtggaacccgtcgaatttgcaacggacaaagatggagttgccgtaccgaccctcaggatgaccagcgccgg

SEQ ID NO: 22245 - DNA, 75 bp, Artificial Sequence
  Synthetic
ggacttttcacacaaaggtgaaccatacatataccttatgctcctggggtttgtcgagaaagtcattgaagaggg

SEQ ID NO: 22246 - DNA, 75 bp, Artificial Sequence
  Synthetic
cgggtcccagaggaagggcaagatgtactgttacggtgccatgcccctaggaatggccaggactcattataatga

SEQ ID NO: 22247 - DNA, 75 bp, Artificial Sequence
  Synthetic
gcaggccctcctggaggcatcagggaacttgaggatcacagtgaggaggaccgcaggtggaggagaaaaagcagt

SEQ ID NO: 22248 - DNA, 75 bp, Artificial Sequence
  Synthetic
aacttgaggatcacagtgaggaggaccgcaggtggaggagaaaaagcagtcttcggtgtttctggggtgacctct

SEQ ID NO: 22249 - DNA, 75 bp, Artificial Sequence
  Synthetic
ccgcaggtggaggagaaaaagcagtcttcggtgtttctggggtgacctctccattaatgccctggaagaatgcct

SEQ ID NO: 22250 - DNA, 75 bp, Artificial Sequence
  Synthetic
tgagtgggggaatgatttatcctgctctcaagactctatcagcaccttacaagataccgctcggtgtcaaggtca

SEQ ID NO: 22251 - DNA, 75 bp, Artificial Sequence
  Synthetic
gaatgcgggtgatctttgtgagcgggacaatcctgggggacataaccatctacaagataccgaaagcactgctgg

SEQ ID NO: 22252 - DNA, 75 bp, Artificial Sequence
  Synthetic
acgtgagggtgcctcaatcaatatcgttcaatctcaatgtcatcattgcgaccggggcaaagctgagcgcaagag

SEQ ID NO: 22253 - DNA, 75 bp, Artificial Sequence
  Synthetic
ggatcgacccagtcatgactccggaggggcagcagactgtatctttcctagtccacatcggacatttcgtcaggg

SEQ ID NO: 22254 - DNA, 75 bp, Artificial Sequence
  Synthetic
acaggaagaaggtctactctgcggactactgcagacataaggtagacatgatggggctgaagttctctctgggaa

SEQ ID NO: 22255 - DNA, 75 bp, Artificial Sequence
  Synthetic
atgtcggaggcgtcagctttcatgtcgccatcacagggaaaatgtccaagaccctgatgacaagcatcgggttca

SEQ ID NO: 22256 - DNA, 75 bp, Artificial Sequence
  Synthetic
agaagaacatatgttaccccctgatggacacaaatcccactctcaactcaatcatgtgggcatcgtctgcagaga

SEQ ID NO: 22257 - DNA, 75 bp, Artificial Sequence
  Synthetic
tctgtagcgtctctgctgtgttccaaccttcagttccgagggagttcaagtaccatgacgacatagtcgttgaag

SEQ ID NO: 22258 - DNA, 75 bp, Artificial Sequence
  Synthetic
gatctgggagagtgaccatgcagaaacactggtacttccctctcctgagcaagactggagtggtgtagggaacat

SEQ ID NO: 22259 - DNA, 75 bp, Artificial Sequence
  Synthetic
tgagtttgggggtgagtttcttctacctgtcagactgtgctgaggtcgaaccttgctgatggagggcagcaaggc

SEQ ID NO: 22260 - DNA, 75 bp, Artificial Sequence
  Synthetic
tatatgctaaaagagcattaatgtacacaacacccgacggggaaacccgcatcaggaccaatcatctctatgtta

SEQ ID NO: 22261 - DNA, 75 bp, Artificial Sequence
  Synthetic
taataattacacgtttgtctgaccttttttcttatacttttgattgatactaaataaacctacaatgcttttaac

SEQ ID NO: 22262 - DNA, 75 bp, Artificial Sequence
  Synthetic
aatgtgaagagtaaaagaactataaagctttagatgtattaataatcagacttaacagttcagaccattactatc

SEQ ID NO: 22263 - DNA, 75 bp, Artificial Sequence
  Synthetic
tgaattagtaccccaactaagcattaatcttataaaccgaataaagaaaacttaggatcaaagtaaaacaacttt

SEQ ID NO: 22264 - DNA, 75 bp, Artificial Sequence
  Synthetic
gaccagtcacaagaccaaccctcagaacacgacccgaagccatggacggccccaaattcagatttgtactactca

SEQ ID NO: 22265 - DNA, 75 bp, Artificial Sequence
  Synthetic
tacttctaaccgccccggcaagaggacaagtcgactacgacaagttactcaaagtcgggatattcgagaaaggga

SEQ ID NO: 22266 - DNA, 75 bp, Artificial Sequence
  Synthetic
cggcgaatctcaaaatatctgtcagctctcaacagagatacatggtgatcaagatgatgccaaacctgggcccaa

SEQ ID NO: 22267 - DNA, 75 bp, Artificial Sequence
  Synthetic
tgaatcagtgcggaataaaagaagtgaatctctacaaagagagtatcctacgtttgataactccaatttctacta

SEQ ID NO: 22268 - DNA, 75 bp, Artificial Sequence
  Synthetic
ctctgaattatataaagagtgagatacaggttgaaagagaagtggctttacaaccaaacgggacaatagtcaggt

SEQ ID NO: 22269 - DNA, 75 bp, Artificial Sequence
  Synthetic
tttttgggctaattgtggcagcaggagcactgaccctggcgacttccgctcagataacagcagggatagctctac

SEQ ID NO: 22270 - DNA, 75 bp, Artificial Sequence
  Synthetic
acaattctcttgagaatgcaaaagcaatcaaagggttaactgatgcaattaaggagtcaaaccttgcaatacaga

SEQ ID NO: 22271 - DNA, 75 bp, Artificial Sequence
  Synthetic
agatacaagacgcaacggctggcactgtgattgcactgaacgctctgcaagatcaggttaatacaaacattatac

SEQ ID NO: 22272 - DNA, 75 bp, Artificial Sequence
  Synthetic
cagcaatcaatactctaggttgcacggccgcagggaacacccttggaattgctctaaccaggtattattctgaat

SEQ ID NO: 22273 - DNA, 75 bp, Artificial Sequence
  Synthetic
taatcatgatttttggtccgagtctcgggaatcctgtcgaggcccctttgacaatacaggcattggcaggtgcgt

SEQ ID NO: 22274 - DNA, 75 bp, Artificial Sequence
  Synthetic
ttaacggggatcttcacggaatgatcagggagtatggatacactcctagtgatatagaggacatacttaggacga

SEQ ID NO: 22275 - DNA, 75 bp, Artificial Sequence
  Synthetic
actcagttacgggtagggtcattgatgtagacctggttgggatgaacatcgttttggagatcaatctcccaactc

SEQ ID NO: 22276 - DNA, 75 bp, Artificial Sequence
  Synthetic
tttacacactccgagataccaagattgttaatctcgggaaaataacttacaatgtagacggatctgaatggcaga

SEQ ID NO: 22277 - DNA, 75 bp, Artificial Sequence
  Synthetic
cccttgtaccagagtggttggcaatcagaaataccctaatgggtggtgtagacctgagcaggtgtgtcgtatcta

SEQ ID NO: 22278 - DNA, 75 bp, Artificial Sequence
  Synthetic
gccgtgacctcatttgcaagcaagaccctgtgttctcactggacaccagtatcatatcttgcttgaatgggaata

SEQ ID NO: 22279 - DNA, 75 bp, Artificial Sequence
  Synthetic
ctgaatcctgccctagaaacagagttgtgaatagtgtggctccgcggtacgccgttatccgcggaaatatacttg

SEQ ID NO: 22280 - DNA, 75 bp, Artificial Sequence
  Synthetic
caaactgtatatctaccacttgtctgtgtggtgacccgggtgttcctattatccaaaaaggggataacacattga

SEQ ID NO: 22281 - DNA, 75 bp, Artificial Sequence
  Synthetic
ccgcgatgtccatcaatgactgcaagctagtcggagtagatggctatgtcttccgtcctggtcctaaagcggtga

SEQ ID NO: 22282 - DNA, 75 bp, Artificial Sequence
  Synthetic
acgtgacttttaacttaccacatctgaatctaggacccgaagtcaatgtcaacccggtggacatctcaggtgccc

SEQ ID NO: 22283 - DNA, 75 bp, Artificial Sequence
  Synthetic
ttgggaaagtagaacaggacttggcatcgtctcgggatcaccttgcaaagtctgagaagatcctctctgggataa

SEQ ID NO: 22284 - DNA, 75 bp, Artificial Sequence
  Synthetic
acccgaacattatcaatacagaaatggtcctggtcgcggtaattctgagcttagtatgcgcaatggttgtgatcg

SEQ ID NO: 22285 - DNA, 75 bp, Artificial Sequence
  Synthetic
gtatcgtgtgttggttatccatactcacaaagtgggttcgatcgtgcagagccgactgccgacggcccaacaagg

SEQ ID NO: 22286 - DNA, 75 bp, Artificial Sequence
  Synthetic
ggccggatcttggtccgataatgtcatctcaagacaacctcagcttttaactgtgacggaattttaaaatcgcag

SEQ ID NO: 22287 - DNA, 75 bp, Artificial Sequence
  Synthetic
ttctgaatagcagttgtttgggcaagtttataaaatgttgaaacttatgattaggtatgcattacagtgaatttg

SEQ ID NO: 22288 - DNA, 75 bp, Artificial Sequence
  Synthetic
gtactctcactttaacactaatattcatgcacttaggagaaatgagatgattacaggtggcattatactaggact

SEQ ID NO: 22289 - DNA, 75 bp, Artificial Sequence
  Synthetic
acctctgcactacttaggagtgtctgctcgtccgaataagggatctataataacgtaaactcttgcattatacat

SEQ ID NO: 22290 - DNA, 75 bp, Artificial Sequence
  Synthetic
tatttaactgcaactatgatacagtgtgttaactttgattaaagaaaacataggatcaaagtcacaacactccac

SEQ ID NO: 22291 - DNA, 75 bp, Artificial Sequence
  Synthetic
acagacatgcctccagccccgagcccagtccacgatccgtcaagcttttacgggtcctccctatttaacgaggac

SEQ ID NO: 22292 - DNA, 75 bp, Artificial Sequence
  Synthetic
accgcatctcgcaaggggacaagtgaagagatccatctacttggaatcaggtggaataccgttctgattgtcctc

SEQ ID NO: 22293 - DNA, 75 bp, Artificial Sequence
  Synthetic
ggactcatccttgctataatagggataggaataggggcttcctccttctcggcaagcggtatcacaggcaacacc

SEQ ID NO: 22294 - DNA, 75 bp, Artificial Sequence
  Synthetic
actaaggagattagattgatagttgaagagatgagctatggattggttagaatatcagacagcgtcagacaggaa

SEQ ID NO: 22295 - DNA, 75 bp, Artificial Sequence
  Synthetic
atctctcccaaggtgacccttctgcaaaatgctgtactatcgagcatacctgcattggttacaactgaaaccaac

SEQ ID NO: 22296 - DNA, 75 bp, Artificial Sequence
  Synthetic
accattatcaacgctgtcaagaatcattgtaactctcctcctacgcctccacctcctaccgaggccccgctcaag

SEQ ID NO: 22297 - DNA, 75 bp, Artificial Sequence
  Synthetic
aagcatgaaaccgggatggcacctctagacccgacgacatattggacttgcacaagtgggacgccaagattctac

SEQ ID NO: 22298 - DNA, 75 bp, Artificial Sequence
  Synthetic
tcctctccaaatgccactttcatacctggcccatcaccacttccacacacagctactcctggaggatgtgtgaga

SEQ ID NO: 22299 - DNA, 75 bp, Artificial Sequence
  Synthetic
atcccatctatgcacatagggagcgagatctatgcctatacatctaacctgatagcatcaggttgtcaagatata

SEQ ID NO: 22300 - DNA, 75 bp, Artificial Sequence
  Synthetic
ggcaaatcataccagaacgtacaaatcggtgtactagatcggacaccagaggggaatccagagatgagccctatg

SEQ ID NO: 22301 - DNA, 75 bp, Artificial Sequence
  Synthetic
ttaagtcacacattccctatcaatgacaataggaagtcctgttctattgtgacactcaaaagggcagcttacatc

SEQ ID NO: 22302 - DNA, 75 bp, Artificial Sequence
  Synthetic
tactgttcccaacctaaggtgacagagtttgttgactatcaaactccggggatagagcctatgtctctagaccac

SEQ ID NO: 22303 - DNA, 75 bp, Artificial Sequence
  Synthetic
ataaatgcaaatgggaccactaaaacgtggatatactctcccacagaagtggtaaccgatgtgccatacgcctct

SEQ ID NO: 22304 - DNA, 75 bp, Artificial Sequence
  Synthetic
atgtatccaagcgttgggtctggggtagtcatagacggcaaactagtgttcctggtttatggcggactcctgaat

SEQ ID NO: 22305 - DNA, 75 bp, Artificial Sequence
  Synthetic
ggtatccaggtccctgcaatgtgtctcagtcccgaatgtccaggtatagaccaagctgcctgcaatgcgagccag

SEQ ID NO: 22306 - DNA, 75 bp, Artificial Sequence
  Synthetic
tacaaccagtacctgtcgggcaggcaagtggtgaatggaatcgcgactgttgatctcatgaatgggcagaaacct

SEQ ID NO: 22307 - DNA, 75 bp, Artificial Sequence
  Synthetic
cacatatcggtcgaaaccatatccccgagcaagaactggttcggggccgaaggaagactggtttatatggggggg

SEQ ID NO: 22308 - DNA, 75 bp, Artificial Sequence
  Synthetic
aggctgtatatctatatcaggtccaccgggtggcactctcctatacaaatcggggtcatatacaccatgaatcct

SEQ ID NO: 22309 - DNA, 75 bp, Artificial Sequence
  Synthetic
ctagccataacatgggtcacaaacacggtcctctcaagaccaggttcggcgggctgcgactggaacaataggtgc

SEQ ID NO: 22310 - DNA, 75 bp, Artificial Sequence
  Synthetic
ccgaaagcatgtctttcaggggtttatactgacgcatatcctatatctcctgattacaaccacctagctaccatg

SEQ ID NO: 22311 - DNA, 75 bp, Artificial Sequence
  Synthetic
atccttcattcaacatccaccaggagtaatcctgtcatggtatatagttcaccgaccaacatggtaaactacgct

SEQ ID NO: 22312 - DNA, 75 bp, Artificial Sequence
  Synthetic
cagttgacaaccacagcacagattgctggatatacaaccacatcatgtttcacggataacgaggtgggttactgt

SEQ ID NO: 22313 - DNA, 75 bp, Artificial Sequence
  Synthetic
gctaccgccttggagttgactcctggaaccttgtcctctgtccagcccatactggtcatgaccaagataccaaaa

SEQ ID NO: 22314 - DNA, 75 bp, Artificial Sequence
  Synthetic
gaatgtgtgtgattgatcctgtacaaccgggcacatctgtatggatctatgttttaaggttttttgcacaaatca

SEQ ID NO: 22315 - DNA, 75 bp, Artificial Sequence
  Synthetic
ctgattatagattaatcaagagaagtaaagaattaagaaggaagcttgaaggtaaccgactctgactccccataa

SEQ ID NO: 22316 - DNA, 75 bp, Artificial Sequence
  Synthetic
ttacctctagatcatatagcattaattacccgaggggtacctttcacgaatgatcattaaatatattagcgggtc

SEQ ID NO: 22317 - DNA, 75 bp, Artificial Sequence
  Synthetic
tcacaaataatttacatagacttatcttgtaatccactgtttgttgtagtaaagaaaacttaggatcaaagcatg

SEQ ID NO: 22318 - DNA, 75 bp, Artificial Sequence
  Synthetic
gatgcggatcagcccgttcagtccaacaaggactgttcctctatcctttatccagaatgccatctcaattcaccg

SEQ ID NO: 22319 - DNA, 75 bp, Artificial Sequence
  Synthetic
atcatactaggcaaaatcgtacagtgtcatgtcgcaatgggggtacatcagccttacatgatggaagacgacaca

SEQ ID NO: 22320 - DNA, 75 bp, Artificial Sequence
  Synthetic
atcataacaaacactcgtaagaatttgagaactaggagggagacaggaagactgtgtagtctaaggaaaatagga

SEQ ID NO: 22321 - DNA, 75 bp, Artificial Sequence
  Synthetic
ggcatccttaaagggatcgtcccaagcctgccgaattacagatttgaagcatatccttataacactaaggagatg

SEQ ID NO: 22322 - DNA, 75 bp, Artificial Sequence
  Synthetic
ttgcggctggatcttaaagagaggtgtgatgagctggataatctcctggggagagccgacagttgtttcaattac

SEQ ID NO: 22323 - DNA, 75 bp, Artificial Sequence
  Synthetic
aacaaggaaaaggtgtctgcaatgctcaaaagctgtctggtgaaaggagtcggcctcccttctcaagatatacct

SEQ ID NO: 22324 - DNA, 75 bp, Artificial Sequence
  Synthetic
ggcctttctgatgattgtgcagcgggtgagtcactaccggcggctgcccgtagatcaagatggtttaagagcttt

SEQ ID NO: 22325 - DNA, 75 bp, Artificial Sequence
  Synthetic
aagagctggttcacaatcaaaagagagatgaggatcctacaaaaagcttgcaataaaggtgcccggatgaataag

SEQ ID NO: 22326 - DNA, 75 bp, Artificial Sequence
  Synthetic
gagcaaaccaaatggctaccgggtaatccttatgacgtcttcattaccgcagaggttgttgtgatactgtctaag

SEQ ID NO: 22327 - DNA, 75 bp, Artificial Sequence
  Synthetic
tcaggaaagataggacacatactaaccccagaattggttctgatgtattgtgacgtagttgagggtcgctggaac

SEQ ID NO: 22328 - DNA, 75 bp, Artificial Sequence
  Synthetic
atggctaccgctgggagcctagacactaaaactagtgggataactaggagaggtgaaaagctctggtccctaatc

SEQ ID NO: 22329 - DNA, 75 bp, Artificial Sequence
  Synthetic
gatacactatttccgaggataggagaaaagacatttgatgttgttgcactgctagaacctctcagccttgcacta

SEQ ID NO: 22330 - DNA, 75 bp, Artificial Sequence
  Synthetic
attcagctgtcagatcctgtcgaagaaatcaaaggtgcatttcttgagttcgttattaacgagctgagtgatgcc

SEQ ID NO: 22331 - DNA, 75 bp, Artificial Sequence
  Synthetic
ttgtctaaagatgactggtacacaccgaagagggtatcggctttttcccggaagttgctagggatactgtccaca

SEQ ID NO: 22332 - DNA, 75 bp, Artificial Sequence
  Synthetic
gatttggtatccgaggccgctgaaatattctcattcttcaggacattcggacatcctgcccttgaggcggtgcaa

SEQ ID NO: 22333 - DNA, 75 bp, Artificial Sequence
  Synthetic
gccgcagaaaaagttaggaaatacatgtatgagcccaagatcctttcgtttgaaacaattatgcaagcccatgct

SEQ ID NO: 22334 - DNA, 75 bp, Artificial Sequence
  Synthetic
atcttctgcgggataatcatagggggctatagagagagacacggcgggcaatggcctccgtgcactattccagaa

SEQ ID NO: 22335 - DNA, 75 bp, Artificial Sequence
  Synthetic
catgcatctaattccataaaggcggcaaaacttcaagggtctgcgctcacgcatgagatgtgctatgacaattgg

SEQ ID NO: 22336 - DNA, 75 bp, Artificial Sequence
  Synthetic
agatctttcacaggattcaagtttgagaagtttttggaaccccagctgtgcgaggatctcactatatacatgaag

SEQ ID NO: 22337 - DNA, 75 bp, Artificial Sequence
  Synthetic
gacaaggctttatcacctcctaaaagtaactgggactccgtttatccgaaccataacatgtgttacaacccaaat

SEQ ID NO: 22338 - DNA, 75 bp, Artificial Sequence
  Synthetic
gtatgcgaagagagcaggagattagtagaggtatttgtcgcagattacaaatttgaccctaaggacatattgaag

SEQ ID NO: 22339 - DNA, 75 bp, Artificial Sequence
  Synthetic
tatgtggaagaagacgagtggcttgccgatgaagagttcaatatttcttacagcttaaaagaaaaggagattaag

SEQ ID NO: 22340 - DNA, 75 bp, Artificial Sequence
  Synthetic
caggcagggagactattcgcaaagatgacatacaagaccagagcagtacaggtactatcagagacactactcgct

SEQ ID NO: 22341 - DNA, 75 bp, Artificial Sequence
  Synthetic
gcaggtattgggcctctgttcagagaaaacggaatggccaagaatgagattgacctcctcaaacagctgagcact

SEQ ID NO: 22342 - DNA, 75 bp, Artificial Sequence
  Synthetic
ctctcaatctcaggagtttcaagatcatctggggaaagtcccttatccgagactagcgagtacctaaagctagaa

SEQ ID NO: 22343 - DNA, 75 bp, Artificial Sequence
  Synthetic
cagaataaagacgcgaagaaaggaaccgctaccaaaactcagaacgacaaatactgttacaagagacccaattta

SEQ ID NO: 22344 - DNA, 75 bp, Artificial Sequence
  Synthetic
gaaatggaggatcatgagacgatcagcgctttcttgacaactgacctcaaaaaatactgcttgaactggaggtcg

SEQ ID NO: 22345 - DNA, 75 bp, Artificial Sequence
  Synthetic
gagacaaccagtatttttggtcttaggtgttgcgagatattcgggctcaagaaattcttcaactggatgcacccc

SEQ ID NO: 22346 - DNA, 75 bp, Artificial Sequence
  Synthetic
atccttgagaagtcagtgctttatgtaggtgacccttactgtcccataccagacgagacttatacaagtcttgat

SEQ ID NO: 22347 - DNA, 75 bp, Artificial Sequence
  Synthetic
gacgaggacgactccgggatctttattcataatccgagaggaggcatagagggttactgtcaaaagatgtggact

SEQ ID NO: 22348 - DNA, 75 bp, Artificial Sequence
  Synthetic
ctcatctcaatcgctctgattcacctaaccgctgttaggaccagtgtcagagtctcagcaatggtccaaggagac

SEQ ID NO: 22349 - DNA, 75 bp, Artificial Sequence
  Synthetic
aatcaggcgatagcggtgacacagagggtccctcatggactcagttacaaggagaagaaacacagagtgtacgat

SEQ ID NO: 22350 - DNA, 75 bp, Artificial Sequence
  Synthetic
gcagtggttcgttatttttaccagatgcaaaaagttatggcagaaatgggtcatgaacttaaacttcaagagaca

SEQ ID NO: 22351 - DNA, 75 bp, Artificial Sequence
  Synthetic
gtaatcagcagtaagttctttgtatatagcaaacgtatatactatgatggacaaattctgcctcagtgtcttaag

SEQ ID NO: 22352 - DNA, 75 bp, Artificial Sequence
  Synthetic
gcactcacccgatgtgtgttctggtctgagactttggtggacgaatctcgagctgcatgttccaacattgccacg

SEQ ID NO: 22353 - DNA, 75 bp, Artificial Sequence
  Synthetic
cagccgccgcaccaccaacctatgaacaaaacaaaatgcctcccaaaagacgcctcgtggacaaccccgaagaca

SEQ ID NO: 22354 - DNA, 75 bp, Artificial Sequence
  Synthetic
tggatgatcaaagttcttcagaacggcctgaccacatgcccaagcttcctgggacttttttgcagtacacatctg

SEQ ID NO: 22355 - DNA, 75 bp, Artificial Sequence
  Synthetic
gaggcactgacccccacccaggaattggtgatgagagagacattaagaaaaatgccttagcattccttgatcctg

SEQ ID NO: 22356 - DNA, 75 bp, Artificial Sequence
  Synthetic
gccgccgagagaagttccacagtgtgaccccaagcttggtatttctgtgtctacttattccaggcttacatggag

SEQ ID NO: 22357 - DNA, 75 bp, Artificial Sequence
  Synthetic
ctttactctatggtggtgttcctcgtgaatcttacctatcaacagtggttgatcgtggaggggagcaaatcatta

SEQ ID NO: 22358 - DNA, 75 bp, Artificial Sequence
  Synthetic
aggccgggaaattctatggagaaaggcttgttgatcgggagttgacagaacttgaagtttcttcgattttcaatc

SEQ ID NO: 22359 - DNA, 75 bp, Artificial Sequence
  Synthetic
attgctgttctttattgattggtgtggtgattgggtcttctgccaaaatcaaagcaggtgcagagcaaattaaga

SEQ ID NO: 22360 - DNA, 75 bp, Artificial Sequence
  Synthetic
aacgctttaagacattaatggcatccctcaacaggcctgctcacggcgagacagcgacactgctgcagatgttta

SEQ ID NO: 22361 - DNA, 75 bp, Artificial Sequence
  Synthetic
atcctcatgaagccattgactggattaatggtcagccatgggttggctcattggttttatcattgattaccacag

SEQ ID NO: 22362 - DNA, 75 bp, Artificial Sequence
  Synthetic
attttgagtctcccgggaaggaattcatggatcaaataaaacttgttgcaagttatgcacaaatgacgacatata

SEQ ID NO: 22363 - DNA, 75 bp, Artificial Sequence
  Synthetic
ctactatcaaggaataccttagtgagtgcatggatgcaacacttaccattccagcagtggcccacgaaatcaagg

SEQ ID NO: 22364 - DNA, 75 bp, Artificial Sequence
  Synthetic
attttattaaggtttcatctgatcttaaagcggaacatggagaactcttcaagttccttggtgccatacgccatc

SEQ ID NO: 22365 - DNA, 75 bp, Artificial Sequence
  Synthetic
cagacgccatcaagctggctccgcggaacttcccgaacttggcgtcagcagcattttactggagcaaaaaggaga

SEQ ID NO: 22366 - DNA, 75 bp, Artificial Sequence
  Synthetic
atcccaccatgtccgggtatcgtgcatcaaccattcagcctgggtctaccgttaaggaagctcaattggcaagat

SEQ ID NO: 22367 - DNA, 75 bp, Artificial Sequence
  Synthetic
acagacgacgtgaggtatctcgcggagaggatggtgtccatctttcagccgagatagctgagataatgaggatga

SEQ ID NO: 22368 - DNA, 75 bp, Artificial Sequence
  Synthetic
ttggagttaccggacttcaaccataatatgaacataccaataaaaaaccatactcagatgcagaggagtctccat

SEQ ID NO: 22369 - DNA, 75 bp, Artificial Sequence
  Synthetic
tgtgatgagctccgatcttcaattgactcttctagagctaattcgccgtcttaatggcatcacgaccatcgagtc

SEQ ID NO: 22370 - DNA, 75 bp, Artificial Sequence
  Synthetic
tggtggattccttggaaggagaggaagacccgcagacagcacgtcgcgttcgctcgaggtctccgaggaggagac

SEQ ID NO: 22371 - DNA, 75 bp, Artificial Sequence
  Synthetic
gaattcctcaagatgcattgacccaaccagtggagcatcttctcaaggcactgaaaaagaatccatccatgatct

SEQ ID NO: 22372 - DNA, 75 bp, Artificial Sequence
  Synthetic
ccgacccagaccaaaggacaggaagggagcagttatcgaatgatgacctcattaagcagcttgtcactgagctgg

SEQ ID NO: 22373 - DNA, 75 bp, Artificial Sequence
  Synthetic
cggaaaatagtatgatcgaaacagaaggtctcaagggcgtactcgatgaaactgcacagaagattgagtcaggat

SEQ ID NO: 22374 - DNA, 75 bp, Artificial Sequence
  Synthetic
ttgaatcactctcttcattgcagattgaaactatccaggctgtccagaagactgattatgcagacagtattaaga

SEQ ID NO: 22375 - DNA, 75 bp, Artificial Sequence
  Synthetic
cacttggagaaaatatcaagatattggacagatccatgaaatcaatgatggagacaatgcgcctgatgatggaaa

SEQ ID NO: 22376 - DNA, 75 bp, Artificial Sequence
  Synthetic
agattgatcttctgtatgcatcagctgcaataggacagccgagtgcacagatgctgccatctcatcccggaccta

SEQ ID NO: 22377 - DNA, 75 bp, Artificial Sequence
  Synthetic
gcaagatatacccagttttacccactgctccaactgccgacgaatgggacattctaccataaaaaaaccgaatca

SEQ ID NO: 22378 - DNA, 75 bp, Artificial Sequence
  Synthetic
acatgaattccaagcactcctatgttgagctcaaggacaaggtaatagttcctgggtggccaacattgatgcttg

SEQ ID NO: 22379 - DNA, 75 bp, Artificial Sequence
  Synthetic
agatagattttgttggaggaacatcaagaaatcaatttctcaacattccgtttctttcagtgaaggaaccactcc

SEQ ID NO: 22380 - DNA, 75 bp, Artificial Sequence
  Synthetic
aattgcctcgggagaagaggctggtagactatctaacactcgacgttgagcctgttggtcattccttggttaacg

SEQ ID NO: 22381 - DNA, 75 bp, Artificial Sequence
  Synthetic
tatatttccaagtcgatgatttcctcgctttgactcttaactccttggcagtatacagcaatccaatcaggaagt

SEQ ID NO: 22382 - DNA, 75 bp, Artificial Sequence
  Synthetic
acatgtatattcgcctgaatgaggagcagagcaagcacgcaatcaatgctgccttcaacgttttttcttatcggt

SEQ ID NO: 22383 - DNA, 75 bp, Artificial Sequence
  Synthetic
tgcggaacattggtgttggtccgcttgcacctgatatccgcacctcaggctcttaagtgcaacaccgactcaact

SEQ ID NO: 22384 - DNA, 75 bp, Artificial Sequence
  Synthetic
ccagcactcattgatctggagataagacgactgtgccataacaagacggaggatgtcgttccatgcgaggttaga

SEQ ID NO: 22385 - DNA, 75 bp, Artificial Sequence
  Synthetic
tataggaaccataccaccactgagctttcagctgtccacatctcatgctataaataccattgtaaaacatactgg

SEQ ID NO: 22386 - DNA, 75 bp, Artificial Sequence
  Synthetic
ggatttttcggcagttatagcgcagacagattaatcaacaggtatctaggaagtgcctcatcatgtattaataca

SEQ ID NO: 22387 - DNA, 75 bp, Artificial Sequence
  Synthetic
tcgtctgaggatccatttaaatgcacttggcattattgttgttcagcacgtgtgacagagatatgtaggtgttca

SEQ ID NO: 22388 - DNA, 75 bp, Artificial Sequence
  Synthetic
atatcgaatgttacagtggctgttaagtcctttcccccatttatgtattgtagcttctctgattgcagcactgtg

SEQ ID NO: 22389 - DNA, 75 bp, Artificial Sequence
  Synthetic
agtgaatcagagttacgcctgggaagagccaatcttagtgatgggagttatttactttttgaccagtataacatt

SEQ ID NO: 22390 - DNA, 75 bp, Artificial Sequence
  Synthetic
tcaagtgatattatcaacggcaccttcaatggcacgatcctatgcaattccacatccaaggttgtgtcatttgat

SEQ ID NO: 22391 - DNA, 75 bp, Artificial Sequence
  Synthetic
gaatttaggagatcatatccacttaaaaactggacttatacgagtgagaccctgaatgttacatgtaatggcact

SEQ ID NO: 22392 - DNA, 75 bp, Artificial Sequence
  Synthetic
tatttctcaaattgtagcggcaagactcgcaagaagagggatacaccacagatagagtatttggtacacaaattg

SEQ ID NO: 22393 - DNA, 75 bp, Artificial Sequence
  Synthetic
aggcctactttaagagatgcttgggaagattgtgaaattctccagtcattgctgttgggtgtctttgcaaatgga

SEQ ID NO: 22394 - DNA, 75 bp, Artificial Sequence
  Synthetic
atggctagttcttcccgatttttaagagagtggcttaaccactcagatattgtgggatatgttgtaaacggaatt

SEQ ID NO: 22395 - DNA, 75 bp, Artificial Sequence
  Synthetic
ggtgttgtatggcagtgtaatcgtgtcaatataacatttcttccgtggaatgagtcaacttattatccccctgtt

SEQ ID NO: 22396 - DNA, 75 bp, Artificial Sequence
  Synthetic
aaggctgagtctaagttgtattatcttaacgaggaaggccggcttcaaactagtacacctgaggcacgaccaggt

SEQ ID NO: 22397 - DNA, 75 bp, Artificial Sequence
  Synthetic
ctcaaacgcatattttttcatgagaggttttaccttgggactgttggttctggactaaggcccaaaagagtcaaa

SEQ ID NO: 22398 - DNA, 75 bp, Artificial Sequence
  Synthetic
tataacagatcatctcatgattatcatctcaatgaatttgagtggagcctgaatgttactccagttgttaatatc

SEQ ID NO: 22399 - DNA, 75 bp, Artificial Sequence
  Synthetic
attgttggtcatgagaccaatccgattaaccatgcatatggtacccagtctgaccttctcccatatactcgatca

SEQ ID NO: 22400 - DNA, 75 bp, Artificial Sequence
  Synthetic
actaacttaacatccacagatacaggctcggggtgggttcatattgggctaccatcttttgcttttatcaatccg

SEQ ID NO: 22401 - DNA, 75 bp, Artificial Sequence
  Synthetic
cttggttggataagggatattctttcatgggctgcgtggcttggtggaattttgtatcttattacactgtgtatt

SEQ ID NO: 22402 - DNA, 75 bp, Artificial Sequence
  Synthetic
tctctcccagccttatttatgaggaggagacgcctcggaaggtggagggagtaaatcgaacagatcaatctctca

SEQ ID NO: 22403 - DNA, 75 bp, Artificial Sequence
  Synthetic
aaaacccattgataggaacagaagttgatttttgccttaactctggctttttacctcatcacgctcgtgctttac

SEQ ID NO: 22404 - DNA, 75 bp, Artificial Sequence
  Synthetic
aatatgttaaatcaaagaatgtaccttcaaaggattattatacgctgtttcgacaaataaaattgccagcgaatg

SEQ ID NO: 22405 - DNA, 75 bp, Artificial Sequence
  Synthetic
tctatccaatcggagttttgattcgagctgctgaaacaattctgcaaatcatcataaggacatggggactagaac

SEQ ID NO: 22406 - DNA, 75 bp, Artificial Sequence
  Synthetic
acatggagaagcctctatcggcggcagttagatatgctctcacaaatccaaggttacgtacccaacttgaactgc

SEQ ID NO: 22407 - DNA, 75 bp, Artificial Sequence
  Synthetic
atataacatttcaacggatcatccggcaagtatcctataccagagaacccgacataggacccaagcaacttggcg

SEQ ID NO: 22408 - DNA, 75 bp, Artificial Sequence
  Synthetic
gattgtcccttatgttcattcaatccttggtaatagcttttacggatggtgagagttgtttgatgacttataatc

SEQ ID NO: 22409 - DNA, 75 bp, Artificial Sequence
  Synthetic
acttcttagcagcagctgatactgcgaagagtagatgtcatcttttgattacagcagtaatacaaggggcacttt

SEQ ID NO: 22410 - DNA, 75 bp, Artificial Sequence
  Synthetic
gggaatcaggatcatttttgaattatgtttttgatcttattgacattattgattctattgatttatctcacgatg

SEQ ID NO: 22411 - DNA, 75 bp, Artificial Sequence
  Synthetic
attattttactgttgtcaagtccatttcaccgtattctaaaggtttagtgatgtctgcttacaatgtgactgtta

SEQ ID NO: 22412 - DNA, 75 bp, Artificial Sequence
  Synthetic
aaactgattttgaattagtgttcagaattaaggaattgtctcctcctcttgatagactactaaaaaaacttttgc

SEQ ID NO: 22413 - DNA, 75 bp, Artificial Sequence
  Synthetic
ttcttaatcctaatctgctcttgatggtgtcgtcagttgaaaagtcatggtatttcccagagatagacatgattt

SEQ ID NO: 22414 - DNA, 75 bp, Artificial Sequence
  Synthetic
caggttcagctgagcaattagggaaaatgcggaattattcggaaaagcctcaagctcttttacaatatggtgaag

SEQ ID NO: 22415 - DNA, 75 bp, Artificial Sequence
  Synthetic
agcttttaacaatgtttaaagctgaattcattaagggttatatttctaaacatgccaaatggccacctgtattac

SEQ ID NO: 22416 - DNA, 75 bp, Artificial Sequence
  Synthetic
ttagtaataaagcacaaagatccttacacaatgctcgtgaactaggcaaatggagcccttcattcgataggaact

SEQ ID NO: 22417 - DNA, 75 bp, Artificial Sequence
  Synthetic
ggaaaatgttttctgaggttactatactaaagattgctgaactagatttggatcctgacttcaatgatgtaatta

SEQ ID NO: 22418 - DNA, 75 bp, Artificial Sequence
  Synthetic
gtgacaaagctataattaactctaaacaagattggccattcgagtataactcggcagcctatcggaagatacatg

SEQ ID NO: 22419 - DNA, 75 bp, Artificial Sequence
  Synthetic
gtgagcgtcttgatagacccaaaaccaagtcagggccttctcgtctggtcaatgccttaattgatggaagacttg

SEQ ID NO: 22420 - DNA, 75 bp, Artificial Sequence
  Synthetic
atgacattccaaggttattggagcccttttgtaggggagcagtggagtatgaagacaggataacagtcctagttc

SEQ ID NO: 22421 - DNA, 75 bp, Artificial Sequence
  Synthetic
ccaaagagaaggagctcaaggttaaaggtaggttcttctcaaagcagtcattggctataaggatttatcaagtga

SEQ ID NO: 22422 - DNA, 75 bp, Artificial Sequence
  Synthetic
ttgctgagtcaacactcaagacagaggtacttccttatttaaagacacattcaatgacaatgaactctacatccc

SEQ ID NO: 22423 - DNA, 75 bp, Artificial Sequence
  Synthetic
tgactcatctcctcaacaagctttctaaacaaatagttactggagagtcttttgtaattaatcttgattatagct

SEQ ID NO: 22424 - DNA, 75 bp, Artificial Sequence
  Synthetic
catggtgcaatgggtttagtcctgagcttcagatgcctatttgtagacaacttgatttaatgtttgattgtggat

SEQ ID NO: 22425 - DNA, 75 bp, Artificial Sequence
  Synthetic
actttttccgtacaggatgcacattgccttgtttcacgacatttattgttcaaaacagatttaatccaccaaagg

SEQ ID NO: 22426 - DNA, 75 bp, Artificial Sequence
  Synthetic
ctggtccttatggtcccattgaggatggcgtcacatgtatagtcggatctaaaacaatgggtgagggaatgaggc

SEQ ID NO: 22427 - DNA, 75 bp, Artificial Sequence
  Synthetic
agaagctgtggactattttaactagctgttgggagacaatcgctctgagagaagcaggtgtctcatttaacatac

SEQ ID NO: 22428 - DNA, 75 bp, Artificial Sequence
  Synthetic
tgggtcaaggtgacaatcagacgataattgtctacaaatcattagcagagacaaaccagactttagctgagagat

SEQ ID NO: 22429 - DNA, 75 bp, Artificial Sequence
  Synthetic
ctcttggttgtttatacaaacacgcgagactggcagggcattatctcaagatggaggagtgttgggtttccgatt

SEQ ID NO: 22430 - DNA, 75 bp, Artificial Sequence
  Synthetic
gcctttatgaatacgggaagcgagtttttttcaagggaattccaatttctggtagcttaaaacagctctcccgag

SEQ ID NO: 22431 - DNA, 75 bp, Artificial Sequence
  Synthetic
ttacggattcaacaggagagctttttcctaatttgtactcaaagttggcatgcttggtttcgtcttgtttaagtg

SEQ ID NO: 22432 - DNA, 75 bp, Artificial Sequence
  Synthetic
cggctatgtctgacacatctccatgggtatcattaacaacaggtgtatgtttgtacttgattgagttgtatgtgg

SEQ ID NO: 22433 - DNA, 75 bp, Artificial Sequence
  Synthetic
aacttcctccatctataatgcaggatgaggtcctattaacaactctttgcttagtcggtccaccactaggtggac

SEQ ID NO: 22434 - DNA, 75 bp, Artificial Sequence
  Synthetic
tacctacacctgccacgcttccaagtgtatttttcagggggatgtcagatcctcttccttttcaattagcccttc

SEQ ID NO: 22435 - DNA, 75 bp, Artificial Sequence
  Synthetic
ttaaaactcttgtgaaaacaacaagtataagtgtgtcctttatcaatcgtgtcgtgaaacttaaaattggtgcct

SEQ ID NO: 22436 - DNA, 75 bp, Artificial Sequence
  Synthetic
acccagactggttatctttagtcacagatccatcgtctctgaatatagcacaggtttttaggcctgagcgtcaaa

SEQ ID NO: 22437 - DNA, 75 bp, Artificial Sequence
  Synthetic
ttcgcaagtgggttgaggaggcaatttctgctaatactcattcatctaaagtaggagagttcttccagcagccac

SEQ ID NO: 22438 - DNA, 75 bp, Artificial Sequence
  Synthetic
taacagaaatggcccaattgctggctagggatttgtcatcaatgatgcctcttcgaccgcgagacatgtctgcat

SEQ ID NO: 22439 - DNA, 75 bp, Artificial Sequence
  Synthetic
tattcagtttatctaatgtttcttatgggctcagcgttatagatctctttcagaagtcttctactgttgtatctg

SEQ ID NO: 22440 - DNA, 75 bp, Artificial Sequence
  Synthetic
ctaatcaagctgtacaccttgaagatgtagtactcgaaagtagtaggtataaggagtccattattcagcgagttc

SEQ ID NO: 22441 - DNA, 75 bp, Artificial Sequence
  Synthetic
ttgatgagagtgaaggcgttgatctaggtccatacttggaaggatgcacttatgttgctgcgaagcaactaagaa

SEQ ID NO: 22442 - DNA, 75 bp, Artificial Sequence
  Synthetic
ggcttacatggggccgagacctcatcggggttactatgccatttgtcgcagaacagtttaagcctcaaagctcag

SEQ ID NO: 22443 - DNA, 75 bp, Artificial Sequence
  Synthetic
ttgacgcaggacctggtgattataaagatgcaataatttactgccctcaagagccactgcgtgttagacatttgt

SEQ ID NO: 22444 - DNA, 75 bp, Artificial Sequence
  Synthetic
ctgctagaggggaccaaccactttatcttggatcaaatacagccattaaggttcagagaggagatatcactgggc

SEQ ID NO: 22445 - DNA, 75 bp, Artificial Sequence
  Synthetic
taaataaatctcgtgctgctggcttagttagggataccttagtattgtaccaatggtacaaggttaggaaagtta

SEQ ID NO: 22446 - DNA, 75 bp, Artificial Sequence
  Synthetic
ttgaccctaatctgtctaaactaatggattgtttccttagagagaaaggatattcctctgacattagacccaatg

SEQ ID NO: 22447 - DNA, 75 bp, Artificial Sequence
  Synthetic
ttcatggagggacattaacacacagattaccatctagaggtgattcaaggcaagggctgacaggctatgttaatt

SEQ ID NO: 22448 - DNA, 75 bp, Artificial Sequence
  Synthetic
tgataagcacatggcttaaattttcaagtgactacttgtcaacattctcacactcctctgatgattatacaattc

SEQ ID NO: 22449 - DNA, 75 bp, Artificial Sequence
  Synthetic
atttccagcatgttttcacttatggctgtctctatgctgattccatcataagatcaggagggatagtgtcgcagc

SEQ ID NO: 22450 - DNA, 75 bp, Artificial Sequence
  Synthetic
cctacctcctcaaagcagactgtttgacttgttttgaaaaaattgagtcagaagagttctttctagcgtgtgaac

SEQ ID NO: 22451 - DNA, 75 bp, Artificial Sequence
  Synthetic
ctcagtatcgaggggcagagtggttgataagtaaacctgttaatatacctgaacaaatttctgatgccgaggtag

SEQ ID NO: 22452 - DNA, 75 bp, Artificial Sequence
  Synthetic
aatttgatccatgtataagtgctggcatagcacttggtgttttaattggtcgatcattgcttgtggatataagat

SEQ ID NO: 22453 - DNA, 75 bp, Artificial Sequence
  Synthetic
cacatcaatcagatataactgaacagaagacatgggccaatctagaaagattttctatctcagacattagaaggt

SEQ ID NO: 22454 - DNA, 75 bp, Artificial Sequence
  Synthetic
tgccatggagcattgtcattaggtctctttggaaattctttattgagacacgactattgtcatttgagagggcag

SEQ ID NO: 22455 - DNA, 75 bp, Artificial Sequence
  Synthetic
ggttgattaaattgttacatcaccaatcaggtccaacattttcctatattaccaaagttttccaggaatcatctc

SEQ ID NO: 22456 - DNA, 75 bp, Artificial Sequence
  Synthetic
tatttttagagacaataccaatagagagagcactttcaaaattgaattttaaggatagatatgatctcatttcca

SEQ ID NO: 22457 - DNA, 75 bp, Artificial Sequence
  Synthetic
aaatcattcttcttccgatcagcaattatgaaattgcatcagttgaggcagcaagaatcgaaagtaagtattgtg

SEQ ID NO: 22458 - DNA, 75 bp, Artificial Sequence
  Synthetic
aagcatcagaattcaatattgacctttatcttgcatcagctaaaggatcaagcgttaaccctatgcaaatttgta

SEQ ID NO: 22459 - DNA, 75 bp, Artificial Sequence
  Synthetic
atgagacgaacgatttcatttctaaagggtcacatcatggccatttttcgctgtcagccacgggacttcaagaaa

SEQ ID NO: 22460 - DNA, 75 bp, Artificial Sequence
  Synthetic
agtcacaagtgattaagatggccattcgtaaactaaatttgcaagagatttatatctgttcagatgttgaaccag

SEQ ID NO: 22461 - DNA, 75 bp, Artificial Sequence
  Synthetic
agttggctttggatatttctcaccttccaggattgtcagttgtttttgtgctatcaggtaatcctgattattttg

SEQ ID NO: 22462 - DNA, 75 bp, Artificial Sequence
  Synthetic
aaaaggtctgcgctatggatctttgcaatgcagtcaaattaaggacaaatgtacctaagtcattgtcatcccgga

SEQ ID NO: 22463 - DNA, 75 bp, Artificial Sequence
  Synthetic
aacctgctggtgtttatataggagggacagatggacccaaacaacttcggctcgaggagctatcagtggcaactt

SEQ ID NO: 22464 - DNA, 75 bp, Artificial Sequence
  Synthetic
acgcacatccttgtctcgaggagttgcagtacaatgttttttgtggacaagactatgttgacatttcagatatgt

SEQ ID NO: 22465 - DNA, 75 bp, Artificial Sequence
  Synthetic
gctgtttatctttgggtgagccatgttctgctctttttaaacctgtatttgacaaaatattgaatcttaagacgg

SEQ ID NO: 22466 - DNA, 75 bp, Artificial Sequence
  Synthetic
cactccttggggcttatgactttttactagatttacttttgattaaaggatttgatattagaccccatttggagg

SEQ ID NO: 22467 - DNA, 75 bp, Artificial Sequence
  Synthetic
aatttgatgagttattagttacggcacaagcaactcttggattggcaacgcatcgatcaattacgtattttgtag

SEQ ID NO: 22468 - DNA, 75 bp, Artificial Sequence
  Synthetic
gacttctaaatcgatgtcccgtcattgtgctggcccgaatctccccaacattgaagcaaatgacaatttgcgaac

SEQ ID NO: 22469 - DNA, 75 bp, Artificial Sequence
  Synthetic
gattaccacacccctcagcggtgcacttggcaagatctcctgacattcatacacttttgtcggagcttccaattg

SEQ ID NO: 22470 - DNA, 75 bp, Artificial Sequence
  Synthetic
gtcttattagacttcttagggggatgccttgttgatttggtgtgattttagtgtgtgtatataaatgtgaatatt

SEQ ID NO: 22471 - DNA, 75 bp, Artificial Sequence
  Synthetic
atgtgaatattgttttttaatatactatattcttaaaaaaccatgcaagtggggatctgtagctttggtttcgtt

SEQ ID NO: 22472 - DNA, 75 bp, Artificial Sequence
  Synthetic
ctaacccattttctgtgttaacttgtaaaaaatgtgcttacctgtctggattacaaagctttgtagattatgagt

SEQ ID NO: 22473 - DNA, 75 bp, Artificial Sequence
  Synthetic
ggcacgtcaaccccaagcgctggcccagagccaaccctaattccggaagtcccgcccaccggaagtgacgtcaca

SEQ ID NO: 22474 - DNA, 75 bp, Artificial Sequence
  Synthetic
gtaatgacacatttgcccaggacgtgtataagcaatttgtacaattttatgaaaaacttactggtacagatttag

SEQ ID NO: 22475 - DNA, 75 bp, Artificial Sequence
  Synthetic
taaattttcgcgggcttttttcccgccttatgcaaataacctgccatgtttgatgctttattttaatttgattgg

SEQ ID NO: 22476 - DNA, 75 bp, Artificial Sequence
  Synthetic
ccttatgcaaataacctgccatgtttgatgctttattttaatttgattggacaaaaacttaacggtttttatggg

SEQ ID NO: 22477 - DNA, 75 bp, Artificial Sequence
  Synthetic
ctggctgctttttactgggaataacttgctgttatttgcctgctaattaacaggtatttatactaacttttaatt

SEQ ID NO: 22478 - DNA, 75 bp, Artificial Sequence
  Synthetic
caggtatttatactaacttttaatttactaacatggagctatttaggggtgtgttgcatatttcctctaacattt

SEQ ID NO: 22479 - DNA, 75 bp, Artificial Sequence
  Synthetic
tactaacatggagctatttaggggtgtgttgcatatttcctctaacattttagactgcgctaatgataactggtg

SEQ ID NO: 22480 - DNA, 75 bp, Artificial Sequence
  Synthetic
gtgctctatgctggatttagatacttctgactgggaaccactaactcactctaacagactaatggcaatatattt

SEQ ID NO: 22481 - DNA, 75 bp, Artificial Sequence
  Synthetic
tctgactgggaaccactaactcactctaacagactaatggcaatatatttaagtaatgttgcttctaaactagat

SEQ ID NO: 22482 - DNA, 75 bp, Artificial Sequence
  Synthetic
tttactggggggccgctggcgggttgcttatatttttttcaggtggaatgtaacaaatttgaggaaggctaccat

SEQ ID NO: 22483 - DNA, 75 bp, Artificial Sequence
  Synthetic
agtgcaaacacagacactgttaataatgaagccggggaatcaagctgtggagggggagatgtggtgccatttgcc

SEQ ID NO: 22484 - DNA, 75 bp, Artificial Sequence
  Synthetic
atgtgaaaacagagtgtttactgaagacaaatggaagttagtggatttcaatcaatatacattattaagcagtag

SEQ ID NO: 22485 - DNA, 75 bp, Artificial Sequence
  Synthetic
ggctctgctacaatgtcctataaatttccagcagtgcccccagaaaacttagagggctgcagccagcatttttat

SEQ ID NO: 22486 - DNA, 75 bp, Artificial Sequence
  Synthetic
cccgtttaggagtacctgacacattaggaggggaccctaaatttagatcactaacacacgaggaccacgcaattc

SEQ ID NO: 22487 - DNA, 75 bp, Artificial Sequence
  Synthetic
ttcatttgaacttttaggaacaggtggctctgctacaatgtcctataaatttccagcagtgcccccagaaaactt

SEQ ID NO: 22488 - DNA, 75 bp, Artificial Sequence
  Synthetic
agtgcattaaagctagctatttataaagctactaacttagttcctactagtacatttttaatgcattcagacttt

SEQ ID NO: 22489 - DNA, 75 bp, Artificial Sequence
  Synthetic
agccacaaaactttatgcctgggccattaatcaactcagtgtctacaaaagaaggagacaactctaatacaggtg

SEQ ID NO: 22490 - DNA, 75 bp, Artificial Sequence
  Synthetic
tacatttttaatgcattcagactttgagcaggttacctgcattaaagaaaataaaatagttaaactattattatg

SEQ ID NO: 22491 - DNA, 75 bp, Artificial Sequence
  Synthetic
ccaaaattatgatcctcttttagtgggtcaacatgttttaaagtggattgacaaaaaatgtggtaaaaaaaacac

SEQ ID NO: 22492 - DNA, 75 bp, Artificial Sequence
  Synthetic
cctgtggttttacgggcccccgagcactggaaaaacaaatttggcaatggctattgccaaaactgtcccagtgta

SEQ ID NO: 22493 - DNA, 75 bp, Artificial Sequence
  Synthetic
tggcatggttaattggaataatgaaaattttccatttaatgatgtagcggggaaaagtttggtggtctgggatga

SEQ ID NO: 22494 - DNA, 75 bp, Artificial Sequence
  Synthetic
gtcagccaaccagggtagatcaaaaaatgcgtggcagtgtggcagtgcctggtgtgccagtggtaataaccagca

SEQ ID NO: 22495 - DNA, 75 bp, Artificial Sequence
  Synthetic
cccgccttatgcaaatgagcagccatgtttagtgttttattttaattttattggacaaaggcctaacggttatta

SEQ ID NO: 22496 - DNA, 75 bp, Artificial Sequence
  Synthetic
taaagctaaactttaccgtaagatgcagccctgacatgggcttacttacagaggctgatgtacagcaatggctaa

SEQ ID NO: 22497 - DNA, 75 bp, Artificial Sequence
  Synthetic
cagccctgacatgggcttacttacagaggctgatgtacagcaatggctaacttggtgtaatgcacaaagctggaa

SEQ ID NO: 22498 - DNA, 75 bp, Artificial Sequence
  Synthetic
aacttactaacatggaactatttaggggtgtgctgcaaatttcctctaacattctggagtgcgctaatgataact

SEQ ID NO: 22499 - DNA, 75 bp, Artificial Sequence
  Synthetic
ccactatgaaaactgggcaataaactacacgtttgatttccctggaataaatgcagatgccctccacccagacct

SEQ ID NO: 22500 - DNA, 75 bp, Artificial Sequence
  Synthetic
aatgtaacaaatttgaggaaggctatcacattcatgtagttattggtggtccaggactaaatgctagaaacttaa

SEQ ID NO: 22501 - DNA, 75 bp, Artificial Sequence
  Synthetic
aaagctctgaagaactcagtgaaagcagctttttcaacctcatcactccaggcgcctggaacagtgaaaccccgc

SEQ ID NO: 22502 - DNA, 75 bp, Artificial Sequence
  Synthetic
gaactgttagttggggttgactatgtgtgggatggtgtgaggggattgcctgtttgttgtgtgcagcatattaat

SEQ ID NO: 22503 - DNA, 75 bp, Artificial Sequence
  Synthetic
tgtgggatggtgtgaggggattgcctgtttgttgtgtgcagcatattaataatagtgggggagggttaggccttt

SEQ ID NO: 22504 - DNA, 75 bp, Artificial Sequence
  Synthetic
gagcctgtcatgctaaaagaccccgcattaccgcaaatacagacaatgttactagtgaaaccggggagtctagct

SEQ ID NO: 22505 - DNA, 75 bp, Artificial Sequence
  Synthetic
gtcctcattgtattaatgtgggagcttggtataatggatggaagtttcgagaatttactccagatttggtacggt

SEQ ID NO: 22506 - DNA, 75 bp, Artificial Sequence
  Synthetic
tgctggaaagggaacaaaggcagggttaaagtttcaaaccatggtaaattggctatgtgaaaacagagtatttac

SEQ ID NO: 22507 - DNA, 75 bp, Artificial Sequence
  Synthetic
tttaaccagtatactttattaagcagtagtcacagtggcagctttcaaatacaaagtgcattaaagttagctatt

SEQ ID NO: 22508 - DNA, 75 bp, Artificial Sequence
  Synthetic
gtagtcacagtggcagctttcaaatacaaagtgcattaaagttagctatttataaagccactaacttagtaccca

SEQ ID NO: 22509 - DNA, 75 bp, Artificial Sequence
  Synthetic
aagttactgggacagacttagagcttatacaaatattaaaagatcattacaatatttctttagataatcccctag

SEQ ID NO: 22510 - DNA, 75 bp, Artificial Sequence
  Synthetic
ctagcacttttttgttacattcagactttgagcaggttacttgtattaaagacaataaaatagttaaattattac

SEQ ID NO: 22511 - DNA, 75 bp, Artificial Sequence
  Synthetic
ctttgagcaggttacttgtattaaagacaataaaatagttaaattattactgtgccagaactatgatcctcttct

SEQ ID NO: 22512 - DNA, 75 bp, Artificial Sequence
  Synthetic
tatacaaatattaaaagatcattacaatatttctttagataatcccctagaaaacccatcttccctgtttgactt

SEQ ID NO: 22513 - DNA, 75 bp, Artificial Sequence
  Synthetic
agttgctcgtattaaaagtaatcttaaagactctccagacctatatagtcatcattttcaaagtcatggacagtt

SEQ ID NO: 22514 - DNA, 75 bp, Artificial Sequence
  Synthetic
aaagactctccagacctatatagtcatcattttcaaagtcatggacagttatctgaccacccccatgccttatca

SEQ ID NO: 22515 - DNA, 75 bp, Artificial Sequence
  Synthetic
actttaggtatagccaattggctaagctgggaataaacccatatactcattggactgtagcagatgaggaactgt

SEQ ID NO: 22516 - DNA, 75 bp, Artificial Sequence
  Synthetic
gcatgctaaagccttgaaagaacgaatggtaaagctaaactttaccgtaagatgtagccctgacatgggcttact

SEQ ID NO: 22517 - DNA, 75 bp, Artificial Sequence
  Synthetic
cacagaggctgatgtacagcaatggctaacttggtgtaatgcacaaagctggagccactatgaaaactgggcaat

SEQ ID NO: 22518 - DNA, 75 bp, Artificial Sequence
  Synthetic
tactttactttaaaaggtgcagctgcccctgtggcccattttcaaggaagtttgccggaagttcccgcatacaac

SEQ ID NO: 22519 - DNA, 75 bp, Artificial Sequence
  Synthetic
gtttcaagcacaagcagtaaaagattactttactttaaaaggtgcagctgcccctgtggcccattttcaaggaag

SEQ ID NO: 22520 - DNA, 75 bp, Artificial Sequence
  Synthetic
agggggccacttttactgccaattctgtaacctgtacattttccagacagtttttaattccatatgacccagagc

SEQ ID NO: 22521 - DNA, 75 bp, Artificial Sequence
  Synthetic
tgtaacctgtacattttccagacagtttttaattccatatgacccagagcaccattacaaagtgttttctcccgc

SEQ ID NO: 22522 - DNA, 75 bp, Artificial Sequence
  Synthetic
tttacacgccacttgcagatcagtttcgtgaactgttagtaggggttgactttgtatgggatggtataaggggat

SEQ ID NO: 22523 - DNA, 75 bp, Artificial Sequence
  Synthetic
tagagagtttactccagacttagtgcgctgtagttgtcatgtaggagcctctaacccattttctgtgcttacctg

SEQ ID NO: 22524 - DNA, 75 bp, Artificial Sequence
  Synthetic
agtactacagggcgtttatgcatgttagtagatcatgagtacaagtacccatatgtgttaggtcagggacaggat

SEQ ID NO: 22525 - DNA, 75 bp, Artificial Sequence
  Synthetic
tagtagatcatgagtacaagtacccatatgtgttaggtcagggacaggataccttagccccagaactgcctattt

SEQ ID NO: 22526 - DNA, 75 bp, Artificial Sequence
  Synthetic
gggtgtactttccccctcaatatgcttatttaacagtgggagatgtaaacacacagggaatttcaggagacagta

SEQ ID NO: 22527 - DNA, 75 bp, Artificial Sequence
  Synthetic
ttatttaacagtgggagatgtaaacacacagggaatttcaggagacagtaaaaaactagcaagtgaagaatcagc

SEQ ID NO: 22528 - DNA, 75 bp, Artificial Sequence
  Synthetic
attttatgttttagaacacagttcatttgaactgttaggtacaggtggctctgccactatgtcctataaatttcc

SEQ ID NO: 22529 - DNA, 75 bp, Artificial Sequence
  Synthetic
tttgaactgttaggtacaggtggctctgccactatgtcctataaatttccaccagtgccgccagaaaacttggag

SEQ ID NO: 22530 - DNA, 75 bp, Artificial Sequence
  Synthetic
ggttgtagccaacacttttatgaaatgtacaaccccctgtatgggtcccgtttaggggtacctgacacactaggg

SEQ ID NO: 22531 - DNA, 75 bp, Artificial Sequence
  Synthetic
tgtacaaccccctgtatgggtcccgtttaggggtacctgacacactagggggggaccctaaatttagatcattaa

SEQ ID NO: 22532 - DNA, 75 bp, Artificial Sequence
  Synthetic
ctcacgaagaccatgcaattcagccacaaaactttatgcctggcccactagtaaactcagtgtccactaaagagg

SEQ ID NO: 22533 - DNA, 75 bp, Artificial Sequence
  Synthetic
gccataccatcactgggacactgataagtatgtcacaggaataaatgctatttcacacggacaaaccacttatgg

SEQ ID NO: 22534 - DNA, 75 bp, Artificial Sequence
  Synthetic
caaggggtaggaagattcccaaatgaaaaagagcaacttaaacagttacaaggcctaaacattcacacatacttt

SEQ ID NO: 22535 - DNA, 75 bp, Artificial Sequence
  Synthetic
aaaaagagcaacttaaacagttacaaggcctaaacattcacacatactttccaaataaaggaacccaacaataca

SEQ ID NO: 22536 - DNA, 75 bp, Artificial Sequence
  Synthetic
cagatcaaattgaacgccccttaatggtagggtctgtgtggaacagaagagctcttcattatgaaagtcagctgt

SEQ ID NO: 22537 - DNA, 75 bp, Artificial Sequence
  Synthetic
ccactagagtttcagcacttaattgagaattatggcagtatagctccagatgctttaactgtgactatttcagaa

SEQ ID NO: 22538 - DNA, 75 bp, Artificial Sequence
  Synthetic
cagttttaaaacccaatttgcagccctgggcgggtggggtttacatcaaccacctcctcaaatatttttaaaaat

SEQ ID NO: 22539 - DNA, 75 bp, Artificial Sequence
  Synthetic
ctgggcgggtggggtttacatcaaccacctcctcaaatatttttaaaaatattgccacaaagtggaccaattggg

SEQ ID NO: 22540 - DNA, 75 bp, Artificial Sequence
  Synthetic
acccatatgtgttgggtcagggacaagacacattagccccagaactgcccatttgggtgtactttccccctcagt

SEQ ID NO: 22541 - DNA, 75 bp, Artificial Sequence
  Synthetic
ggtattaaatccatgggaattactaccttagttcaatatgcagtgggaattatgacagttactatgacatttaaa

SEQ ID NO: 22542 - DNA, 75 bp, Artificial Sequence
  Synthetic
atgcttacttaacagtaggtgaagtaaacacacaaggaatttcaggagacagcaaaaaattggctagtgaagaat

SEQ ID NO: 22543 - DNA, 75 bp, Artificial Sequence
  Synthetic
aaacacacaaggaatttcaggagacagcaaaaaattggctagtgaagaatctgccttttatgtgttggaacatag

SEQ ID NO: 22544 - DNA, 75 bp, Artificial Sequence
  Synthetic
tcctcctcatgcagctggtcatttaccatatgtactgtatgaccctacagctacagatgcaaagcaacaccacag

SEQ ID NO: 22545 - DNA, 75 bp, Artificial Sequence
  Synthetic
ttccagcagtgcccccagaaaacttagagggctgtagccagcatttttatgaaatgtacaatcccctgtatggct

SEQ ID NO: 22546 - DNA, 75 bp, Artificial Sequence
  Synthetic
aggaggggaccccaaatttagatcactaacacacgaggaccacgcaattcagccacaaaactttatgcctggccc

SEQ ID NO: 22547 - DNA, 75 bp, Artificial Sequence
  Synthetic
ccgtccacctgtaccacccagattatatgtgcccccgccaataccccgtagagaaccgtgtgtaaaagatacaga

SEQ ID NO: 22548 - DNA, 75 bp, Artificial Sequence
  Synthetic
gagaaccgtgtgtaaaagatacagatgctgtagaatataagttactaacccgttatgagcaacatgtaattagaa

SEQ ID NO: 22549 - DNA, 75 bp, Artificial Sequence
  Synthetic
ccaaatcagatgccgccggtcgccgccggtaggcgggacttccggtacaagatggcggacaactacgtcatttcc

SEQ ID NO: 22550 - DNA, 75 bp, Artificial Sequence
  Synthetic
tactggcactagtcaaagcaccagaatttctctgcgcccaggtccagtgtctcagccataccatcactgggacac

SEQ ID NO: 22551 - DNA, 75 bp, Artificial Sequence
  Synthetic
ccggtaggcgggacttccggtacaagatggcggacaactacgtcatttcctgtgacgtcatttcctgtgacgtca

SEQ ID NO: 22552 - DNA, 75 bp, Artificial Sequence
  Synthetic
ttagggttggctctgggccagcttgcttggggttgccttgacactaagacaagcggcgcgccgcttgtcttagtg

SEQ ID NO: 22553 - DNA, 75 bp, Artificial Sequence
  Synthetic
ctttcctaataaaggaacccaacaatacacagatcaaattgaacggcctcttatggtgggttctgtgtggaacag

SEQ ID NO: 22554 - DNA, 75 bp, Artificial Sequence
  Synthetic
aagagctcttcactatgaaagtcaactatggagtaagatccctaacttagatgatagttttaaaactcagtttgc

SEQ ID NO: 22555 - DNA, 75 bp, Artificial Sequence
  Synthetic
agccttaggcgggtggggattacatcaaccgccccctcaaatatttttaaaaatactaccgcaaagtgggcccat

SEQ ID NO: 22556 - DNA, 75 bp, Artificial Sequence
  Synthetic
agtgttttactataattttattggttagttttgtaacggttaaaatgggcggagcgtaggcggggactacagtat

SEQ ID NO: 22557 - DNA, 75 bp, Artificial Sequence
  Synthetic
tagttttgtaacggttaaaatgggcggagcgtaggcggggactacagtatatatagcacggcactgccgcagctc

SEQ ID NO: 22558 - DNA, 75 bp, Artificial Sequence
  Synthetic
tttctttctgggctgctttttcctggactttcttgctgttttttgtgagctaactaacaggtatttatactactt

SEQ ID NO: 22559 - DNA, 75 bp, Artificial Sequence
  Synthetic
actggtggtgctctttactggatttagacacttctgactgggaaccactaactcatactaacagactaatggcaa

SEQ ID NO: 22560 - DNA, 75 bp, Artificial Sequence
  Synthetic
agacacttctgactgggaaccactaactcatactaacagactaatggcaatatacttaagcagtgtggcttctaa

SEQ ID NO: 22561 - DNA, 75 bp, Artificial Sequence
  Synthetic
actcatactaacagactaatggcaatatacttaagcagtgtggcttctaagcttgactttaccggggggccacta

SEQ ID NO: 22562 - DNA, 75 bp, Artificial Sequence
  Synthetic
ccaaccgcccacctgtaccgcctagattatatgtgccccctccagtacccagtaggcaaccatttgtgaaagata

SEQ ID NO: 22563 - DNA, 75 bp, Artificial Sequence
  Synthetic
cagacgctgtagagtataaattgctaaccagatatgaacaacatgtaattagaatgctcagattatgtaatatgt

SEQ ID NO: 22564 - DNA, 75 bp, Artificial Sequence
  Synthetic
tagaatgtaacaaatttgaagaaggctatcatattcatgtggttattggggggccagggttaaaccccagaaacc

SEQ ID NO: 22565 - DNA, 75 bp, Artificial Sequence
  Synthetic
gcagggtgcttgtacttttttcaagtagaatgtaacaaatttgaagaaggctatcatattcatgtggttattggg

SEQ ID NO: 22566 - DNA, 75 bp, Artificial Sequence
  Synthetic
taaaataaatatctaatagtgtattttgctttaaaaattttaaaaagaagacaccaaatcagatgccgccggtcg

SEQ ID NO: 22567 - DNA, 75 bp, Artificial Sequence
  Synthetic
gtccgccatcttgtaccggaagatccgcctaccggcggcgaccggcggcatctgatttggtgtcttcttttaaat

SEQ ID NO: 22568 - DNA, 75 bp, Artificial Sequence
  Synthetic
tgccaggaatgactacaaaaggcaaatactttagagatggagagcagtttatagaaaactatttaatgaaaaaaa

SEQ ID NO: 22569 - DNA, 75 bp, Artificial Sequence
  Synthetic
cgcctaccggcggcgaccggcggcatctgatttggtgtcttcttttaaatttttaaagcaacatacacaattagt

SEQ ID NO: 22570 - DNA, 75 bp, Artificial Sequence
  Synthetic
tctgatttggtgtcttcttttaaatttttaaagcaacatacacaattagttatttatttaagccatttatttttc

SEQ ID NO: 22571 - DNA, 75 bp, Artificial Sequence
  Synthetic
caagtttgtatacatattacacaatctaagcattctaattacatgttgctcaaaacgggttcatctgatttggtg

SEQ ID NO: 22572 - DNA, 75 bp, Artificial Sequence
  Synthetic
acctgtatttctgctacttttagaaggggagcttgccatgccaagaaaccccgcattaccacagccataaatgat

SEQ ID NO: 22573 - DNA, 75 bp, Artificial Sequence
  Synthetic
ccgcattaccacagccataaatgatactagtagtgatgctggggagtctagcggcacaggggcagaggttgtgcc

SEQ ID NO: 22574 - DNA, 75 bp, Artificial Sequence
  Synthetic
tttctttcctggctgctttttactgggaataacttgctgttatttgcctgctaattaacaggtatttatactaac

SEQ ID NO: 22575 - DNA, 75 bp, Artificial Sequence
  Synthetic
agactttgaacaggttatgtgtattaaagacaataaaattgttaaattgttactttgtcaaaactatgaccccct

SEQ ID NO: 22576 - DNA, 75 bp, Artificial Sequence
  Synthetic
aaagacaataaaattgttaaattgttactttgtcaaaactatgaccccctattggtggggcagcatgtgttaaag

SEQ ID NO: 22577 - DNA, 75 bp, Artificial Sequence
  Synthetic
tggattgataaaaaatgtggcaagaaaaatacactgtggttttatgggccgccaagtacaggaaaaacaaacttg

SEQ ID NO: 22578 - DNA, 75 bp, Artificial Sequence
  Synthetic
aaaatacactgtggttttatgggccgccaagtacaggaaaaacaaacttggcaatggccattgctaaaagtgttc

SEQ ID NO: 22579 - DNA, 75 bp, Artificial Sequence
  Synthetic
tggtccaggacttaatgctagaaacctaacagtgtgtgtagaaggcttgtttaataatgttctttaccaccttgt

SEQ ID NO: 22580 - DNA, 75 bp, Artificial Sequence
  Synthetic
tgtacatgctaaagccttaaaagagcgcatggtaaagttaaactgtaccgtaagatgcagccctgacatagggtt

SEQ ID NO: 22581 - DNA, 75 bp, Artificial Sequence
  Synthetic
actaacagaggctgatgtacaacagtggcttacatggtgtaatgcacaaagctgggaccactatgaaaactgggc

SEQ ID NO: 22582 - DNA, 75 bp, Artificial Sequence
  Synthetic
agggttaaagtttcaaacaatggtaaattggttatgtgaaaacagagtgtttactgaagacaaatggaagttagt

SEQ ID NO: 22583 - DNA, 75 bp, Artificial Sequence
  Synthetic
ggtggtgaaagctctgaagaactcagtgaaagcagcttttttaacctcatcaccccaggcgcctggaacactgaa

SEQ ID NO: 22584 - DNA, 75 bp, Artificial Sequence
  Synthetic
aaatacaaagtgcattaaagctagctatttataaagctactaacttagttcctactagtacatttttaatgcatt

SEQ ID NO: 22585 - DNA, 75 bp, Artificial Sequence
  Synthetic
accccgcgctctagtacgcccatccccgggaccagttcaggagaatcatttgtcggaagcccagtttcctccgaa

SEQ ID NO: 22586 - DNA, 75 bp, Artificial Sequence
  Synthetic
ccttctacacacctttggcagaccagtttcgtgaactgttagttggggttgattatgtgtgggacggtgtaaggg

SEQ ID NO: 22587 - DNA, 75 bp, Artificial Sequence
  Synthetic
gtttacctgtgtgttgtgtgcaacatattaacaatagtgggggaggcttgggactttgtccccattgcattaatg

SEQ ID NO: 22588 - DNA, 75 bp, Artificial Sequence
  Synthetic
tattaacaatagtgggggaggcttgggactttgtccccattgcattaatgtaggggcttggtataatggatggaa

SEQ ID NO: 22589 - DNA, 75 bp, Artificial Sequence
  Synthetic
atttcgagaatttaccccagatttggtgcggtgtagctgccatgtgggagcttctaatcccttttctgtgctaac

SEQ ID NO: 22590 - DNA, 75 bp, Artificial Sequence
  Synthetic
agtaaagaaagtggcaaatggtgggaaagtgatgataaatttgctaaagctgtgtatcagcaatttgtggaattt

SEQ ID NO: 22591 - DNA, 75 bp, Artificial Sequence
  Synthetic
aaccagcaacggtgacattacctttgttgtaagtggtaataccactacaactgtccatgctaaagccttaaagga

SEQ ID NO: 22592 - DNA, 75 bp, Artificial Sequence
  Synthetic
tagagcttattcaaatattaaaagatcattataatatttctttagataatcccctagaaaacccatcctctctgt

SEQ ID NO: 22593 - DNA, 75 bp, Artificial Sequence
  Synthetic
tcattataatatttctttagataatcccctagaaaacccatcctctctgtttgacttagttgctcgtattaaaaa

SEQ ID NO: 22594 - DNA, 75 bp, Artificial Sequence
  Synthetic
taaccttaaaaactctccagacttatatagtcatcattttcaaagtcatggacagttatctgaccacccccatgc

SEQ ID NO: 22595 - DNA, 75 bp, Artificial Sequence
  Synthetic
gcagctgcccctgtggcccattttcaaggaagtttgccggaagttcccgcttacaacgcctcagaaaaataccca

SEQ ID NO: 22596 - DNA, 75 bp, Artificial Sequence
  Synthetic
tggagtgagggggccacttttagtgccaactctgtaacttgtacattttccagacagtttttaattccatatgac

SEQ ID NO: 22597 - DNA, 75 bp, Artificial Sequence
  Synthetic
gaaagtgatgataaatttgctaaggatgtgtataagcaatttgtagaattttatgaaaaagttactgggacagac

SEQ ID NO: 22598 - DNA, 75 bp, Artificial Sequence
  Synthetic
tgccagtggaaaggaggcaaaggtttgcaccattagtcccataatgggatactcaaccccatggagatatttaga

SEQ ID NO: 22599 - DNA, 75 bp, Artificial Sequence
  Synthetic
tgcaccattagtcccataatgggatactcaaccccatggagatatttagattttaatgctttaaatttatttttt

SEQ ID NO: 22600 - DNA, 75 bp, Artificial Sequence
  Synthetic
tcacctttagagtttcagcacttaattgaaaattatggaagtatagctcctgatgctttaactgtaaccatatca

SEQ ID NO: 22601 - DNA, 75 bp, Artificial Sequence
  Synthetic
ttatctagtgaagacttacacaagcctgggcaagttagcatacaactacccggtactaactatgttgggcctggc

SEQ ID NO: 22602 - DNA, 75 bp, Artificial Sequence
  Synthetic
agtacccatatgtgttagggcaaggtcaggatactttagccccagaacttcctatttgggtatactttccccctc

SEQ ID NO: 22603 - DNA, 75 bp, Artificial Sequence
  Synthetic
gacagcaaaaaattagcaagtgaagaatcagcattttatgttttggaacacagttcttttcagcttttaggtaca

SEQ ID NO: 22604 - DNA, 75 bp, Artificial Sequence
  Synthetic
agtttcctccagtgcccccagaaaatttagagggctgcagtcaacacttttatgaaatgtacaatcccttatacg

SEQ ID NO: 22605 - DNA, 75 bp, Artificial Sequence
  Synthetic
tctttaacacatgaagaccatgcaattcagccccaaaacttcatgccagggccactagtaaactcagtgtctaca

SEQ ID NO: 22606 - DNA, 75 bp, Artificial Sequence
  Synthetic
aaggagggagacagctctaatactggagctggaaaagccttaacaggccttagcacaggtacctctcaaaacact

SEQ ID NO: 22607 - DNA, 75 bp, Artificial Sequence
  Synthetic
caatatacagatcaaattgagcgccccctaatggtgggttctgtatggaacagaagagcccttcactatgaaagc

SEQ ID NO: 22608 - DNA, 75 bp, Artificial Sequence
  Synthetic
ccctaatggtgggttctgtatggaacagaagagcccttcactatgaaagccagctgtggagtaaaattccaaatt

SEQ ID NO: 22609 - DNA, 75 bp, Artificial Sequence
  Synthetic
tagatgacagttttaaaactcagtttgcagccttaggaggatggggtttgcatcagccacctcctcaaatatttt

SEQ ID NO: 22610 - DNA, 75 bp, Artificial Sequence
  Synthetic
taaaaatattaccacaaagtgggccaattggaggtattaaatcaatgggaattactaccttagttcagtatgctg

SEQ ID NO: 22611 - DNA, 75 bp, Artificial Sequence
  Synthetic
aattggaggtattaaatcaatgggaattactaccttagttcagtatgctgtgggaattatgacagtaactatgac

SEQ ID NO: 22612 - DNA, 75 bp, Artificial Sequence
  Synthetic
tgggaattatgacagtaactatgacatttaaattggggccccgtaaagctacaggacggtggaatcctcaacctg

SEQ ID NO: 22613 - DNA, 75 bp, Artificial Sequence
  Synthetic
tcatttaccatatgtactatatgaccgcccagctacagatgcaaaacaacaccacagacatggatatgaaaagcc

SEQ ID NO: 22614 - DNA, 75 bp, Artificial Sequence
  Synthetic
tgaagaattgtggacagccaaaagccgtgtgcacccattgtaaacactccccaccgtgccctcagccaggatgcg

SEQ ID NO: 22615 - DNA, 75 bp, Artificial Sequence
  Synthetic
cttaaccagatatgaacaacatgttattagaatgttaagattgtgtaatatgtatcaaaatttagaaaaataaac

SEQ ID NO: 22616 - DNA, 75 bp, Artificial Sequence
  Synthetic
tgtatcaaaatttagaaaaataaacatttgttgtggttaaaaaattatgttgttgcgctttaaaaatttaaaaga

SEQ ID NO: 22617 - DNA, 75 bp, Artificial Sequence
  Synthetic
agacaccaaatcagatgccgccggtcgccgccggtaggcgggacttccggtacaagatggcggacaaatacgtca

SEQ ID NO: 22618 - DNA, 75 bp, Artificial Sequence
  Synthetic
tttcctgtgacgtcatttcctgtgacgtcacttccggtgggcgggacttccggaattagggttggctctgggcca

SEQ ID NO: 22619 - DNA, 75 bp, Artificial Sequence
  Synthetic
cgtcacttccggtgggcgggacttccggaattagggttggctctgggccagcgcttggggttgacgtgccactaa

SEQ ID NO: 22620 - DNA, 75 bp, Artificial Sequence
  Synthetic
ttagatgacagttttaaaacccaatttgcagccctgggcgggtggggtttacatcaaccacctcctcaaatattt

SEQ ID NO: 22621 - DNA, 75 bp, Artificial Sequence
  Synthetic
ggaaatgacgtatttgtccgccatcttgtaccggaagtcccgcctaccggcggcgaccggcggcatctgatttgg

SEQ ID NO: 22622 - DNA, 75 bp, Artificial Sequence
  Synthetic
tactggtaggtggaatccacagcctggagtatatcctcctcatgcagctggtcatttaccatatgtactgtatga

SEQ ID NO: 22623 - DNA, 75 bp, Artificial Sequence
  Synthetic
ttagggttggctctgggccagcttgcttggggttgccttgacactaagacaagcggcgcgccgcttgatcttagt

SEQ ID NO: 22624 - DNA, 75 bp, Artificial Sequence
  Synthetic
taaattttagcgggcttttttcccgccttatgcaaatgggcagccattttaagtgttttactataattttattgg

SEQ ID NO: 22625 - DNA, 75 bp, Artificial Sequence
  Synthetic
atgtatacaaacttggaaaaataaatggcttaaataaataactaattgtgtatgttgctttaaaaatttaaaaga

SEQ ID NO: 22626 - DNA, 75 bp, Artificial Sequence
  Synthetic
tatgttgctttaaaaatttaaaagaagacaccaaatcagatgccgccggtcgccgccggtaggcgggacttccgg

SEQ ID NO: 22627 - DNA, 75 bp, Artificial Sequence
  Synthetic
cggagcgtaggcggggactacagtatatatagcacggcagtgccgcagctctttctttctgggctgctttttcct

SEQ ID NO: 22628 - DNA, 75 bp, Artificial Sequence
  Synthetic
agcggcacaggggcagaggttgtgccatttaatgggaagggaactaaggctagcataaagtttcaaactatggta

SEQ ID NO: 22629 - DNA, 75 bp, Artificial Sequence
  Synthetic
catttaatgggaagggaactaaggctagcataaagtttcaaactatggtaaactggttgtgtgaaaacagagtgt

SEQ ID NO: 22630 - DNA, 75 bp, Artificial Sequence
  Synthetic
gtcaggatactttagccccagaacttcctatttgggtatactttccccctcaatatgcttacttgacagtaggag

SEQ ID NO: 22631 - DNA, 75 bp, Artificial Sequence
  Synthetic
tcccctagaaaacccatcctctctgtttgacttagttgctcgtattaaaaataaccttaaaaactctccagactt

SEQ ID NO: 22632 - DNA, 75 bp, Artificial Sequence
  Synthetic
aatgagctacaagctgggcccccgcaaagtgctgttgacagtgctgcaaggattcatgactttaggtatagccaa

SEQ ID NO: 22633 - DNA, 75 bp, Artificial Sequence
  Synthetic
ggggcagtaatcctgtcaaaagcatgtggagtgagggggccacttttagtgccaactctgtaacttgtacatttt

SEQ ID NO: 22634 - DNA, 75 bp, Artificial Sequence
  Synthetic
atgcatgttagtagaccatgaatacaagtacccatatgtgttagggcaaggtcaggatactttagccccagaact

SEQ ID NO: 22635 - DNA, 75 bp, Artificial Sequence
  Synthetic
ggagctgggaaagccttaacaggccttagcacaggtacctctcaaaacactagaatatccttacgcccggggcca

SEQ ID NO: 22636 - DNA, 75 bp, Artificial Sequence
  Synthetic
caatatgcttacttaacagtaggagatgttaacacacaaggaatttctggagacagcaaaaaattagcaagtgaa

SEQ ID NO: 22637 - DNA, 75 bp, Artificial Sequence
  Synthetic
atgttaacacacaaggaatttctggagacagcaaaaaattagcaagtgaagaatcagcattttatgttttggaac

SEQ ID NO: 22638 - DNA, 75 bp, Artificial Sequence
  Synthetic
acacagataaatatgttacaggaataaatgccatttctcatggtcagaccacttatggtaacgctgaagacaaag

SEQ ID NO: 22639 - DNA, 75 bp, Artificial Sequence
  Synthetic
tgaaccggaagtcccgcctaccggcggcgaccggcggcatctgatttggtgtcttctttttaaaatttttggcgg

SEQ ID NO: 22640 - DNA, 75 bp, Artificial Sequence
  Synthetic
agtatcagcaaggagtgggtagatttccaaatgaaaaagaacagctaaaacagttacagggtttaaacatgcaca

SEQ ID NO: 22641 - DNA, 75 bp, Artificial Sequence
  Synthetic
gtatataagcagctgagttccctgacactttcttttctggttgctttttactggaactcacttgctgttatttgc

SEQ ID NO: 22642 - DNA, 75 bp, Artificial Sequence
  Synthetic
gataactggtggtgctctatgctggacttagacacttctgactgggagcccctaacccactctaacagactcata

SEQ ID NO: 22643 - DNA, 75 bp, Artificial Sequence
  Synthetic
catttaaattggggccccgtaaagctacgggacggtggaatcctcaacctggagtatatcccccgcacgcagcag

SEQ ID NO: 22644 - DNA, 75 bp, Artificial Sequence
  Synthetic
gcaatatatttaagcagcgttgcttctaagcttgattttactggggggccgctggcaggttgcttatactttttt

SEQ ID NO: 22645 - DNA, 75 bp, Artificial Sequence
  Synthetic
caggtggaatgtaacaaatttgaggaaggctatcacattcatgtggttattggtggtccaggactaaatgctaga

SEQ ID NO: 22646 - DNA, 75 bp, Artificial Sequence
  Synthetic
tatttaataatgttctttaccatcttgtaactgaaactgttaaacttaaatttttgccagggatgactaccaaag

SEQ ID NO: 22647 - DNA, 75 bp, Artificial Sequence
  Synthetic
tgtaactgaaactgttaaacttaaatttttgccagggatgactaccaaaggaaaatattttagagatggagagca

SEQ ID NO: 22648 - DNA, 75 bp, Artificial Sequence
  Synthetic
ccagactgtacctgccccctcctgtacctataagacagcctaacacaaaagatatagacaatgtagaatttaagt

SEQ ID NO: 22649 - DNA, 75 bp, Artificial Sequence
  Synthetic
agacacctgtatttctgcctcttttcggcgaggagcctgtcatgctaaaagacctcgcattaccgcaaatacaga

SEQ ID NO: 22650 - DNA, 75 bp, Artificial Sequence
  Synthetic
agtagattttaaccaatatactttgttaagtagtagtcacagcggcagctttcaaatacaaagtgcattaaaatt

SEQ ID NO: 22651 - DNA, 75 bp, Artificial Sequence
  Synthetic
ttaagtagtagtcacagcggcagctttcaaatacaaagtgcattaaaattagctatttataaagccactagctta

SEQ ID NO: 22652 - DNA, 75 bp, Artificial Sequence
  Synthetic
ggaagtcccgcccaccggaagtgacgtcacaggaaatgacgtcacaggaaatgacgtaattgtccgccatcttgt

SEQ ID NO: 22653 - DNA, 75 bp, Artificial Sequence
  Synthetic
gtacctactagcacttttttgttacattcagactttgagcaggttacttgtattaaagataataaaatagttaaa

SEQ ID NO: 22654 - DNA, 75 bp, Artificial Sequence
  Synthetic
attcagactttgagcaggttacttgtattaaagataataaaatagttaaattgttattgtgccaaaactatgatc

SEQ ID NO: 22655 - DNA, 75 bp, Artificial Sequence
  Synthetic
acaggaaatgacgtaactgtccgccatcttgaaccggaagtcccgcctaccggcggcgaccggcggcatctgatt

SEQ ID NO: 22656 - DNA, 75 bp, Artificial Sequence
  Synthetic
cggcggcgaccggcggcatctgatttggtgtcttctttttaaaatttttggcgggctttttcccgccttatgcaa

SEQ ID NO: 22657 - DNA, 75 bp, Artificial Sequence
  Synthetic
atgaacagccatgtttggtgtattattttaattttattggacacaggcctaacggttattataggcggagttacg

SEQ ID NO: 22658 - DNA, 75 bp, Artificial Sequence
  Synthetic
ttttaattttattggacacaggcctaacggttattataggcggagttacggacagtatataagcagctgagtttc

SEQ ID NO: 22659 - DNA, 75 bp, Artificial Sequence
  Synthetic
gtgacactttcttttctggttgcttcttactggaactcacttgctgttatttgcctgctaactaacaggtattta

SEQ ID NO: 22660 - DNA, 75 bp, Artificial Sequence
  Synthetic
gtctgggatgaaggcataattaagtccactattgtggaagctgcgaaagccattttaggtggccagccaaccagg

SEQ ID NO: 22661 - DNA, 75 bp, Artificial Sequence
  Synthetic
gtctgggatgaaggcataattaagtccactattgtggaagctgcgtaagccattttaggtggccagccaaccagg

SEQ ID NO: 22662 - DNA, 75 bp, Artificial Sequence
  Synthetic
gtctgggatgaaggcataattaagtccactattgtggaagctgcgcaagccattttaggtggccagccaaccagg

SEQ ID NO: 22663 - DNA, 75 bp, Artificial Sequence
  Synthetic
gtctgggatgaaggcataattaagtccactattgtggaagctgcggaagccattttaggtggccagccaaccagg

SEQ ID NO: 22664 - DNA, 75 bp, Artificial Sequence
  Synthetic
ttgcctgctaactaacaggtatttatactaacttttaacttactaacatggaactatttaggggtgtgctgcaca

SEQ ID NO: 22665 - DNA, 75 bp, Artificial Sequence
  Synthetic
taatgataactggtggtgctctatgctggacctagacacttctgactgggagccactaacccactctaacagact

SEQ ID NO: 22666 - DNA, 75 bp, Artificial Sequence
  Synthetic
gaggaaggctatcacattcatgtggttattggtggtccaggactgaatgctagaaatttaactgtgtgtgtagaa

SEQ ID NO: 22667 - DNA, 75 bp, Artificial Sequence
  Synthetic
aaaggaaaatattttagagatggagagcagtttatagaaaattacttaatgaaaaaaattcctttaaatgttgtg

SEQ ID NO: 22668 - DNA, 75 bp, Artificial Sequence
  Synthetic
gtccccgggaccagttcaggagaatcatctgtcggaagcccagtttcctccgaagtggtagccgcgtcgtgggag

SEQ ID NO: 22669 - DNA, 75 bp, Artificial Sequence
  Synthetic
cagacaatgttactagtgaaaccggggagtctagctgtggagggggagatgttgtaccatttgctggaaagggaa

SEQ ID NO: 22670 - DNA, 75 bp, Artificial Sequence
  Synthetic
gttgtaccatttgctggaaagggaacaaaggcagggttaaagtttcaaaccatggtaaattggctatgtgaaaac

SEQ ID NO: 22671 - DNA, 75 bp, Artificial Sequence
  Synthetic
caaaggcagggttaaagtttcaaaccatggtaaattggctatgtgaaaacagagtatttactgaggataaatgga

SEQ ID NO: 22672 - DNA, 75 bp, Artificial Sequence
  Synthetic
aattagtagattttaaccaatatactttattaagcagtagtcacagtggcagctttcagatacaaagtgcattaa

SEQ ID NO: 22673 - DNA, 75 bp, Artificial Sequence
  Synthetic
ggagcctctaacccattttctgtgttaacttgtaagaaatgtgcttacctgtctgggttacaaagctttgtagat

SEQ ID NO: 22674 - DNA, 75 bp, Artificial Sequence
  Synthetic
tttattaagcagtagtcacagtggcagctttcagatacaaagtgcattaaagttagctatctataaagccactaa

SEQ ID NO: 22675 - DNA, 75 bp, Artificial Sequence
  Synthetic
taacttgtaagaaatgtgcttacctgtctgggttacaaagctttgtagattatgagtaatgccactgacaaatgg

SEQ ID NO: 22676 - DNA, 75 bp, Artificial Sequence
  Synthetic
cttagtacctactagcacttttttgttacattcagactttgagcaggttacttgcattaaagataataaaatagt

SEQ ID NO: 22677 - DNA, 75 bp, Artificial Sequence
  Synthetic
tgggaaagtaatgacacatttgcccaggacgtgtataagcaatttgtacaattttatgaaaaagttactggtaca

SEQ ID NO: 22678 - DNA, 75 bp, Artificial Sequence
  Synthetic
ttacattcagactttgagcaggttacttgcattaaagataataaaatagttaaattgttactgtgccaaaactat

SEQ ID NO: 22679 - DNA, 75 bp, Artificial Sequence
  Synthetic
gatcctcttctagtagggcaacatgtgttaaagtggattgacaaaaaatgtggtaaaaaaaacaccttgtggttt

SEQ ID NO: 22680 - DNA, 75 bp, Artificial Sequence
  Synthetic
tgttaaagtggattgacaaaaaatgtggtaaaaaaaacaccttgtggttttacgggccaccaagtactggaaaaa

SEQ ID NO: 22681 - DNA, 75 bp, Artificial Sequence
  Synthetic
caaatttggctatggctattgccaaaactgttccagtgtatggcatggttaattggaataatgaaaactttccat

SEQ ID NO: 22682 - DNA, 75 bp, Artificial Sequence
  Synthetic
catggacagttatctgaccacccccatgccttatcatccagtgacagtagtacagaacctagaggagaaaatgca

SEQ ID NO: 22683 - DNA, 75 bp, Artificial Sequence
  Synthetic
aattggaataatgaaaactttccatttaatgatgtagcgggaaaaagtttggtggtctgggatgaaggcataatt

SEQ ID NO: 22684 - DNA, 75 bp, Artificial Sequence
  Synthetic
acccggtactaactatgttgggcctggcaatgagttacaagctgggcctccgcagaatgctgtggacagtgctgc

SEQ ID NO: 22685 - DNA, 75 bp, Artificial Sequence
  Synthetic
cagggtagatcaaaaaatgcgtggcagtgtggcagtgcctggtgtgcctgtggttataaccagcaatggtgacat

SEQ ID NO: 22686 - DNA, 75 bp, Artificial Sequence
  Synthetic
tggttataaccagcaatggtgacattacctttgttgtaagtggtaataccactacaactgtgcatgctaaagcct

SEQ ID NO: 22687 - DNA, 75 bp, Artificial Sequence
  Synthetic
aatgaaacagggtttcaagcacaagcagtaaaagattactttactttaaaaggtgcagctgcccctgtggcccat

SEQ ID NO: 22688 - DNA, 75 bp, Artificial Sequence
  Synthetic
atttccctggaataaatgcagatgccctccacccagacctccaaaccacccccattgtcccagacaccagtatca

SEQ ID NO: 22689 - DNA, 75 bp, Artificial Sequence
  Synthetic
catgtggaatgaaggggctacattcactgctaattctgtaacatgcacattttctagacagtttttaattccata

SEQ ID NO: 22690 - DNA, 75 bp, Artificial Sequence
  Synthetic
gaatcatttgtcggaagcccagtttcctccgaagtggtagccgcgtcgtgggaggaagccttttacacgccactt

SEQ ID NO: 22691 - DNA, 75 bp, Artificial Sequence
  Synthetic
gcagatcagtttcgtgaactgttagtaggggttgactttgtatgggatggtgtgaggggattgcctgtttgttgt

SEQ ID NO: 22692 - DNA, 75 bp, Artificial Sequence
  Synthetic
gtggaacatattaataacagtgggggagggttggggctttgtcctcattgtattaatgtgggagcttggtataat

SEQ ID NO: 22693 - DNA, 75 bp, Artificial Sequence
  Synthetic
tattaatgtgggagcttggtataatggatggaaatttagagagtttactccagacttagtgcgctgtagttgtca

SEQ ID NO: 22694 - DNA, 75 bp, Artificial Sequence
  Synthetic
tataagtacccatatgtgctgggtcagggacaagacacattagctccagaactgcccatttgggtgtactttcct

SEQ ID NO: 22695 - DNA, 75 bp, Artificial Sequence
  Synthetic
gtgaagtaaacacacagggagttttaggagacagcaaaaaattagctagtgaagaatcagctttttatgttttgg

SEQ ID NO: 22696 - DNA, 75 bp, Artificial Sequence
  Synthetic
tacagatttagaacttattcaaattttaaaagatcattataacatttctttagataatcctttagagaacccctc

SEQ ID NO: 22697 - DNA, 75 bp, Artificial Sequence
  Synthetic
tagataatcctttagagaacccctcttccttatttgacttagttgctcgcattaaaagtaatcttaaaaactctc

SEQ ID NO: 22698 - DNA, 75 bp, Artificial Sequence
  Synthetic
ttccttatttgacttagttgctcgcattaaaagtaatcttaaaaactctccagacctatatagtcatcattttca

SEQ ID NO: 22699 - DNA, 75 bp, Artificial Sequence
  Synthetic
tttttatgaaatgtacaaccccctgtatggttcccgtttaggagtgcctgacacattaggaggggaccctaaatt

SEQ ID NO: 22700 - DNA, 75 bp, Artificial Sequence
  Synthetic
gtagtacagaacctagaggagaaaatgcagtattatctaatgaagacttacacaagcctgggcaagttagcatgc

SEQ ID NO: 22701 - DNA, 75 bp, Artificial Sequence
  Synthetic
ctgggccactgattaactcagtgtctaccaaagaaggagacacctctaatacaggtgctggaaaagcccttacgg

SEQ ID NO: 22702 - DNA, 75 bp, Artificial Sequence
  Synthetic
taccaaagaaggagacacctctaatacaggtgctggaaaagcccttacggggctaagtactggcaccagtcaaag

SEQ ID NO: 22703 - DNA, 75 bp, Artificial Sequence
  Synthetic
cctccgcagaatgctgtggacagtgctgcaaggattcatgactttaggtatagccaattggctaagttgggaata

SEQ ID NO: 22704 - DNA, 75 bp, Artificial Sequence
  Synthetic
caccagaatttccctgcgcccaggtccagtgtctcagccataccatcactgggacactgataaatatgtaacagg

SEQ ID NO: 22705 - DNA, 75 bp, Artificial Sequence
  Synthetic
aagcagttacaagggctaaacatgcacacatactttcccaataaaggtacccaacaatacacagatcaaattgaa

SEQ ID NO: 22706 - DNA, 75 bp, Artificial Sequence
  Synthetic
cagacgaagagttgttaaaaaatataaaaaatgaaacagggtttcaagcacaagcagtaaaagattactttactt

SEQ ID NO: 22707 - DNA, 75 bp, Artificial Sequence
  Synthetic
acacatactttcccaataaaggtacccaacaatacacagatcaaattgaaagacctctaatggtaggctctgtgt

SEQ ID NO: 22708 - DNA, 75 bp, Artificial Sequence
  Synthetic
gtgcccgcgtacaacgcctcagaaaaataccccagcatgacttcagttaactctgcagaagccagcactggtgca

SEQ ID NO: 22709 - DNA, 75 bp, Artificial Sequence
  Synthetic
aaagcatgtggagtgaaggggctacatttactgctaattctgtaacatgcacattctctaggcagtttttaattc

SEQ ID NO: 22710 - DNA, 75 bp, Artificial Sequence
  Synthetic
catatgacccagagcatcattataaagtattttctccagcagccagtagctgccacaatgctagtgggaaagagg

SEQ ID NO: 22711 - DNA, 75 bp, Artificial Sequence
  Synthetic
tgccacaatgctagtgggaaagaggcaaaagtgtgcactattagtcctattatgggatactctactccgtggaga

SEQ ID NO: 22712 - DNA, 75 bp, Artificial Sequence
  Synthetic
caacaccacagacacggatatgaaaagcctgaagaattgtggactgccaaaagccgtgtgcacccactgtaaaca

SEQ ID NO: 22713 - DNA, 75 bp, Artificial Sequence
  Synthetic
tgttacagacaaaacaggaggaggtgtgcaagtaactgacagcaccacaggacgtttgtgtatgttagtggacca

SEQ ID NO: 22714 - DNA, 75 bp, Artificial Sequence
  Synthetic
aaggatacagacgctgtagagtataagttgctaaccagatatgaacaacatgtaattagaatgcttagattatgt

SEQ ID NO: 22715 - DNA, 75 bp, Artificial Sequence
  Synthetic
agttgctaaccagatatgaacaacatgtaattagaatgcttagattatgtaatatgtacacaaatttggaaaaat

SEQ ID NO: 22716 - DNA, 75 bp, Artificial Sequence
  Synthetic
ggtcagggacaagacacattagctccagaactgcctatttgggtgtactttcctccccagtatgcttacttaaca

SEQ ID NO: 22717 - DNA, 75 bp, Artificial Sequence
  Synthetic
aaaaattttaaaaagaagacaccaaatcagatgccgccggtcgccgccggtaggcgggacttccggttcaagatg

SEQ ID NO: 22718 - DNA, 75 bp, Artificial Sequence
  Synthetic
tagtgaagaatcagctttttatgttttggaacacagctcctttcaacttttaggtacaggtggctctgctacaat

SEQ ID NO: 22719 - DNA, 75 bp, Artificial Sequence
  Synthetic
taggtacaggtggctctgctacaatgtcctataaatttccagccgtgcccccagaaaacttagagggctgcagtc

SEQ ID NO: 22720 - DNA, 75 bp, Artificial Sequence
  Synthetic
caggtccagtgtctcagccataccatcactgggacactgataaatatgtaacaggaataaatgccatttcacaag

SEQ ID NO: 22721 - DNA, 75 bp, Artificial Sequence
  Synthetic
caggtccagtgtctcagccataccatcactgggacactgataaatatgtaacaggaataaatgccatttcacatg

SEQ ID NO: 22722 - DNA, 75 bp, Artificial Sequence
  Synthetic
caggtccagtgtctcagccataccatcactgggacactgataaatatgtaacaggaataaatgccatttcacacg

SEQ ID NO: 22723 - DNA, 75 bp, Artificial Sequence
  Synthetic
caggtccagtgtctcagccataccatcactgggacactgataaatatgtaacaggaataaatgccatttcacagg

SEQ ID NO: 22724 - DNA, 75 bp, Artificial Sequence
  Synthetic
tgctgaagacaaagagtatcagcaaggggtaggaaggtttccaaatgaaaaagaacaacttaagcagttacaagg

SEQ ID NO: 22725 - DNA, 75 bp, Artificial Sequence
  Synthetic
cctgacacattaggaggggaccctaaatttagatcattaacacacgaggaccacgcaattcagccacaaaacttt

SEQ ID NO: 22726 - DNA, 75 bp, Artificial Sequence
  Synthetic
cactgggacactgataaatatgtaacaggaataaatgccatctcacatggacaaaccacttatggaaatgctgaa

SEQ ID NO: 22727 - DNA, 75 bp, Artificial Sequence
  Synthetic
gacaaagagtatcagcaaggggtaggaaggtttccaaatgaaaaagaacaacttaagcagttacaagggctaaac

SEQ ID NO: 22728 - DNA, 75 bp, Artificial Sequence
  Synthetic
atgcacacatactttcctaataaaggtacccaacaatacacagatcaaattgaaagacctttaatggtgggctct

SEQ ID NO: 22729 - DNA, 75 bp, Artificial Sequence
  Synthetic
gtgtggaacagaagagctcttcactatgaaagtcagttatggagtaaaatccctaacttagatgatagttttaaa

SEQ ID NO: 22730 - DNA, 75 bp, Artificial Sequence
  Synthetic
actcaatttgcagcgttaggcgggtggggattgcaccaaccaccccctcaaatatttttaaaaatactaccgcaa

SEQ ID NO: 22731 - DNA, 75 bp, Artificial Sequence
  Synthetic
agtgggcccattggaggtattaaatccatgggaattactactttagtccagtatgctgtaggaattatgacagtc

SEQ ID NO: 22732 - DNA, 75 bp, Artificial Sequence
  Synthetic
ccatgggaattactactttagtccagtatgctgtaggaattatgacagtcactatgacatttaaattgggacctc

SEQ ID NO: 22733 - DNA, 75 bp, Artificial Sequence
  Synthetic
gcagctggtcatttaccatatgtactgtatgaccccacagctacagatgcaaagcaacaccacagacacggatat

SEQ ID NO: 22734 - DNA, 75 bp, Artificial Sequence
  Synthetic
gaaaagcctgaagaattgtggactgccaaaagccgtgtgcacccactgtaaacattccccaccgtgtcctaagcc

SEQ ID NO: 22735 - DNA, 75 bp, Artificial Sequence
  Synthetic
aggaaccgtcacccaccgtccacctgtaccgcctagattatatgtgccccctcctgtacccagtaggcaaccatc

SEQ ID NO: 22736 - DNA, 75 bp, Artificial Sequence
  Synthetic
agtgaaggggctacatttactgctaattctgtaacatgtacattttctaggcagtttttaattccatatgaccca

SEQ ID NO: 22737 - DNA, 75 bp, Artificial Sequence
  Synthetic
aatcagatgccgccggtcgccgccggtaggcgggacttccggttcaagatggcggacagttacgtcatttcctgt

SEQ ID NO: 22738 - DNA, 75 bp, Artificial Sequence
  Synthetic
ggaagtcccgcctaccggcggcgaccggcggcatctgatttggtgtcttctttttaaaattttggcgggcttttt

SEQ ID NO: 22739 - DNA, 75 bp, Artificial Sequence
  Synthetic
tgtttagtgttttattttaattttattggacaaaggcctaacggttattatgggcggagctacggacagtatata

SEQ ID NO: 22740 - DNA, 75 bp, Artificial Sequence
  Synthetic
tgggcggagctacggacagtatataagcagctgggttccgtgacactttcttttctggttgcttcttactggaat

SEQ ID NO: 22741 - DNA, 75 bp, Artificial Sequence
  Synthetic
aaacacacaaggaatttcaggagacagcaaaaaattggctagtgaagaatcagccttctatgtgttggaacatag

SEQ ID NO: 22742 - DNA, 75 bp, Artificial Sequence
  Synthetic
actaattaactcagtgtctaccaaagaaggagacaattctaatacaggtgctggaaaagcccttacgggtcttag

SEQ ID NO: 22743 - DNA, 75 bp, Artificial Sequence
  Synthetic
ggtggtgctctatgctggacttagacacttctgactgggaaccactaacccactctaacagacttatggcaatat

SEQ ID NO: 22744 - DNA, 75 bp, Artificial Sequence
  Synthetic
cacttctgactgggaaccactaacccactctaacagacttatggcaatatatttaagtagcgttgcttctaaact

SEQ ID NO: 22745 - DNA, 75 bp, Artificial Sequence
  Synthetic
tgattttactggggggccgctagcaggttgcttatacttttttcaggtggaatgtaacaaatttgaggaaggcta

SEQ ID NO: 22746 - DNA, 75 bp, Artificial Sequence
  Synthetic
ccgtgtcctaagccaggaaccgtcaccaaccgcccacctgtaccgcctagattatatgtgccccctccagtaccc

SEQ ID NO: 22747 - DNA, 75 bp, Artificial Sequence
  Synthetic
ccaggactaaatgctagaaacttaactgtgtgtgtagaaggtttatttaataatgttctttaccatcttgtaact

SEQ ID NO: 22748 - DNA, 75 bp, Artificial Sequence
  Synthetic
gaaagtgttaaacttaaatttttgccagggatgactaccaaaggaaaatattttagagatggagagcaatttata

SEQ ID NO: 22749 - DNA, 75 bp, Artificial Sequence
  Synthetic
taaaataaatatctaatagtgtatgttgcttaaaaattttaaaaagaagacaccaaatcagatgccgccggtcgc

SEQ ID NO: 22750 - DNA, 75 bp, Artificial Sequence
  Synthetic
aaatattgatgggtatatagacacctgtatttctgcctcttttcggcgaggagcctgtcatgctaaaagaccccg

SEQ ID NO: 22751 - DNA, 75 bp, Artificial Sequence
  Synthetic
cattaccgcaaatacagacaatattgctggtgaaactggggagtctagctgtggagggggagatgttgtgccatt

SEQ ID NO: 22752 - DNA, 75 bp, Artificial Sequence
  Synthetic
tatagaaaactatttaatgaaaaaaatacctttaaatgttgggtggtgtgtgactaatattgatggatatataga

SEQ ID NO: 22753 - DNA, 75 bp, Artificial Sequence
  Synthetic
gtggagggggagatgttgtgccatttgctgggaagggaacaaaggcagggttaaagtttcaaaccatggtaaatt

SEQ ID NO: 22754 - DNA, 75 bp, Artificial Sequence
  Synthetic
aggggagcttgccatgccaagaaaccccgcattaccacagccataaatgatactagtagggatgctggggaggct

SEQ ID NO: 22755 - DNA, 75 bp, Artificial Sequence
  Synthetic
tttaaccagtatactttattaagcagcagtcacagtggcagctttcaaatacaaagtgcattaaagttagctatt

SEQ ID NO: 22756 - DNA, 75 bp, Artificial Sequence
  Synthetic
tataaagccaccaacttggtacccactagtacttttttgttacattcagactttgagcaagttacttgtattaaa

SEQ ID NO: 22757 - DNA, 75 bp, Artificial Sequence
  Synthetic
ctagtacttttttgttacattcagactttgagcaagttacttgtattaaagacaataaaatagttaaattgttat

SEQ ID NO: 22758 - DNA, 75 bp, Artificial Sequence
  Synthetic
tgtgccaaaactatgatcctcttttagtaggtcaacatgtgttaaagtggattgacaaaaaatgtggcaaaaaaa

SEQ ID NO: 22759 - DNA, 75 bp, Artificial Sequence
  Synthetic
acactttgtggttttacgggccaccaagtactggaaaaacaaatttggctatggctattgcaaaaactgttccag

SEQ ID NO: 22760 - DNA, 75 bp, Artificial Sequence
  Synthetic
gcggggaaaagtttggtggtctgggatgaaggcattattaagtccactattgtggaagctgcaaaagccatttta

SEQ ID NO: 22761 - DNA, 75 bp, Artificial Sequence
  Synthetic
tgtggaagctgcaaaagccattttaggtggtcagccaaccagggtagatcaaaaaatgcgtggcagtgtggcagt

SEQ ID NO: 22762 - DNA, 75 bp, Artificial Sequence
  Synthetic
acatgctaaagccttaaaagaacggatggtaaagctaaactttaccgtaagatgtagccctgacatgggtttact

SEQ ID NO: 22763 - DNA, 75 bp, Artificial Sequence
  Synthetic
agacaccagtatcagcagcagtggtggtgaaagctctgaagaactcagtgaaagcagctttttcaacctcatcac

SEQ ID NO: 22764 - DNA, 75 bp, Artificial Sequence
  Synthetic
ggaccagttcaggagaatcatctgtcggaagcccagtttcctccgaagtggtagccgcgtcgtgggaagaagctt

SEQ ID NO: 22765 - DNA, 75 bp, Artificial Sequence
  Synthetic
tttgtatgggatggtgtgaggggattgcctgtttgttgtgtggaacatattaataacagtgggggggggttgggg

SEQ ID NO: 22766 - DNA, 75 bp, Artificial Sequence
  Synthetic
taaaaaatgtgcttacctgtctggattacaaagctttgtagattatgagtaagaccactgacaaatggtgggaaa

SEQ ID NO: 22767 - DNA, 75 bp, Artificial Sequence
  Synthetic
gaaaaacttactggtacagatttagagcttattcaaattttaaaagatcattataacatttctttagataatcct

SEQ ID NO: 22768 - DNA, 75 bp, Artificial Sequence
  Synthetic
agtcatcattttcagagccatggacagttatctgaccacccccatgccttatcacccagtgacagtagtacagaa

SEQ ID NO: 22769 - DNA, 75 bp, Artificial Sequence
  Synthetic
tgctgtggacagtgctgcaaggattcatgactttaggtatagccaattggctaagttgggaataaacccgtatac

SEQ ID NO: 22770 - DNA, 75 bp, Artificial Sequence
  Synthetic
atgacttcagttaactctgcagaagccagcactggtgcaggcgggggagggagcaaccctacaaaaagcatgtgg

SEQ ID NO: 22771 - DNA, 75 bp, Artificial Sequence
  Synthetic
ctactccgtggagatacttagattttaatgctttaaatttgtttttttcaccactagagtttcagcacttaattg

SEQ ID NO: 22772 - DNA, 75 bp, Artificial Sequence
  Synthetic
tgacagcaccacaggacgtttgtgtatgttagtggaccatgaatataagtacccatatgtgctgggtcagggaca

SEQ ID NO: 22773 - DNA, 75 bp, Artificial Sequence
  Synthetic
agacacattagctccagaactgcccatttgggtgtactttcccccccagtatgcttacttaacagtaggtgaggt

SEQ ID NO: 22774 - DNA, 75 bp, Artificial Sequence
  Synthetic
aaacacacaaggaatttcaggagacagcaaaaaattggctagtgaagaatcagctttttatgtgttggaacacag

SEQ ID NO: 22775 - DNA, 75 bp, Artificial Sequence
  Synthetic
agcaaaaaattggctagtgaagaatcagctttttatgtgttggaacacagttcatttgaacttttagggacaggt

SEQ ID NO: 22776 - DNA, 75 bp, Artificial Sequence
  Synthetic
ctggaaaagcccttacgggtcttagtactggcactagtcaaaacactagaatttccctgcgcccaggtccagtgt

SEQ ID NO: 22777 - DNA, 75 bp, Artificial Sequence
  Synthetic
tactggcactagtcaaaacactagaatttccctgcgcccaggtccagtgtctcagccataccatcattgggacac

SEQ ID NO: 22778 - DNA, 75 bp, Artificial Sequence
  Synthetic
tgataagtatgtaacaggaataaatgccatttcacatgggcaaaccacttatggaaatgctgaagacaaagagta

SEQ ID NO: 22779 - DNA, 75 bp, Artificial Sequence
  Synthetic
atggaaatgctgaagacaaagagtatcagcaaggggtaggtaggtttccaaatgaaaaagaacaacttaagcaat

SEQ ID NO: 22780 - DNA, 75 bp, Artificial Sequence
  Synthetic
tacaagggctaaacatgcacacatactttcctaataaaggaacccaacaatacacagatcaaattgaacggcctc

SEQ ID NO: 22781 - DNA, 75 bp, Artificial Sequence
  Synthetic
tacacagatcaaattgaacggcctcttatggtaggctctgtgtggaaccgaagagctcttcattatgaaagtcag

SEQ ID NO: 22782 - DNA, 75 bp, Artificial Sequence
  Synthetic
ctatggagtaagatccctaacttagatgatagttttaaaactcaatttgcagccttaggcgggtggggattgcat

SEQ ID NO: 22783 - DNA, 75 bp, Artificial Sequence
  Synthetic
atgatagttttaaaactcaatttgcagccttaggcgggtggggattgcatcaaccgccccctcaaatatttttaa

SEQ ID NO: 22784 - DNA, 75 bp, Artificial Sequence
  Synthetic
acttctgactgggaaccactaactcactctaacagactaatggcaatatatttaagcaatgttgcttctagactg

SEQ ID NO: 22785 - DNA, 75 bp, Artificial Sequence
  Synthetic
ggaaggtggaatcctcaacctggagtttaccctcctcatgcagctggtcatttaccatatgtactgtatgacccc

SEQ ID NO: 22786 - DNA, 75 bp, Artificial Sequence
  Synthetic
ccaaccgcccacctgtaccgcctagattatatgtgccccctccagtacccagtaggcaaccatctgtaaaagata

SEQ ID NO: 22787 - DNA, 75 bp, Artificial Sequence
  Synthetic
agtaggcaaccatctgtaaaagatacagacgctgtagagtataaattgctaactagatatgaacaacatgtaatt

SEQ ID NO: 22788 - DNA, 75 bp, Artificial Sequence
  Synthetic
aactagatatgaacaacatgtaattagaatgctcagattatgtaatatgtacacaaatttggaaaaataaaagcc

SEQ ID NO: 22789 - DNA, 75 bp, Artificial Sequence
  Synthetic
agaatgctcagattatgtaatatgtacacaaatttggaaaaataaaagcctaaaataaataactaatagtgtatg

SEQ ID NO: 22790 - DNA, 75 bp, Artificial Sequence
  Synthetic
aaataactaatagtgtatgttgctttaaaaattttaaaaagaagacaccaaatcagatgccgccggtcgccgccg

SEQ ID NO: 22791 - DNA, 75 bp, Artificial Sequence
  Synthetic
tagtacatttttaatgcattcagactttgagcaggttacctgtattaaagataataaaatagttaaactattatt

SEQ ID NO: 22792 - DNA, 75 bp, Artificial Sequence
  Synthetic
aattcaaagtgcactaaaactagcaatttataaagcaactaatttagtgcctacaagcacatttctattgcatac

SEQ ID NO: 22793 - DNA, 75 bp, Artificial Sequence
  Synthetic
cagtatatggcatggttaactggaataatgaaaactttccatttaatgatgtagcagggaaaagcttggtggtct

SEQ ID NO: 22794 - DNA, 75 bp, Artificial Sequence
  Synthetic
gtagcagggaaaagcttggtggtctgggatgaaggtattattaagtctacaattgtagaagctgcaaaagccatt

SEQ ID NO: 22795 - DNA, 75 bp, Artificial Sequence
  Synthetic
tgtacatgctaaagccttaaaagagcgaatggtaaagttaaactttactgtaagatgcagccctgacatggggtt

SEQ ID NO: 22796 - DNA, 75 bp, Artificial Sequence
  Synthetic
gtgcggtgtagctgccatgtgggagcttctaatcccttttctgtgctaacctgcaaaaaatgtgcttacctgtct

SEQ ID NO: 22797 - DNA, 75 bp, Artificial Sequence
  Synthetic
agcatgacttcagttaattctgcagaagccagcactggtgcaggagggggtggcagtaatcctgtcaaaagcatg

SEQ ID NO: 22798 - DNA, 75 bp, Artificial Sequence
  Synthetic
aagaaagtggcaaatggtgggaaagcaatgataaatttgctaaggacgtgtataagcaatttgtagaattttatg

SEQ ID NO: 22799 - DNA, 75 bp, Artificial Sequence
  Synthetic
tagtgaagacttacacaagcctgggcaagttagcatacaattacccggtactaactatgttgggcctggcaatga

SEQ ID NO: 22800 - DNA, 75 bp, Artificial Sequence
  Synthetic
tagcacaggcacctctcaaaacactagaatatccttacgccctgggccagtgtcacagccataccaccactggga

SEQ ID NO: 22801 - DNA, 75 bp, Artificial Sequence
  Synthetic
tgttaaaaaatataaaaaatgaaactgggtttcaagcacaagcagtaaaagattactttactttaaaaggtgcag

SEQ ID NO: 22802 - DNA, 75 bp, Artificial Sequence
  Synthetic
attactaccttagttcagtatgccgtgggaattatgacagtaactatgacatttaaattggggccccgtaaagct

SEQ ID NO: 22803 - DNA, 75 bp, Artificial Sequence
  Synthetic
cgcagctagtagctgccataatgccagtgggaaagaggcaaaggtttgcactattagtcccataatgggctactc

SEQ ID NO: 22804 - DNA, 75 bp, Artificial Sequence
  Synthetic
ttaacagtgtgtgtagaggggttatttaacaatgtactttatcaccttgtaactggaaatgtaaagctaaaattt

SEQ ID NO: 22805 - DNA, 75 bp, Artificial Sequence
  Synthetic
aatttataaagcaactaatttagtgcctactagcacatttttattgcatacagactttgagcaggttatgtgtat

SEQ ID NO: 22806 - DNA, 75 bp, Artificial Sequence
  Synthetic
caattgtagaagctgcaaaagccattttaggcgggcaacctaccagggtagatcaaaaaatgcgtggaagtgtag

SEQ ID NO: 22807 - DNA, 75 bp, Artificial Sequence
  Synthetic
atatagtcatcattttcaaagtcatggacagttatctgaccacccccatgccttatcatccagtaacagtcatgc

SEQ ID NO: 22808 - DNA, 75 bp, Artificial Sequence
  Synthetic
agaacctagaggagaaaatgcagtattatctagtgaagacttacacaagcctgggcaagttagcgtacaactacc

SEQ ID NO: 22809 - DNA, 75 bp, Artificial Sequence
  Synthetic
ggggcagtaatcctgttaaaagcatgtggagtgagggggccacttttagtgccgactctgtaacttgcacatttt

SEQ ID NO: 22810 - DNA, 75 bp, Artificial Sequence
  Synthetic
attttaatgctttaaatttgtttttttcacctttagagtttcagcatttaattgaaaactatggaagtatagctc

SEQ ID NO: 22811 - DNA, 75 bp, Artificial Sequence
  Synthetic
attgaaaactatggaagtatagctcctgatgctttaactgtaaccatatcagaaattgctgttaaggatgttaca

SEQ ID NO: 22812 - DNA, 75 bp, Artificial Sequence
  Synthetic
tagcataaagtttcagactatggtaaactggttgtgtgaaaacagagtgtttacagaggataagtggaaactagt

SEQ ID NO: 22813 - DNA, 75 bp, Artificial Sequence
  Synthetic
gacaaaactggagggggagtacaagttactgacagcactaccgggcgcctatgcatgttagtagaccatgaatac

SEQ ID NO: 22814 - DNA, 75 bp, Artificial Sequence
  Synthetic
gaatcagcattttatgttttggaacacagttcttttcaacttttaggtacaggaggtacagcaagtatgtcctat

SEQ ID NO: 22815 - DNA, 75 bp, Artificial Sequence
  Synthetic
ggagctggaaaagccttaacaggccttagcacaggaacctctcaaaacactagaatatccttacgccctgggcca

SEQ ID NO: 22816 - DNA, 75 bp, Artificial Sequence
  Synthetic
gtgtctcagccatatcaccactgggacacagataaatatgttacaggaataaatgccatttctcatggtcagacc

SEQ ID NO: 22817 - DNA, 75 bp, Artificial Sequence
  Synthetic
acacagataaatatgttacaggaataaatgccatttctcatggtcagaccacatatggtaatgctgaagataaag

SEQ ID NO: 22818 - DNA, 75 bp, Artificial Sequence
  Synthetic
ccggtaggcgggacttccggtacaagatggcggacaattacgtcatttccggaattagggttggctctgggccag

SEQ ID NO: 22819 - DNA, 75 bp, Artificial Sequence
  Synthetic
cttgcttggggttgacgtgccactaagacaagcggcgcgccgcttgatcttagtgtcaaggcaaccccaagcgct

SEQ ID NO: 22820 - DNA, 75 bp, Artificial Sequence
  Synthetic
agacaagcggcgcgccgcttgatcttagtgtcaaggcaaccccaagcgctggcccagagccaaccctaattccgg

SEQ ID NO: 22821 - DNA, 75 bp, Artificial Sequence
  Synthetic
agcggcgcgccgcttgtcttagtgtcaaggcaaccccaagcaagctggcccagagccaaccctaattccggaagt

SEQ ID NO: 22822 - DNA, 75 bp, Artificial Sequence
  Synthetic
cggcatctgatttggtgtcttcttttaaattttcgcgggctttttcccgccttatgcaaataacctgccatgttt

SEQ ID NO: 22823 - DNA, 75 bp, Artificial Sequence
  Synthetic
gatgctttattttaatttgattggacaaaaacttaacggtttttatgggcggagttacgcatggtatataagcag

SEQ ID NO: 22824 - DNA, 75 bp, Artificial Sequence
  Synthetic
tgttaaacttaaatttttgccaggaatgactactaagggaaagtattttagagatggagagcagtttatagaaaa

SEQ ID NO: 22825 - DNA, 75 bp, Artificial Sequence
  Synthetic
ttctgcatcttttagacgaggagcttgccatgctaaaaaacctcgaattagtgcaaacacagacactgttaataa

SEQ ID NO: 22826 - DNA, 75 bp, Artificial Sequence
  Synthetic
cactatgaaaactgggcaataaactacacgtttgatttccctggaataaatgcagatgccctccacccagacctc

SEQ ID NO: 22827 - DNA, 75 bp, Artificial Sequence
  Synthetic
cccttttctgtgttaacctgcaaaaaatgtgcttacttgtctggattgcaaagttttgtagattatgagtaaaga

SEQ ID NO: 22828 - DNA, 75 bp, Artificial Sequence
  Synthetic
aagtggcaaatggtgggaaagtgatgataaatttgctaaggacgtgtataagcaatttgtaaaattttatgaaca

SEQ ID NO: 22829 - DNA, 75 bp, Artificial Sequence
  Synthetic
ccagtagcagtcatacagaacctagaggagaaaatgcagtattatctagtgaagacttacacaagcctgggcaag

SEQ ID NO: 22830 - DNA, 75 bp, Artificial Sequence
  Synthetic
ccatatgacccagagcaccattataaggtgttttctcccgcagcaagtagctgccacaatgccagtggaaaggag

SEQ ID NO: 22831 - DNA, 75 bp, Artificial Sequence
  Synthetic
accatatcagaaattgctgttaaggatgttacagacaaaactggaggaggggtgcaggttactgacagcactaca

SEQ ID NO: 22832 - DNA, 75 bp, Artificial Sequence
  Synthetic
atgaatacaagtacccatatgtgttagggcaaggtcaagatactttagccccagaacttcccatttgggtgtact

SEQ ID NO: 22833 - DNA, 75 bp, Artificial Sequence
  Synthetic
tagtcccataatgggctactcaacgccatggagatacttagactttaatgctttaaacttatttttttcaccttt

SEQ ID NO: 22834 - DNA, 75 bp, Artificial Sequence
  Synthetic
cccagaaaatttagagggctgcagtcaacacttttatgaaatgtacaatcccttatacggatcccgcttaggggt

SEQ ID NO: 22835 - DNA, 75 bp, Artificial Sequence
  Synthetic
ggaggaggggtgcaggttactgacagtactacagggcgtttatgcatgttagtagatcatgagtacaagtaccca

SEQ ID NO: 22836 - DNA, 75 bp, Artificial Sequence
  Synthetic
aaatatttttaaaaatattaccacaaagtgggccaattggaggtattaaatcaatgggaattactaccttagttc

SEQ ID NO: 22837 - DNA, 75 bp, Artificial Sequence
  Synthetic
cgcagcaggtcatttaccatatgtactatatgaccccacagctacagatgcaaaacaacaccacagacatggata

SEQ ID NO: 22838 - DNA, 75 bp, Artificial Sequence
  Synthetic
gccttgacactaagatcaagcggcgcgccgcttgtcttagtggcacgtcaaccccaagcaagctggcccagagcc

SEQ ID NO: 22839 - DNA, 75 bp, Artificial Sequence
  Synthetic
ccttatgcaaatgggcagccattttaagtgtttaactacaattttattggttagttttgtaacggttaaaatagg

SEQ ID NO: 22840 - DNA, 75 bp, Artificial Sequence
  Synthetic
gcttagattgtgtaatatgtatacaaatttggaaaaataaatggcttaaataaataactaatagtgtatgttgct

SEQ ID NO: 22841 - DNA, 75 bp, Artificial Sequence
  Synthetic
ccattggaggtattaaatcaatgggaattactaccttagttcagtatgccgtgggaataatgacagtaatcatga

SEQ ID NO: 22842 - DNA, 75 bp, Artificial Sequence
  Synthetic
ccaaccctaattccggaagtcccgcccaccggaagtgacgtcacaggaaatgacgtcacaggaaatgacgtagtt

SEQ ID NO: 22843 - DNA, 75 bp, Artificial Sequence
  Synthetic
cgcctaccggcggcgaccggcggcatctgatttggtgtcttcttttaaattttcgcgggctttttcccgccttat

SEQ ID NO: 22844 - DNA, 75 bp, Artificial Sequence
  Synthetic
tttattttaatttgattggacaaaaagttaacggtttttatgggcggagttacgcatggtatataagcagatgga

SEQ ID NO: 22845 - DNA, 75 bp, Artificial Sequence
  Synthetic
tttatactaacttttaatttactaacatggagctatttaggggtgtgttacatatttcctctaacattttagact

SEQ ID NO: 22846 - DNA, 75 bp, Artificial Sequence
  Synthetic
ggggggccgctggcgggttgcttatactttttccaggcggaatgtaacaaatttgaggaaggttaccatattcat

SEQ ID NO: 22847 - DNA, 75 bp, Artificial Sequence
  Synthetic
gtagttattggtggtccaggactaaatgctagaaacttaacagtgtgtgtagaaggcttgtttaataatgttctt

SEQ ID NO: 22848 - DNA, 75 bp, Artificial Sequence
  Synthetic
ggttataaccagcaatggtgacattacttttgttgtaagtgggaacactacaacaactgtacatgctaaagcctt

SEQ ID NO: 22849 - DNA, 75 bp, Artificial Sequence
  Synthetic
taatgaaaaaaattcctttaaatgttgtgtggtgtgtaacaaatattgacgggtatatagacacctgtatttctg

SEQ ID NO: 22850 - DNA, 75 bp, Artificial Sequence
  Synthetic
aacacagacactgttaataatgaagcaggggaatcaagctgtggagggggagatgtggtgccatttgctgggaag

SEQ ID NO: 22851 - DNA, 75 bp, Artificial Sequence
  Synthetic
atccatatactcattggactgtagcagatgaagagcttttaaaaaatataaaaaatgaaactgggtttcaagcac

SEQ ID NO: 22852 - DNA, 75 bp, Artificial Sequence
  Synthetic
ccagtggtaataaccagcaatggtgacattacttttgttgtgagtggtaataccactacaactgtccatgctaaa

SEQ ID NO: 22853 - DNA, 75 bp, Artificial Sequence
  Synthetic
ccccctcaatatgcttacttaacagtaggagatgtaaacacacaaggaatctctggagacagcaaaaaattagca

SEQ ID NO: 22854 - DNA, 75 bp, Artificial Sequence
  Synthetic
attgtattaatgtgggagcttggtataatggatggaagtttcgagaatttactccagatttggtacggtgtagct

SEQ ID NO: 22855 - DNA, 75 bp, Artificial Sequence
  Synthetic
aaaatgcagtattatctagtgaagacttacacaagcctgggcaagttagcatacaactacccggtactaactatg

SEQ ID NO: 22856 - DNA, 75 bp, Artificial Sequence
  Synthetic
gaaaagtacccaagcatgacttcagttaattctgcagaagccagcactggtgcaggagggggaggcagtaatcct

SEQ ID NO: 22857 - DNA, 75 bp, Artificial Sequence
  Synthetic
ccataatgggctactcaacgccatggagatacttagactttaatgcattaaacttattcttttcacctttagaat

SEQ ID NO: 22858 - DNA, 75 bp, Artificial Sequence
  Synthetic
ttcaacatttaattgaaaattatggaagtatagcccctgatgctttaactgttaccatatcagaaattgctgtta

SEQ ID NO: 22859 - DNA, 75 bp, Artificial Sequence
  Synthetic
cttccaatacaggcgccggaaaagcccttacggggcttagtactggcactagtcaaagcaccagaatatccctgc

SEQ ID NO: 22860 - DNA, 75 bp, Artificial Sequence
  Synthetic
ccatcactgggacactgataagtatgtcacaggaataaatgctatttcacacggacaaaccacttatggaaatgc

SEQ ID NO: 22861 - DNA, 75 bp, Artificial Sequence
  Synthetic
atatgaaaagcctgaagaattgtggactgccaaaagccgtgtgcacccattgtaaacactccccaccgtgtcctc

SEQ ID NO: 22862 - DNA, 75 bp, Artificial Sequence
  Synthetic
cccccgccaataccccgtagagaaccgtgtgtaaaagatacagatgctgtagaatataagttactaacccgttat

SEQ ID NO: 22863 - DNA, 75 bp, Artificial Sequence
  Synthetic
tgtagaatataagttactaacccgttatgaacagcatataataagaatgcttagattgtgtaatatgtatcaaaa

SEQ ID NO: 22864 - DNA, 75 bp, Artificial Sequence
  Synthetic
actagtagtgatgctggggagtctagcggcacaggggcagaggttgtgccatttaatgggaagggaactaaggct

SEQ ID NO: 22865 - DNA, 75 bp, Artificial Sequence
  Synthetic
ccaactctgtaacttgtacattttccagacagtttttaattccatatgacccagagcaccattataaggtgtttt

SEQ ID NO: 22866 - DNA, 75 bp, Artificial Sequence
  Synthetic
gagctggaaaagccttaacaggccttagcacaggtacctctcaaaacactagaatatccttacgccctgggccag

SEQ ID NO: 22867 - DNA, 75 bp, Artificial Sequence
  Synthetic
accggaagtcccgcctaccggcggcgaccggcggcatctgatttggtgtcttcttttaaattttagcgggctttt

SEQ ID NO: 22868 - DNA, 75 bp, Artificial Sequence
  Synthetic
gcagctctttctttctgggctgctttttcctggactttcttgctgttttttgtgagctaactaacaggtatttat

SEQ ID NO: 22869 - DNA, 75 bp, Artificial Sequence
  Synthetic
agctatttagaggggtgcttcaagtttcttctaatgttctggactgtgctaacgataactggtggtgctctttac

SEQ ID NO: 22870 - DNA, 75 bp, Artificial Sequence
  Synthetic
cttctaagcttgactttaccggggggccactagcagggtgcttgtacttttttcaagtagaatgtaacaaatttg

SEQ ID NO: 22871 - DNA, 75 bp, Artificial Sequence
  Synthetic
ggttatttaataatgtactttatcaccttgtaactgaaaatgtgaagctaaaatttttgccaggaatgactacaa

SEQ ID NO: 22872 - DNA, 75 bp, Artificial Sequence
  Synthetic
ggtgtgttactaatattgatggatatatagatacctgtatttctgctacttttagaaggggagcttgccatgcca

SEQ ID NO: 22873 - DNA, 75 bp, Artificial Sequence
  Synthetic
gagtctagcggcacaggggcagaggttgtgccatttaatgggaagggaactaaggctagcataaagtttcaaact

SEQ ID NO: 22874 - DNA, 75 bp, Artificial Sequence
  Synthetic
taaggctagcataaagtttcaaactatggtaaactggttgtgtgaaaacagagtgtttacagaggataagtggaa

SEQ ID NO: 22875 - DNA, 75 bp, Artificial Sequence
  Synthetic
actagttgactttaaccagtacactttactaagcagtagtcacagtggaagttttcaaattcaaagtgcactaaa

SEQ ID NO: 22876 - DNA, 75 bp, Artificial Sequence
  Synthetic
tttccctggaattaatgcagatgccctccacccagacctccaaaccaccccaattgtcacagacaccagtatcag

SEQ ID NO: 22877 - DNA, 75 bp, Artificial Sequence
  Synthetic
gaagaagccttctacacacctttggcagaccagtttcgtgaactgttagttggggttgattatgtgtgggacggt

SEQ ID NO: 22878 - DNA, 75 bp, Artificial Sequence
  Synthetic
cctgtctggattgcaaagctttgtagattatgagtaaagaaagtggcaaatggtgggaaagtgatgataaatttg

SEQ ID NO: 22879 - DNA, 75 bp, Artificial Sequence
  Synthetic
tggtgggaaagtgatgataaatttgctaaagctgtgtatcagcaatttgtggaattttatgaaaaggttactgga

SEQ ID NO: 22880 - DNA, 75 bp, Artificial Sequence
  Synthetic
acagacttagagcttattcaaatattaaaagatcattataatatttctttagataatcccctagaaaacccatcc

SEQ ID NO: 22881 - DNA, 75 bp, Artificial Sequence
  Synthetic
tctgcagaagccagcactggtgcaggaggggggggcagtaatcctgtcaaaagcatgtggagtgagggggccact

SEQ ID NO: 22882 - DNA, 75 bp, Artificial Sequence
  Synthetic
gccacaatgccagtggaaaggaggcaaaggtttgcaccattagtcccataatgggatactcaaccccatggagat

SEQ ID NO: 22883 - DNA, 75 bp, Artificial Sequence
  Synthetic
gttacagacaaaactggagggggggtacaggttactgacagcactacagggcgcctatgcatgttagtagaccat

SEQ ID NO: 22884 - DNA, 75 bp, Artificial Sequence
  Synthetic
agtgaagaatcagcattttatgttttggaacacagttcttttcagcttttaggtacaggaggtacagcaactatg

SEQ ID NO: 22885 - DNA, 75 bp, Artificial Sequence
  Synthetic
tgccagggccactagtaaactcagtgtctacaaaggagggagacagctctaatactggagctggaaaagccttaa

SEQ ID NO: 22886 - DNA, 75 bp, Artificial Sequence
  Synthetic
actgggacacagataaatatgtcacaggaataaatgccatttctcatggtcagaccacttatggtaacgctgaag

SEQ ID NO: 22887 - DNA, 75 bp, Artificial Sequence
  Synthetic
aacccagcaatatacagatcaaattgagcgccccctaatggtgggttctgtatggaacagaagagcccttcacta

SEQ ID NO: 22888 - DNA, 75 bp, Artificial Sequence
  Synthetic
gtgggccaattggaggtattaaatcaatgggaattactaccttagttcagtatgctgtgggaattatgacagtaa

SEQ ID NO: 22889 - DNA, 75 bp, Artificial Sequence
  Synthetic
acactccccaccgtgccctcagccaggatgcgtaactaaacgcccaccagtaccacccagactgtacctgccccc

SEQ ID NO: 22890 - DNA, 75 bp, Artificial Sequence
  Synthetic
ccagttttgtaacggttaaaatgggcggagcgtgggcggggaatacagtatatatagcagggcactgccgcagct

SEQ ID NO: 22891 - DNA, 75 bp, Artificial Sequence
  Synthetic
ctcacagtgtgtgtagaggggttatttaacaatgtactttatcatcttgtaactgaaaatgtaaagctaaaattt

SEQ ID NO: 22892 - DNA, 75 bp, Artificial Sequence
  Synthetic
cccgcattactgcagccataaatgatgctagtagtgagccgggggagtctagcggcacaggggcagaggttgtgc

SEQ ID NO: 22893 - DNA, 75 bp, Artificial Sequence
  Synthetic
cattaggaggtgacccaaaatttagatctttaacacatgaagaccatgcaattcagccccaaaactttatgccag

SEQ ID NO: 22894 - DNA, 75 bp, Artificial Sequence
  Synthetic
ggagctggaaaagccttaacaggctttagcacaggtacctctcaaaacactagaatttccttacgccctgggcca

SEQ ID NO: 22895 - DNA, 75 bp, Artificial Sequence
  Synthetic
ctggcccagagccaaccctaattccggaagtcccgcccaccggaagtgacgtcacaggaaatgacgtcacaggaa

SEQ ID NO: 22896 - DNA, 75 bp, Artificial Sequence
  Synthetic
agcagctgggttccgtgacactttcttttctggttgcttcttactggaattcacttgctgttatttgcctgctaa

SEQ ID NO: 22897 - DNA, 75 bp, Artificial Sequence
  Synthetic
gggtgtgctgcacatttcctctaacattctggactgcgctaatgataactggtggtgctctatgctggacttaga

SEQ ID NO: 22898 - DNA, 75 bp, Artificial Sequence
  Synthetic
ctagtacttttttgttacattcagactttgagcaggttacttgtattaaagacaataaaatagttaaactgttac

SEQ ID NO: 22899 - DNA, 75 bp, Artificial Sequence
  Synthetic
agaagttcatctgtgtgaactttgtgattgacagctcaacacaagtgcggactaccgtaaacacagtttgaacgt

SEQ ID NO: 22900 - DNA, 75 bp, Artificial Sequence
  Synthetic
gattgacagctcaacacaagtgcggactaccgtaaacacagtttgaacgttttttggagagagattattatgttt

SEQ ID NO: 22901 - DNA, 75 bp, Artificial Sequence
  Synthetic
aacaaaaaaccaggaaaacccggggcaacccgggttgtcaatatgctaaagcgcggtgcatcccgcggaaatccg

SEQ ID NO: 22902 - DNA, 75 bp, Artificial Sequence
  Synthetic
catcacgaatgccgtgaacacagtgagccagatgttgatcaacagaatgaatagaaccaacagaaatggcccaaa

SEQ ID NO: 22903 - DNA, 75 bp, Artificial Sequence
  Synthetic
atggactactcagaggagtaggaccagtcagaattgtcttggcgatcttaacctttttcaaatttacagctttga

SEQ ID NO: 22904 - DNA, 75 bp, Artificial Sequence
  Synthetic
aaccaacggcaggattgttgagacgatggaagctagtgggggtggttgaggccacccgccacttgaaaagcttcc

SEQ ID NO: 22905 - DNA, 75 bp, Artificial Sequence
  Synthetic
gaaaggacataggacaaatgctagatggactgaacagacgcggcaaaaagaagcgtggggggaccaccgtgggca

SEQ ID NO: 22906 - DNA, 75 bp, Artificial Sequence
  Synthetic
ttgcctttcttgtggcactaggggtagcccaggctatcaagatcggatccttgaacggacggccacttgtcacag

SEQ ID NO: 22907 - DNA, 75 bp, Artificial Sequence
  Synthetic
tcaaccaggcagatgtgttagaggcggttatgatcccaactgctggaggaaacaaccgatgcgttgtgaaagctc

SEQ ID NO: 22908 - DNA, 75 bp, Artificial Sequence
  Synthetic
tggatgtcggattgatgtgccctgatgacatcacgtatttatgtcccaagctagaggatgggtatgacccagagg

SEQ ID NO: 22909 - DNA, 75 bp, Artificial Sequence
  Synthetic
atatagactgctggtgcaacaccacggagatctacatccactacggccggtgcaccccaacgcgacacgcgagac

SEQ ID NO: 22910 - DNA, 75 bp, Artificial Sequence
  Synthetic
gatcgaggcggtctatcacagtgcaccatcacggagagagcttgctcgaagcaaagaatacaccatggatggact

SEQ ID NO: 22911 - DNA, 75 bp, Artificial Sequence
  Synthetic
caaccaaggctaccaaatacttgaccaaggtggaaaactgggccatacgtaaccctggatacgcactagcagcgg

SEQ ID NO: 22912 - DNA, 75 bp, Artificial Sequence
  Synthetic
ctataataggatggaatttagggacaacaaaatcccaaaagatcattttcacaatcatgcttatgctcatcgctc

SEQ ID NO: 22913 - DNA, 75 bp, Artificial Sequence
  Synthetic
cggcctacagcttcaactgcctgggaatgcaaaacagagatttcgtggaaggtgttaatggagttgagtggattg

SEQ ID NO: 22914 - DNA, 75 bp, Artificial Sequence
  Synthetic
atgtcgtgatggaaggtggaagctgtgtgaccattacagcaaaggacaagcccacaatcgatgtgaagatgatga

SEQ ID NO: 22915 - DNA, 75 bp, Artificial Sequence
  Synthetic
acatggaagccactgacttggcgcttgtgagatcatattgttacgagcctaaaatcactgatgttagtactgaac

SEQ ID NO: 22916 - DNA, 75 bp, Artificial Sequence
  Synthetic
caagatgccccaccatgggagaggcccacaacaccaaagccaataaccaggagtacgtgtgtaagaaaggttata

SEQ ID NO: 22917 - DNA, 75 bp, Artificial Sequence
  Synthetic
cacacatgcgccaaatttgagtgcaccaataaggctgagggaagaattgtgcagaaggaaaatgttcatttcgag

SEQ ID NO: 22918 - DNA, 75 bp, Artificial Sequence
  Synthetic
ccaataaggctgagggaagaattgtgcagaaggaaaatgttcatttcgagttggctgtgtttgtgcacggatcaa

SEQ ID NO: 22919 - DNA, 75 bp, Artificial Sequence
  Synthetic
ttggctgtgtttgtgcacggatcaacagaaatgggaacctacaatgactactttatacagcagtcattgaagcag

SEQ ID NO: 22920 - DNA, 75 bp, Artificial Sequence
  Synthetic
gcagcgaggttcattgtcacaccaaaagcaccagtgtacacagccgaactcaatgagtatgggacggtgacactg

SEQ ID NO: 22921 - DNA, 75 bp, Artificial Sequence
  Synthetic
gaatgtgagccccgctccgggatggacatgagccagttttacgtgctaactatgaattcgaagagctggcttgtg

SEQ ID NO: 22922 - DNA, 75 bp, Artificial Sequence
  Synthetic
aacagagactggttccatgacttaaaccttccgtggactggatcatctgctggctcatggcagaacagagaatca

SEQ ID NO: 22923 - DNA, 75 bp, Artificial Sequence
  Synthetic
accttccgtggactggatcatctgctggctcatggcagaacagagaatcactggtggagtttgaagaagctcatg

SEQ ID NO: 22924 - DNA, 75 bp, Artificial Sequence
  Synthetic
ctggtggagtttgaagaagctcatgcaactaaacaatcagtagtggcactggcttcgcaagaaggggcgttacac

SEQ ID NO: 22925 - DNA, 75 bp, Artificial Sequence
  Synthetic
gctgctctggccggagccattccagtgaaatacgccagcagtaagcttgagatgacttctgggcacttgaagtgt

SEQ ID NO: 22926 - DNA, 75 bp, Artificial Sequence
  Synthetic
tgaaatacgccagcagtaagcttgagatgacttctgggcacttgaagtgtcgcgtgaaattacaaggactgaaat

SEQ ID NO: 22927 - DNA, 75 bp, Artificial Sequence
  Synthetic
tgaaaggaatgacttaccccatgtgctcaaataagttcactctagccaagaaccccacagacacagggcatggga

SEQ ID NO: 22928 - DNA, 75 bp, Artificial Sequence
  Synthetic
caccaattatgcagatcagagccctgatcggaccggagcgatatgttgactacatgccaactctgaaccgcttca

SEQ ID NO: 22929 - DNA, 75 bp, Artificial Sequence
  Synthetic
cagttgttgtggaactcagctattctgggtctgatggaccatgtcgtatacccatatcaatgacagccaaccttc

SEQ ID NO: 22930 - DNA, 75 bp, Artificial Sequence
  Synthetic
aggatttgaccccgataggaaggctcataacggtcaatccatatgtgtctacatcatcatcggggacaaaagtgg

SEQ ID NO: 22931 - DNA, 75 bp, Artificial Sequence
  Synthetic
ggattcattcattttggttggaacaggagaaaatcagataaagtatcaatggcacaagagtggaagctccatcgg

SEQ ID NO: 22932 - DNA, 75 bp, Artificial Sequence
  Synthetic
ggagaaaatcagataaagtatcaatggcacaagagtggaagctccatcggtaaggcattcatgtctaccgtgagg

SEQ ID NO: 22933 - DNA, 75 bp, Artificial Sequence
  Synthetic
ggagcgcagaggatggtagcacttggagacaccgcatgggactttggatcagtcggaggttttttcacatcacta

SEQ ID NO: 22934 - DNA, 75 bp, Artificial Sequence
  Synthetic
ggcaaaggaatacaccaagtgtttggaactgccttcagaagcctcttcggaggaatgtcatggataacccagggc

SEQ ID NO: 22935 - DNA, 75 bp, Artificial Sequence
  Synthetic
tcaacacaagtgcggaacaccgtaaacacagtttgaacgttttttggagagagactactatgtctaacaaaaaac

SEQ ID NO: 22936 - DNA, 75 bp, Artificial Sequence
  Synthetic
acacagtttgaacgttttttggagagagactactatgtctaacaaaaaaccaggaaaacccggggcaacccgggt

SEQ ID NO: 22937 - DNA, 75 bp, Artificial Sequence
  Synthetic
ctcctaggagcacttctgttgtggatgggacttaacgcaagagataggtcgatttcactgacgttcttggctgtt

SEQ ID NO: 22938 - DNA, 75 bp, Artificial Sequence
  Synthetic
tgggacttaacgcaagagataggtcgatttcactgacgttcttggctgttggagcaatcctcatattcctagcta

SEQ ID NO: 22939 - DNA, 75 bp, Artificial Sequence
  Synthetic
cgaatgtacatgccgatactggttgcgcagtggacatggacaggaaagaactgaagtgcggaagtggcattttca

SEQ ID NO: 22940 - DNA, 75 bp, Artificial Sequence
  Synthetic
cgcagtggacatggacaggaaagaactgaagtgcggaagtggcattttcatatttaatgatgtggaaacctggag

SEQ ID NO: 22941 - DNA, 75 bp, Artificial Sequence
  Synthetic
ctgaagtgcggaagtggcattttcatatttaatgatgtggaaacctggagggacaactacaagtactacccatca

SEQ ID NO: 22942 - DNA, 75 bp, Artificial Sequence
  Synthetic
actccgcggaatctggctaaagtcataatggaatcacgggaaaaaggaatctgtggtgtaaggtccgtgggaaga

SEQ ID NO: 22943 - DNA, 75 bp, Artificial Sequence
  Synthetic
ctggagcataacatgtggaattcaatcaagcatgagctgaatgccatacttgaggacaacgggccagacttgaca

SEQ ID NO: 22944 - DNA, 75 bp, Artificial Sequence
  Synthetic
tgaggacaacgggccagacttgacagtcgtcgttgaacagccaactggtagatttaggaaaacccaccggcgttt

SEQ ID NO: 22945 - DNA, 75 bp, Artificial Sequence
  Synthetic
cgatgtgctagaggcggtcatgatcccaactactggaggaaacaaccgttgtgttgtgaaagccctggatgttgg

SEQ ID NO: 22946 - DNA, 75 bp, Artificial Sequence
  Synthetic
caataacacatttgttgtggatggtcccaaaacaaaagaatgcccagatgagaatagagcctggaacagtttaga

SEQ ID NO: 22947 - DNA, 75 bp, Artificial Sequence
  Synthetic
agtggaggattttggatttgggctaacatcaacgaaagtttggttaggattaaggaaagaaaacacaaccgaatg

SEQ ID NO: 22948 - DNA, 75 bp, Artificial Sequence
  Synthetic
tgacacggccgtgatgggcacagccatcaagggtgacaaagcagtccacagtgatttgagctactggattgaaag

SEQ ID NO: 22949 - DNA, 75 bp, Artificial Sequence
  Synthetic
gtgatttgagctactggattgaaagcagaaacaatggcagctggaaacttgaaagagctgtgctgggagaagtca

SEQ ID NO: 22950 - DNA, 75 bp, Artificial Sequence
  Synthetic
gaaagagctgtgctgggagaagtcaagtcatgtacttggccagatacccacactctgtggggggagagtgtccag

SEQ ID NO: 22951 - DNA, 75 bp, Artificial Sequence
  Synthetic
caaaagattatctttacaatcatgctcatgctcattgctccggcctacagcttcaattgcctgggaatgcaaaac

SEQ ID NO: 22952 - DNA, 75 bp, Artificial Sequence
  Synthetic
caacatgaggccaggctacaaggtgcaagtttcaggaccatgggatgagagagacatcaccatcgattttgatta

SEQ ID NO: 22953 - DNA, 75 bp, Artificial Sequence
  Synthetic
ctgtccaggcaccaaagtgacagtcaccccaacatgcagggatagggttgcctccgccagaacaacaacggcaag

SEQ ID NO: 22954 - DNA, 75 bp, Artificial Sequence
  Synthetic
accccaacatgcagggatagggttgcctccgccagaacaacaacggcaagcggtaagctgatcacagattggtgc

SEQ ID NO: 22955 - DNA, 75 bp, Artificial Sequence
  Synthetic
tgtaggtcatgcactctccctccattgcggtacatgacaaagagcggctgctggtatggaatggagattagacct

SEQ ID NO: 22956 - DNA, 75 bp, Artificial Sequence
  Synthetic
acagtacatggagatgacatgttgataaaatcaagagtcaccgcttatgacggcgctggcatggaaccatttcag

SEQ ID NO: 22957 - DNA, 75 bp, Artificial Sequence
  Synthetic
ctgggtgtactcatgatgttcgtggccacacaagaggtgctgcggaaaagatggacaggccggatggccggtcca

SEQ ID NO: 22958 - DNA, 75 bp, Artificial Sequence
  Synthetic
gcactggtgggtctgttatgcgctatgattttcggcgggataacttacagggacatggtgaagtacgtcctgttg

SEQ ID NO: 22959 - DNA, 75 bp, Artificial Sequence
  Synthetic
tgattttcggcgggataacttacagggacatggtgaagtacgtcctgttggtggcggccgcctttgccgaaagca

SEQ ID NO: 22960 - DNA, 75 bp, Artificial Sequence
  Synthetic
tcattgtcacaccaaaagcaccagtgtacacggctgaactcaatgagtatgggacggtgacactggaatgtgagc

SEQ ID NO: 22961 - DNA, 75 bp, Artificial Sequence
  Synthetic
acagcgggggtgacgtgatccaccttgctctgatagcaactttcaacgtgcaacctggactgctggtggcgtact

SEQ ID NO: 22962 - DNA, 75 bp, Artificial Sequence
  Synthetic
cccgctctgggatggacatgagccagttttatgtgctaaccatgaattcgaagagttggcttgtgaacagagact

SEQ ID NO: 22963 - DNA, 75 bp, Artificial Sequence
  Synthetic
ccttgcggcggaaatggagtaatcaggatgccaccctcttaggcgtggcactggcaatgataaccatggcgttgc

SEQ ID NO: 22964 - DNA, 75 bp, Artificial Sequence
  Synthetic
acgactggaacatgaccatacccagcttgttgaattcaggagccacggcgtggctgttgctgcgcgcagtgagtg

SEQ ID NO: 22965 - DNA, 75 bp, Artificial Sequence
  Synthetic
aagggaccgtcagcgcggcctgtattcccattctcggacttttggctccaggaatgaaaataattggaattgatg

SEQ ID NO: 22966 - DNA, 75 bp, Artificial Sequence
  Synthetic
tcccattctcggacttttggctccaggaatgaaaataattggaattgatgtatttcggatcgggctgcttatcat

SEQ ID NO: 22967 - DNA, 75 bp, Artificial Sequence
  Synthetic
cggagttatgtcactcctgaaagaaagaaacaatgccatcgcaaaaaagaaaggtggagtgctgattggtttggc

SEQ ID NO: 22968 - DNA, 75 bp, Artificial Sequence
  Synthetic
cctggcccaagacggctgggtgaatccactggtgtacgcaggactgacgttggctctgaaacccagcaatagaag

SEQ ID NO: 22969 - DNA, 75 bp, Artificial Sequence
  Synthetic
ccactggtgtacgcaggactgacgttggctctgaaacccagcaatagaagaggatggccagtgagtgaagccctt

SEQ ID NO: 22970 - DNA, 75 bp, Artificial Sequence
  Synthetic
acagcagtaggattgacctttgcgctagctggtgggatcgcacactttgacgaaggagacatggccatcccactg

SEQ ID NO: 22971 - DNA, 75 bp, Artificial Sequence
  Synthetic
cgaaggagacatggccatcccactggctgtgggaggaataatgctggtggtagctgtggtcacaggattcacaac

SEQ ID NO: 22972 - DNA, 75 bp, Artificial Sequence
  Synthetic
tagctgtggtcacaggattcacaactgacctgtggttggagcgagctggagacatctcgtggattgaggatgccc

SEQ ID NO: 22973 - DNA, 75 bp, Artificial Sequence
  Synthetic
aaataacaggaagctcacaacggtatgacgttgagatagattgtgatgggaacatgaaattgatgaatgatcaag

SEQ ID NO: 22974 - DNA, 75 bp, Artificial Sequence
  Synthetic
tgacgttgagatagattgtgatgggaacatgaaattgatgaatgatcaaggagtccctttttccatttgggccct

SEQ ID NO: 22975 - DNA, 75 bp, Artificial Sequence
  Synthetic
taggacaggactcattctagcatcggcctacaatccatacattctgccagtgacattgggagcttactggatgac

SEQ ID NO: 22976 - DNA, 75 bp, Artificial Sequence
  Synthetic
gacacactccccgaagagaagtggagccatctgggatgttccggcccccagggaaaagaagagagctgaattgag

SEQ ID NO: 22977 - DNA, 75 bp, Artificial Sequence
  Synthetic
cactggagtctttagaattatggctagagggatacttggaaaatatcaagctggagtaggagtgatgtttgatgg

SEQ ID NO: 22978 - DNA, 75 bp, Artificial Sequence
  Synthetic
ggttttccacacgatgtggcatgtgacgaatggggccaccattaacgtgggggacggttgcctagtcccctattg

SEQ ID NO: 22979 - DNA, 75 bp, Artificial Sequence
  Synthetic
atggacaggaaggaactgaagtgcggaagtggcatttttatattcaatgacgtggaaacctggagggacaattat

SEQ ID NO: 22980 - DNA, 75 bp, Artificial Sequence
  Synthetic
ggctagtgtaagagaggacttgatatcgtatggaggaccttggaagatgggcacgaaatggaacggggttgatga

SEQ ID NO: 22981 - DNA, 75 bp, Artificial Sequence
  Synthetic
aagtactacccatcaactccgcggaatctggctaaaatcataatggaatcacgggaaaaaggaatctgtggtgta

SEQ ID NO: 22982 - DNA, 75 bp, Artificial Sequence
  Synthetic
agtgcaagtcattgttgtccagccagggaaatcagtcatgaatgtgcaaacaaagcccggggtctttaagacctc

SEQ ID NO: 22983 - DNA, 75 bp, Artificial Sequence
  Synthetic
cggtctgtgggaagactggaacacaacatgtggaattcgatcaagcatgagctgaatgccatacttgaggacaac

SEQ ID NO: 22984 - DNA, 75 bp, Artificial Sequence
  Synthetic
tactggagagattggggcagtcacccttgattatccaacgggaacatcaggctcgcccatcgtagacaaggaagg

SEQ ID NO: 22985 - DNA, 75 bp, Artificial Sequence
  Synthetic
gggcaagacttgacagtcgttgttgaacagccaactggtagattcaggaaaacccaccgacgtctagtgtggaca

SEQ ID NO: 22986 - DNA, 75 bp, Artificial Sequence
  Synthetic
gaacataattgggctctatggtaatggcattcttgtcggagcaggcagcttcgttagcatgatttcccaaggcca

SEQ ID NO: 22987 - DNA, 75 bp, Artificial Sequence
  Synthetic
gcgaatggaagaagagattccgcaagtgttcagtgaagacatgctgaggaaaagacagctaactgtgcttgactt

SEQ ID NO: 22988 - DNA, 75 bp, Artificial Sequence
  Synthetic
aagaatgcccagatgagaatagagcctggaacagtctagaggtggaggacttcggatttgggctaacatcaacga

SEQ ID NO: 22989 - DNA, 75 bp, Artificial Sequence
  Synthetic
gcacccaggctcaggaaaaacaaggaaagtgcttccccaaattgtgaagacagccattgataggagactcaggac

SEQ ID NO: 22990 - DNA, 75 bp, Artificial Sequence
  Synthetic
aaagtgcttccccaaattgtgaagacagccattgataggagactcaggacagctattttggcaccgacaagagtg

SEQ ID NO: 22991 - DNA, 75 bp, Artificial Sequence
  Synthetic
agctattttggcaccgacaagagtggtagcagctgagatagcggaagctctcaaggaatacccaataaggtacct

SEQ ID NO: 22992 - DNA, 75 bp, Artificial Sequence
  Synthetic
aactccagctgtcaagcgagaacacacaggaacagaaatcattgacgtgatgtgtcatgcaacactgacgtcacg

SEQ ID NO: 22993 - DNA, 75 bp, Artificial Sequence
  Synthetic
ccttctcacgccacaacgtgttcccaactacaacttgtttgtgatggatgaagcccatttcaccgaccccgcgag

SEQ ID NO: 22994 - DNA, 75 bp, Artificial Sequence
  Synthetic
aactacaacttgtttgtgatggatgaagcccatttcaccgaccccgcgagcatagctgcccgaggatacatctca

SEQ ID NO: 22995 - DNA, 75 bp, Artificial Sequence
  Synthetic
catagctgcccgaggatacatctcaaccaaagtggagctaggcgaggcggcagccattttcatgacggccacccc

SEQ ID NO: 22996 - DNA, 75 bp, Artificial Sequence
  Synthetic
gactcgaactcaccaatcgtggatgtggaggagcagatccctgatagggcatggaactcaggatatgagtggata

SEQ ID NO: 22997 - DNA, 75 bp, Artificial Sequence
  Synthetic
atggaactcaggatatgagtggataaccgactataccggaaagacagtgtggtttgttcctagcgtgaagatggg

SEQ ID NO: 22998 - DNA, 75 bp, Artificial Sequence
  Synthetic
aaacgagatagccgtgtgcttgacgaaggccggtaaaaaagtgatccaattgaatagaaagagctttgactctga

SEQ ID NO: 22999 - DNA, 75 bp, Artificial Sequence
  Synthetic
tgaatagaaagagctttgactctgaatacccaaagtgtaaaacaggtgagtgggactttgtgataaccacggata

SEQ ID NO: 23000 - DNA, 75 bp, Artificial Sequence
  Synthetic
tttcggagatgggagccaactttggggcgagccgggttattgatagtcggaaatgcataaaaccagtcgtcgtag

SEQ ID NO: 23001 - DNA, 75 bp, Artificial Sequence
  Synthetic
aggacggggaaggaagcgtgcagctcaatggaccagtgcccatcacagcagccagtgcagcgcagagacgcggaa

SEQ ID NO: 23002 - DNA, 75 bp, Artificial Sequence
  Synthetic
gaattgggagaagctacgtgcaagtcggagacgagtaccacttttctgggccaacaagcgaggacgaccatgact

SEQ ID NO: 23003 - DNA, 75 bp, Artificial Sequence
  Synthetic
ttgcccattggaaagaggccaagatactgctagataatatcaacctgcccaacggcctcgtagcccaactctatg

SEQ ID NO: 23004 - DNA, 75 bp, Artificial Sequence
  Synthetic
agccagagagagagaaggtcttttccatcgatggggaatatcgcttgagaacggaacaacgtaagaattttgttg

SEQ ID NO: 23005 - DNA, 75 bp, Artificial Sequence
  Synthetic
agtttttgagaacaggagatctgcctgtctggctttctcacaaattggcagaagcaggagttgcgtatcacgata

SEQ ID NO: 23006 - DNA, 75 bp, Artificial Sequence
  Synthetic
tgtctggctttctcacaaattggcagaagcaggagttgcgtatcacgataggaagtggtgcttcgatggaccttc

SEQ ID NO: 23007 - DNA, 75 bp, Artificial Sequence
  Synthetic
cgggtgagaagaagatactgcgacctaggttgagagatggaaggctctgggcggaccatcaagccctgaaatcat

SEQ ID NO: 23008 - DNA, 75 bp, Artificial Sequence
  Synthetic
ttaaggacttcgcttgtggcaagagatcagccattggcgtgtctgaagtggtcaaaatgcttccagagcatttcg

SEQ ID NO: 23009 - DNA, 75 bp, Artificial Sequence
  Synthetic
atcagccattggcgtgtctgaagtggtcaaaatgcttccagagcatttcgcacacagaatgggagaatccatgga

SEQ ID NO: 23010 - DNA, 75 bp, Artificial Sequence
  Synthetic
cacacagaatgggagaatccatggacaatctgtacatgttgaccacttctgagaaaggtagcagggctcacaggg

SEQ ID NO: 23011 - DNA, 75 bp, Artificial Sequence
  Synthetic
actggaaacaatcctcttgattaccatgatgacgttagcatcctgtggggtctttctcttttttgttcaaagaag

SEQ ID NO: 23012 - DNA, 75 bp, Artificial Sequence
  Synthetic
ttggagcgagctggagacatctcatggattgaggatgcccaaatcacaggaagctcacaacggtatgacgttgag

SEQ ID NO: 23013 - DNA, 75 bp, Artificial Sequence
  Synthetic
gggtttggggaaaacaggcttgggggccctggtgctgatgacagtgacagggttgctttgggtcgcagaagtcca

SEQ ID NO: 23014 - DNA, 75 bp, Artificial Sequence
  Synthetic
gccctggtgctgatgacagtgacagggttgctttgggtcgcagaagtccaaccacaaaagatagctggaatcttg

SEQ ID NO: 23015 - DNA, 75 bp, Artificial Sequence
  Synthetic
accacaaaagatagctggaatcttgctcatatcattgctactcatgatagttctcatccctgaaccagaaagaca

SEQ ID NO: 23016 - DNA, 75 bp, Artificial Sequence
  Synthetic
agcttactggatgacgatacactccccgaagagaagtggagccatctgggatgttccggctcccaaggaaaagaa

SEQ ID NO: 23017 - DNA, 75 bp, Artificial Sequence
  Synthetic
aagatcacaaactgacagtcacttggcggtattcatgatactggtcctgctcatcgtgggaacagtggcttccaa

SEQ ID NO: 23018 - DNA, 75 bp, Artificial Sequence
  Synthetic
cgagatgggctggcttgaacaaacgaagaaggatgtcgccagcttgtttggtagggcacaccaccaagagccaag

SEQ ID NO: 23019 - DNA, 75 bp, Artificial Sequence
  Synthetic
aagaaggatgtcgccagcttgtttggtagggcacaccaccaagagccaagccgatgggaaatgccgtggcctgat

SEQ ID NO: 23020 - DNA, 75 bp, Artificial Sequence
  Synthetic
catacgctggggccacgacgtttttgacaccactgctgaaacatctcattgtcacagaatatgtgaacttttcac

SEQ ID NO: 23021 - DNA, 75 bp, Artificial Sequence
  Synthetic
gtcacagaatatgtgaacttttcactgatggctgtgaccgctcaagccggagccctatttggattaggaaagggc

SEQ ID NO: 23022 - DNA, 75 bp, Artificial Sequence
  Synthetic
atgccgttcgtggccattgacctgtcgaccccattgttactgttagggtgttggggccaattcacaatgaccacg

SEQ ID NO: 23023 - DNA, 75 bp, Artificial Sequence
  Synthetic
actctgacaacaatcatgcttctgatcattcactacgcgtttttgatccctggctggcaagcggaagccatgcgg

SEQ ID NO: 23024 - DNA, 75 bp, Artificial Sequence
  Synthetic
tctgctcaaaggagaacagcagcaggtgtgatgaaaaatccagtggttgatggaatcgtggcaacggacgtaccg

SEQ ID NO: 23025 - DNA, 75 bp, Artificial Sequence
  Synthetic
gatctagaagcaagcacaccaatcactgagaagaaatttggacaggtcatactaattgtggtagccttgtgctca

SEQ ID NO: 23026 - DNA, 75 bp, Artificial Sequence
  Synthetic
gtttttctgaagcctggaacaacatcactaacggaattcggaatgctcacatcagcagcctccgtgaaccttgat

SEQ ID NO: 23027 - DNA, 75 bp, Artificial Sequence
  Synthetic
gcaccgacaagagtggtggcagctgagatagcggaagctctcaaggagtacccaataaggtacctaactccagct

SEQ ID NO: 23028 - DNA, 75 bp, Artificial Sequence
  Synthetic
aaaggacagcggacggatatggaatgcaccaccgcagttgccatgtgccatctaatgaggaagaactggctaaca

SEQ ID NO: 23029 - DNA, 75 bp, Artificial Sequence
  Synthetic
ggggcatcactcgcctggaccatctcaagaaacctacaaaacggaagcatgagaagaggaggcgggaaaggtaga

SEQ ID NO: 23030 - DNA, 75 bp, Artificial Sequence
  Synthetic
caagaaacctacaaaacggaagcatgagaagaggaggcgggaaaggtagaatgctcggagaaatctggaaggccc

SEQ ID NO: 23031 - DNA, 75 bp, Artificial Sequence
  Synthetic
atgctcggagaaatctggaaggcccaactcaatcaactaacacggcaggaattcatggaataccggaaggacggt

SEQ ID NO: 23032 - DNA, 75 bp, Artificial Sequence
  Synthetic
atcatagaggttgatagagccccggcgcgaaaggcgcgaagagaaggaaacgtgacaggaggacatccggtgtct

SEQ ID NO: 23033 - DNA, 75 bp, Artificial Sequence
  Synthetic
cgcgaaaggcgcgaagagaaggaaacgtgacaggaggacatccggtgtctagaggaacggcaaaactgaggtggc

SEQ ID NO: 23034 - DNA, 75 bp, Artificial Sequence
  Synthetic
cgtgacaggaggacatccggtgtctagaggaacggcaaaactgaggtggctcgttgagagaggattcctgaaacc

SEQ ID NO: 23035 - DNA, 75 bp, Artificial Sequence
  Synthetic
gcgaggaaaggtggtagacctaggttgcggtaggggtggctggagctactactgtgcaaccctgaaaatggttca

SEQ ID NO: 23036 - DNA, 75 bp, Artificial Sequence
  Synthetic
actgtgcaaccctgaaaatggttcaggaagtgaaagggtacacaaaaggaggaccaggacacgaagaacctatga

SEQ ID NO: 23037 - DNA, 75 bp, Artificial Sequence
  Synthetic
ggtttccctgaaaagtgggattgacatcttctacagaccagctgaacattctgacacactcctgtgtgacattgg

SEQ ID NO: 23038 - DNA, 75 bp, Artificial Sequence
  Synthetic
gagaggaactgaagaattttgcataaaagtgctatgcccatacatgccaagagtcctgaaagaactggaacggat

SEQ ID NO: 23039 - DNA, 75 bp, Artificial Sequence
  Synthetic
gcagtcacgctggggagggggtctcgtcagggtcccactttcccggaattcaaaccatgaaatgtactgggtgag

SEQ ID NO: 23040 - DNA, 75 bp, Artificial Sequence
  Synthetic
gtcagggtcccactttcccggaattcaaaccatgaaatgtactgggtgagcggagccagtgggaacatcacgaat

SEQ ID NO: 23041 - DNA, 75 bp, Artificial Sequence
  Synthetic
gccgtgaacacagtgagccagatgttgatcaacagaatgaatagaaccaacagaaatggcccaaaatatgaggaa

SEQ ID NO: 23042 - DNA, 75 bp, Artificial Sequence
  Synthetic
tagcccaactctatgagccagaaagagaaaaggttttttcaattgatggggaataccgcttgagaacggaacaac

SEQ ID NO: 23043 - DNA, 75 bp, Artificial Sequence
  Synthetic
tgatcaacagaatgaatagaaccaacagaaatggcccaaaatatgaggaagacgttcacctaggttcaggaacaa

SEQ ID NO: 23044 - DNA, 75 bp, Artificial Sequence
  Synthetic
gacgttcacctaggttcaggaacaagagcggtgctgacgaagaaagtgaagaccaattggaaaatggtagaagac

SEQ ID NO: 23045 - DNA, 75 bp, Artificial Sequence
  Synthetic
gaccaattggaaaatggtagaagaccgcgtcatgcgcctagccgaagaattctccaccacatggcatcatgacac

SEQ ID NO: 23046 - DNA, 75 bp, Artificial Sequence
  Synthetic
agaaaatccatacaaaacctggaactaccatggaagttatgaagttaaagcaacaggatcagccagttccatggt

SEQ ID NO: 23047 - DNA, 75 bp, Artificial Sequence
  Synthetic
taccatggaagttatgaagttaaagcaacaggatcagccagttccatggttaatggagtcgtgaaggtgttgtca

SEQ ID NO: 23048 - DNA, 75 bp, Artificial Sequence
  Synthetic
taatggagtcgtgaaggtgttgtcaaagccttgggatgccttgcagaacgtagtaaacatggccatgactgacac

SEQ ID NO: 23049 - DNA, 75 bp, Artificial Sequence
  Synthetic
gaccccatttggacagcaaagagtgttcaaggaaaaagtggacacaaaagcgccagaacctcctcgaggaacatc

SEQ ID NO: 23050 - DNA, 75 bp, Artificial Sequence
  Synthetic
agaagttatgaaaatcacagctcggtggatgtgggacttcgtggggaggaataaaagacccagaatttgcacaaa

SEQ ID NO: 23051 - DNA, 75 bp, Artificial Sequence
  Synthetic
tggatgtgggacttcgtggggaggaataaaagacccagaatttgcacaaaggaggagtttatagagaaggtaaat

SEQ ID NO: 23052 - DNA, 75 bp, Artificial Sequence
  Synthetic
agccacgcggcccttggtgcaatctttaaagaacagaacaagtgggcatcagctcgggaagcagtggaggaccca

SEQ ID NO: 23053 - DNA, 75 bp, Artificial Sequence
  Synthetic
gcgttttgggagttggtggatcaggaacgcgaggcgcaccttcaaggaaagtgtgagacatgcatctacaacatg

SEQ ID NO: 23054 - DNA, 75 bp, Artificial Sequence
  Synthetic
cagggccatatggtatatgtggctcggatcccggttcttagaatttgaggcccttgggtttctgaacgaggatca

SEQ ID NO: 23055 - DNA, 75 bp, Artificial Sequence
  Synthetic
ctggatgagcagagaaaacaccttgggaggcgttgaaggcatgggcctacagaagctagggtatgtattgaggga

SEQ ID NO: 23056 - DNA, 75 bp, Artificial Sequence
  Synthetic
catggctggcaaggaaggggggctcatgtacgctgacgacactgctggatgggacaccagaatcaccaaagctga

SEQ ID NO: 23057 - DNA, 75 bp, Artificial Sequence
  Synthetic
gggacaccagaatcaccaaagctgatctggaaaatgaagcactcattctcgaaagaatggacccagagcacaggc

SEQ ID NO: 23058 - DNA, 75 bp, Artificial Sequence
  Synthetic
gtctcgcagagtcactaattaaatttgcttacatgaacaaagtggtgaaagtgatgcggcctgggagggaaggta

SEQ ID NO: 23059 - DNA, 75 bp, Artificial Sequence
  Synthetic
gtgatgcggcctgggagggaaggtatcaccgtgatggatgtgatttccagggaagaccagagaggaagtggacaa

SEQ ID NO: 23060 - DNA, 75 bp, Artificial Sequence
  Synthetic
ggaagaccagagaggaagtggacaagtcgtcacctacgcgttgaataccttcaccaatttgtgtgtccaattgat

SEQ ID NO: 23061 - DNA, 75 bp, Artificial Sequence
  Synthetic
gtcgtcacctacgcgttgaataccttcaccaatttgtgtgtccaattgattagatgcatggaaggagaaggactg

SEQ ID NO: 23062 - DNA, 75 bp, Artificial Sequence
  Synthetic
tgcgtttctgatccccggctggcaagcggaagccatgcggtctgctcaaagaagaacagcagcaggtgtgatgaa

SEQ ID NO: 23063 - DNA, 75 bp, Artificial Sequence
  Synthetic
ctgaagcctgaagaagttgaagggctggagcgaggaaaacacaagaaaatccaagactggctgggcaagaatgga

SEQ ID NO: 23064 - DNA, 75 bp, Artificial Sequence
  Synthetic
tggagcgaggaaaacacaagaaaatccaagactggctgggcaagaatggaagagagagactggcggctatggcag

SEQ ID NO: 23065 - DNA, 75 bp, Artificial Sequence
  Synthetic
caagcacaccaatcactgagaagaaatttggacaggtcatactaattgtggtggccttgtgttcagtctttctga

SEQ ID NO: 23066 - DNA, 75 bp, Artificial Sequence
  Synthetic
tcagcggtgacgattgcgtggtaaagccaaaggatgaccgatttgcaacggcattgcatttcttgaacagcatgt

SEQ ID NO: 23067 - DNA, 75 bp, Artificial Sequence
  Synthetic
caaagatcagaaaagacatccccgagtggaaaccctcaacgggatggaggaactggcaagacgtccctttctgtt

SEQ ID NO: 23068 - DNA, 75 bp, Artificial Sequence
  Synthetic
cacatcatttccacgagttaaacatgaaggatggcagaaccatcgttgtcccatgcagacaccaggatgaactga

SEQ ID NO: 23069 - DNA, 75 bp, Artificial Sequence
  Synthetic
ccatgcagacaccaggatgaactgataggaagggcacgattgtcaccaggatctgggtggtccctcactgaaaca

SEQ ID NO: 23070 - DNA, 75 bp, Artificial Sequence
  Synthetic
gcatgtctgagcaaagcttatggccagatgtggctactcatgtactttcacagacgtgacctgcggctgatggcc

SEQ ID NO: 23071 - DNA, 75 bp, Artificial Sequence
  Synthetic
tctcatgggtgcccacgggaagaaccacctggtcaattcacggaaaaggagaatggatgacaacagaagatatgt

SEQ ID NO: 23072 - DNA, 75 bp, Artificial Sequence
  Synthetic
tgagagtctggaacagggtgtggattgaggagaacgaacacatggaagacaagacccctgtggcctcatggaacg

SEQ ID NO: 23073 - DNA, 75 bp, Artificial Sequence
  Synthetic
atgtgccgtacctcggaaagcgcgaggacagttggtgtggaagtctgatagggcacagaacacgatcaacctggg

SEQ ID NO: 23074 - DNA, 75 bp, Artificial Sequence
  Synthetic
gggcacagaacacgatcaacctgggcagagaacatatacacaccaatcatgcagatcagggccctgattggacca

SEQ ID NO: 23075 - DNA, 75 bp, Artificial Sequence
  Synthetic
gagcggtatgttgactatatgccaactctaaaccgcttcagggcagtggaaacatggtctgatggggttctgtaa

SEQ ID NO: 23076 - DNA, 75 bp, Artificial Sequence
  Synthetic
gatgtaaataaacacagggaaatagactatgtaaatagatttcatatattaattggatttaagtaagtaagtagt

SEQ ID NO: 23077 - DNA, 75 bp, Artificial Sequence
  Synthetic
aattggatttaagtaagtaagtagtttagatggaatgtagtgttaggtgaacttatttagacttgagagtcaggc

SEQ ID NO: 23078 - DNA, 75 bp, Artificial Sequence
  Synthetic
ttggatgacggtgctgcctgcagtccaaccccaggaggactgggtcaccaaagtgtccgacactcaacacgcaaa

SEQ ID NO: 23079 - DNA, 75 bp, Artificial Sequence
  Synthetic
tcccactttcccggaattcaaatcatgagatgtactgggtgagcggagccagtgggaacatcacgaatgccgtga

SEQ ID NO: 23080 - DNA, 75 bp, Artificial Sequence
  Synthetic
ccctggcgttggagaggataggcacccagagtcaggccacaggttttgtgccactagcatgcagtgctgcctgag

SEQ ID NO: 23081 - DNA, 75 bp, Artificial Sequence
  Synthetic
atacagtgagccagatgttgatcaatagaatgaacagaaccaacagaaatggcccaaaatatgaggaagacgtcc

SEQ ID NO: 23082 - DNA, 75 bp, Artificial Sequence
  Synthetic
ccagagtcaggccacaggttttgtgccactagcatgcagtgctgcctgagcaaagacatgccccaggtggactgg

SEQ ID NO: 23083 - DNA, 75 bp, Artificial Sequence
  Synthetic
ggcccaagcaagggaatggtgtgacccttgtgtaaggactagaggttagaggagaccccttgcgagttaacacca

SEQ ID NO: 23084 - DNA, 75 bp, Artificial Sequence
  Synthetic
aaacaaaacagcatattgacacctgggagagactaggagaccctctgtcctaacaacaccagccatccggcacag

SEQ ID NO: 23085 - DNA, 75 bp, Artificial Sequence
  Synthetic
cctctgtcctaacaacaccagccatccggcacagagcgccgtaagtgtggctggtggtggtagaacacagtgtct

SEQ ID NO: 23086 - DNA, 75 bp, Artificial Sequence
  Synthetic
actttgtgattgatagttcaacacaagtgcggaacaccgtaaacacagtttgaacgttttttggagagagactac

SEQ ID NO: 23087 - DNA, 75 bp, Artificial Sequence
  Synthetic
aaatccgatatctcggatcaagaggatgctggatggactactcagaggagtagggccaatcagaatcgtattggc

SEQ ID NO: 23088 - DNA, 75 bp, Artificial Sequence
  Synthetic
gatcctaacctttttcaaatttacagctttgaaaccaacggcaggattgttgagacgatggaagttggtgggagt

SEQ ID NO: 23089 - DNA, 75 bp, Artificial Sequence
  Synthetic
ggttgaagccacccgccacttgaagagcttccgaaaggacataggacaaatgctagatggactaaacagacgcgg

SEQ ID NO: 23090 - DNA, 75 bp, Artificial Sequence
  Synthetic
caaaaagaagcgtgggggaaccaccgtaggcatcgctgttcttgtggtgttgggggtggctcaggccataaagat

SEQ ID NO: 23091 - DNA, 75 bp, Artificial Sequence
  Synthetic
gtttctgaacgaggatcactggatgagcagagaaaacaccttgggaggcgttgaaggtatgggcctacagaagct

SEQ ID NO: 23092 - DNA, 75 bp, Artificial Sequence
  Synthetic
aaagccctggatgttggactgatgtgccctgatgacattacgtacctgtgccctaagttagaggatgggtatgat

SEQ ID NO: 23093 - DNA, 75 bp, Artificial Sequence
  Synthetic
ccagaggatatagactgctggtgcaacaccacggagatctacattcactatggccgatgtaccccaacgcgacac

SEQ ID NO: 23094 - DNA, 75 bp, Artificial Sequence
  Synthetic
gcgagacgatcgaggcggtctatcacagtgcatcatcacggagagagcttgctggaagcaaagaatacaccatgg

SEQ ID NO: 23095 - DNA, 75 bp, Artificial Sequence
  Synthetic
atggattctaccaaggctaccaagtatttgaccaaggtggagaattgggccatacgtaaccctggatacgcacta

SEQ ID NO: 23096 - DNA, 75 bp, Artificial Sequence
  Synthetic
catacgtaaccctggatacgcactagcggcggccataataggatggaatttggggacaactaaatctcaaaagat

SEQ ID NO: 23097 - DNA, 75 bp, Artificial Sequence
  Synthetic
gcctgggaatgcaaaacagagattttgtggaaggtgtcaatggagttgagtggattgatgtcgtgatggaaggtg

SEQ ID NO: 23098 - DNA, 75 bp, Artificial Sequence
  Synthetic
gaggctgcgtgaccatcacagcgaaggacaaacccacaatcgatgtgaagatgatgaatatggaagccactgatt

SEQ ID NO: 23099 - DNA, 75 bp, Artificial Sequence
  Synthetic
atgatgaatatggaagccactgatttggcgctcgtgagatcatattgctataaacccaaaatcactgatgttagt

SEQ ID NO: 23100 - DNA, 75 bp, Artificial Sequence
  Synthetic
actgaaccaaggtgccccaccatgggagaggcccacaacaccaaagcaaacaatcaggagtatgtgtgcaagaaa

SEQ ID NO: 23101 - DNA, 75 bp, Artificial Sequence
  Synthetic
gaatgcaccaacaaggctgagggaaggattgtgcagaaggaaaatgttcattttgagttggctgtgtttgtgcac

SEQ ID NO: 23102 - DNA, 75 bp, Artificial Sequence
  Synthetic
gctactcatgtactttcacagacgtgacctgcggctgatggctaatgccatatgttcatctgtgccagtctcatg

SEQ ID NO: 23103 - DNA, 75 bp, Artificial Sequence
  Synthetic
ggttcaacagaaatgggaacctacaataattactctatacagcagtcattgaagcaggcagcaaggttcattgtc

SEQ ID NO: 23104 - DNA, 75 bp, Artificial Sequence
  Synthetic
ggtgcctacaggaagaaccacctggtcaatccacggaaagggagaatggatgacaacagaagacatgttgagagt

SEQ ID NO: 23105 - DNA, 75 bp, Artificial Sequence
  Synthetic
gggatggacatgagccagttttatgtgctaaccatgaattcgaagagttggcttgtgaacagagactggttccat

SEQ ID NO: 23106 - DNA, 75 bp, Artificial Sequence
  Synthetic
gacctaaaccttccgtggactggatcatccgctggctcgtggcagaacagagaatcactggttgagtttgaagaa

SEQ ID NO: 23107 - DNA, 75 bp, Artificial Sequence
  Synthetic
gctcatgcaactaaacaatcagtggtggcactggcctcgcaagaaggggcgttacacgctgccctggccggagcc

SEQ ID NO: 23108 - DNA, 75 bp, Artificial Sequence
  Synthetic
attccagtgaaatacaccagcagcaagcttgagatgacttcggggcacttaaagtgtcgtgtgaaactacaaggg

SEQ ID NO: 23109 - DNA, 75 bp, Artificial Sequence
  Synthetic
ctgaaattgaaaggaatgacttaccccatgtgctcaaataagttcactctagccaagaaccctacagacacaggg

SEQ ID NO: 23110 - DNA, 75 bp, Artificial Sequence
  Synthetic
cacgggacagttgttgtggaactcagttattctggatctgatggaccatgtcgtatacccatatcaatgacagcc

SEQ ID NO: 23111 - DNA, 75 bp, Artificial Sequence
  Synthetic
aacctgcaggacttgaccccgataggaaggctcataacggtaaatccatatgtgtccacatcatcatcgggaaca

SEQ ID NO: 23112 - DNA, 75 bp, Artificial Sequence
  Synthetic
tatcaatggcacaagagcggaagttctatcggcaaggcattcatgtccaccgtgaggggagcacagagaatggtt

SEQ ID NO: 23113 - DNA, 75 bp, Artificial Sequence
  Synthetic
actttgtgattgacagctcaacacaagtgcggattaccgtaaacacagtttgaacgttttttggagagagactac

SEQ ID NO: 23114 - DNA, 75 bp, Artificial Sequence
  Synthetic
gcacttggagacaccgcatgggactttggatcagtcggaggtttcttcacgtcactaggcaaaggaatacaccaa

SEQ ID NO: 23115 - DNA, 75 bp, Artificial Sequence
  Synthetic
gtgtttggaacggcctttagaagcctcttcggaggaatgtcatggataacccagggactgctgggagcacttctg

SEQ ID NO: 23116 - DNA, 75 bp, Artificial Sequence
  Synthetic
tcttcggaggaatgtcatggataacccagggactgctgggagcacttctgttgtggatgggattgaatgcaagag

SEQ ID NO: 23117 - DNA, 75 bp, Artificial Sequence
  Synthetic
taagacgatggaagctggtgggggtggttgaggctactcgccacttgaagagcttccgaaaggacataggacaaa

SEQ ID NO: 23118 - DNA, 75 bp, Artificial Sequence
  Synthetic
acaggtcgatctcactgacgttcttggctgttggagcaatccttatattcctagctaccaatgtacatgccgaca

SEQ ID NO: 23119 - DNA, 75 bp, Artificial Sequence
  Synthetic
tgctagatgggctaaatagacgcggcaaaaagaagcgtggggggaccactgtgagcgtcgtcatccttgtggtat

SEQ ID NO: 23120 - DNA, 75 bp, Artificial Sequence
  Synthetic
ggctgttggagcaatccttatattcctagctaccaatgtacatgccgacactggttgcgcggtggacatggacag

SEQ ID NO: 23121 - DNA, 75 bp, Artificial Sequence
  Synthetic
taggggtggcccaggctattaagatcggatctttgaatggacggccacttgtcacagttaaccagaccgatgtgc

SEQ ID NO: 23122 - DNA, 75 bp, Artificial Sequence
  Synthetic
tagaggcggttatgatcccaactgctggaggaaacaatcgctgcgttgtgaaagccttggatgttggactgatgt

SEQ ID NO: 23123 - DNA, 75 bp, Artificial Sequence
  Synthetic
gccctgatgacatcacgtatttatgccccaagctagaggatggatatgacccagaggacatagactgctggtgta

SEQ ID NO: 23124 - DNA, 75 bp, Artificial Sequence
  Synthetic
ccagaggacatagactgctggtgtaacaccacggagatctacatccactacggccgatgcactccaactcgacac

SEQ ID NO: 23125 - DNA, 75 bp, Artificial Sequence
  Synthetic
atggactcaactaaggctaccaaatacctgaccaaggtggaaaactgggccatacgtaaccctggatacgcatta

SEQ ID NO: 23126 - DNA, 75 bp, Artificial Sequence
  Synthetic
gggaaaacattgtttgtcactccacccatgtccaataacacttttgttgtggatggtcctaaaacgaaagaatgc

SEQ ID NO: 23127 - DNA, 75 bp, Artificial Sequence
  Synthetic
gcggcggctataataggatggaacttggggacaacaaaatctcaaaagattatctttacaattatgcttatgctc

SEQ ID NO: 23128 - DNA, 75 bp, Artificial Sequence
  Synthetic
tggggacaacaaaatctcaaaagattatctttacaattatgcttatgctcattgctccggcctatagcttcaatt

SEQ ID NO: 23129 - DNA, 75 bp, Artificial Sequence
  Synthetic
ttaggattaaggaaagaaaacacaactgaatgtgacacggccgtgatgggcacagccatcaagggcgacaaagca

SEQ ID NO: 23130 - DNA, 75 bp, Artificial Sequence
  Synthetic
gttcacagtgacttgagctactggattgaaagcagaaacaatggcagttggaaactcgaaagagcggtgctggga

SEQ ID NO: 23131 - DNA, 75 bp, Artificial Sequence
  Synthetic
gaggctgtgtgaccatcacagcgaaggataagcccacaatcgatgtgaagatgatgaacatggaagccactgatt

SEQ ID NO: 23132 - DNA, 75 bp, Artificial Sequence
  Synthetic
gaaatcaagtcatgcacttggccagacacccacactctgtggggagagagtgttcaggagagtgaattgatcatt

SEQ ID NO: 23133 - DNA, 75 bp, Artificial Sequence
  Synthetic
acacccacactctgtggggagagagtgttcaggagagtgaattgatcattccagttacattggctggacccagga

SEQ ID NO: 23134 - DNA, 75 bp, Artificial Sequence
  Synthetic
actgcatcgagatgtcctaccatgggagaggcccacaacaccaaagcaaataaccagatgtatgtgtgtaagaaa

SEQ ID NO: 23135 - DNA, 75 bp, Artificial Sequence
  Synthetic
gcaaacacaacatgaggccaggctacaaggtgcaagtttcaggaccatgggatgagagagacatcaccatcgact

SEQ ID NO: 23136 - DNA, 75 bp, Artificial Sequence
  Synthetic
caaggtgcaagtttcaggaccatgggatgagagagacatcaccatcgactttgactactgtccaggcaccaaagt

SEQ ID NO: 23137 - DNA, 75 bp, Artificial Sequence
  Synthetic
ggctatactgacagaggttggggtaatggttgtggactgttcgggaagggcagtattcacacatgcaccaaattt

SEQ ID NO: 23138 - DNA, 75 bp, Artificial Sequence
  Synthetic
ttgactactgtccaggcaccaaagtaacagtcaccccaacatgcagagatagagctgcctccgccagaacaacaa

SEQ ID NO: 23139 - DNA, 75 bp, Artificial Sequence
  Synthetic
atggttgtggactgttcgggaagggcagtattcacacatgcaccaaatttgagtgcaccaataaggctgaaggaa

SEQ ID NO: 23140 - DNA, 75 bp, Artificial Sequence
  Synthetic
agagctgcctccgccagaacaacaacggcaagtggtaaattgattacagattggtgctgcaggtcatgcactctc

SEQ ID NO: 23141 - DNA, 75 bp, Artificial Sequence
  Synthetic
tttcgagttggctgtgtttgtgcacggttcaacagaaatgggaacccactataactactccatacagcagtcatt

SEQ ID NO: 23142 - DNA, 75 bp, Artificial Sequence
  Synthetic
cctccactgcggtacatgacaaagagcggctgctggtatggaatggagattaggcctacagtacatggagacgac

SEQ ID NO: 23143 - DNA, 75 bp, Artificial Sequence
  Synthetic
gaagcaggcagcgaggttcattgtcacacccaaagcaccagtgtacacggctgaactcaatgagtatgggacggt

SEQ ID NO: 23144 - DNA, 75 bp, Artificial Sequence
  Synthetic
atgttgataaaatcaagagtcattgcttatgacggtgcaggcatggaaccatttcagctgggtgtgctcatgatg

SEQ ID NO: 23145 - DNA, 75 bp, Artificial Sequence
  Synthetic
gactctggaatgtgagccccgctccggaatggacatgagccagttttatgtgctaaccatgaattcgaagagctg

SEQ ID NO: 23146 - DNA, 75 bp, Artificial Sequence
  Synthetic
ttcgtggccacgcaagaggtgctgcgaaaaagatggacaggccggatggccggtccagcactggtaggtctacta

SEQ ID NO: 23147 - DNA, 75 bp, Artificial Sequence
  Synthetic
gcttgtgaacagagactggttccatgacttaaaccttccgtggactggatcatctgctggctcatggcaaaacag

SEQ ID NO: 23148 - DNA, 75 bp, Artificial Sequence
  Synthetic
tgtgccatgattttcggagggataacctacagggacatggtgaagtacatcttgttggtggctgctgcttttgcc

SEQ ID NO: 23149 - DNA, 75 bp, Artificial Sequence
  Synthetic
tgtgccatgattttcggagggataacctacagggacatggtgaagtacttcttgttggtggctgctgcttttgcc

SEQ ID NO: 23150 - DNA, 75 bp, Artificial Sequence
  Synthetic
tgtgccatgattttcggagggataacctacagggacatggtgaagtacctcttgttggtggctgctgcttttgcc

SEQ ID NO: 23151 - DNA, 75 bp, Artificial Sequence
  Synthetic
tgtgccatgattttcggagggataacctacagggacatggtgaagtacgtcttgttggtggctgctgcttttgcc

SEQ ID NO: 23152 - DNA, 75 bp, Artificial Sequence
  Synthetic
agaatcactggtggagtttgaagaagctcatgcaactaaacaatcagtagtggcactggcttcgcaggaaggggc

SEQ ID NO: 23153 - DNA, 75 bp, Artificial Sequence
  Synthetic
caacgtgcaacctggactgctggtagcgtattccttgcgacggaaatggagtaaccaggatgccaccctcttagg

SEQ ID NO: 23154 - DNA, 75 bp, Artificial Sequence
  Synthetic
gttacacgcggctctggctggagccattccagtgaaatatgccagcagtaagcttgagatgacttctgggtactt

SEQ ID NO: 23155 - DNA, 75 bp, Artificial Sequence
  Synthetic
agcttgagatgacttctgggtacttaaagtgccgtgtgaaattacaaggactgaagttgaaaggaatgacttacc

SEQ ID NO: 23156 - DNA, 75 bp, Artificial Sequence
  Synthetic
tgtagcactggcaatgataactatggcgttgcacgactggaacatgaccatacccagcctgctgaattcaggagc

SEQ ID NO: 23157 - DNA, 75 bp, Artificial Sequence
  Synthetic
cacagcgtggctgttgctgcgcgcagtgagtgaagggaccgtcagtgcggcctgcattcccattctaggactttt

SEQ ID NO: 23158 - DNA, 75 bp, Artificial Sequence
  Synthetic
ggctccaggaatgaagatggttggaattgatgtatttcggatcggactgctcatcgtcggagttatgtcactcct

SEQ ID NO: 23159 - DNA, 75 bp, Artificial Sequence
  Synthetic
gaaggctcataacggtcaatccatatgtgtccacatcatcatcagggacaaaagtggttgttgagcttgaacccc

SEQ ID NO: 23160 - DNA, 75 bp, Artificial Sequence
  Synthetic
gaaagaaagaaacaatgccattgcaaagaagaaaggtggagtgctgattggcttagccctggcccaagatggctg

SEQ ID NO: 23161 - DNA, 75 bp, Artificial Sequence
  Synthetic
aaagtggttgttgagcttgaacccccatttggggattcattcattttggttggaacaggagaaaatcagataaag

SEQ ID NO: 23162 - DNA, 75 bp, Artificial Sequence
  Synthetic
ggtgaacccactggtgtatgcaggattgacgttggctctaaaacccagcaatagaagaggatggccagtgagtga

SEQ ID NO: 23163 - DNA, 75 bp, Artificial Sequence
  Synthetic
tatcaatggcacaagagtggaagctccatcggcaaggcattcatgtccaccgtgaggggagctcagagaatggta

SEQ ID NO: 23164 - DNA, 75 bp, Artificial Sequence
  Synthetic
ttgacgttggctctaaaacccagcaatagaagaggatggccagtgagtgaagccctcacggcagtaggactgacc

SEQ ID NO: 23165 - DNA, 75 bp, Artificial Sequence
  Synthetic
ttcgcgctagctggtgggatcgcacactttgacgaaggagacatggccattccactggctgtaggaggaataatg

SEQ ID NO: 23166 - DNA, 75 bp, Artificial Sequence
  Synthetic
gcactaggagacaccgcatgggactttggatcagtcggagggttcttcacgtcgctaggtaaagggatacaccaa

SEQ ID NO: 23167 - DNA, 75 bp, Artificial Sequence
  Synthetic
tccactggctgtaggaggaataatgctggtggtagctgtggttacaggattcacgactgatttgtggttggagcg

SEQ ID NO: 23168 - DNA, 75 bp, Artificial Sequence
  Synthetic
gtgttcggaacggccttcagaagcctctttggaggaatgtcatggataacccagggcctgctgggagcactcctg

SEQ ID NO: 23169 - DNA, 75 bp, Artificial Sequence
  Synthetic
agctggagacatctcatggattgaggatgcccaaatcacaggaagctcacaacggtatgacgttgagatagattg

SEQ ID NO: 23170 - DNA, 75 bp, Artificial Sequence
  Synthetic
ttgtggatgggacttaacgcaagagatagatcgatttcactgacgttcttggccgttggagcgatcctcatattc

SEQ ID NO: 23171 - DNA, 75 bp, Artificial Sequence
  Synthetic
tgacgggaatatgaaattgatgaatgatcaaggagttcctttttcaatttgggccctcaggacaggactcattct

SEQ ID NO: 23172 - DNA, 75 bp, Artificial Sequence
  Synthetic
ctagctacgaatgtacatgccgacactggttgcgcagtggacatggacaggaaagaactgaagtgcggaagtggc

SEQ ID NO: 23173 - DNA, 75 bp, Artificial Sequence
  Synthetic
gggccctcaggacaggactcattctagcatcggcctacaatccatacattctgccagtgacattaggagcttact

SEQ ID NO: 23174 - DNA, 75 bp, Artificial Sequence
  Synthetic
ctgccagtgacattaggagcttactggatgacgatacactccccgaagagaagtggagccatctgggatgttccg

SEQ ID NO: 23175 - DNA, 75 bp, Artificial Sequence
  Synthetic
cctggagggacaattacaagtattacccatcaactccgcggaatctggctaaagtcataatggaatcacgggaaa

SEQ ID NO: 23176 - DNA, 75 bp, Artificial Sequence
  Synthetic
aactgagcaccggagtcttcagaattatggccagaggaatacttggaaaatatcaagctggagtgggagtgatgt

SEQ ID NO: 23177 - DNA, 75 bp, Artificial Sequence
  Synthetic
aaggaatctgtggtgtgaggtccgtgggaagattggaacataacatgtggaactcaatcaagcatgagctgaatg

SEQ ID NO: 23178 - DNA, 75 bp, Artificial Sequence
  Synthetic
actggtagattcaggaaaacccaccggcgtctagtgtggacagacgaggaattggaatacgggtggaaaaaatgg

SEQ ID NO: 23179 - DNA, 75 bp, Artificial Sequence
  Synthetic
cttgatatcgtatggaggaccttggaagatgggcacgaaatggaacggggttgatgaggtgcaagttattgttgt

SEQ ID NO: 23180 - DNA, 75 bp, Artificial Sequence
  Synthetic
gggaaaacattgtttgtaactccacccatgtccaataacacatttgttgtggatggtccaaaaacaagagaatgc

SEQ ID NO: 23181 - DNA, 75 bp, Artificial Sequence
  Synthetic
ccagccagggaaatcagtcatgaatgtgcaaacaaagccaggagtttttaagacctctactggagaaattggggc

SEQ ID NO: 23182 - DNA, 75 bp, Artificial Sequence
  Synthetic
ccagatgagaacagagcctggaacagtctagaggtggaggacttcggatttgggctaacagcaacgaaagtttgg

SEQ ID NO: 23183 - DNA, 75 bp, Artificial Sequence
  Synthetic
agacctctactggagaaattggggcagtcaccctagactatccaacaggaacatcaggctctcccatcgtggaca

SEQ ID NO: 23184 - DNA, 75 bp, Artificial Sequence
  Synthetic
tgggctaacagcaacgaaagtttggttgggattaaggaaagaaaacacaactgaatgtgacacggccgtgatggg

SEQ ID NO: 23185 - DNA, 75 bp, Artificial Sequence
  Synthetic
aggaagggaacataattgggctctatggcaatggcatccttgtcggagcgggcagcttcgttagcatgatttctc

SEQ ID NO: 23186 - DNA, 75 bp, Artificial Sequence
  Synthetic
cacagccatcaagggtgacaaagcagttcacagtgatttgagctactggattgaaagcagaaacaatggcagctg

SEQ ID NO: 23187 - DNA, 75 bp, Artificial Sequence
  Synthetic
aaggccagcgaatggaagaagagattccgcaagtgttcagcgaagacatgctgaggaagagacagctaactgtgc

SEQ ID NO: 23188 - DNA, 75 bp, Artificial Sequence
  Synthetic
gaagcttgaaagagttgtgctgggagaagtcaagtcatgcacttggccagatacccacactctgtggggggagag

SEQ ID NO: 23189 - DNA, 75 bp, Artificial Sequence
  Synthetic
gaagtcaagtcatgcacttggccagatacccacactctgtggggggagagcgtccaggagagtgaattgatcatt

SEQ ID NO: 23190 - DNA, 75 bp, Artificial Sequence
  Synthetic
ttgacttgcacccaggttcagggaaaacaaggaaagtgcttcctcaaattgtgaagacagccattgataggcgac

SEQ ID NO: 23191 - DNA, 75 bp, Artificial Sequence
  Synthetic
gtgaagacagccattgataggcgactcaggacagccatcctggcaccgacaagagtggtggcagctgagatagcg

SEQ ID NO: 23192 - DNA, 75 bp, Artificial Sequence
  Synthetic
aagagtggtggcagctgagatagcggaagctctcaaggagtacccaataaggtacctaactccagctgtcaagcg

SEQ ID NO: 23193 - DNA, 75 bp, Artificial Sequence
  Synthetic
ttgactactgtccaggtaccaaagtgacagtcaccccaacatgcagagatagggctgcctccgctagaacaacaa

SEQ ID NO: 23194 - DNA, 75 bp, Artificial Sequence
  Synthetic
tgaacatacaggaacagaaatcgttgatgtaatgtgtcatgcaacactaacgtcacgccttctcacgccacaacg

SEQ ID NO: 23195 - DNA, 75 bp, Artificial Sequence
  Synthetic
agggctgcctccgctagaacaacaacggctagcggcaagctgatcacagattggtgttgtaggtcatgcactctc

SEQ ID NO: 23196 - DNA, 75 bp, Artificial Sequence
  Synthetic
ggttcccaattataacttgtttgtgatggatgaagcccactttaccgaccccgcgagcatagctgcccgagggta

SEQ ID NO: 23197 - DNA, 75 bp, Artificial Sequence
  Synthetic
cctccattgcggtacatgacaaagagcggctgctggtatggaatggaaattagacctacagtacatggagacgac

SEQ ID NO: 23198 - DNA, 75 bp, Artificial Sequence
  Synthetic
tatttcaactaaagtggaactaggcgaggcggcagccattttcatgacggccacccctccgggaacgcgtgaccc

SEQ ID NO: 23199 - DNA, 75 bp, Artificial Sequence
  Synthetic
gaggcggcagccattttcatgacggccacccctccgggaacgcgtgacccatttccagactcgaactcaccaatc

SEQ ID NO: 23200 - DNA, 75 bp, Artificial Sequence
  Synthetic
atgttgataaaatcaagagtcaccgcttatgacggagcaggcatggaaccatttcagctgggtgtactcatgatg

SEQ ID NO: 23201 - DNA, 75 bp, Artificial Sequence
  Synthetic
ccacccctccgggaacgcgtgacccatttccagactcgaactcaccaatcatggatgtggaggagcagatccctg

SEQ ID NO: 23202 - DNA, 75 bp, Artificial Sequence
  Synthetic
tttgtggccacgcaagaggtgctgcggaaaagatggacaggccggatggccggtccagcactggtgggtctatta

SEQ ID NO: 23203 - DNA, 75 bp, Artificial Sequence
  Synthetic
gtggataaccgactataccggaaagacagtgtggtttgttcctagtgtgaagatgggaaatgagatagccgtgtg

SEQ ID NO: 23204 - DNA, 75 bp, Artificial Sequence
  Synthetic
tgtgctatgatttttggagggataacttatagggacatggtgaagtatgtcttgttggtggcggctgcttttgcc

SEQ ID NO: 23205 - DNA, 75 bp, Artificial Sequence
  Synthetic
acagtgtggtttgttcctagtgtgaagatgggaaatgagatagccgtgtgcttgacgaaggccggtaagaaagtg

SEQ ID NO: 23206 - DNA, 75 bp, Artificial Sequence
  Synthetic
atccaactgaacaggaagagctttgactccgaatacccaaagtgcaaaacaggcgaatgggatttcgtgataacc

SEQ ID NO: 23207 - DNA, 75 bp, Artificial Sequence
  Synthetic
acggatatttcggagatgggggccaacttcggggcgagccgagtcatcgacagccggaaatgcataaaaccagtc

SEQ ID NO: 23208 - DNA, 75 bp, Artificial Sequence
  Synthetic
gcgtactctttgcggcggaaatggagtaaccaggatgccaccctcttaggcgtggcactagcaatgataaccatg

SEQ ID NO: 23209 - DNA, 75 bp, Artificial Sequence
  Synthetic
atcatagaggacggggaaggaagcgtgcagcttaatggaccagtgcctataacagcagccagtgcagctcagaga

SEQ ID NO: 23210 - DNA, 75 bp, Artificial Sequence
  Synthetic
gcgctacacgactggaacatgaccatacccagcttgttgaactcaggagccacagcgtggctgttgctgcgcgca

SEQ ID NO: 23211 - DNA, 75 bp, Artificial Sequence
  Synthetic
tgcagcttaatggaccagtgcctataacagcagccagtgcagctcagagacgcggaagaattggtagaagctacg

SEQ ID NO: 23212 - DNA, 75 bp, Artificial Sequence
  Synthetic
gtgagtgaagggaccgtcagcgcggcttgtattcccatcctcggagttttggctccaggaatgaagatagttggg

SEQ ID NO: 23213 - DNA, 75 bp, Artificial Sequence
  Synthetic
tgcaagttggagatgagtaccacttctctggaccaacaagcgaggacgatcatgacttcgcccattggaaagagg

SEQ ID NO: 23214 - DNA, 75 bp, Artificial Sequence
  Synthetic
ggctccaggaatgaagatagttggggttgatgtatttcgaattggattgcttatcatcggagttatgtcactcct

SEQ ID NO: 23215 - DNA, 75 bp, Artificial Sequence
  Synthetic
catgacttcgcccattggaaagaggccaagatactgctagataacatcaacctgcccaacggtctcgtagcccaa

SEQ ID NO: 23216 - DNA, 75 bp, Artificial Sequence
  Synthetic
gaaagaaagaaacaatgccatcgcaaaaaagaaaggtggagtgctgattggtttggccctggcccaagatggctg

SEQ ID NO: 23217 - DNA, 75 bp, Artificial Sequence
  Synthetic
cttgagaacggaacaacgtaagaactttgttgagtttttgagaacaggagatctgcccgtctggctctcttacaa

SEQ ID NO: 23218 - DNA, 75 bp, Artificial Sequence
  Synthetic
ggtgaacccactggtgtacgcaggactgacgttggctctaaaacccagtaatagaagaggatggccagtaagtga

SEQ ID NO: 23219 - DNA, 75 bp, Artificial Sequence
  Synthetic
atctgcccgtctggctctcttacaaattggcagaggcaggagttgcgtaccacgataggaagtggtgctttgacg

SEQ ID NO: 23220 - DNA, 75 bp, Artificial Sequence
  Synthetic
ctgacgttggctctaaaacccagtaatagaagaggatggccagtaagtgaagccctcacagcagtaggattgacc

SEQ ID NO: 23221 - DNA, 75 bp, Artificial Sequence
  Synthetic
gaccttcaataaacacagttctagaggacaacaacccagttgagctctggacaaaatcgggtgagaagaagatac

SEQ ID NO: 23222 - DNA, 75 bp, Artificial Sequence
  Synthetic
tgcggccaaggtggagagatggaagactctgggcggaccatcaggccctgaaatcattcaaggacttcgcctgtg

SEQ ID NO: 23223 - DNA, 75 bp, Artificial Sequence
  Synthetic
gcaagagatcagccgttggcgtgtttgaagtggtcaaaatgcttccagagcattttgcacacagaatgggagaat

SEQ ID NO: 23224 - DNA, 75 bp, Artificial Sequence
  Synthetic
gggccctcaggacaggactcattctagcgtcggcctacaatccatatattctgccagtgacattaggagcttact

SEQ ID NO: 23225 - DNA, 75 bp, Artificial Sequence
  Synthetic
ctatggacaatctgtacatgctaaccacttctgagaaaggtagcagggctcacagggaagcgctagaggagctgc

SEQ ID NO: 23226 - DNA, 75 bp, Artificial Sequence
  Synthetic
cacttctgagaaaggtagcagggctcacagggaagcgctagaggagctgccagaaacactggaaacaatcctctt

SEQ ID NO: 23227 - DNA, 75 bp, Artificial Sequence
  Synthetic
cagaaacactggaaacaatcctcttgatcgccatgatgacgctagcatcctgtggggtctttctcttctttgtcc

SEQ ID NO: 23228 - DNA, 75 bp, Artificial Sequence
  Synthetic
aattgagcactggagtctttagaatcatggctagagggatactcggaaaatatcaagccggagtgggagtgatgt

SEQ ID NO: 23229 - DNA, 75 bp, Artificial Sequence
  Synthetic
tgtggggtctttctcttctttgtccaaagaagaggtttgggaaaaacaggcttgggagccctggtgctgatgaca

SEQ ID NO: 23230 - DNA, 75 bp, Artificial Sequence
  Synthetic
aaagacagaggtcacaaactgacagccacttggcggtatttatgatactggtcctgcttgttgtggggacagtag

SEQ ID NO: 23231 - DNA, 75 bp, Artificial Sequence
  Synthetic
cttgatatcgtatggagggccttggaagatgggcacgaaatggaatgggattgatgaggtgcaagttattgttgt

SEQ ID NO: 23232 - DNA, 75 bp, Artificial Sequence
  Synthetic
ccacttggcggtatttatgatactggtcctgcttgttgtggggacagtagcttctaacgagatgggctggcttga

SEQ ID NO: 23233 - DNA, 75 bp, Artificial Sequence
  Synthetic
ccaaccaggaaaatcagtaatgaatgtgcaaacaaagccgggggtctttaagacctctactggagaaatcggggc

SEQ ID NO: 23234 - DNA, 75 bp, Artificial Sequence
  Synthetic
agttaccctagactatccaacgggaacatcaggctcgcccatcgtagacaaggaagggaatataattgggctcta

SEQ ID NO: 23235 - DNA, 75 bp, Artificial Sequence
  Synthetic
tgggctgcatatgcgggagccacgacgtttctaacaccactgctgaaacacctcattgtcacggaatacgtgaac

SEQ ID NO: 23236 - DNA, 75 bp, Artificial Sequence
  Synthetic
cgtttctaacaccactgctgaaacacctcattgtcacggaatacgtgaacttttcactgatggccgtaaccgctc

SEQ ID NO: 23237 - DNA, 75 bp, Artificial Sequence
  Synthetic
aagctggagctctatttggtttgggaaagggcatgccgttcgtggccattgacctgtcgaccccattgctactgc

SEQ ID NO: 23238 - DNA, 75 bp, Artificial Sequence
  Synthetic
tagggtgttggggtcaattcacaatgactacgactctgacaacaatcatgcttttgatcattcactatgcgtttc

SEQ ID NO: 23239 - DNA, 75 bp, Artificial Sequence
  Synthetic
catgcggtctgctcaaagaagaacagcagcaggtgtgatgaagaatccagtggttgatggaatcgtggcaacgga

SEQ ID NO: 23240 - DNA, 75 bp, Artificial Sequence
  Synthetic
gcagcaggtgtgatgaagaatccagtggttgatggaatcgtggcaacggacgtgcctgatctggaagcaagcaca

SEQ ID NO: 23241 - DNA, 75 bp, Artificial Sequence
  Synthetic
tgaacacacaggaacagagatcgttgacgtaatgtgtcacgcaacactaacgtcacgccttctcacgccacaacg

SEQ ID NO: 23242 - DNA, 75 bp, Artificial Sequence
  Synthetic
aggtcatactaattgtggtggccttgtgttcagtctttctgaagcctggaacaacatcactaacagaattcggaa

SEQ ID NO: 23243 - DNA, 75 bp, Artificial Sequence
  Synthetic
gtgttcagtctttctgaagcctggaacaacatcactaacagaattcggaatgctcacctcggcagcctccgtgac

SEQ ID NO: 23244 - DNA, 75 bp, Artificial Sequence
  Synthetic
tttgatagaaggagcagcaggacggatatggaatgcaaccacagcagttgccatgtgccatctaatgaggaagaa

SEQ ID NO: 23245 - DNA, 75 bp, Artificial Sequence
  Synthetic
ccatgtgccatctaatgaggaagaattggctagcaggggcatcactcgcctggactatatcaagaaacctacaaa

SEQ ID NO: 23246 - DNA, 75 bp, Artificial Sequence
  Synthetic
acggaagcatgagaagaggaggcgggaaaggtagaatgctcggagaaatctggaaggcccaactcaatcaattaa

SEQ ID NO: 23247 - DNA, 75 bp, Artificial Sequence
  Synthetic
tctgacgaaggccggtaaaaaagtgatccaactgaacagaaagagctttgactctgaatacccaaagtgcaaaac

SEQ ID NO: 23248 - DNA, 75 bp, Artificial Sequence
  Synthetic
cacggcaggaatttatggaatatcgaaaggatggtatcatagaggtcgacagagccccagcacgaaaggcgcgaa

SEQ ID NO: 23249 - DNA, 75 bp, Artificial Sequence
  Synthetic
aaaggatggtatcatagaggtcgacagagccccagcacgaaaggcgcgaagagaaggaaacgtgacaggaggaca

SEQ ID NO: 23250 - DNA, 75 bp, Artificial Sequence
  Synthetic
acggatatttcggagatgggagccaactttggggcgagccgggttattgacagtcggaaatgcataaaaccagtc

SEQ ID NO: 23251 - DNA, 75 bp, Artificial Sequence
  Synthetic
actttggggcgagccgggttattgacagtcggaaatgcataaaaccagtcatcatagaggacggggaaggaagcg

SEQ ID NO: 23252 - DNA, 75 bp, Artificial Sequence
  Synthetic
tgaagctcaatggaccagtacccataacagcagccagtgcagcacagaggcgcggaagaatcggtagaagctatg

SEQ ID NO: 23253 - DNA, 75 bp, Artificial Sequence
  Synthetic
cacaaaaggaggaccaggacacgaagaacctatgatgatgcaaagttatggatggaacctggtttccctgaaaag

SEQ ID NO: 23254 - DNA, 75 bp, Artificial Sequence
  Synthetic
tgcaagtcggagacgagtaccacttctctgggccaacaagcgaggacgaccatgacttcgcccactggaaagagg

SEQ ID NO: 23255 - DNA, 75 bp, Artificial Sequence
  Synthetic
gatggaacctggtttccctgaaaagtggaattgacatcttttacagaccagctgaacattctgacacacttctgt

SEQ ID NO: 23256 - DNA, 75 bp, Artificial Sequence
  Synthetic
ccaagatactgctagataacatcaacctgcccaacggcctcgtagcccagctctatgagccagagagagagaagg

SEQ ID NO: 23257 - DNA, 75 bp, Artificial Sequence
  Synthetic
cctgcccaacggcctcgtagcccagctctatgagccagagagagagaaggttttctcaatcgatggggaataccg

SEQ ID NO: 23258 - DNA, 75 bp, Artificial Sequence
  Synthetic
ttgaaggtactgcaaaccgtggatgagtggttagcgaggggaactgaagaattttgtgtaaaagtgctatgccca

SEQ ID NO: 23259 - DNA, 75 bp, Artificial Sequence
  Synthetic
tacatgccaagagtcctgaaagaactggaaaggatgcagttacgctggggagggggtcttgtcagggtcccactt

SEQ ID NO: 23260 - DNA, 75 bp, Artificial Sequence
  Synthetic
ggacaacaacccagttgagctttggacaaaatcgggtgagaagaagatactgcgaccaaggtggagagatggaag

SEQ ID NO: 23261 - DNA, 75 bp, Artificial Sequence
  Synthetic
gctctgggcggatcatcaagctctgaaatcatttaaggacttcgcctgtggcaagagatcagccattggcgtgtt

SEQ ID NO: 23262 - DNA, 75 bp, Artificial Sequence
  Synthetic
gcaagagatcagccattggcgtgttcgaagtggtcaaaatgcttccagagcattttgcacacagaatgggagaat

SEQ ID NO: 23263 - DNA, 75 bp, Artificial Sequence
  Synthetic
ccatggacaatctgtatatgttgaccacttctgagaaaggtagcagggctcacagggaagcgctagaggagttac

SEQ ID NO: 23264 - DNA, 75 bp, Artificial Sequence
  Synthetic
ggtagaagatcgcgtcacacgcttggctgaagaattttctaccacatggcaccatgatacagaaaatccatacaa

SEQ ID NO: 23265 - DNA, 75 bp, Artificial Sequence
  Synthetic
cagaaacactggaaacaattctcttgatcaccatgatgacgttagcatcctgtggggtctttctcttcttcgtcc

SEQ ID NO: 23266 - DNA, 75 bp, Artificial Sequence
  Synthetic
aacttggaattaccatggaagttatgaagttaaagcaacagggtcagccagttccatggttaacggagtcgtgaa

SEQ ID NO: 23267 - DNA, 75 bp, Artificial Sequence
  Synthetic
gaagttaaagcaacagggtcagccagttccatggttaacggagtcgtgaaagtgttgtcaaaaccttgggacgcc

SEQ ID NO: 23268 - DNA, 75 bp, Artificial Sequence
  Synthetic
aaagaaggggtttgggaaaaacaggcttgggggccctagtgctgatgacagtgacagggttgctctgggtcgcag

SEQ ID NO: 23269 - DNA, 75 bp, Artificial Sequence
  Synthetic
agtgttgtcaaaaccttgggacgccttgcagaatgtggtgaacatggctatgaccgacacaactccatttggaca

SEQ ID NO: 23270 - DNA, 75 bp, Artificial Sequence
  Synthetic
aggtccaaccacaaaagatagctggaatcctgcttatatcattgctactcatgatagttctcatccctgaaccag

SEQ ID NO: 23271 - DNA, 75 bp, Artificial Sequence
  Synthetic
gcaaagggtgtttaaggaaaaagtggacacaaaagcgcccgaaccaccccgaggaacatcagaggtcatgaaaat

SEQ ID NO: 23272 - DNA, 75 bp, Artificial Sequence
  Synthetic
gacacaaaagcgcccgaaccaccccgaggaacatcagaggtcatgaaaatcacagcccggtggatgtgggacttc

SEQ ID NO: 23273 - DNA, 75 bp, Artificial Sequence
  Synthetic
aaagacagagatcacaaactgacagtcacctggcggtatttatgatactggttttgcttatcgtgggaacagtgg

SEQ ID NO: 23274 - DNA, 75 bp, Artificial Sequence
  Synthetic
gtagggaggaataaaagacccagaatctgcacaaaggaggagttcatagagaaggtaaacagccatgcggccctt

SEQ ID NO: 23275 - DNA, 75 bp, Artificial Sequence
  Synthetic
ggtgcaatttttaaagaacaaaataagtgggcatcagctagggaagcagtggaggacccaacattttgggagtta

SEQ ID NO: 23276 - DNA, 75 bp, Artificial Sequence
  Synthetic
ttgtttggtagggcacaccaccaagagccaagccgctgggaaatgccgtggcctgatctcagacccgctacagct

SEQ ID NO: 23277 - DNA, 75 bp, Artificial Sequence
  Synthetic
tgggctgcatacgcaggggccacgacgttcttaacaccactgctgaaacatctcatcgttacagaatatgtgaac

SEQ ID NO: 23278 - DNA, 75 bp, Artificial Sequence
  Synthetic
gtggaccaggaacgcgaggcgcaccttcaggggaggtgcgagacatgcatttacaacatgatgggaaagagagaa

SEQ ID NO: 23279 - DNA, 75 bp, Artificial Sequence
  Synthetic
ttttcgctgatggctgtgactgctcaagctggagctctatttggattaggaaagggcatgccgttcgtggccatt

SEQ ID NO: 23280 - DNA, 75 bp, Artificial Sequence
  Synthetic
caaaaggaagcagggccatatggtatatgtggctcggatcccggtttctagagtttgaggccctcgggtttctga

SEQ ID NO: 23281 - DNA, 75 bp, Artificial Sequence
  Synthetic
gaccacgactttgacaacaatcatgcttttgatcattcactatgcgtttctgatccctggctggcaagcggaggc

SEQ ID NO: 23282 - DNA, 75 bp, Artificial Sequence
  Synthetic
aaacaccttgggaggcgttgaaggtatgggcctacagaagctaggatatgtgttgagggacatggctggcaagga

SEQ ID NO: 23283 - DNA, 75 bp, Artificial Sequence
  Synthetic
tgttgagggacatggctggcaaggaaggggggctcatgtacgctgacgacaccgctgggtgggacaccagaatca

SEQ ID NO: 23284 - DNA, 75 bp, Artificial Sequence
  Synthetic
aggggggctcatgtacgctgacgacaccgctgggtgggacaccagaatcaccaaagctgacttggaaaatgaagc

SEQ ID NO: 23285 - DNA, 75 bp, Artificial Sequence
  Synthetic
gcagcaggtgtgatgaagaacccagtggttgatggaatcgtggcaacggacgtgccagatctggaagcaagcaca

SEQ ID NO: 23286 - DNA, 75 bp, Artificial Sequence
  Synthetic
actcattctcgaaagaatggaaccagaacataggcgtctcgcagagtcactaatcaaatttgcttacatgaacaa

SEQ ID NO: 23287 - DNA, 75 bp, Artificial Sequence
  Synthetic
ccaatcactgagaagaaattcggacaggtcatactaattgtggtggccttgtgttcagtctttctgaaacctgga

SEQ ID NO: 23288 - DNA, 75 bp, Artificial Sequence
  Synthetic
gaacataggcgtctcgcagagtcactaatcaaatttgcttacatgaacaaagtggtgaaagtgatgcggcctggg

SEQ ID NO: 23289 - DNA, 75 bp, Artificial Sequence
  Synthetic
acaacatcactaacggaattcggaatgctcacatcagcagcctccgtgacgctgatagaaggggcggcaggacgg

SEQ ID NO: 23290 - DNA, 75 bp, Artificial Sequence
  Synthetic
agggaaggtatcactgtgatggatgtgatttccagggaagaccagagaggaagtggacaagtcgtcacctatgcg

SEQ ID NO: 23291 - DNA, 75 bp, Artificial Sequence
  Synthetic
ttgaacacctttaccaacttgtgtgtccaattgatcagatgcatggaaggggaaggattgctgaagcctgaagaa

SEQ ID NO: 23292 - DNA, 75 bp, Artificial Sequence
  Synthetic
atatggaatgcaaccacagcagttgccatgtgtcatctaatgaggaagaactggctagcaggggcatcacttgcc

SEQ ID NO: 23293 - DNA, 75 bp, Artificial Sequence
  Synthetic
ccatgtgtcatctaatgaggaagaactggctagcaggggcatcacttgcctggaccatatcaagaaacctacaaa

SEQ ID NO: 23294 - DNA, 75 bp, Artificial Sequence
  Synthetic
gaaaggtagaatgctcggagaaatctggaaggcccaactcaatcaactaacacggcaggaattcatggaatatcg

SEQ ID NO: 23295 - DNA, 75 bp, Artificial Sequence
  Synthetic
caagaatggaagagaaagactagcagccatggcagtcagcggtgacgattgcgtggtaaaaccaaaggatgaccg

SEQ ID NO: 23296 - DNA, 75 bp, Artificial Sequence
  Synthetic
cacggcaggaattcatggaatatcgaaaggatggtatcatagaggttgacagagccccagcgcgaaaggcgcgaa

SEQ ID NO: 23297 - DNA, 75 bp, Artificial Sequence
  Synthetic
gcgtggtaaaaccaaaggatgaccgatttgcaacggcattgcatttcttgaatagtatggcaaagatcaggaaag

SEQ ID NO: 23298 - DNA, 75 bp, Artificial Sequence
  Synthetic
acatccctgagtggaaaccctcaacgggttggaggaactggcaagatgtcccattctgttcacatcatttccatg

SEQ ID NO: 23299 - DNA, 75 bp, Artificial Sequence
  Synthetic
tcctgaaacctcgaggaaaggtggtagacctaggttgcggtaggggcggctggagctactactgtgcgaccctga

SEQ ID NO: 23300 - DNA, 75 bp, Artificial Sequence
  Synthetic
ccattctgttcacatcatttccatgagttaaacatgaaggatggcagaactattgtggtcccatgcagacaccag

SEQ ID NO: 23301 - DNA, 75 bp, Artificial Sequence
  Synthetic
agatggtacaggaagtgaaagggtatacaaaaggaggaccaggacacgaagaacctatgatgatgcaaagttatg

SEQ ID NO: 23302 - DNA, 75 bp, Artificial Sequence
  Synthetic
tgtcaccaggatctgggtggtccctcactgaaacagcatgtctgagcaaagcctacggccagatgtggctactca

SEQ ID NO: 23303 - DNA, 75 bp, Artificial Sequence
  Synthetic
gaacctatgatgatgcaaagttatgggtggaacctggtttcactgaaaagtggagttgacgtcttctacagacca

SEQ ID NO: 23304 - DNA, 75 bp, Artificial Sequence
  Synthetic
caggaagaaccacctggtcaatccacggaaagggagaatggatgacaacagaagacatgttgagagtttggaaca

SEQ ID NO: 23305 - DNA, 75 bp, Artificial Sequence
  Synthetic
gagtgtggattgaggagaatgaacacatggaagacaagacccctgtggcctcatggaacgatgtgccgtacctcg

SEQ ID NO: 23306 - DNA, 75 bp, Artificial Sequence
  Synthetic
catggaagacaagacccctgtggcctcatggaacgatgtgccgtacctcgggaaacgcgaggacagttggtgtgg

SEQ ID NO: 23307 - DNA, 75 bp, Artificial Sequence
  Synthetic
attttgcataaaagtgctatgcccgtacatgccaagagtcctgaaagaactggaaaggatgcagtcacgctgggg

SEQ ID NO: 23308 - DNA, 75 bp, Artificial Sequence
  Synthetic
agggggtctcgttcgggtcccactttcccggaattcaaaccatgagatgtattgggtaagcggagccagtgggaa

SEQ ID NO: 23309 - DNA, 75 bp, Artificial Sequence
  Synthetic
aagtctgatagggcacagaacacgatcaacctgggcagagaacatatacacaccaatcatgcagatcagagccct

SEQ ID NO: 23310 - DNA, 75 bp, Artificial Sequence
  Synthetic
tcccggaattcaaaccatgagatgtattgggtaagcggagccagtgggaacatcacaaatgccgtgaacacagtg

SEQ ID NO: 23311 - DNA, 75 bp, Artificial Sequence
  Synthetic
caccaatcatgcagatcagagccctgatcggaccggagcggtatgttgactacatgccaactctaaaccgcttca

SEQ ID NO: 23312 - DNA, 75 bp, Artificial Sequence
  Synthetic
gagcagtggagacttggtctgatggggtcctgtaagatgtaaataaacacaggaaaatagacaatgtaaatagat

SEQ ID NO: 23313 - DNA, 75 bp, Artificial Sequence
  Synthetic
ggtcctgtaagatgtaaataaacacaggaaaatagacaatgtaaatagattttacaaattaattagatttaagta

SEQ ID NO: 23314 - DNA, 75 bp, Artificial Sequence
  Synthetic
tttacaaattaattagatttaagtaggaaagtagcttagataggatgtagaattaggtgaacttatttagacttg

SEQ ID NO: 23315 - DNA, 75 bp, Artificial Sequence
  Synthetic
gccgaagagttttccaccacatggcatcatgacacagaaaatccatacaaaacctggaactatcatggaagttat

SEQ ID NO: 23316 - DNA, 75 bp, Artificial Sequence
  Synthetic
agagtcaggccggattatatgtccgccaccggatgttggatgacggtgctgcctgcagtccaaccccaggaggac

SEQ ID NO: 23317 - DNA, 75 bp, Artificial Sequence
  Synthetic
gaggttaaggcaacagggtcagccagttctatggttaacggagtcgtgaaagtgttgtcaaagccttgggacgcc

SEQ ID NO: 23318 - DNA, 75 bp, Artificial Sequence
  Synthetic
agtgttgtcaaagccttgggacgccttgcagaacgtagtgaacatggccatgaccgacacaaccccatttggaca

SEQ ID NO: 23319 - DNA, 75 bp, Artificial Sequence
  Synthetic
gcaaagagtgtttaaggaaaaagtagacacaaaagcgccagaacctcctcgaggaacatcagaagtcatgaaaat

SEQ ID NO: 23320 - DNA, 75 bp, Artificial Sequence
  Synthetic
ggtggactgggtaaacaaagccgtaaggcccccgtggcccaagcaagggaatggtgtgacccttgtgtaaggact

SEQ ID NO: 23321 - DNA, 75 bp, Artificial Sequence
  Synthetic
tacagctcggtggatgtgggacttcgtggggaggaataaaagacccagaatttgtacaaaggaggagttcataga

SEQ ID NO: 23322 - DNA, 75 bp, Artificial Sequence
  Synthetic
gccgtaaggcccccgtggcccaagcaagggaatggtgtgacccttgtgtaaggactagaggttagaggagacccc

SEQ ID NO: 23323 - DNA, 75 bp, Artificial Sequence
  Synthetic
ttgacagctcaacacaagtgcggaatatcgtaaacacagtttgaacgttttttggagagagactactatgtctaa

SEQ ID NO: 23324 - DNA, 75 bp, Artificial Sequence
  Synthetic
ggaggacccagcattctgggagttggtggaccaggaacgcgaggcgcaccttcaagggaggtgtgagacatgcat

SEQ ID NO: 23325 - DNA, 75 bp, Artificial Sequence
  Synthetic
atctcggatcaagaggatgcttgatggactactcagaggagtagggccagtcagaatcgtattggcgatcctggc

SEQ ID NO: 23326 - DNA, 75 bp, Artificial Sequence
  Synthetic
ctacaacatgatgggaaagcgagaaaagaaaatgggagaatttggaaaagcaaaaggaagcagggctatatggta

SEQ ID NO: 23327 - DNA, 75 bp, Artificial Sequence
  Synthetic
ctttttcaaatttacagctttgaaaccaacggcaggattgttgagacgatggaagctagtgggggtggttgaagc

SEQ ID NO: 23328 - DNA, 75 bp, Artificial Sequence
  Synthetic
tatgtggctcggatcccggtttttagaatttgaggccctagggtttctgaacgaggaccactggatgagcagaga

SEQ ID NO: 23329 - DNA, 75 bp, Artificial Sequence
  Synthetic
aaacaccttgggaggagttgaaggcatgggcctacagaagctaggatatgtattgagggacatggctggcaagga

SEQ ID NO: 23330 - DNA, 75 bp, Artificial Sequence
  Synthetic
gactaaacagacgcggcaaaaagaagcgtgggggaaccaccttgggcatcgccattcttgcggtgttaggggtgg

SEQ ID NO: 23331 - DNA, 75 bp, Artificial Sequence
  Synthetic
aggagggctcatgtacgctgacgacaccgctggatgggacaccagaatcaccaaagctgacctggaaaatgaagc

SEQ ID NO: 23332 - DNA, 75 bp, Artificial Sequence
  Synthetic
ctcaggccataaagattggatccttgaatggacggccacttgtcacagtcaaccagaccgatgtgctagaggcgg

SEQ ID NO: 23333 - DNA, 75 bp, Artificial Sequence
  Synthetic
actcattctcgaaaaaatggacccagaacacaggcgtcttgcagagtcactgatcaaatttgcttacatgaacaa

SEQ ID NO: 23334 - DNA, 75 bp, Artificial Sequence
  Synthetic
agtggtgaaagtaatgcggcccgggagggaaggtgtcactgtgatggatgtgatttccagggaagaccagagagg

SEQ ID NO: 23335 - DNA, 75 bp, Artificial Sequence
  Synthetic
gatgttggactgatatgccctgatgacatcacgtacctgtgccccaagctagaggatgggtatgatccagaggat

SEQ ID NO: 23336 - DNA, 75 bp, Artificial Sequence
  Synthetic
aagtggacaagtcgtcacctacgctttgaatacctttaccaatttgtgtgtccaattgatcagatgcatggaagg

SEQ ID NO: 23337 - DNA, 75 bp, Artificial Sequence
  Synthetic
tcgaggcggtctatcacagtgcaccatcacggagagagcttgctagaagcaaagaatacaccatggatggattct

SEQ ID NO: 23338 - DNA, 75 bp, Artificial Sequence
  Synthetic
accaaggctaccaaatatttgaccaaggtggagaactgggccatacgtaaccctggatatgcactagcggcggcc

SEQ ID NO: 23339 - DNA, 75 bp, Artificial Sequence
  Synthetic
gctatggcagtcagcggtgacgattgcgtggtaaaaccaaaggatgaccgatttgcaacggcattgcatttcttg

SEQ ID NO: 23340 - DNA, 75 bp, Artificial Sequence
  Synthetic
ccctggatatgcactagcggcggccataataggatggaatttggggacaacaaaatctcagaagattatctttac

SEQ ID NO: 23341 - DNA, 75 bp, Artificial Sequence
  Synthetic
aacagtatgtcaaagatcaggaaagacatccctgagtggaaaccttcaacgggatggaggaactggcaagacgtc

SEQ ID NO: 23342 - DNA, 75 bp, Artificial Sequence
  Synthetic
ccattctgttcacaccatttccatgagttgaacatgaaggatggcagaaccatcgtggtcccatgcagacaccaa

SEQ ID NO: 23343 - DNA, 75 bp, Artificial Sequence
  Synthetic
atggaagccactgatttggcgctcgtgagatcatattgctatgagcctaaaatcactgatgtcagtactgaacca

SEQ ID NO: 23344 - DNA, 75 bp, Artificial Sequence
  Synthetic
gctgatggccaatgccatatgttcatctgtaccaatctcatgggtgcccacgggaagaaccacctggtcaattca

SEQ ID NO: 23345 - DNA, 75 bp, Artificial Sequence
  Synthetic
cggaaagggagaatggatgacaacagaagacatgttgagagtctggaacagggtgtggattgaggagaacgaaca

SEQ ID NO: 23346 - DNA, 75 bp, Artificial Sequence
  Synthetic
gacagaggttggggtaatggttgtggactgttcggaaagggcagcattcacacatgcgccaaatttgagtgcacc

SEQ ID NO: 23347 - DNA, 75 bp, Artificial Sequence
  Synthetic
aacaaggctgagggaagaattgtgcagaaggaaaatgttcattttgaattggctgtgtttgtgcacggttcaaca

SEQ ID NO: 23348 - DNA, 75 bp, Artificial Sequence
  Synthetic
gaaatgggaacctacaacaactactctatacagcagtcattgaagcaggcagcaaggttcattgtcacaccgaaa

SEQ ID NO: 23349 - DNA, 75 bp, Artificial Sequence
  Synthetic
gatcgggccagagcggtatgttgactacatgccaaccctaaaccgcttcagagcagtggagacatggtctgatgg

SEQ ID NO: 23350 - DNA, 75 bp, Artificial Sequence
  Synthetic
ggttctgtaagatgtaaataactgcaggaaaataacaatgtaaatagatttatatattaaccagatttaagtaag

SEQ ID NO: 23351 - DNA, 75 bp, Artificial Sequence
  Synthetic
tatatattaaccagatttaagtaagtaagtagcatagatggaatgtagtgttaggcgaacttatttggacttgag

SEQ ID NO: 23352 - DNA, 75 bp, Artificial Sequence
  Synthetic
ggttgagtttgaagaagctcatgcaaccaaacaatcagtggtggcactggcttcgcaagaaggggcgttacatgc

SEQ ID NO: 23353 - DNA, 75 bp, Artificial Sequence
  Synthetic
tgctctggccggagccattccagtgaaatacaccagcagcaagcttgagatgacctcggggcacttaaagtgtcg

SEQ ID NO: 23354 - DNA, 75 bp, Artificial Sequence
  Synthetic
tgtgaaattacaaggactgaaattgaaaggaatgacttaccccatgtgctcaaacaagttcactctagccaagaa

SEQ ID NO: 23355 - DNA, 75 bp, Artificial Sequence
  Synthetic
aaaggaatgacttaccccatgtgctcaaacaagttcactctagccaagaaccccacagatacaggacacgggaca

SEQ ID NO: 23356 - DNA, 75 bp, Artificial Sequence
  Synthetic
atgtctaacaaaaaaccaggaaaacccggggcaacccgggttgtcaatatgctaaagcgcggtgcatcccgcgga

SEQ ID NO: 23357 - DNA, 75 bp, Artificial Sequence
  Synthetic
gatctgatggaccatgtcgcatacccatatcaatgacagccaacctgcaggacttgaccccgataggaaggctca

SEQ ID NO: 23358 - DNA, 75 bp, Artificial Sequence
  Synthetic
gctaaagcgcggtgcatcccgcggaaatccgatatctcggatcaagaggatgcttgatggactactcagaggagt

SEQ ID NO: 23359 - DNA, 75 bp, Artificial Sequence
  Synthetic
aggaccagtcagaatcgtcttggcgatcttgacctttttcaaatttacagctttgaaaccaacggcgggattgtt

SEQ ID NO: 23360 - DNA, 75 bp, Artificial Sequence
  Synthetic
ctttgaaaccaacggcgggattgttaagacgatggaagctagtgggggtggttgaggctactcgccacttgaaga

SEQ ID NO: 23361 - DNA, 75 bp, Artificial Sequence
  Synthetic
aagacgatggaagctagtgggggtggttgaggctactcgccacttgaagagcttccgaaaggtcataggacaaat

SEQ ID NO: 23362 - DNA, 75 bp, Artificial Sequence
  Synthetic
gacaccgcatgggactttggatcagttggaggtttcttcacgtcactaggcaaaggaatacaccaagtgtttgga

SEQ ID NO: 23363 - DNA, 75 bp, Artificial Sequence
  Synthetic
acggccttcagaagcctctttggagggatgtcatggataacccagggactgctaggagcacttctgttgtggatg

SEQ ID NO: 23364 - DNA, 75 bp, Artificial Sequence
  Synthetic
ggatgtcatggataacccagggactgctaggagcacttctgttgtggatgggactaaatgcaagagacaggtcga

SEQ ID NO: 23365 - DNA, 75 bp, Artificial Sequence
  Synthetic
acaattataagtattacccatcaactccgcggaatttggctaaagtcataatggaatcacgggaaaaaggaatct

SEQ ID NO: 23366 - DNA, 75 bp, Artificial Sequence
  Synthetic
tccgcggaatttggctaaagtcataatggaatcacgggaaaaaggaatctgtggtgtgcggtctgtgggaagact

SEQ ID NO: 23367 - DNA, 75 bp, Artificial Sequence
  Synthetic
aagcatgagctgaatgccatacttgaggacaacgggcaggacttgacagtcgtcgttgaacagccaactggtaga

SEQ ID NO: 23368 - DNA, 75 bp, Artificial Sequence
  Synthetic
aggacaacgggcaggacttgacagtcgtcgttgaacagccaactggtagattcaggaaaacccatcggcgcctag

SEQ ID NO: 23369 - DNA, 75 bp, Artificial Sequence
  Synthetic
tgtggacagatgaggaattggaatacgggtggaaaaaatgggggaaaacattgtttgtcactccacccatgtcca

SEQ ID NO: 23370 - DNA, 75 bp, Artificial Sequence
  Synthetic
cgggtggaaaaaatgggggaaaacattgtttgtcactccacccatgtccaataacacatttgttgtggatggtcc

SEQ ID NO: 23371 - DNA, 75 bp, Artificial Sequence
  Synthetic
ttgtttgtcactccacccatgtccaataacacatttgttgtggatggtcctaagacaaaagaatgcccagatgag

SEQ ID NO: 23372 - DNA, 75 bp, Artificial Sequence
  Synthetic
aatagagcctggaacagtctagaggtggaggacttcggatttgggttaacatcaacgaaagtttggttaggacta

SEQ ID NO: 23373 - DNA, 75 bp, Artificial Sequence
  Synthetic
ctgaaccgagatgtcctaccatgggagaggcccacaacaccaaagcaaataaccaggagtatgtgtgtaagaaag

SEQ ID NO: 23374 - DNA, 75 bp, Artificial Sequence
  Synthetic
aggaaagaaaacacaactgaatgtgacacggccgtgatgggcacagccattaagggcgacaaagcagtccacagt

SEQ ID NO: 23375 - DNA, 75 bp, Artificial Sequence
  Synthetic
gatttgagttactggattgaaagcagaaacaatggcagttggaaacttgaaagagctgtgctgggggaaatcaag

SEQ ID NO: 23376 - DNA, 75 bp, Artificial Sequence
  Synthetic
agtgcaccaataaggctgagggaagaattgtgcagaaggaaaatgtccatttcgagttggctgtgtttgtgcacg

SEQ ID NO: 23377 - DNA, 75 bp, Artificial Sequence
  Synthetic
tcatgcacttggccagacacccacactctgtggggggagagtgttcaggagagcgaattgatcattccagttaca

SEQ ID NO: 23378 - DNA, 75 bp, Artificial Sequence
  Synthetic
ttcgagttggctgtgtttgtgcacggttcaacagaaatgggaacctacaataactacttcatacagcagtcattg

SEQ ID NO: 23379 - DNA, 75 bp, Artificial Sequence
  Synthetic
ttggctggacccaggagtaaacataacatgaggccaggctacaaggtgcaagtttcaggaccatgggacgagaga

SEQ ID NO: 23380 - DNA, 75 bp, Artificial Sequence
  Synthetic
acatgaggccaggctacaaggtgcaagtttcaggaccatgggacgagagagatatcaccatcgactttgactact

SEQ ID NO: 23381 - DNA, 75 bp, Artificial Sequence
  Synthetic
tccgccagaacaacaacggcaagtggtaaactgatcacggattggtgttgcaggtcatgcactctccctccactg

SEQ ID NO: 23382 - DNA, 75 bp, Artificial Sequence
  Synthetic
cgttacatgacaaagagcggctgctggtatggaatggagattaggcctacagtacatggagacgacatgctgata

SEQ ID NO: 23383 - DNA, 75 bp, Artificial Sequence
  Synthetic
aaatcaagagttaccgcctatgacggcgcaggcatggaaccatttcagctgggtgtgctcatgatgtttgtggcc

SEQ ID NO: 23384 - DNA, 75 bp, Artificial Sequence
  Synthetic
ttacacgcggctctggctggagccattccagtgaaatatgccagcggtaagcttgagatgacttctgggcactta

SEQ ID NO: 23385 - DNA, 75 bp, Artificial Sequence
  Synthetic
acgcaagaggtgctgcggaaaagatggacaggccgggtggccggtccagcactggtaggtctactatgtgccatg

SEQ ID NO: 23386 - DNA, 75 bp, Artificial Sequence
  Synthetic
attttcggagggataacttacagggacatggtgaagtatgtcttgttggtggctgctgcctttgctgaaagcaac

SEQ ID NO: 23387 - DNA, 75 bp, Artificial Sequence
  Synthetic
gctgttgctgcgcgcagtgagtgaagggaccgtcagtgcggcctgcattcccattctgggacttttggctccagg

SEQ ID NO: 23388 - DNA, 75 bp, Artificial Sequence
  Synthetic
aatgaggatagttggaattgatgtatttcggattggactgctcattgtcggagttatgtcactcctgaaagaaag

SEQ ID NO: 23389 - DNA, 75 bp, Artificial Sequence
  Synthetic
aaacaatgccatcgcaaaaaagaaaggtggagtgctgattggcctggccctggcccaagatggctgggtaaatcc

SEQ ID NO: 23390 - DNA, 75 bp, Artificial Sequence
  Synthetic
actggtgtatgcaggactgacgttggctctgaaacccagcaacagaagaggatggccagtgagtgaagcccttac

SEQ ID NO: 23391 - DNA, 75 bp, Artificial Sequence
  Synthetic
ggcagtaggactgaccttcgcgctagctggcgggatcgcacactttgacgaaggagacatggccattccactggc

SEQ ID NO: 23392 - DNA, 75 bp, Artificial Sequence
  Synthetic
gccgtggttacaggatttacgactgacttgtggctggagcgagctggagacatctcgtggattgaggacgcccaa

SEQ ID NO: 23393 - DNA, 75 bp, Artificial Sequence
  Synthetic
gtccctttttcaatttgggccctcaggacaggacttattctagcatcggcctacaatccatacatcctgccagtg

SEQ ID NO: 23394 - DNA, 75 bp, Artificial Sequence
  Synthetic
ggacaggacttattctagcatcggcctacaatccatacatcctgccagtgacactaggagcttactggatgacga

SEQ ID NO: 23395 - DNA, 75 bp, Artificial Sequence
  Synthetic
tacactccccgaagagaagtggagccatttgggatgttccggctcccaaggaaaagaagagagctgaactgagca

SEQ ID NO: 23396 - DNA, 75 bp, Artificial Sequence
  Synthetic
ggagtaggagtgatgtttgatggggtcttccacacgatgtggcatgtgacgaatggggccaccattaacgtgggg

SEQ ID NO: 23397 - DNA, 75 bp, Artificial Sequence
  Synthetic
gaatggggccaccattaacgtgggggacggttgcttagtcccctattgggctagtgtgagagatgatttgatatc

SEQ ID NO: 23398 - DNA, 75 bp, Artificial Sequence
  Synthetic
gtatggaggaccttggaagatgggcacgaaatggaacggggttgatgaggtacaagtcattgttgttcagccagg

SEQ ID NO: 23399 - DNA, 75 bp, Artificial Sequence
  Synthetic
aaaatcagtcatgaatgtgcaaacaaagccaggagtctttaagacctctactggggaaatcggagcagtcaccct

SEQ ID NO: 23400 - DNA, 75 bp, Artificial Sequence
  Synthetic
gtccaggagagtgaattgatcattccagtcacactggccgggcccaggagcaaacacaacatgaggccaggctac

SEQ ID NO: 23401 - DNA, 75 bp, Artificial Sequence
  Synthetic
ctggggaaatcggagcagtcaccctagactatccaacgggaacatcaggctcgcccatcgtggacaaggaaggga

SEQ ID NO: 23402 - DNA, 75 bp, Artificial Sequence
  Synthetic
gttagcatgatttctcaaggccagcgaatggaagaagagattccgcaagtgttcagtgaagacatgctgaggaag

SEQ ID NO: 23403 - DNA, 75 bp, Artificial Sequence
  Synthetic
agacagttaactgtgcttgacttgcacccaggctcagggaaaacaaggaaagtgcttccccaaattgtgaagaca

SEQ ID NO: 23404 - DNA, 75 bp, Artificial Sequence
  Synthetic
ggcagctgagatagcggaagctctcaaggagtacccaataaggtacttaactccagctgtcaaacgtgaacatac

SEQ ID NO: 23405 - DNA, 75 bp, Artificial Sequence
  Synthetic
aggaacagaaatcgttgacgtaatgtgtcatgcaacactaacgtcacgccttctcacgccacaacgtgttcccaa

SEQ ID NO: 23406 - DNA, 75 bp, Artificial Sequence
  Synthetic
ttacaacttgtttgtgatggatgaagcccattttaccgaccccgctagcatagctgcccgcggatatatttcaac

SEQ ID NO: 23407 - DNA, 75 bp, Artificial Sequence
  Synthetic
ctcgaattcaccaatcatggatgtggaggagcagatccctgacagagcatggaactcaggatacgagtggataac

SEQ ID NO: 23408 - DNA, 75 bp, Artificial Sequence
  Synthetic
ggccggtaaaaaagtgatccaactgaacaggaagagctttgactccgaatacccaaagtgcaaaacaggcgaatg

SEQ ID NO: 23409 - DNA, 75 bp, Artificial Sequence
  Synthetic
acccaaagtgcaaaacaggcgaatgggactttgtgataaccacggatatttcggagatgggagccaactttgggg

SEQ ID NO: 23410 - DNA, 75 bp, Artificial Sequence
  Synthetic
cgagccgagtcattgacagtcggaaatgcataaaaccagttatcatagaggacggggaaggaagcgtgcagctca

SEQ ID NO: 23411 - DNA, 75 bp, Artificial Sequence
  Synthetic
atggaccagtgcctataacagcagccagtgcagcgcagagacgcggaagaattggtagaagctatgtgcaggttg

SEQ ID NO: 23412 - DNA, 75 bp, Artificial Sequence
  Synthetic
gcccattggaaagaggccaagatactgctagacaacatcaacttgcccaatggtcttgtagcccaactctatgag

SEQ ID NO: 23413 - DNA, 75 bp, Artificial Sequence
  Synthetic
tttttgagaacaggagatctgcccgtctggctttcttacaaattggcagaagcaggagttgcgtaccacgacagg

SEQ ID NO: 23414 - DNA, 75 bp, Artificial Sequence
  Synthetic
tctggctttcttacaaattggcagaagcaggagttgcgtaccacgacaggaagtggtgcttcgacggaccttcaa

SEQ ID NO: 23415 - DNA, 75 bp, Artificial Sequence
  Synthetic
taaacacagttctagaggacaacaatccagttgagctctggacaaaatcgggtgagaagaagatactgcgaccaa

SEQ ID NO: 23416 - DNA, 75 bp, Artificial Sequence
  Synthetic
ggtggagagatggaagactctgggcggaccatcaagctctgaaatcattcaaggaattcgcctgtggcaagagat

SEQ ID NO: 23417 - DNA, 75 bp, Artificial Sequence
  Synthetic
cagccattggcgtgtttgaagtggtcaaaatgcttccagagcattttgcacacaggatgggagaatccatggaca

SEQ ID NO: 23418 - DNA, 75 bp, Artificial Sequence
  Synthetic
gatgacgctagcatcctgtggggtctttctcttctttgtccaaagaaggggtttgggaaaaacaggcttgggggc

SEQ ID NO: 23419 - DNA, 75 bp, Artificial Sequence
  Synthetic
cacaaaagatagctggaatcttgctcatatcactgctactcatgatagttctcatccctgaaccagaaagacaga

SEQ ID NO: 23420 - DNA, 75 bp, Artificial Sequence
  Synthetic
ggaagggaatataattgggctctatggcaatggcatccttgtcggagcgggcaagttcgttagcatgatttctca

SEQ ID NO: 23421 - DNA, 75 bp, Artificial Sequence
  Synthetic
gatcacaaactgacagccacttggcggtattcatgatactggtcctgcttgtcgtgggaacagtagcttctaacg

SEQ ID NO: 23422 - DNA, 75 bp, Artificial Sequence
  Synthetic
agggcacaccaccaagagccaagccgatgggaaatgccgtggcctgatcttagacccgccacagcttgggctgca

SEQ ID NO: 23423 - DNA, 75 bp, Artificial Sequence
  Synthetic
tagacccgccacagcttgggctgcatatgcaggagccacgacgtttttaacaccactgctgaaacacctcattgt

SEQ ID NO: 23424 - DNA, 75 bp, Artificial Sequence
  Synthetic
tatgcaggagccacgacgtttttaacaccactgctgaaacacctcattgtcacagaatacgtgaacttttcattg

SEQ ID NO: 23425 - DNA, 75 bp, Artificial Sequence
  Synthetic
atggctgtaaccgctcaagctggagctctatttggtttgggaaagggcatgccgttcgtggccattgacctgtcg

SEQ ID NO: 23426 - DNA, 75 bp, Artificial Sequence
  Synthetic
gtacctaactcccgctgtcaagcgtgaacacacaggaacagagatcgttgacgtaatgtgtcacgcaacactaac

SEQ ID NO: 23427 - DNA, 75 bp, Artificial Sequence
  Synthetic
accccattgttactgttagggtgttggggtcaattcacgatgactacgactctgacaacaatcatgcttctgatc

SEQ ID NO: 23428 - DNA, 75 bp, Artificial Sequence
  Synthetic
ggggtcaattcacgatgactacgactctgacaacaatcatgcttctgatcatccactacgcgtttctgatccccg

SEQ ID NO: 23429 - DNA, 75 bp, Artificial Sequence
  Synthetic
cacccctccagggacgcgtgacccatttccagactcgaactcaccaatcgtggatgtggaggagcagatccctga

SEQ ID NO: 23430 - DNA, 75 bp, Artificial Sequence
  Synthetic
gaatcgtggcaacagacgtgcctgatctggaagcgagcacaccaatcactgagaagaaatttggacaggtcatac

SEQ ID NO: 23431 - DNA, 75 bp, Artificial Sequence
  Synthetic
taatcgtggtggccttgtgttcagtctttctgaagcctggaacaacatcactaacagaattcggaatgcttacct

SEQ ID NO: 23432 - DNA, 75 bp, Artificial Sequence
  Synthetic
gatgggaaatgagatagccgtgtgtctgacgaaggccggtaaaaaagtgatccaactgaacagaaagagctttga

SEQ ID NO: 23433 - DNA, 75 bp, Artificial Sequence
  Synthetic
cggcagcttccgtgactttgatagaaggagcagcaggacggatatggaatgcaaccacagcagttgccatgtgcc

SEQ ID NO: 23434 - DNA, 75 bp, Artificial Sequence
  Synthetic
atctaatgaggaagaattggctagccggggcatcactcgcctggactatatcaagaaacctacaaaatggaagca

SEQ ID NO: 23435 - DNA, 75 bp, Artificial Sequence
  Synthetic
tgagaagaggaggcggaaaaggtagaatgctcggggaaatctggaaggcccaactcaatcaattaacacggcagg

SEQ ID NO: 23436 - DNA, 75 bp, Artificial Sequence
  Synthetic
aattcatggaatatcgaaaggatggtattatagaggtcgacagagccccagcgcgaaaggcgcgaagagaaggaa

SEQ ID NO: 23437 - DNA, 75 bp, Artificial Sequence
  Synthetic
atgtgacaggaggacatccggtgtctagaggaacggcaaaactgaggtggctcgttgaaagaggattcctaaaac

SEQ ID NO: 23438 - DNA, 75 bp, Artificial Sequence
  Synthetic
cgcgaggaaaggtagtagacctaggttgcggtaggggcggctggagctactactgtgcgaccctgaaaatggttc

SEQ ID NO: 23439 - DNA, 75 bp, Artificial Sequence
  Synthetic
ttgcggtaggggcggctggagctactactgtgcgaccctgaaaatggttcaggaagtgaagggatacacaaaagg

SEQ ID NO: 23440 - DNA, 75 bp, Artificial Sequence
  Synthetic
tctgcccgtctggctttcttacaaattggcagaagcaggagtcgcgtaccacgacaggaggtggtgctttgatgg

SEQ ID NO: 23441 - DNA, 75 bp, Artificial Sequence
  Synthetic
accttcaataaatacagtcctcgaggacaacaacccagttgagctttggacaaaatcgggtgagaagaagatact

SEQ ID NO: 23442 - DNA, 75 bp, Artificial Sequence
  Synthetic
tgaagaggccaggacattgaaggtcctgcaaactgtggatgagtggttagcgcggggaactgaagaattttgtat

SEQ ID NO: 23443 - DNA, 75 bp, Artificial Sequence
  Synthetic
aaaagtgctatgcccatacatgccaagagtcctgaaagaactggaaaggatgcagttacgttggggagggggtct

SEQ ID NO: 23444 - DNA, 75 bp, Artificial Sequence
  Synthetic
agagtcctgaaagaactggaaaggatgcagttacgttggggagggggtcttgtccgggtcccactttcccggaat

SEQ ID NO: 23445 - DNA, 75 bp, Artificial Sequence
  Synthetic
agacgtccacctaggttcaggaacgagagctgtgctgacgaagaaagtgaagaccaattggaacatggtagaaga

SEQ ID NO: 23446 - DNA, 75 bp, Artificial Sequence
  Synthetic
tcgcgttacgcgcttggccgaagaattttccaccacatggcaccatgacacagaaaatccatacaaaacctggaa

SEQ ID NO: 23447 - DNA, 75 bp, Artificial Sequence
  Synthetic
aaaaccttgggacgccttacagaatgtggtgaacatggccatgaccgacacaaccccatttggacaacaaagagt

SEQ ID NO: 23448 - DNA, 75 bp, Artificial Sequence
  Synthetic
gtttaaggaaaaagtggacacaaaagcaccagaacctccccgaggaacagcggaggtcatgaaaatcacagcccg

SEQ ID NO: 23449 - DNA, 75 bp, Artificial Sequence
  Synthetic
gcaccagaacctccccgaggaacagcggaggtcatgaaaatcacagcccgatggatgtgggactttgtggggagg

SEQ ID NO: 23450 - DNA, 75 bp, Artificial Sequence
  Synthetic
aggaggagttcatagagaaggtaaacagccatgcggcccttggagcaattttcaaagaacagaacaagtgggcat

SEQ ID NO: 23451 - DNA, 75 bp, Artificial Sequence
  Synthetic
cagctcgggaagcagtggaggacccagcattttgggagttggtggaccaggaacgcgaggcgcaccttcaaggga

SEQ ID NO: 23452 - DNA, 75 bp, Artificial Sequence
  Synthetic
agcattttgggagttggtggaccaggaacgcgaggcgcaccttcaagggaggtgtgaaacatgcatctacaacat

SEQ ID NO: 23453 - DNA, 75 bp, Artificial Sequence
  Synthetic
gatgggaaagagagaaaagaaaatgggagaatttggaaaagcaaaaggaagcagggccatatggtatatgtggct

SEQ ID NO: 23454 - DNA, 75 bp, Artificial Sequence
  Synthetic
acatggctggcaaggaaggggggctcatgtatgctgacgacaccgctgggtgggacaccaggatcactaaagctg

SEQ ID NO: 23455 - DNA, 75 bp, Artificial Sequence
  Synthetic
catgtatgctgacgacaccgctgggtgggacaccaggatcactaaagctgacttggaaaatgaggcactcattct

SEQ ID NO: 23456 - DNA, 75 bp, Artificial Sequence
  Synthetic
agtgatgcggcccgggagggaaggtattactgtgatggatgttatttccagggaagaccagagaggaagtggaca

SEQ ID NO: 23457 - DNA, 75 bp, Artificial Sequence
  Synthetic
attactgtgatggatgttatttccagggaagaccagagaggaagtggacaagtcgtcacttacgcgttgaacacc

SEQ ID NO: 23458 - DNA, 75 bp, Artificial Sequence
  Synthetic
gctgaagcctgaagaagttgaagggttggagcggggaaaacacaagaagatccaagactggctgggcaagaatgg

SEQ ID NO: 23459 - DNA, 75 bp, Artificial Sequence
  Synthetic
aagagaaaggctagctgccatggcagtcagcggtgatgattgcgtggtaaagccaaaagatgaccgattcgcaac

SEQ ID NO: 23460 - DNA, 75 bp, Artificial Sequence
  Synthetic
agccaaaagatgaccgattcgcaacggcattgcatttcttgaacagcatgtcaaaaatcaggaaagacatccctg

SEQ ID NO: 23461 - DNA, 75 bp, Artificial Sequence
  Synthetic
gaactggcaagatgtcccattctgttcacatcatttccatgagttaaacatgaaggacggcagaactatcgtggt

SEQ ID NO: 23462 - DNA, 75 bp, Artificial Sequence
  Synthetic
cccatgcagacatcaggacgaactgataggaagggcacgattgtcaccaggatctgggtggtccctcactgaaac

SEQ ID NO: 23463 - DNA, 75 bp, Artificial Sequence
  Synthetic
tgacattggagaagcttcacccgtgcccgaaattgaagaggccaggacattgaaggtcctgcaaactgtggatga

SEQ ID NO: 23464 - DNA, 75 bp, Artificial Sequence
  Synthetic
gatctgggtggtccctcactgaaacggcatgtctaagcaaagcctacggccagatgtggctacttatgtactttc

SEQ ID NO: 23465 - DNA, 75 bp, Artificial Sequence
  Synthetic
ttgaggagaatgaacacatggaagacaagacccccgtggcctcatggaacgatgtgccgtacctcggaaagcgcg

SEQ ID NO: 23466 - DNA, 75 bp, Artificial Sequence
  Synthetic
aggacagttggtgtggaagtttgatagggcacagaacacgatcaacctgggcagagaacatatacacaccaatta

SEQ ID NO: 23467 - DNA, 75 bp, Artificial Sequence
  Synthetic
caggaacaagagcggtgctgacgaagaaagtgaagaccaattggaaaatggtagaagaccgcgtcacgcgcctag

SEQ ID NO: 23468 - DNA, 75 bp, Artificial Sequence
  Synthetic
taatcagatttaagtaagtaagtagcttagataggatgtagaactaggtgaacttatttagacttgagagtcagg

SEQ ID NO: 23469 - DNA, 75 bp, Artificial Sequence
  Synthetic
aacttatttagacttgagagtcaggccggactacgtgtccgccaccggatgttggatgacggtgctgcctgcagt

SEQ ID NO: 23470 - DNA, 75 bp, Artificial Sequence
  Synthetic
ccaaccccaggaggactgggttaccaaagtgtccgacactcaacacgcaaagcgctcaataccgactcggagagc

SEQ ID NO: 23471 - DNA, 75 bp, Artificial Sequence
  Synthetic
tccctggcgttggagaggataggcacccagagtcaggccacaggttttgtgccactagcatgcagtgctgcctga

SEQ ID NO: 23472 - DNA, 75 bp, Artificial Sequence
  Synthetic
atgtttaacaaaaaaccaggaaaacccggggcaacccgggttgtcaatatgctaaagcgcggcgcatcccgcgga

SEQ ID NO: 23473 - DNA, 75 bp, Artificial Sequence
  Synthetic
gctaaagcgcggcgcatcccgcggaaatccgatatctcggattaagaggatgcttgatggactactcagaggagt

SEQ ID NO: 23474 - DNA, 75 bp, Artificial Sequence
  Synthetic
ctttgaaaccaacggcaggattgttgagacgatggaagttagtgggggtggttgaagccacccgccacttgaaaa

SEQ ID NO: 23475 - DNA, 75 bp, Artificial Sequence
  Synthetic
gcttccgaaaggacataggacaaatgctagatggacagaatagacgcagcaaaaagaagcgtggggggaccaccg

SEQ ID NO: 23476 - DNA, 75 bp, Artificial Sequence
  Synthetic
tgggcatcgcccttcttgtggcactaggggcagcccaggctatcaagatcggaaccttaaaaggacggccacttg

SEQ ID NO: 23477 - DNA, 75 bp, Artificial Sequence
  Synthetic
tcacagttaaccagaccgatgtggttgaggcggttatgattccaaccaccagaggaaacaaccgatgcgttgtga

SEQ ID NO: 23478 - DNA, 75 bp, Artificial Sequence
  Synthetic
aagccctggatgtaggactgatgtgccctgatgacatcacgtatgtatgtcctaagctagaggatgggtatgatc

SEQ ID NO: 23479 - DNA, 75 bp, Artificial Sequence
  Synthetic
cagaggatatagactgctggtgcaacaccacggagatctatatccactacggccgatgcaccccaacacgacatg

SEQ ID NO: 23480 - DNA, 75 bp, Artificial Sequence
  Synthetic
gagcggtatgttgactacatgccaaccctaaaccgcttcagagcagtggagacatggtctgatggggttctgtaa

SEQ ID NO: 23481 - DNA, 75 bp, Artificial Sequence
  Synthetic
cgagacgatcgaagcggtccatcacagtgcaccatcacggagagagcttgctggaagcaaagaatacaccatgga

SEQ ID NO: 23482 - DNA, 75 bp, Artificial Sequence
  Synthetic
tggactcgatcaaggtcaccaaatacttgaccaaggtggaaaactgggccatacgcaaccctggatacgcgctgg

SEQ ID NO: 23483 - DNA, 75 bp, Artificial Sequence
  Synthetic
tggcgcttgtgagatcatattgttatgaacctaaaatcactgatgtcagtactgaatcgagatgtcctaccatgg

SEQ ID NO: 23484 - DNA, 75 bp, Artificial Sequence
  Synthetic
cagcagtcataataggatggaatttgggaacaacgaaatcccaaaagatcatctttacaatcatgcttatgctca

SEQ ID NO: 23485 - DNA, 75 bp, Artificial Sequence
  Synthetic
tgaacctaaaatcactgatgtcagtactgaatcgagatgtcctaccatgggagaggcccacaacaccaaagcaaa

SEQ ID NO: 23486 - DNA, 75 bp, Artificial Sequence
  Synthetic
tcgctccggcctacagcttcaattgcctgggaatgcaaaacagagattttgtggaaggcgttaatggagttgaat

SEQ ID NO: 23487 - DNA, 75 bp, Artificial Sequence
  Synthetic
actgaatcgagatgtcctaccatgggagaggcccacaacaccaaagcaaataaccagaaatatgtgtgtaagaaa

SEQ ID NO: 23488 - DNA, 75 bp, Artificial Sequence
  Synthetic
actgaatcgagatgtcctaccatgggagaggcccacaacaccaaagcaaataaccagaattatgtgtgtaagaaa

SEQ ID NO: 23489 - DNA, 75 bp, Artificial Sequence
  Synthetic
actgaatcgagatgtcctaccatgggagaggcccacaacaccaaagcaaataaccagaactatgtgtgtaagaaa

SEQ ID NO: 23490 - DNA, 75 bp, Artificial Sequence
  Synthetic
actgaatcgagatgtcctaccatgggagaggcccacaacaccaaagcaaataaccagaagtatgtgtgtaagaaa

SEQ ID NO: 23491 - DNA, 75 bp, Artificial Sequence
  Synthetic
ggattgatgttgtgatagaaggtggaggctgcgtgaccattacagcgaaggacaagccaacaatcgatgtgaaga

SEQ ID NO: 23492 - DNA, 75 bp, Artificial Sequence
  Synthetic
tgatgaacatggaagccactgatttggcgctcgtgagatcatattgttacgaacctaaaatcactgatgtcagta

SEQ ID NO: 23493 - DNA, 75 bp, Artificial Sequence
  Synthetic
ctgaaccaagatgtcccaccatgggagaggcccacaacaccaaagcaaacgaccaggagtatgtgtgtaagaaag

SEQ ID NO: 23494 - DNA, 75 bp, Artificial Sequence
  Synthetic
gttatactgacagaggttggggcaatggttgtggactgtttgggaagggcagtattcacacatgcgccaaatttg

SEQ ID NO: 23495 - DNA, 75 bp, Artificial Sequence
  Synthetic
gatcaacagaaatgggcacctacaacaactattttatacagcagtcactgaaacaggcagcgaggttcattgtca

SEQ ID NO: 23496 - DNA, 75 bp, Artificial Sequence
  Synthetic
gaaggtaaacagccacgcggcccttggtgcaatctttaaagaacagaacaagtgggcatcagctcgggaagcagt

SEQ ID NO: 23497 - DNA, 75 bp, Artificial Sequence
  Synthetic
cttgtgaacagagactggttccatgacttgaacctcccgtggactggatcatctgctggctcttggcagaacaga

SEQ ID NO: 23498 - DNA, 75 bp, Artificial Sequence
  Synthetic
gaatcactagtggagtttgaagaagctcatgcaactaaacaatcagtagtggcactggcttcgcaggaaggggcg

SEQ ID NO: 23499 - DNA, 75 bp, Artificial Sequence
  Synthetic
ttacatgctgctctggctggagccattccagtgaaatatgccagcagtaagctcgagatgacttctgggcacctg

SEQ ID NO: 23500 - DNA, 75 bp, Artificial Sequence
  Synthetic
aagtgtcgtgtgaaattacaaggactgaaactgaaaggaatgacttaccctatgtgctcaaacaagttcactcta

SEQ ID NO: 23501 - DNA, 75 bp, Artificial Sequence
  Synthetic
gctaagaaccctacagacacagggcatgggacagttgttgtggaactcagctattctggatctgatggaccatgt

SEQ ID NO: 23502 - DNA, 75 bp, Artificial Sequence
  Synthetic
cgcattcccatatcaatgacagccaacctgcaggatttgaccccgataggaaggctcataacggtcaatccatat

SEQ ID NO: 23503 - DNA, 75 bp, Artificial Sequence
  Synthetic
gtgtccacatcatcatcgggaacaaaagtagtcgttgagcttgaacccccatttggggattcattcattttggtt

SEQ ID NO: 23504 - DNA, 75 bp, Artificial Sequence
  Synthetic
atcaatggcacaagagtggaagctccatcggtaaggcattcatgtctaccgtcaggggagcacagaggatggtgg

SEQ ID NO: 23505 - DNA, 75 bp, Artificial Sequence
  Synthetic
cacttggagacgccgcatgggactttggatcagtcggaggtttcttcacatcactaggcaaaggaatccatcaag

SEQ ID NO: 23506 - DNA, 75 bp, Artificial Sequence
  Synthetic
tgtttggaacggccttcagaagcctcttcggaggaatgtcatggataacccagggcctgttgggagcacttctat

SEQ ID NO: 23507 - DNA, 75 bp, Artificial Sequence
  Synthetic
tatggatgggactcaatgcaagagataggtcgatttcactgacgttcttggccgttggagcaatcctcatattcc

SEQ ID NO: 23508 - DNA, 75 bp, Artificial Sequence
  Synthetic
tagccacgaatgtacatgccgacactggttgcgcggtggacatggacaggaaagaactgaagtgtggaagtggca

SEQ ID NO: 23509 - DNA, 75 bp, Artificial Sequence
  Synthetic
tggttgcgcggtggacatggacaggaaagaactgaagtgtggaagtggcatttttatattcaatgatgtggaaac

SEQ ID NO: 23510 - DNA, 75 bp, Artificial Sequence
  Synthetic
ctggagggacaattacaagtattacccatcaactccgcggaatctggccaaagtcataatggaatcacgggaaaa

SEQ ID NO: 23511 - DNA, 75 bp, Artificial Sequence
  Synthetic
aggagtctgtggagtaaggtccgtgggaaggctggaacacaatatgtggaattcaatcaagcatgagctgaatgc

SEQ ID NO: 23512 - DNA, 75 bp, Artificial Sequence
  Synthetic
catactagaggacaacgggcaggacctgacagtcgtcgttgaacagccaactggtagattcaggaaaacccatcg

SEQ ID NO: 23513 - DNA, 75 bp, Artificial Sequence
  Synthetic
gcgtttagtgtggacagaagaggaattggaatacgggtggaagaaatgggggaaaacattgtttgtcactccacc

SEQ ID NO: 23514 - DNA, 75 bp, Artificial Sequence
  Synthetic
catgtccaataacacattcgttgtggatggtcccaaaacaaaagaatgcccagatgagaatagagcctggaacag

SEQ ID NO: 23515 - DNA, 75 bp, Artificial Sequence
  Synthetic
cagatgagaatagagcctggaacagtctagaggtggaggacttcggatttgggctaacatcaacgaaagtctggt

SEQ ID NO: 23516 - DNA, 75 bp, Artificial Sequence
  Synthetic
tgggattaaggaaagaaaatacaactgaatgtgacacagctgtgatgggcacagccatcaagggtgacagagcag

SEQ ID NO: 23517 - DNA, 75 bp, Artificial Sequence
  Synthetic
tccacagcgatctgagctactggattgaaagcagaaacaatggtagctggaagcttgaaagagctgtgctgggag

SEQ ID NO: 23518 - DNA, 75 bp, Artificial Sequence
  Synthetic
aaattaagtcatgcacttggccagaaacccacactctgtggggggagagtgtccaggagagtgaactgatcattc

SEQ ID NO: 23519 - DNA, 75 bp, Artificial Sequence
  Synthetic
aacccacactctgtggggggagagtgtccaggagagtgaactgatcattccggtcacattggctgggcccaggag

SEQ ID NO: 23520 - DNA, 75 bp, Artificial Sequence
  Synthetic
tgactactgtccaggcaccaaagtgacagttaccccgacatgtagggatagagctgcctcagccagaacaacaac

SEQ ID NO: 23521 - DNA, 75 bp, Artificial Sequence
  Synthetic
ggcaagtggcaagctgatcacagattggtgttgtaggtcatgcactctccctccattgcggttcatgacaaagag

SEQ ID NO: 23522 - DNA, 75 bp, Artificial Sequence
  Synthetic
ctccattgcggttcatgacaaagagcggctgctggtatgggatggaaattagacccacagtacatggagatgaca

SEQ ID NO: 23523 - DNA, 75 bp, Artificial Sequence
  Synthetic
tgttgataaaatcaagagtcaccgcttatgacggcgcaggcatggaaccatttcagttgggtgtactcatgatgt

SEQ ID NO: 23524 - DNA, 75 bp, Artificial Sequence
  Synthetic
ttgtggccacgcaagaggtgctacggaaaagatggacaggccggatggccggtccagcactggtgggtctgttat

SEQ ID NO: 23525 - DNA, 75 bp, Artificial Sequence
  Synthetic
gtgcaatgattttcggcgggataacttacagggacatggtgaagtatgtgttgttggtggcggctgcttttgccg

SEQ ID NO: 23526 - DNA, 75 bp, Artificial Sequence
  Synthetic
aaagcaacagcggtggtgacgtgatccaccttgctctgatagcagtctttaacgtgcaacctggactgctggtga

SEQ ID NO: 23527 - DNA, 75 bp, Artificial Sequence
  Synthetic
cgtactccttgcggcggaaatggagcaatcaggatgccacccttttaggcgtggcactggcaatgataactatgg

SEQ ID NO: 23528 - DNA, 75 bp, Artificial Sequence
  Synthetic
cactacatgactggaacatgactatacccagcttgttgaattcaggagccacggcttggctgttgctgcgcgcag

SEQ ID NO: 23529 - DNA, 75 bp, Artificial Sequence
  Synthetic
tgagtgaagggaccgtaagcgcggcttgtattcccattctcggacttttggctccaggaatgaaaatagtcggaa

SEQ ID NO: 23530 - DNA, 75 bp, Artificial Sequence
  Synthetic
ttgatgtatttcggatcgggctgcttatcatcggagttatgtcactcatgaaagaaagaaacaacgccatagcaa

SEQ ID NO: 23531 - DNA, 75 bp, Artificial Sequence
  Synthetic
aaaagaaaggtggagtgctgattggtctggccttggcccaggacggttgggtggatccactggtgtatgcaggac

SEQ ID NO: 23532 - DNA, 75 bp, Artificial Sequence
  Synthetic
tgacgctggctctgaaacccagtaatagaagaggatggccagtgagtgaagccctcacagcagtaggcttgacct

SEQ ID NO: 23533 - DNA, 75 bp, Artificial Sequence
  Synthetic
gccctcacagcagtaggcttgacctttgcgctagctggtgggatcgcacattttgacgaaggagacatggccatt

SEQ ID NO: 23534 - DNA, 75 bp, Artificial Sequence
  Synthetic
tggtggtagctgtggtcacaggattcacaactgacttgtggttggaacgagctggagacatctcatggattgagg

SEQ ID NO: 23535 - DNA, 75 bp, Artificial Sequence
  Synthetic
gctggagacatctcatggattgaggatgcccaaatcaccggaagttcacagcggtatgacgttgagatagactgt

SEQ ID NO: 23536 - DNA, 75 bp, Artificial Sequence
  Synthetic
gatgggaacatgaaattgatgaatgatcagggagtccccttctctatctgggcccctaggacaggactcattcta

SEQ ID NO: 23537 - DNA, 75 bp, Artificial Sequence
  Synthetic
gatgacgatacactccccgaagagaagtggagccatctgggatgttccggctcccagggaaaagaagagagctga

SEQ ID NO: 23538 - DNA, 75 bp, Artificial Sequence
  Synthetic
agtggagccatctgggatgttccggctcccagggaaaagaagagagctgagttgagcactggagtctttaggatt

SEQ ID NO: 23539 - DNA, 75 bp, Artificial Sequence
  Synthetic
ttgatatcgtatggaggaccttggaagatgggcacgaaatggaacggggttgatgaggtgcaagtcattgttgtt

SEQ ID NO: 23540 - DNA, 75 bp, Artificial Sequence
  Synthetic
caaccagggaaatcagccatgaatgtgcaaacaaaaccgggggtctttaagacctccactggagaaattggggca

SEQ ID NO: 23541 - DNA, 75 bp, Artificial Sequence
  Synthetic
gtcacccttgactatccaacgggaacatcaggctcacccatagtagacaaggaagggaacataattgggctttac

SEQ ID NO: 23542 - DNA, 75 bp, Artificial Sequence
  Synthetic
ggaagggaacataattgggctttacggcaatggcatcctcgtcggagcaggcaacttcgtcagcatgatttctca

SEQ ID NO: 23543 - DNA, 75 bp, Artificial Sequence
  Synthetic
aggccagcgaatggaagaagagattccgcaagtgttcagtgaagacatgttgaggaaaagacagctaactgtgct

SEQ ID NO: 23544 - DNA, 75 bp, Artificial Sequence
  Synthetic
tgacctgcacccaggctcaggaaaaacaagaaaagtgcttccccaaattgtgaagacagccatcgacaggagact

SEQ ID NO: 23545 - DNA, 75 bp, Artificial Sequence
  Synthetic
caggacagctattctggcaccgacaagagtggtggcagctgagatagcggaagctcttaaggagtacccaataag

SEQ ID NO: 23546 - DNA, 75 bp, Artificial Sequence
  Synthetic
gtatctaacgccagctgtcaagcgagaacacacaggaacagaaattgttgacgtgatgtgtcatgcaacactcac

SEQ ID NO: 23547 - DNA, 75 bp, Artificial Sequence
  Synthetic
gaacacacaggaacagaaattgttgacgtgatgtgtcatgcaacactcacggcacgcctgctcacgccacaacgt

SEQ ID NO: 23548 - DNA, 75 bp, Artificial Sequence
  Synthetic
atctcaactaaagtggagctaggtgaggcggcggccatttttatgacagccacccccccaggaacgcgtgaccca

SEQ ID NO: 23549 - DNA, 75 bp, Artificial Sequence
  Synthetic
aggcggcggccatttttatgacagccacccccccaggaacgcgtgacccattcccagactcaaattcaccaatcg

SEQ ID NO: 23550 - DNA, 75 bp, Artificial Sequence
  Synthetic
tggatgtggaggagcagatccctgatagggcatggaactcaggatatgagtggataaccgactataccggaaaga

SEQ ID NO: 23551 - DNA, 75 bp, Artificial Sequence
  Synthetic
tggataaccgactataccggaaagacagtgtggtttgttcctagcgtgaagatgggaaatgaaatagccgtgtgc

SEQ ID NO: 23552 - DNA, 75 bp, Artificial Sequence
  Synthetic
ttgacgaaggctggtaaaaaagtgatccaactgaataggaagagctttgactctgaatacccaaagtgtaaaaca

SEQ ID NO: 23553 - DNA, 75 bp, Artificial Sequence
  Synthetic
ggtgaatgggactttgtgataactacggatatttcagagatgggagccaactttggggcgagccgggtcattgac

SEQ ID NO: 23554 - DNA, 75 bp, Artificial Sequence
  Synthetic
agtcggaaatgtataaaaccagtcatcatagaggatggggaaggaagcgtgcagctcaatggaccagtgcctatt

SEQ ID NO: 23555 - DNA, 75 bp, Artificial Sequence
  Synthetic
acagcagccagtgcagcgcagagacgcggaagaattggtagaagttacgtgcaagtcggagacgagtaccacttt

SEQ ID NO: 23556 - DNA, 75 bp, Artificial Sequence
  Synthetic
tctgggccaacaagtgaggacgatcacgacttcgctcattggaaagaggccaagatattgctagacaatatcaac

SEQ ID NO: 23557 - DNA, 75 bp, Artificial Sequence
  Synthetic
ctacccaacggtctcgtagcccaactctatgagccagagagagagaaggttttttcaattgatggggaataccgc

SEQ ID NO: 23558 - DNA, 75 bp, Artificial Sequence
  Synthetic
ttgagaacggaacaacgcaagaactttgttgagtttttgaggactggagatctgcctgtctggctctcttacaaa

SEQ ID NO: 23559 - DNA, 75 bp, Artificial Sequence
  Synthetic
ttggcagaagcaggggttgcgtaccacgataggaagtggtgcttcgatggaccttcaatgaatacagtcctcgag

SEQ ID NO: 23560 - DNA, 75 bp, Artificial Sequence
  Synthetic
gacaacaacccagttgagctttggacaaaatcaggtgagaagaagatactgcgaccaaggttgagagatggaagg

SEQ ID NO: 23561 - DNA, 75 bp, Artificial Sequence
  Synthetic
gcgaccaaggttgagagatggaaggctctgggcagaccatcaagctctgaaatcatttaaggacttcgcttgtgg

SEQ ID NO: 23562 - DNA, 75 bp, Artificial Sequence
  Synthetic
catggacaatctgtacacgttgaccacttctgagaaaggtagcagggttcacagggaagcgctagaggagctacc

SEQ ID NO: 23563 - DNA, 75 bp, Artificial Sequence
  Synthetic
agaaacactggaaacaatcctcttgattaccatgatgacgttagcatcctgtggggtctttctcctttttgttca

SEQ ID NO: 23564 - DNA, 75 bp, Artificial Sequence
  Synthetic
attaccatgatgacgttagcatcctgtggggtctttctcctttttgttcaaggaaggggtttggggaaaacaggc

SEQ ID NO: 23565 - DNA, 75 bp, Artificial Sequence
  Synthetic
gagacaaagatcacaaactgacagtcacttagcggtattcatgatactggtcctgctcatcgtgggaacagtagc

SEQ ID NO: 23566 - DNA, 75 bp, Artificial Sequence
  Synthetic
cacttagcggtattcatgatactggtcctgctcatcgtgggaacagtagcttccaatgagatgggctggcttgaa

SEQ ID NO: 23567 - DNA, 75 bp, Artificial Sequence
  Synthetic
gccaagccgatgggaaatgccgtggcctgatcttagacctgccacagcttgggctgcatacgcaggggccacgac

SEQ ID NO: 23568 - DNA, 75 bp, Artificial Sequence
  Synthetic
gtttttgacaccactgctgaaacatctcattgtcacagaatatgtgaacttttcactgatggctgtgactgctca

SEQ ID NO: 23569 - DNA, 75 bp, Artificial Sequence
  Synthetic
agctggagctctattcggactgggaaagggcatgccgttcgtggccattgacttgtcgaccccactgttactgtt

SEQ ID NO: 23570 - DNA, 75 bp, Artificial Sequence
  Synthetic
agggtgttggggccagttcacaatgaccacgactttgacaacaatcatgcttctgatcatccactatgcgttttt

SEQ ID NO: 23571 - DNA, 75 bp, Artificial Sequence
  Synthetic
gatccctggctggcaagcggaagctatgcggtctgctcaaagaagaacagcagcaggtgtgatgaaaaatccggt

SEQ ID NO: 23572 - DNA, 75 bp, Artificial Sequence
  Synthetic
ggttgatggaatcgtggcaacggacgtgccggatctggaagcaagcacaccaattactgagaagaaatttggaca

SEQ ID NO: 23573 - DNA, 75 bp, Artificial Sequence
  Synthetic
ggtcatactaattgtggtggccttatgttcagtttttctgaaacctggaacaacatcactaacggaatttggaat

SEQ ID NO: 23574 - DNA, 75 bp, Artificial Sequence
  Synthetic
tgttcagtttttctgaaacctggaacaacatcactaacggaatttggaatgctcacatcagcagcctccgtgact

SEQ ID NO: 23575 - DNA, 75 bp, Artificial Sequence
  Synthetic
tatggaatgcaaccacagcggttgccatgtgccatctaatgaggaagaattggttagcaggggcatcactcgcct

SEQ ID NO: 23576 - DNA, 75 bp, Artificial Sequence
  Synthetic
ggaaggcccaactcaatcaactaacacggcaggaattcatggaatatcgaaaggacggcatcatagaggttgata

SEQ ID NO: 23577 - DNA, 75 bp, Artificial Sequence
  Synthetic
agaaggaaacgtgacaggaggacatccggtgtctagaggaacggcaaaactgaggtggcttgttgagagaggatt

SEQ ID NO: 23578 - DNA, 75 bp, Artificial Sequence
  Synthetic
ccggtgtctagaggaacggcaaaactgaggtggcttgttgagagaggattcctaaaaccgcgaggaaaggtggta

SEQ ID NO: 23579 - DNA, 75 bp, Artificial Sequence
  Synthetic
atggaacctggtttccctgaaaagtgggattgatgtcttctacagaccagctgaacattctgacactctcctatg

SEQ ID NO: 23580 - DNA, 75 bp, Artificial Sequence
  Synthetic
gtggctggcgagaggaactgaagaattttgcataaaagtgctatgcccgtacatgccaagagtcctgaaagaact

SEQ ID NO: 23581 - DNA, 75 bp, Artificial Sequence
  Synthetic
ggaaaggatgcagttacgttggggtgggggtctcgtcagggtcccactctctcggaactcaaaccatgaaatgta

SEQ ID NO: 23582 - DNA, 75 bp, Artificial Sequence
  Synthetic
gggggtctcgtcagggtcccactctctcggaactcaaaccatgaaatgtattgggtaagtggagccagtgggaac

SEQ ID NO: 23583 - DNA, 75 bp, Artificial Sequence
  Synthetic
gtagaagaccgtgtcgcgcgcctagccgaagaattttccaccacatggcattatgacccagaaaatccatacaaa

SEQ ID NO: 23584 - DNA, 75 bp, Artificial Sequence
  Synthetic
gtgttgtcaaagccttgggacgccttgcagaacgtagtgaacatggccatgaccgacacgactccatttggacag

SEQ ID NO: 23585 - DNA, 75 bp, Artificial Sequence
  Synthetic
acagctcggtggatgtgggacttcgtggggaggaataaaaggcccagaatttgcacaaaggaggagttcatagaa

SEQ ID NO: 23586 - DNA, 75 bp, Artificial Sequence
  Synthetic
aaggtgaatagccatgcagccctcggtgcaatctttaaagaacagaataagtgggcatcagctcgggaagcagtt

SEQ ID NO: 23587 - DNA, 75 bp, Artificial Sequence
  Synthetic
gaggacccagcattttgggagctggtggaccaggaacgcgaggcgcaccttcaaggaaggtgtgagacatgcatc

SEQ ID NO: 23588 - DNA, 75 bp, Artificial Sequence
  Synthetic
tacaatatgatgggaaagagagaaaagaaaatgggggcatttggcaaagcaaaaggaagcagggccatatggtat

SEQ ID NO: 23589 - DNA, 75 bp, Artificial Sequence
  Synthetic
atgtggcttggatcccggttcctagaatttgaggcccttgggtttctgaacgaagatcactggatgagcagagaa

SEQ ID NO: 23590 - DNA, 75 bp, Artificial Sequence
  Synthetic
aacaccttggggggtgttgaaggcatgggcctacagaagctaggatacgtattgagggacatgtctggcaaggaa

SEQ ID NO: 23591 - DNA, 75 bp, Artificial Sequence
  Synthetic
ggggggctcatgtacgccgacgacaccgctggatgggacaccagaatcactagagctgatctggaaaatgaagca

SEQ ID NO: 23592 - DNA, 75 bp, Artificial Sequence
  Synthetic
ctcattcttgaaagaatggacccagagcacaggcgtctcgcggagtcactaatcaaacatgcctacatgaataaa

SEQ ID NO: 23593 - DNA, 75 bp, Artificial Sequence
  Synthetic
gtggtgaaagtgatgcggcctgggagggaaggggtcaccgtgatggatgtgatttctagggaagaccagagagga

SEQ ID NO: 23594 - DNA, 75 bp, Artificial Sequence
  Synthetic
ccaattgatcagatgcatggaaggagaaggactgctgaagcctgaagaagttgaagggttggagcgaggaaaaca

SEQ ID NO: 23595 - DNA, 75 bp, Artificial Sequence
  Synthetic
caagaagatccaagactggctgggcaagaatggaagagaaaggctagctgctatggcagtcagcggtgacgattg

SEQ ID NO: 23596 - DNA, 75 bp, Artificial Sequence
  Synthetic
acagcatgtcaaagattaggaaagacatccctgagtggaaaccttcaacgggctggaggaactggcaagatgtcc

SEQ ID NO: 23597 - DNA, 75 bp, Artificial Sequence
  Synthetic
catccctgagtggaaaccttcaacgggctggaggaactggcaagatgtcccattttgttcacatcatttccatga

SEQ ID NO: 23598 - DNA, 75 bp, Artificial Sequence
  Synthetic
ctgatggccaacgccatatgttcatcggtgccaatctcatgggtgcccacaggaagaaccacctggtcaattcac

SEQ ID NO: 23599 - DNA, 75 bp, Artificial Sequence
  Synthetic
ggaaagggagaatggatgacaacagaagacatgttgagagtctggaatagggtgtggattgaggagaacgaacac

SEQ ID NO: 23600 - DNA, 75 bp, Artificial Sequence
  Synthetic
atggaagacaagacccctgtagcctcatggaatgatgtgccgtacctcggaaagcgtgaggatagttggtgtgga

SEQ ID NO: 23601 - DNA, 75 bp, Artificial Sequence
  Synthetic
agtctgatagggcacaggacacgatcaacctgggcagagaacatatacacaccaatcatgcagatcagagccctg

SEQ ID NO: 23602 - DNA, 75 bp, Artificial Sequence
  Synthetic
attgggccagagcggtatgttgattacatgccaaccctaaaccgctttaaggcagtggagacatggtctgatggg

SEQ ID NO: 23603 - DNA, 75 bp, Artificial Sequence
  Synthetic
gagcggtatgttgattacatgccaaccctaaaccgctttaaggcagtggagacatggtctgatggggttctgtaa

SEQ ID NO: 23604 - DNA, 75 bp, Artificial Sequence
  Synthetic
actttgtgattgacagctcaacacaagtgcggaatatcgtaaacacagtttgaacgttttttggagagagactac

SEQ ID NO: 23605 - DNA, 75 bp, Artificial Sequence
  Synthetic
gcgagacgatcgaggcggtctatcacagtgcaccatcacggagagagcttgctagaagcaaagaatacaccatgg

SEQ ID NO: 23606 - DNA, 75 bp, Artificial Sequence
  Synthetic
ggttatactgacagaggttggggtaatggttgtggactgttcggaaagggcagcattcacacatgcgccaaattt

SEQ ID NO: 23607 - DNA, 75 bp, Artificial Sequence
  Synthetic
tatcaatggcacaagagtggaagttccatcggtaaagcatttatgtccaccgtgaggggagcgcagagaatggtt

SEQ ID NO: 23608 - DNA, 75 bp, Artificial Sequence
  Synthetic
gaaagcaacagcgggggtgacgtgatccaccttgctctgatagcaactttcaacgtgcaacctggactgctggtg

SEQ ID NO: 23609 - DNA, 75 bp, Artificial Sequence
  Synthetic
tgtggcactggcaatgataaccatggcgttacacgattggaacatgaccattcctagcctgctgaattcaggagc

SEQ ID NO: 23610 - DNA, 75 bp, Artificial Sequence
  Synthetic
ctggtggtagccgtggttacaggatttacgactgacttgtggctggagcgagctggagacatctcgtggattgag

SEQ ID NO: 23611 - DNA, 75 bp, Artificial Sequence
  Synthetic
aacggtatgacgttgagatagattgtgatgggaacatgaaattgatgaatgatcaaggagtccctttttcaattt

SEQ ID NO: 23612 - DNA, 75 bp, Artificial Sequence
  Synthetic
gcatgtgacgaatggggccaccattaacgtgggggacggttgcttagtcccctattgggctagtgtgagagatga

SEQ ID NO: 23613 - DNA, 75 bp, Artificial Sequence
  Synthetic
aagtccaaccacaaaagatagctggaatcttgctcatatcactgctactcatgatagttctcatccctgaaccag

SEQ ID NO: 23614 - DNA, 75 bp, Artificial Sequence
  Synthetic
cttctaacgagatgggttggcttgaacaaacgaagaaggatgtcgccagtttgtttggtagggcacaccaccaag

SEQ ID NO: 23615 - DNA, 75 bp, Artificial Sequence
  Synthetic
acaaacgaagaaggatgtcgccagtttgtttggtagggcacaccaccaagagccaagccgatgggaaatgccgtg

SEQ ID NO: 23616 - DNA, 75 bp, Artificial Sequence
  Synthetic
gctgaacattctgacacacttctgtgtgacattggagaagcctcacccgtgcccgaaattgaagaggccaggaca

SEQ ID NO: 23617 - DNA, 75 bp, Artificial Sequence
  Synthetic
gtatttaaaattgtgaggaaagaccaacatggatgtactgagtaaaagttctttgaaggagttgttagctcattt

SEQ ID NO: 23618 - DNA, 75 bp, Artificial Sequence
  Synthetic
aacatggatgtactgagtaaaagttctttgaaggagttgttagctcatttggagagaactcctcttgaggaagca

SEQ ID NO: 23619 - DNA, 75 bp, Artificial Sequence
  Synthetic
cgtgaaattcaaaaagcactgaatagacaacgtgcatactatgataggccagagttgaccattgctgaaaacaga

SEQ ID NO: 23620 - DNA, 75 bp, Artificial Sequence
  Synthetic
atttcttataagataggaactataccatatcagaatgttttgataagcagaaatgaatattataatcaaccgtat

SEQ ID NO: 23621 - DNA, 75 bp, Artificial Sequence
  Synthetic
acgctactctcacagtctatagtatatccggacgtcgatggcaatgatgtctctgtaatattcagtggagctatg

SEQ ID NO: 23622 - DNA, 75 bp, Artificial Sequence
  Synthetic
ccagatgttacttcattaattgacggtgttgctagagaagggcagcgtaacgtcaacggcctgataatgtcaata

SEQ ID NO: 23623 - DNA, 75 bp, Artificial Sequence
  Synthetic
tcacatgccatcttcacctacgcacaaagtcaatggagtaaaaacatcatcaggctggacgactacatccgcgaa

SEQ ID NO: 23624 - DNA, 75 bp, Artificial Sequence
  Synthetic
atatcatatgtggtaagtggctctggtcattatattcctaatattggttacacattacttaggcgatcgatactg

SEQ ID NO: 23625 - DNA, 75 bp, Artificial Sequence
  Synthetic
ataacacttacagttccaaaacactatagaccaagacgtttcaaggaaatagagcatacacatggttacgtttat

SEQ ID NO: 23626 - DNA, 75 bp, Artificial Sequence
  Synthetic
gacattctaactaaacatgacactggattgaatacgaataacattaattacgatctgattgctcgaaacttaacg

SEQ ID NO: 23627 - DNA, 75 bp, Artificial Sequence
  Synthetic
cgtgaattgaatcagggttcattgttgccattagtcgacgcgaatttgaaggaggcatcctcatattacttcaaa

SEQ ID NO: 23628 - DNA, 75 bp, Artificial Sequence
  Synthetic
cgatctgattgctcgaaacttaacggtcagtaaaatgaattgtgaacagagaaaaaggatgttaatatgtttcaa

SEQ ID NO: 23629 - DNA, 75 bp, Artificial Sequence
  Synthetic
aaattgatgccaagcattagcaatgttccagttgacgctcgtactttgcaatcagctacatctgccttggccgct

SEQ ID NO: 23630 - DNA, 75 bp, Artificial Sequence
  Synthetic
acttctagcgtacaaagatggtaatcttaatgattatgaaacgtatttgaatcaaaatatatcattgaaacaaat

SEQ ID NO: 23631 - DNA, 75 bp, Artificial Sequence
  Synthetic
gatacaggtctcgtagaccgtgcaccacatgtttctatgctgacgaatagactaacgacagcaaatgcttcatca

SEQ ID NO: 23632 - DNA, 75 bp, Artificial Sequence
  Synthetic
tgctccaaatttcattcctggtgatatgcgaacagtgatgagtaacagtgataaactgagtattgtaggtatacc

SEQ ID NO: 23633 - DNA, 75 bp, Artificial Sequence
  Synthetic
atgcgaacagtgatgagtaacagtgataaactgagtattgtaggtataccagcatatagattaacgcagtcaact

SEQ ID NO: 23634 - DNA, 75 bp, Artificial Sequence
  Synthetic
gttcgagccattacagttctgacatgtatgtttaaacaattcaggattggtatgacatattcaccagatccaaac

SEQ ID NO: 23635 - DNA, 75 bp, Artificial Sequence
  Synthetic
gaattatcaattcgtgacgacaatgccaaatcatacaaaatcggatacgttgattggtataatagtaattctttt

SEQ ID NO: 23636 - DNA, 75 bp, Artificial Sequence
  Synthetic
atcatggacgtagcagccgcaacttgcatgttactgttcaggcccgctcagtctatatctgatgaacaatataga

SEQ ID NO: 23637 - DNA, 75 bp, Artificial Sequence
  Synthetic
tgattggtataatagtaattcttttctacgagaaaggaatgactttaatttgataagccttaaggatagagataa

SEQ ID NO: 23638 - DNA, 75 bp, Artificial Sequence
  Synthetic
ctacgagaaaggaatgactttaatttgataagccttaaggatagagataataaatatgcaagattaaatggatgg

SEQ ID NO: 23639 - DNA, 75 bp, Artificial Sequence
  Synthetic
tactgccttcagaccatggccgtctttctgaccaacacaacatatgatattgtaaacaatgatactgttgacgtt

SEQ ID NO: 23640 - DNA, 75 bp, Artificial Sequence
  Synthetic
tgaacacgttaacatgatgaagcttgaaaagctttgctgacattaagagttaatgactctggaaattgagcttcg

SEQ ID NO: 23641 - DNA, 75 bp, Artificial Sequence
  Synthetic
cttaaaacgaaactgaggaatcagggttggccactcgttgaaaggtataatgccattgaagtcgatatgtctgta

SEQ ID NO: 23642 - DNA, 75 bp, Artificial Sequence
  Synthetic
taatgactctggaaattgagcttcgaaaggtactgggcaaccatgctttccgaggggctcttgggactggaaagt

SEQ ID NO: 23643 - DNA, 75 bp, Artificial Sequence
  Synthetic
aaaggtactgggcaaccatgctttccgaggggctcttgggactggaaagtagaggatcccgctgggatgtcaacc

SEQ ID NO: 23644 - DNA, 75 bp, Artificial Sequence
  Synthetic
gagccattgaggtcaccaggtcaggttggtaggtattacaatccatttaatatcgatccgctgactaagaagcat

SEQ ID NO: 23645 - DNA, 75 bp, Artificial Sequence
  Synthetic
aggatcccgctgggatgtcaaccaccctctaccaacggtgtcggagtgctcccttaataggacaatttgactgac

SEQ ID NO: 23646 - DNA, 75 bp, Artificial Sequence
  Synthetic
atacgaatctgtaaaagaattcatacatgatgattgctttaattcaaatgaagaatatgaagtgcactttgaaag

SEQ ID NO: 23647 - DNA, 75 bp, Artificial Sequence
  Synthetic
gtggaggacagattagaagagttccccaatcaagttcaggtcggaaggttcaggaatgtatcaaacaatgcagtt

SEQ ID NO: 23648 - DNA, 75 bp, Artificial Sequence
  Synthetic
tcgaagaaacagctgaaaatcatgaattggaaggtgtttcatttgatgaactagttgcattgagagaggagaatg

SEQ ID NO: 23649 - DNA, 75 bp, Artificial Sequence
  Synthetic
ggtgcagcattggccgctttcttgagagcatgtcgtgataagacgagtgctaactggaaagggtatagcatatta

SEQ ID NO: 23650 - DNA, 75 bp, Artificial Sequence
  Synthetic
ccaaactgaaacaagagaatgaagctctgaagactaaacttcatcgtcttgaaagtgattggactacttcggaca

SEQ ID NO: 23651 - DNA, 75 bp, Artificial Sequence
  Synthetic
gtatcacggtacagaagcctaattcctaatgaactatttgagtcccttagaaacattagcggtgaatacaacatt

SEQ ID NO: 23652 - DNA, 75 bp, Artificial Sequence
  Synthetic
tcgttgaaaagattgagttaatggatactcagttcgaaagaattgggaagataatggataagatgcgtgagccga

SEQ ID NO: 23653 - DNA, 75 bp, Artificial Sequence
  Synthetic
aatccgcaagatgagcactctttcttctttgccttagcacagataaatgctgatgaagaattcacaggtgtaatt

SEQ ID NO: 23654 - DNA, 75 bp, Artificial Sequence
  Synthetic
tgttgtttaagcgtgatgagatcgagttacatggtgacttgctagctagagttgaagggttgctacgcattaaga

SEQ ID NO: 23655 - DNA, 75 bp, Artificial Sequence
  Synthetic
gataaggagtcagctgaatacttggacgagtacgccacattagctcgagagatctcaaactctctgaccttggtg

SEQ ID NO: 23656 - DNA, 75 bp, Artificial Sequence
  Synthetic
atgaacgcagtgaggttgaatttgaaaaagacattcagtgcatagttggaaggtatttcagtgacgagactaagc

SEQ ID NO: 23657 - DNA, 75 bp, Artificial Sequence
  Synthetic
aaagcagcattcggaccgctggagagaacaagtggtagcatcctcaatcatgccaataacctaaacaaggtaatc

SEQ ID NO: 23658 - DNA, 75 bp, Artificial Sequence
  Synthetic
aacgtaaccttgaaaagatgataaaatcattcgaatatgacgacatcgctgacaccatcgctctgcgcctgactc

SEQ ID NO: 23659 - DNA, 75 bp, Artificial Sequence
  Synthetic
aaccgcgtttttgctgacaagccattaatctctgagactatgttaaagatattgactattgatggaactacaggg

SEQ ID NO: 23660 - DNA, 75 bp, Artificial Sequence
  Synthetic
gacaccatcgctctgcgcctgactcatttcattcaggatccaggtttacgctcaatagtgtatgctatgtgtaaa

SEQ ID NO: 23661 - DNA, 75 bp, Artificial Sequence
  Synthetic
aaagatgggtacaggaactggttggataagctagttggtcataattacccggtttatgttgaaccggttgtcaac

SEQ ID NO: 23662 - DNA, 75 bp, Artificial Sequence
  Synthetic
atcgtgaatttcattagtgcacgcttcatagctgacagctcttactttggttacaccaacgagatcatgataatg

SEQ ID NO: 23663 - DNA, 75 bp, Artificial Sequence
  Synthetic
taaacatcgaggtgcaagagatagttgatgtgacaaggcaaaagtacactcacaacgcacgtgatgacatcgatt

SEQ ID NO: 23664 - DNA, 75 bp, Artificial Sequence
  Synthetic
tttacccaatgtttacttttgatgctaacgtgcctgaaggtgtcttcgatcacatatacaagaagcactatctat

SEQ ID NO: 23665 - DNA, 75 bp, Artificial Sequence
  Synthetic
ccgaaccacatcactgtcccagttgatgatagattcggtttccgagacagtcctttctgcatgtctctacctagg

SEQ ID NO: 23666 - DNA, 75 bp, Artificial Sequence
  Synthetic
ctccacaatctgctgctttagttcacacactatcgcatcttgatgtgaatgttgatggtaatggaatagcaatgt

SEQ ID NO: 23667 - DNA, 75 bp, Artificial Sequence
  Synthetic
actatcatgggtaatgaagttagaaggatttcatatagtgtattcagtatgatggaggatattgatgaagtgatt

SEQ ID NO: 23668 - DNA, 75 bp, Artificial Sequence
  Synthetic
cacactatcgcatcttgatgtgaatgttgatggtaatggaatagcaatgtatcacattggatcggcaacgcggtt

SEQ ID NO: 23669 - DNA, 75 bp, Artificial Sequence
  Synthetic
agcgagggatttatcttgtatgacgcatacttcaatttcacttatgacattatgactactgatggtgtaacgaga

SEQ ID NO: 23670 - DNA, 75 bp, Artificial Sequence
  Synthetic
tgcagagtgttcggttgtatatgttgatggacgtgcttacaagccaattagagtgatggctgaatatgccatctt

SEQ ID NO: 23671 - DNA, 75 bp, Artificial Sequence
  Synthetic
ttgaaggaagacatacttgtagttactgacactgggaatgacattaagccgatccatttttacatatattttgag

SEQ ID NO: 23672 - DNA, 75 bp, Artificial Sequence
  Synthetic
tccaaccttgccgcatgagtataaaggtagagtcgaaggattgttgctgttgcatgggggattagcgccaataac

SEQ ID NO: 23673 - DNA, 75 bp, Artificial Sequence
  Synthetic
aataagaatgataagaagttgaggtacgagtctaaaatgaatgtgaactatagactgtacatcaagactccagct

SEQ ID NO: 23674 - DNA, 75 bp, Artificial Sequence
  Synthetic
attagttcgtgtttaccatgatgttaatgttggtggtctagttaccggttcgattgcagcatccgtttcaacact

SEQ ID NO: 23675 - DNA, 75 bp, Artificial Sequence
  Synthetic
aatgttggtggtctagttaccggttcgattgcagcatccgtttcaacactattgcgtaattgcatgttatatagt

SEQ ID NO: 23676 - DNA, 75 bp, Artificial Sequence
  Synthetic
tgcttgttaccgctcaatgattacatgagagcgcaacatgagtatgtaagtccaagctcatcaagagtgtatatt

SEQ ID NO: 23677 - DNA, 75 bp, Artificial Sequence
  Synthetic
tttgacatctatttcactccaaacggtgtttgtatcaatgctgttggtaacaacaactttgttaacataatagat

SEQ ID NO: 23678 - DNA, 75 bp, Artificial Sequence
  Synthetic
aaagacccagctgtagtgtacacgcgatcctaagattgtgatgtgattagatgtggtggaatactatcttacgct

SEQ ID NO: 23679 - DNA, 75 bp, Artificial Sequence
  Synthetic
ataaactgctgtggacgtgcttttggcaaagctcctttagaccaaggaacatggaatagaaataagttcatgggt

SEQ ID NO: 23680 - DNA, 75 bp, Artificial Sequence
  Synthetic
agatgtggtggaatactatcttacgcttcataggtgtggttgccgacgttgcgtagtggacaaatagaacccgac

SEQ ID NO: 23681 - DNA, 75 bp, Artificial Sequence
  Synthetic
cacaaacatggaagaggatcaaagtgcaaacagtataagaagatcaattcatagatactgcttatacggtcagtc

SEQ ID NO: 23682 - DNA, 75 bp, Artificial Sequence
  Synthetic
acgattaagacgcgaggatgacgtaatatcacaaaagcgtacgtgtcaatggtgattagtgaaggcttcattctg

SEQ ID NO: 23683 - DNA, 75 bp, Artificial Sequence
  Synthetic
gtattaaaaattatatgttttcttgctgagtagcaacttgactaactccttctaagagaatttatataaatcaag

SEQ ID NO: 23684 - DNA, 75 bp, Artificial Sequence
  Synthetic
caatagtaggttcagacagggccgatgttaccatgcttaacactggagccggagccgcgaacataacctttaact

SEQ ID NO: 23685 - DNA, 75 bp, Artificial Sequence
  Synthetic
atacttatcatttctgctgttgttacagttgttgatcagttatatcaaaaactaccttatgatgaacaaactaag

SEQ ID NO: 23686 - DNA, 75 bp, Artificial Sequence
  Synthetic
ttggacagatagctgaaacagttatacttaaaggttcagttcctttccaattagcacgcgctaatcagccaatgc

SEQ ID NO: 23687 - DNA, 75 bp, Artificial Sequence
  Synthetic
tacatcgtgtctaccatcactgacgggataaatgccaccattatatctattatggctatttttggtttgaacaat

SEQ ID NO: 23688 - DNA, 75 bp, Artificial Sequence
  Synthetic
ctgaacagagtgagatacagtaagttggatgaaaatggaatttactctcaggagatggtaacaatgaatgtgcaa

SEQ ID NO: 23689 - DNA, 75 bp, Artificial Sequence
  Synthetic
tagtgattagtgctacagcagcaacacgtatacaggttcctcttgctttcaacaaagctctagttgaatctggat

SEQ ID NO: 23690 - DNA, 75 bp, Artificial Sequence
  Synthetic
ggagatggtaacaatgaatgtgcaatcagatgccgttaatgacaaaacaaacttgaagaagaaggtaaataaacc

SEQ ID NO: 23691 - DNA, 75 bp, Artificial Sequence
  Synthetic
tgttgatgaggaaaaacaattgtatcctaatttaaaatcaactgaaccaacagcaccaatgattcataagtatat

SEQ ID NO: 23692 - DNA, 75 bp, Artificial Sequence
  Synthetic
gtatttaaaatcatagattgaatatgttatcagagactgagttaagggctttgaagaagttgagtacaacgacca

SEQ ID NO: 23693 - DNA, 75 bp, Artificial Sequence
  Synthetic
gtatgatcaaaactcacaacaagcgtacttgctgacagaacatcaattggaacagatcaggcaaaacactgctga

SEQ ID NO: 23694 - DNA, 75 bp, Artificial Sequence
  Synthetic
ctagggtcgttggagattcaactttagctcttccttcgaatgttaaactaagtaaaggtgaggttgaaaagatcg

SEQ ID NO: 23695 - DNA, 75 bp, Artificial Sequence
  Synthetic
ccctaataatgtaccaaagattgaggtaaggagttagttctaaccgtctactttgcaggagaggaggtaccgggt

SEQ ID NO: 23696 - DNA, 75 bp, Artificial Sequence
  Synthetic
ctgtaacgaagaaagaaatgttcgatgagttagctcaatgtaatctacctacaattgaattaattacaagagaac

SEQ ID NO: 23697 - DNA, 75 bp, Artificial Sequence
  Synthetic
tctgggactcacgtccatcgccactttactcggttacaacctcacggtgtgacaaggtgaagcatgattcatctt

SEQ ID NO: 23698 - DNA, 75 bp, Artificial Sequence
  Synthetic
acacattcaacggtgatgccatccgattcgctgcctggttattcttgatgaatggacaaaagctaatgaccgcaa

SEQ ID NO: 23699 - DNA, 75 bp, Artificial Sequence
  Synthetic
cgtgtgctaatggtgtgtgctgctaatcgctggactgccggagggaaaccggcataaggcgtggccgccactggc

SEQ ID NO: 23700 - DNA, 75 bp, Artificial Sequence
  Synthetic
ataatgttgttgtcagaatgggtatgcaatattctacaaatttggctggtaataacgtcgagattaattacgtga

SEQ ID NO: 23701 - DNA, 75 bp, Artificial Sequence
  Synthetic
ccactggccgttgatgaccatgtggaactgagctttgctcaggccgactcacattaagtataatttagaactgac

SEQ ID NO: 23702 - DNA, 75 bp, Artificial Sequence
  Synthetic
gtattaaaaattgatagcgcttgcgtaagagtaagatctcaagatggatcctgtatctgtagtacatagcttcgc

SEQ ID NO: 23703 - DNA, 75 bp, Artificial Sequence
  Synthetic
taagagtaagatctcaagatggatcctgtatctgtagtacatagcttcgctaggagtcaaggcctgccacttgac

SEQ ID NO: 23704 - DNA, 75 bp, Artificial Sequence
  Synthetic
catcaaatagtgtagttaaattaggacacattcctgctggtgtacttgctgctccttattcaggaaagggaagtg

SEQ ID NO: 23705 - DNA, 75 bp, Artificial Sequence
  Synthetic
tttgaaactgtgggttgtgagggtccaagtcacgacccacgctttgtaattgaatgtaaatttcttgatttccag

SEQ ID NO: 23706 - DNA, 75 bp, Artificial Sequence
  Synthetic
gacttttcattacttatgaacaaaatttgattactaatacagttgaaacaggtaaagtttgtgtcttgtttataa

SEQ ID NO: 23707 - DNA, 75 bp, Artificial Sequence
  Synthetic
caccagtgtaccgatagcagtaagaaacgagctattcaaaagatttgtgtcttaattagtaatgatctaaaggag

SEQ ID NO: 23708 - DNA, 75 bp, Artificial Sequence
  Synthetic
cgtcactttcaactactgcttcagcagttaactcgtttgcttattcttactgtaatgttccagtggagagttggg

SEQ ID NO: 23709 - DNA, 75 bp, Artificial Sequence
  Synthetic
aatggattattagaagaggctaaaacattcagaccagagtataaatcaatcgcccaagtatatggtaaattcttc

SEQ ID NO: 23710 - DNA, 75 bp, Artificial Sequence
  Synthetic
attttaacatgattaaactgactgctgaaactagttgtgcttcacttactgcaatgactaatttggttaatacat

SEQ ID NO: 23711 - DNA, 75 bp, Artificial Sequence
  Synthetic
aaacgatacatcgccgaaaaggaatcatcagttattacaccatttaaactagtaaataatcaaattttacttcat

SEQ ID NO: 23712 - DNA, 75 bp, Artificial Sequence
  Synthetic
tagtgcctgatgatagggttaggccggttggtctttatgtagatatacctggagtaaccgtgactactagcgcat

SEQ ID NO: 23713 - DNA, 75 bp, Artificial Sequence
  Synthetic
gatattgacgaattggttgagtatggtagttcagaatatatgtttagacatatgttgttgtgttacattattcat

SEQ ID NO: 23714 - DNA, 75 bp, Artificial Sequence
  Synthetic
cattaggttcattacctattactaccatcccagcgacaacaccattgatattcagtgcttatacaaaacaagtcg

SEQ ID NO: 23715 - DNA, 75 bp, Artificial Sequence
  Synthetic
aggaagttggcgtcgttaatactctatatgctttaagttacttgccttaaaatctagatgggctaaagtctgata

SEQ ID NO: 23716 - DNA, 75 bp, Artificial Sequence
  Synthetic
tgtgtaacatgaagctttcacctgattacattgagtgtttgagccatcatttaacatcaactgttgacattgacg

SEQ ID NO: 23717 - DNA, 75 bp, Artificial Sequence
  Synthetic
aatgattatggtttgtattcaaagtcgttttaactaagatgcgcatatcatcgtgagctatttacatggccggct

SEQ ID NO: 23718 - DNA, 75 bp, Artificial Sequence
  Synthetic
ttcaccagcaagattgtggtaatttaagcgttgtaatatttgcaaaagataataacattaagaaacagctgcaga

SEQ ID NO: 23719 - DNA, 75 bp, Artificial Sequence
  Synthetic
ttgctgtgtgccatgttcttggccggtgtatgcgttaatctgaacagtcaaagactacgtattcatcgatttacg

SEQ ID NO: 23720 - DNA, 75 bp, Artificial Sequence
  Synthetic
ttcaggtatccgcttgagtagccatggagccgtcggtaattttatggaccaccaggaaactactggtcctgtgcc

SEQ ID NO: 23721 - DNA, 75 bp, Artificial Sequence
  Synthetic
agactacgtattcatcgatttacgaaatcgggggaagccaccccccgagagtagtaactgagtgatttgaccgac

SEQ ID NO: 23722 - DNA, 75 bp, Artificial Sequence
  Synthetic
aacatggatgtactgagtaaaagttctttgaaggagttgttagctcatttggagagaactccacttgaggaagcg

SEQ ID NO: 23723 - DNA, 75 bp, Artificial Sequence
  Synthetic
atcggaaagacgtcccacacccttccactatattcttcatcccgaatagcgcgccgtatccaatttagaactgac

SEQ ID NO: 23724 - DNA, 75 bp, Artificial Sequence
  Synthetic
gtataaaatttcagcacctgtccaatttaggaaacattcgtttaagagtcgatattgcttcaatgaacaatggac

SEQ ID NO: 23725 - DNA, 75 bp, Artificial Sequence
  Synthetic
ccagatgtgacttcattaattgacggtgttgctagagaaggacagcgtaacgtcaacggcttgataatgtcaata

SEQ ID NO: 23726 - DNA, 75 bp, Artificial Sequence
  Synthetic
aagcaacaattaacagaattggagacaaattcgaaatcaggtgtcgtcacttggaccgtgactacaccatgcctt

SEQ ID NO: 23727 - DNA, 75 bp, Artificial Sequence
  Synthetic
atatcatatgtggtaagtggctctggtcactatattcctaatatcggttatacattactgaggcgatcgatactg

SEQ ID NO: 23728 - DNA, 75 bp, Artificial Sequence
  Synthetic
tacccaatgctactactaataataattttcttggttgcattaagtttatcactgagcatatgggctttgactatg

SEQ ID NO: 23729 - DNA, 75 bp, Artificial Sequence
  Synthetic
tacattactgaggcgatcgatactggacattctaactaagcatgacactgggttgaacacgaacaacatcaacta

SEQ ID NO: 23730 - DNA, 75 bp, Artificial Sequence
  Synthetic
taagtatgggattcaagatttgtgcaaacgtagatgattttcaacatttgaatggaaattcaactttaatggttg

SEQ ID NO: 23731 - DNA, 75 bp, Artificial Sequence
  Synthetic
ggaaaacaacgataggaccactgattctaaaaaagattagatctttaccttgctgcaacgatgcattattcaaga

SEQ ID NO: 23732 - DNA, 75 bp, Artificial Sequence
  Synthetic
actcctagcatacaaagatggtaatcttaacgattatgaaacgtatttgaatcagaatatatcattgaaacaaat

SEQ ID NO: 23733 - DNA, 75 bp, Artificial Sequence
  Synthetic
ataagtataggatacttgctaggatgcacggtattcttagattaaagaacgatcgcaacaacttcagatatggag

SEQ ID NO: 23734 - DNA, 75 bp, Artificial Sequence
  Synthetic
ttattcttgagtactgttacaaaccaatgattaacttttccaactttataactgctatcagtgatttaaatgatt

SEQ ID NO: 23735 - DNA, 75 bp, Artificial Sequence
  Synthetic
agcatacagattaacacagtcaactgagttatcaattcgtgatgacaatgccaaatcatacaaaatcggatacgt

SEQ ID NO: 23736 - DNA, 75 bp, Artificial Sequence
  Synthetic
actgctatcagtgatttaaatgatttgcattcaggtgatcaattctatctacatggagatgttaatcctgagatt

SEQ ID NO: 23737 - DNA, 75 bp, Artificial Sequence
  Synthetic
tgattggtataatagtagttcttttctacgagaagggaatgattttaatttgataagtcttaaagatagagataa

SEQ ID NO: 23738 - DNA, 75 bp, Artificial Sequence
  Synthetic
tgcattcaggtgatcaattctatctacatggagatgttaatcctgagattttaatgagtgaccccaatggttatc

SEQ ID NO: 23739 - DNA, 75 bp, Artificial Sequence
  Synthetic
taaagttagttgatccagtgtgtttgctagaaaatcaagtaaatatggtaaacattgagtatgaatcattgactc

SEQ ID NO: 23740 - DNA, 75 bp, Artificial Sequence
  Synthetic
taaatatgtaagattaaatggatggtgaacaagttaacacgataaagcttgaaaagctttgctgacactaagagc

SEQ ID NO: 23741 - DNA, 75 bp, Artificial Sequence
  Synthetic
aggaagcggaaaagaaagtgtttttgaagtcgttggtcacgttagttgagagacaattgtcagctagatctgaag

SEQ ID NO: 23742 - DNA, 75 bp, Artificial Sequence
  Synthetic
gaagtcgttggtcacgttagttgagagacaattgtcagctagatctgaagatatatatgttgatttaagtagtga

SEQ ID NO: 23743 - DNA, 75 bp, Artificial Sequence
  Synthetic
gtattaaatttttgtaagtcgttatggaattatttagtgacagtggaagcatagttgaaaacttcaaggaaagaa

SEQ ID NO: 23744 - DNA, 75 bp, Artificial Sequence
  Synthetic
aaatccatccttcaacttgaccaatggtatgagactgactgacttgttagatagattagacgccacaaatgtaaa

SEQ ID NO: 23745 - DNA, 75 bp, Artificial Sequence
  Synthetic
taaacaaacttgtgtttgattattcattaaaccatggaggatttcgaaaaacatacaaaattcaacgtgacaggg

SEQ ID NO: 23746 - DNA, 75 bp, Artificial Sequence
  Synthetic
tcaatggaaatcacttattaaccataagccgatgctacctagtctacatgccttgaatgatttgacttactacaa

SEQ ID NO: 23747 - DNA, 75 bp, Artificial Sequence
  Synthetic
tttactacatgcttggtgatgcacatcatgcaaacttatcaggtaaatgtttgatgctgtataacagcgagaagg

SEQ ID NO: 23748 - DNA, 75 bp, Artificial Sequence
  Synthetic
attatgtgatgattctagtctaatcactgaagacttggatgatgaagatgatgtgtagtagacccaacctgattt

SEQ ID NO: 23749 - DNA, 75 bp, Artificial Sequence
  Synthetic
atatcttcgaagggttgggatttaaggttaagggttcaagaatcaatgtttcaaaaactcagatcttgcgcaatt

SEQ ID NO: 23750 - DNA, 75 bp, Artificial Sequence
  Synthetic
actgaagacttggatgatgaagatgatgtgtagtagacccaacctgattttaataaatatattcattattattgt

SEQ ID NO: 23751 - DNA, 75 bp, Artificial Sequence
  Synthetic
tcattgtcgccttgttgactcttaatacggatgtacgacctgccatattactgtcgcccaaggtaatgtggtaag

SEQ ID NO: 23752 - DNA, 75 bp, Artificial Sequence
  Synthetic
atgagattaactttgaaaccattatcggtgtcgaaccgaatggattgaagacgatttcaactgcgaaagatgtta

SEQ ID NO: 23753 - DNA, 75 bp, Artificial Sequence
  Synthetic
aggtaatgtggtaaggcgttaggggttggcgccccttatacttctgcggaatcattaactgaaagagaaactgac

SEQ ID NO: 23754 - DNA, 75 bp, Artificial Sequence
  Synthetic
gtatttaaaattgatatcaaccttgaccaacaatggcaaatagagcaacttcagcctttctcgataaccctcatc

SEQ ID NO: 23755 - DNA, 75 bp, Artificial Sequence
  Synthetic
agaagttgtacgatatttactcttataaaagtagtctccatccatttgatgactttatggcgcattgcatcaacc

SEQ ID NO: 23756 - DNA, 75 bp, Artificial Sequence
  Synthetic
gctggggtatgtccataccggcatcacttgagcgtattatcaaaagtgagataattaaagtaaggagtggtgttt

SEQ ID NO: 23757 - DNA, 75 bp, Artificial Sequence
  Synthetic
cagtcggagtcaactatgttgatgaagggtctcgtcaattcgttgcagtcgctgaacttttagcttcaaagttga

SEQ ID NO: 23758 - DNA, 75 bp, Artificial Sequence
  Synthetic
taaatagaaattctgagttgtataactatatccctacagttgatgcaagcttcagcgagatgtcgcgcggtccag

SEQ ID NO: 23759 - DNA, 75 bp, Artificial Sequence
  Synthetic
ttgctagtagtagagagtcagacgaaagtaattcagatgtaccgttcgttcaggcatatagcaagttcgctgatg

SEQ ID NO: 23760 - DNA, 75 bp, Artificial Sequence
  Synthetic
cgaacgttatacttactgacggtaaactggtacccgatggcacctgttttggaccaatattatcaaaatcggttg

SEQ ID NO: 23761 - DNA, 75 bp, Artificial Sequence
  Synthetic
ataatccacgtcatcttcgtgttaagacgggaggtaagatggcaaatgcattgactaatgtcattagatcatatt

SEQ ID NO: 23762 - DNA, 75 bp, Artificial Sequence
  Synthetic
aagatccaagacttaagaatgaattcaggtcgaaagggttgattatggttcacgattattttatactaattggtg

SEQ ID NO: 23763 - DNA, 75 bp, Artificial Sequence
  Synthetic
atagtatcaatgcaccagctattgtaccacaagtcgaaattgatcgcttagcttcaaaggctacggtttcaggtg

SEQ ID NO: 23764 - DNA, 75 bp, Artificial Sequence
  Synthetic
aaagtccgggtccgcattacaagaaatacacaaagatgactaaagataatactatattctgggatcctagacgta

SEQ ID NO: 23765 - DNA, 75 bp, Artificial Sequence
  Synthetic
acatgtacaattcatatgctgtattcaacagtgttccaattgttgaggtactcagtccagctcaaacaactgtgt

SEQ ID NO: 23766 - DNA, 75 bp, Artificial Sequence
  Synthetic
cagatcataagttcaataatgttgtaagttacttcaagaaggagaacatacgcgacgttgttgaatatactactg

SEQ ID NO: 23767 - DNA, 75 bp, Artificial Sequence
  Synthetic
caatagtaggttcagacagagccgatgttaccatgcttaacactggggccggagccgctaacataactttcaact

SEQ ID NO: 23768 - DNA, 75 bp, Artificial Sequence
  Synthetic
acgctttaaacaggggtttgaagccattggttttgatcgatataaggaaagacaagcctaagaatctgaatacac

SEQ ID NO: 23769 - DNA, 75 bp, Artificial Sequence
  Synthetic
ttggacagatagctgaaacagttatactcaaaggttcagttcctttccaattagcacgcgctaatcaaccaatgc

SEQ ID NO: 23770 - DNA, 75 bp, Artificial Sequence
  Synthetic
ctgaaggcgctattgaatgggaacgaatggtacatgatgataataacttgataatagatatggttaacgcacttg

SEQ ID NO: 23771 - DNA, 75 bp, Artificial Sequence
  Synthetic
cagcagcacgttttacgtataaacttcgaccactggacggaccattcatagttgtattaccaattggaaatccgt

SEQ ID NO: 23772 - DNA, 75 bp, Artificial Sequence
  Synthetic
ataagagggtaactgtttgtgcgaaacttcgtccagcattcatgcaagtaggcagcatgcgtaaattgttgagac

SEQ ID NO: 23773 - DNA, 75 bp, Artificial Sequence
  Synthetic
tagtgattaatgctacagcaacaacacgtatacaagtttctcctgccttcaacaaagctttagttgaatccggat

SEQ ID NO: 23774 - DNA, 75 bp, Artificial Sequence
  Synthetic
cagtgcgtattttgccactcccgtatttacgaaggtcaactgctgaattcaacatgtttgtaccgaatgaggctt

SEQ ID NO: 23775 - DNA, 75 bp, Artificial Sequence
  Synthetic
ttcaaacggcaatgaatgatggactgtttgatgcccaaaatgtcaattattactccagcttcgacgaattcatca

SEQ ID NO: 23776 - DNA, 75 bp, Artificial Sequence
  Synthetic
taatgaatggaaatgagatctatgacgtgacgtacgatgatctggttaggatgtcgagtgaagtatttgtgctca

SEQ ID NO: 23777 - DNA, 75 bp, Artificial Sequence
  Synthetic
tacctcaatatcatgcattagatggtataaacagagtgtccacttgtgtcgttctgggattagctttgcaagcat

SEQ ID NO: 23778 - DNA, 75 bp, Artificial Sequence
  Synthetic
agaatataataggtggattatacaatatgtatttgaaagacatgcatctaaatttaggtgtagtgaataagtccg

SEQ ID NO: 23779 - DNA, 75 bp, Artificial Sequence
  Synthetic
acgatcaaatgcgtagagcactacctgtccgacgagtgtagagcactcgtgagtggctcgtcaccctcacgttgc

SEQ ID NO: 23780 - DNA, 75 bp, Artificial Sequence
  Synthetic
tcagtttatccgatggttcttcagcaatatggagtctctcaaatattaacaatgaacgcatatctaattttaatt

SEQ ID NO: 23781 - DNA, 75 bp, Artificial Sequence
  Synthetic
gagtggctcgtcaccctcacgttgctcaaccaaaccaaagaatgctgattgttctattttgacattgtttggttt

SEQ ID NO: 23782 - DNA, 75 bp, Artificial Sequence
  Synthetic
tcaataactttctgtatgctgcaccttacagtgatttcgctacttcatctgtcaagcggcattttaaaggtagga

SEQ ID NO: 23783 - DNA, 75 bp, Artificial Sequence
  Synthetic
gtatttaaaattacagaggaaccatgatatccgacgcagttgtaagaggctttaagcgtcttgctttagaaactg

SEQ ID NO: 23784 - DNA, 75 bp, Artificial Sequence
  Synthetic
attatagtgattggtgtctcaacattttggatgaagttaacctgaaagatggtgtatacttagtaccgttgtacg

SEQ ID NO: 23785 - DNA, 75 bp, Artificial Sequence
  Synthetic
agaggaccgctggagagcagactaaggaattaggatcaaaggtcaaattgagtaagggagaggttgaatatttgg

SEQ ID NO: 23786 - DNA, 75 bp, Artificial Sequence
  Synthetic
ccatagtaggtggtggtcagatcacttcgcatgactttgttaacgccatcataactgatcaagagcagttaattg

SEQ ID NO: 23787 - DNA, 75 bp, Artificial Sequence
  Synthetic
ccgttacaaaagatgaattgttagaaggattgagacaatgtaatcttaagaaagttgagcaattaaaccttgatg

SEQ ID NO: 23788 - DNA, 75 bp, Artificial Sequence
  Synthetic
atttcactcaatctgagagggcattatctactcaagtggtgaaattagtttccttcattttaaaggattcgttta

SEQ ID NO: 23789 - DNA, 75 bp, Artificial Sequence
  Synthetic
ctaccttcaatggtaacttggcgagagcgggtgcttataaatttattaaacatagtatgttgatattcatgacta

SEQ ID NO: 23790 - DNA, 75 bp, Artificial Sequence
  Synthetic
cagcaaaaggactgaattggactgaaattgataatgaaatcaggaaccgtagactgagcagtttaagtggcgttg

SEQ ID NO: 23791 - DNA, 75 bp, Artificial Sequence
  Synthetic
gaccgattgcggtgtcgaataatgaaaaatattctactgacgttgctggaataccgaggagtactacaaatgtaa

SEQ ID NO: 23792 - DNA, 75 bp, Artificial Sequence
  Synthetic
gctttacagtgacgaaaatgcttgacggcaaggttttggttgatggaaaagttgtgactgtgagtggtcatatgt

SEQ ID NO: 23793 - DNA, 75 bp, Artificial Sequence
  Synthetic
tggttggggaaagaatgataatgaaaactgtaccgagaggaacaggttcaccatggtctggccaatgtgcatcat

SEQ ID NO: 23794 - DNA, 75 bp, Artificial Sequence
  Synthetic
tatatatactactcggaagcattttgggtttgccttatggaataaagaaatacttgaaggagattgaactgaata

SEQ ID NO: 23795 - DNA, 75 bp, Artificial Sequence
  Synthetic
tgataataacaaatggaatatcgctacacgattcagttgtcattcctggtagtatttacgtcctgtttcagacgt

SEQ ID NO: 23796 - DNA, 75 bp, Artificial Sequence
  Synthetic
tattgaagccaggatcatcatatgaacgaggtgttggtggacgcgtgtggcacggactgatatcgcactatttag

SEQ ID NO: 23797 - DNA, 75 bp, Artificial Sequence
  Synthetic
cattaaccacttataataaatcgaattcatacgcttactcttattgtgttattccgcatagtaaatgggatccaa

SEQ ID NO: 23798 - DNA, 75 bp, Artificial Sequence
  Synthetic
ctgttgattgtgtcattgatgtaattgatgagtacatggtatgtacgtatgaggataggagtaaacttaatgttg

SEQ ID NO: 23799 - DNA, 75 bp, Artificial Sequence
  Synthetic
agaagatcaaactaacatccgaaacaagttgtccatcgttgaacagtatgcagtcattggccaattctatacttg

SEQ ID NO: 23800 - DNA, 75 bp, Artificial Sequence
  Synthetic
tgttaagatacgttaaaagtaaattgttagaacttggttcaaagtatgatgtttatttgagcgtagatgaaaggt

SEQ ID NO: 23801 - DNA, 75 bp, Artificial Sequence
  Synthetic
aaggtgatagagcaccagtcaccggattatatgttgacattgaaggagtaactgtttcaaccagcaatagtctgt

SEQ ID NO: 23802 - DNA, 75 bp, Artificial Sequence
  Synthetic
tagtattgtgaaaatccaactgtcactgttgtaattcacataactgtcctgtgtggggattctcgtaacgggtga

SEQ ID NO: 23803 - DNA, 75 bp, Artificial Sequence
  Synthetic
caacattgccaattacgaatgtcgctaataactatccaatttgttttgaagcgtgtgtcaggtacgttgaacagg

SEQ ID NO: 23804 - DNA, 75 bp, Artificial Sequence
  Synthetic
tttctgagataaatttgttgtatacattagcttataattagatggcaagatatattcgtatgtacttacatctta

SEQ ID NO: 23805 - DNA, 75 bp, Artificial Sequence
  Synthetic
ggcgccgggttcgttttgcagccatagccaaactgcacgagtggagccagggacctatgcaaaaatagaactgac

SEQ ID NO: 23806 - DNA, 75 bp, Artificial Sequence
  Synthetic
ttaaagtctgatctactagcaatagaagaacgattaactgagagcgctgagcttctgctccggcgttggggttat

SEQ ID NO: 23807 - DNA, 75 bp, Artificial Sequence
  Synthetic
agaattcatacatgatgattgctttaattcaaatgaagaatatgaagtgcactttgaaagtcgaggaaacaactg

SEQ ID NO: 23808 - DNA, 75 bp, Artificial Sequence
  Synthetic
tggggttatggtcttcgattgaggaggccgagggaagccacccctcggtagtactcactgagtaatttgaccgac

SEQ ID NO: 23809 - DNA, 75 bp, Artificial Sequence
  Synthetic
gtaagagtaagatcttaagatggatcctgtgtctgtagtacataactttgccagaagtcaaggcttgccgcttaa

SEQ ID NO: 23810 - DNA, 75 bp, Artificial Sequence
  Synthetic
aaaatcaagaattggaaggcgtttcattcgatgaactagttgcattgagagaggagaatgccaaactgaaacaag

SEQ ID NO: 23811 - DNA, 75 bp, Artificial Sequence
  Synthetic
ctttgaaactgtgggttgtgaaggtccaagtcacgacccgcgcttcgtaattgaatgtaaacttcttgatttcca

SEQ ID NO: 23812 - DNA, 75 bp, Artificial Sequence
  Synthetic
agaatgaagctctgaaggctaagcttcatcgtcttgaaagtgactggactacttcagacatcgttgaaaaggttg

SEQ ID NO: 23813 - DNA, 75 bp, Artificial Sequence
  Synthetic
gcaccagtgcactgatagcagtaagaaacgagcaatacataagatttgtgttttaattagtaacgatctaaaaga

SEQ ID NO: 23814 - DNA, 75 bp, Artificial Sequence
  Synthetic
agttaatggatgctcagtttgataggattgggaagataatggataagatgcgtgagccgatgctgtttaagcgtg

SEQ ID NO: 23815 - DNA, 75 bp, Artificial Sequence
  Synthetic
gaatggactattggaagaggcaaaaacattcaagccagagtacaaagcaatcgcccaagtatatggtaaattctt

SEQ ID NO: 23816 - DNA, 75 bp, Artificial Sequence
  Synthetic
acgaaatcgaattgcatggtgatttgctagctagagttgaagggttactacgcattaagaacgagcgcagtgaga

SEQ ID NO: 23817 - DNA, 75 bp, Artificial Sequence
  Synthetic
caaacggtacattgttgaaaaagaatcatcagttattacaccctataagctaataaacaatcaaatccttcttca

SEQ ID NO: 23818 - DNA, 75 bp, Artificial Sequence
  Synthetic
ttgaatttgaaaaggacattcaatgcatagttggaagatgcttcagtgatgagaataaacaacgtaaccttgaaa

SEQ ID NO: 23819 - DNA, 75 bp, Artificial Sequence
  Synthetic
tgataatgacgaatcagttgattacggtagttcagaattcatgtttcgacacatgttactgtgttacatcattca

SEQ ID NO: 23820 - DNA, 75 bp, Artificial Sequence
  Synthetic
agatgataaaatcattcgagtatgacgacattgctgacaccatcgctctgcgcttgactcatttcattcaggatc

SEQ ID NO: 23821 - DNA, 75 bp, Artificial Sequence
  Synthetic
taaacaaaagattaaggttagtgagatgtataatatgacattctcacccgaatacattgagtgtttgagccatca

SEQ ID NO: 23822 - DNA, 75 bp, Artificial Sequence
  Synthetic
cgcttgactcatttcattcaggatccaggtttacgctcgatagtgtatgcgatgtgtaaagctgctgttctgaat

SEQ ID NO: 23823 - DNA, 75 bp, Artificial Sequence
  Synthetic
atgtataatatgacattctcacccgaatacattgagtgtttgagccatcatttaacttcaatagttgaaattgaa

SEQ ID NO: 23824 - DNA, 75 bp, Artificial Sequence
  Synthetic
caaaattatctaaacatcgaggtgcaggagatagttgacgtgacaaggcaaaagtacactcataacgcacgtgac

SEQ ID NO: 23825 - DNA, 75 bp, Artificial Sequence
  Synthetic
tttcatcatcaagattgtggtaatttaagcattgtaatatttgcaaaagataatgacattaagaaacagctgcag

SEQ ID NO: 23826 - DNA, 75 bp, Artificial Sequence
  Synthetic
gacattgatttttacccaatgtttacttttgatgccaacgtgccggaaggtgtcttcgatcacatatacaaaaag

SEQ ID NO: 23827 - DNA, 75 bp, Artificial Sequence
  Synthetic
attcagatatccgcttaagcagccatgaagccgtcggtaattttatggaccacctggagactactggtcctgtgc

SEQ ID NO: 23828 - DNA, 75 bp, Artificial Sequence
  Synthetic
cttttgatgccaacgtgccggaaggtgtcttcgatcacatatacaaaaagcactatttatctccacaatctgctg

SEQ ID NO: 23829 - DNA, 75 bp, Artificial Sequence
  Synthetic
cacctggagactactggtcctgtgccgttaggtcccgctttgggactaggtcgtcatgcatcttatgctactagg

SEQ ID NO: 23830 - DNA, 75 bp, Artificial Sequence
  Synthetic
ctttggttcacacactgtcacatcttgatgtgaatgttgatggtaatggaatagcgatgtatcatatcggatcag

SEQ ID NO: 23831 - DNA, 75 bp, Artificial Sequence
  Synthetic
cgacgaggtttgctgagtgttcggttgtatatgttgatggacgtgcttacaagccaattagagttatggctgaat

SEQ ID NO: 23832 - DNA, 75 bp, Artificial Sequence
  Synthetic
aaattgatagtgtttgcgtaagagtaagatcttaagatggatcctgtatctgtagtacataatttcgctaggagt

SEQ ID NO: 23833 - DNA, 75 bp, Artificial Sequence
  Synthetic
tgtatatgttgatggacgtgcttacaagccaattagagttatggctgaatatgctatctttccaaccttgccgca

SEQ ID NO: 23834 - DNA, 75 bp, Artificial Sequence
  Synthetic
tgagtataaaggtagagtcgaaggattgttgttgttgcatgggggattagcgccaataacattagtgcgtgttta

SEQ ID NO: 23835 - DNA, 75 bp, Artificial Sequence
  Synthetic
ctgtgggttgtgagggtccaagtcacgacccacgcttcgtaattgaatgtaaacttcttgatttccagcaccagt

SEQ ID NO: 23836 - DNA, 75 bp, Artificial Sequence
  Synthetic
cgacccacgcttcgtaattgaatgtaaacttcttgatttccagcaccagtgcactgatagtagtaagaaacgagc

SEQ ID NO: 23837 - DNA, 75 bp, Artificial Sequence
  Synthetic
tcacgatgttaatgttggtggtctagtgaccggttcgatcgcagcatccgtttcaactctattgcgtaattgcat

SEQ ID NO: 23838 - DNA, 75 bp, Artificial Sequence
  Synthetic
gcactgatagtagtaagaaacgagcaatacaaaagatttgtgtcttaattagtaacgatctaaaagagaatggac

SEQ ID NO: 23839 - DNA, 75 bp, Artificial Sequence
  Synthetic
gttatacagttttgatatctatttcactccgaatggtgtttgtatcaatgctgttggtaacaacaactttgttaa

SEQ ID NO: 23840 - DNA, 75 bp, Artificial Sequence
  Synthetic
cataatagatataaactgttgcggacgtgcttttggtaaagctcctttagaccaaggatcatggaatagaaataa

SEQ ID NO: 23841 - DNA, 75 bp, Artificial Sequence
  Synthetic
gttcatgggtcacaaacatgggagaggatcaaagtgcaagcagtataagaaaatcaattcatagatattgcttat

SEQ ID NO: 23842 - DNA, 75 bp, Artificial Sequence
  Synthetic
acgaaacaatcgattatggtagttcagaattcatgtttcgacatatgttactgtgttacatcatttacaaacaag

SEQ ID NO: 23843 - DNA, 75 bp, Artificial Sequence
  Synthetic
aaatcaattcatagatattgcttatacggtcagtcatagacgtacgattaagacgcgaggatgacgtaaaatcac

SEQ ID NO: 23844 - DNA, 75 bp, Artificial Sequence
  Synthetic
agattaaagtcagtgagatgtgtaatatgacattttcacccgattacattgagtgtttgagccatcatttaactt

SEQ ID NO: 23845 - DNA, 75 bp, Artificial Sequence
  Synthetic
gagtgtttgagccatcatttaacttcaattgttgaaatcgaatttcatcaccaggattgtggtaatttgagcatc

SEQ ID NO: 23846 - DNA, 75 bp, Artificial Sequence
  Synthetic
ctcggaacgtgagctattgtgggcttgtcgggctccacattggccgttcaggaaggtgtgagcttatggccgcct

SEQ ID NO: 23847 - DNA, 75 bp, Artificial Sequence
  Synthetic
ttaagaaacagctgcagattcaggtatccgcttaagtagccatggagccgtcggtaattttatggaccacctgga

SEQ ID NO: 23848 - DNA, 75 bp, Artificial Sequence
  Synthetic
gccttctgagagctgatttgttctccactggatggtggggtagcagggaatgaactggtggtataattgactgac

SEQ ID NO: 23849 - DNA, 75 bp, Artificial Sequence
  Synthetic
gtattaaaaattatatgttttcttgctgagtagcgactggactgactccttctaagagaatttaataaaacgaaa

SEQ ID NO: 23850 - DNA, 75 bp, Artificial Sequence
  Synthetic
tttagatcggaaggacgtcccacacccttccactatttcttcatcccgaatagcacgccgtatccaatttagaac

SEQ ID NO: 23851 - DNA, 75 bp, Artificial Sequence
  Synthetic
gtatttaaaattcatgtttttgcatcatggcgtgggttacgcaagcatatagttcgggattgtcacagaacagta

SEQ ID NO: 23852 - DNA, 75 bp, Artificial Sequence
  Synthetic
atactaatcatttctgctgctgttacagtcattgatcagttatatcaaaagttgccttatgatgagcaaactaag

SEQ ID NO: 23853 - DNA, 75 bp, Artificial Sequence
  Synthetic
catggcgtgggttacgcaagcatatagttcgggattgtcacagaacagtattattagtctaacgggaaatgacag

SEQ ID NO: 23854 - DNA, 75 bp, Artificial Sequence
  Synthetic
aactgttgctgatggcacttttaattccatgattatgcctagagcagtaattgctaatgaacgtgagcatttcat

SEQ ID NO: 23855 - DNA, 75 bp, Artificial Sequence
  Synthetic
tacatcgtgtctaccattactgatggaataaatgctacgattatatctgttatggctatattgggtttgaataat

SEQ ID NO: 23856 - DNA, 75 bp, Artificial Sequence
  Synthetic
ttgaacagagtacgatacagtaaactggatgaaaatggtgtttattctcaggagatggtgacaatgaatgtgcaa

SEQ ID NO: 23857 - DNA, 75 bp, Artificial Sequence
  Synthetic
gaaaacgagaatagataaaattgaacatgacttaaatcgtagtgcaaagcaagagatgatggatcgtcagtcatt

SEQ ID NO: 23858 - DNA, 75 bp, Artificial Sequence
  Synthetic
ggccgaggattataacgcattgaacttagctgttggtcaagagataaagttggacatagcaactcagcatcaact

SEQ ID NO: 23859 - DNA, 75 bp, Artificial Sequence
  Synthetic
tctgatgctgctaataataaaaagcaactaaagaagaaagagaatgaagatgttgatgaagagaaaggattatat

SEQ ID NO: 23860 - DNA, 75 bp, Artificial Sequence
  Synthetic
gaatagactaggatcagctatgtataaggcagatcatgaacgcgagactgaactgactgatttaattaatagaat

SEQ ID NO: 23861 - DNA, 75 bp, Artificial Sequence
  Synthetic
ccaaatttaaaattgactgaaccaacagccccgatgattcataactatatgtatgaccacaaaacacaacaagcg

SEQ ID NO: 23862 - DNA, 75 bp, Artificial Sequence
  Synthetic
aactgactgatttaattaatagaattcgtgagaatgaggtcactgtcaatggaatcttggaaaaccaaaaagcta

SEQ ID NO: 23863 - DNA, 75 bp, Artificial Sequence
  Synthetic
tatctgttgacagaacatcaaattgaacagattaaacagaacagtgttgaccctaacaatacaccaaagattgaa

SEQ ID NO: 23864 - DNA, 75 bp, Artificial Sequence
  Synthetic
aacagattaaacagaacagtgttgaccctaacaatacaccaaagattgaagtgaggagtcagttctaactgttta

SEQ ID NO: 23865 - DNA, 75 bp, Artificial Sequence
  Synthetic
taactgccgctgaacgtgccgatttacttttagaggttgtcgcttctacagcaaaatcagtatctgcagcaggcc

SEQ ID NO: 23866 - DNA, 75 bp, Artificial Sequence
  Synthetic
acttttagaggttgtcgcttctacagcaaaatcagtatctgcagcaggccgagccgcagctgatggttcgggcgt

SEQ ID NO: 23867 - DNA, 75 bp, Artificial Sequence
  Synthetic
tgtgccagtgtttggaccaagtgtagctaatggtattaaagttggaattgatattgctgatagtgtcgcggaggc

SEQ ID NO: 23868 - DNA, 75 bp, Artificial Sequence
  Synthetic
gctaatggtattaaagttggaattgatattgctgatagtgtcgcggaggctgcgatcgctgttaaagagtcagga

SEQ ID NO: 23869 - DNA, 75 bp, Artificial Sequence
  Synthetic
attatcacacaattaaatgatgtgtatcatgctttccaaagtgtacacgttgcacctaatgatgttatcaagcca

SEQ ID NO: 23870 - DNA, 75 bp, Artificial Sequence
  Synthetic
tgcacctaatgatgttatcaagccagctgctgtagttgcaggaactagtactgaattgattggtaatttacaagc

SEQ ID NO: 23871 - DNA, 75 bp, Artificial Sequence
  Synthetic
aatatatagtaggctacggagccatagtgatattggtttcaagaaagcgactgttggcgatgttattcctaattc

SEQ ID NO: 23872 - DNA, 75 bp, Artificial Sequence
  Synthetic
ttatatgattaaaccagtcaattcaactgaatatgcttcatggcaattatacgttatacatcctgttcaaggatc

SEQ ID NO: 23873 - DNA, 75 bp, Artificial Sequence
  Synthetic
gttaggtcccactttgggactaggtcgccatgcatcttatgctactaggatgtaagatttagatcggaaggacgt

SEQ ID NO: 23874 - DNA, 75 bp, Artificial Sequence
  Synthetic
attaggcttggtcgttcaactgatgggtgatgcattaacttacaacgtttttgctcagtatggtactacttcagc

SEQ ID NO: 23875 - DNA, 75 bp, Artificial Sequence
  Synthetic
cgccatgcatcttatgctactaggatgtaagatttagatcggaaggacgtcccacacccttccactatattcttc

SEQ ID NO: 23876 - DNA, 75 bp, Artificial Sequence
  Synthetic
atcggaaggacgtcccacacccttccactatattcttcatcccgaatagcacgtcgtatccaatttagaactgac

SEQ ID NO: 23877 - DNA, 75 bp, Artificial Sequence
  Synthetic
tagtgaatttggaaaaactgtattgactggcggtgccacaaacaccgctttggaagggacaaaagttaagtttca

SEQ ID NO: 23878 - DNA, 75 bp, Artificial Sequence
  Synthetic
gtattaaaaattacaagaacctaacattgcaatggagatcttgagaacgaaatcgcagtcagctgcagtggttat

SEQ ID NO: 23879 - DNA, 75 bp, Artificial Sequence
  Synthetic
attgcaatggagatcttgagaacgaaatcgcagtcagctgcagtggttattggaatttccaaattcttcgatgag

SEQ ID NO: 23880 - DNA, 75 bp, Artificial Sequence
  Synthetic
aaccaaggttacggctcaacaagctttagcgctgacgatggcgctgaaagacgcagcttctatgttatctcaggg

SEQ ID NO: 23881 - DNA, 75 bp, Artificial Sequence
  Synthetic
tgaattgataggatactttgaacaatatatcaacctagcacttgagcctgataatttgagttggcaggttaatat

SEQ ID NO: 23882 - DNA, 75 bp, Artificial Sequence
  Synthetic
aactatttccttggcttagagaatattttccgcaattcacttgatgaactaaaggatatactgattttagctggt

SEQ ID NO: 23883 - DNA, 75 bp, Artificial Sequence
  Synthetic
gcataagtatcatcatctgttgacaagtcaaaattcacctattgattggaactatcatgacgaagagatgcataa

SEQ ID NO: 23884 - DNA, 75 bp, Artificial Sequence
  Synthetic
ggctcaatttcaaagagtaagatcactcaggccgggttgtcgcacatgataacctttcttgagaaattgtgtctt

SEQ ID NO: 23885 - DNA, 75 bp, Artificial Sequence
  Synthetic
gtggcttgacggtcgcaagactacaaattatgatgcgatgcagaagaaagatggtactgttatagctgacattca

SEQ ID NO: 23886 - DNA, 75 bp, Artificial Sequence
  Synthetic
agtgatgacgctggtgtgaacaaagctttgatctttatcgtctttcagattcatgatagctcacaacgcagaggt

SEQ ID NO: 23887 - DNA, 75 bp, Artificial Sequence
  Synthetic
tatacctaaagtttttaatgatcttagaaatactacattacactgcaaattggaaggcaaacagacaatcgctgg

SEQ ID NO: 23888 - DNA, 75 bp, Artificial Sequence
  Synthetic
ggtgtttgtactcttttcgatgtattatacaattacctcgtacagcgcaaactgaatcaggagagtgagttctta

SEQ ID NO: 23889 - DNA, 75 bp, Artificial Sequence
  Synthetic
agaaatactacattacactgcaaattggaaggcaaacagacaatcgctggatatacagtgtacgcatatctgatc

SEQ ID NO: 23890 - DNA, 75 bp, Artificial Sequence
  Synthetic
ggcccttgggctcattatggagatattgattattcagttgtggttgatacgctcaacgaggagactaagtggtat

SEQ ID NO: 23891 - DNA, 75 bp, Artificial Sequence
  Synthetic
agctatggcacgtacaaggaaaagaagtacatatacatcaatgggaagacagtgacttacgtgtgcaagaacgct

SEQ ID NO: 23892 - DNA, 75 bp, Artificial Sequence
  Synthetic
ttgattattcagttgtggttgatacgctcaacgaggagactaagtggtattgtgaggtcatcgggatagatggtc

SEQ ID NO: 23893 - DNA, 75 bp, Artificial Sequence
  Synthetic
tgtgaggtcatcgggatagatggtcatctacttactgagaagagtgttcagcataaacctgaaaagattcttgaa

SEQ ID NO: 23894 - DNA, 75 bp, Artificial Sequence
  Synthetic
gatgctctgactattaaagaattggctaattcaaaatcacatatgacgtatgctgatactattggaagttttcgc

SEQ ID NO: 23895 - DNA, 75 bp, Artificial Sequence
  Synthetic
ctaactcttaatgatagcggtgtagcatcgtttaagggaaagaatcatgacagactgaagcttaaagtatacgta

SEQ ID NO: 23896 - DNA, 75 bp, Artificial Sequence
  Synthetic
aaaaatgcaagtgggatggacgcagtgactttcttaacagtaaaaatggacacaatgcatactgcttcaattttt

SEQ ID NO: 23897 - DNA, 75 bp, Artificial Sequence
  Synthetic
aaagattcgttgtcagtcaaagtttttagaaattggataggcattaatggcacctagagtgaagacgaagatgtt

SEQ ID NO: 23898 - DNA, 75 bp, Artificial Sequence
  Synthetic
gggaagacgtacaacattggtcagctgtactacagacagttgaatgttgaagtcaatactttgaagaaggtgtta

SEQ ID NO: 23899 - DNA, 75 bp, Artificial Sequence
  Synthetic
caacgatcacattggagtgaattatgactattctcacttcgataagaatatttctccagcacacctgactctcac

SEQ ID NO: 23900 - DNA, 75 bp, Artificial Sequence
  Synthetic
gccaatattgatgatcattcaagggttaagatgcacggtaattcacgtgatggctttgtaaaacgtcttgatgat

SEQ ID NO: 23901 - DNA, 75 bp, Artificial Sequence
  Synthetic
tgatctatgttggcatacttgggatcagtatactgcaggaaactggactaacattaaaccgtaattatattatca

SEQ ID NO: 23902 - DNA, 75 bp, Artificial Sequence
  Synthetic
gctgggaaaagtcgtgctactggcttgatcagagctttggatcattccaactcgatacgcttcaaatcaattggc

SEQ ID NO: 23903 - DNA, 75 bp, Artificial Sequence
  Synthetic
cagtatactgcaggaaactggactaacattaaaccgtaattatattatcaatcttcgggcatatgtaagcgtggg

SEQ ID NO: 23904 - DNA, 75 bp, Artificial Sequence
  Synthetic
atgggtagagatgagaaattgtcatacgtagtcgacagctgcttcatcagaaagatgcaaaatggaagaggatta

SEQ ID NO: 23905 - DNA, 75 bp, Artificial Sequence
  Synthetic
acgcgtcaaaacagtgataacctggtcggcggagctacaaatctgcttgtcaggggaaactggatgtactgatgg

SEQ ID NO: 23906 - DNA, 75 bp, Artificial Sequence
  Synthetic
gtgataacctggtcggcggagctacaaatctgcttgtcaggggaaactggatgtactgatgggatttgacccgac

SEQ ID NO: 23907 - DNA, 75 bp, Artificial Sequence
  Synthetic
gtattaaaaattatcaacaaggaatggacgttcaagaacaatttgaaggttatctaagagaagaggtagatctat

SEQ ID NO: 23908 - DNA, 75 bp, Artificial Sequence
  Synthetic
tgtgttaccattgataacataaacaaactgattgaacacaagttagttcatgattgcggtattggacgtacatgt

SEQ ID NO: 23909 - DNA, 75 bp, Artificial Sequence
  Synthetic
tatctaagagaagaggtagatctattgaacaaattcgaagacagtcatttcaaacagttggaaatcttttacaca

SEQ ID NO: 23910 - DNA, 75 bp, Artificial Sequence
  Synthetic
agttgtggagctaaggcttgcgatgatgaatcactgttggatcagttagcggagcgtggccatgatgttgtcgct

SEQ ID NO: 23911 - DNA, 75 bp, Artificial Sequence
  Synthetic
tgaacaaattcgaagacagtcatttcaaacagttggaaatcttttacacaaaaagtcaaaatgatcatgttatca

SEQ ID NO: 23912 - DNA, 75 bp, Artificial Sequence
  Synthetic
ataaagataaactgcaattcaatgcattaccatttcacactacgttatacaaagagattaatggtaaacgagtga

SEQ ID NO: 23913 - DNA, 75 bp, Artificial Sequence
  Synthetic
aatgctaaagaggctatgtcagctatgtgtgatgatgaagaacatgctgaaaaaatagctgtgactaagtcagat

SEQ ID NO: 23914 - DNA, 75 bp, Artificial Sequence
  Synthetic
attaccatttcacactacgttatacaaagagattaatggtaaacgagtgaaactgggtaccctattaaactggac

SEQ ID NO: 23915 - DNA, 75 bp, Artificial Sequence
  Synthetic
gcaaagttggatgataggattgtacaaggtaagggatcacgttatatgtctgcaagtgtatacagatcacgcctg

SEQ ID NO: 23916 - DNA, 75 bp, Artificial Sequence
  Synthetic
taaagctgagcggcttgatacgatacgacatgagtcaatgattaaagatgagcgattacgtcgattaattgactt

SEQ ID NO: 23917 - DNA, 75 bp, Artificial Sequence
  Synthetic
cgacatgagtcaatgattaaagatgagcgattacgtcgattaattgactttgattacggttggattgattatgca

SEQ ID NO: 23918 - DNA, 75 bp, Artificial Sequence
  Synthetic
aatacagaatccactactactaataacgctcagagtcccgtttctgaccctgtcaatgcaagtgctaacgtaaaa

SEQ ID NO: 23919 - DNA, 75 bp, Artificial Sequence
  Synthetic
agcgattacgtcgattaattgactttgattacggttggattgattatgcagttatgcttcagcgttatttagatg

SEQ ID NO: 23920 - DNA, 75 bp, Artificial Sequence
  Synthetic
aagggaatacgatcgaatccgctaacatacttcaatttgatggtgacttcgtcaataatataaaacatcctactc

SEQ ID NO: 23921 - DNA, 75 bp, Artificial Sequence
  Synthetic
acgtcaccagctggtacccacactgatgaatcagtgatgaagaaggaagatcatggagttattgttaatgaaagc

SEQ ID NO: 23922 - DNA, 75 bp, Artificial Sequence
  Synthetic
aaaagaacaatttcttagacattaaagttataaaggagtgcgaaacatacatcttgatgaaagatgataatggaa

SEQ ID NO: 23923 - DNA, 75 bp, Artificial Sequence
  Synthetic
acaacatttaaaattaattcagatgttgtctttgacgccgcagaggcaacttttgcagacacaagctccggtttg

SEQ ID NO: 23924 - DNA, 75 bp, Artificial Sequence
  Synthetic
agttataaaggagtgcgaaacatacatcttgatgaaagatgataatggaattcgagatcctgacatattacgtgc

SEQ ID NO: 23925 - DNA, 75 bp, Artificial Sequence
  Synthetic
tcctcattgctaaaaactaagatgaagttttgattatcgattagtcgattgtcttcgattctcatctcagaatga

SEQ ID NO: 23926 - DNA, 75 bp, Artificial Sequence
  Synthetic
ttgggaactcagttcaatacctgaaattattgaacttgacgttgatggcgagactaagaaatttaatttgagaaa

SEQ ID NO: 23927 - DNA, 75 bp, Artificial Sequence
  Synthetic
attattgaacttgacgttgatggcgagactaagaaatttaatttgagaaaagagatgattaagagaattcaggat

SEQ ID NO: 23928 - DNA, 75 bp, Artificial Sequence
  Synthetic
gagtttagaatcggtggttgatagggtcatccacgccctgtcctgctgacgaactctcgttcggagtccattgtt

SEQ ID NO: 23929 - DNA, 75 bp, Artificial Sequence
  Synthetic
gaggcaccagtatatttcttctgtaatccataccgttatgcagttgctaacttagatccaaacataccagaagtt

SEQ ID NO: 23930 - DNA, 75 bp, Artificial Sequence
  Synthetic
gtattaaaattcagcaattgtccaatttaggaaacattctgtttaagagttgacaaggtctcaatgaataatgga

SEQ ID NO: 23931 - DNA, 75 bp, Artificial Sequence
  Synthetic
cctgctgacgaactctcgttcggagtccattgttttgttagaggtgttgtagcgcctaggtaatttagaactgac

SEQ ID NO: 23932 - DNA, 75 bp, Artificial Sequence
  Synthetic
aggttgtggttagagtattttattggaagtgaagatttcttcggattcaatggaccaaatgttattgtatccaag

SEQ ID NO: 23933 - DNA, 75 bp, Artificial Sequence
  Synthetic
tgacaaggtctcaatgaataatggacaagcaacaattacaagaaatggaggaaggttcgaaatcaggtgtcgtca

SEQ ID NO: 23934 - DNA, 75 bp, Artificial Sequence
  Synthetic
tcactgcttgctgcaaaaaggtttgaagtagtggttaatcatttgaggaaggtagcagctttcgagttagatgca

SEQ ID NO: 23935 - DNA, 75 bp, Artificial Sequence
  Synthetic
gaatcaaaagaagtgatgaatgagtggattaaatatataatgatcgatccagtttacagatcatataagaataga

SEQ ID NO: 23936 - DNA, 75 bp, Artificial Sequence
  Synthetic
cactgagtgtgtgggctttgattatgtaagtagtggttttaagctaattgctaatgttaatgactttcaacattt

SEQ ID NO: 23937 - DNA, 75 bp, Artificial Sequence
  Synthetic
ggattaaatatataatgatcgatccagtttacagatcatataagaatagaggtgcttttggtaacttgaatcaac

SEQ ID NO: 23938 - DNA, 75 bp, Artificial Sequence
  Synthetic
aaacggtaactcaactctactcattggtaaaacgaagatcggaccgttaatattaaagaaagttagatcattgcc

SEQ ID NO: 23939 - DNA, 75 bp, Artificial Sequence
  Synthetic
atgtatttgctagaactaaaagtgaagggttatcttggtcgctaattgacatcggtactacaaattttgaattga

SEQ ID NO: 23940 - DNA, 75 bp, Artificial Sequence
  Synthetic
atcggtactacaaattttgaattgaaaccgacaaagaaagtggctggttcatacgtaaataaattcaatttagtt

SEQ ID NO: 23941 - DNA, 75 bp, Artificial Sequence
  Synthetic
ttgttgtaatgatgctttatttagaaatgaatttcgtattctcgcaaagatgcatggcatactacgattaaagaa

SEQ ID NO: 23942 - DNA, 75 bp, Artificial Sequence
  Synthetic
gacgatgtactggttgaggaatcgttgaaggatcttcgtaacgagggtctacataagatggctgatgtaacgcgt

SEQ ID NO: 23943 - DNA, 75 bp, Artificial Sequence
  Synthetic
tgacgttaacggccacaagtatggaattattctagaaaggtgttacaagccaaaaatcaatttctcaaatttcgt

SEQ ID NO: 23944 - DNA, 75 bp, Artificial Sequence
  Synthetic
aggatggtcgacgcagatataacaccggaaaatgtgaagaaagggaagttgaataggttggctttgtcttattgt

SEQ ID NO: 23945 - DNA, 75 bp, Artificial Sequence
  Synthetic
tacagccattaatgacttagatgtattccattctagtaatcaacacttgttacacggtgatgcaaatcctgataa

SEQ ID NO: 23946 - DNA, 75 bp, Artificial Sequence
  Synthetic
ggatacactggatcacattctgctactgccatggttaaacaattcaatggtacaaaggatttagatcctaattgc

SEQ ID NO: 23947 - DNA, 75 bp, Artificial Sequence
  Synthetic
tatcatgagtgatagtgaaggttacttgaaattggttgacccagtttgcttgcttgaaaatcaagtgaatatggt

SEQ ID NO: 23948 - DNA, 75 bp, Artificial Sequence
  Synthetic
gatccaatgttcgttgacatagtcaaggacaacatgagagtatatatgcaggaaggtcttcagaagtatcctcaa

SEQ ID NO: 23949 - DNA, 75 bp, Artificial Sequence
  Synthetic
aaatatagagtacgaatcgttaacccaagaagctgagaagaaagtatttatcaattcattactacagttagttga

SEQ ID NO: 23950 - DNA, 75 bp, Artificial Sequence
  Synthetic
ggatctaggaaaagtaataggttagatatcttattcaagggtggcacatcatctgctagtagtacaaatgagcat

SEQ ID NO: 23951 - DNA, 75 bp, Artificial Sequence
  Synthetic
gaaacaaatgtctgcaacgattgacgagatatatgtcaatttaaaagaagtaaacccatcgtttaatttagaaca

SEQ ID NO: 23952 - DNA, 75 bp, Artificial Sequence
  Synthetic
atctgctagtagtacaaatgagcatgctgtcgttaacggtagatttaggtatcggtctgaattataccgagagcg

SEQ ID NO: 23953 - DNA, 75 bp, Artificial Sequence
  Synthetic
tggcctgaaattgtctgatttgcttgataacattgatgtctacaactccgatcactggaagctaatgttaaatca

SEQ ID NO: 23954 - DNA, 75 bp, Artificial Sequence
  Synthetic
cgacgtgaattcatcaaccgtatttaagacagcaacgcctggccagtacagagtggtgaagaagatatctgctaa

SEQ ID NO: 23955 - DNA, 75 bp, Artificial Sequence
  Synthetic
tcgaccaatgatgcctgagctatcagtgcttaatgatttaacttactatgatactggtgaagtgagagatttggt

SEQ ID NO: 23956 - DNA, 75 bp, Artificial Sequence
  Synthetic
gcttaagagtaagaatgctaatatcgtaactcatccaatgaatttcattaatttcaaggttgatgacttagacat

SEQ ID NO: 23957 - DNA, 75 bp, Artificial Sequence
  Synthetic
taccgaagatctagatgatgaagatgacgtttaataacacaatatatatattcattgagactaaggaaactctta

SEQ ID NO: 23958 - DNA, 75 bp, Artificial Sequence
  Synthetic
gtaactcatccaatgaatttcattaatttcaaggttgatgacttagacatagttgttaacgcagggtcgagattg

SEQ ID NO: 23959 - DNA, 75 bp, Artificial Sequence
  Synthetic
gttaggggcactcgagcaaagcgtataataaccccgaactacgggacgatttatgcagcatcattaatgacagtg

SEQ ID NO: 23960 - DNA, 75 bp, Artificial Sequence
  Synthetic
acacagatgtacgacctgccacactactgtcgcccaaggtaatgtggtaaggcgttgggggttggcgctccctat

SEQ ID NO: 23961 - DNA, 75 bp, Artificial Sequence
  Synthetic
aggtaatgtggtaaggcgttgggggttggcgctccctatacttctgcggaatcatcacctgaatgaagaactgac

SEQ ID NO: 23962 - DNA, 75 bp, Artificial Sequence
  Synthetic
cttccagctgttagattgttgagttcgagggccagcaatatgggagctctaagtactcaaggaaggataggaact

SEQ ID NO: 23963 - DNA, 75 bp, Artificial Sequence
  Synthetic
aagtactcaaggaaggataggaactacgtatcatggggcattaccacatgatgttatggctcctcagttagccgt

SEQ ID NO: 23964 - DNA, 75 bp, Artificial Sequence
  Synthetic
tattggaagaggcaaaaacattcaagccagagtataaagcaattgcccaagtatatggtaaattcttcaaacggt

SEQ ID NO: 23965 - DNA, 75 bp, Artificial Sequence
  Synthetic
gacttccagtgatgatgtttcaaagatttgtgtagctaaggattttggccaatttgacaccagccagtggggtca

SEQ ID NO: 23966 - DNA, 75 bp, Artificial Sequence
  Synthetic
acattgttgaaaaagaatcatcagttattacgcctttcaaactcataaataatcaaattcttcttcatgatgatg

SEQ ID NO: 23967 - DNA, 75 bp, Artificial Sequence
  Synthetic
aatttgacaccagccagtggggtcagatatcaaaagctcacgcggatggagtacgttcgatgaaagctcattact

SEQ ID NO: 23968 - DNA, 75 bp, Artificial Sequence
  Synthetic
gatatcaaaagctcacgcggatggagtacgttcgatgaaagctcattactcaatgggacatgatactatagtaaa

SEQ ID NO: 23969 - DNA, 75 bp, Artificial Sequence
  Synthetic
acgaattaatcgattatggtagttcagaattcatatttcgacatatgttactgtgttacatcattcacaaacaag

SEQ ID NO: 23970 - DNA, 75 bp, Artificial Sequence
  Synthetic
cttagatttaaatgatgcttcattcgctgatttacttgaggtgacagctatgtcatatgaaagaccgttgaagta

SEQ ID NO: 23971 - DNA, 75 bp, Artificial Sequence
  Synthetic
agataaaaatcagtgagatgtataatatgacattttcacccgattacattgagtgtttgagctatcatttaactt

SEQ ID NO: 23972 - DNA, 75 bp, Artificial Sequence
  Synthetic
tatgacattttcacccgattacattgagtgtttgagctatcatttaacttcaattgttgaaatcgattttcatca

SEQ ID NO: 23973 - DNA, 75 bp, Artificial Sequence
  Synthetic
taagatgaatggtttagtttgcgaaagcgccggtgtcaagtcaggcgagttaacgacgcaaacccgcaatactac

SEQ ID NO: 23974 - DNA, 75 bp, Artificial Sequence
  Synthetic
taacgacgcaaacccgcaatactacaactaacatctcgcattcaacagtggctttagacgattataacaatcggg

SEQ ID NO: 23975 - DNA, 75 bp, Artificial Sequence
  Synthetic
gtaatatttgcaaaagataatgatattaagaaacagctgcagattcaggtatccgcttaagtagccatggagccg

SEQ ID NO: 23976 - DNA, 75 bp, Artificial Sequence
  Synthetic
ttagatcggaaggacgtcccacacccttccactatttcttcatcccgaatagcacgccgtatccaatttagaaca

SEQ ID NO: 23977 - DNA, 75 bp, Artificial Sequence
  Synthetic
cttatcgactgaatttgccaaaattggagctagttactgacaataaggtcggcgacgattcagttgaggttttaa

SEQ ID NO: 23978 - DNA, 75 bp, Artificial Sequence
  Synthetic
ttaaaattcatgtttttacatcatggcgtgggttacgcaagcgtatagttcgggattgtcacagagcagtattat

SEQ ID NO: 23979 - DNA, 75 bp, Artificial Sequence
  Synthetic
gagtggtagatggctcacctttgactccagaaattgctaagctgtatgttaattgcatgcaagatcatgctgata

SEQ ID NO: 23980 - DNA, 75 bp, Artificial Sequence
  Synthetic
tagtctgacaggtaatgacaggactgttgctgatggaacatttaattccatgattatgcctagagcagtaattgc

SEQ ID NO: 23981 - DNA, 75 bp, Artificial Sequence
  Synthetic
aattgcatgcaagatcatgctgataagaatcacctagagatatcagccaagagaacaattgtaggcaataacgta

SEQ ID NO: 23982 - DNA, 75 bp, Artificial Sequence
  Synthetic
taatgaacgtgaacattttatgaaaactagaatggataaaatcgaacatgacttaaatcgtagtactaaacagga

SEQ ID NO: 23983 - DNA, 75 bp, Artificial Sequence
  Synthetic
gctgagcatattaagatctgggtattcaaaggctatttagcgttagacgtatttttggacagtgtaacatctgaa

SEQ ID NO: 23984 - DNA, 75 bp, Artificial Sequence
  Synthetic
gatgatggatcgtcaatctttagctgatgattacaattcattgaatctggcgattggtcaggaggtaaaattgga

SEQ ID NO: 23985 - DNA, 75 bp, Artificial Sequence
  Synthetic
aagaacagtttctctaacttgaattatctggagcaagtgaatatattatatgatatggcaatgacgttgatgatc

SEQ ID NO: 23986 - DNA, 75 bp, Artificial Sequence
  Synthetic
tatagccactcagcatcaattaaacagactggggtcggcaatgtacaaggcggatcatgagcgtgagaccgaact

SEQ ID NO: 23987 - DNA, 75 bp, Artificial Sequence
  Synthetic
agatattgcagtgttcaggcatgtatgacgcagttttgtaatgatatgaagctgttgaatggcattagagctggt

SEQ ID NO: 23988 - DNA, 75 bp, Artificial Sequence
  Synthetic
gacggacttaattaatagaattcgtgagaatgaagttactgttaatgggatcttagagaatcagaaagctataac

SEQ ID NO: 23989 - DNA, 75 bp, Artificial Sequence
  Synthetic
gctgttgaatggcattagagctggtaattatacctttatcccaaccccaaagatcatatgtgcttatggtacgcc

SEQ ID NO: 23990 - DNA, 75 bp, Artificial Sequence
  Synthetic
tgctgctgagcgtgctgatttgttgttggaggttgtcgcttcaacagcaaaatcagtatcagcagcaggccgagc

SEQ ID NO: 23991 - DNA, 75 bp, Artificial Sequence
  Synthetic
tgaaatatgcctaagagcacctgaaattcgatcatttggtagatatctgccaattgatgaagatgaatattcagt

SEQ ID NO: 23992 - DNA, 75 bp, Artificial Sequence
  Synthetic
tgcggctgatggttcaggcgtcgtgccagtattcgggccaagtgttgctaacggcattaaagttggaattgacat

SEQ ID NO: 23993 - DNA, 75 bp, Artificial Sequence
  Synthetic
attgaatgacttggttgcatcactgagcactaacaaaccgaaaatggacttcgttgcccagatgttcgaacagaa

SEQ ID NO: 23994 - DNA, 75 bp, Artificial Sequence
  Synthetic
tgctgacagcgttgctgaagcagcaatcgctgtgaaggaatcagggattatcactcagttgaacgatgtatatca

SEQ ID NO: 23995 - DNA, 75 bp, Artificial Sequence
  Synthetic
tggtaatcaagtacatggtctatggctcgatcactttaaacgtaaaaatgatgttaatcctgatggaggtgggat

SEQ ID NO: 23996 - DNA, 75 bp, Artificial Sequence
  Synthetic
ctcgatcactttaaacgtaaaaatgatgttaatcctgatggaggtgggattcatatatctgaaggacttaaacgg

SEQ ID NO: 23997 - DNA, 75 bp, Artificial Sequence
  Synthetic
tgcttttcaaagcgtacatgtggcacctaatgatgttatcaagccagccgctgtagtggctggcacaagtactga

SEQ ID NO: 23998 - DNA, 75 bp, Artificial Sequence
  Synthetic
ctaatgccagaatactgcgaaagacatcttaatgagttagtatataaaacgctagatgataaagtaatccgtgat

SEQ ID NO: 23999 - DNA, 75 bp, Artificial Sequence
  Synthetic
attgattggtaatttacaagctatatatagtaggttgcgaagtcatagcgacattgggttcaagaaagccactgt

SEQ ID NO: 24000 - DNA, 75 bp, Artificial Sequence
  Synthetic
ttcacatctgatattattatcactaatatatgcaagggcaagttgagtaaagctcctaaactagcgtttttcgcc

SEQ ID NO: 24001 - DNA, 75 bp, Artificial Sequence
  Synthetic
tggagacattattcctaactcctatatggtgaagccagtcaactcgactgagtatgctccatggcagttatatgt

SEQ ID NO: 24002 - DNA, 75 bp, Artificial Sequence
  Synthetic
aatttctatctttcgttaactggctttaatggagtagactctccatacctgacagctgacgaaggagttaaaaac

SEQ ID NO: 24003 - DNA, 75 bp, Artificial Sequence
  Synthetic
tatacatcccgtccaagggtcgttgggaatggtggttcagatgatgggtgatacactaacgtacaatgtgtttgc

SEQ ID NO: 24004 - DNA, 75 bp, Artificial Sequence
  Synthetic
gttcacagagtcattggattatcatacagaaacacattgtcaactagtccgacggctaacgtagatagaatcctt

SEQ ID NO: 24005 - DNA, 75 bp, Artificial Sequence
  Synthetic
tcaatatggtactacttcagctaatgaatttggtaaaaccgtgctgactggtggcgctacaaatactgccttgga

SEQ ID NO: 24006 - DNA, 75 bp, Artificial Sequence
  Synthetic
gacggctaacgtagatagaatccttagaaataatcctggatctgctccagcttatttaactggtaatgatatact

SEQ ID NO: 24007 - DNA, 75 bp, Artificial Sequence
  Synthetic
aggaacaaaggtgaagtttcaaactaaagttacagctcaacaagcgttggcgttgacgatggcattaaaagacgc

SEQ ID NO: 24008 - DNA, 75 bp, Artificial Sequence
  Synthetic
cggcgttttgtctgattatccttatcaaaactggcgcaccgttgttgagttattggacatcacagaaccgtcagc

SEQ ID NO: 24009 - DNA, 75 bp, Artificial Sequence
  Synthetic
aacatcaatgttgtctcagggcgagttgataggatatttcgaacaatatataaatttagcgcttgaacctgacaa

SEQ ID NO: 24010 - DNA, 75 bp, Artificial Sequence
  Synthetic
cacagcgataattgaagtcgccacaaatcagatgcatgcatatttggcagataaggacctgaatactgcaaattt

SEQ ID NO: 24011 - DNA, 75 bp, Artificial Sequence
  Synthetic
cctgagtttgcaagataacatgcataagtatcaccaactattggcaagtcagaattcgcctattgattggaacta

SEQ ID NO: 24012 - DNA, 75 bp, Artificial Sequence
  Synthetic
atttgacaatacctcgcgcacttatgatatctctgaccgtacgtacccaaagtttgtgaacataacatctaattt

SEQ ID NO: 24013 - DNA, 75 bp, Artificial Sequence
  Synthetic
tcatgatgaagagatgcataagtggcttgatggtagaaaaattgtgaactatgatgctatgcaacggaagcacgg

SEQ ID NO: 24014 - DNA, 75 bp, Artificial Sequence
  Synthetic
atcaaatagtaacagacgcggttttcaacttgaagcaatgaaacatgtaatatacatggcaaggcgtggcatcgc

SEQ ID NO: 24015 - DNA, 75 bp, Artificial Sequence
  Synthetic
caacttgaagcaatgaaacatgtaatatacatggcaaggcgtggcatcgccacacttgctaatacgcacccaagt

SEQ ID NO: 24016 - DNA, 75 bp, Artificial Sequence
  Synthetic
taccattatagctgacattcatataccaaaggtgttcaatgatcttaggaataccacattgcactgtaaattgga

SEQ ID NO: 24017 - DNA, 75 bp, Artificial Sequence
  Synthetic
aagattggaaatactgtatattatgactattagaatacgattaactgattggatctactgaactcttagtgacct

SEQ ID NO: 24018 - DNA, 75 bp, Artificial Sequence
  Synthetic
aggcaaacagacaattgctggttatacggtatacgagtacatgattggaccttgggcgcattatggtgatatcga

SEQ ID NO: 24019 - DNA, 75 bp, Artificial Sequence
  Synthetic
cgattaactgattggatctactgaactcttagtgacctttgaactcttgaatgccttggatagtttagaactgac

SEQ ID NO: 24020 - DNA, 75 bp, Artificial Sequence
  Synthetic
gtataaaatttgtatccgatagtagcacatagattcacgatcacatccccgttattaaaattcaataattactac

SEQ ID NO: 24021 - DNA, 75 bp, Artificial Sequence
  Synthetic
ttattcagtggtagttgatacacttaacgaagagaccaagtggtattgtgagatcatcgggattgatggtcattt

SEQ ID NO: 24022 - DNA, 75 bp, Artificial Sequence
  Synthetic
agcaaaattcttatctgatgcctaggaagaaagatcaagtgacaaagaatgacgatggaaatcagactagtaacg

SEQ ID NO: 24023 - DNA, 75 bp, Artificial Sequence
  Synthetic
aatcatagagaagagtgttcaacataaaccagagaagattctcgagctcacagttgataacagtggtgtggcatc

SEQ ID NO: 24024 - DNA, 75 bp, Artificial Sequence
  Synthetic
tccagactcaagactttaaaacagccattcagcctgacactaatactgcacaactgatcaagacatattcaaatc

SEQ ID NO: 24025 - DNA, 75 bp, Artificial Sequence
  Synthetic
atttaaaaataggaatcatgaccgattgaagcttaaggtatatgttaaagattcattgtcagttaaaatctttag

SEQ ID NO: 24026 - DNA, 75 bp, Artificial Sequence
  Synthetic
caactgatcaagacatattcaaatccgaaacaacgtggagataaaggtgagataatctatgacggaggtttgagc

SEQ ID NO: 24027 - DNA, 75 bp, Artificial Sequence
  Synthetic
aaactggataggtatcaacgcaccaagggtgaagactaaaatgtttaacgatcatatcgcagtacggtatgacta

SEQ ID NO: 24028 - DNA, 75 bp, Artificial Sequence
  Synthetic
tctaagcttgctgatgtcgtagacaagacaactgaaccacataatgcagatggcgctgtgaaggatggaaggatt

SEQ ID NO: 24029 - DNA, 75 bp, Artificial Sequence
  Synthetic
ttcacattttgataagaacatatcaccagcacacctaactctaaatgatctaggctggcatacttgggatcagta

SEQ ID NO: 24030 - DNA, 75 bp, Artificial Sequence
  Synthetic
tggcgctgtgaaggatggaaggattgcaccagttaaattggatttggagaaacaaaaattggataagttgaagtt

SEQ ID NO: 24031 - DNA, 75 bp, Artificial Sequence
  Synthetic
atttgagacgtcaccatttgatccgctgacaatcaaaaacaatcaagatgttgtggataaattgtacgctactca

SEQ ID NO: 24032 - DNA, 75 bp, Artificial Sequence
  Synthetic
taatgcaggtaattggactaacattagaccttaatcatatcatcaatcttcggacatacgtaagcgtgggacacg

SEQ ID NO: 24033 - DNA, 75 bp, Artificial Sequence
  Synthetic
atcttcgtcaattcaagaggtcgtgccaacgaagaccttcgctacagagctccagtttggagttacttctgaaga

SEQ ID NO: 24034 - DNA, 75 bp, Artificial Sequence
  Synthetic
aacagtgataacctggtcggcggagctacaaatctgcttgtcaggggaaactggatgtactgatgggatttgacc

SEQ ID NO: 24035 - DNA, 75 bp, Artificial Sequence
  Synthetic
atggatcctgtatctgtagtacataattttgctaggagtcaaggcttgccgcttaactttgaaactgtgggttgt

SEQ ID NO: 24036 - DNA, 75 bp, Artificial Sequence
  Synthetic
catggctaagatttacggtgccgttgctgcagtgtcaaaaaatgtaaattcaagtgtgacatacgaagtaaagcg

SEQ ID NO: 24037 - DNA, 75 bp, Artificial Sequence
  Synthetic
caagtgtgacatacgaagtaaagcgtggtactcacgaattgattaaggtacccaccatccctcacaatctggtat

SEQ ID NO: 24038 - DNA, 75 bp, Artificial Sequence
  Synthetic
tgattcagtccgataatggtaaacacgcattgatcaaagaagatttaggacagtggccagttgaaacaggaattt

SEQ ID NO: 24039 - DNA, 75 bp, Artificial Sequence
  Synthetic
aaaagagaatggactattggaagaggcaaaaacattcaagccagagtataaagcaattgcccaagtatatggtaa

SEQ ID NO: 24040 - DNA, 75 bp, Artificial Sequence
  Synthetic
cactcgttaatcaagcgggcgtattcgctgtgcaattggctaataaattaggcattgataaaccttttgtgttag

SEQ ID NO: 24041 - DNA, 75 bp, Artificial Sequence
  Synthetic
atgctggatcgaattattttacagacactagcttcattgatacccgtaaatactgcactgatggtttatcaccac

SEQ ID NO: 24042 - DNA, 75 bp, Artificial Sequence
  Synthetic
aaggaatcatcagttattacgcctttcaaactcataaataatcaaattcttcttcatgatgatgacgaaacagtc

SEQ ID NO: 24043 - DNA, 75 bp, Artificial Sequence
  Synthetic
gtgaaattcaaaaggcattgaatagacaacgtgcatattacgacagaccagaactgactatctcagaaaataaga

SEQ ID NO: 24044 - DNA, 75 bp, Artificial Sequence
  Synthetic
gattatggtggttcagaattcatgtttcgacatatgttattgtgttacattatttacaaacaagagattaaagtc

SEQ ID NO: 24045 - DNA, 75 bp, Artificial Sequence
  Synthetic
cgttgctttcacagtctataatatatcccgacgctgatggtaatgatgtatccataatattcagcggagcgatgt

SEQ ID NO: 24046 - DNA, 75 bp, Artificial Sequence
  Synthetic
cacacgctatttttacttacgctcaaagtcaatggaacaaaaacatcatcaagttagatgattacatccgtgaga

SEQ ID NO: 24047 - DNA, 75 bp, Artificial Sequence
  Synthetic
taacgctcactgttccaaagcagtacaggcctagaagattcaaagaaatagagcatacgcatggttacgtctatc

SEQ ID NO: 24048 - DNA, 75 bp, Artificial Sequence
  Synthetic
atggaccacctggagactactggtcctgtgccgttaggtcccacgttgggactaggtcgccatgcatcttatgct

SEQ ID NO: 24049 - DNA, 75 bp, Artificial Sequence
  Synthetic
gtgagttaaatcaagggtcattacttccattagttgacgccaatttgaaggagtcttcgtcttattatttcaaga

SEQ ID NO: 24050 - DNA, 75 bp, Artificial Sequence
  Synthetic
agttgatgtctagtatcagtaatgtaccagttgatgcacgcacactacagtcagccacggctgccttggccgctg

SEQ ID NO: 24051 - DNA, 75 bp, Artificial Sequence
  Synthetic
gtaagtcgttatggaattatttagtgacagtggaagtatagtggaaaacttcaaggaaagaataaacaaactagt

SEQ ID NO: 24052 - DNA, 75 bp, Artificial Sequence
  Synthetic
acacaggtcaggcagtgaatagagcacaacatgtttcgatgttgacaaatagattgacaactgcaaatgccccga

SEQ ID NO: 24053 - DNA, 75 bp, Artificial Sequence
  Synthetic
gtttgattattcactaaaccatggaggatttcgtaagacgtacaaacttcaacgagatagagtgtattacatgct

SEQ ID NO: 24054 - DNA, 75 bp, Artificial Sequence
  Synthetic
ctgtacgagcgataacagttctaacgtgtatgttcaagcagtttaggattggtatgacatatgcgttagacccaa

SEQ ID NO: 24055 - DNA, 75 bp, Artificial Sequence
  Synthetic
tggtgatgcttatcaagcaaacttgtcaggtaagtgtctaatgttgttcaacagtgaaaaagatatttttgaagg

SEQ ID NO: 24056 - DNA, 75 bp, Artificial Sequence
  Synthetic
acatcatggacgtagccgctgccacctgtatgctgttgtttagaccagctcagtctatatctgatgaacaataca

SEQ ID NO: 24057 - DNA, 75 bp, Artificial Sequence
  Synthetic
cttaggattcaagagtaaggggtcaaaaatcaatgcttcaaagactcaaattttgagaaattacgaaattaactt

SEQ ID NO: 24058 - DNA, 75 bp, Artificial Sequence
  Synthetic
gatattgtctccagactatggctgtcttcttaactaacaccacatatgacattgtcaacaatgacactattgacg

SEQ ID NO: 24059 - DNA, 75 bp, Artificial Sequence
  Synthetic
cgaaacaatcattggtgtagaaccaaacggtttgaagtcaatttcaaatgctaaagatgttaagaagttatacga

SEQ ID NO: 24060 - DNA, 75 bp, Artificial Sequence
  Synthetic
ttttgaagatgaaactgaggaatcagggctggccatttgtcgagagatataatgcagttgaaattgatatgtcag

SEQ ID NO: 24061 - DNA, 75 bp, Artificial Sequence
  Synthetic
catatattcttataaaagtagtttaaatccattcgatgatttcaaatcacattgtaccgataggtgggggatgtc

SEQ ID NO: 24062 - DNA, 75 bp, Artificial Sequence
  Synthetic
tagaacctctgagatcacctggccaagttggtaggtattataacccatttaacattgacccattgactaagaagc

SEQ ID NO: 24063 - DNA, 75 bp, Artificial Sequence
  Synthetic
tttatcgccatctttggaacgtgtgatcaagagtgagataattagagttgggaacggcagcttgaatagaaactc

SEQ ID NO: 24064 - DNA, 75 bp, Artificial Sequence
  Synthetic
aacattgacccattgactaagaagcatgtggaggacagattagaagagttcatcaatcaagtgcaggtcggcaga

SEQ ID NO: 24065 - DNA, 75 bp, Artificial Sequence
  Synthetic
tgaattacataactacattcctactgttgaagcaagcttcagtgaaatgacgcgtggtccagcgaatgtcgcaat

SEQ ID NO: 24066 - DNA, 75 bp, Artificial Sequence
  Synthetic
ttccgtaatgcgtcaggtaacgctgtgggcacaacgttagctgccttcctgagagcttgtcgtgataagacgagt

SEQ ID NO: 24067 - DNA, 75 bp, Artificial Sequence
  Synthetic
gattgatggaaagttgatgactgatggtatctgcttcaggcctacattgtcgaaatcagttgaagatccaagact

SEQ ID NO: 24068 - DNA, 75 bp, Artificial Sequence
  Synthetic
gcaaactggagggggtatagtgtgttggtgtcaaggtacagaagtctgattcctaatgaactttttgagtcactt

SEQ ID NO: 24069 - DNA, 75 bp, Artificial Sequence
  Synthetic
taagaatgagttcagatcaaagggtttgattatggtgcatgactactttgtgttaattggtgagagcccaggccc

SEQ ID NO: 24070 - DNA, 75 bp, Artificial Sequence
  Synthetic
agaaacatcagcggtgagtacaacattaaccctcaagatgaacactcgtttttcttcgctctggcacaaataaac

SEQ ID NO: 24071 - DNA, 75 bp, Artificial Sequence
  Synthetic
acattataagaagtacgccaaaatgaatagagacaacactatattttgggatcctaggcgcaccgaccataagtt

SEQ ID NO: 24072 - DNA, 75 bp, Artificial Sequence
  Synthetic
ttgataaggaatcagctgagtatttagatgagtatgcaacattagctcgtgatatttcgaactccctaactttag

SEQ ID NO: 24073 - DNA, 75 bp, Artificial Sequence
  Synthetic
ccagaacattgtgagctatttcaagaatgagaacatacgcgacgtcgtcgaatatacagcgaatgctctaagtaa

SEQ ID NO: 24074 - DNA, 75 bp, Artificial Sequence
  Synthetic
ttaaagccgcctttggaccattagaaagaaccagcggtagtatcattaatcatgccaataatctgaataaggtta

SEQ ID NO: 24075 - DNA, 75 bp, Artificial Sequence
  Synthetic
aggattaaagccattggttcttattgatataagaaaagataaacccaagaatctgaatacgcctgagggagctat

SEQ ID NO: 24076 - DNA, 75 bp, Artificial Sequence
  Synthetic
aagaaccagcggtagtatcattaatcatgccaataatctgaataaggttattaaccacgtgttcgctgacagacc

SEQ ID NO: 24077 - DNA, 75 bp, Artificial Sequence
  Synthetic
attaatctctgagaccatgctgaagatactgacaattgacggtactacagggaaagatggatatagaaactggtt

SEQ ID NO: 24078 - DNA, 75 bp, Artificial Sequence
  Synthetic
cgaatgggaacggatggtacatgaagacaacaacctaataattgatatgattaatgctcttgatagtagagttac

SEQ ID NO: 24079 - DNA, 75 bp, Artificial Sequence
  Synthetic
agataagttggttggacataattatccagtatatgttgagccagttgttaacattatgaatttcatcagtgctcg

SEQ ID NO: 24080 - DNA, 75 bp, Artificial Sequence
  Synthetic
gatttgtgctaagttgcgacccgctttcatgaaggtaggtgacatgcgtaaactgctgagaccagtacgcattct

SEQ ID NO: 24081 - DNA, 75 bp, Artificial Sequence
  Synthetic
gtttgtagctgacagctcttattttggttatactaatgagatcatgatcatgccaaatcacattaacgttcctgt

SEQ ID NO: 24082 - DNA, 75 bp, Artificial Sequence
  Synthetic
accacttccatatttacgaaggtcaaccgctgaattcaacatgtttgtgccaaataaggagttgttaaatgggac

SEQ ID NO: 24083 - DNA, 75 bp, Artificial Sequence
  Synthetic
tgccaaatcacattaacgttcctgttgatgacaggtttggattcagggatagtcccttttgcacgtcgttgccta

SEQ ID NO: 24084 - DNA, 75 bp, Artificial Sequence
  Synthetic
ggaggtttatgatgttacatatgatgacttagtcaggatgtcaaacgaagtgtttgtgctcaaaaatataatagg

SEQ ID NO: 24085 - DNA, 75 bp, Artificial Sequence
  Synthetic
gaacaatcatgggtaatgacgttaggcgaatatcttataatgtattcagcatgatggaggatattgatgacgtga

SEQ ID NO: 24086 - DNA, 75 bp, Artificial Sequence
  Synthetic
cgggttgtacaatatgtatctaaaagaccagcacctgaatttaggagtcgtgaaccattctgtcaagttgtctga

SEQ ID NO: 24087 - DNA, 75 bp, Artificial Sequence
  Synthetic
ttagtgaaggcttcattctgtacgatgcatatttcaacttctcgtatgacatcatgactactgatggtgtaacta

SEQ ID NO: 24088 - DNA, 75 bp, Artificial Sequence
  Synthetic
tgcatatttcaacttctcgtatgacatcatgactactgatggtgtaactaggctgaaagaggacatacttatagt

SEQ ID NO: 24089 - DNA, 75 bp, Artificial Sequence
  Synthetic
tgaatcttctgctatatggagtctttcgaatagtaacaatgcgcgcatatctgacttcaactttaacaatttcat

SEQ ID NO: 24090 - DNA, 75 bp, Artificial Sequence
  Synthetic
cactgatactggcaatgatattaagcccattcacttctacatttattttgaaaatagaaacgataaaaagttgag

SEQ ID NO: 24091 - DNA, 75 bp, Artificial Sequence
  Synthetic
gtatgctgcaccatatagtgacttcactacactgattgttaatagacaattcaaaggaagaagctacagcgattg

SEQ ID NO: 24092 - DNA, 75 bp, Artificial Sequence
  Synthetic
atatgaatcaaaaatgaatgtcagttatagattgtacattaagactccggcttgcttgttaccactcagtgatta

SEQ ID NO: 24093 - DNA, 75 bp, Artificial Sequence
  Synthetic
gtgtcttactattctggacgaagtcaacttgagagacgatgtctatttggtaccactttacgcaatagttggcgg

SEQ ID NO: 24094 - DNA, 75 bp, Artificial Sequence
  Synthetic
catgcgagcgcaacatgattatgtgagtccaagttcatctagagtatacattaaagacccagctgtagtgtacac

SEQ ID NO: 24095 - DNA, 75 bp, Artificial Sequence
  Synthetic
tggtcagattacatctcatgactttgttaatgctattatcaccgatcaagaacagttgattgatttcactcagtc

SEQ ID NO: 24096 - DNA, 75 bp, Artificial Sequence
  Synthetic
acgagcataagcttgtgatgtgatgaaatgtggtggaatactatcttacgcttcataggtgtggttgccgacgtt

SEQ ID NO: 24097 - DNA, 75 bp, Artificial Sequence
  Synthetic
tgaaaaagcattatctactcaagttgtgaaattggtttcgttcatactgaaggattcatttacagcaaaaggttc

SEQ ID NO: 24098 - DNA, 75 bp, Artificial Sequence
  Synthetic
aaatgtggtggaatactatcttacgcttcataggtgtggttgccgacgttgcgtagtggacaaagagaactcgac

SEQ ID NO: 24099 - DNA, 75 bp, Artificial Sequence
  Synthetic
gaattggactgaaattgaccatgagattagaaatcgtagattagccagcttaagcggtgttgggttcacggtgac

SEQ ID NO: 24100 - DNA, 75 bp, Artificial Sequence
  Synthetic
gccgaacttttggcttctaagttgattgacagcagcagagaatcagatgaaagtaattcagatgtaccgttcgtt

SEQ ID NO: 24101 - DNA, 75 bp, Artificial Sequence
  Synthetic
aaagatgcttgatggtaaagtcttggttaatgataaagtcgtaacagtgagtggacatatgttatatatactact

SEQ ID NO: 24102 - DNA, 75 bp, Artificial Sequence
  Synthetic
caagcatacagcaaattcgctgatgataatccgcgtcatttgcgtgttaagacgggaggtaagatggctaatgca

SEQ ID NO: 24103 - DNA, 75 bp, Artificial Sequence
  Synthetic
tggtagtatattaggattaccttatggaataaagaaatacctgaaggagattgagttaaacatattgaagccagg

SEQ ID NO: 24104 - DNA, 75 bp, Artificial Sequence
  Synthetic
ctgactaacgtcattagatcatattatagtataaacgcaccagctattgtaccacaagttgaaattgatcgtttg

SEQ ID NO: 24105 - DNA, 75 bp, Artificial Sequence
  Synthetic
atcatcttatgagcgtggtgtaggtggacgagtatggcacgggctgatttctcactatctagctgttgattgcgt

SEQ ID NO: 24106 - DNA, 75 bp, Artificial Sequence
  Synthetic
gcttcaaaggctacggtttcaggtgacatgtacaattcatatgctatattcaacagtgttccaattgttgaagta

SEQ ID NO: 24107 - DNA, 75 bp, Artificial Sequence
  Synthetic
tagtgatgtcatcgatgaatacatggtatgtacgcatgatgatagaagtaaacttagcaatgtattgaagtatgt

SEQ ID NO: 24108 - DNA, 75 bp, Artificial Sequence
  Synthetic
cttagcccagcccaaactactgtgtcgatagtaggttcagatagagcagacgtcactatgctaaacactggagcc

SEQ ID NO: 24109 - DNA, 75 bp, Artificial Sequence
  Synthetic
aacttagcaatgtattgaagtatgtgaagagtaaattgttagaactcggttcaaagtatgatgtctatttgaatg

SEQ ID NO: 24110 - DNA, 75 bp, Artificial Sequence
  Synthetic
ggagctgcgaatataacgtttaattttggacagatagctgagacagttatacttaaaggttcagtccctttccaa

SEQ ID NO: 24111 - DNA, 75 bp, Artificial Sequence
  Synthetic
aagattagtattgtaaagtccagctgtcactattctaatttacataactgtcctgtgtggggattctcgtaacgg

SEQ ID NO: 24112 - DNA, 75 bp, Artificial Sequence
  Synthetic
taaattacaagaacctaacattgcaatggagatcttgagaacgaaatcacggtcagctgcagttgtcattggaat

SEQ ID NO: 24113 - DNA, 75 bp, Artificial Sequence
  Synthetic
ttagcacgcatgaatcagccaatgccagcagcccgttttacttacaagcttcgaccactggacggaccattcatc

SEQ ID NO: 24114 - DNA, 75 bp, Artificial Sequence
  Synthetic
tcctaagttcttcgatgaaaaggaaaaccgtgatgtcattgtgactgcttcggatttcaagcgtaacaatgcttt

SEQ ID NO: 24115 - DNA, 75 bp, Artificial Sequence
  Synthetic
gtcgttctaccagttggaaatccattggtgattagtgctactgcagcgacacgaattcaggtacctttggctttc

SEQ ID NO: 24116 - DNA, 75 bp, Artificial Sequence
  Synthetic
cattttcaaagattcaggtaactattttcttggtctagagaatatctttcgcaattcattagacgaactgaagga

SEQ ID NO: 24117 - DNA, 75 bp, Artificial Sequence
  Synthetic
aataaggctctagtcgaatctggttttcagacagcaatgaatgatggactattcgatattcagaatgttaattac

SEQ ID NO: 24118 - DNA, 75 bp, Artificial Sequence
  Synthetic
tatactagttttggctggtggttcaacatcaaagagtaagattacccaagctggactgtctcacatgataacatt

SEQ ID NO: 24119 - DNA, 75 bp, Artificial Sequence
  Synthetic
tattctagtttcgatgaattcatcatcgctcagtatcatgcacaggatggcataaacagagtttctacttgtgtt

SEQ ID NO: 24120 - DNA, 75 bp, Artificial Sequence
  Synthetic
tcttgaaaagttgtgccttagtgacgatgttggtgtgaataaagctttgagttttatagtctttcagatccatga

SEQ ID NO: 24121 - DNA, 75 bp, Artificial Sequence
  Synthetic
atcttgggattagctttacaagcatacgaccagatgcgtagagcattacccgtccgacgtgtgtagagcattcgt

SEQ ID NO: 24122 - DNA, 75 bp, Artificial Sequence
  Synthetic
tagttcacaacgtaaaggtggtgtctgcacattgttcgacattctgtacaattatctcgtgcaacgtgatcttaa

SEQ ID NO: 24123 - DNA, 75 bp, Artificial Sequence
  Synthetic
cgtccgacgtgtgtagagcattcgtgtgtcgtgtgtggctcgtcaccctcacgatgctcaacccaaccaaagaat

SEQ ID NO: 24124 - DNA, 75 bp, Artificial Sequence
  Synthetic
gctgattgttctattctgacattgtttggttttattcgagcattgtagggtggcccttgggagtgagccattagc

SEQ ID NO: 24125 - DNA, 75 bp, Artificial Sequence
  Synthetic
tcaagaaagtggctttctgagctacggcctatacaaagagaagaagtacatatatattaatgggaaaacagtgac

SEQ ID NO: 24126 - DNA, 75 bp, Artificial Sequence
  Synthetic
ggcccttgggagtgagccattagctcccaagtcctacgatgtgagatcaaggtgtggggatacaatttgaccgac

SEQ ID NO: 24127 - DNA, 75 bp, Artificial Sequence
  Synthetic
gtatttaaaatcatagattgaatatgttatcggagactgagttgagggctttgaaaaagttgagtacaacaacct

SEQ ID NO: 24128 - DNA, 75 bp, Artificial Sequence
  Synthetic
atatgtgtgtaagaatgttgatgctttaacaataaaagagttggccaattcaaaatcacacatgacatacgccga

SEQ ID NO: 24129 - DNA, 75 bp, Artificial Sequence
  Synthetic
tacaattggtagcttccgtaaaagtgctagtggtatggatgctgtgaccttcttgactataaagatggacgctat

SEQ ID NO: 24130 - DNA, 75 bp, Artificial Sequence
  Synthetic
ctagggttgttggagattcaactttagcgcttccttcaaatgttaaattaagtaaaggagaagttgaaaagatag

SEQ ID NO: 24131 - DNA, 75 bp, Artificial Sequence
  Synthetic
gcatacagcttcgatctttggcaagacgtataacataggtcagttgtactatcgacagttgaacgttgaagtcaa

SEQ ID NO: 24132 - DNA, 75 bp, Artificial Sequence
  Synthetic
ctgtaactaaaaaagagatgtttgatgaattggctcaatgtaatctgccaacaattgaattgattaccagagaac

SEQ ID NO: 24133 - DNA, 75 bp, Artificial Sequence
  Synthetic
tgaattggctcaatgtaatctgccaacaattgaattgattaccagagaacatacttttaatggtgacgttatccg

SEQ ID NO: 24134 - DNA, 75 bp, Artificial Sequence
  Synthetic
tacgctgaagaaagtgttgacaaacatcaatgatcactcacgagtcaaaatgcatggtaactctcgcgacgggtt

SEQ ID NO: 24135 - DNA, 75 bp, Artificial Sequence
  Synthetic
attcgcagcctggttattcttaatgaatggacaaaagttaatgattgcaaacaatgttgccgttaggatgggtat

SEQ ID NO: 24136 - DNA, 75 bp, Artificial Sequence
  Synthetic
tgttaaaaggcttgatgatgcaggtaagagtcgtgctacaggattaatccgagcgttggatcactccaattctat

SEQ ID NO: 24137 - DNA, 75 bp, Artificial Sequence
  Synthetic
gcaatatgctacaaatttagctggtaataacgttaaaattacatatgttacatcaaataatgttgtgaaattagg

SEQ ID NO: 24138 - DNA, 75 bp, Artificial Sequence
  Synthetic
acgtttcaagtcacttgggactggtagagacgagaagctatcgtatgtagtcgacagttgcttcatcaagaaaat

SEQ ID NO: 24139 - DNA, 75 bp, Artificial Sequence
  Synthetic
acacattgccgcaggtgtacttgctaatccttattctaataaaggaagtggactttttattacttatgaacataa

SEQ ID NO: 24140 - DNA, 75 bp, Artificial Sequence
  Synthetic
gcagaatggaagaggattatgtgtcaccatcgataatataaataaactgattgagcataaactagttcatgattg

SEQ ID NO: 24141 - DNA, 75 bp, Artificial Sequence
  Synthetic
cttgataagtaatcaaattgaaacgggcaaagtttgcgtcctattcataacatcgctttcaacaactgcatcatc

SEQ ID NO: 24142 - DNA, 75 bp, Artificial Sequence
  Synthetic
tgggattggacgttcatgcagttgtggtgcaaaagcatgtgatgatgagtcattacttaaccagttagaggaacg

SEQ ID NO: 24143 - DNA, 75 bp, Artificial Sequence
  Synthetic
taccaactcatttgcttattctgcttgtagtgttccaattgaggattgggatttcaacatggttaaactcactgc

SEQ ID NO: 24144 - DNA, 75 bp, Artificial Sequence
  Synthetic
tggtcatgatattgttgcaaatgctaaagaagctatgtcagctatgtgtgatgagattggtcagggtaataatag

SEQ ID NO: 24145 - DNA, 75 bp, Artificial Sequence
  Synthetic
tgtagtgttccaattgaggattgggatttcaacatggttaaactcactgctgaaactagctgcgcttcactcact

SEQ ID NO: 24146 - DNA, 75 bp, Artificial Sequence
  Synthetic
gctatgactaatttggttaattcgttagttcctggtgaaagaacgagaccagttggactttatgttgatatacct

SEQ ID NO: 24147 - DNA, 75 bp, Artificial Sequence
  Synthetic
tgtggtcagcactgtagatgcaaaattagatgataggattgtgcagaataagggatcacgctatatgtcagcgag

SEQ ID NO: 24148 - DNA, 75 bp, Artificial Sequence
  Synthetic
ggagtaactgtaacaaccagtgcatcatcgggttcattaccacttactactatcccagctgtaacaccactgata

SEQ ID NO: 24149 - DNA, 75 bp, Artificial Sequence
  Synthetic
tgtttacagatcacgtcagaatactgagtatcaggagccagccatcgtgaattcaaatactaatgcaacaacttc

SEQ ID NO: 24150 - DNA, 75 bp, Artificial Sequence
  Synthetic
tttagtgcttatacgaaacaagttgaagaagttggcgtcatcaacactttgtatgctttaagttatttgccttaa

SEQ ID NO: 24151 - DNA, 75 bp, Artificial Sequence
  Synthetic
agttagtaatgctgatggattcgcgaaaggtaaagaagatcatgatacagtagtaaatgataatcctacatttaa

SEQ ID NO: 24152 - DNA, 75 bp, Artificial Sequence
  Synthetic
gatgtggatgtgctaaagcttaggaaataatcatgatgtgtattcgaagtcgttcagctaagatgcgcacaatat

SEQ ID NO: 24153 - DNA, 75 bp, Artificial Sequence
  Synthetic
aatcaatactgatgtagtgttcgacgctgccgactcgattgttgcagacacaagctcaggtttatcctcattgtt

SEQ ID NO: 24154 - DNA, 75 bp, Artificial Sequence
  Synthetic
cgtgagctagttgcatggccggctttgccgtgcgctatgtttctggccggtatgtgtgactatctgaacagtcaa

SEQ ID NO: 24155 - DNA, 75 bp, Artificial Sequence
  Synthetic
taaaattcatgtttttgcatcatggcgtgggttacgcaagcatatagttcgggattgtcacagaacagtattatt

SEQ ID NO: 24156 - DNA, 75 bp, Artificial Sequence
  Synthetic
tttatcctcattgttaaagacaaaaatgaagttttgattatcaattggttgacggtcttcgattctcatctcaga

SEQ ID NO: 24157 - DNA, 75 bp, Artificial Sequence
  Synthetic
tgactatgtattcatcgatttacgaaatcgggggaagccaccccctgagagtagtaactgagtgatttgaccgac

SEQ ID NO: 24158 - DNA, 75 bp, Artificial Sequence
  Synthetic
gtatttaaaattgtgaggaaagaccaacatggatgtactgagtaagggttcgttgagagaattgttagctcattt

SEQ ID NO: 24159 - DNA, 75 bp, Artificial Sequence
  Synthetic
cgtgggttacgcaagcatatagttcgggattgtcacagaacagtattattagtctaacaggaaacgacagaactg

SEQ ID NO: 24160 - DNA, 75 bp, Artificial Sequence
  Synthetic
aatgaacgtgagcatttcatgaaaacgagaatagataaaattgaacatgacttaaatcgtagtgcaaagcaagag

SEQ ID NO: 24161 - DNA, 75 bp, Artificial Sequence
  Synthetic
ggaaaaaactccacttgaggaagcaatttcttacagaatcggaactgtaccatatcagaatgttttgataagtag

SEQ ID NO: 24162 - DNA, 75 bp, Artificial Sequence
  Synthetic
aaatgaatattacaaccaattgtacccagatacaacttcattaatcgatggtgtgtctagagaaggacagcgtaa

SEQ ID NO: 24163 - DNA, 75 bp, Artificial Sequence
  Synthetic
atgatggatcgccagtcactggccgaggattacaacgcattgaacttagctgttggtcaagagataaagttggac

SEQ ID NO: 24164 - DNA, 75 bp, Artificial Sequence
  Synthetic
cgtcaacggtttgataatgtcaatcatatcatacgtagtaagtgggtcaggacattacatacctaacattggttt

SEQ ID NO: 24165 - DNA, 75 bp, Artificial Sequence
  Synthetic
gtagcaactcagcaccaattgaacaggctaggatcagctatgtataaagcagatcatgaacgtgagactgaactg

SEQ ID NO: 24166 - DNA, 75 bp, Artificial Sequence
  Synthetic
atatcatacgtagtaagtgggtcaggacattacatacctaacattggttttatgctgctaagacgttcaatatta

SEQ ID NO: 24167 - DNA, 75 bp, Artificial Sequence
  Synthetic
actgacttaattaatagaattcgtgagaatgaggttactgtcaatggcatcttggaaaatcaaaaagctataact

SEQ ID NO: 24168 - DNA, 75 bp, Artificial Sequence
  Synthetic
gatattttaactaagcacgacactggactagttactaataatctaaattatggtataattgctcggaacttaact

SEQ ID NO: 24169 - DNA, 75 bp, Artificial Sequence
  Synthetic
gttagcaagatgaactatgaacaaaggaaaaggatgttgatttgtttcaaacttctagcatacaaggatggcaat

SEQ ID NO: 24170 - DNA, 75 bp, Artificial Sequence
  Synthetic
tagaggttgtcgcttctacagcaaaatcagtatctgcagcaggccgagccgcagctgatggttcaggtgttgtgc

SEQ ID NO: 24171 - DNA, 75 bp, Artificial Sequence
  Synthetic
cagaatgattacgaaatatacttaaatcaaaacataccattgaagcaaatagctccaaatttcattccaggtgac

SEQ ID NO: 24172 - DNA, 75 bp, Artificial Sequence
  Synthetic
cggtattaaagttggaattgatattgctgatagtgtcgcggaggctgcgatcgctgtcaaagagtcaggaattat

SEQ ID NO: 24173 - DNA, 75 bp, Artificial Sequence
  Synthetic
atgcgaactgtaatacataaccaagaccaacttgctatcgtaggtataccagcttacagattaactcaatccaca

SEQ ID NO: 24174 - DNA, 75 bp, Artificial Sequence
  Synthetic
gaactgtcaattcgtgacgacaacgccaagtcatataaattaggatacgtcgattggtacaacagtaattctttt

SEQ ID NO: 24175 - DNA, 75 bp, Artificial Sequence
  Synthetic
ctaatgatgttatcaagccagctgctgtagtggcgggaactagtactgagttgattggtaatttacaagcaatat

SEQ ID NO: 24176 - DNA, 75 bp, Artificial Sequence
  Synthetic
cgattggtacaacagtaattcttttctgcgtgaaagaagtgagtttaacttgattagactaaaagacagagatac

SEQ ID NO: 24177 - DNA, 75 bp, Artificial Sequence
  Synthetic
ctgcgtgaaagaagtgagtttaacttgattagactaaaagacagagatactaaatacggtaagttaaatggatgg

SEQ ID NO: 24178 - DNA, 75 bp, Artificial Sequence
  Synthetic
tgaacacattaaattaataaggcctgaaaagcctagatgacatacagagctgatgattcttgaaatcgagcttcg

SEQ ID NO: 24179 - DNA, 75 bp, Artificial Sequence
  Synthetic
tgattaaaccagtcaattcaactgaatatgcttcatggcaattatacgttatacatcctgttcaagggtcattag

SEQ ID NO: 24180 - DNA, 75 bp, Artificial Sequence
  Synthetic
gcttggttgttcaattgatgggtgatgcattaacttacaacgtttttgctcagtacggtactacctcagctagtg

SEQ ID NO: 24181 - DNA, 75 bp, Artificial Sequence
  Synthetic
aatttggaaaaactgtattgactggcggtgccacaaacaccgctttggaaggtacgaaggttaagtttcaaacca

SEQ ID NO: 24182 - DNA, 75 bp, Artificial Sequence
  Synthetic
gtattaaatttttgtaagtcgttatggaattatttagtgacagtggaagtatagtagaaaacttcaaggaaagaa

SEQ ID NO: 24183 - DNA, 75 bp, Artificial Sequence
  Synthetic
aggttacggctcaacaagctttagcgctgacgatggcgttgaaagacgcagcttctatgttatctcagggtgaat

SEQ ID NO: 24184 - DNA, 75 bp, Artificial Sequence
  Synthetic
taaacaaactggtgtttgattattcattaaaccatggaggatttcgtaaaacatacaaacttcagcgagacagag

SEQ ID NO: 24185 - DNA, 75 bp, Artificial Sequence
  Synthetic
tgataggatattttgaacaatatatcaacctagcgcttgagcctgataatttgagtttgcaagacaatatgcata

SEQ ID NO: 24186 - DNA, 75 bp, Artificial Sequence
  Synthetic
tgtattacatgcttggtgatgcttatcatgcgaacttgtcaggtaagtgtctaatgttgtttaacagtgaaaaag

SEQ ID NO: 24187 - DNA, 75 bp, Artificial Sequence
  Synthetic
agtatcatcatctgttgacaggtcaaaattcacctattgattggaactatcatgacgaagagatgcataagtggc

SEQ ID NO: 24188 - DNA, 75 bp, Artificial Sequence
  Synthetic
atatctttgaaggtttaggattcaagagtaaagggtcgaaaataaatgtttcaaaaacccaaatcctgagagatt

SEQ ID NO: 24189 - DNA, 75 bp, Artificial Sequence
  Synthetic
ttgatggccgcaagactacaaattatgatgcgatgcagaaaaaagatggtactgttatagccgatattcatatac

SEQ ID NO: 24190 - DNA, 75 bp, Artificial Sequence
  Synthetic
atgagattaacttcgaaacgatcattggtgtagaaccaaatggtctaaagtcaatttcaactgctaaggatgtta

SEQ ID NO: 24191 - DNA, 75 bp, Artificial Sequence
  Synthetic
ctaaagttttcaatgatcttagaaatactacattacactgcaaactggaaggcaaacagacaatcgctggatata

SEQ ID NO: 24192 - DNA, 75 bp, Artificial Sequence
  Synthetic
agaaattgtatgatatatatgtttataaaagtagtttaaatccatttgatgatttcaaatcgcattgcgtcgaca

SEQ ID NO: 24193 - DNA, 75 bp, Artificial Sequence
  Synthetic
tactacattacactgcaaactggaaggcaaacagacaatcgctggatatacagtgtatgaatatctgattggccc

SEQ ID NO: 24194 - DNA, 75 bp, Artificial Sequence
  Synthetic
ggtgggggatgtctttatcgccatctttggagagggtgcttaagagtgagataactagagttggaaatggtagct

SEQ ID NO: 24195 - DNA, 75 bp, Artificial Sequence
  Synthetic
taaatagaaattctgaattacacaattacatccctactgttgaagcaagctttagtgaaatgacacgcggtccag

SEQ ID NO: 24196 - DNA, 75 bp, Artificial Sequence
  Synthetic
ggtcatcgggatagatggtcatctgcttattgagaagagtgttcagcataaacctgaaaagattcttgaactaac

SEQ ID NO: 24197 - DNA, 75 bp, Artificial Sequence
  Synthetic
ccaatgttacaatgctagatgaaaagttgatagctgatggtgcttgctttggaccaacgttgtcaaagtcagttg

SEQ ID NO: 24198 - DNA, 75 bp, Artificial Sequence
  Synthetic
tgttaatgatagcggtgtagcatcatttaatggtaagaatcatgacagactgaagcttaaagtatacgtaaaaga

SEQ ID NO: 24199 - DNA, 75 bp, Artificial Sequence
  Synthetic
aagacccaagacttaagaacgagttcagatcgaaagggttgatcatggtgcatgattatttcgtgttaattggtg

SEQ ID NO: 24200 - DNA, 75 bp, Artificial Sequence
  Synthetic
ttcgttgtcagttaaagtttttagaaattggataggaattaatggcacctagagtaaaaaccaagatgtttaatg

SEQ ID NO: 24201 - DNA, 75 bp, Artificial Sequence
  Synthetic
taaagtttttagaaattggataggaattaatggcacctagagtaaaaaccaagatgtttaatgaaatcactagtg

SEQ ID NO: 24202 - DNA, 75 bp, Artificial Sequence
  Synthetic
agagtcccggcccacactacaagaaatacgctaaaatgaataaagacaacactatattttgggatccgaggcgta

SEQ ID NO: 24203 - DNA, 75 bp, Artificial Sequence
  Synthetic
tgaacaaattcgaagacagtcatttcaaacagttgaaaatcttttacacaaaaagtcaaactgatcatgttatca

SEQ ID NO: 24204 - DNA, 75 bp, Artificial Sequence
  Synthetic
ctgaccataagttcaagaacatcgtgagctacttcaagaatgagaacatacgtgacgttgttggatatacagcga

SEQ ID NO: 24205 - DNA, 75 bp, Artificial Sequence
  Synthetic
atgctctaagtaaaggattgaagccattagttctgatcgatataagaaaggataaacctaagaatcttaatacac

SEQ ID NO: 24206 - DNA, 75 bp, Artificial Sequence
  Synthetic
ctgaaggagctatcgaatgggaacgtatggtccacgaagacaataacttgataattgatatgattaatgctcttg

SEQ ID NO: 24207 - DNA, 75 bp, Artificial Sequence
  Synthetic
agcgattacgtcgattaattgactttgattacggttggattgattatgcagttgtacttcagcgttatttagatg

SEQ ID NO: 24208 - DNA, 75 bp, Artificial Sequence
  Synthetic
acaaaagagttacggtttgtgctaagttacgtccagctttcatgaaggtaggtgacatgcgcaaattgttgagac

SEQ ID NO: 24209 - DNA, 75 bp, Artificial Sequence
  Synthetic
cagtacgaattttaccgcttccatatttacggagatcgactgccgaattcaacatgtttgtgccaagcgaagaat

SEQ ID NO: 24210 - DNA, 75 bp, Artificial Sequence
  Synthetic
gttattgaacttgacgttgatggcgagactaagaaatttaatttgagaaaggagatgattaaaagaattcaggat

SEQ ID NO: 24211 - DNA, 75 bp, Artificial Sequence
  Synthetic
taataaatggaacggaggtttataatgttacatatgatgacttagtcagaatgtcaaatgaagtgttcgtactca

SEQ ID NO: 24212 - DNA, 75 bp, Artificial Sequence
  Synthetic
aaaacataataggtggattatacaatatgtatctaaaagaccagcacctaaatttaggagtcgtgaaccattctg

SEQ ID NO: 24213 - DNA, 75 bp, Artificial Sequence
  Synthetic
aggttgtggttagagtactttattggaagtgaagatttcttcggattcaatggaccaaatgttattgtatccaaa

SEQ ID NO: 24214 - DNA, 75 bp, Artificial Sequence
  Synthetic
tcaagttgtctgatgcatcttctgctatatggagcctttcaaatagtaacaatgtgcgtatatctaactttaatt

SEQ ID NO: 24215 - DNA, 75 bp, Artificial Sequence
  Synthetic
tcactgctggctgcaaaaaggtttgaagtagtagttaatcatttgaggaaagtagcagctttcgagttagatgct

SEQ ID NO: 24216 - DNA, 75 bp, Artificial Sequence
  Synthetic
ctaacaattttatgtatgccgcaccatacagtgatttcacgacattagttgttaacagacaattcaaaggaagga

SEQ ID NO: 24217 - DNA, 75 bp, Artificial Sequence
  Synthetic
gaatcaaaagaagtgatgaataagtggattaaatatataatgatcgatccagtttacaggtcatataagaataga

SEQ ID NO: 24218 - DNA, 75 bp, Artificial Sequence
  Synthetic
gttacagtgattggtgtcttactattttagatgaaattaacttgagagatggtgtctatttagtaccgctttacg

SEQ ID NO: 24219 - DNA, 75 bp, Artificial Sequence
  Synthetic
ggattaaatatataatgatcgatccagtttacaggtcatataagaatagaggtgctttcggcaacttgaatcaac

SEQ ID NO: 24220 - DNA, 75 bp, Artificial Sequence
  Synthetic
caatagtcgggggcggtcaggttacatcacacgattttgtcaatgccattatcactgatcaagagcagcttattg

SEQ ID NO: 24221 - DNA, 75 bp, Artificial Sequence
  Synthetic
atttcactcagtctgaaaaagcattatctactcaagttgtgaagttagtttcattcattctgaaggactcattca

SEQ ID NO: 24222 - DNA, 75 bp, Artificial Sequence
  Synthetic
gacgatgtactggttgaggaatcattgaaggatcttcgcaacgagggtctacataagatggctgatgtaacgcgc

SEQ ID NO: 24223 - DNA, 75 bp, Artificial Sequence
  Synthetic
cagcaaaaggtttgaattggactgaaattgacaacgagattagaagcaggagattaaacagtctaagcggtgttg

SEQ ID NO: 24224 - DNA, 75 bp, Artificial Sequence
  Synthetic
aggatgatcgacgcagatataacaccggaaaatgtaaagaaagggaagttgaataggttggctttatcttattgt

SEQ ID NO: 24225 - DNA, 75 bp, Artificial Sequence
  Synthetic
ggtttacagtgacgaagatgcttgatggtaaagtcttggttaatgataaggtcgtaacagtgagtgggcatatgt

SEQ ID NO: 24226 - DNA, 75 bp, Artificial Sequence
  Synthetic
tatatatactacttggtagcatattaggattgccctatggaataaagaaatatctgaaggagatcgagttaaaca

SEQ ID NO: 24227 - DNA, 75 bp, Artificial Sequence
  Synthetic
tattgaagccaggatcatcttacgaacgtggtgtaggcggacgagtatggcacggactaatttctcactatctag

SEQ ID NO: 24228 - DNA, 75 bp, Artificial Sequence
  Synthetic
ggatctagaaagagtaataggttagatatcttattcaagggtggcacatcatcagctagtagtacaaatgagcat

SEQ ID NO: 24229 - DNA, 75 bp, Artificial Sequence
  Synthetic
ctgttgattgcgttagcgatgttatcgatgagtatatggtatgtacatacgatgatagaaataaacttagtattg

SEQ ID NO: 24230 - DNA, 75 bp, Artificial Sequence
  Synthetic
atcagctagtagtacaaatgagcatgctgttgttaacggtaggtttaggtatcggtctgaattatacagagagcg

SEQ ID NO: 24231 - DNA, 75 bp, Artificial Sequence
  Synthetic
gatgatagaaataaacttagtattgtgttgaagtatgtgaagagtaaattactagaacttggtttaaagtatgac

SEQ ID NO: 24232 - DNA, 75 bp, Artificial Sequence
  Synthetic
gtctatttaaatgtagatgaaagattagtattgtaaagtccagctgtcactattctaatttacataactgtcctg

SEQ ID NO: 24233 - DNA, 75 bp, Artificial Sequence
  Synthetic
gtaactcatccaatgaatttcattaatttcaaggttgatgacttagatatagttgttaacgcaggatcgagattg

SEQ ID NO: 24234 - DNA, 75 bp, Artificial Sequence
  Synthetic
tgtggggattctcgtaaagggtgaagccacgggtggaacctgcaggcctggagttatggtgtaaggcgtctggtt

SEQ ID NO: 24235 - DNA, 75 bp, Artificial Sequence
  Synthetic
gccacgggtggaacctgcaggcctggagttatggtgtaaggcgtctggttgtgtctatggagggaaaccataggt

SEQ ID NO: 24236 - DNA, 75 bp, Artificial Sequence
  Synthetic
gtgtctatggagggaaaccataggtgcgctgggttcgttttgcagccatagccaaactgcacgagtggagccagg

SEQ ID NO: 24237 - DNA, 75 bp, Artificial Sequence
  Synthetic
cttccggctgttagattgttgagttcgagggccagcaacatgggagctttaagtactcaaggaaggataggaact

SEQ ID NO: 24238 - DNA, 75 bp, Artificial Sequence
  Synthetic
gtatttaaaattatagaaagttctgaacctaggggtctttctgtctctgctgtgtggtgggaatcacacggtctc

SEQ ID NO: 24239 - DNA, 75 bp, Artificial Sequence
  Synthetic
aagtactcaaggaaggataggaactacgtatcatggtgcattaccacatgatgtgatggctcctcagttagccgt

SEQ ID NO: 24240 - DNA, 75 bp, Artificial Sequence
  Synthetic
tgtgtggtgggaatcacacggtctctactaatcacatacgaatctgtaaaagaattcttacatgatgattgctct

SEQ ID NO: 24241 - DNA, 75 bp, Artificial Sequence
  Synthetic
tgcgctgggttcgttttgcagccatagccaaactgcacgagtggagccagggacctatgcaaaaatagaactgac

SEQ ID NO: 24242 - DNA, 75 bp, Artificial Sequence
  Synthetic
aacctaggggtctttctgtctctgctgtgtggtgggaatcacacggtctctactaatcacatacgaatctgtaaa

SEQ ID NO: 24243 - DNA, 75 bp, Artificial Sequence
  Synthetic
aattcaaatgaagaatatgaagtgcactttgaaggttgaagaaacggctgaaaatcatgaattggagggcgtttc

SEQ ID NO: 24244 - DNA, 75 bp, Artificial Sequence
  Synthetic
gatatcaaaagctcacgcggatggagtacgttcgatgaaagctcattactcaatgggacatgatactctggtaga

SEQ ID NO: 24245 - DNA, 75 bp, Artificial Sequence
  Synthetic
attcgatgaacttgctgctttgagagaagagaatgccaagttaaagaaggagaacgaaatcctgaagactaagat

SEQ ID NO: 24246 - DNA, 75 bp, Artificial Sequence
  Synthetic
tcatcgtctcgagagtgactggactacatctgacatcgtcgaaaaagtcgaactgatggatgctcaatttgacag

SEQ ID NO: 24247 - DNA, 75 bp, Artificial Sequence
  Synthetic
taagatgaatggtttagtttgtgaaagcgctggtgtcaagtctggcgagttaacgacgcaaacccgcaatactac

SEQ ID NO: 24248 - DNA, 75 bp, Artificial Sequence
  Synthetic
taacgacgcaaacccgcaatactacaactaatatctctcattcaaccgtggctttagacgattataacaatcgag

SEQ ID NO: 24249 - DNA, 75 bp, Artificial Sequence
  Synthetic
gattggaaagataatggataaaatgcgcgaaccgatgttattcaagcgtgatgacattgagttgcacggtgactt

SEQ ID NO: 24250 - DNA, 75 bp, Artificial Sequence
  Synthetic
gctagcgagggtcgagggtttgctacgcatcaagaatgaacgaagtgaggttgaattcgacaaggacatccagtg

SEQ ID NO: 24251 - DNA, 75 bp, Artificial Sequence
  Synthetic
cgcatcaagaatgaacgaagtgaggttgaattcgacaaggacatccagtgcatagttggaagatacttcagtgat

SEQ ID NO: 24252 - DNA, 75 bp, Artificial Sequence
  Synthetic
gagtggtagatagctcacctttgactccagagattgctaagctgtatgttaattgcatgcaagatcacgctgaca

SEQ ID NO: 24253 - DNA, 75 bp, Artificial Sequence
  Synthetic
gaagtgaagcaacgtaaccttgagaagatgataaaatcatttgagtatgatgacatcgctgataccattgctcta

SEQ ID NO: 24254 - DNA, 75 bp, Artificial Sequence
  Synthetic
aattgcatgcaagatcacgctgacaagaatcatctagagatatcagccaagaggacaattgtaggcaataatgta

SEQ ID NO: 24255 - DNA, 75 bp, Artificial Sequence
  Synthetic
tgacatcgctgataccattgctctacgtttgacttactttatccaggatccaggtctgcgttcaatagtgtatgc

SEQ ID NO: 24256 - DNA, 75 bp, Artificial Sequence
  Synthetic
tatgtgcaaagctgccgtacttaatcaaaactatctaaacattgaagtacaagaaatagttgatgtgacaaggca

SEQ ID NO: 24257 - DNA, 75 bp, Artificial Sequence
  Synthetic
aaagtatactcataatgcacgtgacgacattgatttttacccaatgttcactttcgatgccaatgttccagaggg

SEQ ID NO: 24258 - DNA, 75 bp, Artificial Sequence
  Synthetic
agtttttgatcatatatacaagaaacattatttgtcacctcagtcggcagcattggttcatacgctgtcgcatct

SEQ ID NO: 24259 - DNA, 75 bp, Artificial Sequence
  Synthetic
tgaaatatgcctaagagcgcctgaaattcgatcatttggtagatatttgccaattgatgaagatgagtattcagt

SEQ ID NO: 24260 - DNA, 75 bp, Artificial Sequence
  Synthetic
cgatgtgaatgttgatggaactggaatcgctttgtatcacattggatcagctactagatttgctgagtgttcggt

SEQ ID NO: 24261 - DNA, 75 bp, Artificial Sequence
  Synthetic
attgaatgaattggttgcatcactgagcactaacaaaccaaaaatggacttcgttgcccagatgttcgaacagaa

SEQ ID NO: 24262 - DNA, 75 bp, Artificial Sequence
  Synthetic
tggtaatcaagtacatggtatatggctcgatcactttaaacgcaaaaatgatgtcaatcctgatggaggcgggat

SEQ ID NO: 24263 - DNA, 75 bp, Artificial Sequence
  Synthetic
tgagtacaaaggtagagttgaaggattgctgttattgcatggcggattagcaccgataacgttagtgcgagttta

SEQ ID NO: 24264 - DNA, 75 bp, Artificial Sequence
  Synthetic
ctcgatcactttaaacgcaaaaatgatgtcaatcctgatggaggcgggattcatatatctgaaggactcaagcgg

SEQ ID NO: 24265 - DNA, 75 bp, Artificial Sequence
  Synthetic
tctccacattgatacgcaactgcatgctatacagttttgatgtctacttcactccaaatggaatctgtattaatg

SEQ ID NO: 24266 - DNA, 75 bp, Artificial Sequence
  Synthetic
tacacatctgacattattatcactaatatatgcaagggcaagttgagcaaagctcccaaactggcatttttcgcc

SEQ ID NO: 24267 - DNA, 75 bp, Artificial Sequence
  Synthetic
ctgttggtaacaacaatttagtcaacatcattgatatagattgttgtggtcgcgcattcggcaaagctcctttag

SEQ ID NO: 24268 - DNA, 75 bp, Artificial Sequence
  Synthetic
aatttctatctttcgttaactggctttaatggagtagactctccatacctgacagctgacgaaggagttagaaat

SEQ ID NO: 24269 - DNA, 75 bp, Artificial Sequence
  Synthetic
atcagggggcatggaatagaaataagttcatgggtcacaaacacggaaaaggatcaaagtgcaagcaatacaaga

SEQ ID NO: 24270 - DNA, 75 bp, Artificial Sequence
  Synthetic
gttcacagagttattggattatcatacagaaacacgttatcaactagtccgacggctaacgtagatagaatcctt

SEQ ID NO: 24271 - DNA, 75 bp, Artificial Sequence
  Synthetic
aattcagtacataaatattgcttacacggtcagtcatagacgtacgattaagatgcgaagaggacgtaaaaacac

SEQ ID NO: 24272 - DNA, 75 bp, Artificial Sequence
  Synthetic
gacggctaacgtagatagaatccttagaaacaatcctggatctgctccagcctatttaactggtaatgatatact

SEQ ID NO: 24273 - DNA, 75 bp, Artificial Sequence
  Synthetic
aaaaacgtacgtgtcaaaggtgattagggtttacaacaggtacagaatacttcatctcggcgtaatgatgacgtt

SEQ ID NO: 24274 - DNA, 75 bp, Artificial Sequence
  Synthetic
ctcagaacgtgagctgttgtgggcttgtcgggctccacatcggccgttcaggaaggcgtgagcttatggccgcct

SEQ ID NO: 24275 - DNA, 75 bp, Artificial Sequence
  Synthetic
gccttctgaggactgatttgttctccactggatggtggggtagcagggaatgaactggtggtataattgactgac

SEQ ID NO: 24276 - DNA, 75 bp, Artificial Sequence
  Synthetic
gtattaaaaattatatgttttcttgctgagtagcaacttgactgactccttctaagagaattttataaaaatcaa

SEQ ID NO: 24277 - DNA, 75 bp, Artificial Sequence
  Synthetic
gatgacgatccaagttcagaatttgaattgctgtccgggacgttttgtttgtgttcataagatgacactattgat

SEQ ID NO: 24278 - DNA, 75 bp, Artificial Sequence
  Synthetic
tatacttatcatttctgctgctgttacagttattgatcagttgtatcaaaaattaccttatgatgaacagactaa

SEQ ID NO: 24279 - DNA, 75 bp, Artificial Sequence
  Synthetic
gtacatcgtgtctaccattactgacgggataaacgctactattatatcaattatggctatttttggtttgaacaa

SEQ ID NO: 24280 - DNA, 75 bp, Artificial Sequence
  Synthetic
ttatggctatttttggtttgaacaacttgaacagagtaagatatagtaaactggatgaaaatggagtttattctc

SEQ ID NO: 24281 - DNA, 75 bp, Artificial Sequence
  Synthetic
aggagatggtgacaatgaatgtgcaatcagatgccgctaataataagacaaagctaaagaagaaacagaatgaag

SEQ ID NO: 24282 - DNA, 75 bp, Artificial Sequence
  Synthetic
atcagatgccgctaataataagacaaagctaaagaagaaacagaatgaagatgttgatgaagagaaaggattgta

SEQ ID NO: 24283 - DNA, 75 bp, Artificial Sequence
  Synthetic
tcctaatctgaaattgactgagccaacagcaccaatgattcataattatatgtacgatcacaaaacacaacaagc

SEQ ID NO: 24284 - DNA, 75 bp, Artificial Sequence
  Synthetic
acagcaccaatgattcataattatatgtacgatcacaaaacacaacaagcgtacttgttgacagaacatcaaatt

SEQ ID NO: 24285 - DNA, 75 bp, Artificial Sequence
  Synthetic
tgtacgatcacaaaacacaacaagcgtacttgttgacagaacatcaaattgaacagataaaacaaaacagtgttg

SEQ ID NO: 24286 - DNA, 75 bp, Artificial Sequence
  Synthetic
accctaataatacaccaaagattgaagtaaggagtcagttctaaccgtctattttgcaggagaggaggtaccgag

SEQ ID NO: 24287 - DNA, 75 bp, Artificial Sequence
  Synthetic
attttgcaggagaggaggtaccgagttctgggactcacgtccatcgccactttacttggttacaacctcacggtg

SEQ ID NO: 24288 - DNA, 75 bp, Artificial Sequence
  Synthetic
tttacttggttacaacctcacggtgtgacaaggtgaaacatgactcgtcttcgtgtgctaatggtgtgtgctgct

SEQ ID NO: 24289 - DNA, 75 bp, Artificial Sequence
  Synthetic
gccactggccgttgatgaccatgtggaactgagcttgctcaggccgactcacattaagtataatttagaactgac

SEQ ID NO: 24290 - DNA, 75 bp, Artificial Sequence
  Synthetic
gtattaaaaattgatagtgtttgcgtaagagtaagatcttaagatggatcctgtatctgtagtacataatttcgc

SEQ ID NO: 24291 - DNA, 75 bp, Artificial Sequence
  Synthetic
gataatgacgaatcaatcgattatggtagttcagaattcatgtttcgacatatgttactgtgttacatcattcac

SEQ ID NO: 24292 - DNA, 75 bp, Artificial Sequence
  Synthetic
gtagttcagaattcatgtttcgacatatgttactgtgttacatcattcacaaacgagagattaaagtcagtgaga

SEQ ID NO: 24293 - DNA, 75 bp, Artificial Sequence
  Synthetic
ttaacttcaattgttgaaatcgaatttcatcaccaagattgtggtagtttaagcattgtaatatttgcaaaagat

SEQ ID NO: 24294 - DNA, 75 bp, Artificial Sequence
  Synthetic
cgccatgcatcttatgctactaggatgtaaggtttagatcggaaggacgtcccacacccttccactatttcttca

SEQ ID NO: 24295 - DNA, 75 bp, Artificial Sequence
  Synthetic
gatcggaaggacgtcccacacccttccactatttcttcatcccgaatagcacgccgtatccaatttagaactgac

SEQ ID NO: 24296 - DNA, 75 bp, Artificial Sequence
  Synthetic
gtattaaaaattacaagaacctaacatcgcaatggagatcttgagaacgaaatcgcagtcagctgcagtggtcat

SEQ ID NO: 24297 - DNA, 75 bp, Artificial Sequence
  Synthetic
atcgcaatggagatcttgagaacgaaatcgcagtcagctgcagtggtcattggaattccaaaattcttcgatgag

SEQ ID NO: 24298 - DNA, 75 bp, Artificial Sequence
  Synthetic
aaggaaaaccgtgatgtcattgtgactgcttcggatttcaaacgtaacaatgctttcattttcaaagattctggt

SEQ ID NO: 24299 - DNA, 75 bp, Artificial Sequence
  Synthetic
aactattttcttggtctggagaacatttttcgtaattcacttgatgaattgaaagatatactgattttagctggt

SEQ ID NO: 24300 - DNA, 75 bp, Artificial Sequence
  Synthetic
ggctcagtgtcaaaaagtaagattactcaagctggattgtcacatatgataacttttctcgaaaagttgtgttta

SEQ ID NO: 24301 - DNA, 75 bp, Artificial Sequence
  Synthetic
agcgataatgttggtgtgaataaagccttgagctttatagtcttccagatacatgatagctctcaacgtagaggt

SEQ ID NO: 24302 - DNA, 75 bp, Artificial Sequence
  Synthetic
ggtgtatgtacactgttcgacattctgtacaactatcttgtgcaacgtgagctcaatcaagagagtggctttcta

SEQ ID NO: 24303 - DNA, 75 bp, Artificial Sequence
  Synthetic
agctacggcttgtataaagaaaagaagtacatatacatcaacggcaagacagtgacgtatgtatgcaagaatgtt

SEQ ID NO: 24304 - DNA, 75 bp, Artificial Sequence
  Synthetic
gacgctctgactatcaaggagttggctaattcgaaatcacacatgacgtatgctgatactattggaagctttcgc

SEQ ID NO: 24305 - DNA, 75 bp, Artificial Sequence
  Synthetic
aaaagtactagtggcatggacgcagtgactttcttgacagttaaaatggataccactcacaccgcttcaattttt

SEQ ID NO: 24306 - DNA, 75 bp, Artificial Sequence
  Synthetic
ggaaagacatacaatattggacaactatattatagacaacttaacgtcgaagtcaacacgttgaagaaggtactc

SEQ ID NO: 24307 - DNA, 75 bp, Artificial Sequence
  Synthetic
gcgaacatcaatgatcattccagagttaagatgcatggtaattcgcgagacggatttgtgaaacggctcgatgat

SEQ ID NO: 24308 - DNA, 75 bp, Artificial Sequence
  Synthetic
gcagggaaaagtcgtgcaactggtttgattcgtgcattagatcattctaattccatacgattcaaatcacttggt

SEQ ID NO: 24309 - DNA, 75 bp, Artificial Sequence
  Synthetic
gctggtagagacgagaaactatcatacgttgttgatggctgtttcatcaagaaaatgcagaatgggcgcggcttg

SEQ ID NO: 24310 - DNA, 75 bp, Artificial Sequence
  Synthetic
tgcgttaccattgataacataaataaactgattgagcataagctagttcatgattgtggtattggacgttcatgc

SEQ ID NO: 24311 - DNA, 75 bp, Artificial Sequence
  Synthetic
agttgtggtgctaaggcatgtgatgatgattcacttcttaatcaattagaagagcgtggccatgacatcattgct

SEQ ID NO: 24312 - DNA, 75 bp, Artificial Sequence
  Synthetic
aacgctaaagaatccatgtcagctatgtgtgatgagagtgaacctgagaccatcagtgctgtacctaacgcggat

SEQ ID NO: 24313 - DNA, 75 bp, Artificial Sequence
  Synthetic
gcaaaattggatgacagaattgtgcagaataaaggatcacgctacatgtcagctagcgtatacagatcacgcaac

SEQ ID NO: 24314 - DNA, 75 bp, Artificial Sequence
  Synthetic
aatcctgagtttaacgctacaaatgacgttcagataccgacttcaagtgttggtgtaacttccaggaacaacagt

SEQ ID NO: 24315 - DNA, 75 bp, Artificial Sequence
  Synthetic
accgatgtacaagatgcagagaaggatggtcatgcagtagcagccggtgagagtaccacttttaagatcaattct

SEQ ID NO: 24316 - DNA, 75 bp, Artificial Sequence
  Synthetic
gacgttgtgtttgatgctgccgactcaattgttgcagacgctaaatctggtttgtcctcattgttgaagacgaag

SEQ ID NO: 24317 - DNA, 75 bp, Artificial Sequence
  Synthetic
atgaagttttgattattaaatagttgattgtcttcgattctcatctcagagtgtgagtttagaatcggtggttga

SEQ ID NO: 24318 - DNA, 75 bp, Artificial Sequence
  Synthetic
tagggtcatccacgccctgtcctgctgacgaactctcattcagagtcctatgttttgttagaggtgttgtagcac

SEQ ID NO: 24319 - DNA, 75 bp, Artificial Sequence
  Synthetic
cctgctgacgaactctcattcagagtcctatgttttgttagaggtgttgtagcacctaggtaatttagaactgac

SEQ ID NO: 24320 - DNA, 75 bp, Artificial Sequence
  Synthetic
gtattaaaattcatcgaactgtccaatttaggaaacattctgtttaagagttgacgaagtctcaatgaacaatgg

SEQ ID NO: 24321 - DNA, 75 bp, Artificial Sequence
  Synthetic
acaagcaacaattgcaagaatcggaggaaactttgaaatccggtgtcgtcacttggaccgtgactacaccatgcc

SEQ ID NO: 24322 - DNA, 75 bp, Artificial Sequence
  Synthetic
tcactgagtgtgtgggctttgattatgtgagtagtggttttaagttaagtgctaatgttaatgattttcaacatc

SEQ ID NO: 24323 - DNA, 75 bp, Artificial Sequence
  Synthetic
taaatggtaactcaactttactaatcggtaggactaagatcggaccattgatattgaagaaagttagatcattac

SEQ ID NO: 24324 - DNA, 75 bp, Artificial Sequence
  Synthetic
catgttgtaatgacgctttatttaggaacgaatttcgtattctcgcgaagatgcatggtatactgagattaaaga

SEQ ID NO: 24325 - DNA, 75 bp, Artificial Sequence
  Synthetic
atgacattaacggacataagtatggaattattctagaacgttgttataaaccaagaatcaacttttccaatttcg

SEQ ID NO: 24326 - DNA, 75 bp, Artificial Sequence
  Synthetic
taactgcaattaacgatttagaaacgttccactctagtaatccacatttgctgcacggcgatgctaatcctgata

SEQ ID NO: 24327 - DNA, 75 bp, Artificial Sequence
  Synthetic
acataatgagtgatggtgatggctatctaaagttagttgatccagtttgtttgctcgaaaaccaagtaaatatgg

SEQ ID NO: 24328 - DNA, 75 bp, Artificial Sequence
  Synthetic
tgaatatagattatgaatcattgactcaggatgccgagaagaaagtgttcgttaaatcactattactattagttg

SEQ ID NO: 24329 - DNA, 75 bp, Artificial Sequence
  Synthetic
agaagcagttgtcagcatcaatggatgagatatatgttaatctgaaagaaacaaacccatcttttaacctagaat

SEQ ID NO: 24330 - DNA, 75 bp, Artificial Sequence
  Synthetic
gtggtttgaaactgactgatttactcgataacatagatatatatagttcagaccactggaagttgatgttgaatc

SEQ ID NO: 24331 - DNA, 75 bp, Artificial Sequence
  Synthetic
atcgaccaatgatgcccgaactatcagtacttaatgatttgacctattatgatactggtgatgtgaaggatttag

SEQ ID NO: 24332 - DNA, 75 bp, Artificial Sequence
  Synthetic
gatactggtgatgtgaaggatttagttaccgaggatctagatgatgaagatgacgtttgataatatgacaaagat

SEQ ID NO: 24333 - DNA, 75 bp, Artificial Sequence
  Synthetic
gttcactgagactaagaagactcttaacacaggtgtacgacctgccacgttactgtcgcccaaggtatcgtggta

SEQ ID NO: 24334 - DNA, 75 bp, Artificial Sequence
  Synthetic
aggtatcgtggtaaggcgttgggggttggcgctccctatacttctgcggaatcattgactgaatgaagaactgac

SEQ ID NO: 24335 - DNA, 75 bp, Artificial Sequence
  Synthetic
ggaaaaaactccacttgaggaagcagtttcttacagaatcggaactgtaccatatcagaatgttttgataaatag

SEQ ID NO: 24336 - DNA, 75 bp, Artificial Sequence
  Synthetic
ctgcgtgaaagaagtgagtttaacttgattagactaaaagacagagataccaaatatggtaagttaaatggatgg

SEQ ID NO: 24337 - DNA, 75 bp, Artificial Sequence
  Synthetic
tatacttatcatttctgctgctgttacagtcattgatcagttatatcaaaaattaccttatgatgaacaaactaa

SEQ ID NO: 24338 - DNA, 75 bp, Artificial Sequence
  Synthetic
aggagatgttgccaatgaatgtacaatcagatgctgctaataatgaaacaaagctaaagaagaaacggaatgaag

SEQ ID NO: 24339 - DNA, 75 bp, Artificial Sequence
  Synthetic
atcagatgctgctaataatgaaacaaagctaaagaagaaacggaatgaagatgttgacaaagagaaaggattgta

SEQ ID NO: 24340 - DNA, 75 bp, Artificial Sequence
  Synthetic
tgtacgatcacaaaacacaacaagcgtacttgttgacagaacatcaaatcgagcagataaaacaaaacagtgttg

SEQ ID NO: 24341 - DNA, 75 bp, Artificial Sequence
  Synthetic
tttacttggttacaacctcacggtgtgacaaggtgaagcatgactcatcttcgtgtgctaatggtgtgtgctgct

SEQ ID NO: 24342 - DNA, 75 bp, Artificial Sequence
  Synthetic
cattcaagccagagtataaagcaattgcccaattatatggtaaattctttaaacggtacattgttgaaaaagaat

SEQ ID NO: 24343 - DNA, 75 bp, Artificial Sequence
  Synthetic
acttggaccgtgactacaccatgccactaccaaatgctactagtactgataattttcttgattgtattaagttta

SEQ ID NO: 24344 - DNA, 75 bp, Artificial Sequence
  Synthetic
actaccaaatgctactagtactgataattttcttgattgtattaagtttatcactgagtgtgtgggctttgatta

SEQ ID NO: 24345 - DNA, 75 bp, Artificial Sequence
  Synthetic
tcactgagtgtgtgggctttgattatgtaagtagtggtttcaagttaagtgctaacgttaatgattttcaacatc

SEQ ID NO: 24346 - DNA, 75 bp, Artificial Sequence
  Synthetic
taaacggtaactcaactttactaatcggtaggacaaagatcggaccattgatattgaagaaagttagatcattac

SEQ ID NO: 24347 - DNA, 75 bp, Artificial Sequence
  Synthetic
catgttgcaatgacgctttatttaggaacgaatttcgtattcttgcgaagatacatggcatactgagattaaaga

SEQ ID NO: 24348 - DNA, 75 bp, Artificial Sequence
  Synthetic
atgacgttaacgggcataagtatggaattattctagaacgttgctataaaccaagaatcaatttttcaaactttg

SEQ ID NO: 24349 - DNA, 75 bp, Artificial Sequence
  Synthetic
acatcatgagtgatagtaatggatatctaaagttagttgatccagtttgcttgctcgaaaaccaagtaaatatgg

SEQ ID NO: 24350 - DNA, 75 bp, Artificial Sequence
  Synthetic
tgaatatagattatgaatcattaactcaggaagccgagaagaaagtattcgttaaatcattattactattagttg

SEQ ID NO: 24351 - DNA, 75 bp, Artificial Sequence
  Synthetic
agaagcagttgtcagcatcaatggatgagatatatgtcaatctaaaagaaacaaacccatcctttaatctagaat

SEQ ID NO: 24352 - DNA, 75 bp, Artificial Sequence
  Synthetic
gtggtttgaaactgactgatttactcgctaacatagatgtatatagttcagatcactggaagttaatgttgaatc

SEQ ID NO: 24353 - DNA, 75 bp, Artificial Sequence
  Synthetic
atcgaccaattatgcctgagttatcagtgcttaatgatttaacctattatgatactggtgatgtgaaggatttag

SEQ ID NO: 24354 - DNA, 75 bp, Artificial Sequence
  Synthetic
gatactggtgatgtgaaggatttagttaccgaggatcttgatgatgaagatgacgtttgataatataacaaagat

SEQ ID NO: 24355 - DNA, 75 bp, Artificial Sequence
  Synthetic
tcagcctttctcgataaccctcatccagtcggagtcaactatgttgatgaagggtctcgacaattcgttgcagtc

SEQ ID NO: 24356 - DNA, 75 bp, Artificial Sequence
  Synthetic
gctgaacttttggcttctaagctaattgatagcagcagagaatcagatgaaagtaattcagatgtaccgttcgtc

SEQ ID NO: 24357 - DNA, 75 bp, Artificial Sequence
  Synthetic
caggcatatagcaagtttgctgatgataatccacgtcacttgcgtgttaagacgggaggtaagatggctaatgca

SEQ ID NO: 24358 - DNA, 75 bp, Artificial Sequence
  Synthetic
ctaactaacgtcattagatcatattacagtataaacgcaccagctattgtgccacaagtggaaattgatcgttta

SEQ ID NO: 24359 - DNA, 75 bp, Artificial Sequence
  Synthetic
gcttcaaaggctacggtttcaggtgacatgtataattcgtatgctatattcaacagtgttccaattgttgaagta

SEQ ID NO: 24360 - DNA, 75 bp, Artificial Sequence
  Synthetic
ctcagcccagcacaaactactgtctcaatagtaggttcagatcgagcagatgttactatgcttaacaccggggcc

SEQ ID NO: 24361 - DNA, 75 bp, Artificial Sequence
  Synthetic
ggagccgcaaatataacatttaactttggacagatagttgaaacggttgtacttaaaggttcagtccctttccaa

SEQ ID NO: 24362 - DNA, 75 bp, Artificial Sequence
  Synthetic
ttagcacgtttgaatcagccgatgccagcggcccgctttacttacaagcttcgaccactggacggaccgttcatc

SEQ ID NO: 24363 - DNA, 75 bp, Artificial Sequence
  Synthetic
gtcgtgttcccagttgggaatcctttggtgattagtgctactgcagcgacacgtatccaagtacctctggctttc

SEQ ID NO: 24364 - DNA, 75 bp, Artificial Sequence
  Synthetic
aacaaggctttagttgaatctggtttccaaacggcaatgaatgatggactattcgatattcagaatgttaattac

SEQ ID NO: 24365 - DNA, 75 bp, Artificial Sequence
  Synthetic
tattctagtttcgatgaattcatcatcgctcaatatcatgcacaagatggcataaatagagtttctacttgtgtt

SEQ ID NO: 24366 - DNA, 75 bp, Artificial Sequence
  Synthetic
attttgggattagctttacaggcatatgaccagatgcgtagagcattacctgtccggcgtgtgtagagcattcgt

SEQ ID NO: 24367 - DNA, 75 bp, Artificial Sequence
  Synthetic
tgtccggcgtgtgtagagcattcgtgtgtggctcgtcaccctcacgatgctcaaccaagccaaagaatgctgatt

SEQ ID NO: 24368 - DNA, 75 bp, Artificial Sequence
  Synthetic
ctgtaactaaaaaggagatgtttgatgaattggctcaatgtaatttaccaacaattgaattgattactagagaac

SEQ ID NO: 24369 - DNA, 75 bp, Artificial Sequence
  Synthetic
tgaattggctcaatgtaatttaccaacaattgaattgattactagagaacacacttttaatggtgacgtcatccg

SEQ ID NO: 24370 - DNA, 75 bp, Artificial Sequence
  Synthetic
taccaactcatttgcctactccgcttgcagtgttccaattgaggattgggacttcaacatgattaaactcactgc

SEQ ID NO: 24371 - DNA, 75 bp, Artificial Sequence
  Synthetic
tgcagtgttccaattgaggattgggacttcaacatgattaaactcactgctgaaactagctgtgcttcacttact

SEQ ID NO: 24372 - DNA, 75 bp, Artificial Sequence
  Synthetic
gtataaaatttgtatccgatagtagcacatagattcacgatcacatccccgttcttaaaattcaataattattac

SEQ ID NO: 24373 - DNA, 75 bp, Artificial Sequence
  Synthetic
cacatagattcacgatcacatccccgttcttaaaattcaataattattacagcaaaattcttatctgatgcctag

SEQ ID NO: 24374 - DNA, 75 bp, Artificial Sequence
  Synthetic
gaagaaagatcaagtgacaaagaatgacgatggaaatcagaccagtgacgtccagactcaagactttaaaacggc

SEQ ID NO: 24375 - DNA, 75 bp, Artificial Sequence
  Synthetic
tgttcagcccgacactaatactgcacaactgatcaagacatattcaaatccgaaacaacgtggagacaaaggtga

SEQ ID NO: 24376 - DNA, 75 bp, Artificial Sequence
  Synthetic
caactgatcaagacatattcaaatccgaaacaacgtggagacaaaggtgagataatatacgacggaggattgagc

SEQ ID NO: 24377 - DNA, 75 bp, Artificial Sequence
  Synthetic
tggcgctgtgaaggatggaaggattgcaccagttaaattagatttggagaaacaaagattggataagttgaagtt

SEQ ID NO: 24378 - DNA, 75 bp, Artificial Sequence
  Synthetic
caagtgtgacatacgaagtaaagcgtggtactcacgaattgattaaggtacccaccattcctcacaatctggtgt

SEQ ID NO: 24379 - DNA, 75 bp, Artificial Sequence
  Synthetic
ttgataaggaatcagctgagtatctagatgagtatgcaacattagctcgcgatatttcgaactcactaactttag

SEQ ID NO: 24380 - DNA, 75 bp, Artificial Sequence
  Synthetic
aagaaccagcggtagtatcatcaatcatgccaataatctgaataaggttattaaccacgtgttcgctgacaaacc

SEQ ID NO: 24381 - DNA, 75 bp, Artificial Sequence
  Synthetic
tgccaaatcacattaacgttcctgttgatgacaggtttggatttagggatagccccttttgcacgtcgttgccta

SEQ ID NO: 24382 - DNA, 75 bp, Artificial Sequence
  Synthetic
gtaagagtaagatctcatgatggatcctgtgtctgttgtacatagctttgctaggagtcagggtttgccacttaa

SEQ ID NO: 24383 - DNA, 75 bp, Artificial Sequence
  Synthetic
cttcaaaactgtgggttgtgagggtccaagtcacgacccacgattcataattgaatgtaaatttcttgatttcca

SEQ ID NO: 24384 - DNA, 75 bp, Artificial Sequence
  Synthetic
gcaccagtgcactgacagtagtaagaagcgagcaatacaaaagatttgtgtattaattagtaatgatcttaggga

SEQ ID NO: 24385 - DNA, 75 bp, Artificial Sequence
  Synthetic
gaatggactattagaggaggccagaacattcaagccagagtataaagcaatagctcaagtatatggtaagttctt

SEQ ID NO: 24386 - DNA, 75 bp, Artificial Sequence
  Synthetic
cagacggtacattgtcgaaagagagtcatcagtaatcacacctttcaaactcataaataatcagattcttcttca

SEQ ID NO: 24387 - DNA, 75 bp, Artificial Sequence
  Synthetic
tgataatgacgagtcaattgaatatggtagttcagaattcatgtttagacatatgttactgtgttatataattta

SEQ ID NO: 24388 - DNA, 75 bp, Artificial Sequence
  Synthetic
taaacaggaggttaagattagtgagacgtgtaatatgatattttcacccgattacattgagtgtttgagccatca

SEQ ID NO: 24389 - DNA, 75 bp, Artificial Sequence
  Synthetic
tttaacttcaatcgttgaaatcgaatttcatcagcaagactgtggtaatttaagtattgtaatatttgcaaaaga

SEQ ID NO: 24390 - DNA, 75 bp, Artificial Sequence
  Synthetic
taagtattgtaatatttgcaaaagatgataacgttaagaaacagctgcagattcaggtatccgcgtgagcagtca

SEQ ID NO: 24391 - DNA, 75 bp, Artificial Sequence
  Synthetic
tggagccgtcggtattttatggaccacctggagactactggtcctgtgccgttaggtcccactttggggctaggt

SEQ ID NO: 24392 - DNA, 75 bp, Artificial Sequence
  Synthetic
gcatcttatgctactaggatgtaaggtttagatcggaaggacgtcccacacccttccactatttcttcatcccga

SEQ ID NO: 24393 - DNA, 75 bp, Artificial Sequence
  Synthetic
gtaagagtaagatctcatgatggatcctgtgtctgttgtacatagctttgctaggagtcagggcctgccacttaa

SEQ ID NO: 24394 - DNA, 75 bp, Artificial Sequence
  Synthetic
cctgtgtctgttgtacatagctttgctaggagtcagggcctgccacttaacttcaaaactgtgggttgtgagggt

SEQ ID NO: 24395 - DNA, 75 bp, Artificial Sequence
  Synthetic
aaacgagcaatacaaaagatttgtgtcttaattagtaatgatcttagagagaatggactattagaagaggccaaa

SEQ ID NO: 24396 - DNA, 75 bp, Artificial Sequence
  Synthetic
acattcaagccagagtataaagcaatagctcaagtatatggtaagttcttcaaacggtacatcgtagatagagaa

SEQ ID NO: 24397 - DNA, 75 bp, Artificial Sequence
  Synthetic
tcatcagtaattacacctttcaaactcattaataatcaaattcttcttcatgataatgacgaatcaattgaatat

SEQ ID NO: 24398 - DNA, 75 bp, Artificial Sequence
  Synthetic
ggtagttctgaattcatgtttcgacatatgttactgtgttatattatccataaacaggaaattaaggttaatgaa

SEQ ID NO: 24399 - DNA, 75 bp, Artificial Sequence
  Synthetic
gtgtgtaatatgatattttcacccgattacattgagtgtttgagccatcacttaacttcaattgttgaaatcgaa

SEQ ID NO: 24400 - DNA, 75 bp, Artificial Sequence
  Synthetic
tttcaccagcaagattgtggtaatttaagtattgtaatatttgcaaaagataatgacgttaagaaacagctgcag

SEQ ID NO: 24401 - DNA, 75 bp, Artificial Sequence
  Synthetic
taagtattgtaatatttgcaaaagataatgacgttaagaaacagctgcagattcaggtatccgcgtgagtagcca

SEQ ID NO: 24402 - DNA, 75 bp, Artificial Sequence
  Synthetic
actaggatgtaaggtttagatcggaaggacgtcccacacccttccactatttcttcatcccgaatagcacgccgt

SEQ ID NO: 24403 - DNA, 75 bp, Artificial Sequence
  Synthetic
atctgatgcctaggaagaaagatcaagtgacaaagaatgacgatggaaatcagaccagtgacgtccagactcaag

SEQ ID NO: 24404 - DNA, 75 bp, Artificial Sequence
  Synthetic
aaaaatgtaaattcaagtgtgacatacgaagtaaagcgtggtactcacgaattgattaaggtacccaccattcct

SEQ ID NO: 24405 - DNA, 75 bp, Artificial Sequence
  Synthetic
ggcacaaataaacgctgatgatgaattcattggagcaattgataaggaatcagctgagtatctagatgagtatgc

SEQ ID NO: 24406 - DNA, 75 bp, Artificial Sequence
  Synthetic
atgtgagtccaagttcatctagagtatacattaaagacccggctgtagtgtacacacgatcataagcttgtgatg

SEQ ID NO: 24407 - DNA, 75 bp, Artificial Sequence
  Synthetic
ttcttacatgatgattgctctaattcaaatgaagaatatgaagtgcactttgaaggttgaagaaacggctgaaaa

SEQ ID NO: 24408 - DNA, 75 bp, Artificial Sequence
  Synthetic
tagatttgctgagtgttcggttgtgtatgttgatggacgtgcttacaaaccaatcagagtaatggctgaatacgc

SEQ ID NO: 24409 - DNA, 75 bp, Artificial Sequence
  Synthetic
tatatttccgactttgccacatgagtacaaaggtagagttgaaggattgctgttattgcatggcggattagcacc

SEQ ID NO: 24410 - DNA, 75 bp, Artificial Sequence
  Synthetic
gataacgttagtgcgagtttaccacgatgttaatgttggtggtttggtaaccggttcgattgcagcatctgtctc

SEQ ID NO: 24411 - DNA, 75 bp, Artificial Sequence
  Synthetic
cacattaatacgtaactgcatgctatacagttttgatgtctacttcactccgaatggaatttgtattaatgctgt

SEQ ID NO: 24412 - DNA, 75 bp, Artificial Sequence
  Synthetic
ttcatgggtcacaaacacggaaaaggatcaaagtgcaagcaatacaagaaattcagtacataaatattgcttaca

SEQ ID NO: 24413 - DNA, 75 bp, Artificial Sequence
  Synthetic
aacatggatgtactgagtaaaagttctttgaaggagttgttagctcatttggagagaactcctcttgaggaagtg

SEQ ID NO: 24414 - DNA, 75 bp, Artificial Sequence
  Synthetic
atatcatatgtggtaagcggctctggtcattatattcctaatattggttatacattacttaggcgatcgatactg

SEQ ID NO: 24415 - DNA, 75 bp, Artificial Sequence
  Synthetic
tgctccaaatttcattcctggtgacatgcgaacggtgatgagtaacagtgataaactgagtatagtaggtatacc

SEQ ID NO: 24416 - DNA, 75 bp, Artificial Sequence
  Synthetic
atgcgaacggtgatgagtaacagtgataaactgagtatagtaggtataccagcgtacagattaacgcagtcaact

SEQ ID NO: 24417 - DNA, 75 bp, Artificial Sequence
  Synthetic
ctacgagaaaggaatgactttaatttgataagccttaaggatagagataattaaatagcaagattaaatggatgg

SEQ ID NO: 24418 - DNA, 75 bp, Artificial Sequence
  Synthetic
gctgctgttctgaatcaaaattatctaaacatcgaggtgcaggagatagttgatgtgacaaggcaaaagtacact

SEQ ID NO: 24419 - DNA, 75 bp, Artificial Sequence
  Synthetic
taaacatcgaggtgcaggagatagttgatgtgacaaggcaaaagtacactcacaacgcgcgtgatgacatcgatt

SEQ ID NO: 24420 - DNA, 75 bp, Artificial Sequence
  Synthetic
ctccacaatctgctgctttggttcacacactgtcgcatcttgatgtgaatgttgatggtaatggaatagcgatgt

SEQ ID NO: 24421 - DNA, 75 bp, Artificial Sequence
  Synthetic
cacactgtcgcatcttgatgtgaatgttgatggtaatggaatagcgatgtatcatattggaccggcaacgcggtt

SEQ ID NO: 24422 - DNA, 75 bp, Artificial Sequence
  Synthetic
aatgttggtggtctagttaccggttcgattgcagcatccgtttcaacgctattacgtaattgcatgttatacagt

SEQ ID NO: 24423 - DNA, 75 bp, Artificial Sequence
  Synthetic
acggtcagtcatagacgtacgattaagacgcgaggatgacgtaatatcacaaaagcgtacgtgtcaatggtgatt

SEQ ID NO: 24424 - DNA, 75 bp, Artificial Sequence
  Synthetic
atgacgatccaagttcagaatttgaattgctgtccaggacgttttgtttgtgttcataagatgacactattaatc

SEQ ID NO: 24425 - DNA, 75 bp, Artificial Sequence
  Synthetic
caccagtgcaccgatagcagtaagaaacgagcaattcaaaagatttgtgtcttaattagtaacgatctaaaggag

SEQ ID NO: 24426 - DNA, 75 bp, Artificial Sequence
  Synthetic
gtagttcagaatatatgtttagacatatgttgttgtgttacattattcataagcaaggaattgacattaaggaga

SEQ ID NO: 24427 - DNA, 75 bp, Artificial Sequence
  Synthetic
atcggaaggacgtcccacacccttccactatattcttcatcccgaatagcatgccgtatccaatttagagctgac

SEQ ID NO: 24428 - DNA, 75 bp, Artificial Sequence
  Synthetic
cagcagcacgttttacgtataaacttcgaccactggacggaccattcatagttgtattaccagttggaaatccat

SEQ ID NO: 24429 - DNA, 75 bp, Artificial Sequence
  Synthetic
gttgtattaccagttggaaatccattagtgattagtgctacagcagcaacacgtatacaggttcctcttgccttc

SEQ ID NO: 24430 - DNA, 75 bp, Artificial Sequence
  Synthetic
tagtgattagtgctacagcagcaacacgtatacaggttcctcttgccttcaacaaagctttagttgaatctggat

SEQ ID NO: 24431 - DNA, 75 bp, Artificial Sequence
  Synthetic
ttcaaacggcaatgaatgatggactgtttgatgcgcagaatgtcaattattactctagcttcgacgaattcatca

SEQ ID NO: 24432 - DNA, 75 bp, Artificial Sequence
  Synthetic
acaagtacaggatacttgctaggatgcacggtattcttagattaaagaacgatcgcaacaatttcaaatatggag

SEQ ID NO: 24433 - DNA, 75 bp, Artificial Sequence
  Synthetic
tgcattcaggtgatcaattctatctacatggagatgttaatcctgagaatataatgagtgatgccaatggttatc

SEQ ID NO: 24434 - DNA, 75 bp, Artificial Sequence
  Synthetic
gaagtcgttggtcacgttagttgagagacaattgtcagctagacctgaagatatatatgctgatttaagtagtga

SEQ ID NO: 24435 - DNA, 75 bp, Artificial Sequence
  Synthetic
tcaatggaaatcacttatcaaccacaagccgatgctacctagtctacatgccttgaatgatttgacctactacaa

SEQ ID NO: 24436 - DNA, 75 bp, Artificial Sequence
  Synthetic
attatgtgatgattcaagtctaatcactgaagacttggatgatgaagatgatgtgtagtaaacccaacctgattt

SEQ ID NO: 24437 - DNA, 75 bp, Artificial Sequence
  Synthetic
actgaagacttggatgatgaagatgatgtgtagtaaacccaacctgattttaataattatattcatcactattgt

SEQ ID NO: 24438 - DNA, 75 bp, Artificial Sequence
  Synthetic
tcattagtctaacagggaatgacaggactgttgctgatggcacttttaattccatgattatgccaagagctgtaa

SEQ ID NO: 24439 - DNA, 75 bp, Artificial Sequence
  Synthetic
ttgctaatgagcgtgaacattttatgaaaacgagaatagataagattgaacatgatttaagtcgtaacgctaaac

SEQ ID NO: 24440 - DNA, 75 bp, Artificial Sequence
  Synthetic
aagagatgatggatcgccagtctctggctgaggattacagtgcattgaatttagcagttggtcaggagataaaac

SEQ ID NO: 24441 - DNA, 75 bp, Artificial Sequence
  Synthetic
tagatatcgctactcaacatcagctaaatagattaggttcatcaatgtataaggctgatcatgaacgtgaggctg

SEQ ID NO: 24442 - DNA, 75 bp, Artificial Sequence
  Synthetic
aactgactgatctaattaacaggattcgtgagaatgaagtcaccgttaatggtattctagagaaccagaaagcta

SEQ ID NO: 24443 - DNA, 75 bp, Artificial Sequence
  Synthetic
taacagctgctgaacgtgcagatttactattagaggttgtcgcttcgaccgctaagtcagtgtcggcagcaggta

SEQ ID NO: 24444 - DNA, 75 bp, Artificial Sequence
  Synthetic
gggctgcagctgacggttcaggtgttgttccagtattcgggccaagcgtcgccaatggtattaaggttgggattg

SEQ ID NO: 24445 - DNA, 75 bp, Artificial Sequence
  Synthetic
acatagcagacagtgttgctgaagctgcaatagctgtaaaagagtcaggaatcattacacaactgaatgacgttt

SEQ ID NO: 24446 - DNA, 75 bp, Artificial Sequence
  Synthetic
atcacgcttttcaaagcgtgcacgttgcaccaaatgatatcattaaaccagccgctgtagtggctggcacgagca

SEQ ID NO: 24447 - DNA, 75 bp, Artificial Sequence
  Synthetic
ctgaattgattggtaatctgcaggcaatatacagtagattaagaagtcacagtgatattggattcaaaaaagcaa

SEQ ID NO: 24448 - DNA, 75 bp, Artificial Sequence
  Synthetic
ccgttggtgatgtgattcctcattcgtacatggttaagccagtcaattcaactgaatatgcttcatggcaattat

SEQ ID NO: 24449 - DNA, 75 bp, Artificial Sequence
  Synthetic
acgtcatacatcccgttcaaggttcattaggtttggtggttcaggtgatgggagatgctctgacttataatgtct

SEQ ID NO: 24450 - DNA, 75 bp, Artificial Sequence
  Synthetic
ttgcacaatatggaacaacttcagctagtgaatttggaaagactgtcttgactggtggtgctacgaacacagctc

SEQ ID NO: 24451 - DNA, 75 bp, Artificial Sequence
  Synthetic
tggagggaacaaaagttaaatttcaaaccaaagttactgctcagcaagcattggcattgacaatggctttgaagg

SEQ ID NO: 24452 - DNA, 75 bp, Artificial Sequence
  Synthetic
atgcagcttcgatgttatctcaaggtgaattaataggatattttgaacagtatataaacttagcgttagaaccag

SEQ ID NO: 24453 - DNA, 75 bp, Artificial Sequence
  Synthetic
ataatctaagtctgcaagataacatgcacaagtatcaccacctgttgacaagtcaaaattcacctatcgattgga

SEQ ID NO: 24454 - DNA, 75 bp, Artificial Sequence
  Synthetic
attatcatgacgaggaaatgcataagtggcttgatagtcgcaagattactaattatgatactatgaagcagaagg

SEQ ID NO: 24455 - DNA, 75 bp, Artificial Sequence
  Synthetic
atggtgtggtgatagcagacattcacattccaaaagtgttcaatgaccttagaaatacaacacttcattgcaaac

SEQ ID NO: 24456 - DNA, 75 bp, Artificial Sequence
  Synthetic
tagaaggtaagcaaaatatcgctggatatacagtctatgagtatctgattggaccttgggctcattacggtgaca

SEQ ID NO: 24457 - DNA, 75 bp, Artificial Sequence
  Synthetic
tagactactcagttgtagttgatacgctcaatgaggagacgaaatggtattgtgagattattggtattgatggtc

SEQ ID NO: 24458 - DNA, 75 bp, Artificial Sequence
  Synthetic
acctaatcattgagaagagtgttcaacataagcctgagaagattcttgagctaaccgttaatgacgacggcttga

SEQ ID NO: 24459 - DNA, 75 bp, Artificial Sequence
  Synthetic
cttcgttcaaaggtaagaatcatgacagactaaaacttaaggtgtatgtgaaagattcgttggctgtgaaggttt

SEQ ID NO: 24460 - DNA, 75 bp, Artificial Sequence
  Synthetic
ttaggaactggataggtattaacggcacctagagtaaaaaccaagatgtttaatgatcatattggagtgaagtat

SEQ ID NO: 24461 - DNA, 75 bp, Artificial Sequence
  Synthetic
gattactctcattttgataagaatatatcgccatcgcacctgactctaactgatctaggctggcacacttggaat

SEQ ID NO: 24462 - DNA, 75 bp, Artificial Sequence
  Synthetic
cagtataatgcaggtaattggactaacattaaaccgtaagtaaattatcaatcttcggacatatgtaagcgtggg

SEQ ID NO: 24463 - DNA, 75 bp, Artificial Sequence
  Synthetic
acacgtcaaaacagtgataacctggtcggcggagctacaaatccgcttgtcaggggaaactggatgtactaatgg

SEQ ID NO: 24464 - DNA, 75 bp, Artificial Sequence
  Synthetic
gtgataacctggtcggcggagctacaaatccgcttgtcaggggaaactggatgtactaatgggatttgacccgac

SEQ ID NO: 24465 - DNA, 75 bp, Artificial Sequence
  Synthetic
gtattaaaaattatcaacaaggaatggacattcaagaacaatttgaaggttatttaagagaagaggtggatctac

SEQ ID NO: 24466 - DNA, 75 bp, Artificial Sequence
  Synthetic
tgaacaaatttgaagatagtcattttaaacaattagaagtattttatacaaacagtcaagctgaccatgtcatca

SEQ ID NO: 24467 - DNA, 75 bp, Artificial Sequence
  Synthetic
ataaagataaagcgcaatttagtgatttgccatttcacactaccttatacaaggaagttaacggtaaacgtgtta

SEQ ID NO: 24468 - DNA, 75 bp, Artificial Sequence
  Synthetic
aattaggtacattgttaaactggactaaagctgaacgtttggacacaatacgacatgaatcaatgattaaagatg

SEQ ID NO: 24469 - DNA, 75 bp, Artificial Sequence
  Synthetic
aacggctacgtcgcctaatcgatttcgactatagttggattgattatgcggttgtattgcagcgttatctggatg

SEQ ID NO: 24470 - DNA, 75 bp, Artificial Sequence
  Synthetic
agggaaatgtgattgcacctgctgatattctcaagtttgacagtgacttcatcaataatataaagcatccaactg

SEQ ID NO: 24471 - DNA, 75 bp, Artificial Sequence
  Synthetic
aaaagaacaatttcttagatattaaagtgataaaggaatgtgaaacctacatcttgatgaaagatgataacggta

SEQ ID NO: 24472 - DNA, 75 bp, Artificial Sequence
  Synthetic
ttcgtgaccctgacatattgcgtgcctgggaactcgattcaataccagatgttattgaacttgatgttgatggcg

SEQ ID NO: 24473 - DNA, 75 bp, Artificial Sequence
  Synthetic
aagttaagaagtttaatctaagaaaggagatgataaaaagaatacaggatgaagctccagtgtatttctttgcat

SEQ ID NO: 24474 - DNA, 75 bp, Artificial Sequence
  Synthetic
ccgtatcgttatgcagtcgcaatttggatccaaacatatcagaggtcaaactgtggttggaatatttcataggga

SEQ ID NO: 24475 - DNA, 75 bp, Artificial Sequence
  Synthetic
gtgaagatttcttcgggttcaatggaccaaatgtggttgtgtcaaagtctttgttagctgccaaacgttttgaag

SEQ ID NO: 24476 - DNA, 75 bp, Artificial Sequence
  Synthetic
ttgttgttaatcacttaaggaaggttgcagcttttgaattggatgatgagtctaaagaagtgatgactgaatggc

SEQ ID NO: 24477 - DNA, 75 bp, Artificial Sequence
  Synthetic
ttaaatacataatgatcgatccagtttatagatcatataaaaatagaggtgcttttggtaatctgaatcaacatg

SEQ ID NO: 24478 - DNA, 75 bp, Artificial Sequence
  Synthetic
tgtttgcaaggactaagagtgagggattgtcatggtctcttattgacattggtacgacaaattttgaattaaagc

SEQ ID NO: 24479 - DNA, 75 bp, Artificial Sequence
  Synthetic
cgactaagaaactagctggctcatacgttaagaaattcaacttagttgatgatgtgctggttgaggaatcgttga

SEQ ID NO: 24480 - DNA, 75 bp, Artificial Sequence
  Synthetic
aagatttgcgtaatgagggtctatacaagatggctgatataacacgtaggatgattgatgctgatataacgcctg

SEQ ID NO: 24481 - DNA, 75 bp, Artificial Sequence
  Synthetic
aaaacgtgaagaagggaaagttgaatcgattagctttatcgtattgtggttacactgggtcgcattcagcaacag

SEQ ID NO: 24482 - DNA, 75 bp, Artificial Sequence
  Synthetic
ctatggttaagcagttcaatggtacgaaggatttagatcctaactgtgacccaatgttcgtcgatatagttaaag

SEQ ID NO: 24483 - DNA, 75 bp, Artificial Sequence
  Synthetic
acaacatgaaagtttacatgcaggagggcttacagaagtaccctcatgggtcaagaaaaattaatagattggaca

SEQ ID NO: 24484 - DNA, 75 bp, Artificial Sequence
  Synthetic
tattattcaagggtggtacatcatctgccagtagtacaaacgaacatgctactgttaacggtaggttcagataca

SEQ ID NO: 24485 - DNA, 75 bp, Artificial Sequence
  Synthetic
ggtcggagttatatcgggaacgtgatgtaaattcgtcgacagtattcaagacagcaacagctggacagtatagag

SEQ ID NO: 24486 - DNA, 75 bp, Artificial Sequence
  Synthetic
tggtgaaaaagatttctgctaaacttaagagtaagaatgctaacataataactcatccaatgaattttataaact

SEQ ID NO: 24487 - DNA, 75 bp, Artificial Sequence
  Synthetic
ctaaagtcagtgacttagacgtagttgtcaacgctggttcaagattggtgagagggactagagctaaacgtataa

SEQ ID NO: 24488 - DNA, 75 bp, Artificial Sequence
  Synthetic
taactccaaattatggaacaatttatgcagcttcattgatgacagtgcttccggctgttaggttattaagttcaa

SEQ ID NO: 24489 - DNA, 75 bp, Artificial Sequence
  Synthetic
gggctagtaacatgggagctttgagtactcaaggaagtctcgtagaccgtgcaccacatgatgtgatggctcctc

SEQ ID NO: 24490 - DNA, 75 bp, Artificial Sequence
  Synthetic
aattggctgtgacttccagtgatgacgtctcaaaggtttgtgttgcaaaggatttcggacaattcgacactagtc

SEQ ID NO: 24491 - DNA, 75 bp, Artificial Sequence
  Synthetic
agtggggtcaaatatccaaagctcatgcagatggagtgcgctcaatgaaagttcattattctatgggacacgatg

SEQ ID NO: 24492 - DNA, 75 bp, Artificial Sequence
  Synthetic
ctttggtcgatttagatttgaatgatgcttcatttgcggatttgttagaagttacagccatgtcttttgaaaaac

SEQ ID NO: 24493 - DNA, 75 bp, Artificial Sequence
  Synthetic
cattgaaatacaagatgaacggtttagtttgtgaaagtgctggtgttaagtcgggcgaattgacaacacaaactc

SEQ ID NO: 24494 - DNA, 75 bp, Artificial Sequence
  Synthetic
gcaataccacgaccaatatttcacattcaactgtggcattagatgattataataacagagcttatcgtttgaact

SEQ ID NO: 24495 - DNA, 75 bp, Artificial Sequence
  Synthetic
tgccgaagctagaattagtcacagataataaagtaggtgacgattcggttgaagttttgagagtggtggacggct

SEQ ID NO: 24496 - DNA, 75 bp, Artificial Sequence
  Synthetic
caccattgacacctgaaattgcaaaactatatgtgagttgtatgcaggatcatgctgacaggaatcatctggaga

SEQ ID NO: 24497 - DNA, 75 bp, Artificial Sequence
  Synthetic
tttcagcgaaacgtacaatcgtaggcaacaacgttgcagagcatattaagatttgggtctttaagggttacttgg

SEQ ID NO: 24498 - DNA, 75 bp, Artificial Sequence
  Synthetic
ctctcgatgtatttctggacagtgtgacctcagagaaaaatagtttttccaatttgaactatttggagcaagtaa

SEQ ID NO: 24499 - DNA, 75 bp, Artificial Sequence
  Synthetic
atatattgtatgatatggctatgacactaatgattagatattgcagcgtgcaagcgtgtatgacacaattttgca

SEQ ID NO: 24500 - DNA, 75 bp, Artificial Sequence
  Synthetic
atgacatgaagttgttgaatggaattagggctggcaattatacatttattcctactccgaaaattatatgtgcat

SEQ ID NO: 24501 - DNA, 75 bp, Artificial Sequence
  Synthetic
atggtactcctgaaatatgtttgagagcccctgagatacgatcatttggtagatatttaccaattgacaaggatg

SEQ ID NO: 24502 - DNA, 75 bp, Artificial Sequence
  Synthetic
aatactctgtattgaatgacttagttgcatcactaagtaccaacaaaccaaagatggagtttgtatcgcaaatga

SEQ ID NO: 24503 - DNA, 75 bp, Artificial Sequence
  Synthetic
tcgagcagaatggcaataaagtacacagtttatggcttgatcacttcaaacgtaaaaatgacgtcaatcctaatg

SEQ ID NO: 24504 - DNA, 75 bp, Artificial Sequence
  Synthetic
gagggggtatccatatatctgaaggacttaaacgtctaatgcctgagtattgtgagaaacatttgaatgaattag

SEQ ID NO: 24505 - DNA, 75 bp, Artificial Sequence
  Synthetic
tgtacaagacgttagatgataaggtcattcgcgactatacatctgatatcattatttctaatatttgtaaaggta

SEQ ID NO: 24506 - DNA, 75 bp, Artificial Sequence
  Synthetic
agttaagtaaagcgccaaaactagcattttatgctaatttctatctttcattgactaacacaaacggagttgact

SEQ ID NO: 24507 - DNA, 75 bp, Artificial Sequence
  Synthetic
ctccataccttaccgccgatgaaggagtgaagaatgtgcatagagttatcggtttgtcatacagaaatacattat

SEQ ID NO: 24508 - DNA, 75 bp, Artificial Sequence
  Synthetic
caactagtccaacttccaatgtagataggatccttagaaataatccgggatctgctccagcttacttaactggca

SEQ ID NO: 24509 - DNA, 75 bp, Artificial Sequence
  Synthetic
acgacatacttggtgttttatcggattacccatatcaaaactggcgtacagttgttgaactattggacattaccg

SEQ ID NO: 24510 - DNA, 75 bp, Artificial Sequence
  Synthetic
aaccatcagcaacggcaataattgaagtagctactaatcaaatgcatgcgtacttagcagataaggatttgaata

SEQ ID NO: 24511 - DNA, 75 bp, Artificial Sequence
  Synthetic
ccgcaaatctattcgataatacttcccgtacttacgatatctctgatcgtacgtatcctaagtttgttaacataa

SEQ ID NO: 24512 - DNA, 75 bp, Artificial Sequence
  Synthetic
catccagcttgtcaaacagtaatagacgtggttttcagattgaagctatgaagcatgttatatatatggctagac

SEQ ID NO: 24513 - DNA, 75 bp, Artificial Sequence
  Synthetic
gtggtgtggctgtactcgccaacacacatccaacaaaaattggaaatactgtatactatgactactaaaatacga

SEQ ID NO: 24514 - DNA, 75 bp, Artificial Sequence
  Synthetic
cgattaactggttagatctgctgaactcttattagccttcgaactcttgaatgccttggataatttagaactgac

SEQ ID NO: 24515 - DNA, 75 bp, Artificial Sequence
  Synthetic
gtataaattttgtatccgatagtagcacatagaatcacaatcacatccccgttttttgaaattttataatttcta

SEQ ID NO: 24516 - DNA, 75 bp, Artificial Sequence
  Synthetic
cagcaaattttatatcaaatgcctaggaaaaaggagcaggccagcaagagtgaaaatgaaaagcaaacaagtaac

SEQ ID NO: 24517 - DNA, 75 bp, Artificial Sequence
  Synthetic
gttcaagctcaagatttcaaaactgcgattcaacctgatactgctactgcacaactgatcaaaacatattcaaac

SEQ ID NO: 24518 - DNA, 75 bp, Artificial Sequence
  Synthetic
ccaaaacagcgtggagataagggagaaattgtttacgatggagggcagagctctaagcttgccgaggttgttgat

SEQ ID NO: 24519 - DNA, 75 bp, Artificial Sequence
  Synthetic
cagaccactgagccgcacaatgcagatggagctgtaaaggatgggaggatagctccagtgaagttagatttagag

SEQ ID NO: 24520 - DNA, 75 bp, Artificial Sequence
  Synthetic
aagcaaaaacttgataaattaaagttatttgaagcatcacctttcgaccctttgacagtgaagaataatcaagat

SEQ ID NO: 24521 - DNA, 75 bp, Artificial Sequence
  Synthetic
gttgtggacaagttgtacgctactcagtcatcatcaattcaagaagttgtgccgacgaagacttttgccacagaa

SEQ ID NO: 24522 - DNA, 75 bp, Artificial Sequence
  Synthetic
cttcagttcggtgtcacctctgaggatatggctaagatttatggagctgttgtcgcagtgtcaaagaatgtgaac

SEQ ID NO: 24523 - DNA, 75 bp, Artificial Sequence
  Synthetic
tcaagcgtaacgtatgaagtgaagcgtggcacacacgaattgatcaaagtacctaccatcccgcacaacttagtg

SEQ ID NO: 24524 - DNA, 75 bp, Artificial Sequence
  Synthetic
ttgattcaatcagataatggtaaacacgcattaataaaagaagatttgggacaatggccggttgaaactggagtt

SEQ ID NO: 24525 - DNA, 75 bp, Artificial Sequence
  Synthetic
tctttagttaatcaagcaggtgtgtttgctgtgcagttagctaataagttaggcattgacaaaccttttgtttta

SEQ ID NO: 24526 - DNA, 75 bp, Artificial Sequence
  Synthetic
gatgccggatccaactatttcactgacaccagtttcatcgatactagaaagtactgtactgatggtctgtcgcca

SEQ ID NO: 24527 - DNA, 75 bp, Artificial Sequence
  Synthetic
ataacctccgttatggatgtttcgcagtgggccgccccaaagggggcggccaatgcaattgaagctgctgctctt

SEQ ID NO: 24528 - DNA, 75 bp, Artificial Sequence
  Synthetic
tacaaccgtgccggttacccttatcagtatgacaacaatgagagtggggttatttttgtgtcgtcagagggcgat

SEQ ID NO: 24529 - DNA, 75 bp, Artificial Sequence
  Synthetic
gctgccactgctagtgctattgaccatgcacttttggtagagtgttatctcaccaagacccagacggaggttttg

SEQ ID NO: 24530 - DNA, 75 bp, Artificial Sequence
  Synthetic
gcttacacttacatctccacttatagtaacagcctcggcagctccaacctggacctcgctgccgttggccaagct

SEQ ID NO: 24531 - DNA, 75 bp, Artificial Sequence
  Synthetic
attgggctctttgccccgatgcagttacggtttgagcccaaaacttgctggtcacaccctctccagcggtttata

SEQ ID NO: 24532 - DNA, 75 bp, Artificial Sequence
  Synthetic
caagcaccggcgacaagatctgccagagcccttctcgatgcccgacattcgttcaatgacagctgtgagatttgc

SEQ ID NO: 24533 - DNA, 75 bp, Artificial Sequence
  Synthetic
cataattatctggaagtgctcgcccgccgcaaagctggaccgcgttacttagaggtaggtgcccaccctcgttcc

SEQ ID NO: 24534 - DNA, 75 bp, Artificial Sequence
  Synthetic
atctcggtcgggcttgggaagtgtatatttgtttacccttccgagcgcccccatgaaggcgttccgcaaccacca

SEQ ID NO: 24535 - DNA, 75 bp, Artificial Sequence
  Synthetic
attaataacaacccggctgtcgtccaccgctgctttttacctttgcgcggtagggaccggcagcgatggaactca

SEQ ID NO: 24536 - DNA, 75 bp, Artificial Sequence
  Synthetic
tgctttccggccccattgccacccaggggcctgccggccgttaggtctgatgagtatgcttgtagtgtagacact

SEQ ID NO: 24537 - DNA, 75 bp, Artificial Sequence
  Synthetic
gcaccccggagggggctagccaatgccatccgccgtggcctactttgtggccggtcgtcaaatgagttttgctca

SEQ ID NO: 24538 - DNA, 75 bp, Artificial Sequence
  Synthetic
aatgaaatttgttaatcatggttaaggttttatttagttatgattttaggtatttagtattttagattcttttaa

SEQ ID NO: 24539 - DNA, 75 bp, Artificial Sequence
  Synthetic
gttggcttccataattgtgactttaaaagtgagatagcggttgcatgctactcattacatgacctgtcacctcgg

SEQ ID NO: 24540 - DNA, 75 bp, Artificial Sequence
  Synthetic
taggtatttagtattttagattcttttaattcagtgtaatacccttaaaaaaaaaaaaaaaaaaaaaaaaaaaaa

SEQ ID NO: 24541 - DNA, 75 bp, Artificial Sequence
  Synthetic
gaggttgcatgtgcaatgtataagcacggtgtgcgcacgctttatgcggcactgcacctaccgtttgagtgttta

SEQ ID NO: 24542 - DNA, 75 bp, Artificial Sequence
  Synthetic
ctgcctgatggtgtttatcaaactaagtcataccacgtgttacaacgtgagggggccactatagttacctatgtt

SEQ ID NO: 24543 - DNA, 75 bp, Artificial Sequence
  Synthetic
ggtgatacctcagccggttaccgccacaagacatccattttgcgtgagtggttgcagacgacccaggtcaccggt

SEQ ID NO: 24544 - DNA, 75 bp, Artificial Sequence
  Synthetic
cggcacccagttataatcgaacgggtgcgtgcagttgggtgtcatttcctactgtgcattacagccactcattgc

SEQ ID NO: 24545 - DNA, 75 bp, Artificial Sequence
  Synthetic
gaaccaatgccttacagcccgtttcccaatagtgattatgtttatgttctggacatttatgggccgggatttgag

SEQ ID NO: 24546 - DNA, 75 bp, Artificial Sequence
  Synthetic
ggtggtgttttctccgggggcacgcatacgtaccatgccgtcccactggatatctggcggcggttgatgatgttt

SEQ ID NO: 24547 - DNA, 75 bp, Artificial Sequence
  Synthetic
ggtgagacccttgatgatgatgctttctgttgctcacgtatgcaaacgtaccttcgtggtatatctcacaaagtg

SEQ ID NO: 24548 - DNA, 75 bp, Artificial Sequence
  Synthetic
accgtggggaatgttgtggctaatacagggtggcaaccggacgagaggtcgctaacggccacaattacggccgct

SEQ ID NO: 24549 - DNA, 75 bp, Artificial Sequence
  Synthetic
tatttgaccatcgctcatcaacggtggctgcgcacccagggcatatctaaaggtgtacagcggcttaagaaggag

SEQ ID NO: 24550 - DNA, 75 bp, Artificial Sequence
  Synthetic
cacgtccagggtttcttccatcggcttttagaatggttgaccccatgtctgcgccaggccggagtgggcttttac

SEQ ID NO: 24551 - DNA, 75 bp, Artificial Sequence
  Synthetic
aggcaactcaaacattggcttagtgcaggccttgttcgcaacccgcaggctgaagtgtttgatgactgtagaagg

SEQ ID NO: 24552 - DNA, 75 bp, Artificial Sequence
  Synthetic
tgtgcttgcccagtggtccggcgggttcatggtgaggagtgttgggtaccatccccgtggggtaacctacggtat

SEQ ID NO: 24553 - DNA, 75 bp, Artificial Sequence
  Synthetic
gttgatagcacacccaagccaatcaaggccgtgaagatggtggagcggcccagccagccggtgttagcccctgtt

SEQ ID NO: 24554 - DNA, 75 bp, Artificial Sequence
  Synthetic
aagaagatccacccacgtgttgcgtccacggtttaccccgggttgcagttaccagaagaattggctgtggaactg

SEQ ID NO: 24555 - DNA, 75 bp, Artificial Sequence
  Synthetic
gaggagtcgctgtgggaagatggtagatactattatgtcatgccatgtccaattgagctgatccccgccactgtg

SEQ ID NO: 24556 - DNA, 75 bp, Artificial Sequence
  Synthetic
cgcgtgtgtgcgggtggtaaccgcatagccccgcgagtcagtgcccgcaagctgtttgtcaaagtaggtggtaat

SEQ ID NO: 24557 - DNA, 75 bp, Artificial Sequence
  Synthetic
gtgagtcaggaggatgttacgattggctatgactcaggcaagcgaaggtactatgcagtggttggtgatcggcag

SEQ ID NO: 24558 - DNA, 75 bp, Artificial Sequence
  Synthetic
attttctttgacagttttacgccctttagtcatgacaataattttgagctgcctggggggtaccagatctccaca

SEQ ID NO: 24559 - DNA, 75 bp, Artificial Sequence
  Synthetic
gagcggccagaccaagggctcggtcatgctggggcagagattctgttggacttacctgatggctcacagatttta

SEQ ID NO: 24560 - DNA, 75 bp, Artificial Sequence
  Synthetic
tgcggagatctgtttgggtccaaatgtgattggttggtgaatgcagcgaatggcgaccacttgccagggggtggt

SEQ ID NO: 24561 - DNA, 75 bp, Artificial Sequence
  Synthetic
atatgcgggcaattccatcgccgctaccctgacttgttcccggttcaaggtcggcgtcatggtcgggtcattttc

SEQ ID NO: 24562 - DNA, 75 bp, Artificial Sequence
  Synthetic
caagaagagcccgttaaagttattcatgcggttgctccagattatcgggtcagtgagcgccccgacttattagaa

SEQ ID NO: 24563 - DNA, 75 bp, Artificial Sequence
  Synthetic
gccacctaccgagatgccatggatcgaactggcactgctgcctacccagtgctcggtgcaggcatttatcaggta

SEQ ID NO: 24564 - DNA, 75 bp, Artificial Sequence
  Synthetic
ccctacatgctctccgtgtctgcttggttgcggcaccaccgacctggggatgccctctacatccaccctgcagat

SEQ ID NO: 24565 - DNA, 75 bp, Artificial Sequence
  Synthetic
cgtcatcgctacttaggtgtggatgttaaaaccccaaaccagattaatataactgagtcaatggcagccaaagct

SEQ ID NO: 24566 - DNA, 75 bp, Artificial Sequence
  Synthetic
aatttggcgctgtcgcttgagaaggagccttacaaaaagtttgttgacggtgtgacagttctggcaggaacagtg

SEQ ID NO: 24567 - DNA, 75 bp, Artificial Sequence
  Synthetic
tattatgactatatcacgggcgttccggggagtggtaagtcccgttcggtgccgaatgatggtcaattggttgtt

SEQ ID NO: 24568 - DNA, 75 bp, Artificial Sequence
  Synthetic
gccccaactaagaagttggttgcggattggagagatcgaggttttgaggcctacaccccgcataagtccctgacc

SEQ ID NO: 24569 - DNA, 75 bp, Artificial Sequence
  Synthetic
aaggtgaccggtcgggactgtgtgtatgatgaagccccgaccctaccaccgcatttgttgctctcttgcatgcag

SEQ ID NO: 24570 - DNA, 75 bp, Artificial Sequence
  Synthetic
ttggcctcaagcaatttgctactgggggatccccggcagatacctgccctagatttccaacatactggccttgtt

SEQ ID NO: 24571 - DNA, 75 bp, Artificial Sequence
  Synthetic
gaccctttgcggttacctttggtgccatctgagcactggactgtttcccaccgttgcccgtatgatgtctgtcgg

SEQ ID NO: 24572 - DNA, 75 bp, Artificial Sequence
  Synthetic
tttctggcggccgattaccctggcatcacgacaactagtcaggttaggcggtccctgttctggggccgacctagt

SEQ ID NO: 24573 - DNA, 75 bp, Artificial Sequence
  Synthetic
gtgggccagatcatagtgttcacacaagcggctaaaggctgttatgaggggagcatcacggtgcatgagtcacag

SEQ ID NO: 24574 - DNA, 75 bp, Artificial Sequence
  Synthetic
ggcagcacatttgatcaaacaactattattgccacccttgatgcccggggcttaattgcctcaagtcgtgctcac

SEQ ID NO: 24575 - DNA, 75 bp, Artificial Sequence
  Synthetic
gccattgtggctatcacccgccacacaaaggcctgtcacgtgattgaccagggtggcttgttggccgaggtcggc

SEQ ID NO: 24576 - DNA, 75 bp, Artificial Sequence
  Synthetic
ttaactgatgccatgattaccatgttgttggcccaggagttggcagtcaccccgactccggtagttgagcccgtt

SEQ ID NO: 24577 - DNA, 75 bp, Artificial Sequence
  Synthetic
agaatccctcgtgtgggtggccaaccagccctgcctcatacacacacagatgttgcagccacattgacagctgag

SEQ ID NO: 24578 - DNA, 75 bp, Artificial Sequence
  Synthetic
gcacttgggcatcaacctaccgaagttgccgcagttgtcccagcgtgcccggccctccagcaggggctgctgttt

SEQ ID NO: 24579 - DNA, 75 bp, Artificial Sequence
  Synthetic
atgccagaccgtttagatggcaaggatgatgtgattgttactaggctatctgacacagtccattgccgattactt

SEQ ID NO: 24580 - DNA, 75 bp, Artificial Sequence
  Synthetic
gcccctgctgacaggcttagtgtcgtgtcaactctcgttggcaggtatggcaaatttactttgaccccaaaagat

SEQ ID NO: 24581 - DNA, 75 bp, Artificial Sequence
  Synthetic
gattttgacctgcgccggttgagctggtttataccagacctttccggctgcaaaccaacagaggtggagtacatg

SEQ ID NO: 24582 - DNA, 75 bp, Artificial Sequence
  Synthetic
cagttggtgcaggccatgacatccaaaggccagacaggggagctggtgttagagttgactggtgacaataaggat

SEQ ID NO: 24583 - DNA, 75 bp, Artificial Sequence
  Synthetic
tgttaccggataactttctttcagaaagattgtaataagtttacattagaagatccagtacaacatggcaaggtg

SEQ ID NO: 24584 - DNA, 75 bp, Artificial Sequence
  Synthetic
ggtcaagggatttcagcatggccaaaaacgttgtgcgccctattcggcccatggttccgggcgattgagaaacgc

SEQ ID NO: 24585 - DNA, 75 bp, Artificial Sequence
  Synthetic
attgtaagtgcgctacccccgggctggttttatgccgatctttataccgaggccgacctccatgcgcactgtatt

SEQ ID NO: 24586 - DNA, 75 bp, Artificial Sequence
  Synthetic
gcagtcccacctggcacccaggtctttgagaatgatttcagtgagtttgacagcacccaaaacaacgtttccctg

SEQ ID NO: 24587 - DNA, 75 bp, Artificial Sequence
  Synthetic
gatttcgagtgtcagctgttgtctgagtgtggtatgcctgagtggatggtcaggctgtattggctgcagcgagcc

SEQ ID NO: 24588 - DNA, 75 bp, Artificial Sequence
  Synthetic
tattggacattagtggcccccaatgcagccctgcggggctgttggaagaaacactctggggaacctggcacgctg

SEQ ID NO: 24589 - DNA, 75 bp, Artificial Sequence
  Synthetic
ttattcaatacagtctggaacatggttgtggttaatgtgtgctatgaattccgaggggatgtggtgcatgtctac

SEQ ID NO: 24590 - DNA, 75 bp, Artificial Sequence
  Synthetic
aaaggggacgactctgttgtgctctgtcaggatgctcagctacgtgacggtggccaacaccttgtcaccgcatgt

SEQ ID NO: 24591 - DNA, 75 bp, Artificial Sequence
  Synthetic
ggccttaaactcaagcagaattttggcccaataggttgcttctcaaattacattatagcccccggtgcaggctgc

SEQ ID NO: 24592 - DNA, 75 bp, Artificial Sequence
  Synthetic
tgcaaggacctattgcggacttggggccgcatgactgaaaagaacttttcgtcatcgggtcgtgcgcatgatttg

SEQ ID NO: 24593 - DNA, 75 bp, Artificial Sequence
  Synthetic
actgttgcggcgcaagatttttgtaatgcggttgtagcagaggggaaggagttcttgactattgagatcaatgcc

SEQ ID NO: 24594 - DNA, 75 bp, Artificial Sequence
  Synthetic
gcttattatgggcaaccgcgagggttctttgaagtggtctggggcgccattcagtctgtcgcccggggggagatg

SEQ ID NO: 24595 - DNA, 75 bp, Artificial Sequence
  Synthetic
ggtttgactgactaccgactaccaattttgagggtagagggggaccaatgaataacactctgtttcataccgcca

SEQ ID NO: 24596 - DNA, 75 bp, Artificial Sequence
  Synthetic
tgcgtttcttatcgcttggctactttctccttatcttcttgtccggtgtaacaccccctggtgatggtcgacctt

SEQ ID NO: 24597 - DNA, 75 bp, Artificial Sequence
  Synthetic
ggggacaccgaggtggcccagccccacgttggcgcggcccccgccgcaatcgttccagcggcccgcaacaggtat

SEQ ID NO: 24598 - DNA, 75 bp, Artificial Sequence
  Synthetic
caaatacccccctcaccaccagggcaggtgcgcctggcactgtacctgtaccagacatcgatcagcgtgggacta

SEQ ID NO: 24599 - DNA, 75 bp, Artificial Sequence
  Synthetic
ttttgcggcgccaatacaaccttgtcacttctccacttgcacttacagtccctggtgccactaatgctatcctat

SEQ ID NO: 24600 - DNA, 75 bp, Artificial Sequence
  Synthetic
atactgcacccttatctcccttacttcccttgcaggacggcaccaatgcacatattatgtctacagaggccagta

SEQ ID NO: 24601 - DNA, 75 bp, Artificial Sequence
  Synthetic
attacgctcaatatcgggtggttgcggctacactcaggttccgtccagttgttcctgcgtctgtcggtggctact

SEQ ID NO: 24602 - DNA, 75 bp, Artificial Sequence
  Synthetic
cgataagtatgtcattctggccacaggctaataatgtcccaacgtccgtggatatgaactctataacttccacgg

SEQ ID NO: 24603 - DNA, 75 bp, Artificial Sequence
  Synthetic
atgtccgtatcatatcccaacctggtattgcaactgaattggttattccaaaagaaagattacattaccgcaacc

SEQ ID NO: 24604 - DNA, 75 bp, Artificial Sequence
  Synthetic
agggttggcggggtgttgaaacagctaatgttcccctcgaggagagtacctctgggcagataatagttgcagtcc

SEQ ID NO: 24605 - DNA, 75 bp, Artificial Sequence
  Synthetic
atggcagtccaataaattcatacacgaacacatcatattccggaccccttggtgtgttggatttggctgtggtta

SEQ ID NO: 24606 - DNA, 75 bp, Artificial Sequence
  Synthetic
tggactatcgcaacctcacacccggtaatacgaactccaaagtgtctagaatcaaggtcaccactaaacaccgga

SEQ ID NO: 24607 - DNA, 75 bp, Artificial Sequence
  Synthetic
ttcagaggggaccgcgtggggctgttttatccactcctgcagcactgcggtttatgaatgacctggatcttcgtg

SEQ ID NO: 24608 - DNA, 75 bp, Artificial Sequence
  Synthetic
gtaacaactctgttggcgaccttggtggtggaatagtagggttaatactcaatgttgctgacaatctactgggta

SEQ ID NO: 24609 - DNA, 75 bp, Artificial Sequence
  Synthetic
atctgccatcaaatttattgagtttggccggcggccagatgctttatggcaagcccactatagcatctaatggtg

SEQ ID NO: 24610 - DNA, 75 bp, Artificial Sequence
  Synthetic
aaccggccttgcagctgtatggatcagttgaacaggcccagctcgataagcctctgcaagttccacatgatatag

SEQ ID NO: 24611 - DNA, 75 bp, Artificial Sequence
  Synthetic
acctcgggaattctagtgtggttgtgcaggattttgtgaacaatcatgagtcagaccgccctgcccccgcacccg

SEQ ID NO: 24612 - DNA, 75 bp, Artificial Sequence
  Synthetic
cccccaagcggccgctggggacgctacggactggagatattctgttcttgcgtatgcagaatagtgattatctga

SEQ ID NO: 24613 - DNA, 75 bp, Artificial Sequence
  Synthetic
actcttcaccagatatggggggcccggtctacaggtgtgagaaagctgagttgatcaatgttgtcaccggcgtga

SEQ ID NO: 24614 - DNA, 75 bp, Artificial Sequence
  Synthetic
ggggtatgatggacacagttgattggactaaggccactgttgatggagaggatttgccccggacatcgacgggca

SEQ ID NO: 24615 - DNA, 75 bp, Artificial Sequence
  Synthetic
cacctccttatcttatgatacccttaggcggcaaattgtcattttgggaacatggtaagtccaatagagctggtt

SEQ ID NO: 24616 - DNA, 75 bp, Artificial Sequence
  Synthetic
acccttatcagtataacaacaatgattccggtgttgtgtatgtttccagtgagggcctggcctacacttatattt

SEQ ID NO: 24617 - DNA, 75 bp, Artificial Sequence
  Synthetic
ctacctattctaattcattgggcagcactggtgtggaccttgcatgtgtcggtcaggtgcagcgcactgctggcg

SEQ ID NO: 24618 - DNA, 75 bp, Artificial Sequence
  Synthetic
ggcgccgcacaagagaccttcgtgatgcgaagcacacattgaatgatagctgccccatttgtagagcagttgatt

SEQ ID NO: 24619 - DNA, 75 bp, Artificial Sequence
  Synthetic
tagataaatgcatatttagttatggggttgtggatcctgtagataatcatatatatgatgatgtttatgaaggta

SEQ ID NO: 24620 - DNA, 75 bp, Artificial Sequence
  Synthetic
atgaaataaattagttcccttccaagtgtttattaggtttaagttttctgtgtctttcttttcttatttcttttt

SEQ ID NO: 24621 - DNA, 75 bp, Artificial Sequence
  Synthetic
tattaggtttaagttttctgtgtctttcttttcttatttcttttttctgtgtttcacgcttgtaaaaaaaaaaaa

SEQ ID NO: 24622 - DNA, 75 bp, Artificial Sequence
  Synthetic
gcatccttgccacagagtccatggtccgccgccatggacatttcacagtggtccgccccgaagggggcgggcgca

SEQ ID NO: 24623 - DNA, 75 bp, Artificial Sequence
  Synthetic
gccttcgaagcgtacgctcaggctgctgtgaacattgctgttgagcatgcccatgttgtcacatgttttcttagc

SEQ ID NO: 24624 - DNA, 75 bp, Artificial Sequence
  Synthetic
cggcagcagaccgagctattgattgggctttttagcccagtgcagcttaggtttgagcctaggcatatttggcaa

SEQ ID NO: 24625 - DNA, 75 bp, Artificial Sequence
  Synthetic
catcctgtggcaagggtgatccataactatctggaaggggtcgcacggcggaaatgtggcccgtcttgtcttgag

SEQ ID NO: 24626 - DNA, 75 bp, Artificial Sequence
  Synthetic
attggtgctcatcccaggtcaatcaatgagcaccctgctgttaaacatcgctgcttcctcccccctgcgggtcga

SEQ ID NO: 24627 - DNA, 75 bp, Artificial Sequence
  Synthetic
gatgtgcagcggtggaattcagccccccgccgagggactgccaattttatccggcgggcagttctacgtggccag

SEQ ID NO: 24628 - DNA, 75 bp, Artificial Sequence
  Synthetic
ctttacacagataatttctgcaccctggggttccatgggtgcaaccatcaagctgaagttggcttggccagttat

SEQ ID NO: 24629 - DNA, 75 bp, Artificial Sequence
  Synthetic
agcttgcatgacttgtgcccgcgtgaggtcgcctgcgcaatgtatcgccatgggatgcatacattgtttgcagta

SEQ ID NO: 24630 - DNA, 75 bp, Artificial Sequence
  Synthetic
ctccacctacctcctgaggctctcttacctgatggacagtataccaatgaatcatatagtgccttggttcttaag

SEQ ID NO: 24631 - DNA, 75 bp, Artificial Sequence
  Synthetic
gatgagatcgtggtcacgtaccatggtgactcctgtgctggctatcgtcacagtaagtctaccatccaggcatgg

SEQ ID NO: 24632 - DNA, 75 bp, Artificial Sequence
  Synthetic
atccggacgactcgtgtgtgcggcacccaccccgttgtcatcgagagggttgctagaatcggtgtacactttgta

SEQ ID NO: 24633 - DNA, 75 bp, Artificial Sequence
  Synthetic
ctgtgtatcaccgcttgtgcccctgcacctatgccgtacacccctttcccggatcttgactatatttttgtttat

SEQ ID NO: 24634 - DNA, 75 bp, Artificial Sequence
  Synthetic
gatgtctacccgcaggttagtggacttttaccatcaagggtcgacacctgcgtgcaaatacctcgttccatatgg

SEQ ID NO: 24635 - DNA, 75 bp, Artificial Sequence
  Synthetic
cagcggctaatgctttttggtaacacactagatgatgaggccttttgttgttcgcggctaatgacttacctgcgt

SEQ ID NO: 24636 - DNA, 75 bp, Artificial Sequence
  Synthetic
ggcataagccacaaagtcaccattggtaatgttgttgccaatgaaggttggagaccggactctcacactctctct

SEQ ID NO: 24637 - DNA, 75 bp, Artificial Sequence
  Synthetic
gttacagttgctgctgcatatttgactattgcccatgataggtggatgcgtactcaggccatatccaagggtgtt

SEQ ID NO: 24638 - DNA, 75 bp, Artificial Sequence
  Synthetic
aaaaggttgactgttgaacacggtcagagtttcatccgccggtgctgggagtgggtcactggttgtacgaggaaa

SEQ ID NO: 24639 - DNA, 75 bp, Artificial Sequence
  Synthetic
gtggctgtcagctggtataaatctttgacacattggctcagtcatggccttgttattgacccgagtaactggctg

SEQ ID NO: 24640 - DNA, 75 bp, Artificial Sequence
  Synthetic
tttgatgctagtcagaattgcaggtgctgcctgttccgtaggcaccgtggacccaaggctgttctgatcagacct

SEQ ID NO: 24641 - DNA, 75 bp, Artificial Sequence
  Synthetic
agttgccgtccagggcgtgtccgcagccttgatggccagttgctcgcggctgggatgattggctttaagtatgac

SEQ ID NO: 24642 - DNA, 75 bp, Artificial Sequence
  Synthetic
agtaaaactcgccgctattacattcactgcggcagtttgacttgccatgttcccacattcactggatttgacatg

SEQ ID NO: 24643 - DNA, 75 bp, Artificial Sequence
  Synthetic
caccgtgtgccgcataacggccaggtggtttgttttgagtttctttctgagtaccgagaagaccctaacagctat

SEQ ID NO: 24644 - DNA, 75 bp, Artificial Sequence
  Synthetic
ctcagcatagaccttgagggcgccacatcgctggctgatgtgccttcttgcgatggggacttaccatctccaact

SEQ ID NO: 24645 - DNA, 75 bp, Artificial Sequence
  Synthetic
gcacccatgcccgatcttgagtttgttggtaagactgacgctgcttatgctattgctcgcgtccccgggggctcg

SEQ ID NO: 24646 - DNA, 75 bp, Artificial Sequence
  Synthetic
acagtccttgttccaacagatatcgttccaggttcctggccgccacgacccgctaccgggcaaccatcttcatct

SEQ ID NO: 24647 - DNA, 75 bp, Artificial Sequence
  Synthetic
caaaaatccattgacacagtcgatgccccagccttgaaaccacggtccgctactgggcaatcatcctcatctcaa

SEQ ID NO: 24648 - DNA, 75 bp, Artificial Sequence
  Synthetic
aaatccattgacacagttgatgccccagccttgaaaccgcctgtggttatacctaaggcttttcaggcgccccag

SEQ ID NO: 24649 - DNA, 75 bp, Artificial Sequence
  Synthetic
actgatttaaagctgcagtttggtgatgttcaacctgctcaagatgttttgtattgctgccctgatggttcaaag

SEQ ID NO: 24650 - DNA, 75 bp, Artificial Sequence
  Synthetic
atcatttgtggtgatttgtttaagaccacatgccattggcttgtcaacgcggcaaattctaactatctccctggc

SEQ ID NO: 24651 - DNA, 75 bp, Artificial Sequence
  Synthetic
ggtggcatctgcggtgagtttcaccgcaggttccctgatttgttcccggtacgcgggcagcgtgtccgctcagct

SEQ ID NO: 24652 - DNA, 75 bp, Artificial Sequence
  Synthetic
atgtaccaacgcggcgctgttaatgttatccatgcggttgcacccgattatcgggataaagttgaccaccgcgcc

SEQ ID NO: 24653 - DNA, 75 bp, Artificial Sequence
  Synthetic
cttcttgcggcataccgggacgcttgcgtgcgcactcagcccgctgctttccctgtgctgggttcagggatttac

SEQ ID NO: 24654 - DNA, 75 bp, Artificial Sequence
  Synthetic
caggtaccatacatggagtctgtgaaagcgtgggtggacaaccacctgccaggggatgagctgtatgttcaccca

SEQ ID NO: 24655 - DNA, 75 bp, Artificial Sequence
  Synthetic
ggggaccgccatcgattcattcttgctgatctaacaaaccctgttagtgtactcacggtgacactaaatatggct

SEQ ID NO: 24656 - DNA, 75 bp, Artificial Sequence
  Synthetic
aggttggctaaccttgccattgccgcagagaaaccaccattcaacaaatttttaactgatttgactgtgagccag

SEQ ID NO: 24657 - DNA, 75 bp, Artificial Sequence
  Synthetic
gggtctgtccgatatcggtttatatcgggtgttcccggggctgggaaatctacgggtgttaagaacactggccag

SEQ ID NO: 24658 - DNA, 75 bp, Artificial Sequence
  Synthetic
ttagtcatcacacccacccgcgagttggctattgaatggaaggagcgtggtttcgaggcatgcacggctcatgtc

SEQ ID NO: 24659 - DNA, 75 bp, Artificial Sequence
  Synthetic
ggctgccagcgtgcttctggccgtgaagtgattgttgatgaggcccctgttcaccagcctcatttgctgcttttg

SEQ ID NO: 24660 - DNA, 75 bp, Artificial Sequence
  Synthetic
attatgcagcgtgcgaaatccgtcaccttgttaggagaccccaaacagatcccagctcttgactttgcccacacc

SEQ ID NO: 24661 - DNA, 75 bp, Artificial Sequence
  Synthetic
ggtgtgactgacgcgctgcgtttggatctgcatcctaccacccagcttttaatcactcaccggtgtccacaggac

SEQ ID NO: 24662 - DNA, 75 bp, Artificial Sequence
  Synthetic
gtgacaaaatttttggccgctgactatcctggcatcagtagtacctccaatgtgatacggtccctgttctggggc

SEQ ID NO: 24663 - DNA, 75 bp, Artificial Sequence
  Synthetic
tgtacggctgagggtaaggtcttggtgttcacacaggctgctaagaagatttatcctggtgcaatgacagttcat

SEQ ID NO: 24664 - DNA, 75 bp, Artificial Sequence
  Synthetic
gaggcacagggtagcacttttgatcagaccacacttatagctacccaagacgctaggggcttgatttgctccagc

SEQ ID NO: 24665 - DNA, 75 bp, Artificial Sequence
  Synthetic
cgtgcccatgccattgtcgcgctcacccgccaccgtaagcgctgcaatgtcattgaccagccgggacttttggcg

SEQ ID NO: 24666 - DNA, 75 bp, Artificial Sequence
  Synthetic
gagatagggttaactgactctatgattactatgcttctcaaccaaagcatggcgccaacgcccgcccctgttgtt

SEQ ID NO: 24667 - DNA, 75 bp, Artificial Sequence
  Synthetic
cagcctgttcgtgcgccggtcgagtctgttgttgccactttaccacctgcgttcactgatgttgctgcgtgttta

SEQ ID NO: 24668 - DNA, 75 bp, Artificial Sequence
  Synthetic
tcagcagaggctatcggccatactacgcaagatctggccgctgtcatccccccggcaccccagttagaacagggc

SEQ ID NO: 24669 - DNA, 75 bp, Artificial Sequence
  Synthetic
acgttgttcttgcctgatcggcttgatggtaaggatgaggtcaccgtcattcgactttctgatattgtccattgt

SEQ ID NO: 24670 - DNA, 75 bp, Artificial Sequence
  Synthetic
cggttactggccccccgtgaccgattgtcagtcgtcggtaccttggtcggtcggtatgggaagttgacgttgacg

SEQ ID NO: 24671 - DNA, 75 bp, Artificial Sequence
  Synthetic
cctcgagcggaattcaacctgcgtcagaagagtttgtggtttctaccaagccttgagaactgtttgccagatgat

SEQ ID NO: 24672 - DNA, 75 bp, Artificial Sequence
  Synthetic
gttgaggtattagagttggtcaacgcaatgcatgataaaggccagacgggtgagctagtccttgacttgactagt

SEQ ID NO: 24673 - DNA, 75 bp, Artificial Sequence
  Synthetic
gatgatgcagcgtgttatcgtataacatttttccagaaggactgcaataagttcaccactggtgacactctagaa

SEQ ID NO: 24674 - DNA, 75 bp, Artificial Sequence
  Synthetic
catggccgtgtgggtcagggtatatctgcctggcccaaaactctctgtgccctttttggtccttggttccgtgcc

SEQ ID NO: 24675 - DNA, 75 bp, Artificial Sequence
  Synthetic
attgagaagagaattgtagcacaacttccatcaggctggttttacggcgacttgtataccgaggctgatctgcat

SEQ ID NO: 24676 - DNA, 75 bp, Artificial Sequence
  Synthetic
gcacatgcaatggcagttcctgatggcataaaggtctttgagaatgacttttctgaatttgacagcacacaaaat

SEQ ID NO: 24677 - DNA, 75 bp, Artificial Sequence
  Synthetic
aatgtttctttaagcttggagtgtgagctcctcactgagaccggtatgccggagtggatggtccgcctctattgg

SEQ ID NO: 24678 - DNA, 75 bp, Artificial Sequence
  Synthetic
cttcagcgggcttactggaatcttgttgctccagatgcgtgccttcgggggtgctggaaaaagcactctggagag

SEQ ID NO: 24679 - DNA, 75 bp, Artificial Sequence
  Synthetic
ccggggactcttttgtttaacaccgtgtggaacatggtcgttgtcaatgcgtgctatgttttcactgatgcagtc

SEQ ID NO: 24680 - DNA, 75 bp, Artificial Sequence
  Synthetic
ctccacgtctataagggtgatgattcagttgtgctctgccgcagctttgaggagcagccagatgctgcccatctg

SEQ ID NO: 24681 - DNA, 75 bp, Artificial Sequence
  Synthetic
attacatcttgtggtttgaagctgaaggtgcaatttgcgggcattggggttttcagccactatatagttgccccc

SEQ ID NO: 24682 - DNA, 75 bp, Artificial Sequence
  Synthetic
ggcgagggtgttgttaaggatctgttgcggacttgggggcgtatgactgaaaagaacttttctgatagtgagagg

SEQ ID NO: 24683 - DNA, 75 bp, Artificial Sequence
  Synthetic
tcacatgacctctgtgttgcagcccaagattttgttaattctgtgacatctcagggtaaagagcacttgactatt

SEQ ID NO: 24684 - DNA, 75 bp, Artificial Sequence
  Synthetic
gctgttaattgtgtgtatcaccgtcagccagaaggatttttccaagtcatttggggggcaattcagtcggtggcc

SEQ ID NO: 24685 - DNA, 75 bp, Artificial Sequence
  Synthetic
ctaggtaaggctgacttgaccacctaccgactaccaatatttagggcttaaatgaataacaccctattttgcttc

SEQ ID NO: 24686 - DNA, 75 bp, Artificial Sequence
  Synthetic
gccatgaggctccaactcccttttgcttacttgctccttttgttcctttccggcgttaatgggggcggatgggac

SEQ ID NO: 24687 - DNA, 75 bp, Artificial Sequence
  Synthetic
cctcgttcccctcaaggacctgccccccgctggcgcggcccgcgtcgcggtcggtcaggtggctcccgccctcag

SEQ ID NO: 24688 - DNA, 75 bp, Artificial Sequence
  Synthetic
ggagccaatcagacctctgccacaccgctcacaacccgcgcatctgcgcctggcactgtccctgtccctgacgtc

SEQ ID NO: 24689 - DNA, 75 bp, Artificial Sequence
  Synthetic
gaccagcgtggcactatcctccggcgtcaatacaatcttgcttcgtctccactttccctatctgtcgctggttca

SEQ ID NO: 24690 - DNA, 75 bp, Artificial Sequence
  Synthetic
tctaatgctgtgctgtactctgcccctctctcccctttgctgcctttgcaggacgggactaatgcgcacatcatg

SEQ ID NO: 24691 - DNA, 75 bp, Artificial Sequence
  Synthetic
tcaacggaggctagtaattatgctcaatacagggttgttgctgcaaccctgcgttttcgacctgtcgtgcctgcg

SEQ ID NO: 24692 - DNA, 75 bp, Artificial Sequence
  Synthetic
tctgtcggtgggttttctataagcatgtctttttggccacagtccaacaatgttccaacatctgttgacatgaat

SEQ ID NO: 24693 - DNA, 75 bp, Artificial Sequence
  Synthetic
tctatcacatctactgacgtgcgcattgtctctcagcctggtatggccactgagcttgtgatcccaaaagagcgc

SEQ ID NO: 24694 - DNA, 75 bp, Artificial Sequence
  Synthetic
ctgcactatcgcaatcagggctggcgtagtgttgagactgcaaacacatcacaggaggaggcgacgtctggtacc

SEQ ID NO: 24695 - DNA, 75 bp, Artificial Sequence
  Synthetic
atcatagtggcctgccatggcagtcctattaattcttataccaacacaccttacactggccccttggggcttctt

SEQ ID NO: 24696 - DNA, 75 bp, Artificial Sequence
  Synthetic
gaccttgcactcgtccttgacttccgtaatctaacgcctggcaatactaattctaggttgacccggattaagacc

SEQ ID NO: 24697 - DNA, 75 bp, Artificial Sequence
  Synthetic
acaactcagcaccgcctgacccgcgggccacgcggtgctcaattgtcttccccgtctttccaaagatttatgggt

SEQ ID NO: 24698 - DNA, 75 bp, Artificial Sequence
  Synthetic
gatgccacacttggtaacaattctgctgttggtgaggttgggggcgggatcgtcggtttgattctgaatgtggct

SEQ ID NO: 24699 - DNA, 75 bp, Artificial Sequence
  Synthetic
gatagtttgttggggaatataccatccactattttatccctcgctggtgggcagcttttatatgggaagccagtg

SEQ ID NO: 24700 - DNA, 75 bp, Artificial Sequence
  Synthetic
acctcatccaatggtgagcctacagtcctgctttatgggtctgttgagcaggctcagcttgacaaaccactgcag

SEQ ID NO: 24701 - DNA, 75 bp, Artificial Sequence
  Synthetic
attcctcatgatgttgatctcggcctgagtagcgttgtcgcccaggactatgttaacaatcatgaggctgaccgc

SEQ ID NO: 24702 - DNA, 75 bp, Artificial Sequence
  Synthetic
ccatcacctgcgcctgccccgaagcgtccgctcgggactctgcgcactggtgacatcttgttcttgcgtatgccg

SEQ ID NO: 24703 - DNA, 75 bp, Artificial Sequence
  Synthetic
aacagtgagtatatcaactctacacctgacatgggcggtcctgtttatcgcagtcaaaatgctgagcttgtcaat

SEQ ID NO: 24704 - DNA, 75 bp, Artificial Sequence
  Synthetic
gtcatcacaggtcaaagaggcccaatgcggtctgttgattggacgaaagccacactggatggggaggccctcccc

SEQ ID NO: 24705 - DNA, 75 bp, Artificial Sequence
  Synthetic
cgtactagcactggcacccccccatacataaagattcctcttgccggcaaattgtcgttctggcttcacggccat

SEQ ID NO: 24706 - DNA, 75 bp, Artificial Sequence
  Synthetic
gtgatagtgatggcggcgttaagccgtgtgctcgccccagccccccccagggggggttggggcaagcgtttcagg

SEQ ID NO: 24707 - DNA, 75 bp, Artificial Sequence
  Synthetic
cgcttgcctgaccattatttttcttgcccaccctgtaaagggtggacagagtccaggccacatctcctggacatt

SEQ ID NO: 24708 - DNA, 75 bp, Artificial Sequence
  Synthetic
gaacccgcgccctgttgggtgcgggtgaagccgccgcgcaagcggcggtacgtccccgaagggcgattggctgat

SEQ ID NO: 24709 - DNA, 75 bp, Artificial Sequence
  Synthetic
ttgtttcagccacgcgactctggggacacactcctgcgcgatgcgtgggaaagtttcctaggcgtgcccctccca

SEQ ID NO: 24710 - DNA, 75 bp, Artificial Sequence
  Synthetic
tctgccaccaacccgcggccgctcacgcttgccgggatgcgcgagctatacgtttacctcacggagctcgcgcct

SEQ ID NO: 24711 - DNA, 75 bp, Artificial Sequence
  Synthetic
ggcggggacgcggggccttaccacgccgggttcaaccgggcccaggtcgaggccgcgattgcgacgtttgaggcc

SEQ ID NO: 24712 - DNA, 75 bp, Artificial Sequence
  Synthetic
acgcttcctccagagatgctcgcaccccgccggcagcgggtcgaggtgcccccagacatgcttgagctgctctac

SEQ ID NO: 24713 - DNA, 75 bp, Artificial Sequence
  Synthetic
gacgccaaaggttgggatgacataccgggcccaggcatgcgcgacatcttccgggccatgtggaccaagctgcgg

SEQ ID NO: 24714 - DNA, 75 bp, Artificial Sequence
  Synthetic
aaaggggtaaacgatgctttcatcccgcttgcgcagtgccgcgactggatcacacagaacctaaacccaggcatc

SEQ ID NO: 24715 - DNA, 75 bp, Artificial Sequence
  Synthetic
tctgttaaagaggctgtcttggcgttcatcactggtggccagaacgcactgcgtgggaatgctgcagtccttgca

SEQ ID NO: 24716 - DNA, 75 bp, Artificial Sequence
  Synthetic
gcgaaggtgcttgcgctgctcaagccaaccaccctcgcaatcattctctctcaacatcgcaacactactgccggt

SEQ ID NO: 24717 - DNA, 75 bp, Artificial Sequence
  Synthetic
tgggtgctcaccctaaccgcacttgtggagctgtatgccggccttggccccatctgcgaatgggtagttgacctg

SEQ ID NO: 24718 - DNA, 75 bp, Artificial Sequence
  Synthetic
ttaaaagcgctgcttgagttcgctggtggggttgctggatgtatttttgaccagttcaccacctggtatggtcga

SEQ ID NO: 24719 - DNA, 75 bp, Artificial Sequence
  Synthetic
ctgacgcagtctgaggggccagcagggtatgcggccgtgggtgcagggctcatcggcctcatctacctgtggtac

SEQ ID NO: 24720 - DNA, 75 bp, Artificial Sequence
  Synthetic
gcgggtcgactccctggcaccagcgcaaccacacgcctgctcaaggcgtgtggggcggtcaccaccggcgttggg

SEQ ID NO: 24721 - DNA, 75 bp, Artificial Sequence
  Synthetic
gcagtgcgcgcagtcaagtggatcattgacatgttccgcgagcaacatcaagctggcatggtgcgtatgttcatg

SEQ ID NO: 24722 - DNA, 75 bp, Artificial Sequence
  Synthetic
gcaagaacagcagcgcttctcgactgcattgaggagaacccatctcccaacagtgaagaggcgcgtgggtggttg

SEQ ID NO: 24723 - DNA, 75 bp, Artificial Sequence
  Synthetic
tctagcctagaagtgattgcgggggagggggaggagatgctcttactacttggtgcgtcgccccttgccggcatg

SEQ ID NO: 24724 - DNA, 75 bp, Artificial Sequence
  Synthetic
gttcgcagtatgtgcgaacgggttcagggtgcagcctcagccatgcgagcgcaccttgcactcaataccacccgt

SEQ ID NO: 24725 - DNA, 75 bp, Artificial Sequence
  Synthetic
aagcaaccaacaatggttgtctttgggggcccacctggcattggtaagaccactctctgccatgccattgctgcc

SEQ ID NO: 24726 - DNA, 75 bp, Artificial Sequence
  Synthetic
aaaatgggactgcccacctccactttcagcctgctcaatgaccaccacgacacttacactggcaaccctgtcgca

SEQ ID NO: 24727 - DNA, 75 bp, Artificial Sequence
  Synthetic
atttgggacgagtttgacacggataagaacggcgactttgtcgagatggtggtgtccctagtgaacacccagccg

SEQ ID NO: 24728 - DNA, 75 bp, Artificial Sequence
  Synthetic
tgcccgctggactgtgacaggattgagaacaagggtcgggtgtttaccagcagcatcatcttggccaccaccaac

SEQ ID NO: 24729 - DNA, 75 bp, Artificial Sequence
  Synthetic
tacgccacccctgtcctcccggagcacccgcgatctgaggccttctggcgtcgaatcatgtatgttgacgtcaag

SEQ ID NO: 24730 - DNA, 75 bp, Artificial Sequence
  Synthetic
tgcgcggactacgagaagtgggtccgggacaaccctggcaagcctgccccccccaccctgtttaagagtgacttc

SEQ ID NO: 24731 - DNA, 75 bp, Artificial Sequence
  Synthetic
tcccacctgcagatgaccatccgaccgttcatgggcgtggacgaccaaggcacgcttcttgatggccgcactgct

SEQ ID NO: 24732 - DNA, 75 bp, Artificial Sequence
  Synthetic
cggggcacaagcgtgaccctctctgggattgtacggcgcctcaacaaatcatataaggctgagggcgggccgcct

SEQ ID NO: 24733 - DNA, 75 bp, Artificial Sequence
  Synthetic
aagcgccacctctgggtgcaggttccgcatgaccaactagagcagtcggccggcgcattgcgggggtggagggtg

SEQ ID NO: 24734 - DNA, 75 bp, Artificial Sequence
  Synthetic
tgggcttgtgccccttgtgaagtagtggtgtcgcctgaaagttgccgtgtggtgaacgggtctgggctcaacacc

SEQ ID NO: 24735 - DNA, 75 bp, Artificial Sequence
  Synthetic
atcttcgtggcaagcgtgccaccaacagtggagcaaatggagttttgtctccacgtgccaaccaaaggcatggcc

SEQ ID NO: 24736 - DNA, 75 bp, Artificial Sequence
  Synthetic
aacatccaaccaaatatgtcccgagcgtttgacagctcaatgtgggggtctccactcgacctgtttgtccacaac

SEQ ID NO: 24737 - DNA, 75 bp, Artificial Sequence
  Synthetic
gtgtcagtgtcgtcctcaaccatgcgcgacatcgtgttcggtgtgagcggtgccactgtccacgtatgggatgac

SEQ ID NO: 24738 - DNA, 75 bp, Artificial Sequence
  Synthetic
cccaaaaccatgcccgtcatacctgtcacacgcactgtggtcgctgccggcctccctgcagttgtggctggcata

SEQ ID NO: 24739 - DNA, 75 bp, Artificial Sequence
  Synthetic
tggcgtcacgtgtgctggcgctcggcgcctggtgcagtgcgcgcaatgagggctgcatggtctggcgggatagac

SEQ ID NO: 24740 - DNA, 75 bp, Artificial Sequence
  Synthetic
aacttcatcgactgtttccgggccttggcagggacgcgcttcacggcaaacccagtttccaccctgttccgcacg

SEQ ID NO: 24741 - DNA, 75 bp, Artificial Sequence
  Synthetic
cccggtggtgacatctccctttacacctacaaggagggaatgtacgtgtgtgcaacaccaggcagggtgcctgtt

SEQ ID NO: 24742 - DNA, 75 bp, Artificial Sequence
  Synthetic
gtggggggtggagactttccaaaccttggcacctccataccagacaacacaagctggtgggatttgctgtccctt

SEQ ID NO: 24743 - DNA, 75 bp, Artificial Sequence
  Synthetic
ttccttgatgtgctggtcaccaattatctgcccctcatcctcgtcggggtgacaatgtacaacgtgaccacgctg

SEQ ID NO: 24744 - DNA, 75 bp, Artificial Sequence
  Synthetic
atgcgccgcggccagggccacgcggaagcgaagggcaagacaaaacatggtcgcggtcacgcgttgcgcgacagt

SEQ ID NO: 24745 - DNA, 75 bp, Artificial Sequence
  Synthetic
gagtacgaggagtacaaggacctgatgcgcgactggcggcgtgacctcactgtggcagagttcagggagattcgc

SEQ ID NO: 24746 - DNA, 75 bp, Artificial Sequence
  Synthetic
gaccgcgcgcttgctggcggcaatgacgctgcatcccagcggtatcgggcgtggctagacgtgcgcgaattgcgc

SEQ ID NO: 24747 - DNA, 75 bp, Artificial Sequence
  Synthetic
atgcaaaacaatgcctaccgttatgacgtggtggacgtgattggccgccaggggcacacggtgcaggcagtgcgg

SEQ ID NO: 24748 - DNA, 75 bp, Artificial Sequence
  Synthetic
caggacctcatccgtgcaccccgcaagccactccgggacgactatgaggatgcttactgcatggaaggggctggc

SEQ ID NO: 24749 - DNA, 75 bp, Artificial Sequence
  Synthetic
tcccctttggtgcctgtgatcactggtggcgtgcgcgtggggtgggcgtgccacgttgggaatggccgctttgtc

SEQ ID NO: 24750 - DNA, 75 bp, Artificial Sequence
  Synthetic
acgtgcgcacaccttcttgacggcaccaccactgtggcagatgatgtcccaagggatgtcgtgatccaccaggac

SEQ ID NO: 24751 - DNA, 75 bp, Artificial Sequence
  Synthetic
accgcgcagttccgcactaacttcaacggccccgcataccagcttggcgaagggctcccagagtacttttccggc

SEQ ID NO: 24752 - DNA, 75 bp, Artificial Sequence
  Synthetic
cagcgcctcccagtgcgcgtcattggcgagggagtgtttgagacatccacgaccactgttgatggttggcagtac

SEQ ID NO: 24753 - DNA, 75 bp, Artificial Sequence
  Synthetic
tcagttgtcgcgggcgttgacacctgcccgggcgattgcggactgccactcttcaacgcccgccaccagctcgtt

SEQ ID NO: 24754 - DNA, 75 bp, Artificial Sequence
  Synthetic
gcaatccacgccgcgtcctcagtggacaggtctgtcaagcttgccaaccgtgtgtttggcgtcaaggggaccgcc

SEQ ID NO: 24755 - DNA, 75 bp, Artificial Sequence
  Synthetic
aatacctttgcgtggaagggactccaggtcaaggaatcaggccggaacgtgggcggcatgccaactggcacccgg

SEQ ID NO: 24756 - DNA, 75 bp, Artificial Sequence
  Synthetic
tatgggcggtcaccagcacaccccaagcagcaggaaggggagacgtatgagcctgcgccgctgggcgcgggtgac

SEQ ID NO: 24757 - DNA, 75 bp, Artificial Sequence
  Synthetic
ccgcgctatacccactcccaggtggaaatgctggttaacgggttacgaccttaccaggagacgccccctgccgcg

SEQ ID NO: 24758 - DNA, 75 bp, Artificial Sequence
  Synthetic
tttgacctcaacatactgcgtgcggccgtcaaccactgccgcgggtacattcactctgtcattgggaaccaccgc

SEQ ID NO: 24759 - DNA, 75 bp, Artificial Sequence
  Synthetic
agcccaaatctgccatttaacctggcggctggcagcatggatcgggcgacagcagcaggcccgttcgtggcaggt

SEQ ID NO: 24760 - DNA, 75 bp, Artificial Sequence
  Synthetic
ttgaaaggagattactgggatgaagacgctggccgctatgttggtgcgctcggggaccacattgagcgcacgtgg

SEQ ID NO: 24761 - DNA, 75 bp, Artificial Sequence
  Synthetic
gacggcgcagcgcgcggggcaccaccatgcaatgcgtataagcttgcgctaaaagacgagctcaggcccattgag

SEQ ID NO: 24762 - DNA, 75 bp, Artificial Sequence
  Synthetic
aagaaccagcaagggaaacggcgacttctgtggggggccgatgctgggctgacgtgttgtgcggctgccgttttc

SEQ ID NO: 24763 - DNA, 75 bp, Artificial Sequence
  Synthetic
actggggtcgcgaacaggctgaaagaggtcgtgccgctgaccccggtctgcgttgggataaacatggactcagcc

SEQ ID NO: 24764 - DNA, 75 bp, Artificial Sequence
  Synthetic
caagttgaggtcgtccaccgggcccttcaagaccggacagtttacaacgtagattacaccaagtgggactccaca

SEQ ID NO: 24765 - DNA, 75 bp, Artificial Sequence
  Synthetic
atgcagccagccatcattgctgaggcaatacagattatgtgtgacttgtcagaggacaccccgatgacaacagca

SEQ ID NO: 24766 - DNA, 75 bp, Artificial Sequence
  Synthetic
gtcggaaatgcgctcaaatcacctgctctcgggttctttgaggacatagtgttcaccacgcgcaccgggctcccg

SEQ ID NO: 24767 - DNA, 75 bp, Artificial Sequence
  Synthetic
tctggaatgccattcacctcccagatcaattcactatgccacatgatcttgattgcgtactgcatcctgaaggtc

SEQ ID NO: 24768 - DNA, 75 bp, Artificial Sequence
  Synthetic
taccacacggctgaagtggcgtaccctggcaacatcttcaatggcgaaaccatcttcacgtatggcgacgacggg

SEQ ID NO: 24769 - DNA, 75 bp, Artificial Sequence
  Synthetic
ctgtatggtttcacgcgcgccactgcatcggtgtttgagcatatcattgaggtcatgagatccgtgggcctgcag

SEQ ID NO: 24770 - DNA, 75 bp, Artificial Sequence
  Synthetic
ccaacagccccagacaagtcccccgagatcaagccggtcaccggggacccagtgttccttaagagatcaatccac

SEQ ID NO: 24771 - DNA, 75 bp, Artificial Sequence
  Synthetic
cggtatgctgatggtcgggtgcgcgctctaattgaccctacgagcctgactcggcagtgttattgggttaagggt

SEQ ID NO: 24772 - DNA, 75 bp, Artificial Sequence
  Synthetic
ccccgtcaccgagacccccgggaggtgacctaccctgaccccgttatacgcggggttcaacttgacaacgtgctc

SEQ ID NO: 24773 - DNA, 75 bp, Artificial Sequence
  Synthetic
attgctgcctcccaacaccccatggacgtatgggagcccatctaccagcttgtgatcaagacagcggcaggcgag

SEQ ID NO: 24774 - DNA, 75 bp, Artificial Sequence
  Synthetic
cgggcaccgctctctatattggaccgccaccaggccaacgccgcgtacatcatgtggtacagcggtgctaccagc

SEQ ID NO: 24775 - DNA, 75 bp, Artificial Sequence
  Synthetic
ggtggcgacgccgccagcgatgaggctggcgacaaaatagtgtttgtgatggagggcgatcgtgcgcccgcgccg

SEQ ID NO: 24776 - DNA, 75 bp, Artificial Sequence
  Synthetic
tccaccgctccggcggtggacggcgtggtggggcccaatgactctgcccttgtgccaacgggcggccctgcgcca

SEQ ID NO: 24777 - DNA, 75 bp, Artificial Sequence
  Synthetic
tctgcagcggcccaggtggctcaggttgctgccgccacgggcgccgtgagtaccaacgtgccgcctgatattgga

SEQ ID NO: 24778 - DNA, 75 bp, Artificial Sequence
  Synthetic
atgacttttgtgatgttgactcaggtcacttggactagtcggcagccgcagggcaccctcctgggctccctccaa

SEQ ID NO: 24779 - DNA, 75 bp, Artificial Sequence
  Synthetic
cttgggcccgggattaacccgtacattgcgcacatggcgcgtatgtacacagtgtggtctggggggtttgaggtc

SEQ ID NO: 24780 - DNA, 75 bp, Artificial Sequence
  Synthetic
cggctgaccgtggctggctctgggatatttgccggacgggttatggcggcactcgtcccccccggcatctcccca

SEQ ID NO: 24781 - DNA, 75 bp, Artificial Sequence
  Synthetic
aatgaggtgcgtaacccgggcgctttcccacacaacattcttgacgcccgtaccacctcacccatcacgatggtc

SEQ ID NO: 24782 - DNA, 75 bp, Artificial Sequence
  Synthetic
atccctgacgtgcgccccggcgactaccatgggcccggcgacaacacaccaacaacatcaattggcctgtgggtc

SEQ ID NO: 24783 - DNA, 75 bp, Artificial Sequence
  Synthetic
ttcaaccccttgatcaacccgtttgccgggggcagtgcaacaatcaccagcgttaccatcacggtggaaaccagg

SEQ ID NO: 24784 - DNA, 75 bp, Artificial Sequence
  Synthetic
cctttgccagagttcacgctcgccatcctcaagcctcccgaccaagaaactgtcgacggcgcccaccccaacggc

SEQ ID NO: 24785 - DNA, 75 bp, Artificial Sequence
  Synthetic
ctattgccccgtcggcttggccgatcccggggtaatcgggttggcggcgtggtgacggcgctgtctgtggtgtcg

SEQ ID NO: 24786 - DNA, 75 bp, Artificial Sequence
  Synthetic
attgtggaccaagtgaaccaccattggaacgctagcggcgccacctacgggtggagcgtcgggccccccgccccg

SEQ ID NO: 24787 - DNA, 75 bp, Artificial Sequence
  Synthetic
ctggtctgcaatgtggacaatgggacttacactaccgggtacctcaacatagacgcagactccaagggacccatc

SEQ ID NO: 24788 - DNA, 75 bp, Artificial Sequence
  Synthetic
atgcccaacattccaaacaactggccagatttctgtgtcagctcaattgaccacacaggcaccaccgtgggccag

SEQ ID NO: 24789 - DNA, 75 bp, Artificial Sequence
  Synthetic
tggaaccaagggggtgtggttggcaacatcaacttcttcgatgacaattgggacgtgactgagggtgtagtggcc

SEQ ID NO: 24790 - DNA, 75 bp, Artificial Sequence
  Synthetic
aatggtatgacattttgtggcacgttcgccgggggcagcgccgtcgtcgtgacgcttgaaaaggagatcaatgct

SEQ ID NO: 24791 - DNA, 75 bp, Artificial Sequence
  Synthetic
gccaacatggggatagcgcttgaagtcaaggctgggggcactgccacgagtgccgtgtcaaatgtaatcttcact

SEQ ID NO: 24792 - DNA, 75 bp, Artificial Sequence
  Synthetic
ccgatgtggcaaacaacctctgtatcccggtcaccaccagtggtgccaatgtatggcgtccgccggtcgtacggg

SEQ ID NO: 24793 - DNA, 75 bp, Artificial Sequence
  Synthetic
cccattggccctaaccacccggtggtgtggcacgagcacctcctccgggaccaccccaccttggcaagcgtcacg

SEQ ID NO: 24794 - DNA, 75 bp, Artificial Sequence
  Synthetic
tgttctcaacttgcccacacgtcagacgtcctcgaatcgggaccagtcaacgtgcccagtggccagatggcagtt

SEQ ID NO: 24795 - DNA, 75 bp, Artificial Sequence
  Synthetic
tttgaagtcaactccaacgggaatacattccagcttggaattgcctcttcaggggtagcatacactggcggcacg

SEQ ID NO: 24796 - DNA, 75 bp, Artificial Sequence
  Synthetic
ccgggcacggtggtcgacctagaccctgacaccaccttcacttttactggattgttcacaatcaacactgccctc

SEQ ID NO: 24797 - DNA, 75 bp, Artificial Sequence
  Synthetic
atgggaccggcaggggctgcagggttccgccatgggtagctggacacagggaatgattggcctcgcgggcttcac

SEQ ID NO: 24798 - DNA, 75 bp, Artificial Sequence
  Synthetic
cgtcgatgccatcaccgggcttggcgcactaggcgtccaggcgcaaaatgctgagacaaaccgccaacttgcaac

SEQ ID NO: 24799 - DNA, 75 bp, Artificial Sequence
  Synthetic
cctccaggccgaggctctcaagcagcagcttgctgctaacaagctatccatggagcagtgggagaagattaacaa

SEQ ID NO: 24800 - DNA, 75 bp, Artificial Sequence
  Synthetic
ccccgccagcatgctctcctctgccacggcagctgggtttgaccccgtggccgccatgcagatcgcctcacgggg

SEQ ID NO: 24801 - DNA, 75 bp, Artificial Sequence
  Synthetic
caccgtttcaaggtggcacggcggtgttcagctggccccactctcccaagtccaagtggatggcttacggggcac

SEQ ID NO: 24802 - DNA, 75 bp, Artificial Sequence
  Synthetic
ggccctggcaagggccggcctccaagccggcggcacgttcaccactggggtccgcggcccctacaggctgcaggc

SEQ ID NO: 24803 - DNA, 75 bp, Artificial Sequence
  Synthetic
tggtcgccctgtttatcgcagagactccatctcttcctgggctgagtcgacatcaactatgtccacgcgggtgcg

SEQ ID NO: 24804 - DNA, 75 bp, Artificial Sequence
  Synthetic
gtccccttcagtgacatccgcctcctcaagcggatcgtcaacgagctcacttgggccccgcccggtggtcgtcat

SEQ ID NO: 24805 - DNA, 75 bp, Artificial Sequence
  Synthetic
cccagggtctacctctgcaacttgggtgccaggctcagaggcctgatgtgcacgggtgggtccactgatgctggt

SEQ ID NO: 24806 - DNA, 75 bp, Artificial Sequence
  Synthetic
ctttcccagccagtctttctatctttcctttctttgccctcttttgtttctgtggcatcctgcacgcgttcgggc

SEQ ID NO: 24807 - DNA, 75 bp, Artificial Sequence
  Synthetic
aggttcaaatgcgattaagcgatcgcagtgtcatgcattttcttccctcttgcgctgcacacgcgttcgggtgca

SEQ ID NO: 24808 - DNA, 75 bp, Artificial Sequence
  Synthetic
ctcttgcgctgcacacgcgttcgggtgcactaagccatgttaagcgacatgggcgcctccagtcggagatgggga

SEQ ID NO: 24809 - DNA, 75 bp, Artificial Sequence
  Synthetic
cgcaccgtggatcctaggctttactggtcattgcgcaaagtgaaatcttttcaagtcccaatgggtcttagatat

SEQ ID NO: 24810 - DNA, 75 bp, Artificial Sequence
  Synthetic
cacaactccgttcgtcccgactctccctgccttttgaataccaatgaattgtagtagttcacctctccttgtgag

SEQ ID NO: 24811 - DNA, 75 bp, Artificial Sequence
  Synthetic
tcaagagaggtcaaacaacggtatggtgaaaaagaactagaaggtagaatacccatcactttagatatgcctcag

SEQ ID NO: 24812 - DNA, 75 bp, Artificial Sequence
  Synthetic
ttgagtagtggtgagattgccctggtactgaccacccgaacctggtggtctttcagtcctctgcactttgtcttt

SEQ ID NO: 24813 - DNA, 75 bp, Artificial Sequence
  Synthetic
actctgtatgggagatacaattgcaaatcttgttggtttgccaacaaaggattgattaagtgcagcaatcattac

SEQ ID NO: 24814 - DNA, 75 bp, Artificial Sequence
  Synthetic
caacttattgagatcaccagacaactccattagttctcctttggagagtgacccaacctttaggaacatgttttt

SEQ ID NO: 24815 - DNA, 75 bp, Artificial Sequence
  Synthetic
ttgtgtttgaagtgtctaacagcaatgttgagcaggtcagattattgtggcatctgtgggggcatcctcccaaag

SEQ ID NO: 24816 - DNA, 75 bp, Artificial Sequence
  Synthetic
ttgtgttgatttcattgtcatcaatgaatcaacttctttattaaggtctctcaaacttgtaagatcactttcatc

SEQ ID NO: 24817 - DNA, 75 bp, Artificial Sequence
  Synthetic
aaactggtctttgaaaccacgccatctgcaccaccctacaccccatagaatagggcccagggcgcaccccccatt

SEQ ID NO: 24818 - DNA, 75 bp, Artificial Sequence
  Synthetic
tctcttatccctcctcatcattctctggacactggccacctttgcgaagtccaatccagacagtaaagccctcgt

SEQ ID NO: 24819 - DNA, 75 bp, Artificial Sequence
  Synthetic
ggggggtgcgccctcggcccctggactccgtgggccacggagtccattagtcaatttcgaggggtgctgatgctg

SEQ ID NO: 24820 - DNA, 75 bp, Artificial Sequence
  Synthetic
atgagacctttctacactgtctacctttgagtttgaattgcccatctgggtctgcaatcatgatgcaatttaagt

SEQ ID NO: 24821 - DNA, 75 bp, Artificial Sequence
  Synthetic
ggagtgcaccacctgatcagacatgatgaaggtagaagttgatgcgtagaatctccaaagcctaggatcctctgt

SEQ ID NO: 24822 - DNA, 75 bp, Artificial Sequence
  Synthetic
tgttgctgaagcatagagcaaagtcaccaaagtccatccaatccgatagggattttagtacttcagtgaactcct

SEQ ID NO: 24823 - DNA, 75 bp, Artificial Sequence
  Synthetic
cgcaccgaggatcctaggcattcctttatcatgagtgaataccttgatgaattgaaggaacttattaggaaatgg

SEQ ID NO: 24824 - DNA, 75 bp, Artificial Sequence
  Synthetic
gtgcaccacctgatcagacatgatgaaggtagaagttgatgcgtagaatctccaaagcctaggatcctctgtgcg

SEQ ID NO: 24825 - DNA, 75 bp, Artificial Sequence
  Synthetic
tttcgtaggaatcaatcaatagacagagatcagattgtgtcatccttataaaacaagaattttctttcttgttat

SEQ ID NO: 24826 - DNA, 75 bp, Artificial Sequence
  Synthetic
atacctgacgaagagatgtatatagaacagaagaccagtttcttgtctcaagtcaatctcagatcagcagtcatt

SEQ ID NO: 24827 - DNA, 75 bp, Artificial Sequence
  Synthetic
ttgatcttgtgtagatatgtaaagaaatcaggaaaggaatcctgtcttcactttccagtgcttccaaagcaagga

SEQ ID NO: 24828 - DNA, 75 bp, Artificial Sequence
  Synthetic
gaaggcctaaaattgttgtcaattattatagagatagattcctgcaagaagcatggatgcgtgcacaacaagaac

SEQ ID NO: 24829 - DNA, 75 bp, Artificial Sequence
  Synthetic
agactgatctggaagttatctgaacatcaagccttgaaattacaaagttgttttccataatttgccctctgtaaa

SEQ ID NO: 24830 - DNA, 75 bp, Artificial Sequence
  Synthetic
aaaacagtgaatcagatcttgagagatcataagattgtgggacccactctacccgatattgtgcctgatggttac

SEQ ID NO: 24831 - DNA, 75 bp, Artificial Sequence
  Synthetic
ggtgcaaagggttcatattgtattcaggtccctgtaatttataggagtacttatttttcagatcttttgtgtggt

SEQ ID NO: 24832 - DNA, 75 bp, Artificial Sequence
  Synthetic
agagtgattggatcaacgataatcttgttggaggctttcgttagggtaagtcatgaatcctttgagatcaagtac

SEQ ID NO: 24833 - DNA, 75 bp, Artificial Sequence
  Synthetic
tactgaagttcagtttgaccttggaaaagacggaatgggtggattcaaaattttcatcctgctttatgaggagtt

SEQ ID NO: 24834 - DNA, 75 bp, Artificial Sequence
  Synthetic
aaatcagattttgagaagttaatgcagttgtctaaagaccttagtaggtgtggtctaacactcatccctgttgta

SEQ ID NO: 24835 - DNA, 75 bp, Artificial Sequence
  Synthetic
tgttaacatcaaggaattccttgccactaaaaagagggtgtagtggaatgagacccactccatcaagactgatgt

SEQ ID NO: 24836 - DNA, 75 bp, Artificial Sequence
  Synthetic
gatggtagatcaaattattatacagaacactttccagactggacaatagagagaatgagatggttgatactgaaa

SEQ ID NO: 24837 - DNA, 75 bp, Artificial Sequence
  Synthetic
ggttcccttgagatccactaacaaaacattcaatttcatgtacttcaagttcaagtatgtcaaacccctgatttt

SEQ ID NO: 24838 - DNA, 75 bp, Artificial Sequence
  Synthetic
ataactaacttcttaagagacaacggggaagagatcgaggaattagaatattctagacttgtgtacagtctctca

SEQ ID NO: 24839 - DNA, 75 bp, Artificial Sequence
  Synthetic
gtgcctcttctatgtcgaccttctgaaccagaaccttgcttttaatgtgatagttagtttttctttcatatttaa

SEQ ID NO: 24840 - DNA, 75 bp, Artificial Sequence
  Synthetic
aatatggaaaataaaaacttgggccttgagtctctcaaaatattgaaagaagaaggcttagattacaaagcaaaa

SEQ ID NO: 24841 - DNA, 75 bp, Artificial Sequence
  Synthetic
atttgaaactcttccttgaatggcttatagtgaagtcaatttccattggaatggtgtcctctcttgagcacaaaa

SEQ ID NO: 24842 - DNA, 75 bp, Artificial Sequence
  Synthetic
ttgatgtcagtgatgagagatggtgtcaactccaacatgtcggcttctgaatgcagagttggaatggccaaagtt

SEQ ID NO: 24843 - DNA, 75 bp, Artificial Sequence
  Synthetic
tgatctcatcaaaagtcttataattacgcctattttcccaatccagtaagtgtaagaaactagaaaagttcacat

SEQ ID NO: 24844 - DNA, 75 bp, Artificial Sequence
  Synthetic
tatgatcaattttctttcttgagaaaaaatggattatataaagatgtgtattgtaagacatcacgaacagaaatt

SEQ ID NO: 24845 - DNA, 75 bp, Artificial Sequence
  Synthetic
aaatgtcacccattagaattgagctatgcacatatccaacatctaaatcatcgagggacatgcatctggagatgt

SEQ ID NO: 24846 - DNA, 75 bp, Artificial Sequence
  Synthetic
atcaattggttgaaggaccataaattaatcctgcttagtggtgaaactaggactgctatgttggacgagagacag

SEQ ID NO: 24847 - DNA, 75 bp, Artificial Sequence
  Synthetic
tgagtgttttgcaatccattacaaattgagttaactgccccaggtcatgatctgcttcattaggcaggagttcta

SEQ ID NO: 24848 - DNA, 75 bp, Artificial Sequence
  Synthetic
tgcggttactgtagaaaccatatgtttagaattttggcaagtctgatcaaaaataaaagacactaccaaagtctc

SEQ ID NO: 24849 - DNA, 75 bp, Artificial Sequence
  Synthetic
cttcaccgaaccagaagtactttttaaattgacctgtggttaataaaacaggatgaagcatagattcaaaaacta

SEQ ID NO: 24850 - DNA, 75 bp, Artificial Sequence
  Synthetic
accaaccctataaaatgtggcaatatacaaagtcataagaaattactttctgattgcaacaagatcaaaggttta

SEQ ID NO: 24851 - DNA, 75 bp, Artificial Sequence
  Synthetic
actgacagagaaaattatgacaaatttcagatgagtttaattgataccctgcttccattggtgaggaatccctca

SEQ ID NO: 24852 - DNA, 75 bp, Artificial Sequence
  Synthetic
aaagtactaaatactcgaagattcacactcctatgccttgatgtcatcattctcaacagtctactcgaattgata

SEQ ID NO: 24853 - DNA, 75 bp, Artificial Sequence
  Synthetic
tgtgtgcaacagacagttcattttgcttcacaatgtataattcttccctcttccttctcattatgtgcgaaataa

SEQ ID NO: 24854 - DNA, 75 bp, Artificial Sequence
  Synthetic
gatacaggggaagttgataatgagttcttgattaacaaccattttaaaagtgtgaatgatagactggtgtcaatt

SEQ ID NO: 24855 - DNA, 75 bp, Artificial Sequence
  Synthetic
tacctaaacactcacttgacatatccatggcaacacataaatccaagaactttattctctgtatccaggaaattt

SEQ ID NO: 24856 - DNA, 75 bp, Artificial Sequence
  Synthetic
gatttggtaatagacagattgaataaaaaactaatgagtaagccaaactggattgatagtgtcaaatacaaaatg

SEQ ID NO: 24857 - DNA, 75 bp, Artificial Sequence
  Synthetic
tcagagagttaaggtctgataagaatggagcaatgtgctcatcaaaaaggtcaggaaaatttcttttgattgagt

SEQ ID NO: 24858 - DNA, 75 bp, Artificial Sequence
  Synthetic
aagaggacacttgagatacatgggctatactatgtatctaagtggctcaaacaggttgatattgattcttggtat

SEQ ID NO: 24859 - DNA, 75 bp, Artificial Sequence
  Synthetic
agagcacatgattcatgtttactttgtcctctaattcagtgtggctccctggttttacaggccaaaagaagttgg

SEQ ID NO: 24860 - DNA, 75 bp, Artificial Sequence
  Synthetic
gagtttaagatgatgcgagagcactctgataaatgtgtaaagccaaccttgaaatataaaaaagatgctgcaaga

SEQ ID NO: 24861 - DNA, 75 bp, Artificial Sequence
  Synthetic
gatttactgttgttggagttcttttaggaatggtcacattcgaaaaaacccaatttcccaattcacaggcatttg

SEQ ID NO: 24862 - DNA, 75 bp, Artificial Sequence
  Synthetic
aaatgtggtcaacctgaatttggtagtagcacaattttagatgatgaagttttccttgagtatcttgaggcacta

SEQ ID NO: 24863 - DNA, 75 bp, Artificial Sequence
  Synthetic
aaaaagtcaaagaaaaataatcccaaaagatgggtcttgagaagggtttaagctcctctagtgctgctcgacaaa

SEQ ID NO: 24864 - DNA, 75 bp, Artificial Sequence
  Synthetic
tcaaccttaagccttggtttagtcaactcaatgaaaacaagttcggctgcaaaatttctaatcaatgataagagc

SEQ ID NO: 24865 - DNA, 75 bp, Artificial Sequence
  Synthetic
agacactcatctctggtttgcagacttcacaatgcgaatgcaagatgatagatttcaaaaaatgttttatgtact

SEQ ID NO: 24866 - DNA, 75 bp, Artificial Sequence
  Synthetic
aattactttggcacagttcaatgcagtgagtgttattttcaagatcttgataaaagttataatagtttgctaatc

SEQ ID NO: 24867 - DNA, 75 bp, Artificial Sequence
  Synthetic
gaaaactaccgtttccatctctaacacatttagaacccatactcttacaaaatcctatgaagccggagcaaatac

SEQ ID NO: 24868 - DNA, 75 bp, Artificial Sequence
  Synthetic
tatcagaaaactggtgaacggtcaaggtgttacgggctgatgtttaggagtgaacaatttgagaatgtatatgag

SEQ ID NO: 24869 - DNA, 75 bp, Artificial Sequence
  Synthetic
tactctgaaaggctgatttattaatagcatcagtgattatcttctttgcccctctgacaaagttttttgaaagct

SEQ ID NO: 24870 - DNA, 75 bp, Artificial Sequence
  Synthetic
gttggtgagagcttttatgcagatcctaaaagatttttcttgcccataatgagttcagaagtaatcttaaagatg

SEQ ID NO: 24871 - DNA, 75 bp, Artificial Sequence
  Synthetic
tagactgtaccgatttaaccagtgagggcacttcttccctatctaaaattcttgtgcctgacatgaccttagtcc

SEQ ID NO: 24872 - DNA, 75 bp, Artificial Sequence
  Synthetic
tgtgttgagatgttatcatggctagactggctgagtgagcaagagttgagggcttttaagtcaaaactctacact

SEQ ID NO: 24873 - DNA, 75 bp, Artificial Sequence
  Synthetic
tcaagaccaatcttaagtcaccatgagctcttaagttcaaccatctgaactcaagcaccttatcaattgtacttt

SEQ ID NO: 24874 - DNA, 75 bp, Artificial Sequence
  Synthetic
ctaataattaacatactaactgttccaagtaagcgagttcaggtttacctgcaggggtttagatacttaataatg

SEQ ID NO: 24875 - DNA, 75 bp, Artificial Sequence
  Synthetic
catcaacatcactcaacctcaacatttttgctagacattcatcaggtgaggtttgcaatgcattgattagaaact

SEQ ID NO: 24876 - DNA, 75 bp, Artificial Sequence
  Synthetic
gcgtttgttaatgaactacactttaaggaattacaaaataagcttaaggtccaacctttgacaatctcagagtgt

SEQ ID NO: 24877 - DNA, 75 bp, Artificial Sequence
  Synthetic
cttcttgtatatcacctgatctgattctatgaaacaaacttctacatgagtttctgattgtcaatgggaggtcat

SEQ ID NO: 24878 - DNA, 75 bp, Artificial Sequence
  Synthetic
tatgtgtttacattaatggatgatttagttcattcattattaacagaagcccaagaggaaaatatgtctaaggtg

SEQ ID NO: 24879 - DNA, 75 bp, Artificial Sequence
  Synthetic
catcattaaacagtgactccactgacctctgaagacggtaaccccttgaaccatccacccaatctttcaggtctg

SEQ ID NO: 24880 - DNA, 75 bp, Artificial Sequence
  Synthetic
tttagatttgtgttaaacttgtcatatttatgccatctagttacaaaagaaaccccagatcgtttgactgatcaa

SEQ ID NO: 24881 - DNA, 75 bp, Artificial Sequence
  Synthetic
tattttcaacacaaagaaagggatttttaggatgtccactataggtgataagtttgttagtccttcttgaaattg

SEQ ID NO: 24882 - DNA, 75 bp, Artificial Sequence
  Synthetic
attaaatgttttgagaagtttttagagccaaaacttgacttcaattctgtttttgtcaatttggactcatcacca

SEQ ID NO: 24883 - DNA, 75 bp, Artificial Sequence
  Synthetic
ctttaaccacttcaattgacacaccgtttgctatacactgatccaaaattgtatctactgtttcagccaactgat

SEQ ID NO: 24884 - DNA, 75 bp, Artificial Sequence
  Synthetic
cacttgtcaagagaggtggaggaaaagtttatcaaggatctcaatagacttttttccaaagatttgggtgttgag

SEQ ID NO: 24885 - DNA, 75 bp, Artificial Sequence
  Synthetic
gtggagattttgcttttacattatgaagtgctgctgctacaaactttgtgagcagtggaacttcctgagaccaga

SEQ ID NO: 24886 - DNA, 75 bp, Artificial Sequence
  Synthetic
gatttgaaagaccctggaatttcaaaagaactgatttcattgtgtacatcttgcttcaactgtggtttactgcca

SEQ ID NO: 24887 - DNA, 75 bp, Artificial Sequence
  Synthetic
taaagaatctagatttaaactcacttgcaaaggagcctgccactgttttggggcttacaaatttgttgaatttag

SEQ ID NO: 24888 - DNA, 75 bp, Artificial Sequence
  Synthetic
atgagcaaagttcttaaacatgacccacagtcaccatcattcactagtacagccttggatatctctagtaacaaa

SEQ ID NO: 24889 - DNA, 75 bp, Artificial Sequence
  Synthetic
atgacaagtaattatggaattcaagtacttcttggcatttgtttatatctagtgagtcttcatcaactttcttta

SEQ ID NO: 24890 - DNA, 75 bp, Artificial Sequence
  Synthetic
agtgttgtcgttccgaagttagatgaagtaggtgaaacaataacacaatatgattaccaatcattactgtcttct

SEQ ID NO: 24891 - DNA, 75 bp, Artificial Sequence
  Synthetic
aggaaggagaattacttaagaggatctcatcatcacttgatgtgtaagctgttgacttgatgtcaaagataaaat

SEQ ID NO: 24892 - DNA, 75 bp, Artificial Sequence
  Synthetic
actgttgttgatatggctcagtcctttaaggacaaattgaagtataaacttgatagaaaaagtatccaatttgca

SEQ ID NO: 24893 - DNA, 75 bp, Artificial Sequence
  Synthetic
ccagacactgcaagatgaactgttctgtgagcagaccataataatctgaggtattatgcaaaattccctgtccca

SEQ ID NO: 24894 - DNA, 75 bp, Artificial Sequence
  Synthetic
attttcaaacgcttaacaaatatggtcttaaagaggaagatagatcatgatcttaaagatgatcttgatgatgaa

SEQ ID NO: 24895 - DNA, 75 bp, Artificial Sequence
  Synthetic
tgtccagaacagaagaaatgtgcgaaggaacaaccccttttgcaaaccagttaaaaatgaagtcttctgtgatgg

SEQ ID NO: 24896 - DNA, 75 bp, Artificial Sequence
  Synthetic
ctgtcagaaattgtggatgataatacacttaaagtcataaatgatgtagaagctaatgtctctgaatgtctaagc

SEQ ID NO: 24897 - DNA, 75 bp, Artificial Sequence
  Synthetic
atgtacttgacctgtccattaagccaagccttctctttgtgtaacctttcaaataagcatcaatcacattataag

SEQ ID NO: 24898 - DNA, 75 bp, Artificial Sequence
  Synthetic
aaaatggggaagatctccaaagctgccactgtaggtggtcagaacaatttaggtaggtttgaaaaaactgataca

SEQ ID NO: 24899 - DNA, 75 bp, Artificial Sequence
  Synthetic
gtacctcaacaatcttatgtaagtgccaattcaaaaggttctcaataggagctttgtcaataaacaccccgtcat

SEQ ID NO: 24900 - DNA, 75 bp, Artificial Sequence
  Synthetic
ttgaagagactatgggatagagaatcaatgaactttattttgatggaaacttctctacatgaggtcaaggatttt

SEQ ID NO: 24901 - DNA, 75 bp, Artificial Sequence
  Synthetic
ttaactcaaggttcagattactaaaaagtatgttgaagattgcaggtgacatatatggcccccacttggaatgat

SEQ ID NO: 24902 - DNA, 75 bp, Artificial Sequence
  Synthetic
gatccctcaatattccccattgagaagtacaaatcgatgtgcgagttagtttatgatagtaaaatgaaatctgaa

SEQ ID NO: 24903 - DNA, 75 bp, Artificial Sequence
  Synthetic
ccatgctcactgctagacctgaaagccttacgacacacttcatatctaaaagagccctttcaaattctgcatcat

SEQ ID NO: 24904 - DNA, 75 bp, Artificial Sequence
  Synthetic
ttttttaccgatgaagttttgaagttttgtccactggatttgctggtgaaaaatctggccacaaaatgctacttg

SEQ ID NO: 24905 - DNA, 75 bp, Artificial Sequence
  Synthetic
tattaagacaggagaacttacactctgaggttaaggattcaaagtaatcttcaatcagtctactagtaagctttg

SEQ ID NO: 24906 - DNA, 75 bp, Artificial Sequence
  Synthetic
gaggaagatttttttgaatgctttaaatatatcctcataagtgctggttttgataatagagttggtaggtatgat

SEQ ID NO: 24907 - DNA, 75 bp, Artificial Sequence
  Synthetic
tgtttagatccccaacataaagttctctattgcttccaacctgttctttgtaagaaagaccaaatttcagtttcc

SEQ ID NO: 24908 - DNA, 75 bp, Artificial Sequence
  Synthetic
cacagaagtagatctagattaggatttaaagatgaggcaatattaattaaagagaactccagaattagttcaagg

SEQ ID NO: 24909 - DNA, 75 bp, Artificial Sequence
  Synthetic
caacactggatgacacagtggatctataagttggggactcttcagaatagaaacacaagttcctcaaggaagaat

SEQ ID NO: 24910 - DNA, 75 bp, Artificial Sequence
  Synthetic
gaaagtaactcagaagcaatttctagaagacttgataagagtttctttaccaattcttctttgaggaacttgtgt

SEQ ID NO: 24911 - DNA, 75 bp, Artificial Sequence
  Synthetic
tggtaaaaaaactcttatcaagtcttctagaaattgcttctgagttactttcccttgaactaattctggagttct

SEQ ID NO: 24912 - DNA, 75 bp, Artificial Sequence
  Synthetic
ttctattctgaagagtccccaacttatagatccactgtgtcatctagtgttgggaaactgaaatttggtctttct

SEQ ID NO: 24913 - DNA, 75 bp, Artificial Sequence
  Synthetic
ctttaattaatattgcctcatctttaaatcctaatctagatctacttctgtgatcatacctaccaactctattat

SEQ ID NO: 24914 - DNA, 75 bp, Artificial Sequence
  Synthetic
tacaaagaacaggttggaagtaatagagaactctatgttggggatctaaacacaaagcttactagtagactgatt

SEQ ID NO: 24915 - DNA, 75 bp, Artificial Sequence
  Synthetic
caaaaccagcacttatgaggatatatttaaagcattcaaaaaaatcttcctccaaatagcattttgtggccaaat

SEQ ID NO: 24916 - DNA, 75 bp, Artificial Sequence
  Synthetic
gaagattactttgaatccttaacctcagagtgtaagttctcctgtctaaataatgatgcagaatttgaaagggct

SEQ ID NO: 24917 - DNA, 75 bp, Artificial Sequence
  Synthetic
tcttcaccagcaaatccagtggacaaaacttcaaaacttcatcggtaaaaaattcagatttcattttactatcat

SEQ ID NO: 24918 - DNA, 75 bp, Artificial Sequence
  Synthetic
cttttggatatgaagtgtgtcgtaaggctttcaggtctagcagtgagcatggatcattccaagtgggggccatat

SEQ ID NO: 24919 - DNA, 75 bp, Artificial Sequence
  Synthetic
aaactaactcgcacattgatttgtatttctcaatggggaatattgaggggtcaaaatccttgacctcatgtaggg

SEQ ID NO: 24920 - DNA, 75 bp, Artificial Sequence
  Synthetic
atgtcacctgcaatcttcaacatactttttagtaatctgaaccttgagttaaatgacggagtgtttattgacaaa

SEQ ID NO: 24921 - DNA, 75 bp, Artificial Sequence
  Synthetic
aagtttccatcaaaataaagttcattgattctctatcccatagtctcttcaatgtatcaattttttcaaacctac

SEQ ID NO: 24922 - DNA, 75 bp, Artificial Sequence
  Synthetic
gctcctattgagaaccttttgaattggcacttacataagattgttgaggtaccttataatgtgattgatgcttat

SEQ ID NO: 24923 - DNA, 75 bp, Artificial Sequence
  Synthetic
ctagattgttctgaccacccacagtggcagctctggagatcttccccatcttgcttagacattcagagacattag

SEQ ID NO: 24924 - DNA, 75 bp, Artificial Sequence
  Synthetic
ttgaaaagttacacaaagagaaggcttggtctaatggacaggtcaagtgcatccatcacagaagacttcattttc

SEQ ID NO: 24925 - DNA, 75 bp, Artificial Sequence
  Synthetic
cttctacatcatttatgactctaagtgtatcatcatctacaatttctgacagttcatcatcaagatcatctttta

SEQ ID NO: 24926 - DNA, 75 bp, Artificial Sequence
  Synthetic
aactggtttacaaaaggggttgttccttcgcacatttcttctgttctggacatgggacagggaattttgcataat

SEQ ID NO: 24927 - DNA, 75 bp, Artificial Sequence
  Synthetic
catcatgatctgtcttcctctttaagaccatgtttgttaagcgtttgaaaattgcaaattggatactttttctat

SEQ ID NO: 24928 - DNA, 75 bp, Artificial Sequence
  Synthetic
acctcagattattatggtctgctcacagaacagttcatcttgcagtgtctggattttatctttgacatcaaacca

SEQ ID NO: 24929 - DNA, 75 bp, Artificial Sequence
  Synthetic
caagtttatacttcagtttgtctttaaaggactgagccatatcaacaacagtggaagacagtaatgattggtaat

SEQ ID NO: 24930 - DNA, 75 bp, Artificial Sequence
  Synthetic
acagcttacacatcaagtgatgatgagatcttcttaagtaattctccttctttaaagaaagttgatgaagactca

SEQ ID NO: 24931 - DNA, 75 bp, Artificial Sequence
  Synthetic
catattgtgttactgtttcacctacttcatctaacttcggaacgacaacacttttgttactagaaatatccaagg

SEQ ID NO: 24932 - DNA, 75 bp, Artificial Sequence
  Synthetic
ctggatatagacaagtgccaagaagtacttgaattccataattatttatcatctaaattcaataaatttataagc

SEQ ID NO: 24933 - DNA, 75 bp, Artificial Sequence
  Synthetic
ctgtactagtgaatgatggtgactgtgggtcatgtttaaggactttgctcattggcagcaaaccacagttgaagc

SEQ ID NO: 24934 - DNA, 75 bp, Artificial Sequence
  Synthetic
cccaaaacagtggcaggctcctttgcaagtgagtttaaatctagattctttatctggtctcaggaagttccactg

SEQ ID NO: 24935 - DNA, 75 bp, Artificial Sequence
  Synthetic
atgatgcacataatgaaatcagttcttttgaaattccagggtctttcaaatcctcaacacccaaatctttggaga

SEQ ID NO: 24936 - DNA, 75 bp, Artificial Sequence
  Synthetic
ctcacaaagtttgtagcagcagcacttcataatgtaaaagcaaaatctccacatcagttggctgaaacggtagat

SEQ ID NO: 24937 - DNA, 75 bp, Artificial Sequence
  Synthetic
aaagtctattgagatccttgataaacttttcttccacctctcctgacaggtgtggtgatgaatccaaattaacaa

SEQ ID NO: 24938 - DNA, 75 bp, Artificial Sequence
  Synthetic
actattttggatcagtgtatagcaaacggtgtgtcaattgaagtggtcaaagcaatttcaagaaggactaacaaa

SEQ ID NO: 24939 - DNA, 75 bp, Artificial Sequence
  Synthetic
aaacagaattgaagtcaacttttggctctaaaaacttctcaaaacatttgatttgatcagtcaaacgatctgggg

SEQ ID NO: 24940 - DNA, 75 bp, Artificial Sequence
  Synthetic
cttatcacctatagtggacatcctcaaaatcccttcctttgtgttgaaaatacagacttgaaagactgggtggat

SEQ ID NO: 24941 - DNA, 75 bp, Artificial Sequence
  Synthetic
tttcttttgtaactagatggcataaatatgacaagtttaaaacaaatctaaacaccttagacatgttttcctctt

SEQ ID NO: 24942 - DNA, 75 bp, Artificial Sequence
  Synthetic
ggttcaagaggttaccgtcttcagaggtcagtggagtcactgtttaatgatgatgacctcccattaacaattaga

SEQ ID NO: 24943 - DNA, 75 bp, Artificial Sequence
  Synthetic
gggcttctgttaataagagatgaactaaatcatccattagtgtaaacacataacactctgaaattgtcaaaggtt

SEQ ID NO: 24944 - DNA, 75 bp, Artificial Sequence
  Synthetic
aactcatgtagaagtttgtttcatagaatcagatcaggtgatatacaagaagagtttctaatcaatgcattgcaa

SEQ ID NO: 24945 - DNA, 75 bp, Artificial Sequence
  Synthetic
ggacctttagcttattttgtaattccttaaagtgtagttcattaacaaacgccattattaagtatctaaacccct

SEQ ID NO: 24946 - DNA, 75 bp, Artificial Sequence
  Synthetic
acttcacctgatgaatgtctggcacagatgttgaggttgagtaatgttgatgaaagtacaattgataaggtgctt

SEQ ID NO: 24947 - DNA, 75 bp, Artificial Sequence
  Synthetic
gcaggtaaacctgaactcgcttacttggaacagttagtatattaattattagagtgtagagttttgacttaaaag

SEQ ID NO: 24948 - DNA, 75 bp, Artificial Sequence
  Synthetic
gagttcagatggttgaacttaagagctcatggtgacttaagactggttttgaggactaaggtgatgtcaggcaca

SEQ ID NO: 24949 - DNA, 75 bp, Artificial Sequence
  Synthetic
ccttcaactcttgctcactcagccagtctagccatgataacatctcaacacacatctttaagatgacttctgaac

SEQ ID NO: 24950 - DNA, 75 bp, Artificial Sequence
  Synthetic
agaattttagacagggaagaagtaccctcactgattaaatcagtacagtctaagctttcaaaaaactttgtcaga

SEQ ID NO: 24951 - DNA, 75 bp, Artificial Sequence
  Synthetic
tcattatgggcaagaaaaatcttttaggatctgcataaaagctttcaccaacctcatatacattctcaaattgtt

SEQ ID NO: 24952 - DNA, 75 bp, Artificial Sequence
  Synthetic
ggggcaaagaagataatcactgatgccattaataaatcagcctttcagagtagtatttgctccggtttcatagga

SEQ ID NO: 24953 - DNA, 75 bp, Artificial Sequence
  Synthetic
cactcttgaacatcagcccgtaacaccttgaccgttcaccagttttctgataaattagcaaactattataacttt

SEQ ID NO: 24954 - DNA, 75 bp, Artificial Sequence
  Synthetic
ttttgtaagagtatggggtccaaatgtgttagagatggaaacggtagtttccagtacataagacattttttgaaa

SEQ ID NO: 24955 - DNA, 75 bp, Artificial Sequence
  Synthetic
tatcaagatcttgaaaataacactcattgcattgaactgtaccaaagtaattgctcttatcattgattagaaatt

SEQ ID NO: 24956 - DNA, 75 bp, Artificial Sequence
  Synthetic
tctatcatgttacattcacattgtgaagtctgcaaaccagagatgagtgtcttttgtcgagcagcactagagaag

SEQ ID NO: 24957 - DNA, 75 bp, Artificial Sequence
  Synthetic
ttgcagctgaacttgttttcattgagttgactaaaccaagactcaaggttgatagcgcctcaagatactcaagga

SEQ ID NO: 24958 - DNA, 75 bp, Artificial Sequence
  Synthetic
cttaaacccttctcaagacccatcttttgggattatttttctttgactttttcaaatgcttgtgaattgggaaat

SEQ ID NO: 24959 - DNA, 75 bp, Artificial Sequence
  Synthetic
aaacttcatcatctaaaattgtgctactaccaaattcaggttgaccacattttcttgcagcatcttttttgtatt

SEQ ID NO: 24960 - DNA, 75 bp, Artificial Sequence
  Synthetic
tgggttttttcaaatgtgactattcccaaaagaactccaaccacagtgaatcccaacttcttttggcctgtgaag

SEQ ID NO: 24961 - DNA, 75 bp, Artificial Sequence
  Synthetic
tcaaggttggctttacacatttatctgagtgctctcgcatcatcttaaactcataccaagaatcaatatcaacct

SEQ ID NO: 24962 - DNA, 75 bp, Artificial Sequence
  Synthetic
ccaggaagccacactgaattagaggataaagtgaacatgaatcatgtgctctactcaatcaaaagaaattttcct

SEQ ID NO: 24963 - DNA, 75 bp, Artificial Sequence
  Synthetic
gtttaagccatttagatacatagtacagcccatgtatctcaagtgtcctcttcattttgtatttgacactaccaa

SEQ ID NO: 24964 - DNA, 75 bp, Artificial Sequence
  Synthetic
gacctttttgatgagcacattgctccattcttatcagaccttaactctctaaaaatttcctggatacagagaata

SEQ ID NO: 24965 - DNA, 75 bp, Artificial Sequence
  Synthetic
tccagtttggcttactcattagttttttattcaatctgtctattatcaaatcaattgacaccagtctatcattca

SEQ ID NO: 24966 - DNA, 75 bp, Artificial Sequence
  Synthetic
aagttcttggatctatgtgttgctatggatatgtcaagtgagtgtttaggtattatttcgcacataatgagaagg

SEQ ID NO: 24967 - DNA, 75 bp, Artificial Sequence
  Synthetic
cacttttaaaatggttgttaaccaagaactcattatcaatttcccctgcatctatcaattcgagtagactgttaa

SEQ ID NO: 24968 - DNA, 75 bp, Artificial Sequence
  Synthetic
aagagggaagaattatacattgtgaagcaaaatgaactgtctgttgcacacatgagagattcctcaccaatggaa

SEQ ID NO: 24969 - DNA, 75 bp, Artificial Sequence
  Synthetic
gaatgatgacatcaaggcataggagtgtaaatcttcgagtatttagtacttttaaacctttaatcttgttgcaat

SEQ ID NO: 24970 - DNA, 75 bp, Artificial Sequence
  Synthetic
gcagggtatcaattaaactcatctgaagtttgtcataattttctttgtcagttggtttttgaatctatgcttcac

SEQ ID NO: 24971 - DNA, 75 bp, Artificial Sequence
  Synthetic
cagaaagtagtttcttatgactttgtatactgccacattttttagggttggtgagactttggtagtgtcttttat

SEQ ID NO: 24972 - DNA, 75 bp, Artificial Sequence
  Synthetic
cctgttttattgactacaggtcaatttaaaaagtacttctggttcggtgaagtagaactcctgcctaatgaagca

SEQ ID NO: 24973 - DNA, 75 bp, Artificial Sequence
  Synthetic
tcttgatcagacttgccaatattctaaacatgtggtttctacagtaaccgcactgcctctcgtccagcatggcag

SEQ ID NO: 24974 - DNA, 75 bp, Artificial Sequence
  Synthetic
gatcatgacctggggcaattaactcaatttgtaatggattgtaaaacactcaacatctccaggtgcatgtccctc

SEQ ID NO: 24975 - DNA, 75 bp, Artificial Sequence
  Synthetic
tcctggtctcaccactaagcaggattaatttatgatccttcaaccagttgataatttctgttcgtgatgtcttac

SEQ ID NO: 24976 - DNA, 75 bp, Artificial Sequence
  Synthetic
gatgatttagatgttggatatgtgcatagctcaattgtaatgggtgacatttatgtaaacttttctagcttctta

SEQ ID NO: 24977 - DNA, 75 bp, Artificial Sequence
  Synthetic
aatacacatctttatataatccattttttctcaagaaagaaaattgatcataaattttggccatttcaactctgc

SEQ ID NO: 24978 - DNA, 75 bp, Artificial Sequence
  Synthetic
cacttactggattgggaaaataggcgtaattataagacttttgatgagatcattttgcgctcaagtgaggagact

SEQ ID NO: 24979 - DNA, 75 bp, Artificial Sequence
  Synthetic
attcagaggccgacatgttggagttgacaccatctctcatcactgacatcaattttgctttgtaatctaagcctt

SEQ ID NO: 24980 - DNA, 75 bp, Artificial Sequence
  Synthetic
atcccaatggaaattaacttcactataagccattcaaggaagagtttcaaatttaaatatgaaagaaaaactaac

SEQ ID NO: 24981 - DNA, 75 bp, Artificial Sequence
  Synthetic
cttctttcaatatcttcagagactcaaggcccaagtttttattttccatatttgagagactgtacacaagtctag

SEQ ID NO: 24982 - DNA, 75 bp, Artificial Sequence
  Synthetic
tatcacattaaaagcagggttctagttcagaaggtcgacatagaagaggcacaaaatcaggggtttgacatactt

SEQ ID NO: 24983 - DNA, 75 bp, Artificial Sequence
  Synthetic
agtattctagttcctcaatctcttccccgttgtctcttaggaagttagttattttcagtatcaaccatctcattc

SEQ ID NO: 24984 - DNA, 75 bp, Artificial Sequence
  Synthetic
gaacttgaagtacatggaattgaatgttttgttagtggatctcaagggaaccacatcagtcttgatggagtgggt

SEQ ID NO: 24985 - DNA, 75 bp, Artificial Sequence
  Synthetic
tctctattgtccaatctggaaagtgttctgtataataatttgatctaccatctacaacagggatgagtgttagac

SEQ ID NO: 24986 - DNA, 75 bp, Artificial Sequence
  Synthetic
ctcattccactacaccctctttttagtggcaaggaattccttgatgttaacaaactcctcattaagcaggatgaa

SEQ ID NO: 24987 - DNA, 75 bp, Artificial Sequence
  Synthetic
cacatctactaaggtctttagataactgcatcaacttctcaaaatctgatttgtacttgatctcaaaggattcat

SEQ ID NO: 24988 - DNA, 75 bp, Artificial Sequence
  Synthetic
aatttcgaatccacccattccgtcttttccaaggtcaaactgaacttcagtaaccacacaaaagatctaagaaat

SEQ ID NO: 24989 - DNA, 75 bp, Artificial Sequence
  Synthetic
gacttaccctaacaaaagcctccaacaagattatcgttgatccaatcactctgtaaccatcaggcacaacatcgg

SEQ ID NO: 24990 - DNA, 75 bp, Artificial Sequence
  Synthetic
aagtactcctataaattacaaggacctgaatacaatatgaaccctttgcacctttacagagggcaaattatggaa

SEQ ID NO: 24991 - DNA, 75 bp, Artificial Sequence
  Synthetic
gtagagtaggtcccacaatcctatgatctctcaagatctgattcactgttttgttcttgttgtgcacgcatccat

SEQ ID NO: 24992 - DNA, 75 bp, Artificial Sequence
  Synthetic
aacaactttgtaatttcaaggcttgatgttcagataacttccagatcagtcttccttgctttggaagcactggaa

SEQ ID NO: 24993 - DNA, 75 bp, Artificial Sequence
  Synthetic
gcttcttgcaggaatctatctctataataattgacaataattttaggccttcaatgactactgatctgagattga

SEQ ID NO: 24994 - DNA, 75 bp, Artificial Sequence
  Synthetic
agtgaagacaggatccctttcctgatctctctacatatctacacaagatcaaataacaagaaagaaaatccttgt

SEQ ID NO: 24995 - DNA, 75 bp, Artificial Sequence
  Synthetic
cttgagacaagaaactggtcttctgttctatatacatctcttcgtcaggtatccatttcctaatgagttccttca

SEQ ID NO: 24996 - DNA, 75 bp, Artificial Sequence
  Synthetic
tttataaggatgacacaatctgatctctgtctattgattgattcttacgaaaaggagttcactgaagtactaaaa

SEQ ID NO: 24997 - DNA, 75 bp, Artificial Sequence
  Synthetic
ccatttcctaatgagttccttcaattcatcaaggtattcactcatgataaaggaatgcctaggatccacggtgcg

SEQ ID NO: 24998 - DNA, 75 bp, Artificial Sequence
  Synthetic
tccctatcggattggatggactttggtgactttgctctatgcttcagcaacaacttaaattgcatcatgattgca

SEQ ID NO: 24999 - DNA, 75 bp, Artificial Sequence
  Synthetic
tgttcacgcttcctgtttctctatcatttcaatgggacagcttgtctccttcattggagaaataccagccattgt

SEQ ID NO: 25000 - DNA, 75 bp, Artificial Sequence
  Synthetic
cgcacagtggattctaggcgatttttgttcacgcttcctgtttctctatcatttcaatgggacagcttgtctcct

SEQ ID NO: 25001 - DNA, 75 bp, Artificial Sequence
  Synthetic
gacccagatgggcaattcaaactcaaaggtagacagtgtagaaaggtctcaccagcatcagcacccctcgagatt

SEQ ID NO: 25002 - DNA, 75 bp, Artificial Sequence
  Synthetic
gcacgaagccctgaatgtagctttaatcgcagtaagtatcattgcgattatgaagggcctcataaatatctggaa

SEQ ID NO: 25003 - DNA, 75 bp, Artificial Sequence
  Synthetic
gactaatggactccgcggcccgcggagtccaggggccgagggcgcacccccccagtggggggtgcgccctgggcc

SEQ ID NO: 25004 - DNA, 75 bp, Artificial Sequence
  Synthetic
aagtgggttattccaattgataatgttcctcatacttgctgggagatcctgttcaatttccattggacaccatct

SEQ ID NO: 25005 - DNA, 75 bp, Artificial Sequence
  Synthetic
ctatttatggggtgtagggtggtgcagatggcgtggtttcaaagaccagtttctttgggagaatgcccccacaga

SEQ ID NO: 25006 - DNA, 75 bp, Artificial Sequence
  Synthetic
ggaacttcaacatttcataataaacagcacatcactcctcccttctatgcccacactgtgcagaatcaatgccac

SEQ ID NO: 25007 - DNA, 75 bp, Artificial Sequence
  Synthetic
agcacatcactcctcccttctatgcccacactgtgcagaatcaatgccaccaactccctcataagaggtccattt

SEQ ID NO: 25008 - DNA, 75 bp, Artificial Sequence
  Synthetic
tgccacaataatctgacctgctcaacattgctgttagacacttcaaacacaagtaatgattgctgcacttaatca

SEQ ID NO: 25009 - DNA, 75 bp, Artificial Sequence
  Synthetic
tctgcgcagtggggccttgatatattcattggtgacctcaccattttagtaaaccctgagccaggtagcaagaca

SEQ ID NO: 25010 - DNA, 75 bp, Artificial Sequence
  Synthetic
atcctttgttggcaaaccaacaagatttgcaattgtatctcccatacagagtctgaggcatatctaaagtgatgg

SEQ ID NO: 25011 - DNA, 75 bp, Artificial Sequence
  Synthetic
aaacggatgactgcaaccaacattactgggtgtttcccaaataatgaagatcctgactctgtagcacaggtccta

SEQ ID NO: 25012 - DNA, 75 bp, Artificial Sequence
  Synthetic
gtattctaccttctaattctttttcaccataccgttgcttgacctcttttgaatatctaagacccattgggactt

SEQ ID NO: 25013 - DNA, 75 bp, Artificial Sequence
  Synthetic
agttggttttttagaggtgtgcatcatgatttccatttagacccaacaattctttgtgatgaaagtgtcactgtc

SEQ ID NO: 25014 - DNA, 75 bp, Artificial Sequence
  Synthetic
atatctaagacccattgggacttgaaaagatatcactttgcgcaatgaccagtaaagcctaggatccccggtgcg

SEQ ID NO: 25015 - DNA, 75 bp, Artificial Sequence
  Synthetic
cgcacagtggatcctaggccgcacagtggatcctaggcgatttttgttcacgcttcctgtttctctatcacttca

SEQ ID NO: 25016 - DNA, 75 bp, Artificial Sequence
  Synthetic
ttcagaatccaaatgaacctaactgaaagaatgtactgtgataggattgtttcaaaactagcaagactttttggt

SEQ ID NO: 25017 - DNA, 75 bp, Artificial Sequence
  Synthetic
atgggacagcttgtctccttcattggagaaataccagccattgtccacgaagccctaaatgtagctttaatcgca

SEQ ID NO: 25018 - DNA, 75 bp, Artificial Sequence
  Synthetic
tcctttggagactattgttcaaaggttggaaagaaattggttataatcagaaatgtaacctggtccaatcagtgt

SEQ ID NO: 25019 - DNA, 75 bp, Artificial Sequence
  Synthetic
ttggaaagaaattggttataatcagaaatgtaacctggtccaatcagtgtcatgaagatcatgtcggctccatgc

SEQ ID NO: 25020 - DNA, 75 bp, Artificial Sequence
  Synthetic
gtaagtatcattgcgattatgaaggggctcataaatatctggaaaagtgggttattccaattgataatgttcctc

SEQ ID NO: 25021 - DNA, 75 bp, Artificial Sequence
  Synthetic
aactcattctacaaaatgcccataatcaagtcatgagattcagaaaactgcaaaatttcttctcttggtcattgg

SEQ ID NO: 25022 - DNA, 75 bp, Artificial Sequence
  Synthetic
atacttgccgggagatcctgttcaatttccattggacaccatttggaacttcaacatttcataataaacagcaca

SEQ ID NO: 25023 - DNA, 75 bp, Artificial Sequence
  Synthetic
ttgactctgcaggaaacagtatgcctgggggatactgtttggagaaatggatgttggtagcaagtgaattgaagt

SEQ ID NO: 25024 - DNA, 75 bp, Artificial Sequence
  Synthetic
tcactcctcccttccatgcccacactgtgcagaatcaatgccaccaattccttcataagaggtccattttctgcg

SEQ ID NO: 25025 - DNA, 75 bp, Artificial Sequence
  Synthetic
gctttggtaatacagctgttgctaaatgtaacatcaatcatgattctgaattctgtgatatgttgaggctctttg

SEQ ID NO: 25026 - DNA, 75 bp, Artificial Sequence
  Synthetic
cagtggggccttgatatattcattggtgacctcaccattttagtaaaccctgagccaggcagcaagacaaaacgg

SEQ ID NO: 25027 - DNA, 75 bp, Artificial Sequence
  Synthetic
attataataaaaaggcaattgttaaccttcaagacaaaacaaaagcacaacttgattcacttattgatgctgtta

SEQ ID NO: 25028 - DNA, 75 bp, Artificial Sequence
  Synthetic
atgactgcaaccaacattactggctgtttcccaaataatgaagaccctgactctgtagcacaggttctaagttgg

SEQ ID NO: 25029 - DNA, 75 bp, Artificial Sequence
  Synthetic
attctttgatttctgacaatctgataactaaaaataaaataagagaactcatgaatattccttattgcaactaca

SEQ ID NO: 25030 - DNA, 75 bp, Artificial Sequence
  Synthetic
ttctttagaggtgtgtatcatgatttccatctagacccaacaattctttgtgatgaaagtgtcactgtcttcaga

SEQ ID NO: 25031 - DNA, 75 bp, Artificial Sequence
  Synthetic
caaagttttggtatgtgaaccacacaggtctaaatgttcattctttgcctaaatgttggcatgtgaggaatggca

SEQ ID NO: 25032 - DNA, 75 bp, Artificial Sequence
  Synthetic
aggtctaaatgttcattctttgcctaaatgttggcatgtgaggaatggcagttacctgaatgagtcagactttag

SEQ ID NO: 25033 - DNA, 75 bp, Artificial Sequence
  Synthetic
aaatgagtggatcatcgagagtgatcatcttgtttctgagatattagctaaagagtatgaagaaaggcagaagag

SEQ ID NO: 25034 - DNA, 75 bp, Artificial Sequence
  Synthetic
agaaattggttataatcagaaatgcaacctggtccaatcagtgtcatgaagatcatgtcggctctatgcaactca

SEQ ID NO: 25035 - DNA, 75 bp, Artificial Sequence
  Synthetic
aagagtatgaagaaaggcagaagagaacaccactgagtcttgttgacctctgtttctggagtaccctattctata

SEQ ID NO: 25036 - DNA, 75 bp, Artificial Sequence
  Synthetic
cagcatcaatcttcctacatcttctgcacattcccacccacagacacatcatcggcgagggctgtcctaaacctc

SEQ ID NO: 25037 - DNA, 75 bp, Artificial Sequence
  Synthetic
acagactgacatctgattcactctgtgcatgtgggttctttcaactgaaggggaggccaaccagatgggcaagga

SEQ ID NO: 25038 - DNA, 75 bp, Artificial Sequence
  Synthetic
gtaatacagctgttgctaaatgtaacatcaatcatgattctgaattctgtgatatgttgaggctctttgattata

SEQ ID NO: 25039 - DNA, 75 bp, Artificial Sequence
  Synthetic
taccttaaagcagatgaaatagaatagagtcgagactcggcctccattgctgcaccccaatggggtgcagcaatg

SEQ ID NO: 25040 - DNA, 75 bp, Artificial Sequence
  Synthetic
agagtcgagactcggcctccattgctgcaccccaatggggtgcagcaatggaggcctctcaatgcttagaggacc

SEQ ID NO: 25041 - DNA, 75 bp, Artificial Sequence
  Synthetic
ataaaaaagcaattgttaaccttcaagacaaaacaaaagcacaagttgattcacttattgatgctgttaattctt

SEQ ID NO: 25042 - DNA, 75 bp, Artificial Sequence
  Synthetic
acagttgtgtctggttctctgaagagaatgtcaataggaaggagtcttttgggcttctcgtctgccacaaatccc

SEQ ID NO: 25043 - DNA, 75 bp, Artificial Sequence
  Synthetic
taatttctgataatctgataactaaaaataaaataagagaactcatgaatgttccttattgcaattacacaaagt

SEQ ID NO: 25044 - DNA, 75 bp, Artificial Sequence
  Synthetic
gggcttctcgtctgccacaaatcccaccagaactgcattgaacatgatacaatccatcaatgcacagtgagcatt

SEQ ID NO: 25045 - DNA, 75 bp, Artificial Sequence
  Synthetic
aatccatcaatgcacagtgagcatttgtagatgcaggttttgagcctttctttttgcttttgatcacaattccct

SEQ ID NO: 25046 - DNA, 75 bp, Artificial Sequence
  Synthetic
tttggtatgtgaaccacacaggtctgaatgttcattctttgcctaaatgttggcatgtgaagaatggcagttacc

SEQ ID NO: 25047 - DNA, 75 bp, Artificial Sequence
  Synthetic
tatgcctgtcacaaagatgttcaaatttcttccaaacaagttcctcaaagactctagattgctctgcacttagtt

SEQ ID NO: 25048 - DNA, 75 bp, Artificial Sequence
  Synthetic
tgaatgagtcagactttagaaatgagtggatcatcgaaagtgatcaccttatttctgagatattagctaaagagt

SEQ ID NO: 25049 - DNA, 75 bp, Artificial Sequence
  Synthetic
atttctgagatattagctaaagagtatgaagaaagacagaagaggacaccactgagtcttgttgatctctgcttc

SEQ ID NO: 25050 - DNA, 75 bp, Artificial Sequence
  Synthetic
tcacatcaacaatctttaaatcttggcgtccgtgcatatcaaaaagtctcttaatgtcatcttcaccttgagctg

SEQ ID NO: 25051 - DNA, 75 bp, Artificial Sequence
  Synthetic
tggagtaccctattctatacagcatcaatcttcctacatcttctgcacattcccacccacagacacatcatcggc

SEQ ID NO: 25052 - DNA, 75 bp, Artificial Sequence
  Synthetic
tgaagaccatagacttgggaaggtatcttatgatagttgagatcaatcctggtcgagcattctccacgtccttca

SEQ ID NO: 25053 - DNA, 75 bp, Artificial Sequence
  Synthetic
tcttatgatagttgagatcaatcctggtcgagcattctccacgtccttcaacaatatcccatggcagtacttgct

SEQ ID NO: 25054 - DNA, 75 bp, Artificial Sequence
  Synthetic
gagggctgtcccaagcctcatagactgacatctgattcactctgtgcatgtgggttctttcaattgaaagggaaa

SEQ ID NO: 25055 - DNA, 75 bp, Artificial Sequence
  Synthetic
ctgatctttgaaagacttaatgtcatttggtcttcgataacaatgtaagtacttttgagtctcaggttggtagat

SEQ ID NO: 25056 - DNA, 75 bp, Artificial Sequence
  Synthetic
cgtaccagatgggcaaggataccttaaggcagataaaatagagtcgagactcggcctccattgctgcaccccaat

SEQ ID NO: 25057 - DNA, 75 bp, Artificial Sequence
  Synthetic
tttggtcttcgataacaatgtaagtacttttgagtctcaggttggtagattgccagttctactgggtcattgggt

SEQ ID NO: 25058 - DNA, 75 bp, Artificial Sequence
  Synthetic
tcggcctccattgctgcaccccaatggggtgcagcaatggaggcctctcaatgcttagaggacaacagttgtgtc

SEQ ID NO: 25059 - DNA, 75 bp, Artificial Sequence
  Synthetic
ggtccttcaatgtcaatccaagttgtgaggtttggagataggccttcgactccctttcggacctggtcttctaat

SEQ ID NO: 25060 - DNA, 75 bp, Artificial Sequence
  Synthetic
tccggccttaatggtcctagtaagggtgcacctccgtttctcactggaacaggggcccttggtggagcactatca

SEQ ID NO: 25061 - DNA, 75 bp, Artificial Sequence
  Synthetic
gtgcacctccgtttctcactggaacaggggcccttggtggagcactatcaaactcaaccacagtgttatcccatg

SEQ ID NO: 25062 - DNA, 75 bp, Artificial Sequence
  Synthetic
aactcaaccacagtgttatcccatgctcttccctttatttgtgaacgagaagctatgtaaggccatccttctcca

SEQ ID NO: 25063 - DNA, 75 bp, Artificial Sequence
  Synthetic
gcacagtgagcatttgtagacgcaggcttcgagcctttctttttgcttttgatcacaatccccttatgcctgtca

SEQ ID NO: 25064 - DNA, 75 bp, Artificial Sequence
  Synthetic
ctcttccctttatttgtgaacgagaagctatgtaaggccatccttctccagagaggcacaatttataaagaatgt

SEQ ID NO: 25065 - DNA, 75 bp, Artificial Sequence
  Synthetic
tctcataagggttcctttgaccaggaaccgaacttacaaacattctttcccttgctttcacttctaggagtgttt

SEQ ID NO: 25066 - DNA, 75 bp, Artificial Sequence
  Synthetic
ctctgcacttagtttcacatcaacaatctttaaatcttggcgtccgtgcatatcaaaaagtctcttaatgtcatc

SEQ ID NO: 25067 - DNA, 75 bp, Artificial Sequence
  Synthetic
aaccgaacttacaaacattctttcccttgctttcacttctaggagtgttttgataactgtggtgaaagtggatgt

SEQ ID NO: 25068 - DNA, 75 bp, Artificial Sequence
  Synthetic
ttcaccttgagctgtaaaggccatagacttgggaaggtgtcttatgatagttgaaatcagtcctggtcgagcatt

SEQ ID NO: 25069 - DNA, 75 bp, Artificial Sequence
  Synthetic
gtcaatcttgatggtctcaagcatatttcctccatctatcaagcatgcacctgccttcacagctgcagacaaact

SEQ ID NO: 25070 - DNA, 75 bp, Artificial Sequence
  Synthetic
ttgaaatcagtcctggtcgagcattctccacgtccttcaataatatcccatggcaatatttgctctgatctttga

SEQ ID NO: 25071 - DNA, 75 bp, Artificial Sequence
  Synthetic
tgtgactcctcttgggtgattacctttaagcaagggtgtttttctgagagagcctcaagatcattgaggtttggg

SEQ ID NO: 25072 - DNA, 75 bp, Artificial Sequence
  Synthetic
aagacttaatgtcatttggtcttcgataacaatgtaagtacttttgagtctcaggttggtagattgccagttcta

SEQ ID NO: 25073 - DNA, 75 bp, Artificial Sequence
  Synthetic
tattttgctgtataaagtagacccaaatctgttaatccttgaacaacatcatttagggtttcaccaccctgttct

SEQ ID NO: 25074 - DNA, 75 bp, Artificial Sequence
  Synthetic
cgggttcattaggtggtccttcaatatcaatccaagttgtgagatttggagataggccctcaactccctttcgga

SEQ ID NO: 25075 - DNA, 75 bp, Artificial Sequence
  Synthetic
gccatacaagagatagtaagtgcaggcattgaaccaaactggttgatcataagtgaggaatctttgacatcccat

SEQ ID NO: 25076 - DNA, 75 bp, Artificial Sequence
  Synthetic
cctgatcttctaattccggccttaatggtcctagcaagggtgcacctccgtttctcactggaacaggggcccttg

SEQ ID NO: 25077 - DNA, 75 bp, Artificial Sequence
  Synthetic
actttcacaaccccgttcatcccgactctccctgccttttgaataccaatgaattgtagtagttcacctctcctt

SEQ ID NO: 25078 - DNA, 75 bp, Artificial Sequence
  Synthetic
gtggagcactatcaaactcaaccacagtgttgtcccaggctcttccttttatttgtgaacgagaagctatgtaag

SEQ ID NO: 25079 - DNA, 75 bp, Artificial Sequence
  Synthetic
gtgagttgagtggtggtgagattgccctggtactgaccacccgaacctggtggtctctcagtcctctgcaccttg

SEQ ID NO: 25080 - DNA, 75 bp, Artificial Sequence
  Synthetic
gccatccttctccagagagacacaatttataaagaatattctcataagggttcctctgaccaggaaccgaactta

SEQ ID NO: 25081 - DNA, 75 bp, Artificial Sequence
  Synthetic
tctttcaacttattgagatcaccggacaactccattagttctcccttggagagtgagccaacctttaggaacatg

SEQ ID NO: 25082 - DNA, 75 bp, Artificial Sequence
  Synthetic
caaacattctttcccttgccttcacttctaggagtgttttgatgactgtggtgaaggtggacgtgtcaatcttga

SEQ ID NO: 25083 - DNA, 75 bp, Artificial Sequence
  Synthetic
ttctaggagtgttttgatgactgtggtgaaggtggacgtgtcaatcttgatggtctcaagcatgttccctccatc

SEQ ID NO: 25084 - DNA, 75 bp, Artificial Sequence
  Synthetic
tttttttgtgttgatttcattgtcatcaatgaatcaacttctttattaaggtctctcaaacttgtaagatcactt

SEQ ID NO: 25085 - DNA, 75 bp, Artificial Sequence
  Synthetic
tatcaagcatgcacctgccttcacagctgcagacaaactcaagttataacctgagatgttaatctgtgactcctc

SEQ ID NO: 25086 - DNA, 75 bp, Artificial Sequence
  Synthetic
tcatctctcttgtccctcctcatcattctctgaacactagccacctttgcaaaatccaatccagacagtaaagcc

SEQ ID NO: 25087 - DNA, 75 bp, Artificial Sequence
  Synthetic
ttgggtaattacctttaagcaagggtgtttttctgagagagcctcaagatcattgaggtttgggtattttgctgt

SEQ ID NO: 25088 - DNA, 75 bp, Artificial Sequence
  Synthetic
ctcgtatcattgaggacgtcagccttcactggacatgtccaattggagagtcctctcctgagtgactgagtccag

SEQ ID NO: 25089 - DNA, 75 bp, Artificial Sequence
  Synthetic
gtaaagcaaacccaagtctgttaatccttgaacgacatcatttagggtctcaccaccctgttctgccatacaaga

SEQ ID NO: 25090 - DNA, 75 bp, Artificial Sequence
  Synthetic
cgaaaggagtgcaccacctgatcagacatgatgaaggtagaagttgatgttgatgcgtagaatctccaaagccta

SEQ ID NO: 25091 - DNA, 75 bp, Artificial Sequence
  Synthetic
cacctgatcagacatgatgaaggtagaagttgatgttgatgcgtagaatctccaaagcctaggatccactgtgcg

SEQ ID NO: 25092 - DNA, 75 bp, Artificial Sequence
  Synthetic
aatagtgagtgcaggcattgaaccaaactggttgatcatgagtgaggaatccttgacatcccacactttcacaac

SEQ ID NO: 25093 - DNA, 75 bp, Artificial Sequence
  Synthetic
cgcacggaggatcctaggcgatttttgttcacgcttcctgtttctctatcatttcaatgggacagcttgtctcct

SEQ ID NO: 25094 - DNA, 75 bp, Artificial Sequence
  Synthetic
ccacgaagccctgaatgtagctttaatcgcagtaagtatcattgcgattatgaagggcctcataaatgtctggaa

SEQ ID NO: 25095 - DNA, 75 bp, Artificial Sequence
  Synthetic
cccgttcgtcccgactctccctgctttttgaatgccaatgaattgtaatagttcacctctccttgtgagttgagt

SEQ ID NO: 25096 - DNA, 75 bp, Artificial Sequence
  Synthetic
ggtggtgagattgccctggtactgaccacccgaacctggtggtctttcagtcctttgcactttgtctttcaactt

SEQ ID NO: 25097 - DNA, 75 bp, Artificial Sequence
  Synthetic
ggaacttcaacattttataataaacagcacatcactcctcccttctatgcccacactgtgcagaatcaatgccac

SEQ ID NO: 25098 - DNA, 75 bp, Artificial Sequence
  Synthetic
attgagatcaccagacaactccattagttctcctttggagagtgagccaatctttaggaacatgtttttctgtgt

SEQ ID NO: 25099 - DNA, 75 bp, Artificial Sequence
  Synthetic
agcacatcactcctcccttctatgcccacactgtgcagaatcaatgccaccaattccttcataagaggtccgttt

SEQ ID NO: 25100 - DNA, 75 bp, Artificial Sequence
  Synthetic
tgatttcattgtcatcaatgaatcaacttctttattaaggtctctcaaacttgtaagatcactttcatctctttt

SEQ ID NO: 25101 - DNA, 75 bp, Artificial Sequence
  Synthetic
aaacggatgaccgcaaccaacattactggctgtttcccaaataatgaagatcctgactctgtggcacaggtccta

SEQ ID NO: 25102 - DNA, 75 bp, Artificial Sequence
  Synthetic
gtctctcctcatcattctctggacactagccacctttgcaaaatccaatccagacagtaatgccctcgtatcatt

SEQ ID NO: 25103 - DNA, 75 bp, Artificial Sequence
  Synthetic
gaggacgtcagccttcactggacatgtccaattggagagtcctctcctgagtgactgagtccagcggaaggagtg

SEQ ID NO: 25104 - DNA, 75 bp, Artificial Sequence
  Synthetic
ttcagaatccaaatgaacctaaccgaaagaatgtactgtgataggatagtttcaaaactagcaagactctttggt

SEQ ID NO: 25105 - DNA, 75 bp, Artificial Sequence
  Synthetic
gtgcactacctgatcagacatgatgaaagtagaacttgatgcgtagaatctccaaagcctaggatccactgtgcg

SEQ ID NO: 25106 - DNA, 75 bp, Artificial Sequence
  Synthetic
tcctttggagactattgttcaaaggttggaaagaaattggttataatcagaaatgcaacctggtccaatcagtgt

SEQ ID NO: 25107 - DNA, 75 bp, Artificial Sequence
  Synthetic
ttggaaagaaattggttataatcagaaatgcaacctggtccaatcagtgtcatgaagatcatatcggctccatgc

SEQ ID NO: 25108 - DNA, 75 bp, Artificial Sequence
  Synthetic
attataacaaaaaggcaattgttaaccttcaagacaaaacaaaagcgcaagttgattcacttattgatgctgtta

SEQ ID NO: 25109 - DNA, 75 bp, Artificial Sequence
  Synthetic
attctttgatttctgacaatctgataactaaaaataaaataagagaactcatgaatattccttattgcaattaca

SEQ ID NO: 25110 - DNA, 75 bp, Artificial Sequence
  Synthetic
caaagttttggtatgtgaaccacacaggtctgaatgttcattctttgcctaaatgttggcatgtgaggaatggca

SEQ ID NO: 25111 - DNA, 75 bp, Artificial Sequence
  Synthetic
aggtctgaatgttcattctttgcctaaatgttggcatgtgaggaatggcagttacctaaatgagtcagactttag

SEQ ID NO: 25112 - DNA, 75 bp, Artificial Sequence
  Synthetic
aacaccactgagtcttgttgacctctgtttttggagtaccctattctatacagcatcaatcttcctacatcttct

SEQ ID NO: 25113 - DNA, 75 bp, Artificial Sequence
  Synthetic
gcatattcccacccacagacacatcatcggcgagggctgtcctaaacctcacagactgacatctgattcactctg

SEQ ID NO: 25114 - DNA, 75 bp, Artificial Sequence
  Synthetic
tgcatgtgggttctttcaattgaaagggaaaccaaccagatgggcaaggacaccttaaagcagataaaatagagt

SEQ ID NO: 25115 - DNA, 75 bp, Artificial Sequence
  Synthetic
cgagacccggcctccattgctgcaccccaatagggtgcagcaatggaggcctcccaatgcttagaggaccacagt

SEQ ID NO: 25116 - DNA, 75 bp, Artificial Sequence
  Synthetic
tcaataggaaggagtcttttgggcttctcgtctgccacaaatcccaccagaactgcattgaacatgatgcaatcc

SEQ ID NO: 25117 - DNA, 75 bp, Artificial Sequence
  Synthetic
tcaacaatctttaaatcttggcgtccgtgcatatcaaaaagtctcttaatgtcatcctcaccttgagctgtgaag

SEQ ID NO: 25118 - DNA, 75 bp, Artificial Sequence
  Synthetic
gccatggacttgggaaggtatcttattatagttgagatcagtcctggtcgagcattctccacgtccttcaacaat

SEQ ID NO: 25119 - DNA, 75 bp, Artificial Sequence
  Synthetic
atcccatggcaatacttgctctgatctttgaaagacttgatgtcatttggtcttcgataacaatgtaagtacttt

SEQ ID NO: 25120 - DNA, 75 bp, Artificial Sequence
  Synthetic
tcttcgataacaatgtaagtacttttgagtctcaggttggtagattgccagttctactgggtcgttaggtggtcc

SEQ ID NO: 25121 - DNA, 75 bp, Artificial Sequence
  Synthetic
aaccacagtgttatcccatgctcttccttttatttgtgaacgagaagctatgtaaggccatccttctccagagag

SEQ ID NO: 25122 - DNA, 75 bp, Artificial Sequence
  Synthetic
ccttttatttgtgaacgagaagctatgtaaggccatccttctccagagagacacaatttataaagaatgttctca

SEQ ID NO: 25123 - DNA, 75 bp, Artificial Sequence
  Synthetic
aacttacaaacattctttcccttgctttcacttctaggagtgttttgataactgtggtgaaagtggacgtgtcaa

SEQ ID NO: 25124 - DNA, 75 bp, Artificial Sequence
  Synthetic
tccatctatcaagcatgcacctgccttcacagctgcagacaaactcaagttataacctgagatgttaatctgtga

SEQ ID NO: 25125 - DNA, 75 bp, Artificial Sequence
  Synthetic
tataacctgagatgttaatctgtgactcctcttgggtgattacctttaagcaagggtgtttttctgagagagcct

SEQ ID NO: 25126 - DNA, 75 bp, Artificial Sequence
  Synthetic
ctcctcttgggtgattacctttaagcaagggtgtttttctgagagagcctcaagatcattgaggtttggatattt

SEQ ID NO: 25127 - DNA, 75 bp, Artificial Sequence
  Synthetic
tgctgtataaagtagacccaaatctgttaatccttgaacaacatcatttagggtttcaccaccctgttctgccat

SEQ ID NO: 25128 - DNA, 75 bp, Artificial Sequence
  Synthetic
acaagaaatagtgagtgcaggcattgaaccaaactggttgatcataagtgaagaatccttgacatcccacacttt

SEQ ID NO: 25129 - DNA, 75 bp, Artificial Sequence
  Synthetic
accaaacaaagatgtatgagatattattatctgttaaaatgaaatttaatatcttaggagcaaagattctccttc

SEQ ID NO: 25130 - DNA, 75 bp, Artificial Sequence
  Synthetic
taactcctataccatatccttatgggaataaatacttattcaggatcacagatgtggaatatactcaggatataa

SEQ ID NO: 25131 - DNA, 75 bp, Artificial Sequence
  Synthetic
ttggatctgggtttgggataaccaaaatgtcccgacttggacctgcgttggatgagtttcgctcctttaagaata

SEQ ID NO: 25132 - DNA, 75 bp, Artificial Sequence
  Synthetic
gctctgtactgtcgctggcttcaacatgctaccgcaagatatctactcgcatagtcaagctcagagacctcactg

SEQ ID NO: 25133 - DNA, 75 bp, Artificial Sequence
  Synthetic
atccccctaggagaggtgcactcacaacagcaatccaagggatcaagaagaatgttattgtcttggttcctacca

SEQ ID NO: 25134 - DNA, 75 bp, Artificial Sequence
  Synthetic
cctcaaagctgggaataaacaaggcaatacctacagatagggttgatcacgaggcttcgatgatcaccaaacttc

SEQ ID NO: 25135 - DNA, 75 bp, Artificial Sequence
  Synthetic
tgaaacaaccagcaaagagattccaatttatgacattaatacttcagattgcttggtctgccaaatcctctgctg

SEQ ID NO: 25136 - DNA, 75 bp, Artificial Sequence
  Synthetic
cttcagttatggagggtgggagatggtatgagccttttttgttctggtttaaatgtaaatacactatgagaaagc

SEQ ID NO: 25137 - DNA, 75 bp, Artificial Sequence
  Synthetic
catttatcactggtgcttttttctcactgctctcgatgtttgctgacaatcctggagctatgttaaggaaccttg

SEQ ID NO: 25138 - DNA, 75 bp, Artificial Sequence
  Synthetic
tcattaagaggaacactaaactcaggtataactcatatcagaatgaaatcatatccgatacttcagtgcacttta

SEQ ID NO: 25139 - DNA, 75 bp, Artificial Sequence
  Synthetic
tcaatgaccctgacattgatgtgcagattgccgaagtgtcagacgtcaatgattcaaggataacacttgccacaa

SEQ ID NO: 25140 - DNA, 75 bp, Artificial Sequence
  Synthetic
tagctattaataaacacatgtgtttaatagttaataagaggaatttacacatatattattttacacttgaaatgg

SEQ ID NO: 25141 - DNA, 75 bp, Artificial Sequence
  Synthetic
gaggtcgcggtatggagcgttatgaggaagagatagtgcagatggtggaaacaccaccgaaaggaagggacaagg

SEQ ID NO: 25142 - DNA, 75 bp, Artificial Sequence
  Synthetic
tcttaatgttctgtgatgttttagaaggcagggttatgatagatctcggtatgacttgtgatttgaggtttgagg

SEQ ID NO: 25143 - DNA, 75 bp, Artificial Sequence
  Synthetic
cgtatccatatgcagagagtgattatgtcaaaataattcctcgctctacggaggaccttcagattgctattcaga

SEQ ID NO: 25144 - DNA, 75 bp, Artificial Sequence
  Synthetic
atttcaaacatagagggcataatctttgggaactaatggactcattatttgaggatttaggtaatgacacttatg

SEQ ID NO: 25145 - DNA, 75 bp, Artificial Sequence
  Synthetic
ccgtgactgcgcaactttggatcctactgacaaaggcagtaactgccattgacacagcacgtgactctgagaaca

SEQ ID NO: 25146 - DNA, 75 bp, Artificial Sequence
  Synthetic
atatggtggctatgattgaacctcttgttttagggtttctacagttaaaggatgattcactccttctccgcgggg

SEQ ID NO: 25147 - DNA, 75 bp, Artificial Sequence
  Synthetic
ggcgctggattaagtacgaacagcagagaagagcagatgctgattacaggttggatgagggttggctgaattttg

SEQ ID NO: 25148 - DNA, 75 bp, Artificial Sequence
  Synthetic
ctttcctacaattttgctttaatgagatacaggaaatgttgatatcaaaaggatttgataaccctcaagacattg

SEQ ID NO: 25149 - DNA, 75 bp, Artificial Sequence
  Synthetic
ccagagtgaggattgcagctgatcttgctgtgagaaggtatatggttgagattctcattgacgcaaacagagccc

SEQ ID NO: 25150 - DNA, 75 bp, Artificial Sequence
  Synthetic
cttcagtgatagaatcacttaccgctattttcttgactaaagacatccatatgacaggagaattcttctcattct

SEQ ID NO: 25151 - DNA, 75 bp, Artificial Sequence
  Synthetic
cttccccgaaagcaagagtccttgagctgatttgcgatatcgggaactatataagtgaagcagggttggccggtt

SEQ ID NO: 25152 - DNA, 75 bp, Artificial Sequence
  Synthetic
tcagaacattcggtcaccccactcttgaggcagaagaggctgcagacaaggttagagcacatatgaacaagccta

SEQ ID NO: 25153 - DNA, 75 bp, Artificial Sequence
  Synthetic
tccacttgacaatcaagtatgggattgagactcgttatcctgccttggcattgaatgagttgcaagctgatctag

SEQ ID NO: 25154 - DNA, 75 bp, Artificial Sequence
  Synthetic
aacttgtcgactttgaaataatgatgaaagggcatgctctcttttgtggaataatagtgaacgggttcagagaga

SEQ ID NO: 25155 - DNA, 75 bp, Artificial Sequence
  Synthetic
ggactatcctggctctgatgaaatgttatgttgaactaggagagagagcaccctttatggttattcttgaagatt

SEQ ID NO: 25156 - DNA, 75 bp, Artificial Sequence
  Synthetic
ggcacggaggggcttggcctcctcatcattttccagaacacgtgagctccatcattaagtcagccgccgctaaca

SEQ ID NO: 25157 - DNA, 75 bp, Artificial Sequence
  Synthetic
cagttcagaccaagttttctccgggttcgtacccgttgctctggagctacgccatgggggttgggtcaatgctag

SEQ ID NO: 25158 - DNA, 75 bp, Artificial Sequence
  Synthetic
atgaggctcttactcatgaggtatgtatacaagaatggaaatcttttgtgggattccaattcaagtgttttatgc

SEQ ID NO: 25159 - DNA, 75 bp, Artificial Sequence
  Synthetic
atcgagctgtcaacaacctgaactatgcaagaaattaccttgagcagcctttttataaccttggtgttgggatgg

SEQ ID NO: 25160 - DNA, 75 bp, Artificial Sequence
  Synthetic
cactgactcttgatgaggatctgaccatgtatatgaaagacaaagctttagcagctgtgaaagctgaatgggact

SEQ ID NO: 25161 - DNA, 75 bp, Artificial Sequence
  Synthetic
tagaaaagatggaggggtcggttaacaggcatgtggctgaagaacttggactgacaggtgagcaaattgcccaga

SEQ ID NO: 25162 - DNA, 75 bp, Artificial Sequence
  Synthetic
cggtgtatttaagagagaatatggcttatccccctccgaaacagactacttctcggcgactcgtggaggtcttcc

SEQ ID NO: 25163 - DNA, 75 bp, Artificial Sequence
  Synthetic
tcaaagacctggtaaagcaggaggcggaccactctggtgctgttccaaaacatacatccagaactggagtcggca

SEQ ID NO: 25164 - DNA, 75 bp, Artificial Sequence
  Synthetic
tcaatgatcataattttgatccagtgaacttgatcaactatgtactgagtggggattatttggaagataaagagt

SEQ ID NO: 25165 - DNA, 75 bp, Artificial Sequence
  Synthetic
gcgccaaattcaatcctgcgagcgtagatgaacttatccctagtgatgaggacaaccaagacgatgatgatgcta

SEQ ID NO: 25166 - DNA, 75 bp, Artificial Sequence
  Synthetic
tcaatttatcttacagccttaaggagaaggagattaagagggtaggtagactctttgctaagatgacttacaaga

SEQ ID NO: 25167 - DNA, 75 bp, Artificial Sequence
  Synthetic
caacgtcctatgggaaaccatacagaccccagattgagcttgcagagaaaccagacagtgtgccaatcaatgaac

SEQ ID NO: 25168 - DNA, 75 bp, Artificial Sequence
  Synthetic
tgagggcatgtcaggtggtaggagaatcattgattgcgacaggtgtgggacaatatttcaaagagaacggaatgg

SEQ ID NO: 25169 - DNA, 75 bp, Artificial Sequence
  Synthetic
accttgctcgaaagtatgcagacgcggacacagatgccatgagagggcaagtagctgggatcctgaggaaagaaa

SEQ ID NO: 25170 - DNA, 75 bp, Artificial Sequence
  Synthetic
tcaagaatgaacatgagttgcttaaaactttgcacaagctgtcggtatcctctgttgcacgtgataacaagactg

SEQ ID NO: 25171 - DNA, 75 bp, Artificial Sequence
  Synthetic
ggaagaaaaagaaacacagcaaggaaaatgcacctggtgtggtgctccccgactcgcagagcacaggtggggacc

SEQ ID NO: 25172 - DNA, 75 bp, Artificial Sequence
  Synthetic
ggaacaagtcagaggtcaagccgagaagaaccagtaaggggaagatactatatagtgaaaatgttgatattaaag

SEQ ID NO: 25173 - DNA, 75 bp, Artificial Sequence
  Synthetic
tatctgtcatagactcataaatacacacttgactccacaatcgcctgattctaatcccgactggattttataata

SEQ ID NO: 25174 - DNA, 75 bp, Artificial Sequence
  Synthetic
atatccagtatgagactatgagcacattcttgacaactgacttacagaagttctgcttaaattggagacaagaaa

SEQ ID NO: 25175 - DNA, 75 bp, Artificial Sequence
  Synthetic
gttatgaaataatcaatcatttaatctattaagaaaaacttaggaacaaggttccttcaagttgggtctattttc

SEQ ID NO: 25176 - DNA, 75 bp, Artificial Sequence
  Synthetic
ccacaaacatatttgcacaaaggcttgatgaaatttatgggttacccggcttcttttcatggctccataaacggt

SEQ ID NO: 25177 - DNA, 75 bp, Artificial Sequence
  Synthetic
ttctaagtttatcactgctccatagcagttataattagattaccctgatgtcagattataatcctgatgtcctcc

SEQ ID NO: 25178 - DNA, 75 bp, Artificial Sequence
  Synthetic
tggagaagtcgactctttatgtatctgatccaaattgtcctccttacaatgatatgaggcttgggattgacgacg

SEQ ID NO: 25179 - DNA, 75 bp, Artificial Sequence
  Synthetic
agcagcttgtcaaggatggaatcaagactatcgagcttttacagcagagtccggaagactttcagaagacgtacg

SEQ ID NO: 25180 - DNA, 75 bp, Artificial Sequence
  Synthetic
ttgaaaatcgacagattttcatcaaaaatcctatgggtggtattgagggctattgccaaaagatgtggactatca

SEQ ID NO: 25181 - DNA, 75 bp, Artificial Sequence
  Synthetic
gcagaagtgccatccaggagccgtcgacaagagccagaatccaaagttgggagtcccgcaatcccgatcatgatt

SEQ ID NO: 25182 - DNA, 75 bp, Artificial Sequence
  Synthetic
taactatacccttactatttctgagtgcatatgaatgtggggcaaagatagcagcagtagttcagggtgataacc

SEQ ID NO: 25183 - DNA, 75 bp, Artificial Sequence
  Synthetic
acaccggtaataaaaatcagagaagcgagggagctaaagagagagcaaacaagagcgagagcgcgggaactgctt

SEQ ID NO: 25184 - DNA, 75 bp, Artificial Sequence
  Synthetic
aagccatagctataaccaagagggttcatcctaatataccttatcgccaaaagaagttcctgtgttctcagctag

SEQ ID NO: 25185 - DNA, 75 bp, Artificial Sequence
  Synthetic
cagctgatggaggacatggagataaaccctcaaataacgggggtgactcccaaaacgagtaccaagggtcagatc

SEQ ID NO: 25186 - DNA, 75 bp, Artificial Sequence
  Synthetic
ctcaacagtacttcaatagattgaggcaaaacatggcaggtatagggcacaatctgaaagcgaatgaaaccattg

SEQ ID NO: 25187 - DNA, 75 bp, Artificial Sequence
  Synthetic
aacaggtatgggatgctgcgtataatgatgggaatagtggcggagcttggggaggtcccacaggtggacttccca

SEQ ID NO: 25188 - DNA, 75 bp, Artificial Sequence
  Synthetic
tgagttcgcactttttcatttattcaaagaggatatattacgatggacaagtgttgtcacaagctctaaaaccat

SEQ ID NO: 25189 - DNA, 75 bp, Artificial Sequence
  Synthetic
cggctggagaaagagggtatcctatcacaacaggaaatcaagaatttgagggataccatcccgacggtccagttg

SEQ ID NO: 25190 - DNA, 75 bp, Artificial Sequence
  Synthetic
tgtctagatgtgtattttggtcagagactgttgtggatgaaactcgatccgcttgcagcaatatatgcactgctg

SEQ ID NO: 25191 - DNA, 75 bp, Artificial Sequence
  Synthetic
atgctcgagagtataatcagataagctccatggatcatgagatgtctgctgcagaaactttgggctcgtctactc

SEQ ID NO: 25192 - DNA, 75 bp, Artificial Sequence
  Synthetic
ttgcaaagagcatcgaacaaggttatagtagatggattggttacagtatttgcattttcaaaacacttcagcaaa

SEQ ID NO: 25193 - DNA, 75 bp, Artificial Sequence
  Synthetic
agctaactactatgagaaacgcaacaactgatgattttgcgaaaatttttgaggaggggacacctaaagtgcacc

SEQ ID NO: 25194 - DNA, 75 bp, Artificial Sequence
  Synthetic
ttgtgatatcattgaggtatactattaatgactccatgactaaagatattacagatcccctgattaaaaacccaa

SEQ ID NO: 25195 - DNA, 75 bp, Artificial Sequence
  Synthetic
gacggctgagggggataactgctgttgtgccggctcaaaagcaaccaggggcagtcggtggacctgttaaaaaag

SEQ ID NO: 25196 - DNA, 75 bp, Artificial Sequence
  Synthetic
actggatactcgctgctacactactaccttcacaattggggggattcaactatatcaacattggtcggttatata

SEQ ID NO: 25197 - DNA, 75 bp, Artificial Sequence
  Synthetic
gcaccgacgggagtactgcatcgacacttttgggggacgtaccattatccgggagtggtgcaatccccaatgtgc

SEQ ID NO: 25198 - DNA, 75 bp, Artificial Sequence
  Synthetic
ttaggaatataggagacccagtcacagcctcattagctgatctaaaacgaatgattaaagtcgggcttcttgatg

SEQ ID NO: 25199 - DNA, 75 bp, Artificial Sequence
  Synthetic
acccctcactgttacaccaacccaaaaagaatgctcatgcggagaatgcccaaggcagtgtgcaagatgtatcga

SEQ ID NO: 25200 - DNA, 75 bp, Artificial Sequence
  Synthetic
agcggattctgcagaaagttatgcatcagaaacctggagactgcacatatctggactgggccagcgacccttatt

SEQ ID NO: 25201 - DNA, 75 bp, Artificial Sequence
  Synthetic
cgaccggggctattggccaaagtgacgaggctgcacactttgatcaggagattgaaggaaaactcaatcttgtgc

SEQ ID NO: 25202 - DNA, 75 bp, Artificial Sequence
  Synthetic
ctataaacattccatcgtctcaaagtgttaccatcgtattaaagaatataactgccagaatgatacttcaaaata

SEQ ID NO: 25203 - DNA, 75 bp, Artificial Sequence
  Synthetic
ttaaggaattagatctgatcagtaagaagctagactatctaccggagatcaaagaggagatcaggaatattaata

SEQ ID NO: 25204 - DNA, 75 bp, Artificial Sequence
  Synthetic
gcagaaaccctatgctaagtggactatttcatgatgattttgaccaggaggatcgagatctggccagattccttc

SEQ ID NO: 25205 - DNA, 75 bp, Artificial Sequence
  Synthetic
agaaaataaccaatcttagcctaggactctctacagttgaaaactatatcaaatccatgatgatcattatcccta

SEQ ID NO: 25206 - DNA, 75 bp, Artificial Sequence
  Synthetic
tagacagggcaattattattcctagagcagctcatgagattatggccaagtcattaactggtgcacgccaagaga

SEQ ID NO: 25207 - DNA, 75 bp, Artificial Sequence
  Synthetic
gctcaggaaagcctgatgtgaatgacacggctgaggtgaatccagatctgaaggcagtaattgggagagataaaa

SEQ ID NO: 25208 - DNA, 75 bp, Artificial Sequence
  Synthetic
ttgctggtatgttggattctaccaaaggattaatccggaatggcctccgggccggtggactaaggccccgactag

SEQ ID NO: 25209 - DNA, 75 bp, Artificial Sequence
  Synthetic
ctagggggttgaaggaagttacaacacacaggagtgatctagaaagtttagacctcctaagcccagcaacatcag

SEQ ID NO: 25210 - DNA, 75 bp, Artificial Sequence
  Synthetic
ttgagaaattatcactttatgattatgaacaattccgggtgtttaacaacctgatgtcagtaaaggagaacagca

SEQ ID NO: 25211 - DNA, 75 bp, Artificial Sequence
  Synthetic
aaatagaccctaaatacctgactcaagacctggatttcactaagtctaatgccgccaattttgtcccaggcaatg

SEQ ID NO: 25212 - DNA, 75 bp, Artificial Sequence
  Synthetic
tcttaattactgctgatgcctgtgcagttgaattggctaggcgcattagaaacgtgatgtggaaccatctaactc

SEQ ID NO: 25213 - DNA, 75 bp, Artificial Sequence
  Synthetic
atgccagctcattttataccattgtggctatgatcaagggtgaagtaactgatgtcaaacgtcagcaagagttga

SEQ ID NO: 25214 - DNA, 75 bp, Artificial Sequence
  Synthetic
atggaaggccgatttatgggcttgaggtgcctgataccattgaggcaatgaatgggtttcttattgaaagctgtt

SEQ ID NO: 25215 - DNA, 75 bp, Artificial Sequence
  Synthetic
tcaagtgggtgtctgactccatgaacaaacaccccatgggacagatctaccgtgtcgtgagggaggctctggatg

SEQ ID NO: 25216 - DNA, 75 bp, Artificial Sequence
  Synthetic
ccgattgctactattgccaggccaataaccaggagttttgttggttctttgtacctaaccactgtgagctagacc

SEQ ID NO: 25217 - DNA, 75 bp, Artificial Sequence
  Synthetic
ctgaaagtgacagctcctcaagctcagatagtgattagatgccaaggcaaccagcttacacattatacaattatt

SEQ ID NO: 25218 - DNA, 75 bp, Artificial Sequence
  Synthetic
aagtcaagaaggagtccaacagtatcagggtcccttactttggatcaacaactgaggaaaggagtgagattaaat

SEQ ID NO: 25219 - DNA, 75 bp, Artificial Sequence
  Synthetic
gttgttattgtaacactggctttgaattactctactaaattgcacagaatgtataatcattaagaaaaacttagg

SEQ ID NO: 25220 - DNA, 75 bp, Artificial Sequence
  Synthetic
tatcaagtgttagatcagcatcacgtgccctcaaagctgccattaggattgctaccgtttatacctgggcatatg

SEQ ID NO: 25221 - DNA, 75 bp, Artificial Sequence
  Synthetic
gccaaggtacaatggccgggaatgctggaacagctgatttcctgaattcctcctgggaggaaggaggaactctca

SEQ ID NO: 25222 - DNA, 75 bp, Artificial Sequence
  Synthetic
gtgatactgatgagtgttgggatgaagcttggtatttagcttcctttagagcaaatttaacactcgctgagttaa

SEQ ID NO: 25223 - DNA, 75 bp, Artificial Sequence
  Synthetic
ctgccattgaccctgaagcagatgagaggggaagactaattcctaagtatagagttataaaccccggtacaaaca

SEQ ID NO: 25224 - DNA, 75 bp, Artificial Sequence
  Synthetic
aagcaattacacccatatcgacatctaacaatattgcccatagattgagggataagagcacccagatgaaatatt

SEQ ID NO: 25225 - DNA, 75 bp, Artificial Sequence
  Synthetic
gcaggaagagtgccggttatatgtacctattggtacatggcataattgaagagaaggatgttgcaggcgcatcag

SEQ ID NO: 25226 - DNA, 75 bp, Artificial Sequence
  Synthetic
ccggtaattctcttagccgcgtgagtcgttataccatgatcagcaatgataatctgaactttaccagagacggta

SEQ ID NO: 25227 - DNA, 75 bp, Artificial Sequence
  Synthetic
cgaagaacaacaaaacatttgcagctttcccattaggcgttgggagatcaaacgctcttccccaggatcttctgg

SEQ ID NO: 25228 - DNA, 75 bp, Artificial Sequence
  Synthetic
ataagattgatactaatttagtgtatcagcaagtgatgttgttgggcctcgcatctctagaggatcttttcaggt

SEQ ID NO: 25229 - DNA, 75 bp, Artificial Sequence
  Synthetic
atagtgtcgtagggcttgatgttaccgtgcggagaacagctgggtcaagcgagatgctagtattcggtactagta

SEQ ID NO: 25230 - DNA, 75 bp, Artificial Sequence
  Synthetic
ttaacaaaaccacaggtatggagaacacggtataccacctacatgtagaagagaactgctgcgtgatagaaatgg

SEQ ID NO: 25231 - DNA, 75 bp, Artificial Sequence
  Synthetic
acattagccctgtgctcacaccttggaaagacatcctgaccactggggcaatattccctgctataaaagtgtgca

SEQ ID NO: 25232 - DNA, 75 bp, Artificial Sequence
  Synthetic
aagaccacccttatgttgtaacagaggagcctccacctgtcttgagaggtgtgtacaacaacaagttaatttatg

SEQ ID NO: 25233 - DNA, 75 bp, Artificial Sequence
  Synthetic
acaatgttgacatggttgctgtggacaggcagcagaagtttcgctgcatcttcttgacaatcacaatgttgacag

SEQ ID NO: 25234 - DNA, 75 bp, Artificial Sequence
  Synthetic
atgatcaccccttagaggataaggaggtggagaacatttataagcagacctatacatcagccatacttgatttcc

SEQ ID NO: 25235 - DNA, 75 bp, Artificial Sequence
  Synthetic
atgcgggtgtttacaaagtcccaaagaccattctcgattttcggatggctaatgcggtgtctttcaatctgcttg

SEQ ID NO: 25236 - DNA, 75 bp, Artificial Sequence
  Synthetic
caaggtataatattcaggagttgaacacagtgctggctcagtctctatcaattactattattgacattatcaccc

SEQ ID NO: 25237 - DNA, 75 bp, Artificial Sequence
  Synthetic
ttgaactgctaatcggggcggacatgacagcgtccggcatcaagggcataattaatgattacggtgagagggtga

SEQ ID NO: 25238 - DNA, 75 bp, Artificial Sequence
  Synthetic
gtgagaacaaggaccatctaaccgagtttaaagttcttgcaaacgacgatgatgttaacagtcttataactgagt

SEQ ID NO: 25239 - DNA, 75 bp, Artificial Sequence
  Synthetic
cgacattcatgattcatgtcgggaacttcctcaggaggcgaaacaaagaatactcggtcgactattgtcgtcaaa

SEQ ID NO: 25240 - DNA, 75 bp, Artificial Sequence
  Synthetic
ttctattagtggacccttcagaatttgtcctatacctcggcttagcagtggctattaactggtcctttgatattt

SEQ ID NO: 25241 - DNA, 75 bp, Artificial Sequence
  Synthetic
aaattgacaagatggaccttcgcttttcacttggtgcagtgggtggcctaagtcttcatgtctgtatcaagggga

SEQ ID NO: 25242 - DNA, 75 bp, Artificial Sequence
  Synthetic
attatagaaggccacaagggaaataccagatggtggaatacttgtcatcatatctgaggataacgtcaaggtctt

SEQ ID NO: 25243 - DNA, 75 bp, Artificial Sequence
  Synthetic
agatgagcaatgcccttaaggctcagctaggatacaaaaccacgatttgttattctctcatggacaccaacccgt

SEQ ID NO: 25244 - DNA, 75 bp, Artificial Sequence
  Synthetic
ttataaatgtatttgctaatgccctgtcacaccctagagttttccgaaggttttgggacgtgggattgatcgagc

SEQ ID NO: 25245 - DNA, 75 bp, Artificial Sequence
  Synthetic
acctgaacaagttgatgtggaaggctgaatgcaagatcaacaaggtgactgctgttctccagccatctgtcccta

SEQ ID NO: 25246 - DNA, 75 bp, Artificial Sequence
  Synthetic
cagtctacgggcctaacctcaacacccagaatttcaaccttattgctattgaactgctaatcagaggttttgagg

SEQ ID NO: 25247 - DNA, 75 bp, Artificial Sequence
  Synthetic
aagaattcaaggtctatgaggatgtgctgattgaccacactgggaagattatgaagtgagtgcatacaagctagg

SEQ ID NO: 25248 - DNA, 75 bp, Artificial Sequence
  Synthetic
tttatctagactactggttagatggggagactgcagaatatatgctgcctgagagtgtacaagatattgttgatc

SEQ ID NO: 25249 - DNA, 75 bp, Artificial Sequence
  Synthetic
ttgtttggatcctaaaaccagcatttggatatagagttctcaatttttgcactttgagctatagttttgtgcaat

SEQ ID NO: 25250 - DNA, 75 bp, Artificial Sequence
  Synthetic
aaagatacgagagtattcagtcacgtcatctatgtataatttgctgtttataccttgaacgagaatatatgccaa

SEQ ID NO: 25251 - DNA, 75 bp, Artificial Sequence
  Synthetic
gttgcattgcttgtttactttaactttggcccaatataatcctccggcacgtgaattgatactcaatctcaagtc

SEQ ID NO: 25252 - DNA, 75 bp, Artificial Sequence
  Synthetic
agattcttggtctgacatcaattgaaaagtgtagccttctgactgacattctccaaaaacataaatacactactc

SEQ ID NO: 25253 - DNA, 75 bp, Artificial Sequence
  Synthetic
ctcattcaagatgcattattaggttattctatcatttagaatagagcattctacattcaagtatatgctagaatc

SEQ ID NO: 25254 - DNA, 75 bp, Artificial Sequence
  Synthetic
ctcagttctttacctggaatcttgagccgctgcctgtggtagtctaccctgtctctcttacctacatacgccgag

SEQ ID NO: 25255 - DNA, 75 bp, Artificial Sequence
  Synthetic
ttggaaagatatgcaccttgttctataaaaaacttaggaggacggggtctacttcttataccattagaattagtt

SEQ ID NO: 25256 - DNA, 75 bp, Artificial Sequence
  Synthetic
gctctgttaaacatctgaggttaagaaggatgattcagtttaacgatcccgtcgctgataaatcaaggattgatc

SEQ ID NO: 25257 - DNA, 75 bp, Artificial Sequence
  Synthetic
ttagagatcccttcttcgggtgcaactcaagatcaattatgaaggtaactattttgacagcctacattgcagcaa

SEQ ID NO: 25258 - DNA, 75 bp, Artificial Sequence
  Synthetic
cacttaacatgaaaagttttgttgttcaacggaacaacgttgcagggataactacatccttcaaagcatttcagg

SEQ ID NO: 25259 - DNA, 75 bp, Artificial Sequence
  Synthetic
gtgttttcacctgttgccactcccagttggccctcagtgagctcaccaagattggcattatccctgggaggtcat

SEQ ID NO: 25260 - DNA, 75 bp, Artificial Sequence
  Synthetic
cagtgctccttatcagtgatgacttcagaaaactgcaggggctggaagaatatttaccgacaaagaatcgatggg

SEQ ID NO: 25261 - DNA, 75 bp, Artificial Sequence
  Synthetic
atgatctcaaaacctcgactcaagcttcttatcagtacatggttataaaacttattcctaatgtgaatggcttaa

SEQ ID NO: 25262 - DNA, 75 bp, Artificial Sequence
  Synthetic
aagcacatgtccatagacgagtcggtgtaaattccacatcctgctacaaagcctgtgaaataggaatatacatca

SEQ ID NO: 25263 - DNA, 75 bp, Artificial Sequence
  Synthetic
acaactgtactaacagtacagtcgaatcatacaagaaaatgctaacaagactcctgaatcccattgacgtagcac

SEQ ID NO: 25264 - DNA, 75 bp, Artificial Sequence
  Synthetic
taaataagatggataccaaagggcctagactattcctcggtgagggatcaggatccatgcttacaacctattaca

SEQ ID NO: 25265 - DNA, 75 bp, Artificial Sequence
  Synthetic
ttaagaagatgaaaaatgcagtctcggacaaggctccagaaaagctaggcaacgtcaagttctggggggcggtca

SEQ ID NO: 25266 - DNA, 75 bp, Artificial Sequence
  Synthetic
tgcttctgggtccttctaagacttattataacactgaggtcttgaacgtaggcttagttggacagagagttttcc

SEQ ID NO: 25267 - DNA, 75 bp, Artificial Sequence
  Synthetic
tcggtggagttgcattaggggtggcgacttcagcgcagattacagcaggcgttgctcttcacaactccattcaga

SEQ ID NO: 25268 - DNA, 75 bp, Artificial Sequence
  Synthetic
aggtcttcccttctgaagtaatgttggtgtcacataataacccaagagatatgggactcgaacatgatatcaagg

SEQ ID NO: 25269 - DNA, 75 bp, Artificial Sequence
  Synthetic
atgcaaatgctattttgacactcaaagattctatcaggcagtctaacaaagcaatacaagaattacaaacagcta

SEQ ID NO: 25270 - DNA, 75 bp, Artificial Sequence
  Synthetic
tcttgttcaatggcaagccggagtgcacttgggttggtgatatggaatgtttttcatatctcatgaattcggttg

SEQ ID NO: 25271 - DNA, 75 bp, Artificial Sequence
  Synthetic
tgtctaccactgtcgttgtgttaaatgctctccaggaccagataaataatcagttggccccagctataaattctc

SEQ ID NO: 25272 - DNA, 75 bp, Artificial Sequence
  Synthetic
aagcacacaccctcgcactagtgcataatgatatggaatcatcccttgagaaatcaccggagaccatcttactag

SEQ ID NO: 25273 - DNA, 75 bp, Artificial Sequence
  Synthetic
taggatgccaggtggttgctaatacactaggtctaaaattaaaccagtacttcagtgaaatctcacttgtctttg

SEQ ID NO: 25274 - DNA, 75 bp, Artificial Sequence
  Synthetic
agcaagttcatagcttgtgtatagctgttaaccttacaaaagatgatgggctttatatcacaaaggttgccccta

SEQ ID NO: 25275 - DNA, 75 bp, Artificial Sequence
  Synthetic
gcccgaatttgcgagaccccacttcagaaacactttcaatccaggcactttccagagcatttaacggtgactttg

SEQ ID NO: 25276 - DNA, 75 bp, Artificial Sequence
  Synthetic
gatctggagatatgagccatatactattaagcttattgtaccattactttagtgaagttacatgttttataccag

SEQ ID NO: 25277 - DNA, 75 bp, Artificial Sequence
  Synthetic
attctatgctgtctagacttaaatatgatgacagtgatttccttgatttgttggagagtgacagcatcagaggaa

SEQ ID NO: 25278 - DNA, 75 bp, Artificial Sequence
  Synthetic
cctacagcaacagttgttcccctgaatgttatctggtatgtagtggaaagaagtatcatagcttaatctaccctg

SEQ ID NO: 25279 - DNA, 75 bp, Artificial Sequence
  Synthetic
gaataatagatgtgtctctagaagattacctaattacaattcagattgagtaccctgctctattgacaataaagg

SEQ ID NO: 25280 - DNA, 75 bp, Artificial Sequence
  Synthetic
aaattataatgcctgggataagcaaaagtaactttgcaaaaaacattattatcagccagaacatattggacatga

SEQ ID NO: 25281 - DNA, 75 bp, Artificial Sequence
  Synthetic
atgctattatacagacattcaatttaataagctataatactagaggaactgagtggatatctatatttcctaagc

SEQ ID NO: 25282 - DNA, 75 bp, Artificial Sequence
  Synthetic
aatttaatatgcggaagagtcttgttaatgaactaaagctatatggtgactacctacagtccactcttcagagcc

SEQ ID NO: 25283 - DNA, 75 bp, Artificial Sequence
  Synthetic
agctgttggttagagggacttacatatctaacattgatatatcacaatgtgttcttgctgcaacttctattatat

SEQ ID NO: 25284 - DNA, 75 bp, Artificial Sequence
  Synthetic
tagatgaaacggagaagcttcttatgtcctatgggtttcagattaatggtcctaagctcattaagcaggttactg

SEQ ID NO: 25285 - DNA, 75 bp, Artificial Sequence
  Synthetic
gcaaatcagacactagtacccctattagttctgctacttgggcttgtgctacagggaatgtaactagctgcgcca

SEQ ID NO: 25286 - DNA, 75 bp, Artificial Sequence
  Synthetic
gacatgacgtgggttcaggttctcataacctcaaggcttatatcaattcaagtgtcaataacatcatcaattact

SEQ ID NO: 25287 - DNA, 75 bp, Artificial Sequence
  Synthetic
gaactagggttgtaaatgctcatgtccccaggtttgctctctcaggtggtgttatatttgctaattgtgcacctg

SEQ ID NO: 25288 - DNA, 75 bp, Artificial Sequence
  Synthetic
gtgacacggagaggacaactagtcactttcttgaaccttacccactagcacgcgattcaaaacttagggagctga

SEQ ID NO: 25289 - DNA, 75 bp, Artificial Sequence
  Synthetic
ttgtatgtaaatgccaagatccgctttatagcataaatcaagaacccaaagtgacaaatgtaatggtcgatgttg

SEQ ID NO: 25290 - DNA, 75 bp, Artificial Sequence
  Synthetic
tggactcattatgtaaaaagatctgtgtttacattttattatacatgaaagagacaaataaggagtctcgtcgca

SEQ ID NO: 25291 - DNA, 75 bp, Artificial Sequence
  Synthetic
atgcctgtaaagagatgtatcttgatggattatacataacacttggtaagtcacagttaccccgtgctatgtatg

SEQ ID NO: 25292 - DNA, 75 bp, Artificial Sequence
  Synthetic
gcctgattaatatgattagagggaaagtactcagggtatcacttagctctaacattacaagaagtataatacagg

SEQ ID NO: 25293 - DNA, 75 bp, Artificial Sequence
  Synthetic
ccgaggatgtgtctttgggaggtccaataagcgtggatctcatagacctgggcaatgagatcaattcaatcaata

SEQ ID NO: 25294 - DNA, 75 bp, Artificial Sequence
  Synthetic
actatctgcttaagaaactgtcgaaaaccagtgtgaacttacaatgggcttatccattgcctacagcagaagtta

SEQ ID NO: 25295 - DNA, 75 bp, Artificial Sequence
  Synthetic
gtgcaatcaataggtcggaggagcatctggatcatgcaaatgagctacttgatcaggttaatcctaagatagtca

SEQ ID NO: 25296 - DNA, 75 bp, Artificial Sequence
  Synthetic
agatatggtggaagatagtgggctactctgtcctacacaaagaatcttaaggattttgagttaacgggcatccaa

SEQ ID NO: 25297 - DNA, 75 bp, Artificial Sequence
  Synthetic
atgtcaagaccttcggggttatgttgggattattgctgctcctgatactatggtgtgttgtgactttggtgtggc

SEQ ID NO: 25298 - DNA, 75 bp, Artificial Sequence
  Synthetic
caccattaccttatgacagcaggtctgtcactatacccatatcaaaatattaagaaaaacttagaatttatatat

SEQ ID NO: 25299 - DNA, 75 bp, Artificial Sequence
  Synthetic
atgacagcaggtctgtcactatacccatatcaaaatattaagaaaaacttagaatttatatatcctttgtctggt

SEQ ID NO: 25300 - DNA, 75 bp, Artificial Sequence
  Synthetic
tcatttgccttacaaaacaagtgagtagagtgtcttttggaggaagcatgggtagtcgggcatcgacagttaatt

SEQ ID NO: 25301 - DNA, 75 bp, Artificial Sequence
  Synthetic
cactctccggattcgtgggttaacataaagaaaatggtactctggttataatatacatgattagtatttgtgttg

SEQ ID NO: 25302 - DNA, 75 bp, Artificial Sequence
  Synthetic
accctttacggtacaatccagcttaggctctatcattcctatttcaataaggcgctaatcagaaaaaacttaggg

SEQ ID NO: 25303 - DNA, 75 bp, Artificial Sequence
  Synthetic
tgaatgcatacgccctacctatcatcctaaccttgatgcaaaacaatacttctacagattttctgattcaagacg

SEQ ID NO: 25304 - DNA, 75 bp, Artificial Sequence
  Synthetic
atggagagggatgttacgattgccttgtttacaatttaccttgtctgtatattctggggtatctcatctattatc

SEQ ID NO: 25305 - DNA, 75 bp, Artificial Sequence
  Synthetic
tggtttatgtacttaactatccgtttgtacatgatccggtcagagatttataaaaagatctctatccttaacaat

SEQ ID NO: 25306 - DNA, 75 bp, Artificial Sequence
  Synthetic
gaggttgtattcttgcaagagttgtctagagagcatcctgaggttttggtgaacggaccacccccctatacacag

SEQ ID NO: 25307 - DNA, 75 bp, Artificial Sequence
  Synthetic
gtataactcctggctggtgttgctttcactcgatctgttattatctataaaaaacttagggtcaatgcctttccc

SEQ ID NO: 25308 - DNA, 75 bp, Artificial Sequence
  Synthetic
tgctgttattgtggtggcttttttgttggtttatttcaccattaggcttctgctcatttattgcatacctaactc

SEQ ID NO: 25309 - DNA, 75 bp, Artificial Sequence
  Synthetic
gagaagctaaacatcaggtgatgacttctgattatgaggatccggcttcgatgccttcttgctatggttcgatga

SEQ ID NO: 25310 - DNA, 75 bp, Artificial Sequence
  Synthetic
ggagttcaggggccacctataaggctacccagattagaaggccttatcagaatggagttcctaggagtttgaaat

SEQ ID NO: 25311 - DNA, 75 bp, Artificial Sequence
  Synthetic
ctggttactccacagctacagcgaggaagagtacaaatatatattttgcattcatcctcttcgtaagtagtgtta

SEQ ID NO: 25312 - DNA, 75 bp, Artificial Sequence
  Synthetic
acatggctatgctatgctacataatcatctccatggaggctaagaattgtgctcctgagaagccagcaactcggc

SEQ ID NO: 25313 - DNA, 75 bp, Artificial Sequence
  Synthetic
cactgcctaaagttgataaccagaattgtcctgaactcgatcagatatctagcagtatcaacacaatgatgcacg

SEQ ID NO: 25314 - DNA, 75 bp, Artificial Sequence
  Synthetic
ctctgacatatacccttccgcaggtactgacatctaacaagcatgctctggtttcaagattaaatcaccttgctt

SEQ ID NO: 25315 - DNA, 75 bp, Artificial Sequence
  Synthetic
ttgagctgagagaaacagttcgcatgaacaatcttgatcttaatgtacgactgggattgaaccgaacaattgctc

SEQ ID NO: 25316 - DNA, 75 bp, Artificial Sequence
  Synthetic
tgagaacaggctcaaatacagctaagataacagccacatccagcggtccaattggatctactaaaccccctctgg

SEQ ID NO: 25317 - DNA, 75 bp, Artificial Sequence
  Synthetic
ttcctgtgtttactctggtgcctcctcgtgctactagcagggtgatgttttatccgcttatgaaaggagagagaa

SEQ ID NO: 25318 - DNA, 75 bp, Artificial Sequence
  Synthetic
acatgatgtcagatgaaaatcttgagaatgtcagaaggctgaacaagcaccacaaccctaacaatgggggtgtgc

SEQ ID NO: 25319 - DNA, 75 bp, Artificial Sequence
  Synthetic
aggatgatatagctgttctaaaccccgctttctaatacccagaaaagtaatgacacatctctccataaccaaatc

SEQ ID NO: 25320 - DNA, 75 bp, Artificial Sequence
  Synthetic
actactcatataacaggcagctttattaaaatgatgcttatgagttaatttgtgcttctgctaacgcaccaacac

SEQ ID NO: 25321 - DNA, 75 bp, Artificial Sequence
  Synthetic
atgacttcaatatactaagaaaaacttagggtcaacgatcctacttttccactagatgcaatcaaatgagtcagt

SEQ ID NO: 25322 - DNA, 75 bp, Artificial Sequence
  Synthetic
tggcggcacacaaccttgccatgtcgaatttctacgggacccatcagggagatctctctggatcacagaaaggcg

SEQ ID NO: 25323 - DNA, 75 bp, Artificial Sequence
  Synthetic
aagagcaacaggtgcaaggtgtaatcaggtatgtttctatgattgttagcttgttgagcttgtttaccatcattg

SEQ ID NO: 25324 - DNA, 75 bp, Artificial Sequence
  Synthetic
ccctcaatgtgaccaatattatttatatgacagagtctggtggtactatgcaatcgatcaagacagcccagggct

SEQ ID NO: 25325 - DNA, 75 bp, Artificial Sequence
  Synthetic
ccatcgatggctcaatgagagagatctctggtgtaattatggaagacgtcaaacctaagacagatctgattaata

SEQ ID NO: 25326 - DNA, 75 bp, Artificial Sequence
  Synthetic
gcatggtcagttacaatatcccggctcagttgtccatgatacaccagataatcaaaaatgatgttcccaaacagt

SEQ ID NO: 25327 - DNA, 75 bp, Artificial Sequence
  Synthetic
gcacaccttcatttatgtttaacaatactatctgccccttagctgaaaatccaactcactccaggtattttgaag

SEQ ID NO: 25328 - DNA, 75 bp, Artificial Sequence
  Synthetic
aagtcaatctggacagcatctctgaatgctctggccccgatatgcatttagggctaggagtgaatcctgagttca

SEQ ID NO: 25329 - DNA, 75 bp, Artificial Sequence
  Synthetic
ttgagtttccgtcatttgctccagggtcaacaaagccgggtagttgtgttcggcttccttctttctctctaagca

SEQ ID NO: 25330 - DNA, 75 bp, Artificial Sequence
  Synthetic
ctactgtttttgcatacacccacacgattatggggcatggctgttccgagcttgacgtgggtgaccattattttt

SEQ ID NO: 25331 - DNA, 75 bp, Artificial Sequence
  Synthetic
cagttgggaggatagctgatgcaggccatgaaattcctcagtttgagacaattagcagttggtttattaatgaca

SEQ ID NO: 25332 - DNA, 75 bp, Artificial Sequence
  Synthetic
agataaatagacggtcttgcactgtagcggctggagccatggaggcatggatgggatgcgtgatcatgactgaga

SEQ ID NO: 25333 - DNA, 75 bp, Artificial Sequence
  Synthetic
cattttacgacgaccgcaactcccttgatacaggcaagctgacaatatcataccttgatgtttttgggagaaaga

SEQ ID NO: 25334 - DNA, 75 bp, Artificial Sequence
  Synthetic
aagaatggatttacacaagaagtgagatcctatatgattacacatatacctcggtatacttctctgttgggtctg

SEQ ID NO: 25335 - DNA, 75 bp, Artificial Sequence
  Synthetic
gtgttgtagtgggcgacactgtttactttttgatctgggggagcctatcatctcccattgaagagacagcttact

SEQ ID NO: 25336 - DNA, 75 bp, Artificial Sequence
  Synthetic
gctttgctccagactgcagcaattacaatcagaggatgtgcaatgaggctcaacgcccatccaagttcggtcatc

SEQ ID NO: 25337 - DNA, 75 bp, Artificial Sequence
  Synthetic
gccagatggtcaatgggatactcaagttcaaaacaacatcaactgggaaacctttattgagtgtcgggactcttt

SEQ ID NO: 25338 - DNA, 75 bp, Artificial Sequence
  Synthetic
ctccttctgtggtaccatttggctctgaggggcgtttgatgtattctgagattaccaaaattatttacctgtacc

SEQ ID NO: 25339 - DNA, 75 bp, Artificial Sequence
  Synthetic
ttaggtcaacatcctggcatgctctccctctaaccggactatttgttcttggcccccctactagcatctcatgga

SEQ ID NO: 25340 - DNA, 75 bp, Artificial Sequence
  Synthetic
tagtacaaagagcagtgtctcgtccaggggagtttccttgtggggcttcaaatcgctgccctaaagattgtgtaa

SEQ ID NO: 25341 - DNA, 75 bp, Artificial Sequence
  Synthetic
caggggtttataccgatttgttccctctaggctctagatacgaatatgctgcaacagtctatcttaattctgaga

SEQ ID NO: 25342 - DNA, 75 bp, Artificial Sequence
  Synthetic
cttacagagtcaacccgacactggcccttatcaaccagacaaatataatagctagcaaaaaggtaacaacggagt

SEQ ID NO: 25343 - DNA, 75 bp, Artificial Sequence
  Synthetic
ctcaacgagctggttatactacaacaacctgttttgtttttaagctgcgagtctggtgcatcagtgtggtggagc

SEQ ID NO: 25344 - DNA, 75 bp, Artificial Sequence
  Synthetic
ttgctccctcaacgatgactgcttacgagcctattccgttcctctaccagctggatttaacttgcaagggcaaaa

SEQ ID NO: 25345 - DNA, 75 bp, Artificial Sequence
  Synthetic
acgggagtctggctatgcggttcgccgggaaagaagggacttataaatctggcagatacaagtctcccagaaacg

SEQ ID NO: 25346 - DNA, 75 bp, Artificial Sequence
  Synthetic
aatgcttctttgaaaaggtcagcaataagtattacttcattgtgtccacacctgaagggatccaaccttacgaga

SEQ ID NO: 25347 - DNA, 75 bp, Artificial Sequence
  Synthetic
ttcgggacctcacacctgatagaatgcctcatataattatgtacatatctgatgtttgtgctcctgcattaagtg

SEQ ID NO: 25348 - DNA, 75 bp, Artificial Sequence
  Synthetic
cattcaagaaactgctcccggctatgcggcctataactaccctaacaatcggcaattggcagttcagaccagtgg

SEQ ID NO: 25349 - DNA, 75 bp, Artificial Sequence
  Synthetic
aggtgagtgggggactcagggtgaatataggtaggaacctgactaaagagggtgatttaaccatgtcagcccctg

SEQ ID NO: 25350 - DNA, 75 bp, Artificial Sequence
  Synthetic
aggatccaggctctaatacctttcctggaaaccatatacctggaaatggaatacttgatgctggctattatacgg

SEQ ID NO: 25351 - DNA, 75 bp, Artificial Sequence
  Synthetic
ttgaataccctaaagagtagaaacagacaacacctaagtccagtggagggggtaacatgattgagaagaataaga

SEQ ID NO: 25352 - DNA, 75 bp, Artificial Sequence
  Synthetic
ccccagttattccttcaaaagacagtccaacctctgaaagcagcactctttatcgagagagcgttgagcccatta

SEQ ID NO: 25353 - DNA, 75 bp, Artificial Sequence
  Synthetic
gacctacacgggaagttctaaagagcagtgattatatcacgatagtgagttatgacagcgggtcgggatcaggtg

SEQ ID NO: 25354 - DNA, 75 bp, Artificial Sequence
  Synthetic
attttgccactgggggcccctggacaggcatatcacctaaggctcctcagaatggaatcaatccacttggtacta

SEQ ID NO: 25355 - DNA, 75 bp, Artificial Sequence
  Synthetic
ggctgcctcattcaactgccctggaaagaataaatactcctgcacctttggattcagagacttcagtcgactctg

SEQ ID NO: 25356 - DNA, 75 bp, Artificial Sequence
  Synthetic
atcacactgggaacacgattgatccgacagcattatccaggcctctaaatcatgacacgaccggagatacagata

SEQ ID NO: 25357 - DNA, 75 bp, Artificial Sequence
  Synthetic
cccggatcaatactgagactgctactcatggattcactccaggaagagaagcaaccagtagcgagagactaacaa

SEQ ID NO: 25358 - DNA, 75 bp, Artificial Sequence
  Synthetic
atgacttgaccaattctacaagtgtaccctcagagacacacccaagtgcatccaccagtgaagccagcaagccag

SEQ ID NO: 25359 - DNA, 75 bp, Artificial Sequence
  Synthetic
agaaaagcaccgacaacagggtgaatcaggactcaacatcggaatcagcagtggaatccaccacaaacgcacctg

SEQ ID NO: 25360 - DNA, 75 bp, Artificial Sequence
  Synthetic
tagacgacaagcattcaacacgacccgcaaagactagacctaacactgcagacccagaaagtacttctcagcaca

SEQ ID NO: 25361 - DNA, 75 bp, Artificial Sequence
  Synthetic
gttcatcaacaacgagggatgaggtcaagcccagcttaccaggcacaactgaaacaagtacccaccaacgcacgg

SEQ ID NO: 25362 - DNA, 75 bp, Artificial Sequence
  Synthetic
aggtaactacaacacctgaactggtcaacaacacgttaaaccccccgagcacacaggcaagatcagtgaggtcac

SEQ ID NO: 25363 - DNA, 75 bp, Artificial Sequence
  Synthetic
tgatgcaggatgcaatagctcaagcatggaactttgtacgcatagtaacaccgtaagcactcacactgcccctgc

SEQ ID NO: 25364 - DNA, 75 bp, Artificial Sequence
  Synthetic
aatccctacaaccacctcaaacccgtacctatacaataaaggtatcacagagaccatacgatctacctcagatgt

SEQ ID NO: 25365 - DNA, 75 bp, Artificial Sequence
  Synthetic
aagattatcgactgtcaagcccaccattccaaatagtacatcacatatagacaccacttcaactgctccttcagc

SEQ ID NO: 25366 - DNA, 75 bp, Artificial Sequence
  Synthetic
acattcagtgtcatccttgtttacaacacctgctgctgtgatcgttgacacctccagcaatgatagtcggggtcg

SEQ ID NO: 25367 - DNA, 75 bp, Artificial Sequence
  Synthetic
tgcaacggaccattatacttttatttcaggtggtgaggtatctacggatcataccaagacccatggtcctacacg

SEQ ID NO: 25368 - DNA, 75 bp, Artificial Sequence
  Synthetic
acatcctgtagctgaggataagagccttcatttgatcagattaatcactagtgattgtaatatagagtatcctgt

SEQ ID NO: 25369 - DNA, 75 bp, Artificial Sequence
  Synthetic
agcacaattggaggatctttctaaatggtccatcagctctccacggaatcagcaagagcactacacagttagcag

SEQ ID NO: 25370 - DNA, 75 bp, Artificial Sequence
  Synthetic
tcaaccctcctgcataggttatgtaacacagtctgcagatatgatgagcaagaagctgaacaccaagccatcaat

SEQ ID NO: 25371 - DNA, 75 bp, Artificial Sequence
  Synthetic
tccaaacatagatccagatgatctaactgtaccttatgcttatacttgcacaaataacagcgatacatatctgat

SEQ ID NO: 25372 - DNA, 75 bp, Artificial Sequence
  Synthetic
cccatacctctctggaggtgggtcagaaggccctgctcgcggccagtcaatatcgggatacatgaacggacgttc

SEQ ID NO: 25373 - DNA, 75 bp, Artificial Sequence
  Synthetic
tggggggatagacgaggtgtcagggggattcatatactatatgttgcctgtatcaaaagttgacttacacttaag

SEQ ID NO: 25374 - DNA, 75 bp, Artificial Sequence
  Synthetic
agtgcgggatattaggcagcaggggtaccagtatgcatgcttggcactcgatatctgtggctacaccttaattgc

SEQ ID NO: 25375 - DNA, 75 bp, Artificial Sequence
  Synthetic
tacacaatcagacgataccactatattctattttgtaatcaacccttctgacggagtcagtgtgtatgaagtatt

SEQ ID NO: 25376 - DNA, 75 bp, Artificial Sequence
  Synthetic
gaacctagaatctgtgtgtgtccccgctctgaaagtcctgacagatgaatctcagtggttatacggtgttgttga

SEQ ID NO: 25377 - DNA, 75 bp, Artificial Sequence
  Synthetic
tccgataattatatctggaaccatgtccctagtgcaggttaatgattaccactatagtgccatttatgcaacaaa

SEQ ID NO: 25378 - DNA, 75 bp, Artificial Sequence
  Synthetic
tagttactgttcgactagaatactcaaatcattttggggttattttgctacacctgcaataatgaaatatttgat

SEQ ID NO: 25379 - DNA, 75 bp, Artificial Sequence
  Synthetic
atctagatgaggtaattaatcctaaataaccctccaggccttggaaataagagaaatgtagcctacgagtgcgtg

SEQ ID NO: 25380 - DNA, 75 bp, Artificial Sequence
  Synthetic
ctcttttgagggatttctagggcgttgtacagtgataataataattgatagttattctgaggcctggactttagt

SEQ ID NO: 25381 - DNA, 75 bp, Artificial Sequence
  Synthetic
ttaaattgatgtgagtgaagctcaatcaactattgtcttgtgaactaagaaaaacttaggactaatgtcctaact

SEQ ID NO: 25382 - DNA, 75 bp, Artificial Sequence
  Synthetic
caattaactctggattcctcatgccggatatgttatgatctcgctgtgattctggaatggcgcacccgactatat

SEQ ID NO: 25383 - DNA, 75 bp, Artificial Sequence
  Synthetic
cagatgtgctctatcccgaatgccatctagatagtcctatcgtgactgggaaactctattcactactggaaaagg

SEQ ID NO: 25384 - DNA, 75 bp, Artificial Sequence
  Synthetic
gaggattccctcatagagaagaactgaatgacaagaccctagataagaatctcaaacttaatacacactacatca

SEQ ID NO: 25385 - DNA, 75 bp, Artificial Sequence
  Synthetic
gacaccttcaaaccactatagaccagaatgccttaaaacgtaagctgctagagaagtacccaaacttaaataagc

SEQ ID NO: 25386 - DNA, 75 bp, Artificial Sequence
  Synthetic
caaagcatggcaataaaaccacagacagggtctgcactggcagccttgttaggtcttcagctacaggagttatca

SEQ ID NO: 25387 - DNA, 75 bp, Artificial Sequence
  Synthetic
ctgccgtgtaacttttgcggtaatttcctctcggtttcggaacttctagaacttgaggaaaaagggcttcagctt

SEQ ID NO: 25388 - DNA, 75 bp, Artificial Sequence
  Synthetic
atttggaagggagactttgtgtatggctgttgtagatgctgctgtgtagccacagcaacatatgagtgtatggca

SEQ ID NO: 25389 - DNA, 75 bp, Artificial Sequence
  Synthetic
tttttagaggacactatattaggtagtgacattgaggaaagggaaggaaagccaattgctgaaattagcatcaga

SEQ ID NO: 25390 - DNA, 75 bp, Artificial Sequence
  Synthetic
tgtcagaattgtctgcgacgcttggacctgattgacaagctagatattgtaggtcgcaacgagttgttccacaag

SEQ ID NO: 25391 - DNA, 75 bp, Artificial Sequence
  Synthetic
gttagaggacgctggaagggactttgcaggcagtgtaaaacattataatgattggtaaagaagtcactctacaag

SEQ ID NO: 25392 - DNA, 75 bp, Artificial Sequence
  Synthetic
atattgtcctggagttaaagcctcaagtggaacccgacctgttttgcgacgaggagttaccaggtgaagaggagg

SEQ ID NO: 25393 - DNA, 75 bp, Artificial Sequence
  Synthetic
aagaggaggagccagtaacaagaaatccttttaaagttcttacttcgtgtggtggctgtgaaacaaagctccgat

SEQ ID NO: 25394 - DNA, 75 bp, Artificial Sequence
  Synthetic
tgtttgtagtagcgacagagagtgggattcgggaatttcaagaacttctcttcggggacctaatccttctgtgtc

SEQ ID NO: 25395 - DNA, 75 bp, Artificial Sequence
  Synthetic
cggagtgccgaagagcacatctacagcccaatggcggacgataaaggtagtgataaacattttgatgaaaatgac

SEQ ID NO: 25396 - DNA, 75 bp, Artificial Sequence
  Synthetic
aattggtgtttattagaagctgattgtagtgatatagaaaatgatgagttggacaatttatttgatcgggacact

SEQ ID NO: 25397 - DNA, 75 bp, Artificial Sequence
  Synthetic
gattcggacatatcagatttagttgataatgcagacctggagcagggaaattcccgagagctccttcaccaacag

SEQ ID NO: 25398 - DNA, 75 bp, Artificial Sequence
  Synthetic
cagtgtaatgacagtgaactgcaagtgcaaaaactaaaacgaaagtatttgagtccaaaagcagttgcacagctc

SEQ ID NO: 25399 - DNA, 75 bp, Artificial Sequence
  Synthetic
agtccgcgcctcgagtcgatatcaataagtccgcagcaaaaatctaagagaaaattgtttgctgaacaagacagc

SEQ ID NO: 25400 - DNA, 75 bp, Artificial Sequence
  Synthetic
gggctagaactatcaattacaaatgaagaagatgtttctcctgaggtggaggtaccttcagtagaaacaactgcg

SEQ ID NO: 25401 - DNA, 75 bp, Artificial Sequence
  Synthetic
gggggtggagacgggagatctagagtgcattgtgaagaattaatgcggtgtagtaatgtaaaagcaactttgctt

SEQ ID NO: 25402 - DNA, 75 bp, Artificial Sequence
  Synthetic
tgcaaatttaagttagcatttggtgttagcttttctgaattgaccaggcaatataaaagtaataaaacatgctgt

SEQ ID NO: 25403 - DNA, 75 bp, Artificial Sequence
  Synthetic
aatgattgggttatttcagtatatggtatacgcgatgagttatatgagggttcgaagcaattgttgcaacagcac

SEQ ID NO: 25404 - DNA, 75 bp, Artificial Sequence
  Synthetic
tgtgattatatttgggtatatgcaattgatgctatgtcgttatttctattgtgttttaaggcgggcaaaaatcgt

SEQ ID NO: 25405 - DNA, 75 bp, Artificial Sequence
  Synthetic
accactgtacatagattactcatggctatgctagatgtgcaagagcagcaaattttgtctgagccaccaaaatta

SEQ ID NO: 25406 - DNA, 75 bp, Artificial Sequence
  Synthetic
agaagcacagtagcagctctgttttggtataaaggcagttttggttcaaaagcatatacacatggagcctatcca

SEQ ID NO: 25407 - DNA, 75 bp, Artificial Sequence
  Synthetic
caatggatagtgcaacaaacaatggtagggcatcaaacagcagaagcacataattttgaattgtcaacaatggtg

SEQ ID NO: 25408 - DNA, 75 bp, Artificial Sequence
  Synthetic
caatgggcctttgacaataacttaacagacgaagctgacatagcatataaatatgcaaatatggcttttgaagat

SEQ ID NO: 25409 - DNA, 75 bp, Artificial Sequence
  Synthetic
gtaaatgctgcggcgtggcttgcacataacaatcaagccagatttgttagagaatgtgcgtctatggtaagattt

SEQ ID NO: 25410 - DNA, 75 bp, Artificial Sequence
  Synthetic
tataaacgaggtcaaatgagagaaatgagtatatcagaatggatacatcataagataagtaatgtagaaggaact

SEQ ID NO: 25411 - DNA, 75 bp, Artificial Sequence
  Synthetic
ggacattggtcatcaattgtaaagtttattagataccaggaaataaattttatatgctttttagctgcattaaag

SEQ ID NO: 25412 - DNA, 75 bp, Artificial Sequence
  Synthetic
gattttttacatagcaagcctaaaagaaactgccttttaatatatggcccaccaaatacaggaaaatcagcattt

SEQ ID NO: 25413 - DNA, 75 bp, Artificial Sequence
  Synthetic
acaatgtcactaataaaagtactaggaggtagggtaatatcctttgttaactcaagaagtcaattctggctacag

SEQ ID NO: 25414 - DNA, 75 bp, Artificial Sequence
  Synthetic
cctctttcagagtgcaaaatagcactgctagacgatgctacagatccatgctggacatacatggacacatattta

SEQ ID NO: 25415 - DNA, 75 bp, Artificial Sequence
  Synthetic
agaaatggattagatggtcatatggtttccttagattgtaagcataaggcaccaatgcaaacaaaatttccaccc

SEQ ID NO: 25416 - DNA, 75 bp, Artificial Sequence
  Synthetic
atgctagtaacatcaaatataaatgtactagaagaggagaactatagatatctgcatagtagaattgtgggcttt

SEQ ID NO: 25417 - DNA, 75 bp, Artificial Sequence
  Synthetic
aaatttccaaacccctttccccttaaacccgataatacacctgaatttgagcttactgaccaaagctggaaatct

SEQ ID NO: 25418 - DNA, 75 bp, Artificial Sequence
  Synthetic
ttttttgaaaggctttggagtcaattagacctaagtgaccaagaagaagagggcagtgatggagaacctcagcga

SEQ ID NO: 25419 - DNA, 75 bp, Artificial Sequence
  Synthetic
gcgtttcaatgccttgcaagacgaactaatgaacatttatgaaagtgcaaaagagacactacaggctcagatcga

SEQ ID NO: 25420 - DNA, 75 bp, Artificial Sequence
  Synthetic
tcattggcagctattgcgtcaagaagcagtgatgatgtactatggtagaaagaaaggctacatgagattagggta

SEQ ID NO: 25421 - DNA, 75 bp, Artificial Sequence
  Synthetic
tcagcccctgccaccacttgcagtgtcagagcacaaagcaaaagaagcaattgccatggtgctgcatttgcaatc

SEQ ID NO: 25422 - DNA, 75 bp, Artificial Sequence
  Synthetic
attgcagcattccccattttcagaggaaaagtggacattaatggatgcaagtgcagagacatttagaaatgcgcc

SEQ ID NO: 25423 - DNA, 75 bp, Artificial Sequence
  Synthetic
agagggttattttaaaaaaggagcgacaaatgtggaagttatttatgataataatgaggagaatgcaaatttgta

SEQ ID NO: 25424 - DNA, 75 bp, Artificial Sequence
  Synthetic
cacgttatggaaatatgtatattacctggatggagatgatatgtggcagaaaaccaccagtgaagtaaaccacac

SEQ ID NO: 25425 - DNA, 75 bp, Artificial Sequence
  Synthetic
aggcatttattttgtggaaggggactataggcactattatgtgagatttgcggatgatgctgctagatatagcac

SEQ ID NO: 25426 - DNA, 75 bp, Artificial Sequence
  Synthetic
atcaggactgtgggaagtaagaattaataaggacactgtatttacccctgtcactagctccacaccgcccgacac

SEQ ID NO: 25427 - DNA, 75 bp, Artificial Sequence
  Synthetic
agcgggaggacgacaagaagaggaaggaccaagagtctgggccgattcggcagccacccttgccgtctccagact

SEQ ID NO: 25428 - DNA, 75 bp, Artificial Sequence
  Synthetic
tcaacagccacaacaatcatccgaagccaacaccagggaaagaggaccagacaatactgaaccaaccaccactgc

SEQ ID NO: 25429 - DNA, 75 bp, Artificial Sequence
  Synthetic
cgtcaccagacgttccggagcagaaaccagaaaaagaaggtacggaagaaaagcctccagccccaccagcaccgc

SEQ ID NO: 25430 - DNA, 75 bp, Artificial Sequence
  Synthetic
ctcacgaaggaaacgacgtagagcgtccccccaacaaaaggaacaggggcaacgggctaggtccaaaacccgcgc

SEQ ID NO: 25431 - DNA, 75 bp, Artificial Sequence
  Synthetic
ccaaacccaagctgaaagcagattccgatcgaggtccaggtcccgatccagatccagatcacgatcccacacccc

SEQ ID NO: 25432 - DNA, 75 bp, Artificial Sequence
  Synthetic
ccaaacccgatcccgagcgagttcctccaccaggggcagagggcggagatccgcctccgatacctccagaagggg

SEQ ID NO: 25433 - DNA, 75 bp, Artificial Sequence
  Synthetic
gagagggcgagggagaggtagaaggccatccgcctccccctcctccaccacctcctccgcctcctacaggagaag

SEQ ID NO: 25434 - DNA, 75 bp, Artificial Sequence
  Synthetic
gtcagagtcttctagggacggtggcatctctcctagagacgtgggaagtgcagttcagacagttagtggacgaaa

SEQ ID NO: 25435 - DNA, 75 bp, Artificial Sequence
  Synthetic
tacaggacgacttggaagattactggcggaggctgtcgatcccccagtaatacttgtcaggggggatgctaacac

SEQ ID NO: 25436 - DNA, 75 bp, Artificial Sequence
  Synthetic
tttgaaatgctttagaaatagggctaagcagcggtattggggtctctataaatcatttagtaccacgtggtcctg

SEQ ID NO: 25437 - DNA, 75 bp, Artificial Sequence
  Synthetic
ggttgcaggcgatggcacagagcgtctaggcaggtccagaatgctcatcagttttctgagcacaacacagagaag

SEQ ID NO: 25438 - DNA, 75 bp, Artificial Sequence
  Synthetic
ccattttgagaagactgttcgttatccacgtggtgttgattggtcatacggaagttttgatagtttataaatttt

SEQ ID NO: 25439 - DNA, 75 bp, Artificial Sequence
  Synthetic
gttgcatgatttacactgcttcgctttagctgcatggctgcacactaatttttataactacgcttttttacattt

SEQ ID NO: 25440 - DNA, 75 bp, Artificial Sequence
  Synthetic
ttgtacggctgcatggcacgacccaagagggtaaagcgcgactctgcaagtaatatttacagaacctgcaagcag

SEQ ID NO: 25441 - DNA, 75 bp, Artificial Sequence
  Synthetic
gcaggcacatgccctcctgatgtaattaataaaattgagcaaacaacagttgctgacaatattttgaaatatggc

SEQ ID NO: 25442 - DNA, 75 bp, Artificial Sequence
  Synthetic
agtgctggtgtgttttttggaggcctgggcattagtacgggccgaggaactggtggttccacagggtatgttcct

SEQ ID NO: 25443 - DNA, 75 bp, Artificial Sequence
  Synthetic
ttgggggaaggcaccagtatccgtgtgggcggcactcctgcgattgttcgaccctcattgattccggatgccata

SEQ ID NO: 25444 - DNA, 75 bp, Artificial Sequence
  Synthetic
ggaccctctgatattattcctgtggacacaataaatcctgtagagcctggtgcctcatctgttgtccctctggtg

SEQ ID NO: 25445 - DNA, 75 bp, Artificial Sequence
  Synthetic
gaaacatctggtacagatttgcttccaggtgagattgaaacaatagctgaaatcaatcctgttcctggcgcaact

SEQ ID NO: 25446 - DNA, 75 bp, Artificial Sequence
  Synthetic
cccacagactccccagttgtcacatccagcattggctccagtgccgtgcttgaagtcgctcctgagcctacgcct

SEQ ID NO: 25447 - DNA, 75 bp, Artificial Sequence
  Synthetic
cctacacgtgttagggttagtcgtacccaatatcataacccctcttttcagatcataacagaatctacaccttcc

SEQ ID NO: 25448 - DNA, 75 bp, Artificial Sequence
  Synthetic
cagggggaaagctctcttgcagatcaaatagtggttgccgttggttcaggtgggcaaaccattggaggtgctgtt

SEQ ID NO: 25449 - DNA, 75 bp, Artificial Sequence
  Synthetic
tctacgtctgaggttattgaactagatacttttcctactaggtactcttttgaaattgaggagcccactcctcca

SEQ ID NO: 25450 - DNA, 75 bp, Artificial Sequence
  Synthetic
cgttctgctagcacacctattcagcaacgggtgcaacaggctgctagacgggttcgtggagctttaactaacagg

SEQ ID NO: 25451 - DNA, 75 bp, Artificial Sequence
  Synthetic
cgcctgttacagcaggttcaggttgaaaatccactatttttaagccggccctctaggcttgtaaggtttcagttt

SEQ ID NO: 25452 - DNA, 75 bp, Artificial Sequence
  Synthetic
gataaccctgcttttgaagaggaggtaacacaaatatttgaacgtgacattacttccatagaggaacctcctgac

SEQ ID NO: 25453 - DNA, 75 bp, Artificial Sequence
  Synthetic
cgtgatttcttagatgtcgctaggctaggaagaccacagtactctactacacctgctggctatgttagggttagt

SEQ ID NO: 25454 - DNA, 75 bp, Artificial Sequence
  Synthetic
cgtgtgggtcaacgggccaccatccgaacacgttctggcgcacaaataggctctcaggtacatttttatagagat

SEQ ID NO: 25455 - DNA, 75 bp, Artificial Sequence
  Synthetic
ctcagtagcatatctgccgaagatcctattgaattagaactgctaggtcagcattcaggggatgcttccattgtt

SEQ ID NO: 25456 - DNA, 75 bp, Artificial Sequence
  Synthetic
cagggccctgtagaaagcacttttgttaatatagatttaggggaaaacccgctctctgaaagtattgaggcctac

SEQ ID NO: 25457 - DNA, 75 bp, Artificial Sequence
  Synthetic
tctgatgatttccttctagatgaggcagtggaggattttagtgggtcccaattagtaataggtaataggcgtaca

SEQ ID NO: 25458 - DNA, 75 bp, Artificial Sequence
  Synthetic
acagcttcttatactgttcctcggttcgagtccccccgtagcttgtcatattatacacaggatacacaggggtat

SEQ ID NO: 25459 - DNA, 75 bp, Artificial Sequence
  Synthetic
tatgttgcatatccgcaggatacatccacctcccaagatattatttatcctactccacaagtcccaattgtagtt

SEQ ID NO: 25460 - DNA, 75 bp, Artificial Sequence
  Synthetic
attcacccgcatgataattctggggatttctatttacatcctagcctaacacggcgcctgcgacgcaaacgtaaa

SEQ ID NO: 25461 - DNA, 75 bp, Artificial Sequence
  Synthetic
tatttgtgatttttgcagatggcagtgtggttaccagctagcggtaaggtgtatttgcctccatcaacgccagtt

SEQ ID NO: 25462 - DNA, 75 bp, Artificial Sequence
  Synthetic
gccagggtccagagcaccgatgaatatgttgaaaggacaaacatctattatcatgcctatagtgatcgactctta

SEQ ID NO: 25463 - DNA, 75 bp, Artificial Sequence
  Synthetic
actgtaggccacccatactttactgtatatagtaatgacggctccaaagttgaggtgcctaaggtttcaggcaat

SEQ ID NO: 25464 - DNA, 75 bp, Artificial Sequence
  Synthetic
caacacagggttttcagacttcgattacctgatccaaatcgctttgctttagctgacatgtcagtctataatcct

SEQ ID NO: 25465 - DNA, 75 bp, Artificial Sequence
  Synthetic
gataaggagcgcttagtatgggcctgcagaggcctggaaattggacggggtcagcctcttggggttgggagttct

SEQ ID NO: 25466 - DNA, 75 bp, Artificial Sequence
  Synthetic
gggcatcctttgttcaataagttaggggatactgaaaaccctaataattataggcagccatcatctgacgatagg

SEQ ID NO: 25467 - DNA, 75 bp, Artificial Sequence
  Synthetic
caaaacgtttcttttgatccaaaacaactccaaatgtttgttattggctgtgccccctgcatcggtgagcattgg

SEQ ID NO: 25468 - DNA, 75 bp, Artificial Sequence
  Synthetic
gatagggctatagcttgtgcaggagatgaaaaacagggctcctgccctcccattgaattaaaaaatacatatatt

SEQ ID NO: 25469 - DNA, 75 bp, Artificial Sequence
  Synthetic
gaggatggggatatggctgatataggttatggaaacctaaacttccaaactttacagcaaagtagggctgatgtt

SEQ ID NO: 25470 - DNA, 75 bp, Artificial Sequence
  Synthetic
agcctagatatagtacacgaaacatgcaaatatcctgatttcttaaagatgcagaacgatgtttatggcgactcc

SEQ ID NO: 25471 - DNA, 75 bp, Artificial Sequence
  Synthetic
tgctttttttatgcacggagagaacagtgttatgcaagacatttttttgttagaggaggaaaggttggtgacgat

SEQ ID NO: 25472 - DNA, 75 bp, Artificial Sequence
  Synthetic
atacctgcaggtcagatagatgatggcaaccttaaaaatgccttttatatccctgcggccaataaccagggtcaa

SEQ ID NO: 25473 - DNA, 75 bp, Artificial Sequence
  Synthetic
tacactattggcaattccatgtatttcccaactgtcagtggctcattggtatccactgatgcacaactgtttaac

SEQ ID NO: 25474 - DNA, 75 bp, Artificial Sequence
  Synthetic
agacctttctggttgcaacgcgctcagggtcataataatggcatctgctgggccaatcaattatttctcacggtt

SEQ ID NO: 25475 - DNA, 75 bp, Artificial Sequence
  Synthetic
gttgacaacaccaggaacacaaattttagtatatctgtttacaatgatgcaggggaaattaaggatattcaaagt

SEQ ID NO: 25476 - DNA, 75 bp, Artificial Sequence
  Synthetic
tatgatcccaacaagtttcgggaataccaacgacatgtggaggaatatgaaatatcattgattttgcagctttgt

SEQ ID NO: 25477 - DNA, 75 bp, Artificial Sequence
  Synthetic
aaaattcctttaactgctgaggttttagcacagattaatgcaatgaatcctgcattattggaggattggcagtta

SEQ ID NO: 25478 - DNA, 75 bp, Artificial Sequence
  Synthetic
ggttttgtacctgctccagacaaccctattcatgatacctatagatatttagattccttggcaacacgatgcccc

SEQ ID NO: 25479 - DNA, 75 bp, Artificial Sequence
  Synthetic
gataaaacccctgcaaaggagaaggaagatccctatggtaaatatactttttgggaggttgatttaacagaacgg

SEQ ID NO: 25480 - DNA, 75 bp, Artificial Sequence
  Synthetic
ttgtctcttgatttggatcagtattctcttggaagaaagttcttatttcaggcagggctgcagcaacgcaaaaat

SEQ ID NO: 25481 - DNA, 75 bp, Artificial Sequence
  Synthetic
accaaatctggtacagtgtctgctgtttctaagggaactaaacgtaaaagaaaataatgtgaccgttttcggtaa

SEQ ID NO: 25482 - DNA, 75 bp, Artificial Sequence
  Synthetic
taaaatatcttttggcattcttgtgtgttgattctctgtgactaacatggactttgctcgaatatgtgaccgcac

SEQ ID NO: 25483 - DNA, 75 bp, Artificial Sequence
  Synthetic
ccggttaatcatattttaaaagacccaaaggagacgcgttccaacctttgtcggtcttaacacgttcggaatcgg

SEQ ID NO: 25484 - DNA, 75 bp, Artificial Sequence
  Synthetic
tctgcttcctcttggcacggcattttggcgcgaaaacactggcagccagtcaacaccgttaacggtaattgtacc

SEQ ID NO: 25485 - DNA, 75 bp, Artificial Sequence
  Synthetic
aggtgcgtatactttgtaccgccaaggtacatatattattcatcactctaatggttgttgccaacaaccattgtc

SEQ ID NO: 25486 - DNA, 75 bp, Artificial Sequence
  Synthetic
tattatacatgtgtctgcttgtaacgttttagttgcagtttatatatatatatatatgtacgtatgtactgtgaa

SEQ ID NO: 25487 - DNA, 75 bp, Artificial Sequence
  Synthetic
tctgcttgtaacgttttagttgcagtttatatatatatatatatgtacgtatgtactgtgaacatagtgttctag

SEQ ID NO: 25488 - DNA, 75 bp, Artificial Sequence
  Synthetic
aacggtaagttgcaatttccttgtaccaggtgcggtattgggatttcacaattataatggttgttgccaactacc

SEQ ID NO: 25489 - DNA, 75 bp, Artificial Sequence
  Synthetic
ataggcatattcaagtttttgcctgtatcgttttcgtatcctgtaataatatccaatatatgtatacataaataa

SEQ ID NO: 25490 - DNA, 75 bp, Artificial Sequence
  Synthetic
atatatatatatataagtgtctaagattgggttcttctgtaatcaggcaatggctgagggagccgaacaccaaca

SEQ ID NO: 25491 - DNA, 75 bp, Artificial Sequence
  Synthetic
attgggttcttctgtaatcaggcaatggctgagggagccgaacaccaacagaaactgacagaaaaagataaggca

SEQ ID NO: 25492 - DNA, 75 bp, Artificial Sequence
  Synthetic
gaaactgacagaaaaagataaggcagaattacctttaagtattagagacttagctgaagccttaggcatccctgt

SEQ ID NO: 25493 - DNA, 75 bp, Artificial Sequence
  Synthetic
gattgattgtttaataccttgcaatttctgtggcaactttctaaattatttggaagcttgtgaattcgactacaa

SEQ ID NO: 25494 - DNA, 75 bp, Artificial Sequence
  Synthetic
aaggcttagtctaatttggaaagattattgtgtgtttgcgtgctgtcgcgtatgctgtggcgccactgcaactta

SEQ ID NO: 25495 - DNA, 75 bp, Artificial Sequence
  Synthetic
tgaatttaaccaattttatgagcagacagtgttaggaagagatattgaattagcttcaggactttcaatatttga

SEQ ID NO: 25496 - DNA, 75 bp, Artificial Sequence
  Synthetic
tattgatatcaggtgtcaaacttgcttagcatttcttgacattatagaaaagttagattgctgtggcagaggcct

SEQ ID NO: 25497 - DNA, 75 bp, Artificial Sequence
  Synthetic
tccctttcataaggtgaggaacgcctggaagggaatctgtaggcagtgtaagcatttttatcatgattggtaaag

SEQ ID NO: 25498 - DNA, 75 bp, Artificial Sequence
  Synthetic
aggtcaccgtgcaagatattattctggagctcagtgaggtgcagcccgaagtgctaccagttgacctgttttgtg

SEQ ID NO: 25499 - DNA, 75 bp, Artificial Sequence
  Synthetic
aagaggaattaccaaacgagcaggaaacggaggaggagcctgacaacgaaaggatctcttacaaagttatagctc

SEQ ID NO: 25500 - DNA, 75 bp, Artificial Sequence
  Synthetic
caagcttcgcatttttgtccacgccacagaatttggtattagagctttccaacagctactgaccggagatctgca

SEQ ID NO: 25501 - DNA, 75 bp, Artificial Sequence
  Synthetic
acagaatttggtattagagctttccaacagctactgaccggagatctgcagctcctgtgccctgactgtcgcgga

SEQ ID NO: 25502 - DNA, 75 bp, Artificial Sequence
  Synthetic
aactgcaaacatgacggatcctaattctaaaggtagtacatctaaagaagggtttggtgattggtgtttattgga

SEQ ID NO: 25503 - DNA, 75 bp, Artificial Sequence
  Synthetic
agctgactgtagtgatgtagaaaatgatttgggacaattatttgagagagatacagactctgatatatcggattt

SEQ ID NO: 25504 - DNA, 75 bp, Artificial Sequence
  Synthetic
atacagactctgatatatcggatttgttagatgatactgaactggagcagggcaattccctggaactatttcatc

SEQ ID NO: 25505 - DNA, 75 bp, Artificial Sequence
  Synthetic
agcttagtccgcgacttgagtcaatttcattgtcaccccagcagaagtctaagcgaaggctctttgcagagcagg

SEQ ID NO: 25506 - DNA, 75 bp, Artificial Sequence
  Synthetic
acagcggactcgagctgactttaaacaatgaagctgaagatgttactcctgaggtggaggtaccggctattgact

SEQ ID NO: 25507 - DNA, 75 bp, Artificial Sequence
  Synthetic
aggggacgtagatatacattacactgcattgttgcgttctagcaacaaaaaagctacattaatggctaagtttaa

SEQ ID NO: 25508 - DNA, 75 bp, Artificial Sequence
  Synthetic
agagtcgtttggagtaggttttaatgaattgacacggcaattcaaaagccacaaaacctgctgtaaggactgggt

SEQ ID NO: 25509 - DNA, 75 bp, Artificial Sequence
  Synthetic
acaaaacctgctgtaaggactgggttgtctctgtatatgcagtgcatgatgatctatttgaaagctcaaagcagc

SEQ ID NO: 25510 - DNA, 75 bp, Artificial Sequence
  Synthetic
tattgcaacagcattgtgactatatctgggtccgtgggataggtgcaatgtcattatacctattgtgttttaagg

SEQ ID NO: 25511 - DNA, 75 bp, Artificial Sequence
  Synthetic
cgggaaaaaatcgcgggacagttcataagttaattacctcaatgttaaatgtgcatgaacagcaaatattgtctg

SEQ ID NO: 25512 - DNA, 75 bp, Artificial Sequence
  Synthetic
taagttaattacctcaatgttaaatgtgcatgaacagcaaatattgtctgagccgccaaaattgagaaatacagc

SEQ ID NO: 25513 - DNA, 75 bp, Artificial Sequence
  Synthetic
gtgcatgaacagcaaatattgtctgagccgccaaaattgagaaatacagccgctgcattgttctggtataagggt

SEQ ID NO: 25514 - DNA, 75 bp, Artificial Sequence
  Synthetic
tgtatgggatcgggggcgtttagccatggaccatatcctgattggattgcccaacaaactatattaggtcacaaa

SEQ ID NO: 25515 - DNA, 75 bp, Artificial Sequence
  Synthetic
agtgctgaggcaagtacttttgatttttcagcaatggtccaatgggcatttcataatcacttattagacgaagca

SEQ ID NO: 25516 - DNA, 75 bp, Artificial Sequence
  Synthetic
gatatagcataccagtatgcaaggcttgctcccgaagacgcgaatgcagtagcttggcttgcacataacaaccag

SEQ ID NO: 25517 - DNA, 75 bp, Artificial Sequence
  Synthetic
gccaaatttgtgagagaatgtgcatatatggtacgattttataagaagggacaaatgagagacatgagtatatct

SEQ ID NO: 25518 - DNA, 75 bp, Artificial Sequence
  Synthetic
atatggtacgattttataagaagggacaaatgagagacatgagtatatctgaatggatatacactaaaatcaatg

SEQ ID NO: 25519 - DNA, 75 bp, Artificial Sequence
  Synthetic
aagtagaaggggaagggcactggtcagatatagtaaagtttattagataccaaaatataaactttattgtattcc

SEQ ID NO: 25520 - DNA, 75 bp, Artificial Sequence
  Synthetic
caaaatataaactttattgtattcctaactgcattaaaagaattcctacactcagtgccaaaaaaaaattgcatt

SEQ ID NO: 25521 - DNA, 75 bp, Artificial Sequence
  Synthetic
ttaatttatggtcctccaaattctggaaagtcatcatttgcaatgtcattaataagagtgttgaagggtagagtg

SEQ ID NO: 25522 - DNA, 75 bp, Artificial Sequence
  Synthetic
ttgtcatttgtaaattctaaaagtcagttttggctgcaacccctttcagagtgcaagatagctctattggatgat

SEQ ID NO: 25523 - DNA, 75 bp, Artificial Sequence
  Synthetic
gtaacagacccttgttggatatacatggatacatatttaagaaatggcttggatggacattatgtttcattagat

SEQ ID NO: 25524 - DNA, 75 bp, Artificial Sequence
  Synthetic
ggatggacattatgtttcattagattgtaaatatagagccccaacgcaaatgaaatttcccccattattattaac

SEQ ID NO: 25525 - DNA, 75 bp, Artificial Sequence
  Synthetic
tgaaatttcccccattattattaacatctaacattaatgtgcatggggaaactaattatagatatttacacacta

SEQ ID NO: 25526 - DNA, 75 bp, Artificial Sequence
  Synthetic
tccttttcctatgaaagcagataatacacctcagttcgaactaactgaccaaagctggaaatctttttttacaag

SEQ ID NO: 25527 - DNA, 75 bp, Artificial Sequence
  Synthetic
gctttggacacaattagacctgagtgatcaagaagaggagggcgaggatggagaatctcagcgagcgtttcaatg

SEQ ID NO: 25528 - DNA, 75 bp, Artificial Sequence
  Synthetic
ctctgcaagatcagctaatgaacatttatgaagctgcagaacaaacattgcaggcacaaattaaacattggcaaa

SEQ ID NO: 25529 - DNA, 75 bp, Artificial Sequence
  Synthetic
ctactatgctagggagaaaggtgttacaaggcttggatatcaacctgtgcctgtaaaggcagtatcagaaacaaa

SEQ ID NO: 25530 - DNA, 75 bp, Artificial Sequence
  Synthetic
ggctaaagaagccatagcaatggtgctgcagcttgagtcactacagacatctgattttgctcatgagccatggac

SEQ ID NO: 25531 - DNA, 75 bp, Artificial Sequence
  Synthetic
agttatttatgacaatgatccagataatgccaatttgtatacaatgtggacctatgtgtattatatggatgcgga

SEQ ID NO: 25532 - DNA, 75 bp, Artificial Sequence
  Synthetic
tgataagtggcataaggcaagaagtggggtgaatcacattggcatttattatttacaaggaacttttaaaaacta

SEQ ID NO: 25533 - DNA, 75 bp, Artificial Sequence
  Synthetic
ggggtgaatcacattggcatttattatttacaaggaacttttaaaaactattatgtactgtttgctgacgatgcg

SEQ ID NO: 25534 - DNA, 75 bp, Artificial Sequence
  Synthetic
atttacaaggaacttttaaaaactattatgtactgtttgctgacgatgcgaaaagatatggtacaactggagaat

SEQ ID NO: 25535 - DNA, 75 bp, Artificial Sequence
  Synthetic
tgtgtttgctcctgtcaccagctccacgcctccagggtcgccaggaggacaagcagacacaaacaccacccccgc

SEQ ID NO: 25536 - DNA, 75 bp, Artificial Sequence
  Synthetic
gacccccaccacctccacaaccgccgttgactccacgtccagacagctcaccacatcaaaacagccacaacaaac

SEQ ID NO: 25537 - DNA, 75 bp, Artificial Sequence
  Synthetic
cgaaaccagaggaagaaggtacggacggaggccctccagcaagtcaaggagatcgcaaacgcagcaaaggcgatc

SEQ ID NO: 25538 - DNA, 75 bp, Artificial Sequence
  Synthetic
gatcgcaaacgcagcaaaggcgatcaaggtcccgacaccggtcccggtctcggtcccggtcgcggtccaagtccc

SEQ ID NO: 25539 - DNA, 75 bp, Artificial Sequence
  Synthetic
aaacccacaccactcggtccaccaccaggtcccggtccacgtcgctcaccaagactcgggcccttacaagcagat

SEQ ID NO: 25540 - DNA, 75 bp, Artificial Sequence
  Synthetic
aagactcgggcccttacaagcagatcgcgatccagaggaaggtccccaaccacctgcagaaggggaggtggaagg

SEQ ID NO: 25541 - DNA, 75 bp, Artificial Sequence
  Synthetic
tcacccaggcggcgatcaaggtcaccctccacctcctcctcctgcaccacacaacggtcacagcgggcacgagcc

SEQ ID NO: 25542 - DNA, 75 bp, Artificial Sequence
  Synthetic
gaaagttcaacaaccagaggggcccgagggtcgagagggtcacgaggagggagccgtggggggagagggcggcga

SEQ ID NO: 25543 - DNA, 75 bp, Artificial Sequence
  Synthetic
cgaggaaggtcatcctcctcctcctcccccgcccacaaacggtcacgaggggggtctgctaagctccgtggcgtc

SEQ ID NO: 25544 - DNA, 75 bp, Artificial Sequence
  Synthetic
tctcctggtgaagtgggagggtcacttcgatcagttagttcaaagcatacaggacgacttggaagattactggaa

SEQ ID NO: 25545 - DNA, 75 bp, Artificial Sequence
  Synthetic
aggacgacttggaagattactggaagaagctcgcgaccccccagtaatcattgtcaaaggggcggctaacacact

SEQ ID NO: 25546 - DNA, 75 bp, Artificial Sequence
  Synthetic
gaagctcgcgaccccccagtaatcattgtcaaaggggcggctaacacactgaaaaatgtccgcaacagagctaaa

SEQ ID NO: 25547 - DNA, 75 bp, Artificial Sequence
  Synthetic
attaaatacatgggactgtttaggtcatttagtactacctggtcatgggtggcaggagatggcactgagcgtcta

SEQ ID NO: 25548 - DNA, 75 bp, Artificial Sequence
  Synthetic
ggcaggagatggcactgagcgtctaggcaggcccagaatgctcattagcttttcttcctatactcaaaggagaga

SEQ ID NO: 25549 - DNA, 75 bp, Artificial Sequence
  Synthetic
ttttgatgaagcggtgcgataccccaaaggagttgataaggcctatggcaacctggacagtctttaacatttact

SEQ ID NO: 25550 - DNA, 75 bp, Artificial Sequence
  Synthetic
acctggacagtctttaacatttactaatgctgcttttgctactaacatactaacataccctagcattttatattt

SEQ ID NO: 25551 - DNA, 75 bp, Artificial Sequence
  Synthetic
ctgcaaacaggcaggcacttgcccccctgatgttattaataaagtggaacaaacaacagttgctgacaatatttt

SEQ ID NO: 25552 - DNA, 75 bp, Artificial Sequence
  Synthetic
aaaatatggcagtgctggtgtattttttggtggccttggtattagtacaggccgaggaactgggggtgctacagg

SEQ ID NO: 25553 - DNA, 75 bp, Artificial Sequence
  Synthetic
gtacgtgccacttggggaaggtcctggtgtccgtgtcggaggaacccccacggttgtaaggccttccttggttcc

SEQ ID NO: 25554 - DNA, 75 bp, Artificial Sequence
  Synthetic
tgaaacaatcgggcccgttgatattttgcccattgatacagttaaccccgtggaacctacagcatcatccgtggt

SEQ ID NO: 25555 - DNA, 75 bp, Artificial Sequence
  Synthetic
ccctctaactgagtccacaggcgctgatttacttccaggtgaagtagaaacaattgctgaaatccatcctgtacc

SEQ ID NO: 25556 - DNA, 75 bp, Artificial Sequence
  Synthetic
tgaggggccatcagtggatacccctgtagttaccactagcacaggttccagtgctgttttagaggttgccccaga

SEQ ID NO: 25557 - DNA, 75 bp, Artificial Sequence
  Synthetic
gcctattcctccaacacgggtcagggtttcacgcacacagtatcacaatccatcttttcaaataataactgagtc

SEQ ID NO: 25558 - DNA, 75 bp, Artificial Sequence
  Synthetic
tactccagcacaaggggaatcgtctcttgcagatcacgttttggtgacatcgggttctggggggcaacgaatagg

SEQ ID NO: 25559 - DNA, 75 bp, Artificial Sequence
  Synthetic
cttgcagatcacgttttggtgacatcgggttctggggggcaacgaatagggggtgatataactgacataattgag

SEQ ID NO: 25560 - DNA, 75 bp, Artificial Sequence
  Synthetic
ttagaggaaattcctagtaggtatacatttgaaattgaagaaccaactcctccacgccgcagcagtactccattg

SEQ ID NO: 25561 - DNA, 75 bp, Artificial Sequence
  Synthetic
ccacgcaatcaatctgtaggccgtaggaggggtttctctttgactaatagacgtttagtacagcaggtacaagtg

SEQ ID NO: 25562 - DNA, 75 bp, Artificial Sequence
  Synthetic
gacaatccattgtttctaactcaaccatctaagttagttcgttttgcatttgataatcctgtttttgaggaagaa

SEQ ID NO: 25563 - DNA, 75 bp, Artificial Sequence
  Synthetic
gtgactaatatatttgaaaatgatctggatgtctttgaagaacctccagacagagattttcttgatgttagggaa

SEQ ID NO: 25564 - DNA, 75 bp, Artificial Sequence
  Synthetic
ttgggacgtccacaatattctacaacaccagcgggatatgttagagtaagcaggttggggactcgagccactatt

SEQ ID NO: 25565 - DNA, 75 bp, Artificial Sequence
  Synthetic
caccagcgggatatgttagagtaagcaggttggggactcgagccactattcgcactcgctctggtgcacagatag

SEQ ID NO: 25566 - DNA, 75 bp, Artificial Sequence
  Synthetic
ggtcgcaagtccatttttacagagatcttagctctattaatactgaagatcctattgaattacaattattaggcc

SEQ ID NO: 25567 - DNA, 75 bp, Artificial Sequence
  Synthetic
cattatctgaaagcattgaagcatattcacatgatttattattagatgaaacggtggaagatttcagtgggtctc

SEQ ID NO: 25568 - DNA, 75 bp, Artificial Sequence
  Synthetic
agctggttataggtaatcgaaggagcacaaactcttacactgttcctaggtttgaaactacaagaaatggttcat

SEQ ID NO: 25569 - DNA, 75 bp, Artificial Sequence
  Synthetic
actatacacaagacacaaagggatattatgttgcatatccagagtcacgtaataatgcagaaatcatttatccta

SEQ ID NO: 25570 - DNA, 75 bp, Artificial Sequence
  Synthetic
cacctgatattcctgtagtcattatacaccctcatgacagtacaggggacttttatttacatcccagtcttcaca

SEQ ID NO: 25571 - DNA, 75 bp, Artificial Sequence
  Synthetic
ttttatttacatcccagtcttcacaggcgcaaacgtaaaagaaaatatttgtgatttgcattcgagatggcagtg

SEQ ID NO: 25572 - DNA, 75 bp, Artificial Sequence
  Synthetic
tggcactcggctaatggtaaagtatatcttccaccatcgacaccggtggccagagtccaaagcaccgatgaatac

SEQ ID NO: 25573 - DNA, 75 bp, Artificial Sequence
  Synthetic
attcaaagaacaaatatctactatcatgcatttagtgacagattgttaactgtaggtcatccttatttcaatgta

SEQ ID NO: 25574 - DNA, 75 bp, Artificial Sequence
  Synthetic
tgtaggtcatccttatttcaatgtatacaatattaatggtgataagcttgaggttcctaaggtttcaggaaatca

SEQ ID NO: 25575 - DNA, 75 bp, Artificial Sequence
  Synthetic
ctgatatgtctgtttacaaccctgacaaagaacgtttggtttgggcctgtagaggcttagaaataggtaggggcc

SEQ ID NO: 25576 - DNA, 75 bp, Artificial Sequence
  Synthetic
caaagaacgtttggtttgggcctgtagaggcttagaaataggtaggggccagccattaggtgtacggagtactgg

SEQ ID NO: 25577 - DNA, 75 bp, Artificial Sequence
  Synthetic
tcacccttatttcaataaagtaaaagatacagaaaacagtaatgcatacataacattttctaaagatgacagaca

SEQ ID NO: 25578 - DNA, 75 bp, Artificial Sequence
  Synthetic
ggatacatcttttgatcctaaacagatccaaatgtttattgtaggatgcacaccttgcataggagagcattggga

SEQ ID NO: 25579 - DNA, 75 bp, Artificial Sequence
  Synthetic
taaagctgttccatgtgcagaaaatgatcagcaaactggcctttgtcctcctattgaactaaaaaacacatatat

SEQ ID NO: 25580 - DNA, 75 bp, Artificial Sequence
  Synthetic
acaagatggtgatatggcagacataggttttgggaacatgaattttaaggcacttcaagatagtagatcagatgt

SEQ ID NO: 25581 - DNA, 75 bp, Artificial Sequence
  Synthetic
cagtttagacatcgtcaatgaaacttgcaagtatccagattttttaaagatgcaaaacgatatttatggcgatgc

SEQ ID NO: 25582 - DNA, 75 bp, Artificial Sequence
  Synthetic
gtgctttttttatgctcgtagggagcaatgttatgccagacacttttttgttagagggggaaaaactggtgatga

SEQ ID NO: 25583 - DNA, 75 bp, Artificial Sequence
  Synthetic
caatgttatgccagacacttttttgttagagggggaaaaactggtgatgacattccacgtgcacaaattgacaat

SEQ ID NO: 25584 - DNA, 75 bp, Artificial Sequence
  Synthetic
ggtacatacaaaaatcagttttacattccaggggctgatggccaagctcaaaagactataggaaattccatgtat

SEQ ID NO: 25585 - DNA, 75 bp, Artificial Sequence
  Synthetic
ttcccaactgttagtggctcattagtatccagtgatgctcaattgtttaacaggcccttctggctccaaagagcc

SEQ ID NO: 25586 - DNA, 75 bp, Artificial Sequence
  Synthetic
caaggtcataataatggcatcctgtgggctaatcaaatgtttatcacagtggttgacaacacaagaaatactaat

SEQ ID NO: 25587 - DNA, 75 bp, Artificial Sequence
  Synthetic
ttcagtatttctgtatataatcaggctggagcactaaaagatgttgcagactataatgcagatcaatttagagaa

SEQ ID NO: 25588 - DNA, 75 bp, Artificial Sequence
  Synthetic
tatcaaagacatgtagaagaatatgaaatatctttaattctacaactctgtaaggttcctttaaaggcacaggta

SEQ ID NO: 25589 - DNA, 75 bp, Artificial Sequence
  Synthetic
ttggcacagatcaatgcaatgaactcttcgttattggaggattggcagttaggatttgttcccactcctgataat

SEQ ID NO: 25590 - DNA, 75 bp, Artificial Sequence
  Synthetic
ccaattcaggacacctacagatatattgactctttggctacacggtgtccagataagaatcctccgaaagaaaag

SEQ ID NO: 25591 - DNA, 75 bp, Artificial Sequence
  Synthetic
gaagacccttataagggcttacatttttgggatgtagatttaactgaaagattgtcattagatttagatcaatat

SEQ ID NO: 25592 - DNA, 75 bp, Artificial Sequence
  Synthetic
tttgggatgtagatttaactgaaagattgtcattagatttagatcaatattccttaggcagaaaatttttattcc

SEQ ID NO: 25593 - DNA, 75 bp, Artificial Sequence
  Synthetic
attgtcattagatttagatcaatattccttaggcagaaaatttttattccaagctgggttacaacaaacgaccgt

SEQ ID NO: 25594 - DNA, 75 bp, Artificial Sequence
  Synthetic
gcaaacgtaaaaattgaggtctgaccgaaagtggtacatttttataaacttttacacagtattcaaggaatgttt

SEQ ID NO: 25595 - DNA, 75 bp, Artificial Sequence
  Synthetic
gtttactctgactaagtataagtcttccaaggataccgaccgcacccggtacactcagtcaagttgttgccaata

SEQ ID NO: 25596 - DNA, 75 bp, Artificial Sequence
  Synthetic
tagaatcagatcagtgccaaacacaccgtcttggactcagaacagaccgtgttcgttataacatgctcggattag

SEQ ID NO: 25597 - DNA, 75 bp, Artificial Sequence
  Synthetic
ttagggacctccccaaagaagatttaatctacaatcgcttttggcaatcgcatttggcactgctaaaagaccgtt

SEQ ID NO: 25598 - DNA, 75 bp, Artificial Sequence
  Synthetic
ggtaagtttattgatacgggcgcggttagaagttactcattcggtgcttgttgttgccaacaatcagcgttatga

SEQ ID NO: 25599 - DNA, 75 bp, Artificial Sequence
  Synthetic
acttgtttctgcctgtatcggtatcgacacaggtattatatatatatatatatatatatatatatatatatatat

SEQ ID NO: 25600 - DNA, 75 bp, Artificial Sequence
  Synthetic
atatatatatatatatacacacacagatacattttgcagctgcaaacttatggctaacgcacaggctacagaaga

SEQ ID NO: 25601 - DNA, 75 bp, Artificial Sequence
  Synthetic
agagatagaaattgtagaagagggaactactgcaccacaggtcacagagccaccattaccagcaacaattgctgg

SEQ ID NO: 25602 - DNA, 75 bp, Artificial Sequence
  Synthetic
attagcagcattgctagaaataccgttggatgactgtttagtgccttgtaatttctgtggcaagtttttatcaca

SEQ ID NO: 25603 - DNA, 75 bp, Artificial Sequence
  Synthetic
tttagaagcgtgcgaatttgatgataaaagacttagtttgatttggaaaggtcatcttgtgtatgcttgctgtcg

SEQ ID NO: 25604 - DNA, 75 bp, Artificial Sequence
  Synthetic
ctggtgttgcacagcaactgcaacatttgaatttaatgagttctatgagcatactgtaacaggtagagaaattga

SEQ ID NO: 25605 - DNA, 75 bp, Artificial Sequence
  Synthetic
gtttgtaacaggtaaatctgtctttgacattgatgttagatgtcaaaattgcatgagatatcttgattcaattga

SEQ ID NO: 25606 - DNA, 75 bp, Artificial Sequence
  Synthetic
aaagcttgatatctgtggaagaagacttccttttcataaagtaagagactcttggaaagggatctgtaggctgtg

SEQ ID NO: 25607 - DNA, 75 bp, Artificial Sequence
  Synthetic
taagcatttctataatgattggtaaagaggtgatattgcaagacattgtattagaattaagtgagttgcagcctg

SEQ ID NO: 25608 - DNA, 75 bp, Artificial Sequence
  Synthetic
aggtacaaccagttgacctgttttgtgaagaggagttaccgaccgaacagcaggaaacagaggaggagcctgcta

SEQ ID NO: 25609 - DNA, 75 bp, Artificial Sequence
  Synthetic
ttgaaagatctgcgtacaaagttgttgtactttgtggctgctgcaaggtgaagcttcgcatctttgtgaaagcca

SEQ ID NO: 25610 - DNA, 75 bp, Artificial Sequence
  Synthetic
cgcaatttggtattagaaccctacaggacatcctgattgaagaattgcaactgttgtgcccggagtgccgtggga

SEQ ID NO: 25611 - DNA, 75 bp, Artificial Sequence
  Synthetic
actgcaatcatggcggagtctaaaggtagtacatctaaagaagggtttggtgattggtgtattttggaagctgaa

SEQ ID NO: 25612 - DNA, 75 bp, Artificial Sequence
  Synthetic
tgtagtgatgtagaaaatgatttggaaaaattatttgatgaagatacagactcagatatttcagacttattagat

SEQ ID NO: 25613 - DNA, 75 bp, Artificial Sequence
  Synthetic
gataatgacttggagcagggtaactctcgggaactatttcatcaacaagagtgtcaggaaagcgaagagcatttg

SEQ ID NO: 25614 - DNA, 75 bp, Artificial Sequence
  Synthetic
caaaaactaaaacgaaagtacttaagtcccaaagctgtcgcacagcttagtccgcgatttgaaagtatttcttta

SEQ ID NO: 25615 - DNA, 75 bp, Artificial Sequence
  Synthetic
tcacctcagcagaagtctaaacgaagactttttgcagagcaggacagcggactcgagttgactttaacaaatgaa

SEQ ID NO: 25616 - DNA, 75 bp, Artificial Sequence
  Synthetic
gctgaagatgtttcttctgaggtggaggtaccggctttagattctcagccggtagctggggaacaatcaggggac

SEQ ID NO: 25617 - DNA, 75 bp, Artificial Sequence
  Synthetic
atagacatacattttacagcattattgcgtgcaaacaataacagagcaattttaatggcaaaattcaaggaagcg

SEQ ID NO: 25618 - DNA, 75 bp, Artificial Sequence
  Synthetic
tttggggtagggttttatgacttaacacgccaatttaaaagttataaaacatgctgtaatgcttgggttatatct

SEQ ID NO: 25619 - DNA, 75 bp, Artificial Sequence
  Synthetic
gtgtatgcagttcatgatgatctgcttgaaagctcaaaacagctgttgcaacagcattgtgactatgtgtggatt

SEQ ID NO: 25620 - DNA, 75 bp, Artificial Sequence
  Synthetic
agacagacagcagcaatgtcattgtttttattgtgctttaaagtgggaaaaaaccgtggcacggtgcataagtta

SEQ ID NO: 25621 - DNA, 75 bp, Artificial Sequence
  Synthetic
atgatgtctatgttaaatgtacatgaaaaacaaatattatctgagccacctaaactgagaaatactgctgctgcg

SEQ ID NO: 25622 - DNA, 75 bp, Artificial Sequence
  Synthetic
ttattttggtataagggctgtatgggatctggagggtttacttatggtccatacccagattggatagcacaacaa

SEQ ID NO: 25623 - DNA, 75 bp, Artificial Sequence
  Synthetic
acaatattaggtcatcaaaatgctgaagcaagtagttttgatttgtctgaaatgattcaatgggcatttgataac

SEQ ID NO: 25624 - DNA, 75 bp, Artificial Sequence
  Synthetic
aaccacatggacgaatcagatattgcgtatcaatatgcaaaattagcaccagaaaacagcaatgctgtggcatgg

SEQ ID NO: 25625 - DNA, 75 bp, Artificial Sequence
  Synthetic
cttgcacataataatcaagctagatttgttagagaatgtgcggcaatggtgcgtttttataaaaaaggtcaaatg

SEQ ID NO: 25626 - DNA, 75 bp, Artificial Sequence
  Synthetic
aaagaaatgagcatgtctgagtggatttatgctagaatccatgaggtggacggagaaggacactggtccactatt

SEQ ID NO: 25627 - DNA, 75 bp, Artificial Sequence
  Synthetic
gctaaatttttaagatatcaacaagtaaattttataatgtttttagcagccctaaaagatttattgcatgcagtg

SEQ ID NO: 25628 - DNA, 75 bp, Artificial Sequence
  Synthetic
ccaaaacgaaattgtatactaatttatggtcctcctaatactggcaaatcagcctttactatgtcactaataaga

SEQ ID NO: 25629 - DNA, 75 bp, Artificial Sequence
  Synthetic
gtgttaaaaggcagagtaatatcgtttgtaaactccaaaagtcagttttggttacaacctttgtcagagtgtaaa

SEQ ID NO: 25630 - DNA, 75 bp, Artificial Sequence
  Synthetic
atagcactcttagatgacgtcactgatccgtgttggatttacatggatacatatttgcgaaatggtttagatggg

SEQ ID NO: 25631 - DNA, 75 bp, Artificial Sequence
  Synthetic
catgttgtgtctttggattgcaaacataaagcccccattcaaactaaatttcctgcgcttttacttacatctaat

SEQ ID NO: 25632 - DNA, 75 bp, Artificial Sequence
  Synthetic
ataaatgtacataatgaggttaattatagatacttacacagcagaatacaaggatttgagtttccaaacccattt

SEQ ID NO: 25633 - DNA, 75 bp, Artificial Sequence
  Synthetic
cctatgaaagcagacaatacacctcaatttgaacttactgaccaaagctggaaatctttttttacaaggctttgg

SEQ ID NO: 25634 - DNA, 75 bp, Artificial Sequence
  Synthetic
caacaattagaactgagtgaccacgaagaggagggcgaaaatggagaatctcagcgaacgtttcaatgttctaca

SEQ ID NO: 25635 - DNA, 75 bp, Artificial Sequence
  Synthetic
agatcagctaatgaacatttatgaatctgcagcagaaacccttgagtcacaaattgaacactggcaaattttgcg

SEQ ID NO: 25636 - DNA, 75 bp, Artificial Sequence
  Synthetic
aaaagaagctgtactactatattttgctaggcgaaagggtgttacgcgaattggatatcaacctgttcccacgtt

SEQ ID NO: 25637 - DNA, 75 bp, Artificial Sequence
  Synthetic
agcagtgtctgaagcaaaagctaaggaagcgatagggatggtactgcagctgcagtcattacaaaaatctgaata

SEQ ID NO: 25638 - DNA, 75 bp, Artificial Sequence
  Synthetic
tggaactgagccttggtccttggttgacaccagtgcagagacgtatagaagtgctccagaaaattattttaaaaa

SEQ ID NO: 25639 - DNA, 75 bp, Artificial Sequence
  Synthetic
gggtccaatgcctatagaggttatatatgacaaagatgcagataatgccaatttgtataccatgtggaaatttgt

SEQ ID NO: 25640 - DNA, 75 bp, Artificial Sequence
  Synthetic
gtattacgtggatgaggatgacaattggcataaaagtgaaagtggggtaaatcatactggtttatattttatgca

SEQ ID NO: 25641 - DNA, 75 bp, Artificial Sequence
  Synthetic
aggaaactttagacactattatgtgttatttgctgatgatgcacgtaaatatagtgcaactggacattgggaagt

SEQ ID NO: 25642 - DNA, 75 bp, Artificial Sequence
  Synthetic
aaaagttaataaggaaactgtgtttactcctgtcaccagctcaacaccccccgactcaccaggaggacaaagaga

SEQ ID NO: 25643 - DNA, 75 bp, Artificial Sequence
  Synthetic
cccaaacacctcctccaagacccccaccaccaccactgactccgcgtccagactctcgcccacagcctccagaga

SEQ ID NO: 25644 - DNA, 75 bp, Artificial Sequence
  Synthetic
acagtcacaacaaaccaacaccaaaggacggaggtacgagagacgaccttccagcaggacccgacgacaaaccca

SEQ ID NO: 25645 - DNA, 75 bp, Artificial Sequence
  Synthetic
aacgcgccagaaacgatcaaggtccaaatccaagtcccggtcgcggtcgcggtcgcggtctctttcgtctaaccg

SEQ ID NO: 25646 - DNA, 75 bp, Artificial Sequence
  Synthetic
gcgatcacgatccaaatccagaagaaaggcctccaccactagagggagaggtcgagggtcacccaccgccaccag

SEQ ID NO: 25647 - DNA, 75 bp, Artificial Sequence
  Synthetic
tgaccaatcctccaggtcaccctcagccacttcctccacaacctccttgcgatcaagagggagcagcagggtcgg

SEQ ID NO: 25648 - DNA, 75 bp, Artificial Sequence
  Synthetic
gcgcagcaggggggggcgcagcagggtcgggcgcagtagggggagagggaaacgatccagagagtcaccatcccc

SEQ ID NO: 25649 - DNA, 75 bp, Artificial Sequence
  Synthetic
caccaacaccaaacggtcacgaagacagtcagggtcttctaggctccatggcgtctctgctgacgcagtgggaac

SEQ ID NO: 25650 - DNA, 75 bp, Artificial Sequence
  Synthetic
atcagttcacacggttagtggaagaaatacaggaagacttggaagattactggaagaggctcttgatcccccagt

SEQ ID NO: 25651 - DNA, 75 bp, Artificial Sequence
  Synthetic
aattttagttaggggggaacctaacacgctacgtagctttcgcaacagagctaagcacatgtatcgagggctttt

SEQ ID NO: 25652 - DNA, 75 bp, Artificial Sequence
  Synthetic
tagctcatttagcactgcatggtcatgggtggctggagatggaattgagcgtctaggcaggaccagaatgctcat

SEQ ID NO: 25653 - DNA, 75 bp, Artificial Sequence
  Synthetic
tagttttgtctcctttaatcaacgaaagcactttgatgatacagtaaggtatcctaaaggtgtggaccgatcgtt

SEQ ID NO: 25654 - DNA, 75 bp, Artificial Sequence
  Synthetic
tggctcatttgatagcctttaacatactaactgctttttttgctactaacacaataacttacctatatatatttt

SEQ ID NO: 25655 - DNA, 75 bp, Artificial Sequence
  Synthetic
tttactgcaatggcgcgcgccaggcgtactaagcgagattctgctaccaatatatacagaacctgcaaacaagca

SEQ ID NO: 25656 - DNA, 75 bp, Artificial Sequence
  Synthetic
ggtacctgtcctcctgatgtaatcaataaagtagaacaaactacaatagctgacaaaatcttgcaatatggcagt

SEQ ID NO: 25657 - DNA, 75 bp, Artificial Sequence
  Synthetic
gctggcgtcttttttgggggtttgggcataagtactggcaagggcacaggaggagcaactggttacgtgcctttg

SEQ ID NO: 25658 - DNA, 75 bp, Artificial Sequence
  Synthetic
ggggagggtccagtacgtgttggtggtactgcaacggtgatcaggccttcgttggttccagacaccattggacca

SEQ ID NO: 25659 - DNA, 75 bp, Artificial Sequence
  Synthetic
tcagacataatacctgtggacaccctgaatccagtagagcccactacctcctctattgttccactaacagaggct

SEQ ID NO: 25660 - DNA, 75 bp, Artificial Sequence
  Synthetic
tcaggttctgacctgttacctggagaagtggaaaccattgcagaggtgcaccctacacctagtataccctcaaca

SEQ ID NO: 25661 - DNA, 75 bp, Artificial Sequence
  Synthetic
gataccccagtgaccacaacttcaagtggtgctagtgctgttttagaagttgccccagaacctgttcctccatca

SEQ ID NO: 25662 - DNA, 75 bp, Artificial Sequence
  Synthetic
cgtgtaagagttactcgcacacaatatcataatccttcctttcaaatattaactgaatctactccaacacagggt

SEQ ID NO: 25663 - DNA, 75 bp, Artificial Sequence
  Synthetic
gaaagctccttggctgatcatattctggtcacttcaggttctggaggacaaacaattggtagttctggcagtgat

SEQ ID NO: 25664 - DNA, 75 bp, Artificial Sequence
  Synthetic
ttaatagaacttcaagaatttcctactcgttattcttttgagatagaagaacctacacctccacgccaaagtagt

SEQ ID NO: 25665 - DNA, 75 bp, Artificial Sequence
  Synthetic
actccaattcaaagacttagaactgcatttaggcgaaggggaggattaacaaataggcgtttagtacaacaagta

SEQ ID NO: 25666 - DNA, 75 bp, Artificial Sequence
  Synthetic
gctgtagatgatcccatattcttaactcagccttcaaggttagtttcttttcagtttgataatcctgcatttgaa

SEQ ID NO: 25667 - DNA, 75 bp, Artificial Sequence
  Synthetic
gaagaagtaacacaaatatttgaacaagatttagataattttcgggagccacctaatagggattttttggatgtg

SEQ ID NO: 25668 - DNA, 75 bp, Artificial Sequence
  Synthetic
caaactttaggtaggccacaatattcagaaacaccatctggttacatcagagttagtcgcctaggccaaaggcga

SEQ ID NO: 25669 - DNA, 75 bp, Artificial Sequence
  Synthetic
accattcgcactcgctctggagcacagataggttcacaagttcatttctatagagacttaagtactatagactcg

SEQ ID NO: 25670 - DNA, 75 bp, Artificial Sequence
  Synthetic
gaagatcctatagagctacaattgttaggtcagcattctggtgacgcttcaatagttcaaggtaatacagaaagc

SEQ ID NO: 25671 - DNA, 75 bp, Artificial Sequence
  Synthetic
acatttataaatattaatattgatgaaaatccattagctgaagattatagtattactgctaactcagaagatttg

SEQ ID NO: 25672 - DNA, 75 bp, Artificial Sequence
  Synthetic
cttttagatgaagcacaggaagactttagtgggtcacagttagtagttggtgggcgccgttctacttccacatat

SEQ ID NO: 25673 - DNA, 75 bp, Artificial Sequence
  Synthetic
acagttccccaatttgaaactacaaggtctggatcatattatacacaagacactaaaggctattatgttgcatat

SEQ ID NO: 25674 - DNA, 75 bp, Artificial Sequence
  Synthetic
cctgaagatagaagtactagtaaggatataatttatcccatgcctgacttgcctgtggttattatacatacatat

SEQ ID NO: 25675 - DNA, 75 bp, Artificial Sequence
  Synthetic
gacaccagtggtgatttttacttacatcccagccttcgcaagcgattcaaacgaaaacgtaaatatttataattt

SEQ ID NO: 25676 - DNA, 75 bp, Artificial Sequence
  Synthetic
tcttttgcagatggcagtatggcaagcagctagtggtaaggtataccttccaccatctacaccagttgccagggt

SEQ ID NO: 25677 - DNA, 75 bp, Artificial Sequence
  Synthetic
acaaagcacggatgaatatgttcaaaggacaaatatctactatcatgcttatagtgaccgcctactcactgttgg

SEQ ID NO: 25678 - DNA, 75 bp, Artificial Sequence
  Synthetic
tcacccatattttaatgtttataatgttgcaggatcaaaattagaaattccaaaagtttcaggaaatcaacacag

SEQ ID NO: 25679 - DNA, 75 bp, Artificial Sequence
  Synthetic
ggtttttagattaaaactaccagaccctaatcgctttgcacttgctgatatgtcagtgtataatcctgataaaga

SEQ ID NO: 25680 - DNA, 75 bp, Artificial Sequence
  Synthetic
aaggttagtgtggggctgcagaggaattgaaataggtagagggcaaccactaggtgtaggtagtgtaggacatcc

SEQ ID NO: 25681 - DNA, 75 bp, Artificial Sequence
  Synthetic
attgtttaacaaagtaggggatacagagaaccctaactcatataagggcacttctactgatgataggcaaaatgt

SEQ ID NO: 25682 - DNA, 75 bp, Artificial Sequence
  Synthetic
atcatttgaccctaaacagctacaaatgtttattataggctgtgctccctgtataggggaacactgggataaagc

SEQ ID NO: 25683 - DNA, 75 bp, Artificial Sequence
  Synthetic
attaccatgtgctgagcaagatattcctcagggatcctgtcctcctatagagttaattaactcagttattgaaga

SEQ ID NO: 25684 - DNA, 75 bp, Artificial Sequence
  Synthetic
tggagacatggcagatattggctatggcaatttaaattttaaggccttacaacaaaacagatctgatgtcagttt

SEQ ID NO: 25685 - DNA, 75 bp, Artificial Sequence
  Synthetic
agatatagtaaatgaaacttgtaaatatccagatttcttaaagatgcaaaatgatgtgtatggtgattcctgctt

SEQ ID NO: 25686 - DNA, 75 bp, Artificial Sequence
  Synthetic
tttttatgcaaggcgagagcaatgttatgctagacatttttttgttcgtggaggcaagacaggtgatgacattcc

SEQ ID NO: 25687 - DNA, 75 bp, Artificial Sequence
  Synthetic
agcaggacaaatcgatgagggaagcatgaaaaatacatactacatacctcctaacaatagtcagcaacaatatac

SEQ ID NO: 25688 - DNA, 75 bp, Artificial Sequence
  Synthetic
taatttaggaaatgccatgtatttcccaactgttagtggctcattagtatccagtgatgctcaattgtttaacag

SEQ ID NO: 25689 - DNA, 75 bp, Artificial Sequence
  Synthetic
gccattttggttgcagcgcgcacaaggtcataacaatggcatatgctggtttaatcagctatttgtcacagtagt

SEQ ID NO: 25690 - DNA, 75 bp, Artificial Sequence
  Synthetic
agacaacacgcgtaacactaattttagtatatcagttaattcagatggaacagatgttgctaaaattgcagatta

SEQ ID NO: 25691 - DNA, 75 bp, Artificial Sequence
  Synthetic
taattctgcaaactttaaagaatacttaagacatgtagaagaatatgaaatatctttaattttacaattatgtaa

SEQ ID NO: 25692 - DNA, 75 bp, Artificial Sequence
  Synthetic
aatacctttgaaagcagaagttctggcacaaatcaatgcaatgaattctaacatattggaagaatggcaattagg

SEQ ID NO: 25693 - DNA, 75 bp, Artificial Sequence
  Synthetic
tttcgtgcctgcacccgataatcctattcaggacacttatagatatatagattctttagctactagatgccctga

SEQ ID NO: 25694 - DNA, 75 bp, Artificial Sequence
  Synthetic
caaaaatcctcctaaggaaaaagtagatccttataaaaacttacacttttggaatgtagatttatcagaacgcct

SEQ ID NO: 25695 - DNA, 75 bp, Artificial Sequence
  Synthetic
ctctttagatttagatcaatatgctcttggccgcaagtttttatttcaggctggtttgcaacaggcaaccgtaaa

SEQ ID NO: 25696 - DNA, 75 bp, Artificial Sequence
  Synthetic
cggtacaaaaactatatcttcacgggtctccagcagaggaactaaaagaaagcgtaaaaattaaatttgttcgtt

SEQ ID NO: 25697 - DNA, 75 bp, Artificial Sequence
  Synthetic
ttcgttacaataaagtcaacttttgcacagtattcaaggaatgtttatttactatgactaactaagaaacgaacc

SEQ ID NO: 25698 - DNA, 75 bp, Artificial Sequence
  Synthetic
gcacccgatacataaaggtgagttatgtgccaaatcagatacagtctgagccgcatcaggcacagcagctggcca

SEQ ID NO: 25699 - DNA, 75 bp, Artificial Sequence
  Synthetic
gatctgatcttcgttgttttaacacgctcggattaggactctcgccaatggaatcataatcttgccaatctcttt

SEQ ID NO: 25700 - DNA, 75 bp, Artificial Sequence
  Synthetic
ggactctcgccaatggaatcataatcttgccaatctcttttggcactgcacttggcaaaggtaaggaccgttaac

SEQ ID NO: 25701 - DNA, 75 bp, Artificial Sequence
  Synthetic
gaataaaaggatttgaatttccaaatccttttcctatgaaagcagataatacacctcagttcgaactaactgacc

SEQ ID NO: 25702 - DNA, 75 bp, Artificial Sequence
  Synthetic
ttatgaagctgcagaacaaacattgcaggcacaaattaaacattggcaaaccttacgaaaagaagctgtattact

SEQ ID NO: 25703 - DNA, 75 bp, Artificial Sequence
  Synthetic
tctagttgataccagcatagaaacatttagaagcgctccagaaggtcacttcaaaaaaggccccgtccctgtaga

SEQ ID NO: 25704 - DNA, 75 bp, Artificial Sequence
  Synthetic
ttttttacattttgtatttgctatggcgcgtgcaaaaagggtcaagcgagactctgtaactcatatttaccaaac

SEQ ID NO: 25705 - DNA, 75 bp, Artificial Sequence
  Synthetic
aacattcaggtgatgctactatagtccagggacctgttgaaagcacatttatagatatggatatttctgaaaatc

SEQ ID NO: 25706 - DNA, 75 bp, Artificial Sequence
  Synthetic
acacagagtatttcgcctaaaattaccagatcctaacagatttgcattagctgatatgtctgtttacaaccctga

SEQ ID NO: 25707 - DNA, 75 bp, Artificial Sequence
  Synthetic
ttagggacgtcgccaaagaagatttaatctacaatcgcttttggcaatcgcatttggcactgctaaaagaccgtt

SEQ ID NO: 25708 - DNA, 75 bp, Artificial Sequence
  Synthetic
acggtaagttatgcaccgggtgcggtcgaattattactcattcgatagttgttgttgccagctaccatttaggac

SEQ ID NO: 25709 - DNA, 75 bp, Artificial Sequence
  Synthetic
agcatgtttttgcctgtaacgttatcgacacatactcacaccatatatatatatatatatatatatatatatata

SEQ ID NO: 25710 - DNA, 75 bp, Artificial Sequence
  Synthetic
tatatatatatattcatatatacatactagggaagatgccctagtactcatggctgactcttcaacagacagtgc

SEQ ID NO: 25711 - DNA, 75 bp, Artificial Sequence
  Synthetic
tgacgaaggtccttctcctaagcgtagacatttagaagaagaaaatacatctagctttttagagccaccattacc

SEQ ID NO: 25712 - DNA, 75 bp, Artificial Sequence
  Synthetic
agctacaattcgtgacctagccaatctgttagagataccattggatgattgtttagtaccttgtaacttttgcgg

SEQ ID NO: 25713 - DNA, 75 bp, Artificial Sequence
  Synthetic
taattttcttactcatttagaagtttgtgagtttgatgagaaaaagcttagtttactttggaaagatcattgtgt

SEQ ID NO: 25714 - DNA, 75 bp, Artificial Sequence
  Synthetic
gtttgcctgttgtcgtgtttgttgcgcagcaacagcgacatatgaatataatgaattttatgaatctactgttgt

SEQ ID NO: 25715 - DNA, 75 bp, Artificial Sequence
  Synthetic
aggtagagatatagaagaaataacaggcaaatctatttttgatattgatgtcaggtgctacaattgcatgaaatt

SEQ ID NO: 25716 - DNA, 75 bp, Artificial Sequence
  Synthetic
tttagactcaatagaaaagctagacatttgtggtaggaagtttttttttcataaagtgagaggctcttggaaagg

SEQ ID NO: 25717 - DNA, 75 bp, Artificial Sequence
  Synthetic
aatctgtaggctgtgtaagcattttcaataatgattggtaaagaggtcacattgcaagatattgttctggagtta

SEQ ID NO: 25718 - DNA, 75 bp, Artificial Sequence
  Synthetic
aatgaattgcagcctgaggtacaaccagttgacctgttttgtgaagaggagttaccgagcgagcagcaggaaaca

SEQ ID NO: 25719 - DNA, 75 bp, Artificial Sequence
  Synthetic
gaggaggagctaccagaaaggaccgcgtacaaagttgttacaccttgcggctgctgcaaggtcaagcttcgcatc

SEQ ID NO: 25720 - DNA, 75 bp, Artificial Sequence
  Synthetic
tttgtaaacgctacacaatttgctattagaacatttcagaatctgctgtttgaagaattgcagctgttgtgtcct

SEQ ID NO: 25721 - DNA, 75 bp, Artificial Sequence
  Synthetic
gagtgccgcggaaactgcaaacatggcggatcctaaaggtagtacatctaaagaagggttggaggattggtgtat

SEQ ID NO: 25722 - DNA, 75 bp, Artificial Sequence
  Synthetic
tgtggaagctgaatgtagcgatgtagaaaatgatttggaagaattatttgacagagatacagactcagatatttc

SEQ ID NO: 25723 - DNA, 75 bp, Artificial Sequence
  Synthetic
agaattgttagatgataatgacctggagcagggaaattcgcgggaactatttcaccagcaagagagtaaggaaag

SEQ ID NO: 25724 - DNA, 75 bp, Artificial Sequence
  Synthetic
cgaggagcaattacaaaaactaaaacgaaagtacttaagtcctaaagctgtcgcacagctcagtccgcgactcga

SEQ ID NO: 25725 - DNA, 75 bp, Artificial Sequence
  Synthetic
aagtataacgctgtcacctcagcagaagtctaaacgaaggctctttgcagagcaggacagcgggctcgagtgtac

SEQ ID NO: 25726 - DNA, 75 bp, Artificial Sequence
  Synthetic
aagtctaaacgaaggctctttgcagagcaggacagcgggctcgagtgtactcttacaaatgaagaagatgtttct

SEQ ID NO: 25727 - DNA, 75 bp, Artificial Sequence
  Synthetic
tctgaggtggaggtaccggctctagactctcagccggttgctgaggcacaattaggaacagtagacattcattat

SEQ ID NO: 25728 - DNA, 75 bp, Artificial Sequence
  Synthetic
aaagagttattacgtgccagcaacaataaggcgattcttatggcaaaatttaaagagttttttggggtaggattt

SEQ ID NO: 25729 - DNA, 75 bp, Artificial Sequence
  Synthetic
aatgatctgacacgccaatttaaaagttacaaaacctgttgtaatgcttgggttctgtctgtatatgcagttcat

SEQ ID NO: 25730 - DNA, 75 bp, Artificial Sequence
  Synthetic
gatgatcttcttgaaagctcaaagcagttattgcaacagcattgtgattatatatggatacgtgggataggagca

SEQ ID NO: 25731 - DNA, 75 bp, Artificial Sequence
  Synthetic
atgtcattgtttttgttatgttttaaagttggaaaaaatcgtgggactgtgcataagttgatgactgcaatgtta

SEQ ID NO: 25732 - DNA, 75 bp, Artificial Sequence
  Synthetic
aatgtgcatgaaaagcagatcatatctgagccaccaaaattaagaaatgttgctgctgcattgttttggtataag

SEQ ID NO: 25733 - DNA, 75 bp, Artificial Sequence
  Synthetic
ggtgcgatggggtctggagcatttacttatggaccttatcctgattggattgcccagcaaacaattgttggtcat

SEQ ID NO: 25734 - DNA, 75 bp, Artificial Sequence
  Synthetic
caaagtacagaagccagtgcatttgatatgtctgcaatggttcaatgggcgtttgataataactatttagatgaa

SEQ ID NO: 25735 - DNA, 75 bp, Artificial Sequence
  Synthetic
gctgatatagcctatcaatatgctaagctagcaccagaagatagtaatgctgtagcatggcttgcacataataat

SEQ ID NO: 25736 - DNA, 75 bp, Artificial Sequence
  Synthetic
caggccagatatgttagagaagttgcatctatggtaagattttataaaaaaggacaaatgaaagaaatgtctatg

SEQ ID NO: 25737 - DNA, 75 bp, Artificial Sequence
  Synthetic
tcagagtggatacatactagaattaatgaagtagaaggagaaggacattggtcaactatagcaaagttccttaga

SEQ ID NO: 25738 - DNA, 75 bp, Artificial Sequence
  Synthetic
tatcagcaagtaaattttataatgtttctagcagcattaaaagacatgctacattcagttcctaaacgtaattgt

SEQ ID NO: 25739 - DNA, 75 bp, Artificial Sequence
  Synthetic
atattgatttatggtccccctaacactggaaagtcagcatttactatgtctttaattcatgtactaagagggagg

SEQ ID NO: 25740 - DNA, 75 bp, Artificial Sequence
  Synthetic
gtgctatcatttgtgaattccaaaagccagttttggctgcagccaatgtcagaatgtaaaatagcattaattgat

SEQ ID NO: 25741 - DNA, 75 bp, Artificial Sequence
  Synthetic
gatgtgacagatccatgctggatatatatggatacttatttaagaaatggcctagatggtcatgttgtatcatta

SEQ ID NO: 25742 - DNA, 75 bp, Artificial Sequence
  Synthetic
gactgcaaacataaagcaccgatgcaaaccaaatttcctgcattactacttacatctaatatcaatgtgcataat

SEQ ID NO: 25743 - DNA, 75 bp, Artificial Sequence
  Synthetic
gaagttaattatagatatttgcatagcaggattaaaggctttgaattcccaaatccatttcccatgaaagcagac

SEQ ID NO: 25744 - DNA, 75 bp, Artificial Sequence
  Synthetic
gcaggattaaaggctttgaattcccaaatccatttcccatgaaagcagacaatacccctgaatttgagcttactg

SEQ ID NO: 25745 - DNA, 75 bp, Artificial Sequence
  Synthetic
accaaagctggaaatctttttttacaaggctttggaatcaattagagctgagtgaccaagaagacgagggagaaa

SEQ ID NO: 25746 - DNA, 75 bp, Artificial Sequence
  Synthetic
atggagaatctcagcgatcgtttcaatgttctgcaagatcagctaatgaacatttatgagtctgcagcaaacact

SEQ ID NO: 25747 - DNA, 75 bp, Artificial Sequence
  Synthetic
attgagtcgcaaattgagcattggcaaacactgcgaaaagaagctgtgctgctttattttgctaggcaaaagggt

SEQ ID NO: 25748 - DNA, 75 bp, Artificial Sequence
  Synthetic
gtgacacggcttggatatcaatatgtacctccattagcagtttcagaatcaagagctaaacaggctatagggatg

SEQ ID NO: 25749 - DNA, 75 bp, Artificial Sequence
  Synthetic
atgctgcagttgcaatcattgcaaaaatctgaatatgcaaaggaaccatggtcactggtagataccagtgcagag

SEQ ID NO: 25750 - DNA, 75 bp, Artificial Sequence
  Synthetic
acatttagaagccctcctgaaaatcatttcaaaaaagggccagtgtcagttgaggttatttatgataacgataaa

SEQ ID NO: 25751 - DNA, 75 bp, Artificial Sequence
  Synthetic
gacaatgctaatgcttacaccatgtggagatatgtttattacgtggatgatgacgaccaatggcataaaagtcca

SEQ ID NO: 25752 - DNA, 75 bp, Artificial Sequence
  Synthetic
agcggtgtcaaccacacaggcatatattttatgcaaggaacttttagacactactatgttttatttgctgatgat

SEQ ID NO: 25753 - DNA, 75 bp, Artificial Sequence
  Synthetic
gcaagtagatatagcagaactggacattgggaagttaacgttaataaggaaactgtgtttgctcctgtcaccagc

SEQ ID NO: 25754 - DNA, 75 bp, Artificial Sequence
  Synthetic
tccaccccacccgactcaccaggaggacaagcagactcaaacacctcctccacgacccccgccaccaccactgac

SEQ ID NO: 25755 - DNA, 75 bp, Artificial Sequence
  Synthetic
tccacgtccagactctcgtccaccagaaaacagtcacaacaaaccaacaccaaaggaagaaggtacggacggaga

SEQ ID NO: 25756 - DNA, 75 bp, Artificial Sequence
  Synthetic
ccgtccagtaggacccggcgaacgacccaaacgcatcaaaggcggcgatcgaggtccaagtccaggtcgcggtcg

SEQ ID NO: 25757 - DNA, 75 bp, Artificial Sequence
  Synthetic
cggtcgcggtcgcggctccgatcccgatcccggtcccgatcccggtcctattcccggtcccggtctcaatcgtct

SEQ ID NO: 25758 - DNA, 75 bp, Artificial Sequence
  Synthetic
gaccagccgcaataccgattcagatccggagggcaagtgtccctcatcactaccgccaccaccaccaccaccacc

SEQ ID NO: 25759 - DNA, 75 bp, Artificial Sequence
  Synthetic
gcaaccaactactccaccagagggtcagggcgagggtcatcctccacctcctcctccacctccaaacggccacga

SEQ ID NO: 25760 - DNA, 75 bp, Artificial Sequence
  Synthetic
cggccacgaggaggggccattggagggagcagtgggagggggagacggtcatcctccacctcccccagcccctcc

SEQ ID NO: 25761 - DNA, 75 bp, Artificial Sequence
  Synthetic
aaacggtcacgaggaaagtcagagtctgttaggcaacgtggcatctctcctgacgacgtgggaaagtctcttcaa

SEQ ID NO: 25762 - DNA, 75 bp, Artificial Sequence
  Synthetic
tcagttagtacaagaaatacaggtcgacttggaagattactggacgaagctctcgatcccccagtaatcttagtc

SEQ ID NO: 25763 - DNA, 75 bp, Artificial Sequence
  Synthetic
aggggggaacccaatacgctaaaatgctttcgcaatagagccaagcttaaatacgcagggttgtataaggctttc

SEQ ID NO: 25764 - DNA, 75 bp, Artificial Sequence
  Synthetic
agtacggcctggtcgtgggtggctggagatggtactgagcgtctaggcaggtccagaatgctcattagcttcttc

SEQ ID NO: 25765 - DNA, 75 bp, Artificial Sequence
  Synthetic
tcctttgagcaaagaaaagattttgataagactgttaaatatccgaaaggtgttgaccggtcgtatggttccttt

SEQ ID NO: 25766 - DNA, 75 bp, Artificial Sequence
  Synthetic
gatagcctatagcagcctttaacatactaactatagctctgctactaacatattaacactttttgattatatatt

SEQ ID NO: 25767 - DNA, 75 bp, Artificial Sequence
  Synthetic
ttttttttatttttatttttatgctatggcgcgtgctaagcgagtcaagcgagactctgctactaatatttacag

SEQ ID NO: 25768 - DNA, 75 bp, Artificial Sequence
  Synthetic
aacctgcaaacaagcaggcacatgtccccctgatgttattaataaagttgaaagcacaactattgctgataaaat

SEQ ID NO: 25769 - DNA, 75 bp, Artificial Sequence
  Synthetic
attgcagtatggtagtgctggtgtttttttcggggggctgggcataagcactggaaaaggtacaggcggtaccac

SEQ ID NO: 25770 - DNA, 75 bp, Artificial Sequence
  Synthetic
aggttatgtgcctttgggagaaggtcctgcagtccgtgttggcaatgctcctacggtcattagacctgcattggt

SEQ ID NO: 25771 - DNA, 75 bp, Artificial Sequence
  Synthetic
ccctgacaccattggcccgtctgatattattcctgtggacaccttaaatccagtggagcccacaacttcctctat

SEQ ID NO: 25772 - DNA, 75 bp, Artificial Sequence
  Synthetic
tgttccactcacagactctacaggcccagatctgttacctggagaagtggaaactattgcagaaatacatcctgg

SEQ ID NO: 25773 - DNA, 75 bp, Artificial Sequence
  Synthetic
tccgaccaggcctccacctgacactgcagtcactactagtacaaatggttctagtgctgttttagaagtagcacc

SEQ ID NO: 25774 - DNA, 75 bp, Artificial Sequence
  Synthetic
agagcctacccctccttctcgtgttagagtaaccagaacacaatatcataatccatcttttcaagtaataactga

SEQ ID NO: 25775 - DNA, 75 bp, Artificial Sequence
  Synthetic
atcaactcctactacaggcgaaagttctttagcagatcatatattagtaacatcagggactgggggacaaactat

SEQ ID NO: 25776 - DNA, 75 bp, Artificial Sequence
  Synthetic
agggggcagtacacctgaactcatagaactccaggactttccttctagatattcatttgaaattgaggagccaac

SEQ ID NO: 25777 - DNA, 75 bp, Artificial Sequence
  Synthetic
acctcctagaagaactagtacacccattcaaagaattcaaaatattataaggagaaggggtggcgggctcacaaa

SEQ ID NO: 25778 - DNA, 75 bp, Artificial Sequence
  Synthetic
taggcgtttggttcaacaggttaatgtagagaatcctttgtttgtatccaggccttctagattagtgcagtttca

SEQ ID NO: 25779 - DNA, 75 bp, Artificial Sequence
  Synthetic
atttgataaccctgcatttgaagaagaagtgacacaaatatttgagcaagatattgatactttcaatgaaccacc

SEQ ID NO: 25780 - DNA, 75 bp, Artificial Sequence
  Synthetic
agatagagactttttagatattaaaacacttggtaggcctcaatactcagaaacccctgcaggttacgtgagagt

SEQ ID NO: 25781 - DNA, 75 bp, Artificial Sequence
  Synthetic
tagtcgtcttggtaaacgaggaactattcgtactcgttcaggaacacaaattggttctcaggtccatttttacag

SEQ ID NO: 25782 - DNA, 75 bp, Artificial Sequence
  Synthetic
ggaccttagcaccattaacacagaggaccctattgaacttcaattattgggtgagcattctggcgatgctacaat

SEQ ID NO: 25783 - DNA, 75 bp, Artificial Sequence
  Synthetic
tgtccagggtccagttgaaagcacatttattgatattaacgttgatgaaaaccctctttctgaagattttagtgc

SEQ ID NO: 25784 - DNA, 75 bp, Artificial Sequence
  Synthetic
acattcagatgatttacttctagatgaggcaaatgaagattttagtggttcccaattagtggttggaggccgccg

SEQ ID NO: 25785 - DNA, 75 bp, Artificial Sequence
  Synthetic
ctccacttcttcttatactgttccacgttttgaaactactagatctggttcttattacgtgcaggacaccaaggg

SEQ ID NO: 25786 - DNA, 75 bp, Artificial Sequence
  Synthetic
ctattatgtagcctatcctgaagatcgagacactagtacagatataatctatccaacaccagatttgccagttgt

SEQ ID NO: 25787 - DNA, 75 bp, Artificial Sequence
  Synthetic
aatcatacacacatttgatacaagcggtgatttttacttacatccgagtcttagcagaaaatttaagagaagaag

SEQ ID NO: 25788 - DNA, 75 bp, Artificial Sequence
  Synthetic
gaaatatttgtaaccttttcttttgcagatggcagtttggcaagcagctagtggtaaggtttaccttccaccgtc

SEQ ID NO: 25789 - DNA, 75 bp, Artificial Sequence
  Synthetic
tacaccagttgccagggtccaaagcacggatgaatatgtacaaagaacaaacatctactatcatgcatatagtga

SEQ ID NO: 25790 - DNA, 75 bp, Artificial Sequence
  Synthetic
tcgcttattaactgttggtcatccatattttaatgtctatgacgtcaatagtgctaagataaaagtacctaaagt

SEQ ID NO: 25791 - DNA, 75 bp, Artificial Sequence
  Synthetic
atctgggaatcaacacagggtattcagactcaaattgccagatcctaatagatttgcacttgcagatatgtctgt

SEQ ID NO: 25792 - DNA, 75 bp, Artificial Sequence
  Synthetic
atacaatccagacaaggaaagattagtttgggcctgcagaggtatagaaataggaagagggcaacccttgggggt

SEQ ID NO: 25793 - DNA, 75 bp, Artificial Sequence
  Synthetic
gggaagtgtaggtcaccctttatttaataaagttggggacacagaaaatcctagttcatacaaaactcaaccaaa

SEQ ID NO: 25794 - DNA, 75 bp, Artificial Sequence
  Synthetic
ttctactgatgatagacaaaatgtatcatttgatcccaaacaactacaaatgtttataataggctgtgcaccttg

SEQ ID NO: 25795 - DNA, 75 bp, Artificial Sequence
  Synthetic
cttaggagaacattgggataaagctatcccatgtgcaactgacaatccacctccaggatcgtgccctccgattga

SEQ ID NO: 25796 - DNA, 75 bp, Artificial Sequence
  Synthetic
attaattaattcagcaatacaagatggcgatatggcagatataggatatggcaatctaaatttcaaagccttaca

SEQ ID NO: 25797 - DNA, 75 bp, Artificial Sequence
  Synthetic
acaaaataggtctgatgttagtttagacatagttaatgaaacgtgtaagtatccagacttcttaaaaatgcaaaa

SEQ ID NO: 25798 - DNA, 75 bp, Artificial Sequence
  Synthetic
tgatgtgtatggagattcatgtttcttttatgcacgcagagagcaatgttatgccagacacttctttgttagagg

SEQ ID NO: 25799 - DNA, 75 bp, Artificial Sequence
  Synthetic
gggcaaaacaggagatgacatacccgcaggacaaattgatgagggtagtatgaagaatgcatattacattccacc

SEQ ID NO: 25800 - DNA, 75 bp, Artificial Sequence
  Synthetic
aatgaatgatcaagcacagtacaagattggtaactccatgtatttcccaactgtcagtggctcattggtgtctag

SEQ ID NO: 25801 - DNA, 75 bp, Artificial Sequence
  Synthetic
tgacgctcaattgtttaacaggccattttggctacagcgtgcacaaggccataataatggcatatgttggtttaa

SEQ ID NO: 25802 - DNA, 75 bp, Artificial Sequence
  Synthetic
tcaattatttgttacagtagtagacaacactcgtaacacaaactttagtatttcagtaaatcctgagaatgcaga

SEQ ID NO: 25803 - DNA, 75 bp, Artificial Sequence
  Synthetic
cgtgtctaaaattgaaaattataaagccgagagctttcaagaatatttaagacacgttgaagaatatgaactttc

SEQ ID NO: 25804 - DNA, 75 bp, Artificial Sequence
  Synthetic
tttaattttacaattatgtaaagttcctttaacagcagaagtcttagctcaaattaatgcaatgaatgcaaatat

SEQ ID NO: 25805 - DNA, 75 bp, Artificial Sequence
  Synthetic
tttagaagaatggcagttaggatttgttcctgccccagacaatcctattcatgatacatatagatacattgactc

SEQ ID NO: 25806 - DNA, 75 bp, Artificial Sequence
  Synthetic
tgcagctactagatgtcctgataaaaaccctccaaaagaacgagaagatccttataaaaatatgaaattttggga

SEQ ID NO: 25807 - DNA, 75 bp, Artificial Sequence
  Synthetic
tgtagatttaacagaacggttgtctctagacttagatcaatattctcttggaagaaaatttttatttcaagcagg

SEQ ID NO: 25808 - DNA, 75 bp, Artificial Sequence
  Synthetic
tttgcagcagacgaccgttaacggtacaaagacactttcttcaagggtatctaccagaggaattaaacgaaaacg

SEQ ID NO: 25809 - DNA, 75 bp, Artificial Sequence
  Synthetic
caaaaattagacatgaccgttttcggtacaataaagtcaacttttacacagtattcaaggaatgtttatttactc

SEQ ID NO: 25810 - DNA, 75 bp, Artificial Sequence
  Synthetic
tgactaagcaaaataccaaccgcgcccgacacataaaggtgagttgtgagccaaatgaggtgagttgtaagccaa

SEQ ID NO: 25811 - DNA, 75 bp, Artificial Sequence
  Synthetic
aagaggtcagagccaagtctgttctgagccagatcagatactacgcgcgccagagttggatcacatctcgttgtt

SEQ ID NO: 25812 - DNA, 75 bp, Artificial Sequence
  Synthetic
ctaacacgctaaggactcaaggaaatgtaagtctgccaatcgattttggctcgtgttttggcagaagttaggacc

SEQ ID NO: 25813 - DNA, 75 bp, Artificial Sequence
  Synthetic
cacgctaaggactcaaggaaatgtaagtctgccaatcgattttggctcgtgttttggcagaagttaggaccgtta

SEQ ID NO: 25814 - DNA, 75 bp, Artificial Sequence
  Synthetic
gtaagttatttaatttatgtaccaggtgcggtactggaatttcacaataataattgttgttgccaactaccattg

SEQ ID NO: 25815 - DNA, 75 bp, Artificial Sequence
  Synthetic
ctatattcaagtttttgcctgtatcgttttcgtatcatgtgaataatatactgtatagtataaataaataaataa

SEQ ID NO: 25816 - DNA, 75 bp, Artificial Sequence
  Synthetic
atatatatatatatgcttcaaaggttgggttttttaataattaaggcaaatggcagagcaagcctccgaacagca

SEQ ID NO: 25817 - DNA, 75 bp, Artificial Sequence
  Synthetic
gaatattacagaaaaagaaaaagaacagctgcctttaactattaagggcctgtcagaatcattaggcattccgtt

SEQ ID NO: 25818 - DNA, 75 bp, Artificial Sequence
  Synthetic
tgtagactgtctaataccttgtaacttttgtggcaaatttttagattatttagaagcttgtgagtttgaggttaa

SEQ ID NO: 25819 - DNA, 75 bp, Artificial Sequence
  Synthetic
aaagcttagtttaatttggaaggattactgtgtatttgcctgctgtcgtgtttgttgtggtgcaacagccacata

SEQ ID NO: 25820 - DNA, 75 bp, Artificial Sequence
  Synthetic
tgagtttaatcagttttatcagcagacagtattaggaagagatattgaattggctgcaggtcgctccatatttga

SEQ ID NO: 25821 - DNA, 75 bp, Artificial Sequence
  Synthetic
aattgacattaggtgtcagacgtgcttagcttttcttgacataattgagaagttagattgttgtggaagaggact

SEQ ID NO: 25822 - DNA, 75 bp, Artificial Sequence
  Synthetic
tccctttcatagagtcagaaacgcctggaagggaatctgtaggcagtgtaagcatttttataatgattggtaaag

SEQ ID NO: 25823 - DNA, 75 bp, Artificial Sequence
  Synthetic
aggtcaccgtgcaagatattgttctggagctcagtgaggtgcagcctgaagtactaccagttgacctgttttgtg

SEQ ID NO: 25824 - DNA, 75 bp, Artificial Sequence
  Synthetic
aagaggaattaccaaacgaggatacggaggaggagcttgacaccgaaagaatcgttttcaaagtcattgcaccgt

SEQ ID NO: 25825 - DNA, 75 bp, Artificial Sequence
  Synthetic
gtggttgcagccactgtgaggtcaagctccgcgtttttgtccaagctacagaatttggcatcagagcatttcaac

SEQ ID NO: 25826 - DNA, 75 bp, Artificial Sequence
  Synthetic
agttgctgaccggtgacctgcagcttctgtgtcccgagtgtcgtgggaactgcgaacatggcggatcctaaaggt

SEQ ID NO: 25827 - DNA, 75 bp, Artificial Sequence
  Synthetic
agtacatctaaagaagggtttggtgattggtgtattttggaagctgactgtagtgatatagaaaatgatatggaa

SEQ ID NO: 25828 - DNA, 75 bp, Artificial Sequence
  Synthetic
caattatttgaaagagatacagattctgatatttcggacttaatagatgattgtgacctggaacagggaaattct

SEQ ID NO: 25829 - DNA, 75 bp, Artificial Sequence
  Synthetic
ttggaactatttcaccaacaggagtgtaagcagagcgaggagcaattacaaaaactaaaacgaaagtgtcttagt

SEQ ID NO: 25830 - DNA, 75 bp, Artificial Sequence
  Synthetic
gtaagcagagcgaggagcaattacaaaaactaaaacgaaagtgtcttagtccaaaagctgtcgcacagcttagtc

SEQ ID NO: 25831 - DNA, 75 bp, Artificial Sequence
  Synthetic
cgcgacttcagtcaatttcattgtcacctcagcagaagtctaagcgaaggctctttgcagagcaggacagcggag

SEQ ID NO: 25832 - DNA, 75 bp, Artificial Sequence
  Synthetic
tcgagctgaccttaaacaatgaagctgaagatgttactactgaggtggaggtaccggctatagactctcggccgg

SEQ ID NO: 25833 - DNA, 75 bp, Artificial Sequence
  Synthetic
atgacgagggaggatcaggggatgtagatatacattatctttcactgttgcgttccagcaacaaaaaagccacat

SEQ ID NO: 25834 - DNA, 75 bp, Artificial Sequence
  Synthetic
taatggcaaaatttaaagcagcgtttggggtaggctttaatgaattgacacgtcaattcaaaagtcacaaaacct

SEQ ID NO: 25835 - DNA, 75 bp, Artificial Sequence
  Synthetic
gctgtaatcattgggttgtctctgtttatgcagtccatgatgatctatttgaaagttcaaagcagttgttgcaac

SEQ ID NO: 25836 - DNA, 75 bp, Artificial Sequence
  Synthetic
agcattgtgactatttatgggttcgtgggatagatgcaatgtcattatatctattgtgttttaaggcgggaaaaa

SEQ ID NO: 25837 - DNA, 75 bp, Artificial Sequence
  Synthetic
atcgcgggacagtgcataagttgatgacttcaatgttaaatgtgcatgaacagcagattttgtctgagcctccaa

SEQ ID NO: 25838 - DNA, 75 bp, Artificial Sequence
  Synthetic
agttaagaaatactgctgctgcattgttttggtacaaaggctgtatgggatcgggggtgttcagttatgggccat

SEQ ID NO: 25839 - DNA, 75 bp, Artificial Sequence
  Synthetic
atcctgattggattgcacaacagactatattaggtcacaataatgctgaagcaagcacctttgatttttcacaga

SEQ ID NO: 25840 - DNA, 75 bp, Artificial Sequence
  Synthetic
tggtacaatgggcctttgataatcagttagttgatgaaggagatattgcatatcgatatgcaaggcttgcaccag

SEQ ID NO: 25841 - DNA, 75 bp, Artificial Sequence
  Synthetic
aagatgccaatgctgttgcatggcttgcacataatagtcaagctaaatttgtaagagagtgtgcagcaatggtgc

SEQ ID NO: 25842 - DNA, 75 bp, Artificial Sequence
  Synthetic
gcttttataaaaaaggtcaaatgagggatatgtccatgtcggaatggatctatactaaaatacatgaggtagaag

SEQ ID NO: 25843 - DNA, 75 bp, Artificial Sequence
  Synthetic
gtgaaggtcactggtcagatatagtaaaatttttaagatatcaggaggtaaactttataatgtttttggctgcat

SEQ ID NO: 25844 - DNA, 75 bp, Artificial Sequence
  Synthetic
tcaaagattttttgcactcaaagccaaaaaaaaattgtattttaattcatggccctcctaattcaggaaagtcat

SEQ ID NO: 25845 - DNA, 75 bp, Artificial Sequence
  Synthetic
catttgcaatgtcattaataagggtattaaaaggcagagtattatcttttgtaaattcaaaaagccaattttggt

SEQ ID NO: 25846 - DNA, 75 bp, Artificial Sequence
  Synthetic
tgcaacccctttctgaatgtaaaatagcattgattgatgatgtaactgacccctgttggttatatatggataatt

SEQ ID NO: 25847 - DNA, 75 bp, Artificial Sequence
  Synthetic
atctaagaaacggtttagatgggcattatgtctcattggattgtaaatacaaagctccaatgcaaacaaagtttc

SEQ ID NO: 25848 - DNA, 75 bp, Artificial Sequence
  Synthetic
ctccattattactaacatctaatataaatgtgcatgaggaagctaattacagatacttacacagtagaattaaag

SEQ ID NO: 25849 - DNA, 75 bp, Artificial Sequence
  Synthetic
agatacttacacagtagaattaaaggatttgcatttccaaatccattcccaatgaaatcagacgatacacctcag

SEQ ID NO: 25850 - DNA, 75 bp, Artificial Sequence
  Synthetic
tttgagttaactgaccaaagctggaaatctttttttgaaaggctttggacacaattagaactcagtgaccaagaa

SEQ ID NO: 25851 - DNA, 75 bp, Artificial Sequence
  Synthetic
gacgagggcgaaaatggagaatctcagcgagcgtttcaatgctctgcaggatctgctaatgaacatttatgaagc

SEQ ID NO: 25852 - DNA, 75 bp, Artificial Sequence
  Synthetic
tgcagaacagacacttgaggcacagataaaacactggcaaaccttgcgacaagaagctgttttgctctactttgc

SEQ ID NO: 25853 - DNA, 75 bp, Artificial Sequence
  Synthetic
taggcagagaggtgtgacaaggcttggatatcaacctgtgcctgtaaaagctgtatctgaagcaaaagctaaaga

SEQ ID NO: 25854 - DNA, 75 bp, Artificial Sequence
  Synthetic
ggctatagcaatggtgctgcagcttcagtctctacaaacgtctgaatatgcatctgaaacttggacattagttga

SEQ ID NO: 25855 - DNA, 75 bp, Artificial Sequence
  Synthetic
caccagtatagaaacttttagaagcgctccagacggtcactttaaaaagggtccagtgcctgtagaagtgattta

SEQ ID NO: 25856 - DNA, 75 bp, Artificial Sequence
  Synthetic
tgacaatgatgcagataatgccaatttgtacactatgtggacatacgtgtattatatggaagacgatgtgtggca

SEQ ID NO: 25857 - DNA, 75 bp, Artificial Sequence
  Synthetic
taaagccagaagtggggtcaatgagactggcatatattatttacaaggaacatttaaatattactatgtactatt

SEQ ID NO: 25858 - DNA, 75 bp, Artificial Sequence
  Synthetic
tgctgacgatgcacgtaaatatagtcaaactggacaatgggaagtgaaagttaataaggaaactgtctttgcccc

SEQ ID NO: 25859 - DNA, 75 bp, Artificial Sequence
  Synthetic
tgtcaccagctccacccctccagggtcgccaggaggacaagcagacacaaacgcctcctccaagacctccaccac

SEQ ID NO: 25860 - DNA, 75 bp, Artificial Sequence
  Synthetic
caccacagccaccgttgactccacgaccaagcagctcaccacatcagaacagccacaacaaaccgaaaccaaagg

SEQ ID NO: 25861 - DNA, 75 bp, Artificial Sequence
  Synthetic
aagaaagtacggacggaggccctccagcaggacaaggagaccgcaagcgaagcaaaggcgatcaaggtccagaca

SEQ ID NO: 25862 - DNA, 75 bp, Artificial Sequence
  Synthetic
ccgatcctctaggtcccgatcgcggtcccagtcccggtcccacaccccaaccactcggtctgccaccacccggtc

SEQ ID NO: 25863 - DNA, 75 bp, Artificial Sequence
  Synthetic
taggtccccgtcgctcgccaagactggggtccagcgggtatcaaccagatcacgatccagaagcacctctagaag

SEQ ID NO: 25864 - DNA, 75 bp, Artificial Sequence
  Synthetic
gggaggtagaaggcggaggtcacggtcaccatccacctcctcctccaccaccaccaccaacaaacggtcacgagt

SEQ ID NO: 25865 - DNA, 75 bp, Artificial Sequence
  Synthetic
gcgggccgaaaccacagggtccagaggggcgcgagggggtagaggggccaggggtgggagcggtggggggcggcg

SEQ ID NO: 25866 - DNA, 75 bp, Artificial Sequence
  Synthetic
acgaggacgatcatcctcctccacctcccccgcccacaaacggtcaagagagcactctgttaggagccgtggcgt

SEQ ID NO: 25867 - DNA, 75 bp, Artificial Sequence
  Synthetic
gtctcctgaccaagtgggaaagtcacttcgatctgttagttcaaaacatacaggacgacttggaagattactgga

SEQ ID NO: 25868 - DNA, 75 bp, Artificial Sequence
  Synthetic
agaagctctcgatcccccagtgatccttgttagaggggaggcaaatacactaaaatgctttcgcaacagagctaa

SEQ ID NO: 25869 - DNA, 75 bp, Artificial Sequence
  Synthetic
gataaaatacatgggactgtataggtcatttagtacaacttggtcatgggtggcaggagatggcactgagcgtct

SEQ ID NO: 25870 - DNA, 75 bp, Artificial Sequence
  Synthetic
aggcaggcccagaatgctcattagcttttcgtcctacaatcagagaagggattttgatgacgtggtgagataccc

SEQ ID NO: 25871 - DNA, 75 bp, Artificial Sequence
  Synthetic
gaaaggagttgaaaaatcatatggcaaccttgacagtctctaaccactaatgctatgctgctttgctactaacaa

SEQ ID NO: 25872 - DNA, 75 bp, Artificial Sequence
  Synthetic
cactaacaaattagctttttatacttttttacttttgtacctgcaatggcgcgtgctaaaagggtcaagcgagac

SEQ ID NO: 25873 - DNA, 75 bp, Artificial Sequence
  Synthetic
tctgtaacacatatataccagacctgcaaacaagcaggcacatgcccccctgatgttgtgaataaagtggaacaa

SEQ ID NO: 25874 - DNA, 75 bp, Artificial Sequence
  Synthetic
acaacagttgctgacaatattttgaaatatggcagtgctggtgtcttttttggtggccttggcattggttcgggc

SEQ ID NO: 25875 - DNA, 75 bp, Artificial Sequence
  Synthetic
cgaggtactgggggtgctaccgggtacgtgccacttagtgaaggtcctggtatccgtgtcggaggtacccccacg

SEQ ID NO: 25876 - DNA, 75 bp, Artificial Sequence
  Synthetic
gttgtaaggccttcattagttcctgaagcaattgggccagtcgatattttgcccattgatacaattgatcctgtg

SEQ ID NO: 25877 - DNA, 75 bp, Artificial Sequence
  Synthetic
gagcctacagcatcgtccgtggttcctcttactgaatccactggacctgatttacttccaggtgaggtggaaaca

SEQ ID NO: 25878 - DNA, 75 bp, Artificial Sequence
  Synthetic
atagctgaaattcatcctgttgctgaaggcccatcagttgatacccctgtggttaccacaagcacgggttccagt

SEQ ID NO: 25879 - DNA, 75 bp, Artificial Sequence
  Synthetic
gctgttttggaagttgctccagagcctatacctccaacacgggttagaatctcacgtacacaatatcacaatcct

SEQ ID NO: 25880 - DNA, 75 bp, Artificial Sequence
  Synthetic
tcctttcaaattattacagaatcaacacctgcacagggtgaaagctctcttgcagatcacattttagtgacatca

SEQ ID NO: 25881 - DNA, 75 bp, Artificial Sequence
  Synthetic
gggtccgggggacaaagaataggggctgatattactgatgaaattgaacttcaagaacttcctagtagatatact

SEQ ID NO: 25882 - DNA, 75 bp, Artificial Sequence
  Synthetic
tttgaaaatgaagaaccaactccacctagacgtagcagcacacctttacaggccacacgagctgcaggtagacgg

SEQ ID NO: 25883 - DNA, 75 bp, Artificial Sequence
  Synthetic
agaggtgtttctttaactaatagacgtctagtacagcaggtacctgtagaaaatcctttgtttttaactcaaccc

SEQ ID NO: 25884 - DNA, 75 bp, Artificial Sequence
  Synthetic
tctcgattggtgcgttttgcttttgaaaatcctgcatttgaagaagaagttacaaatatatttgaacatgatgta

SEQ ID NO: 25885 - DNA, 75 bp, Artificial Sequence
  Synthetic
gatgcttttgaagaaccaccagatagggattttcttgatgtccaacggttgggtcgtccccaatattctacaact

SEQ ID NO: 25886 - DNA, 75 bp, Artificial Sequence
  Synthetic
cctgcagggtatgtgagggttagtagattaggtactcgtgcaaccattcgcacgcggtctggtgcacaaataggg

SEQ ID NO: 25887 - DNA, 75 bp, Artificial Sequence
  Synthetic
tcacaggtgcacttttatagggatctcagttccattaatactgaagatcctatagaattgcagttgttggggcaa

SEQ ID NO: 25888 - DNA, 75 bp, Artificial Sequence
  Synthetic
cattcgggggatgctagtatagttcaaggccctgtggaaagcacatttatagacgtaaatgtgtctgaaaatcct

SEQ ID NO: 25889 - DNA, 75 bp, Artificial Sequence
  Synthetic
ttgtctgaaagtgtggaagccttttctgatgatttattgctggatgaagctgtggaggattttagtgggtcacaa

SEQ ID NO: 25890 - DNA, 75 bp, Artificial Sequence
  Synthetic
ttagttattggtaatagaagaagtaccacttcttacactgttcccagatttgaaactactaggagtggttcttat

SEQ ID NO: 25891 - DNA, 75 bp, Artificial Sequence
  Synthetic
tatgtccaggacagtaaaggatattatgttgcatacccagaatctcgcaataatgcagaaataatttatcctaca

SEQ ID NO: 25892 - DNA, 75 bp, Artificial Sequence
  Synthetic
cctgatatacctgtagtggtaatacacactcatgacaatacaggtgacttttatttacatcctagtcttcgatgg

SEQ ID NO: 25893 - DNA, 75 bp, Artificial Sequence
  Synthetic
cgcaaacgtaaaagaaaatatttgtgattttgcattgcagatggcagtgtggcattcggctaatggtaaagtata

SEQ ID NO: 25894 - DNA, 75 bp, Artificial Sequence
  Synthetic
ccttcctccatcgacaccggttgccagggtgcaaagcacggatgaatatatacaaaggacaaatatttattatca

SEQ ID NO: 25895 - DNA, 75 bp, Artificial Sequence
  Synthetic
tgcattcagcgacagactactgactgtaggccatccatacttcaatgtttacgatattactggtaacaaattaga

SEQ ID NO: 25896 - DNA, 75 bp, Artificial Sequence
  Synthetic
agtccctaaagtgtctggtaaccaacacagggtttttcgcttgaaattacctgatcctaatagatttgcattagc

SEQ ID NO: 25897 - DNA, 75 bp, Artificial Sequence
  Synthetic
tgacatgtcagtttataacccagataaagaacggttggtgtggagctgtaggggccttgaaataggtagaggaca

SEQ ID NO: 25898 - DNA, 75 bp, Artificial Sequence
  Synthetic
accgttaggtgttggcagtacgggacacccactatttaataagttgaaagacactgaaaacagtaattcatatat

SEQ ID NO: 25899 - DNA, 75 bp, Artificial Sequence
  Synthetic
aaaatcttctaaagatgatagacaggatacatcatttgatcccaaacaaattcaaatgtttatcgtgggatgcac

SEQ ID NO: 25900 - DNA, 75 bp, Artificial Sequence
  Synthetic
accttgtataggtgaacattgggacaaggctataccttgtgaaaaggagcgccaggacaacagactatgcccacc

SEQ ID NO: 25901 - DNA, 75 bp, Artificial Sequence
  Synthetic
aattgaattgaaaactacttatatagaagatggcgacatggcagatataggttttggaaatttaaacttcaaaaa

SEQ ID NO: 25902 - DNA, 75 bp, Artificial Sequence
  Synthetic
tctgcaagagagtaggtcagatgtaagtttggatatagttaatgaaacctgcaaatatcctgacttcttaaaaat

SEQ ID NO: 25903 - DNA, 75 bp, Artificial Sequence
  Synthetic
gcagaatgatgtttatggagatgcctgttttttttatgctcgcagagagcaatgttatgccagacatttttttgt

SEQ ID NO: 25904 - DNA, 75 bp, Artificial Sequence
  Synthetic
ccgtggaggtaaaacgggtgacgacatccctgacgccagaattgataatgggacttttaagaatcagtttttcat

SEQ ID NO: 25905 - DNA, 75 bp, Artificial Sequence
  Synthetic
tcctggggctgacggccaagatcaaaagaccataggaaatgccatgtattacccaactgttagtggctcattggt

SEQ ID NO: 25906 - DNA, 75 bp, Artificial Sequence
  Synthetic
gtctagtgatgctcaattgtttaacaggcccttctggctccagcgagcacaaggtcataataatggcattctgtg

SEQ ID NO: 25907 - DNA, 75 bp, Artificial Sequence
  Synthetic
ggctaatcagatgtttattacagtggtagacaacacacgaaatactaactttagtatttcaatatataacaataa

SEQ ID NO: 25908 - DNA, 75 bp, Artificial Sequence
  Synthetic
tggggcactaaaggacatcaatgattacactgcagagcaatttagagaatatcaaaggcacgtggaggaatatga

SEQ ID NO: 25909 - DNA, 75 bp, Artificial Sequence
  Synthetic
aatttcattaatattacagctatgtaaggttcctctgaaggcagaagtattggctcagataaatgctatgaattc

SEQ ID NO: 25910 - DNA, 75 bp, Artificial Sequence
  Synthetic
ttctttattggaagattggcagttaggttttgtacctactccagataaccctattcaagacacctatcgatatat

SEQ ID NO: 25911 - DNA, 75 bp, Artificial Sequence
  Synthetic
tgattcattagccactcgctgtcctgataaaaccccccctaaggaaaaagaggatccctacaaggggttaaagtt

SEQ ID NO: 25912 - DNA, 75 bp, Artificial Sequence
  Synthetic
ctgggatgtggatcttactgaacggttgtcactagatttggatcaatactctttaggtagaaagtttctatttca

SEQ ID NO: 25913 - DNA, 75 bp, Artificial Sequence
  Synthetic
agccggcttacagcagacgaccgtaagcggtacaaaatcagtgtcttatcgagggttcaccagaggaaccaagcg

SEQ ID NO: 25914 - DNA, 75 bp, Artificial Sequence
  Synthetic
caagcgaaaacagtaatatgaccgtttttggtacagatttataaacttttacacagtattcaaggaatgtttgtt

SEQ ID NO: 25915 - DNA, 75 bp, Artificial Sequence
  Synthetic
tactctgactaagtataactctaccaagggaaccgaccgcacccggtacagtcaacgatactgctgccaatatag

SEQ ID NO: 25916 - DNA, 75 bp, Artificial Sequence
  Synthetic
actctgtttagtgccagaacatatcatcttggaagcagatcgaccgtgttcgttgtaacacgctcggattagaga

SEQ ID NO: 25917 - DNA, 75 bp, Artificial Sequence
  Synthetic
agacattgccaaggaagatttaatctacaatcgctgttggcaatcgcttttggctgagatagctgaccggtaacg

SEQ ID NO: 25918 - DNA, 75 bp, Artificial Sequence
  Synthetic
caccaagtattgcacctggatgattgttgttggcaacaacctttattactcaacaagtattttcttgcaccgatt

SEQ ID NO: 25919 - DNA, 75 bp, Artificial Sequence
  Synthetic
tcgtagcacctgtttataagtattgatatatggtatataaggcagacatcttaatggcggcagtaagtaaacctc

SEQ ID NO: 25920 - DNA, 75 bp, Artificial Sequence
  Synthetic
agaccattacagagcttgctaggtgtcttggtataccgttagaagatgctttggtgccttgtaatttttgtaaaa

SEQ ID NO: 25921 - DNA, 75 bp, Artificial Sequence
  Synthetic
agtttttaacatatttggaagtcgttgaatttgatgtaaaacaactttgtctaatttggaaagaagatttagtgt

SEQ ID NO: 25922 - DNA, 75 bp, Artificial Sequence
  Synthetic
ttggctgttgcagatgttgttgtatagcatcagccacgtatgaatttgataattacttgaatgatagtgttgttg

SEQ ID NO: 25923 - DNA, 75 bp, Artificial Sequence
  Synthetic
gctgggcaatagaagttaaggaaaaaaagccactctctgaaattatagtgaggtgtcgccattgtatgaaaaaat

SEQ ID NO: 25924 - DNA, 75 bp, Artificial Sequence
  Synthetic
tagatcaaattgaaaagcttgatatctgtggtagatctctattgttttacaaagtgaggaggggctggaaaggac

SEQ ID NO: 25925 - DNA, 75 bp, Artificial Sequence
  Synthetic
tctgtaggcagtgtaagtagatataatgattggaaaagaggtcactctgcaagacattgtgttagggttgacacc

SEQ ID NO: 25926 - DNA, 75 bp, Artificial Sequence
  Synthetic
accagagcctgttgcattgaattgtgaagaggagttaccaaccgagcaggatacggaggaggagcctgcaagaac

SEQ ID NO: 25927 - DNA, 75 bp, Artificial Sequence
  Synthetic
agctttcaagattattgtgttctgcggcggaggctgtggatcccgacttcgaatatttgttgctgccacagaatt

SEQ ID NO: 25928 - DNA, 75 bp, Artificial Sequence
  Synthetic
tggagttcgttgctttcagcaattgctagttaaggagttggatcttctgtgtcctaactgccgaaacagcgacct

SEQ ID NO: 25929 - DNA, 75 bp, Artificial Sequence
  Synthetic
gcagcatggcggacaataaaggtagtggtcctgaagggttaagtgattggtgtttattagaagcggaatgtagtg

SEQ ID NO: 25930 - DNA, 75 bp, Artificial Sequence
  Synthetic
atattgaaaatgatttggaaacattatatgaacaaaatgcagattcagatgtttctgatttattaaatgatgatg

SEQ ID NO: 25931 - DNA, 75 bp, Artificial Sequence
  Synthetic
aggacttggagcagggaaattccagagaactatttcaacaacaagagttagaagacagcgagactttattgcaat

SEQ ID NO: 25932 - DNA, 75 bp, Artificial Sequence
  Synthetic
cattaaagcgaaagtatattagtcccagggctgttttacaattaagtcctcaacttgaatctatttcgctgtcat

SEQ ID NO: 25933 - DNA, 75 bp, Artificial Sequence
  Synthetic
cacagcataaaagtaaaaggaaactgtttgctgagcaggacagtggagtagagctgaacttaacaaatgaagttg

SEQ ID NO: 25934 - DNA, 75 bp, Artificial Sequence
  Synthetic
aagatattgttacacaggtggaacaaaaggaggaggtaccgacagcatccacaaacttgagggagggggaaaatg

SEQ ID NO: 25935 - DNA, 75 bp, Artificial Sequence
  Synthetic
tacattacaaggaacttatgagatgtagtaatttgaaagctacattacttgcaaaattcaaaagtgcttttggtg

SEQ ID NO: 25936 - DNA, 75 bp, Artificial Sequence
  Synthetic
ttagttttgcagagttgacgcggcagtataaaagtaataagacatgttgtaacgattgggtgattgcaatttatg

SEQ ID NO: 25937 - DNA, 75 bp, Artificial Sequence
  Synthetic
gtgtgaataatgatttgtttgaaggttccaaaaaattgctgcaacagcactgtgattatatttggctcactgaaa

SEQ ID NO: 25938 - DNA, 75 bp, Artificial Sequence
  Synthetic
tgtctgcaatgtatttatatttattatgttttaaagctgggaagaataggcatactgtgataagattattaatct

SEQ ID NO: 25939 - DNA, 75 bp, Artificial Sequence
  Synthetic
ctatgctacatgttgcagaggaacaaatactgtctgaaccaccaaagcttagaagcactgtagcagctttgtttt

SEQ ID NO: 25940 - DNA, 75 bp, Artificial Sequence
  Synthetic
ggtataaaggcagttccaactcgggaacatttacccatggttcatatcctaaatggatagtagaacaaacattaa

SEQ ID NO: 25941 - DNA, 75 bp, Artificial Sequence
  Synthetic
taggacatcagtctggagaagcggcaacatttgatatgtcaactatggtacaatgggcgtttgataataatctta

SEQ ID NO: 25942 - DNA, 75 bp, Artificial Sequence
  Synthetic
cagaagaggctgacatagcttttcaatatgctaaactagcacctgatgatgttaatgcaactgcctggttggcac

SEQ ID NO: 25943 - DNA, 75 bp, Artificial Sequence
  Synthetic
ataataatcaagctagatttgttagagaagttgctgcaatggtcaggttttataaaaaaggacaaatgagagaaa

SEQ ID NO: 25944 - DNA, 75 bp, Artificial Sequence
  Synthetic
tgagtatgtctgcatggatacattttagattagagcaagtagagggagaaggacattggtcctctatagtaaaat

SEQ ID NO: 25945 - DNA, 75 bp, Artificial Sequence
  Synthetic
ttattagataccaaggtattaattttataagttttctctctgctttgaaggactttttgcatgctaaaccaaaaa

SEQ ID NO: 25946 - DNA, 75 bp, Artificial Sequence
  Synthetic
aaaattgtttgcttatatatggaccgccgaatactggcaaatcagcattcacaatgtcattaattaaagtattaa

SEQ ID NO: 25947 - DNA, 75 bp, Artificial Sequence
  Synthetic
atggaagagtaatatcctttgttaattctaaaagtcatttttggttacaacctatgtctgagtgtaaaattgctt

SEQ ID NO: 25948 - DNA, 75 bp, Artificial Sequence
  Synthetic
tattagatgatgcaacagatccatgttgggtttatatggatacatatttaaggaatggtcttgatggacatttag

SEQ ID NO: 25949 - DNA, 75 bp, Artificial Sequence
  Synthetic
tatcattagattgtaaacatagagcaccaatgcaaattaaatttcctccacttttaataacttctaatattaatg

SEQ ID NO: 25950 - DNA, 75 bp, Artificial Sequence
  Synthetic
caatggctgaatcagcatatagatatttacatagtagacttgtagcttttgaatttcctaatccttttcctatga

SEQ ID NO: 25951 - DNA, 75 bp, Artificial Sequence
  Synthetic
aagatgatgatacccctgaatttgagctaactgaccaaagctggaaatctttttttacaaggctttggacacaat

SEQ ID NO: 25952 - DNA, 75 bp, Artificial Sequence
  Synthetic
tagaactgagtgaccaagaagacgagggagaggatggagactctgagagaacgtttcgatgtgttacaagatcaa

SEQ ID NO: 25953 - DNA, 75 bp, Artificial Sequence
  Synthetic
ctaatgaacatttatgaagttgctagtgataccctagaagcacaaatagaacattggcggcttcttcgtaaagaa

SEQ ID NO: 25954 - DNA, 75 bp, Artificial Sequence
  Synthetic
gctgtgctgttatactttgctaggcaaaatggtgttttaagacttgggtatcagccagtaccaccacttgcaaca

SEQ ID NO: 25955 - DNA, 75 bp, Artificial Sequence
  Synthetic
tctgaagcaaaagccaaagaggcaattggcatgatgttacagctgcagtcattacaaaagtcagcctatgcatct

SEQ ID NO: 25956 - DNA, 75 bp, Artificial Sequence
  Synthetic
gaaaagtggactttggtggataccagcatagagacctttaaaaatactccagaaaatcattttaaaaaaggacct

SEQ ID NO: 25957 - DNA, 75 bp, Artificial Sequence
  Synthetic
gtaaatgtggaagtgatttatgatggtgaccctgacaatgcaaatttgtatacaatgtggaaatatgtgtattat

SEQ ID NO: 25958 - DNA, 75 bp, Artificial Sequence
  Synthetic
ttggactctgaggacagatggcaaaaaactgaaagtggggcaaatcatacaggcatttattatactataaaggat

SEQ ID NO: 25959 - DNA, 75 bp, Artificial Sequence
  Synthetic
ttcaagcattactatactttgtttgctgacgatgcaaaaaaatatggtaaatctggccagtgggaggtcagaatt

SEQ ID NO: 25960 - DNA, 75 bp, Artificial Sequence
  Synthetic
aataaggaaactgtgtttgctcctgttactagctccacgccgccagaatccccaggacgagaaagagcttcccca

SEQ ID NO: 25961 - DNA, 75 bp, Artificial Sequence
  Synthetic
gagtccaccgctcacaccaagaccaccgcccgttccagcgcctcccccgaccacgaactcccacaacaaaccagt

SEQ ID NO: 25962 - DNA, 75 bp, Artificial Sequence
  Synthetic
gacgaaaccaaccgaaagcggaggtacggaaggcgagaatcaagtcccacagagtccaaacgaaagcgacgacgg

SEQ ID NO: 25963 - DNA, 75 bp, Artificial Sequence
  Synthetic
tcctcgtccaggcaaaagaagcaagggcgaaggtcgcggtccagaacaacatcctctcaatctcgatctcggtcg

SEQ ID NO: 25964 - DNA, 75 bp, Artificial Sequence
  Synthetic
cgatcctcttcctctagaggatcaagggggtcacggggacgaacccccagagggaggggaaaacacacaacccgg

SEQ ID NO: 25965 - DNA, 75 bp, Artificial Sequence
  Synthetic
ggcagggggagagggagtggaaggaaaggtgacagaaggggaaggagaagtcgaaggtcatcctcctcttcctcc

SEQ ID NO: 25966 - DNA, 75 bp, Artificial Sequence
  Synthetic
cccaccatctgcaccagatcagcctcacaaacccgatcaaaacaatccaagtgtgctagggacggtggcatatct

SEQ ID NO: 25967 - DNA, 75 bp, Artificial Sequence
  Synthetic
cctggggacgtgggaagatcagttcagacagttagtggacgaaatacagggagacttggaagattattggaagaa

SEQ ID NO: 25968 - DNA, 75 bp, Artificial Sequence
  Synthetic
gctcgcgatcccccagtaattttaattagaggggaagcaaatacagtaaaatgctttaggaatcgggcaaaacaa

SEQ ID NO: 25969 - DNA, 75 bp, Artificial Sequence
  Synthetic
aagtataaaggcttatgcaaggcatttagcacaacatggtcatgggttgccgcagatggcacagagcgtctaggc

SEQ ID NO: 25970 - DNA, 75 bp, Artificial Sequence
  Synthetic
aggtccagagtgctcgtaagttttaccagccatacacagcgcagctcttttttaaaggtagttaagtttccaaaa

SEQ ID NO: 25971 - DNA, 75 bp, Artificial Sequence
  Synthetic
ggagtagattggtctttaggcaacttagataaactataatactaacttgcttttgctactaacatataaccaagc

SEQ ID NO: 25972 - DNA, 75 bp, Artificial Sequence
  Synthetic
tttctttgtttttgtatattcttgcaatggtgcgtgccaaaagaacaaagagagattctgcaactaatatttaca

SEQ ID NO: 25973 - DNA, 75 bp, Artificial Sequence
  Synthetic
gaacatgcaagcaggcgggaacttgtcccactgatgtcattaataaagtggaacaaacaaccattgctgacaata

SEQ ID NO: 25974 - DNA, 75 bp, Artificial Sequence
  Synthetic
ttttaagatatggcagtgctggtgtgttctttggtggccttggaatcagtaccggccgtggtacaggaggtgcaa

SEQ ID NO: 25975 - DNA, 75 bp, Artificial Sequence
  Synthetic
ctggatacgtccccttaagtgaagggcctgtaagagtgggtagtacacccactgtagttaggcctgctttggttc

SEQ ID NO: 25976 - DNA, 75 bp, Artificial Sequence
  Synthetic
ctgaagttattgggcctgcagaattgctacccgtagataccatagctcctgtagaaccatcctcatcttcaattg

SEQ ID NO: 25977 - DNA, 75 bp, Artificial Sequence
  Synthetic
ttccattaacagaaacttctggtgtagatttattaccaggagaaattgaatctattgcagaagtacatcctgtac

SEQ ID NO: 25978 - DNA, 75 bp, Artificial Sequence
  Synthetic
ctgatgttgccagttttgatacaccagttgttaccaccagtaaaggttccagtgcaattttagaagttgctcccg

SEQ ID NO: 25979 - DNA, 75 bp, Artificial Sequence
  Synthetic
atccaactcctcctacacgtgtacgtgtaagcagaacacaatatcataatccttcttttcaaattatgacagagt

SEQ ID NO: 25980 - DNA, 75 bp, Artificial Sequence
  Synthetic
ctacacctacacaaggtgaaagttctctatctgatcaaatttttgtggcttctggttctggtggacagtcagtag

SEQ ID NO: 25981 - DNA, 75 bp, Artificial Sequence
  Synthetic
gtagagctgaagaaatcgagttgcaagaattccctagtagatattcatttgaaatagaaacacctactccaccaa

SEQ ID NO: 25982 - DNA, 75 bp, Artificial Sequence
  Synthetic
ggagaagtagcactcctttacaaagacttagacaagctgtaaggggcagatctttaacaaatagacggttaatac

SEQ ID NO: 25983 - DNA, 75 bp, Artificial Sequence
  Synthetic
aacaagtaaatgtagaagatcctttgtttttatcacagccatctaaattggttagattttcttttgataatccag

SEQ ID NO: 25984 - DNA, 75 bp, Artificial Sequence
  Synthetic
catttgaagaagaagtgacacagcaatttgagcaagatttagatgattttatagaaccaccaaacagagattttc

SEQ ID NO: 25985 - DNA, 75 bp, Artificial Sequence
  Synthetic
ttgatattcaaactctcagtaggcctcaatattctgaaactcctgcaggatatattagagtaagcagattgggaa

SEQ ID NO: 25986 - DNA, 75 bp, Artificial Sequence
  Synthetic
aacgagccactattcgtacacgctcgggggcccaaattgggtcacaggtacacttttataaagatctcagttcca

SEQ ID NO: 25987 - DNA, 75 bp, Artificial Sequence
  Synthetic
ttgatactgaagcacctattgaattagatttactgggacaacgttctggtgatgccactatagttcaagggactg

SEQ ID NO: 25988 - DNA, 75 bp, Artificial Sequence
  Synthetic
tagaaagcacatttatagatgtcaatgttgatgacaatcctttatcagagttggaatcataccctgaggcacata

SEQ ID NO: 25989 - DNA, 75 bp, Artificial Sequence
  Synthetic
cagaggatgcattattagatgaagcagtagaagatttcagtggttctcaattggtaattggcaatagaagatcta

SEQ ID NO: 25990 - DNA, 75 bp, Artificial Sequence
  Synthetic
cctctacttacacagtacctcgctttgaaaccccaagaaatgctacatattacacacaagacttaaaaggttatt

SEQ ID NO: 25991 - DNA, 75 bp, Artificial Sequence
  Synthetic
atgtatcatatccagaatctagagatgatttgcaaattatttatccctctccagatctcccagcagttgtaattc

SEQ ID NO: 25992 - DNA, 75 bp, Artificial Sequence
  Synthetic
atacatatgataatagtggggatttttatttacacccaagtttactacggagacgcagacgcaaacgtaaatatt

SEQ ID NO: 25993 - DNA, 75 bp, Artificial Sequence
  Synthetic
tgtgatttttacagatgtcggtgtggttacctgccagtggtaaggtatatttgccaccttcaacaccagttgcca

SEQ ID NO: 25994 - DNA, 75 bp, Artificial Sequence
  Synthetic
gagtacaaagcacggatgaatatgtacaaaggaccaatattttctatcatgcatatagtgacagattattaacag

SEQ ID NO: 25995 - DNA, 75 bp, Artificial Sequence
  Synthetic
taggtcacccatattacaatgtttacaataataatggaacagtattggaagtaccaaaggtttcaggtaatcagc

SEQ ID NO: 25996 - DNA, 75 bp, Artificial Sequence
  Synthetic
acagggtgtttagattgaaattaccagacccaaataggtttgcattagctgatatgtctgtttataacccggaaa

SEQ ID NO: 25997 - DNA, 75 bp, Artificial Sequence
  Synthetic
aggaaaggttagtttgggcctgtagaggcttggaaatagggcggggccaacctttaggtgttggtactactgggc

SEQ ID NO: 25998 - DNA, 75 bp, Artificial Sequence
  Synthetic
atccattatttaataaggtaaatgatacagaaaatcctttaaattacagaactcaggcattttctactgatgata

SEQ ID NO: 25999 - DNA, 75 bp, Artificial Sequence
  Synthetic
gacaaaacctatcatttgatccaaaacaaatacaaatgttcataataggttgcacaccatgtgtaggtgaacact

SEQ ID NO: 26000 - DNA, 75 bp, Artificial Sequence
  Synthetic
gggatgttgcacctaaatgtgatggagccaatgaccaaaatgggatttgcccacctatacaattagtaaacactg

SEQ ID NO: 26001 - DNA, 75 bp, Artificial Sequence
  Synthetic
ttattcaagatggggatatggcagatatcgggtatggtaatcttaattttaaggctttgcaggaaaatagatctg

SEQ ID NO: 26002 - DNA, 75 bp, Artificial Sequence
  Synthetic
atgttagtcttgacattgttaatgaaacctgcgaatatcctgattttttaaagatgcaaaatgatgtttatgggg

SEQ ID NO: 26003 - DNA, 75 bp, Artificial Sequence
  Synthetic
attcttgctttttttttgctcgcagagagcaatgttatgccagacacttttttgtaagaggtggcaacgtaggag

SEQ ID NO: 26004 - DNA, 75 bp, Artificial Sequence
  Synthetic
atgacattcctggtgaacaaatagacgcaggcacatataaaaatgatttttacattccaggagcaacaggtcaga

SEQ ID NO: 26005 - DNA, 75 bp, Artificial Sequence
  Synthetic
cacaaaataaaataggtaactccatgtatttcccaacagttagtggctcattagtgtctagtgatgctcagttgt

SEQ ID NO: 26006 - DNA, 75 bp, Artificial Sequence
  Synthetic
ttaataggcccttctggctccaacgcgcacaaggtcataataatggtatttgttgggcaaaccaattgtttatta

SEQ ID NO: 26007 - DNA, 75 bp, Artificial Sequence
  Synthetic
cagttgtagacaacacaagaaacacaaacttcagtattagtgtttatacagaccctgggaaaataagggatataa

SEQ ID NO: 26008 - DNA, 75 bp, Artificial Sequence
  Synthetic
atgattatgatgctaacaaatttagagaatatcaaagacatgtggaagaatatgaaatttccttgatattacaat

SEQ ID NO: 26009 - DNA, 75 bp, Artificial Sequence
  Synthetic
tatgtaaaatacctttaaaatcagaagtactggctcaaataaatgcaatgaacccctcactgctagaggaatggc

SEQ ID NO: 26010 - DNA, 75 bp, Artificial Sequence
  Synthetic
aattagggtttgtcccaactccagacaatccgttacagagtacttatcgatatattaatagtttagctacaccat

SEQ ID NO: 26011 - DNA, 75 bp, Artificial Sequence
  Synthetic
gtcccgataaggttccaccaaaggaaaaggaagatccttatgcaccgtatacattttggaatgtagatttaactg

SEQ ID NO: 26012 - DNA, 75 bp, Artificial Sequence
  Synthetic
aaagattatcattagatctagatcaatactccttagggcgcaaatttctgtatcaggcaaatcttgtacaatcac

SEQ ID NO: 26013 - DNA, 75 bp, Artificial Sequence
  Synthetic
cagctaaacggtcatcatctatttctcgaggaactaaaagaaaaagaagcaaataattttaccacttttggtaca

SEQ ID NO: 26014 - DNA, 75 bp, Artificial Sequence
  Synthetic
ataaagagtatatcaaacagtattccaagaatgcttgtattcatatgtctgactaatttgaactttggctagaat

SEQ ID NO: 26015 - DNA, 75 bp, Artificial Sequence
  Synthetic
gtgaaccgcgcccgatacagatagataacatcttgcaaccacagcagagacaatgagaaccttgtaggttccaac

SEQ ID NO: 26016 - DNA, 75 bp, Artificial Sequence
  Synthetic
acgctcggatttggcgcatcctaccacatttggcgccttttctgctggcaagaaaactgcaccgttaacggtaag

SEQ ID NO: 26017 - DNA, 75 bp, Artificial Sequence
  Synthetic
acatttggcgccttttctgctggcaagaaaactgcaccgttaacggtaagttttttgtttatgtaccaggcaaga

SEQ ID NO: 26018 - DNA, 75 bp, Artificial Sequence
  Synthetic
ttgtaccaggtgcggtacgatttcccaatagcacattatactagattgttgttgccaactaccatcatcagtttc

SEQ ID NO: 26019 - DNA, 75 bp, Artificial Sequence
  Synthetic
aagtttttgcctgtatcgttttcgtatcatactaattctgtatataattaaataaataaataaatatatatatat

SEQ ID NO: 26020 - DNA, 75 bp, Artificial Sequence
  Synthetic
atatatataatgtataaggcttggttcttttgcaatgtgattgggacaaatggcacagcaggccgatcagcagac

SEQ ID NO: 26021 - DNA, 75 bp, Artificial Sequence
  Synthetic
agtgacagacagtacgcctgagctgcccacaactattaaagagttagctgaccttttagatatacctttagttga

SEQ ID NO: 26022 - DNA, 75 bp, Artificial Sequence
  Synthetic
ctgtttggtaccttgcaatttttgcggaaagttcttagattttctggaagtgtgtgattttgacaaaaagcagct

SEQ ID NO: 26023 - DNA, 75 bp, Artificial Sequence
  Synthetic
aacactaatttggaaaggtcattttgttactgcttgctgtcgaagttgttgcgcagctactgcaatatatgaatt

SEQ ID NO: 26024 - DNA, 75 bp, Artificial Sequence
  Synthetic
taatgaattttatcaacaaacagtgctaggtagagatatagagcttgctactggaaaatctatatttgacttaaa

SEQ ID NO: 26025 - DNA, 75 bp, Artificial Sequence
  Synthetic
gataaggtgtcagacgtgcttgtcatttttagatacaattgaaaagttagacagctgtggtcggggccttccgtt

SEQ ID NO: 26026 - DNA, 75 bp, Artificial Sequence
  Synthetic
ccacaaggttagagacaggtggaagggaatttgcagacagtgcaagcatttgtatctgaataatgatcggtaaag

SEQ ID NO: 26027 - DNA, 75 bp, Artificial Sequence
  Synthetic
aggtcaccgtgcaagattttaccttggagcttagtgagctgcagcctgaagtgttaccagttgacctgctttgtg

SEQ ID NO: 26028 - DNA, 75 bp, Artificial Sequence
  Synthetic
aagaggaattaccaaacgagcaggaaacggaggaggagtcagatatcgacaggactgtattcaaaatcattgcac

SEQ ID NO: 26029 - DNA, 75 bp, Artificial Sequence
  Synthetic
cgtgtggctgcagctcctgtgaggtcaaccttcgtatttttgtcaacgcaactgatactggcattaggaccctac

SEQ ID NO: 26030 - DNA, 75 bp, Artificial Sequence
  Synthetic
aggacctgctgatcagtgacctgcagctgctgtgcccagagtgccgtggtaactgcaaacatggcggattctaaa

SEQ ID NO: 26031 - DNA, 75 bp, Artificial Sequence
  Synthetic
ggtagtacctctaaagaagggttaagtgattggtgtattttggaagcagaatgtagtgatttagagaatgatttt

SEQ ID NO: 26032 - DNA, 75 bp, Artificial Sequence
  Synthetic
gaacagttatttgagcaagatacagactccgatgtatcggacttgctagataatggtgaacttgaacaggggaat

SEQ ID NO: 26033 - DNA, 75 bp, Artificial Sequence
  Synthetic
tctctggaactatttcatcaacaagagtgtgagcaaagcgaggagcaattacaaattctaaaacgaaagtatctt

SEQ ID NO: 26034 - DNA, 75 bp, Artificial Sequence
  Synthetic
agtccaaaagctgtcgcgcagcttagtccgcgtctcgagtcgatatcgttgtcacctcagcagaaatcgaaacga

SEQ ID NO: 26035 - DNA, 75 bp, Artificial Sequence
  Synthetic
aggctctttgcagagcaggacagcggactcgagctatctctaaacaatgaagctgaagatgtttctcctgaggtg

SEQ ID NO: 26036 - DNA, 75 bp, Artificial Sequence
  Synthetic
gaggtaccggctatagactctcggccggtagatgagggaggatcaggggccatagatattgattatctgtcattg

SEQ ID NO: 26037 - DNA, 75 bp, Artificial Sequence
  Synthetic
ctgcgtagtagcaatattaaagccacgttaatggcaaaattcaaagagtcatttggggtaggctttaatgaattg

SEQ ID NO: 26038 - DNA, 75 bp, Artificial Sequence
  Synthetic
atttggggtaggctttaatgaattgactcgccagtttaaaagttacaaaacctgttgtaacgattgggttttagc

SEQ ID NO: 26039 - DNA, 75 bp, Artificial Sequence
  Synthetic
tgtgtatgcagttcatgatgatctatttgaaagctcaaagcagctgttgcaacagcattgtgactatatctgggt

SEQ ID NO: 26040 - DNA, 75 bp, Artificial Sequence
  Synthetic
ccgtgggataggagctatgacactttacctattgtgtttcaaagcgggaaaaaatcgcggtactgtgcataagtt

SEQ ID NO: 26041 - DNA, 75 bp, Artificial Sequence
  Synthetic
aatgacatcaatgctaaatgtgcaagaacagcagattttgtctgagcctcctaagttaagaaatacagctgctgc

SEQ ID NO: 26042 - DNA, 75 bp, Artificial Sequence
  Synthetic
attgttctggtacaaaggtggtatggggtcaggcgcatttacccatggcacatatcctgattggattgcacatca

SEQ ID NO: 26043 - DNA, 75 bp, Artificial Sequence
  Synthetic
aacaattttgggccatcaaaatgctgaagcaagcacatttgatttttcagccatggtccaatgggccttcgataa

SEQ ID NO: 26044 - DNA, 75 bp, Artificial Sequence
  Synthetic
taattacttagaagaaccagatatagcttatcaatatgccaagcttgcaccagaagatagcaatgcagtagcatg

SEQ ID NO: 26045 - DNA, 75 bp, Artificial Sequence
  Synthetic
gctagcacataatcaacaagctaaatttgtaagagagtgtgcagcaatggtacggttttataaaaaaggacaaat

SEQ ID NO: 26046 - DNA, 75 bp, Artificial Sequence
  Synthetic
gaaagaaatgagtatgtcagagtggatacacacaaaaattaatgaagtagaaggtgaagggcattggtcagatat

SEQ ID NO: 26047 - DNA, 75 bp, Artificial Sequence
  Synthetic
agtaaaatttttaagatatcaagatgtaaactttattacctttttggcagcatttaaaaactttttgcatgctgt

SEQ ID NO: 26048 - DNA, 75 bp, Artificial Sequence
  Synthetic
accaaaacacaattgtattcttatatatgggccccctaactctggaaagtcatcatttgcaatgtcactgataaa

SEQ ID NO: 26049 - DNA, 75 bp, Artificial Sequence
  Synthetic
agttttaaaaggtagagtgttgtcatttgtgaattccaaaagtcaattttggttacaacctcttggagaaagtaa

SEQ ID NO: 26050 - DNA, 75 bp, Artificial Sequence
  Synthetic
aattgcattgttggatgatgttacagacccttgctgggtatatatagacacatatttaagaaatggcttagacgg

SEQ ID NO: 26051 - DNA, 75 bp, Artificial Sequence
  Synthetic
ccattttgtttctttagattgtaaatataaagcgcccgtacaaattaagtttcctccattgttactcacatctaa

SEQ ID NO: 26052 - DNA, 75 bp, Artificial Sequence
  Synthetic
tattaatgttcatggagaaacaaattatagatatttacatagtaggataaagggatttgaatttccacatccctt

SEQ ID NO: 26053 - DNA, 75 bp, Artificial Sequence
  Synthetic
tcctatgaaaccagacaatacacctcagtttcagttaactgaccaaagctggaaatctttttttgaaaggctttg

SEQ ID NO: 26054 - DNA, 75 bp, Artificial Sequence
  Synthetic
ggaaatctttttttgaaaggctttggacacaattagacctgagtgaccaagaagaggagggccaacatggagaat

SEQ ID NO: 26055 - DNA, 75 bp, Artificial Sequence
  Synthetic
ctcagcgagcgtttcaatgttctgcaagatcagctaatgaacatatatgaagctgcagaacatacacttgagaca

SEQ ID NO: 26056 - DNA, 75 bp, Artificial Sequence
  Synthetic
cagattgcccattggacacttttgcgaagagaagctgttttgctttattatgctaggcaaaagggtattacaagg

SEQ ID NO: 26057 - DNA, 75 bp, Artificial Sequence
  Synthetic
cttggataccaaccggtgcctacattggcagtttctgaagcaaaagcaaaagaggctatagggataatgctgcaa

SEQ ID NO: 26058 - DNA, 75 bp, Artificial Sequence
  Synthetic
ttgcaatctctacagaagtctgagtatgcttcggagaactggacattagtggacacaagtgcagaaacgtataac

SEQ ID NO: 26059 - DNA, 75 bp, Artificial Sequence
  Synthetic
aatgttccagaacatcactttaaaaagggtccagtgcctgtggaggtcatttatgataaggagccagaaaatgca

SEQ ID NO: 26060 - DNA, 75 bp, Artificial Sequence
  Synthetic
aatgtgtatacaatgtggaagtatgtgtattatatggacccagaggatgtatggcataaaaccacaagtggtgta

SEQ ID NO: 26061 - DNA, 75 bp, Artificial Sequence
  Synthetic
aatcagacgggcatttactatttacatggagactttaaacactattatgtactttttgctgatggtgcacgaatg

SEQ ID NO: 26062 - DNA, 75 bp, Artificial Sequence
  Synthetic
tatagtaaaactggacaatgggaagttaaggttaataaggaaactgtgtttgctcctgtcaccagctccacacca

SEQ ID NO: 26063 - DNA, 75 bp, Artificial Sequence
  Synthetic
cccgggtcaccaggacaaagagacccagacgccaccagcaagacccccgccacctcctccgactccacgaccaga

SEQ ID NO: 26064 - DNA, 75 bp, Artificial Sequence
  Synthetic
tccagtgacaaacagtcacaacaagccgaccccaggaggaaaggatacggacgacgaccatctagcagaacaagg

SEQ ID NO: 26065 - DNA, 75 bp, Artificial Sequence
  Synthetic
cgacaggaaacgcagcaaaggcgatcaaggtcgcgataccgctcccagtctaactcccggtcgcgctcccagtcc

SEQ ID NO: 26066 - DNA, 75 bp, Artificial Sequence
  Synthetic
caaaccagggcccttggcgccacctccgtatccaggtcctccaggtccccgtcggtcacacagattaggaaccgg

SEQ ID NO: 26067 - DNA, 75 bp, Artificial Sequence
  Synthetic
aggtcgcgatcgcaatccagaggaagggggggtcgagggtcatccaccgacaccaccactaagcggcggagatcc

SEQ ID NO: 26068 - DNA, 75 bp, Artificial Sequence
  Synthetic
agatcatcctcctccaacaccagaaaacggtcacaacggggagaaagaggacggggagaaaggggcggtaggggg

SEQ ID NO: 26069 - DNA, 75 bp, Artificial Sequence
  Synthetic
aagcgacgagaccgatcatcctccacctcccccaccccaaaacgatcccgagcagggtctaggtctagcaggcaa

SEQ ID NO: 26070 - DNA, 75 bp, Artificial Sequence
  Synthetic
cgtggcgtgtctcctgagcaagtgggaagatctcttcaatctgttagttcaaaacatagaggacgacttgggaga

SEQ ID NO: 26071 - DNA, 75 bp, Artificial Sequence
  Synthetic
ttattggaagaagctctcgaccccccagtgatcatttgcaaagggggggcaaacacgctaaaatgctttcgcaac

SEQ ID NO: 26072 - DNA, 75 bp, Artificial Sequence
  Synthetic
agagctagacacaaatatacagggctgtttaaggcttttagcacaacatggtcatgggtggctggagatagcact

SEQ ID NO: 26073 - DNA, 75 bp, Artificial Sequence
  Synthetic
gagcgtctaggcaggcccagaatgctcattagctttacttcaactaatcagagaaaggattttgatgagactgtg

SEQ ID NO: 26074 - DNA, 75 bp, Artificial Sequence
  Synthetic
aaatatccgaagggagttgaaactgcatatggcaacttagacagcctataacataactaactttgctttgctact

SEQ ID NO: 26075 - DNA, 75 bp, Artificial Sequence
  Synthetic
aaccacactaacaatttttttacatttatttttacgtttttattattgctatggcgcgtgctaagcgggtcaagc

SEQ ID NO: 26076 - DNA, 75 bp, Artificial Sequence
  Synthetic
ttatttttacgtttttattattgctatggcgcgtgctaagcgggtcaagcgagactctgttactcatatatatca

SEQ ID NO: 26077 - DNA, 75 bp, Artificial Sequence
  Synthetic
aacctgcaaacaagcaggcacttgcccccctgatgttctcaataaagtggagcaaacaacagttgctgacaatat

SEQ ID NO: 26078 - DNA, 75 bp, Artificial Sequence
  Synthetic
tttgaaatatggtagtggtggtgtcttttttggaggcctcggtattggtaccggtcgcggtactggaggtgtcac

SEQ ID NO: 26079 - DNA, 75 bp, Artificial Sequence
  Synthetic
tggatacagacctctacctgaagggcccggtatccgtgttggagggactcccacggttgtaaggccttcacttgt

SEQ ID NO: 26080 - DNA, 75 bp, Artificial Sequence
  Synthetic
tcctgaatctgtgggtccagcagatatattaccaatagacactatcgatcctgtggagcccactgcttcctcggt

SEQ ID NO: 26081 - DNA, 75 bp, Artificial Sequence
  Synthetic
agttccattaactgaatcctcagcaactgatctacttccaggagaagttgagacaatagctgagattaatcctgt

SEQ ID NO: 26082 - DNA, 75 bp, Artificial Sequence
  Synthetic
ttcagagggccctacgattgattcacctgttgtgacaacaagcagaggctccagtgcaatattggaagttgcacc

SEQ ID NO: 26083 - DNA, 75 bp, Artificial Sequence
  Synthetic
agaccctatacctccaacacgtgttagagtggcacgcacacagtaccataatcctgcttttcaaattataacaga

SEQ ID NO: 26084 - DNA, 75 bp, Artificial Sequence
  Synthetic
gtccacacctgctcaaggtgaaacatctttggcagaccacatcctggtcacatctggctcaggaggtcaaactat

SEQ ID NO: 26085 - DNA, 75 bp, Artificial Sequence
  Synthetic
aggtagtgacataacagacattattgaattacaggaaatacccagtagatactcctttgaaatagaagagccaac

SEQ ID NO: 26086 - DNA, 75 bp, Artificial Sequence
  Synthetic
ccccccccggcaaagcagcactccacttcagaggacacaaaccactggccgacgtagaggagtgtccctaacaaa

SEQ ID NO: 26087 - DNA, 75 bp, Artificial Sequence
  Synthetic
tagaaggctagtacaacaagtgcaagttgataatcctttatttatagataaaccttctaagttagtacgcttttc

SEQ ID NO: 26088 - DNA, 75 bp, Artificial Sequence
  Synthetic
atttgataaccctgtatttgaggaggatataacaaatatttttgaacaggacttagaaacatttgaggagccacc

SEQ ID NO: 26089 - DNA, 75 bp, Artificial Sequence
  Synthetic
tgatagggatttccttgatattaaaaagctaagtcgacctcaatactctacaacacctgctggatatgttagggt

SEQ ID NO: 26090 - DNA, 75 bp, Artificial Sequence
  Synthetic
cagtaggctaggcacgcggggtaccattcgcacacgttccggagctcaaataggatcacaggttcatttttatag

SEQ ID NO: 26091 - DNA, 75 bp, Artificial Sequence
  Synthetic
agacttaagttctattgattcagaagaccctattgagctacaattattaggccaacattcaggtgatgcaaccat

SEQ ID NO: 26092 - DNA, 75 bp, Artificial Sequence
  Synthetic
agtgcaaggcactgttgaaagtacatttgtagatatggacatagcggaagatcctttgtctgaaagtattgaggc

SEQ ID NO: 26093 - DNA, 75 bp, Artificial Sequence
  Synthetic
tcattctgatgacctattacttgatgaagctgtggaggattttagcgggtcacaattagttattggaaacagacg

SEQ ID NO: 26094 - DNA, 75 bp, Artificial Sequence
  Synthetic
cagcacaacatcatacactgtgccccgttttgaaactacaaggagcagttcttattatgtgcaagatacacaagg

SEQ ID NO: 26095 - DNA, 75 bp, Artificial Sequence
  Synthetic
ttattatgtggcttatcctgaacatagaaatactgcagaaatcatttatccaacaccagatatacctgtggtagt

SEQ ID NO: 26096 - DNA, 75 bp, Artificial Sequence
  Synthetic
tatacatacacatgataatagtggtgacttttatttacatcctagcctgcggaggcgcaagcgtaaaagaaaata

SEQ ID NO: 26097 - DNA, 75 bp, Artificial Sequence
  Synthetic
tttgtgatttacttgcagatggctgtgtggcaagcggcccatggtaaggtctatctaccaccatcaacaccagtg

SEQ ID NO: 26098 - DNA, 75 bp, Artificial Sequence
  Synthetic
gccagggtgcaaagcacggatgaatacattcaaaggactaacatctactatcacgccaatactgacagactactc

SEQ ID NO: 26099 - DNA, 75 bp, Artificial Sequence
  Synthetic
actgtaggacatccatatttcaatgtttatgataacactggtaaaaaattggaggttcctaaagtgtcaggaaat

SEQ ID NO: 26100 - DNA, 75 bp, Artificial Sequence
  Synthetic
caacacagagtatttcgcctcaaattgccagatccaaacagatttgctttagctgacatgtctgtatataatcct

SEQ ID NO: 26101 - DNA, 75 bp, Artificial Sequence
  Synthetic
gatagggaaaggttggtctgggcctgcagaggattggaaataagtaggggtcagcctttaggcgttggaagtact

SEQ ID NO: 26102 - DNA, 75 bp, Artificial Sequence
  Synthetic
ggacatccctattttaacaaaattaaagacacggaaaactcaaataactatgccacaggcagtaaggatgataga

SEQ ID NO: 26103 - DNA, 75 bp, Artificial Sequence
  Synthetic
cagaacacatcatttgatcctaaacaaatccaaatgtttatagtgggctgtacaccttgtgtgggagaacactgg

SEQ ID NO: 26104 - DNA, 75 bp, Artificial Sequence
  Synthetic
gagaaagccttaccctgcggggatgcaccagctgaaaatggtgtttgccctcccatagagttaaagaacactttc

SEQ ID NO: 26105 - DNA, 75 bp, Artificial Sequence
  Synthetic
attgaagatggtgacatggcagatattggttttggcaacatgaattttaaaacattgcaacaaaacagatctgat

SEQ ID NO: 26106 - DNA, 75 bp, Artificial Sequence
  Synthetic
gtcagccttgacatagtgaatgaaacttgcaaatatccagattttttgaaaatgcaaaacgatgtatatggagat

SEQ ID NO: 26107 - DNA, 75 bp, Artificial Sequence
  Synthetic
gcttgctttttttatgctcgtagagagcagtgttatgccagacatttctttgtgagaggaggtaaaacaggtgat

SEQ ID NO: 26108 - DNA, 75 bp, Artificial Sequence
  Synthetic
gacattcctgacgcacaaattgatgatggcaatatgaaaaatcagtattacattcctggagctcaggatcaatct

SEQ ID NO: 26109 - DNA, 75 bp, Artificial Sequence
  Synthetic
caaaaggatataggtaatgcgatgtatttcccaactgtaagtggctcattagtttctagtgatgctcagttgttt

SEQ ID NO: 26110 - DNA, 75 bp, Artificial Sequence
  Synthetic
aataggcccttctggcttcaaagagcacagggtcataataatggcatcctgtgggctaatcagatgtttgtcaca

SEQ ID NO: 26111 - DNA, 75 bp, Artificial Sequence
  Synthetic
gttgtagacaatacacgaaacaccaatttcagtatatctatttacagtgataatcaaaatgtacacgacattcca

SEQ ID NO: 26112 - DNA, 75 bp, Artificial Sequence
  Synthetic
aattatgattctcaaaaatttagagaatatttaagacatgtagaggaatatgaaatttctcttattttacaatta

SEQ ID NO: 26113 - DNA, 75 bp, Artificial Sequence
  Synthetic
tgtaaagttcctttaaaggcagaagtgttagcacagataaatgcaatgaactcttctttgctggaggactggcaa

SEQ ID NO: 26114 - DNA, 75 bp, Artificial Sequence
  Synthetic
ttaggcttcgtgccaactcctgacaatcctattcatgacacatacagatatatcgaatctctggctactaggtgc

SEQ ID NO: 26115 - DNA, 75 bp, Artificial Sequence
  Synthetic
cctgataaaaatcctccaaaagaaaagccggacccttatgatggcttaagtttttggactgtagatatgactgag

SEQ ID NO: 26116 - DNA, 75 bp, Artificial Sequence
  Synthetic
agactttctttagacctggatcagtattccttagggcgcaagttcttattccaggctggcctccaacaaacgacc

SEQ ID NO: 26117 - DNA, 75 bp, Artificial Sequence
  Synthetic
gttaacggtacaacaaaatcatcaagctatagaagttccataagggggaccaaaagaaaacgcaaaaactaaatg

SEQ ID NO: 26118 - DNA, 75 bp, Artificial Sequence
  Synthetic
taccgaatttggtacaattacctcaacttttgcacagtattcaaggaatgtttgtttactctgactaagtctaac

SEQ ID NO: 26119 - DNA, 75 bp, Artificial Sequence
  Synthetic
tctaccaaggaaacagaccgcgcccggtacataaaggtgagttggtgccaaattagtctcactttgttgccagaa

SEQ ID NO: 26120 - DNA, 75 bp, Artificial Sequence
  Synthetic
cataccgtgttcgtcctaacatgctcggattaggtcgaccgccaaaggacctttggtttgccaaatagcttacag

SEQ ID NO: 26121 - DNA, 75 bp, Artificial Sequence
  Synthetic
acctttggtttgccaaatagcttacagcagctcagttctggcacatttgtggaccgataacggtaagtctcattc

SEQ ID NO: 26122 - DNA, 75 bp, Artificial Sequence
  Synthetic
aacggtaagtttcatcagtgtaccaggtgcggtatgaaaatttcttaatcataagttgttattgccaacaaccat

SEQ ID NO: 26123 - DNA, 75 bp, Artificial Sequence
  Synthetic
cgtctatagcatgtttttgcctgtatcgttttcgatcacaccatattgtatattaaataaataaataaatatata

SEQ ID NO: 26124 - DNA, 75 bp, Artificial Sequence
  Synthetic
tatatattgttacaatgctgtgacttgtgcaattttcctaagcaaatggacgggcaggacaaggcttcatattta

SEQ ID NO: 26125 - DNA, 75 bp, Artificial Sequence
  Synthetic
gacactaataaggacgagctaccctctactattaaagagttagctgcggctttaggtattccattgcaggactgt

SEQ ID NO: 26126 - DNA, 75 bp, Artificial Sequence
  Synthetic
tcagtaccgtgcaacttttgtggtaactttttggatttcttagaactgtgtgagtttgacaaaaagagactgtgc

SEQ ID NO: 26127 - DNA, 75 bp, Artificial Sequence
  Synthetic
ctaatttggaaaaattacgttgttactgcgtgttgtcgttgttgttgtgtagcaaccgcaacgtttgaatttaat

SEQ ID NO: 26128 - DNA, 75 bp, Artificial Sequence
  Synthetic
gaatattatgagcaaactgtgctaggcagagatattgaattagctacaggacgttcaatttttgagatagacgtt

SEQ ID NO: 26129 - DNA, 75 bp, Artificial Sequence
  Synthetic
aggtgtcaaaactgcttgtcatttttggatatcatagagaaattagattgctgtgggagaggccgtccctttcat

SEQ ID NO: 26130 - DNA, 75 bp, Artificial Sequence
  Synthetic
aaagttagaggaggctggaaaggagtttgcaggctttgtaagcatttgtatcatgattggtaaagaggtcactgt

SEQ ID NO: 26131 - DNA, 75 bp, Artificial Sequence
  Synthetic
gcaagattttgtgttgaagttaagtgagatacaacctgaagtgttaccagttgacctgctttgtgaagaggaatt

SEQ ID NO: 26132 - DNA, 75 bp, Artificial Sequence
  Synthetic
accaaacgaacaggaaacggaggaggagctagacatcgaaagaactgtattcaaaattgttgcaccgtgtggctg

SEQ ID NO: 26133 - DNA, 75 bp, Artificial Sequence
  Synthetic
cagctgctgtcaggtcaagctacgtctttttgtcaacgcaactgattcgggtatcaggacctttcaagaattgct

SEQ ID NO: 26134 - DNA, 75 bp, Artificial Sequence
  Synthetic
gttcagagacctacagcttctgtgtcctgagtgccgcggtaactgcaaacatggcggatcataaaggtagtacat

SEQ ID NO: 26135 - DNA, 75 bp, Artificial Sequence
  Synthetic
ctaaagaagggttaagtgagtggtgtattttggaagctgaatgtagtgatgtagacaatgattttgaacaattat

SEQ ID NO: 26136 - DNA, 75 bp, Artificial Sequence
  Synthetic
ttgagcgagatacagactcagatatttcggacttattagataattgtgacctggatcagggaaattctctggaac

SEQ ID NO: 26137 - DNA, 75 bp, Artificial Sequence
  Synthetic
ttcggacttattagataattgtgacctggatcagggaaattctctggaactatttcatcaacaggagtgtgagca

SEQ ID NO: 26138 - DNA, 75 bp, Artificial Sequence
  Synthetic
gagcgaggagcaattacaaaaactaaaacgaaagtatcttagtcctaaagctgtcgcgcagctcagtccgcggct

SEQ ID NO: 26139 - DNA, 75 bp, Artificial Sequence
  Synthetic
ccagtcaatatcactgtcacctcagcagaaatccaagcgaaggctctttgcagagcaggacagcggagtcgagct

SEQ ID NO: 26140 - DNA, 75 bp, Artificial Sequence
  Synthetic
aactcttaacaatgaagctgaagatgtttctcatgaggtggaggtaccggctatagactctcggccggaagatga

SEQ ID NO: 26141 - DNA, 75 bp, Artificial Sequence
  Synthetic
gggaggatcaggggctttagatattgactatacagcattgttgcggtccagcaacacaaaggccacattaatggc

SEQ ID NO: 26142 - DNA, 75 bp, Artificial Sequence
  Synthetic
aaaatttaaagaggcatttggggatggctttaatgaactaacacgccaatttaaaagttacaaaacttgctgtaa

SEQ ID NO: 26143 - DNA, 75 bp, Artificial Sequence
  Synthetic
ctattgggttgtagctgcttatgcagtgcatgatgtatatgaaagctcaaagcagttattgcaacagcattgtga

SEQ ID NO: 26144 - DNA, 75 bp, Artificial Sequence
  Synthetic
ttatatttgggttagaagtatagctgcaattacattatatctattgtcttttaaggcgggaaaaaatcgcggtac

SEQ ID NO: 26145 - DNA, 75 bp, Artificial Sequence
  Synthetic
tgtgcataaactaatgacctcaatgctaaatgtgcaagagcagcagatattgtctgagcctcctaaattgagaca

SEQ ID NO: 26146 - DNA, 75 bp, Artificial Sequence
  Synthetic
cactgctgctgctttgttttggtataaaggaggaatggggacaggaacattcacgtatggttcataccctgattg

SEQ ID NO: 26147 - DNA, 75 bp, Artificial Sequence
  Synthetic
gattgcacatcaaacaattcttggccatcaaagtgctgaagcaagcacctttgatttttctgtaatggtacaatg

SEQ ID NO: 26148 - DNA, 75 bp, Artificial Sequence
  Synthetic
ggcatttgataataatcattttgaggaggccgacattgcttatggatatgcaaaactagccccagaagatgctaa

SEQ ID NO: 26149 - DNA, 75 bp, Artificial Sequence
  Synthetic
tgctgtagcctggcttgctcataatagccaagctaaatttgtaagagagtgtgcagcaatggttcgattttacaa

SEQ ID NO: 26150 - DNA, 75 bp, Artificial Sequence
  Synthetic
aagggggcaaatgagagaaatgaccatgtctgagtggatatatacaaggatcaatgaggttgaaggagaggggca

SEQ ID NO: 26151 - DNA, 75 bp, Artificial Sequence
  Synthetic
ttggtcttccatagtaaaatttgtaaggtaccagggtataaattttattacatttttagctgccttaaaagattt

SEQ ID NO: 26152 - DNA, 75 bp, Artificial Sequence
  Synthetic
tttgcattccgtacctaagcgaaactgtttgttaatctatggtccacctaatactgggaaatctacatttgctat

SEQ ID NO: 26153 - DNA, 75 bp, Artificial Sequence
  Synthetic
gtcattaatacaggtgctgaagggtagagtattatcatatgtaaattccaaaagccaattttggttacaacctct

SEQ ID NO: 26154 - DNA, 75 bp, Artificial Sequence
  Synthetic
tggtgactgtaaaatagcactgttagatgatgtgacagacccctgctggctgtacatggatacatttctgcgaaa

SEQ ID NO: 26155 - DNA, 75 bp, Artificial Sequence
  Synthetic
tggattagatgggcatgttgtgtcattagattgtaaatataaagcacccatgcaaattaaatttcctcccctttt

SEQ ID NO: 26156 - DNA, 75 bp, Artificial Sequence
  Synthetic
gttaacttccaatattaacctgcatgaggaggctaactatagatatttacatagcagagtcagaggatttgaatt

SEQ ID NO: 26157 - DNA, 75 bp, Artificial Sequence
  Synthetic
tccaaatccttttccaatgaaaccagacaatacacctgaatttgaattaactgaccaaagctggaaatctttttt

SEQ ID NO: 26158 - DNA, 75 bp, Artificial Sequence
  Synthetic
ctgaccaaagctggaaatctttttttgcaaggctttggacacaattagagctgagtgatcaagaagacgagggcg

SEQ ID NO: 26159 - DNA, 75 bp, Artificial Sequence
  Synthetic
aacatggagaatctcagcgagcgtttcaatgttctgcaagatcagctaatgaacatttatgaagctgcagaacaa

SEQ ID NO: 26160 - DNA, 75 bp, Artificial Sequence
  Synthetic
acacttgaggcacagattgcgcattggctgcttttgcgaaaagaagctgtgttgctatatttcgctaggcaaaaa

SEQ ID NO: 26161 - DNA, 75 bp, Artificial Sequence
  Synthetic
ggcatcaccaggattggatatcaacctgtgccgccactagcagtgtctgaagcaaaagccaagcaggctatagga

SEQ ID NO: 26162 - DNA, 75 bp, Artificial Sequence
  Synthetic
ataatgttgcagctgcagtcactacagaaatctgagtttgcagatgagccttggacattagtggacacaagtata

SEQ ID NO: 26163 - DNA, 75 bp, Artificial Sequence
  Synthetic
gagacttataagaatgctccagaaaatcattttaaaaaaggcgccacacctgtggaggtgatatatgataaacag

SEQ ID NO: 26164 - DNA, 75 bp, Artificial Sequence
  Synthetic
cctgacaatgccaatgtatacactatgtggaagcacatttactacactgatgcagacgataagtggcacaaaacc

SEQ ID NO: 26165 - DNA, 75 bp, Artificial Sequence
  Synthetic
accagtggggttaaccagactggcatatactatatgcaaggcagcttcagacattattatgttgtgtttgctgat

SEQ ID NO: 26166 - DNA, 75 bp, Artificial Sequence
  Synthetic
gatgcacgtagatatagtgctactggagaatgggaagtaaaaattaataaggacactgtgtttgctcctgttacc

SEQ ID NO: 26167 - DNA, 75 bp, Artificial Sequence
  Synthetic
agctccaccccccccggatcaccaccaggacaagcagacacagacaccgccgccaagacccccaccacctccgct

SEQ ID NO: 26168 - DNA, 75 bp, Artificial Sequence
  Synthetic
gactccacgtccagacagcagcggtcccctgcaaaacagccacaacaaaccgaaaccaaaggacgaaggtacggg

SEQ ID NO: 26169 - DNA, 75 bp, Artificial Sequence
  Synthetic
agacggccgtccagcagaacaagaccgcaaaaagagcagaggcgatcaaggtcgcgacaccgcaccaggtctcgc

SEQ ID NO: 26170 - DNA, 75 bp, Artificial Sequence
  Synthetic
tcccggtcgctctcccgggttagggccgttggctccaccaccgtatccaggtccaggtcctcgtcgctcaccaag

SEQ ID NO: 26171 - DNA, 75 bp, Artificial Sequence
  Synthetic
gcagttcggccccggtccagatcgcgatccagaggacgggctacagccacctctaggcgaagggcaggtcgaggg

SEQ ID NO: 26172 - DNA, 75 bp, Artificial Sequence
  Synthetic
tcacccaggcgacggcgatcaacctcaaggtcaccctccaccaacaccttcaaacggtcacaaaggggaggaggg

SEQ ID NO: 26173 - DNA, 75 bp, Artificial Sequence
  Synthetic
agacggggaagaggaaggggcagtagggggagacgggaacgatcatcctccacctcccccacccccaccaaacgt

SEQ ID NO: 26174 - DNA, 75 bp, Artificial Sequence
  Synthetic
tcaagaggggagtcttctaggttgcgtggggtctctccttctgaagtgggaagatcagttcaatctgttagtgca

SEQ ID NO: 26175 - DNA, 75 bp, Artificial Sequence
  Synthetic
aaacatacagggcgacttggaagactactggacgaagctatcgaccccccagtaatattggttcgaggggaggca

SEQ ID NO: 26176 - DNA, 75 bp, Artificial Sequence
  Synthetic
aacacattaaaatgctttcgcaacagagctagagttagatatagaggactgttcaaatactttagcaccacgtgg

SEQ ID NO: 26177 - DNA, 75 bp, Artificial Sequence
  Synthetic
tcatgggtggccggcgatagcactgagcgtctaggcaggtccagaatgctcattctgtttacttcagctggccaa

SEQ ID NO: 26178 - DNA, 75 bp, Artificial Sequence
  Synthetic
agaaaggactttgatgagactgtgaaatacccgaagggagttgatacatcttatggtaacctggacagtctataa

SEQ ID NO: 26179 - DNA, 75 bp, Artificial Sequence
  Synthetic
cattactaacgctgccttgctactaacacactaacatattcccatttgctttttactatattttttaattgtata

SEQ ID NO: 26180 - DNA, 75 bp, Artificial Sequence
  Synthetic
ctgctatggcgcgtgctagacgggtcaagagagactctgtcacacacatttatcaaacctgcaaacaggcaggta

SEQ ID NO: 26181 - DNA, 75 bp, Artificial Sequence
  Synthetic
catgcccccctgatgttattaataaagttgagcaaacaacagttgctgacaatattttaaaatatggcagtgctg

SEQ ID NO: 26182 - DNA, 75 bp, Artificial Sequence
  Synthetic
gtgtattttttggaggccttggtataggtaccggccgtggtacagggggtgttactgggtacacgccattaagtg

SEQ ID NO: 26183 - DNA, 75 bp, Artificial Sequence
  Synthetic
aggggcctggtatccgtgttggaaatactcccacagtggtacggccctcacttgttccagaagcggtaggtccta

SEQ ID NO: 26184 - DNA, 75 bp, Artificial Sequence
  Synthetic
tggacatactgccaatcgacactattgaccctgtagagccttcagtctcctctgtggtgccactcactgaatctt

SEQ ID NO: 26185 - DNA, 75 bp, Artificial Sequence
  Synthetic
caggagccgacctacttccaggggaagttgagacaattgctgaaattcaccctgtacctgaaggccccaccattg

SEQ ID NO: 26186 - DNA, 75 bp, Artificial Sequence
  Synthetic
attcacctgtggtgacgacaagcaaagggtcaagtgccattttagaggtggctcctgagccaacccctcctaccc

SEQ ID NO: 26187 - DNA, 75 bp, Artificial Sequence
  Synthetic
gtgtcagagtttcacgtacacaatatcacaacccttcttttcaaatcataactgattccacacctacacaaggag

SEQ ID NO: 26188 - DNA, 75 bp, Artificial Sequence
  Synthetic
aaagttctctagcagaccacattttagtgacttctggctctggaggccagactataggtagtgacataacagatg

SEQ ID NO: 26189 - DNA, 75 bp, Artificial Sequence
  Synthetic
tcatagaactgcaagaatttcctagtaggtattcatttgagattgatgaacctacaccaccacggcaaagtagca

SEQ ID NO: 26190 - DNA, 75 bp, Artificial Sequence
  Synthetic
cacctattgagagacctcaagtagttggtagacgtagaggtatttctttaacaaatagacgactgatacagcagg

SEQ ID NO: 26191 - DNA, 75 bp, Artificial Sequence
  Synthetic
tggctgttgaggatcctttgtttttatcaaaaccttccaaattagtaaggttcagttttgataatcctgtatttg

SEQ ID NO: 26192 - DNA, 75 bp, Artificial Sequence
  Synthetic
aagaggaggtcactaatatatttgagcaagatgtggacatggtcgaggagcctccagatagagattttcttgatg

SEQ ID NO: 26193 - DNA, 75 bp, Artificial Sequence
  Synthetic
ttcggcagctagggcgcccacaatactctactacaccagctggctatgtcagagttagcaggttaggcacacgtg

SEQ ID NO: 26194 - DNA, 75 bp, Artificial Sequence
  Synthetic
gcaccattcgcacacgttctggtgcacaaattgggtcgcaggtacatttttacagggatttaagttcaatcaata

SEQ ID NO: 26195 - DNA, 75 bp, Artificial Sequence
  Synthetic
cagaagatcctatagaactccaactattaggtcaacattctggggattctacaatagtacagggtcctgtggaaa

SEQ ID NO: 26196 - DNA, 75 bp, Artificial Sequence
  Synthetic
gcacttttgtaaatgttgatatttctgaaaatcctttatctgaaagtattcaggcattttcagatgatttactac

SEQ ID NO: 26197 - DNA, 75 bp, Artificial Sequence
  Synthetic
tggatgaaactgtagaggattttagtgggtcccaactggtaataggtaatagaagaagtacaacttcttatactg

SEQ ID NO: 26198 - DNA, 75 bp, Artificial Sequence
  Synthetic
ttcctagatttgaaacaacaagaagtggctcttattatgtgcaagacactaaaggttattatgtggcttatcctg

SEQ ID NO: 26199 - DNA, 75 bp, Artificial Sequence
  Synthetic
aaagtcgcaataatgaggaaataatttaccctacacctgatcttccggtggtaataatccacacacatgataaca

SEQ ID NO: 26200 - DNA, 75 bp, Artificial Sequence
  Synthetic
gtaataatccacacacatgataacagtggtgacttcttcttacatcctagccttcgcagacgcaaacgtaaaaga

SEQ ID NO: 26201 - DNA, 75 bp, Artificial Sequence
  Synthetic
aaatatttgtgattttgcattacagatggcagtgtggcaatcggctaccggtaaggtttatctgcctccttcaac

SEQ ID NO: 26202 - DNA, 75 bp, Artificial Sequence
  Synthetic
atggcagtgtggcaatcggctaccggtaaggtttatctgcctccttcaacaccagtggccagggtgcaaagcacg

SEQ ID NO: 26203 - DNA, 75 bp, Artificial Sequence
  Synthetic
accagtggccagggtgcaaagcacggatgaatacattcaaagaactaacatctactatcacgccaatactgacag

SEQ ID NO: 26204 - DNA, 75 bp, Artificial Sequence
  Synthetic
actgctcactgtaggacatccatatttcaatgtttacaacaataatggtgacacattacaggttcccaaagtatc

SEQ ID NO: 26205 - DNA, 75 bp, Artificial Sequence
  Synthetic
gggaaatcaacacagggtctttcgcttaaagttaccagatccaaataggtttgcactggcagatatgtctgtata

SEQ ID NO: 26206 - DNA, 75 bp, Artificial Sequence
  Synthetic
caatccagacaaagaaaggttggtatgggcttgcagaggcttagaaatcagtaggggacaaccattaggtgttgg

SEQ ID NO: 26207 - DNA, 75 bp, Artificial Sequence
  Synthetic
gagcaccggccatccctattttaataaagtgaaagacactgaaaacagcaattcatacaccacaacatctacaga

SEQ ID NO: 26208 - DNA, 75 bp, Artificial Sequence
  Synthetic
tgacagacaaaatacttcctttgatcctaagcaaatacaaatgttcattgtgggttgcacaccctgcattggtga

SEQ ID NO: 26209 - DNA, 75 bp, Artificial Sequence
  Synthetic
gcattgggaaaaagccattccatgtgcagaggaccaacagcaaggtctgtgcccacccattgaactaaaaaatac

SEQ ID NO: 26210 - DNA, 75 bp, Artificial Sequence
  Synthetic
agttattgaagatggggacatggcagatattggttttggtaatatgaactttaagactttacaacagaacagatc

SEQ ID NO: 26211 - DNA, 75 bp, Artificial Sequence
  Synthetic
tgatgtaagtctcgacatagtaaatgagatatgcaaatatcctgattttttgaaaatgcagaatgatgtgtatgg

SEQ ID NO: 26212 - DNA, 75 bp, Artificial Sequence
  Synthetic
tgatgcctgtttcttttatgcacgaagggaacagtgctatgctagacatttttttgtgagagggggtaagacagg

SEQ ID NO: 26213 - DNA, 75 bp, Artificial Sequence
  Synthetic
tgatgacatacctgctgctcaaattgatgatggcatgatgaaaaatcaatattacattcctggtggacaagatca

SEQ ID NO: 26214 - DNA, 75 bp, Artificial Sequence
  Synthetic
atcacaaaaggatataggtaatgctatgtatttcccaaccgtcagtggctcacttgtttcaagtgatgctcaatt

SEQ ID NO: 26215 - DNA, 75 bp, Artificial Sequence
  Synthetic
gtttaacaggcctttctggctgcagcgtgcccagggtcataataatggcattctctgggctaatcaaatgtttgt

SEQ ID NO: 26216 - DNA, 75 bp, Artificial Sequence
  Synthetic
cactgtggtagacaacacgcgaaacaccaattttagtatttcagtttacactgaaaatggggaacttaagaacat

SEQ ID NO: 26217 - DNA, 75 bp, Artificial Sequence
  Synthetic
cacagactataaatcaacccagttcagagaatatctgagacatgtagaagaatatgaaatttccctcatattaca

SEQ ID NO: 26218 - DNA, 75 bp, Artificial Sequence
  Synthetic
attgtgtaagataccactaaaggctgatgttttagcacaaatcaatgccatgaattcatcactacttgaggaatg

SEQ ID NO: 26219 - DNA, 75 bp, Artificial Sequence
  Synthetic
gcaactgggatttgtacctacccctgatactccaattcatgacacctacagatatattgattctcttgccacacg

SEQ ID NO: 26220 - DNA, 75 bp, Artificial Sequence
  Synthetic
ttgtcctgataaaagtccccctaaggaaaagcctgatccatatgcaaagtttaacttctggaatgtggaccttac

SEQ ID NO: 26221 - DNA, 75 bp, Artificial Sequence
  Synthetic
agaacgactttccctggatttggatcaatattcattaggcaggaagttcttgtttcaagcaggtttgcaacagac

SEQ ID NO: 26222 - DNA, 75 bp, Artificial Sequence
  Synthetic
gaccgtaaatggtacaaaatctatatctaggggctccgtcaggggcacaaaacgaaaacggaaaaattagattgt

SEQ ID NO: 26223 - DNA, 75 bp, Artificial Sequence
  Synthetic
accgttttcggtacaaaaccataaacttttacacagtattcaaggaatgtttgtttattctgactcagcatcact

SEQ ID NO: 26224 - DNA, 75 bp, Artificial Sequence
  Synthetic
ctacctaagaaaccgaccgcacccggtacataaaggtgagtagttgccaaaacagactcagtttagtgccagaat

SEQ ID NO: 26225 - DNA, 75 bp, Artificial Sequence
  Synthetic
agaccatgttcgttcaaacatgctcggattaggtcgcctgccaaggaagtattgatcttgccaatctattttggc

SEQ ID NO: 26226 - DNA, 75 bp, Artificial Sequence
  Synthetic
taggtcgcctgccaaggaagtattgatcttgccaatctattttggcagcgcttttggcatctccaacggaccgtt

SEQ ID NO: 26227 - DNA, 75 bp, Artificial Sequence
  Synthetic
cactgtcggtctgaacacgctcggatttggcgcattccatcggttttggcgccaagaattttggcagaagattag

SEQ ID NO: 26228 - DNA, 75 bp, Artificial Sequence
  Synthetic
caccgctaacggtaagtcttttgtttatgtaccgggcgcggtaccaaatacaacacctgcgtaattgttgttgcc

SEQ ID NO: 26229 - DNA, 75 bp, Artificial Sequence
  Synthetic
aaccaccttctttacttaacaagtactttcatgcatcgtttccgtatcagttcatatgtatgtatcgattacata

SEQ ID NO: 26230 - DNA, 75 bp, Artificial Sequence
  Synthetic
taaaaaggaagacatcttgatggcacaagacggtaaaccacagtcagtgctagaacttagtagattgttaaatat

SEQ ID NO: 26231 - DNA, 75 bp, Artificial Sequence
  Synthetic
tcctttagatgattgtttagtaccatgtaatttttgtgggcgctttttaagctatacagagttaactgattttga

SEQ ID NO: 26232 - DNA, 75 bp, Artificial Sequence
  Synthetic
caataaaaggttgagtcttatttggaaaggcgatttggtgtttgcatgctgtagatcgtgttgtgttgcaacggc

SEQ ID NO: 26233 - DNA, 75 bp, Artificial Sequence
  Synthetic
aacgttcgaatttgatcaatattttgtagaaagtgttatcgggtgggagatagaacaaaaggaaggtacttcaat

SEQ ID NO: 26234 - DNA, 75 bp, Artificial Sequence
  Synthetic
atctgatataattgtgagatgccatcattgtttaacattacttaatcaaattgaaaagcttgatatctgtggtag

SEQ ID NO: 26235 - DNA, 75 bp, Artificial Sequence
  Synthetic
cattgtttaacattacttaatcaaattgaaaagcttgatatctgtggtagatctcaattatttcatagagtgagg

SEQ ID NO: 26236 - DNA, 75 bp, Artificial Sequence
  Synthetic
aggggctggaaaggactctgtaggcagtgtaagcagatataatgattggaaaagaggtcactcttcaagacattg

SEQ ID NO: 26237 - DNA, 75 bp, Artificial Sequence
  Synthetic
tcttagagttgactgagccacagcctgttgatttgcactgcgaagaggagttgccagagcaggatacggaggtgg

SEQ ID NO: 26238 - DNA, 75 bp, Artificial Sequence
  Synthetic
agcctgaaaggacatcttacaaaataattttgcgctgcggcggaggctgtggaacccggcttcgaatatttgttg

SEQ ID NO: 26239 - DNA, 75 bp, Artificial Sequence
  Synthetic
cagccacacacagtggtatacgatccctgcaggagctgctacttgaagaagtggtcttattgtgcccggattgcc

SEQ ID NO: 26240 - DNA, 75 bp, Artificial Sequence
  Synthetic
gtaacagcgatcagcatggaggacaataaaggtagtagcaaagacgggttacatgaatggtgtttagtagaagcc

SEQ ID NO: 26241 - DNA, 75 bp, Artificial Sequence
  Synthetic
gaatgtagtgatatagaaaatgatttggaacctttacttgacaaaaattcagattctgatgtttcggatctaata

SEQ ID NO: 26242 - DNA, 75 bp, Artificial Sequence
  Synthetic
agtaatgatgaggacttggagcagggaaattcccgagaactctttcaacagcaagagttagaggacagcgatgct

SEQ ID NO: 26243 - DNA, 75 bp, Artificial Sequence
  Synthetic
ctattacaaagtctaaaacgaaagtatattagtccttctgcagctgtattacagcttagtccacaacttgaatcc

SEQ ID NO: 26244 - DNA, 75 bp, Artificial Sequence
  Synthetic
atttcgctgtcgacacagcataaatctaaaaggaaactgtttgctgaacagggcagtggagtagaggtaactctt

SEQ ID NO: 26245 - DNA, 75 bp, Artificial Sequence
  Synthetic
acaaatgaaactgaagatgttacttcattggtgcagcagcaacaggaggaagaggtaccatcattagagacatct

SEQ ID NO: 26246 - DNA, 75 bp, Artificial Sequence
  Synthetic
tccgtcagtaccttaagaaatgctgacaatgctcattataaagaacttatgaggagtagtaacttacgagctaca

SEQ ID NO: 26247 - DNA, 75 bp, Artificial Sequence
  Synthetic
tttttatccaagtttaaaaatgcctatggtgttagttttactgaattgacgcggcaatttagaagtaataaaacg

SEQ ID NO: 26248 - DNA, 75 bp, Artificial Sequence
  Synthetic
tgctgtaatgattgggtagtagcgatatatggtgttaactatgatttgtatgaagctgcaaaacagttattgcag

SEQ ID NO: 26249 - DNA, 75 bp, Artificial Sequence
  Synthetic
cagtactgtgattatatatgggttacagaaatgtctgcaatgtatttatatttattgtgttttaaagccggtaag

SEQ ID NO: 26250 - DNA, 75 bp, Artificial Sequence
  Synthetic
aatagacaaactgtgattagattattagtgtccatgttgcatgtggcagaggaacaaatattgtctgaaccacca

SEQ ID NO: 26251 - DNA, 75 bp, Artificial Sequence
  Synthetic
aagctgcgtagtactgtggcagctttattttggtataaaggcagttccaactctggaacatttacttttgggtct

SEQ ID NO: 26252 - DNA, 75 bp, Artificial Sequence
  Synthetic
tatccaaaatggatagtagaacaaacattaataggacatcagacaggagacgcagccacatttgatttttctact

SEQ ID NO: 26253 - DNA, 75 bp, Artificial Sequence
  Synthetic
atggtacaatgggcatttgataatgatcatactgatgaggctgatattgcgtttcagtatgccaagttagctccc

SEQ ID NO: 26254 - DNA, 75 bp, Artificial Sequence
  Synthetic
gatgatgttaatgcaactgcatggttggcccaaaacaatcaagcgcgttttgttcgggaatgtgctgcaatggtt

SEQ ID NO: 26255 - DNA, 75 bp, Artificial Sequence
  Synthetic
agatattataaaaagggacagatgcgagaaatgtctatgtcatcttggatacattttaagttacagcaagtagaa

SEQ ID NO: 26256 - DNA, 75 bp, Artificial Sequence
  Synthetic
ggcccagggcactggtcatccattgtaaaatttatcagatatcaagatataaattttataagttttttaagtgca

SEQ ID NO: 26257 - DNA, 75 bp, Artificial Sequence
  Synthetic
ttaaaagactttttgcgtgcaaaacctaaaaaaaactgcttgttaatatatgggccccctaatactggtaaatct

SEQ ID NO: 26258 - DNA, 75 bp, Artificial Sequence
  Synthetic
gcatttacaatgtctttaataagagtgttacatggtagggtaatttcatttgtaaattctagaagccatttttgg

SEQ ID NO: 26259 - DNA, 75 bp, Artificial Sequence
  Synthetic
ttacaacctatgtctgaatgtaagatagcgttattggacgatgcaactgacccgtgttgggtttatatggatact

SEQ ID NO: 26260 - DNA, 75 bp, Artificial Sequence
  Synthetic
tatttaagaaatggattagatggacatttagtgtcattagattgcaagcataaagcacctatgcaaatcaaattt

SEQ ID NO: 26261 - DNA, 75 bp, Artificial Sequence
  Synthetic
cctccattactgatcacttctaatataaatgctatggcagagccagcctataaatatttacatagtaggctaagg

SEQ ID NO: 26262 - DNA, 75 bp, Artificial Sequence
  Synthetic
gcctttgaatttcctaatccttttcctatgaaagatgataatacccctgagtttgaacttactgaccaaagctgg

SEQ ID NO: 26263 - DNA, 75 bp, Artificial Sequence
  Synthetic
aaatctttttttgaaaggctttggacacaattagaactgagtgaccaagaagacgagggagaggatggagacgct

SEQ ID NO: 26264 - DNA, 75 bp, Artificial Sequence
  Synthetic
gacaaaacgtttcgatgcattgcaagaccttctaatgaccatttatgaacaaggcagtgatactatagaagcaca

SEQ ID NO: 26265 - DNA, 75 bp, Artificial Sequence
  Synthetic
aattgaacattggcaggcccttcgtagagaggccgtcttattatattatgctaggcagaatggtgtgttgcggtt

SEQ ID NO: 26266 - DNA, 75 bp, Artificial Sequence
  Synthetic
ggggtatcagcctgtgccaccacttgcaacatctgaagctaaagccaaagaggccattagaatggtgctgcagct

SEQ ID NO: 26267 - DNA, 75 bp, Artificial Sequence
  Synthetic
gcaatcattacaacaatcagtatatggcaaagagaaatggacattggtggacaccagtatagaaacctataaaaa

SEQ ID NO: 26268 - DNA, 75 bp, Artificial Sequence
  Synthetic
tgcacccgaaaatcattttaaaaaaggaccagtaaatgttgaagtgatttatgatggtgaccctgataatgccaa

SEQ ID NO: 26269 - DNA, 75 bp, Artificial Sequence
  Synthetic
tttgtatacaatgtggaagtatgtgtattatatggatgacgacgaacaatggcagaaagctgaaagtggggcaaa

SEQ ID NO: 26270 - DNA, 75 bp, Artificial Sequence
  Synthetic
tcatacaggactgtattatactattggagattttaagcattattatgtggtatttgctgatgatgccagtagata

SEQ ID NO: 26271 - DNA, 75 bp, Artificial Sequence
  Synthetic
cagtaaatctggccagtgggaggtcagaattaataaggaaattgtgtttgcccctgttaccagctccacaccacc

SEQ ID NO: 26272 - DNA, 75 bp, Artificial Sequence
  Synthetic
cgaatccccaggaggatccagacaagaacccgagtccaccgccacaaccaccaccgactccaagacctcccgcag

SEQ ID NO: 26273 - DNA, 75 bp, Artificial Sequence
  Synthetic
tgcccaacggtcacaacaagccccctgtgacaaaacaaccaggcaaagaaggtacggaaggagatcatcaagccc

SEQ ID NO: 26274 - DNA, 75 bp, Artificial Sequence
  Synthetic
cacaggcagcagacggagacgacgatccgcgtcccggcaaacgaagcaaggccggcggtcccaaacccggtcccg

SEQ ID NO: 26275 - DNA, 75 bp, Artificial Sequence
  Synthetic
gtcgcggtcgcctgtctccattcaaactagatctagatcaagatccacttcacggagatccagatccacctcaag

SEQ ID NO: 26276 - DNA, 75 bp, Artificial Sequence
  Synthetic
gggccgtaggcggtcaggggagcgaacccccagagggcggcgaagagtctcagccacctctaggggaaggggagg

SEQ ID NO: 26277 - DNA, 75 bp, Artificial Sequence
  Synthetic
ggcaggtagaagggcatcctcctcctcttcccccagccccagaaccaaaacctcacaacggggatcagacacacg

SEQ ID NO: 26278 - DNA, 75 bp, Artificial Sequence
  Synthetic
gtctgttagggacggtggcgtgtctcctggggacgtgggaagaaaccttcagacagttagtggaagacatacagg

SEQ ID NO: 26279 - DNA, 75 bp, Artificial Sequence
  Synthetic
aagacttggacggttactggaggaagctcgggatcccccagtaatacttattcgtggagatgctaacacagtaag

SEQ ID NO: 26280 - DNA, 75 bp, Artificial Sequence
  Synthetic
gtgttttagaaatagggctaagcgcaggtataagggacagtataaagcatttagcacctcattttcatgggtagc

SEQ ID NO: 26281 - DNA, 75 bp, Artificial Sequence
  Synthetic
tgcagatggcacagagcgtctaggcaggtccagattgcttgtaagttttaccagccacaagcagcgtagtgggtt

SEQ ID NO: 26282 - DNA, 75 bp, Artificial Sequence
  Synthetic
tttagctgtagtacgtttccctaaaggtgtagattggtctttagggagtttcgataaattgtaatctactaacac

SEQ ID NO: 26283 - DNA, 75 bp, Artificial Sequence
  Synthetic
tgcttatgctactaacatccatataaccacatttcattttttgtatacgcttgcaatggttcgtgctagaagaac

SEQ ID NO: 26284 - DNA, 75 bp, Artificial Sequence
  Synthetic
aaaaagagattctgccactaatatttacaggacatgtaagcaagcaggcacatgtcctcctgatgttataaataa

SEQ ID NO: 26285 - DNA, 75 bp, Artificial Sequence
  Synthetic
agtggaacaaacaaccgttgcagataacattttaaaatatggaagttctgctgtgttttttggtgggttgggcat

SEQ ID NO: 26286 - DNA, 75 bp, Artificial Sequence
  Synthetic
tagtacaggccgggggtcaggcggtgccacaggctatgtgccactaagtgaaggcactggtgtacgtgtgggtag

SEQ ID NO: 26287 - DNA, 75 bp, Artificial Sequence
  Synthetic
cacaccaacagttgttcggcctgctgtagttcctgaagtaataggcccagcagatctggttccaattgacacagt

SEQ ID NO: 26288 - DNA, 75 bp, Artificial Sequence
  Synthetic
ggcccctattgaccctgcttcctcatctattatccctcttactgaatcatcaggagtagatcttttacctggtga

SEQ ID NO: 26289 - DNA, 75 bp, Artificial Sequence
  Synthetic
ggttgaaactattgctgagatacatccaattccagatgtatctcctattgatactcctgtcactacaaccagcaa

SEQ ID NO: 26290 - DNA, 75 bp, Artificial Sequence
  Synthetic
aggttcaagtgctgttttagaagttgcacctgaaccattgccacctacgcgggtacgtgttagtagaacacaata

SEQ ID NO: 26291 - DNA, 75 bp, Artificial Sequence
  Synthetic
tcacaatcctgcattccatgtcattacagaatccacgccaagccaaggtgaaagttcattatctgatgaaatcat

SEQ ID NO: 26292 - DNA, 75 bp, Artificial Sequence
  Synthetic
agtggccacgggctcaggagggcaaacagttggtgctactgaaaatatagaattacaagacttgtccagtagata

SEQ ID NO: 26293 - DNA, 75 bp, Artificial Sequence
  Synthetic
ctcttttgatattgaaactccaacacctccacggcgcagtagcaccccgttgcaaagggcaacacaagcatttag

SEQ ID NO: 26294 - DNA, 75 bp, Artificial Sequence
  Synthetic
aagtagatcacttactaatagacgattattggaacaagttccagtacaggatccactgtttttaactcagccttc

SEQ ID NO: 26295 - DNA, 75 bp, Artificial Sequence
  Synthetic
aaggctggtcagatttgcttttgaaaatcccgcgtttgaggaagaagtcacacaggtgtttgaacaagatgtaga

SEQ ID NO: 26296 - DNA, 75 bp, Artificial Sequence
  Synthetic
aaatgttttagaacccccagatcgggattttttagatatagcagaattgggaaggcctagatactcagaaacacg

SEQ ID NO: 26297 - DNA, 75 bp, Artificial Sequence
  Synthetic
tgagggttatgtcagattaagtagattgggccgtcgagccactataaggactcgatcaggtactcagataggagc

SEQ ID NO: 26298 - DNA, 75 bp, Artificial Sequence
  Synthetic
acaggtacatttttacagagatttaagttccataaacacagaagagccaattgaattagatcttttaggacagca

SEQ ID NO: 26299 - DNA, 75 bp, Artificial Sequence
  Synthetic
ttctggagatgcaaccattgtgtatgggactgttgaaagtacatttatagatgttaacatggaagaaaatccctt

SEQ ID NO: 26300 - DNA, 75 bp, Artificial Sequence
  Synthetic
agctgagcaaatatcagaccttggatcatatcctgaagctcattcatatgatgttttgttagatgaagcatcaga

SEQ ID NO: 26301 - DNA, 75 bp, Artificial Sequence
  Synthetic
agattttagtggttcacagttggtaataggtaatagaaggtcgacatcttcatttactgtccccagattcgagtc

SEQ ID NO: 26302 - DNA, 75 bp, Artificial Sequence
  Synthetic
tcctaaaaatgcatcgtattatgtacaggacttagagggatattatgttacatatccagagtccagggatgatgt

SEQ ID NO: 26303 - DNA, 75 bp, Artificial Sequence
  Synthetic
acaaattgtataccccactcctgagttgccagtggttgtaatacatacgcatgataatagtggggatttttatct

SEQ ID NO: 26304 - DNA, 75 bp, Artificial Sequence
  Synthetic
acatcccagccttttccgcaggcgcagacgcaaacgcaaatatttgtgatttttacagatgtcggtgtggttgcc

SEQ ID NO: 26305 - DNA, 75 bp, Artificial Sequence
  Synthetic
agccagcggtaaggtatatttgccaccatcaacaccagtcgcgaaagtccaaagcacggatgaatacatacaaag

SEQ ID NO: 26306 - DNA, 75 bp, Artificial Sequence
  Synthetic
aaccaatatcttctatcatgcatatagtgatcgcctcttaactgtaggacacccctattataatgtttataataa

SEQ ID NO: 26307 - DNA, 75 bp, Artificial Sequence
  Synthetic
tgatggcacagtactagaggttcccaaagtttcaggtaaccagcacagagtgtttagactaaaactgccagatcc

SEQ ID NO: 26308 - DNA, 75 bp, Artificial Sequence
  Synthetic
taatagatttgctttagctgacatgtcagtatataatcctgaaaaagaaaggttagtgtggggttgtagaggagt

SEQ ID NO: 26309 - DNA, 75 bp, Artificial Sequence
  Synthetic
agaaataggacgtggtcagccattaggcgttggtaccagtggacatccactgtttaacaaggttaatgatgccga

SEQ ID NO: 26310 - DNA, 75 bp, Artificial Sequence
  Synthetic
aaatcccttagcttacagggcacaggccttttctactgatgataggcaaaacacatcctttgatcctaaacaaat

SEQ ID NO: 26311 - DNA, 75 bp, Artificial Sequence
  Synthetic
acaaatgtttataataggttgtgcaccctgtattggagagcattgggatgtaggtgaacgttgtgcaggagccaa

SEQ ID NO: 26312 - DNA, 75 bp, Artificial Sequence
  Synthetic
taatgaaaatggtcgatgcccccctatcaaattggtaaattcagtcatccaagatggagatatggcagatattgg

SEQ ID NO: 26313 - DNA, 75 bp, Artificial Sequence
  Synthetic
ttatggaaacctaaatttccgtaccttacaggaaaacagatctgatgtaagtttagatatagtgaatgaaacctg

SEQ ID NO: 26314 - DNA, 75 bp, Artificial Sequence
  Synthetic
taaatatccagactttttaaagatgcagaatgatatatatggcgattcttgctttttttttgctcgccgggagca

SEQ ID NO: 26315 - DNA, 75 bp, Artificial Sequence
  Synthetic
atgttatgcaagacattttttcgttcgtgggggtaaggcgggggatgacattcctggtgcgcaaatcgatgcagg

SEQ ID NO: 26316 - DNA, 75 bp, Artificial Sequence
  Synthetic
tacatataaaaatgatttttacatacctggagcgtcaggtcagacacaaaagaatataggtaactcgatgtattt

SEQ ID NO: 26317 - DNA, 75 bp, Artificial Sequence
  Synthetic
cccaacagtaagtggctcattggtgtctagtgatgctcaattgtttaataggcccttctggctccaacgggcgca

SEQ ID NO: 26318 - DNA, 75 bp, Artificial Sequence
  Synthetic
aggtcataataatggtatttgctgggcaaatcaattgtttattactgtggtggacaacacaagaaacacaaactt

SEQ ID NO: 26319 - DNA, 75 bp, Artificial Sequence
  Synthetic
cagtattagtgtgtatagtgaagcaggtaaagtaaaggatatttcagattatgatgcaaacaaatttagggaata

SEQ ID NO: 26320 - DNA, 75 bp, Artificial Sequence
  Synthetic
tcaaagacatgtagaagaatatgaaatttctttaatattacaactatgtaagatacctttaaaagccgacgtgtt

SEQ ID NO: 26321 - DNA, 75 bp, Artificial Sequence
  Synthetic
ggcacaaattaatgcaatgaatccatcgttattagaagagtggcaactggggtttgtacctgcgccagacaatcc

SEQ ID NO: 26322 - DNA, 75 bp, Artificial Sequence
  Synthetic
attgcaaagtacctataggtatatcgatagcttggccacaccatgtcctgataaagtgcctaccaaagaaaagga

SEQ ID NO: 26323 - DNA, 75 bp, Artificial Sequence
  Synthetic
agatccatatgctccgtttacattttggaacgttgatttgacagaaagactttccttggaactggatcaatattc

SEQ ID NO: 26324 - DNA, 75 bp, Artificial Sequence
  Synthetic
tttaggtagaaaatttttatttcaggccggacttgtgcaaaaatcatctaaaaaaacaactaatgtatctaaagg

SEQ ID NO: 26325 - DNA, 75 bp, Artificial Sequence
  Synthetic
aaccaaacgaaaaaggtcttaagatgttaccgttttcggtgcaataaggatgtattccaagaatgcttgttattc

SEQ ID NO: 26326 - DNA, 75 bp, Artificial Sequence
  Synthetic
atgtctatgactaatatgaactttggctcgaatgttaaccgcacccggtgcagtagataaaatcttgcaacccta

SEQ ID NO: 26327 - DNA, 75 bp, Artificial Sequence
  Synthetic
tgaactttggctcgaatgttaaccgcacccggtgcagtagataaaatcttgcaaccctagcagacacaaagagat

SEQ ID NO: 26328 - DNA, 75 bp, Artificial Sequence
  Synthetic
tgttccaggtgcggtaccaggtggttattactcactatagttgttgccaacaactattgtctacatgtaatcacc

SEQ ID NO: 26329 - DNA, 75 bp, Artificial Sequence
  Synthetic
tgaccgcttccgtagcatatacatatatatatatatatatatatatatgtatattctgctacagcacagaaggaa

SEQ ID NO: 26330 - DNA, 75 bp, Artificial Sequence
  Synthetic
acttgccacggctacatggaggagtatcctatgagaatagtagacttagctgccttattagatataccagttgta

SEQ ID NO: 26331 - DNA, 75 bp, Artificial Sequence
  Synthetic
gacttgctagtaccgtgtaatttttgtaatacgtttttaacatattttgagttgtgtgattttgataacaaacaa

SEQ ID NO: 26332 - DNA, 75 bp, Artificial Sequence
  Synthetic
ctaactttgatatggaaggatagtaaagtatttggctgctgtagaccttgctgtgtggcgagtggtttttttgaa

SEQ ID NO: 26333 - DNA, 75 bp, Artificial Sequence
  Synthetic
tttcagcagttttatgaaggctccgtgattggaagacacatagaagctgtagaacagaaaactgtttttgaaata

SEQ ID NO: 26334 - DNA, 75 bp, Artificial Sequence
  Synthetic
agtgtaaggtgtcatcactgtttgagattattagatagtatagaaaagctagacatttgtggacggcaacaaccg

SEQ ID NO: 26335 - DNA, 75 bp, Artificial Sequence
  Synthetic
ttccatagagtaagggctggttggaaaggtctttgtaagttttgtaaataaatggttggaaatgaggtcactctt

SEQ ID NO: 26336 - DNA, 75 bp, Artificial Sequence
  Synthetic
caagatattgtcttggagttagaacctcaggccattgacctcttttgctacgaagaggagttaccaaccgagcag

SEQ ID NO: 26337 - DNA, 75 bp, Artificial Sequence
  Synthetic
gatacatcttcggaggaggagcctgaccctgtcaaaataccttacaaagttgttgcaccttgcggctgctgtggg

SEQ ID NO: 26338 - DNA, 75 bp, Artificial Sequence
  Synthetic
cccagacttcgactttgtctgcttgcaacaacctttggaattcgaaccttggaaagcttgctgctagacgaaata

SEQ ID NO: 26339 - DNA, 75 bp, Artificial Sequence
  Synthetic
aatctattgtgtcctccgtgtcgtcacagccttcagcatggcaaccaataaaggtactgataatgctatcgaagg

SEQ ID NO: 26340 - DNA, 75 bp, Artificial Sequence
  Synthetic
gtgcagtagttggtgtatattggaagcggaatgtagtgatatagaaaatgatttggaaactttaattgaaaagtc

SEQ ID NO: 26341 - DNA, 75 bp, Artificial Sequence
  Synthetic
agactcagatttatcagacctaattgatgatggggacttggagcaggggaattcccgagagctatttcagcaaca

SEQ ID NO: 26342 - DNA, 75 bp, Artificial Sequence
  Synthetic
ggagagtgaggacagcgaggagcaattacaaaaactaaaacgaaagtatttgagtcctcaagcagttgcacagct

SEQ ID NO: 26343 - DNA, 75 bp, Artificial Sequence
  Synthetic
cagtccgcggcttgcgtgtatttcattatctcctcagcaaaaaagtaaaagacgcctttttacagagcaggacag

SEQ ID NO: 26344 - DNA, 75 bp, Artificial Sequence
  Synthetic
cggacttgagctaactcttacaaatgaagctgaagatatttcttctgaaaaattggaggtaccaactgacattgc

SEQ ID NO: 26345 - DNA, 75 bp, Artificial Sequence
  Synthetic
atctcctactgctacagaaagcaggcaggagacagaaaactatcattttaaagaactgttgcgttgtagtaatat

SEQ ID NO: 26346 - DNA, 75 bp, Artificial Sequence
  Synthetic
aaaagctactttacttgcaaaatttaaaatggcgtatgaagttgggtttaatgaactaactcgccagtttaaaag

SEQ ID NO: 26347 - DNA, 75 bp, Artificial Sequence
  Synthetic
tcataaaacatgctgtaaggactgggtagcaactgtttatggagtcaacgatgatctgtatgaaagtgcaaagca

SEQ ID NO: 26348 - DNA, 75 bp, Artificial Sequence
  Synthetic
gttgttgcaacagcattgtgaatatgtgtgggctttaagatctagtgcgatgtcattgtttctattgtgttttaa

SEQ ID NO: 26349 - DNA, 75 bp, Artificial Sequence
  Synthetic
ggcgggtaaaaatcgttgtactgtgttgaaattgctgacatctatattgtgtgttcgcgaagaacaaatattggc

SEQ ID NO: 26350 - DNA, 75 bp, Artificial Sequence
  Synthetic
tgagcctcccaaaatacgtagtacagtagcagccatattttggtatcaaggcagtcatatttcaggagcatttac

SEQ ID NO: 26351 - DNA, 75 bp, Artificial Sequence
  Synthetic
atatgggcaatatccaacatggattgttcagcaaacaatgataggacatcaaaccgctgacgccacaacctttga

SEQ ID NO: 26352 - DNA, 75 bp, Artificial Sequence
  Synthetic
tttttctaaaatggttcaatgggcttttgacaataattatgtggaggacgcagatatagcatatcattatgcacg

SEQ ID NO: 26353 - DNA, 75 bp, Artificial Sequence
  Synthetic
gttagcaccggaagatgtaaatgcattagcttggctagcgcacaacagtcaggctagatttgtaagagaatgtac

SEQ ID NO: 26354 - DNA, 75 bp, Artificial Sequence
  Synthetic
acaaatggtgaggtattataaaagaggacaaatgcgagatatgagtatgtctgaatggatatacactagaattaa

SEQ ID NO: 26355 - DNA, 75 bp, Artificial Sequence
  Synthetic
tgaagtggaaggcgaagggcattggtcaagcatagtgcgatttattagatatcaggaaataaatttcattatgtt

SEQ ID NO: 26356 - DNA, 75 bp, Artificial Sequence
  Synthetic
tctttcagctttaaaaaattttttacattcagttccaaaacataattgtattttaattcatggccctcctaatac

SEQ ID NO: 26357 - DNA, 75 bp, Artificial Sequence
  Synthetic
gggaaaatcggcatttaccatgtcattaataaatgtattacatggaaaagtaatttcttttgtaaatgcaaagag

SEQ ID NO: 26358 - DNA, 75 bp, Artificial Sequence
  Synthetic
tcacttttggctacaaccattaaaagattgtaaaatagcactattagatgatgccacagatccatgctggttata

SEQ ID NO: 26359 - DNA, 75 bp, Artificial Sequence
  Synthetic
tatggatcaatatttaagaaatgggttagatggacatcctgtttcattagattgtaaacacaaagcgcccttgca

SEQ ID NO: 26360 - DNA, 75 bp, Artificial Sequence
  Synthetic
aattaagtttcctccattaatgataacttcaaatattgatgtgcatagtgaagtgcaatacaaatatttacatag

SEQ ID NO: 26361 - DNA, 75 bp, Artificial Sequence
  Synthetic
tcgaatcacagcttttaaatttcctaataaattcccttttaaatctgataatacaccgcaatttgaacttactaa

SEQ ID NO: 26362 - DNA, 75 bp, Artificial Sequence
  Synthetic
ccaaagctggaaatctttctttgaaaggctttggaatcaattagaactcagtgaccaagaagaggaggaggagga

SEQ ID NO: 26363 - DNA, 75 bp, Artificial Sequence
  Synthetic
tggaggcactcaacgagcgtttcagtgcactgcaagaccagctaatgaacatttatgaagctgctaaaagtactc

SEQ ID NO: 26364 - DNA, 75 bp, Artificial Sequence
  Synthetic
ttgatgcacaaattgaccattggcaacatttgcgaaaggaggcagtattattatttgttgctagacaaaaaggaa

SEQ ID NO: 26365 - DNA, 75 bp, Artificial Sequence
  Synthetic
tattgcgtttgggatatcagcctgtcccgccacaagcagtatcagaaagcaaagccaaaaatgcaataatgatgg

SEQ ID NO: 26366 - DNA, 75 bp, Artificial Sequence
  Synthetic
tgttgcaactagaatcacttaaaaaatcacaatttgcagaggaaccatggacattagtggacactagtttggaaa

SEQ ID NO: 26367 - DNA, 75 bp, Artificial Sequence
  Synthetic
catacaaaaatgcacctgaaaatacatttaaaaaggggcctataaacgtggaagttatgtatgacaaagaccctg

SEQ ID NO: 26368 - DNA, 75 bp, Artificial Sequence
  Synthetic
ataatacaaatttatatacaatgtggaaatacatatattatttggatgcagaggaggagtggcaaaaagccgaaa

SEQ ID NO: 26369 - DNA, 75 bp, Artificial Sequence
  Synthetic
gtggagctaatcatacaggaatatattatatgcatggctcattcagacattactatgtgctgtttgctgatgatg

SEQ ID NO: 26370 - DNA, 75 bp, Artificial Sequence
  Synthetic
cacctagatttagtagaactggacactgggaagtgattattaataaagacactgtgtttgcccctgtcactagct

SEQ ID NO: 26371 - DNA, 75 bp, Artificial Sequence
  Synthetic
ccacaccaccagaatcaccaggacaaagccaaggacgacaaccacctgacaaaggcaccgggattaccaccaccg

SEQ ID NO: 26372 - DNA, 75 bp, Artificial Sequence
  Synthetic
acgccgcgaccaacagatctccccgggcgtcccccacgaccacagccgtcaccgagcgcccccagaaacgacgat

SEQ ID NO: 26373 - DNA, 75 bp, Artificial Sequence
  Synthetic
acggaagaaaagactctagtcctacagccacccccaagaagagatccaccaggcaaacgtggcagagacggcgac

SEQ ID NO: 26374 - DNA, 75 bp, Artificial Sequence
  Synthetic
caagatcacggtccctccgagccgaaaagaggcgacaaaccagatccagatcaacatcctctaaagcctccaaaa

SEQ ID NO: 26375 - DNA, 75 bp, Artificial Sequence
  Synthetic
acagaaggcgaagaagcagcagcagcagcagcagcagcagctgcagcagaggaagcagcagcaggcgacgaagga

SEQ ID NO: 26376 - DNA, 75 bp, Artificial Sequence
  Synthetic
ggacaaggtccaggtcagcctccagaacaaagtccccagcctccagaacaaggtccagaacaaggtccccaacct

SEQ ID NO: 26377 - DNA, 75 bp, Artificial Sequence
  Synthetic
ccaaagcacaatcccctgggagaagggcaggtggaaggtcatccagaaggtctacctcctcctccacatcaccct

SEQ ID NO: 26378 - DNA, 75 bp, Artificial Sequence
  Synthetic
ccaagagaagaaaacgtgccagagaccgagggcctagctacaaccgtggcatctctcctggtgacgtgggaaaat

SEQ ID NO: 26379 - DNA, 75 bp, Artificial Sequence
  Synthetic
cagttcagacagttagtggacgacataaggggcgacttggaagattattggcagaagctcatgatcccccagtaa

SEQ ID NO: 26380 - DNA, 75 bp, Artificial Sequence
  Synthetic
ttttggtgaaaggtgaccctaatacgctgaaatgctttcgtaatcgctctaaaaccaaatatagagatttaatta

SEQ ID NO: 26381 - DNA, 75 bp, Artificial Sequence
  Synthetic
aggctgttagcaccacatggtcatgggtgtctacagatggctgcgatcgcataggaagggctagaatgttattta

SEQ ID NO: 26382 - DNA, 75 bp, Artificial Sequence
  Synthetic
gttttgcctcatatgaacaaaggaacacatttgacaacaaagtgacatatcctaaaaacgtggaaaggacgtttg

SEQ ID NO: 26383 - DNA, 75 bp, Artificial Sequence
  Synthetic
gaaattttgacagtctttagatgctacattaaccttactgcttactaatgctgctttgctgctaacccttaacta

SEQ ID NO: 26384 - DNA, 75 bp, Artificial Sequence
  Synthetic
cccagctttcatattttttattatatatctattgctatggtgcgagccaggagagttaaacgagactctgtaacc

SEQ ID NO: 26385 - DNA, 75 bp, Artificial Sequence
  Synthetic
catatttaccaaacctgcaagcaagcaggcacctgcccttcagatgtagttaataaagttgagcaaaatactgtt

SEQ ID NO: 26386 - DNA, 75 bp, Artificial Sequence
  Synthetic
gcagataatattttaaaatatgggggtgctgctgttttttttggtggtttgggtattggtactggccgtggtact

SEQ ID NO: 26387 - DNA, 75 bp, Artificial Sequence
  Synthetic
gggggtactacaggctatatacctcttggtgaaggtcctggagtacgtgtgggaaacacacctacggtggtaagg

SEQ ID NO: 26388 - DNA, 75 bp, Artificial Sequence
  Synthetic
ccatcactaattccagaaactattgggcctgctgatataacacctatagatacagctaacccaatagatgccaca

SEQ ID NO: 26389 - DNA, 75 bp, Artificial Sequence
  Synthetic
gcatcttctattgtgcctttaactgaaaccacttcggatttattaccaggagaagtagaaacaatagctgaaata

SEQ ID NO: 26390 - DNA, 75 bp, Artificial Sequence
  Synthetic
catcctgttcctgagaatcctattattgatgcccctgttaccacaactaataggggtgctagtgctattttggaa

SEQ ID NO: 26391 - DNA, 75 bp, Artificial Sequence
  Synthetic
gttgcccctgaaccaacccccccatcccgtgttagagtttctcgtagtcaatatcataatccttcttttcaaatt

SEQ ID NO: 26392 - DNA, 75 bp, Artificial Sequence
  Synthetic
atcactgaatctacaccaacacaaggagaaagttctttagctgatcacattattgtgacgtcaggtgctggaggc

SEQ ID NO: 26393 - DNA, 75 bp, Artificial Sequence
  Synthetic
caagtaattggtggctctaccagtgaacttattgaattgcaagagtttcctagtagatattcattcgaaatagaa

SEQ ID NO: 26394 - DNA, 75 bp, Artificial Sequence
  Synthetic
gagccaacacctccccgtaaaagtagcactcccaatgaaaggtcatctacgcgaccacctcgagggcggtcatta

SEQ ID NO: 26395 - DNA, 75 bp, Artificial Sequence
  Synthetic
accaatagacgtctgctacaacaggtacaagttgacaatcctttatttttatcacagccctctagattggtaaga

SEQ ID NO: 26396 - DNA, 75 bp, Artificial Sequence
  Synthetic
tttgcttttgataatccagtttttgaggaagatgtaactaatatttttgaacatgatgtgagtacctttgaagag

SEQ ID NO: 26397 - DNA, 75 bp, Artificial Sequence
  Synthetic
cctccagacagagactttttggatattggtacattaggcagaccacaatacagtgacactccagctggatatgta

SEQ ID NO: 26398 - DNA, 75 bp, Artificial Sequence
  Synthetic
agggttagccgtgtgggacagagacgaactataaccacacggtctggaacccaaatagggagtcaggtccatttt

SEQ ID NO: 26399 - DNA, 75 bp, Artificial Sequence
  Synthetic
tatagagatttgagcacaattaatactgaagatcccatagaactgcaattattaggtcagcattcgggtgatgca

SEQ ID NO: 26400 - DNA, 75 bp, Artificial Sequence
  Synthetic
accattgtacagggtcctgcagcagaaagcacttttgttaatgttgatatgggtactactcctttttctgacact

SEQ ID NO: 26401 - DNA, 75 bp, Artificial Sequence
  Synthetic
gtggaacatttgtcagatgatctattattagatgaagctgtggaagatttttcaggttctcaattggtcataggt

SEQ ID NO: 26402 - DNA, 75 bp, Artificial Sequence
  Synthetic
aatagacgtaatacatctacatacacagtgccacgttttgaaacacctagaagtgcttcatattatgtacaggat

SEQ ID NO: 26403 - DNA, 75 bp, Artificial Sequence
  Synthetic
acacaaggttattatgtggcttacccagagtctagaaatgaggttgaaattatttatcccacacctgagttacct

SEQ ID NO: 26404 - DNA, 75 bp, Artificial Sequence
  Synthetic
gtagttgtcattcacacccatgacacatctggtgatttttatttgcatcctagtttatccagaaaacgacgcaaa

SEQ ID NO: 26405 - DNA, 75 bp, Artificial Sequence
  Synthetic
agaaaatatttgtgattttgttcgcagatggctgtgtggcaagctgccagtggtaaagtatatctaccaccttca

SEQ ID NO: 26406 - DNA, 75 bp, Artificial Sequence
  Synthetic
acacctgtggcgagggtacaaagtaccgatgaatatgttgagcgcaccaatatttattatcatgcatttactgat

SEQ ID NO: 26407 - DNA, 75 bp, Artificial Sequence
  Synthetic
cgtctgttaactgtaggacatccttatttcaatatatttaataatgatggtaataagttggaagtgcccaaagta

SEQ ID NO: 26408 - DNA, 75 bp, Artificial Sequence
  Synthetic
tcaggaaaccagcatagagtatttcgattgcgcttgccagaccctaacagatttgctctagcagatatgtctgtt

SEQ ID NO: 26409 - DNA, 75 bp, Artificial Sequence
  Synthetic
tataatcctgataaggaacgattggtatgggctattactggcctggaaataggtaggggacagccgcttggtgtt

SEQ ID NO: 26410 - DNA, 75 bp, Artificial Sequence
  Synthetic
ggtactagtggtcatccattatttaacaaatttaatgatactgaaaatggtaacaaatataccaacactagtaca

SEQ ID NO: 26411 - DNA, 75 bp, Artificial Sequence
  Synthetic
gatgataggcaaaatatttcctttgatcccaaacagcttcagatgtttataataggctgtaccccttgtattggt

SEQ ID NO: 26412 - DNA, 75 bp, Artificial Sequence
  Synthetic
gagcactgggacagagcaccagcgtgtgttgaggacgagcaactgggtagatgtcctcctatcgaattggtgaat

SEQ ID NO: 26413 - DNA, 75 bp, Artificial Sequence
  Synthetic
acttttattcaggatgatgatatggcagatataggatatggtaatttaaattttaaagcactacagcaaaatcgc

SEQ ID NO: 26414 - DNA, 75 bp, Artificial Sequence
  Synthetic
tctgatgttagtttggatatagtagatgaaatctgcaagtatccagactttttaaaaatgcaaaatgatgtgtat

SEQ ID NO: 26415 - DNA, 75 bp, Artificial Sequence
  Synthetic
ggcgatgcatgctttttttatgctagacgtgagcagtgttatgccagacgcttttttgttcgtggtggtaagcct

SEQ ID NO: 26416 - DNA, 75 bp, Artificial Sequence
  Synthetic
ggtgatgatattcctgcagagcaaatagatgctggtaaacttaaaaatgaattctatataccagctgcgggtggg

SEQ ID NO: 26417 - DNA, 75 bp, Artificial Sequence
  Synthetic
caggctcaaggtcaacttggaaattccatgtatttcccaactgtgagtggatcattagtatcgagtgatgcccaa

SEQ ID NO: 26418 - DNA, 75 bp, Artificial Sequence
  Synthetic
ttatttaataggcccttctggctacaaagagcacagggtcataataatggcatcttatggggtaatcaattattt

SEQ ID NO: 26419 - DNA, 75 bp, Artificial Sequence
  Synthetic
gtgactgtattagacaacacacgaaatactaatttcagtattgctgtatacagtgaagcaggcaaaatacaagat

SEQ ID NO: 26420 - DNA, 75 bp, Artificial Sequence
  Synthetic
attgctaattatgattcctccaagtcccgagaatatcagcgacatgtagaggaatatgaggtatcaatgattttg

SEQ ID NO: 26421 - DNA, 75 bp, Artificial Sequence
  Synthetic
cagttatgcaaaattcctttaaagcctgaagtactggcccacattaatgcaatgaatcccgccattttggaagac

SEQ ID NO: 26422 - DNA, 75 bp, Artificial Sequence
  Synthetic
tggcaattgggctttataccaacaccagataatccaatacatgatacataccgttatatagattctctagctaca

SEQ ID NO: 26423 - DNA, 75 bp, Artificial Sequence
  Synthetic
cggtgtcctgataaggtccctgcaaaagaaaaagaagacccttatggtaaatatgtgttttggaatgtagatctt

SEQ ID NO: 26424 - DNA, 75 bp, Artificial Sequence
  Synthetic
tctgagcgattgtctttggatttggatcagtatcctttggggcgtaagttcctatttcaggctgggttaagacaa

SEQ ID NO: 26425 - DNA, 75 bp, Artificial Sequence
  Synthetic
aagtctgtaaatgggtctgtcacacggacagttagtaggggtgctaaaaggaaaagaaaataaacttgtaccgct

SEQ ID NO: 26426 - DNA, 75 bp, Artificial Sequence
  Synthetic
ttcggtacccttcagtattcaaggaatgttgtgttattcatgagtgactaagttgaactttgcctacatgccaag

SEQ ID NO: 26427 - DNA, 75 bp, Artificial Sequence
  Synthetic
attgtaccgcgcccgattttttatctgagagatcagtaccaatcttggcacagttgaaacgccggcggtctgaac

SEQ ID NO: 26428 - DNA, 75 bp, Artificial Sequence
  Synthetic
aggcacgaaattgttttggcgccaaaatcgctggcagcacatcaggaccgataacggtaagtcattttttgtgtt

SEQ ID NO: 26429 - DNA, 75 bp, Artificial Sequence
  Synthetic
caaaatcgctggcagcacatcaggaccgataacggtaagtcattttttgtgttttgtaccagaatcggcacaaaa

SEQ ID NO: 26430 - DNA, 75 bp, Artificial Sequence
  Synthetic
aacggtaagttgtattaaactgtaccaggtgcggtgctatttctcaatacagagctgtggttgccaactacaatt

SEQ ID NO: 26431 - DNA, 75 bp, Artificial Sequence
  Synthetic
atctctttcaagtttttgcttgtatcgttttcgtataataacaacctctgtatataattaaataaatatatatat

SEQ ID NO: 26432 - DNA, 75 bp, Artificial Sequence
  Synthetic
ttgtttgaagatttggctgatttgcaatttggtgggcgaatggagaggcagacaaatcaagaagctacagctaac

SEQ ID NO: 26433 - DNA, 75 bp, Artificial Sequence
  Synthetic
caaactctgcagcttcccacatcaattaaagagttagcagatctattagagataccattggtagattgtttaata

SEQ ID NO: 26434 - DNA, 75 bp, Artificial Sequence
  Synthetic
ccttgtaatttctgtgggaggtttttagattatttagagctttgtgagtttgacaaaaagaagcttactttgatt

SEQ ID NO: 26435 - DNA, 75 bp, Artificial Sequence
  Synthetic
tggaaagactactttgttactgcatgctgtcgtagttgctgtgtagccacagcaacatttgaatttaatgaacat

SEQ ID NO: 26436 - DNA, 75 bp, Artificial Sequence
  Synthetic
tatgagcaaactgttttaggaagggacatagaattggctacaggtctttcaatatttgagatcaacatcaggtgt

SEQ ID NO: 26437 - DNA, 75 bp, Artificial Sequence
  Synthetic
caaacttgcctatcctttcttgatctgatagaaaagctagatagttgtggcggaggccttccctttcataaggtc

SEQ ID NO: 26438 - DNA, 75 bp, Artificial Sequence
  Synthetic
agaggaggttggaagggaatttgcagacattgcaaacatttgtataatgattggtaaagaggtcaccgtgcaaga

SEQ ID NO: 26439 - DNA, 75 bp, Artificial Sequence
  Synthetic
ctttgttttggagcttagtgagatacagcctgaagtattaccagttgacctgttttgtgaagaggaattgccaaa

SEQ ID NO: 26440 - DNA, 75 bp, Artificial Sequence
  Synthetic
cgagcaggaggaggagctagacatccagaagactgtattcaaaatcatagcaccgtgtggctgcagttgctgtga

SEQ ID NO: 26441 - DNA, 75 bp, Artificial Sequence
  Synthetic
ggtcaatcttcgtatttttgtgaacgctaccgacgttggaattagaaccctgcaagagctactgaccagtgacct

SEQ ID NO: 26442 - DNA, 75 bp, Artificial Sequence
  Synthetic
gcaactgctgtgtccagagtgccgtggtaactgcaaacatggcggatcctaaaggtagtacatctaaagaagggt

SEQ ID NO: 26443 - DNA, 75 bp, Artificial Sequence
  Synthetic
taagtgattggtgtttgttggaagctgactgtagtgatttagaaaatgattttgaacaattgtgtgagagagata

SEQ ID NO: 26444 - DNA, 75 bp, Artificial Sequence
  Synthetic
cagactcagatatctcggacttattagataattgtgacctggaacagggcaattctttggaactatttcatcaac

SEQ ID NO: 26445 - DNA, 75 bp, Artificial Sequence
  Synthetic
aggagtgtaaggagagcggggagcaattacaaaaactaaaacgaaagtatcttagtccaaaagctgtcgcgcagc

SEQ ID NO: 26446 - DNA, 75 bp, Artificial Sequence
  Synthetic
tcagtccgcgtctcgagtcaatttcattgtcacctcagcagaaatccaagcgaaggctctttgcagagcaggaca

SEQ ID NO: 26447 - DNA, 75 bp, Artificial Sequence
  Synthetic
gcggactcgagttatcacttaacaatgaagctgaagatgtttctcctgaggtggaggtaccggctatagactctc

SEQ ID NO: 26448 - DNA, 75 bp, Artificial Sequence
  Synthetic
ggccggtagagggaggatcaggggatgtagatattaattacacagcgcttttgcgatccagcaaccacagagcta

SEQ ID NO: 26449 - DNA, 75 bp, Artificial Sequence
  Synthetic
ctttattgtcaaaatttaaagacgcgtttggggtaggctttaacgaattgacacgtcaatttaaaagttacaaaa

SEQ ID NO: 26450 - DNA, 75 bp, Artificial Sequence
  Synthetic
cctgttgtaatgattgggtcgtagctgtttatgcagttcatgatgatctatttgaaagctcaaagcagttgttgc

SEQ ID NO: 26451 - DNA, 75 bp, Artificial Sequence
  Synthetic
aacagcattgcgactatatctgggttagtggaataggcgcaatgacattatatctattatgttttaaggcgggaa

SEQ ID NO: 26452 - DNA, 75 bp, Artificial Sequence
  Synthetic
aaaatcgtggtactgtacataagctaactacctcaatgttaaatgtgcatgaacagcaaatcttgtctgagccac

SEQ ID NO: 26453 - DNA, 75 bp, Artificial Sequence
  Synthetic
ctaagttaagaaatactgctgctgcattgttttggtacaaagggtgtatggggtcagggacgtttacatatggcc

SEQ ID NO: 26454 - DNA, 75 bp, Artificial Sequence
  Synthetic
cataccctgagtggattgctcatcaaactatacttggtcaccaaaatgctgaagcaagcacgtttgatctttctg

SEQ ID NO: 26455 - DNA, 75 bp, Artificial Sequence
  Synthetic
taatggttcaatgggcatttgatcacaatctggtggatgaagcagatattgcttacaaatatgcaaagcttgcac

SEQ ID NO: 26456 - DNA, 75 bp, Artificial Sequence
  Synthetic
cagaagatagtaatgcagtagcttggcttgctcataataatcaggcaaaatttgttcgtgaatgtgcatcaatgg

SEQ ID NO: 26457 - DNA, 75 bp, Artificial Sequence
  Synthetic
tgcgattttataaaaaaggccaaatgaaagaaatgagtatgtcagaatggatatacactaagataaatgaggttg

SEQ ID NO: 26458 - DNA, 75 bp, Artificial Sequence
  Synthetic
agggagaaggtcattggtcatctattgttaaatttttaagatatcagggaatcaatttcattatgtttttggctg

SEQ ID NO: 26459 - DNA, 75 bp, Artificial Sequence
  Synthetic
cattaaaagattttttgcatgcagtaccaaagaaaaattgtattttaatatatggacctcctaattcagggaagt

SEQ ID NO: 26460 - DNA, 75 bp, Artificial Sequence
  Synthetic
catcctttgctatgtccttaatcaaggtgctgaaaggtagagtcctgtcctttgtaaattctaaaagccagtttt

SEQ ID NO: 26461 - DNA, 75 bp, Artificial Sequence
  Synthetic
ggttgcaaccactctctgaatgcaaaattgcactattggatgacgtaacagatccgtgctggctatatatggaca

SEQ ID NO: 26462 - DNA, 75 bp, Artificial Sequence
  Synthetic
aatatttaagaaatggcctagacggccattttgtgtctctagactgcaaatataaagctcctatgcaaacaaaat

SEQ ID NO: 26463 - DNA, 75 bp, Artificial Sequence
  Synthetic
tccctccattgttacttacttccaatattaatgtacatgcggaagtaaattacagatatttacatagtagaatta

SEQ ID NO: 26464 - DNA, 75 bp, Artificial Sequence
  Synthetic
aaggatttgagtttccaaatccttttccaatgaaatcagataatacacccgagtttgaattaactgaccaaagct

SEQ ID NO: 26465 - DNA, 75 bp, Artificial Sequence
  Synthetic
ggaaatctttttttgaaaggctttggacacaattagagctgagtgaccaagaagacgagggcgaaaatggagaat

SEQ ID NO: 26466 - DNA, 75 bp, Artificial Sequence
  Synthetic
gacacaattagagctgagtgaccaagaagacgagggcgaaaatggagaatctcagcgagcgtttcaatgttctgc

SEQ ID NO: 26467 - DNA, 75 bp, Artificial Sequence
  Synthetic
ctcagcgagcgtttcaatgttctgcaagatcagctaatgaacatatatgaagctgcagaacagacacttgaggca

SEQ ID NO: 26468 - DNA, 75 bp, Artificial Sequence
  Synthetic
caaatcacacactggacattgttgcgaaaagaagctgtgttgcttcattttgctaggcaaaagggtgttacaagg

SEQ ID NO: 26469 - DNA, 75 bp, Artificial Sequence
  Synthetic
cttggataccaacctgtgcccccattagcagtaactgaagcaaaagccaaagaggccatagggatgatgctgcaa

SEQ ID NO: 26470 - DNA, 75 bp, Artificial Sequence
  Synthetic
ctgcagtctctgcaaaagtctgagtatgcatcggagacatggactttagtggacactagcactgagacctttaga

SEQ ID NO: 26471 - DNA, 75 bp, Artificial Sequence
  Synthetic
agtgctccagaaaatcattttaagaaaggcccagtgtctgtggaggtgatttatgataaagacccagagaatgct

SEQ ID NO: 26472 - DNA, 75 bp, Artificial Sequence
  Synthetic
aatgcatacactatgtggaattatgtttattatatggattcagatgatgtttggcacaaaaccacaagtggggtg

SEQ ID NO: 26473 - DNA, 75 bp, Artificial Sequence
  Synthetic
aatcaaactggcatatattacatgcatggcaattttaagcactattatgttgtatttgctgatgatgcaagtaga

SEQ ID NO: 26474 - DNA, 75 bp, Artificial Sequence
  Synthetic
tatagtgctaccggacagtgggaagtaaaggttaataaggaaactgtgtttgctcctgtcaccagctccacccct

SEQ ID NO: 26475 - DNA, 75 bp, Artificial Sequence
  Synthetic
ccagggtcaccaggacaaacagacacaaacgcctcctccacgacccccacaaccacctctgactccgcgtccaga

SEQ ID NO: 26476 - DNA, 75 bp, Artificial Sequence
  Synthetic
caccaacagccacaacaaaccgaagccaaaggacgacaatacggaagacgaccatccagcagaacacggcgacag

SEQ ID NO: 26477 - DNA, 75 bp, Artificial Sequence
  Synthetic
gaaacgcagcaaaggagaaggcgatcaaggtcgcgataccgttcccgttctcgctcccgttcccggtcgcgggcc

SEQ ID NO: 26478 - DNA, 75 bp, Artificial Sequence
  Synthetic
aagtcccaagccgggttacgggccatacgcgccacctccatatccaggtccaggtccccgtcggtcacccagact

SEQ ID NO: 26479 - DNA, 75 bp, Artificial Sequence
  Synthetic
gggtcaggttcaggtctcggtccagatctcgatccagaaccagactcgcagccacctctaggcgaaggggaggtg

SEQ ID NO: 26480 - DNA, 75 bp, Artificial Sequence
  Synthetic
gagggtcaccccggcggcgctccaaatcacccgccaccccttcccgagaacgggaagaaaacagaagggcgcggg

SEQ ID NO: 26481 - DNA, 75 bp, Artificial Sequence
  Synthetic
gaggaaggagcaacgggaggagcgggcgacgtaggggaagatcatcttccacccccccccacccccacccccaca

SEQ ID NO: 26482 - DNA, 75 bp, Artificial Sequence
  Synthetic
aaacggcgaagaacagagtctgttagggtgcgcggcgtctctcctgacgaagtgggaaaatcacttcacacagtt

SEQ ID NO: 26483 - DNA, 75 bp, Artificial Sequence
  Synthetic
agtgcaagaaatagaggagaacttggaagattattggaggaagctctcgatcccccagtaattctatgtcgcggg

SEQ ID NO: 26484 - DNA, 75 bp, Artificial Sequence
  Synthetic
gaggcgaataccctgaaatgctttcgcaacagagctaaaaagaaatatgagggcttgttcagggcatttagcact

SEQ ID NO: 26485 - DNA, 75 bp, Artificial Sequence
  Synthetic
acgtggtcctgggtggctggagatagcattgagcgtctaggcaggcccagaatgctcattagctttgcttcagac

SEQ ID NO: 26486 - DNA, 75 bp, Artificial Sequence
  Synthetic
agacaaagaaaacattttgatgtcactgttaaatatccgaagggtgtagagacatcgtatggcaacctggacagc

SEQ ID NO: 26487 - DNA, 75 bp, Artificial Sequence
  Synthetic
ctgtaacagtactaatgcagctttgctactaacttatactaacatttaacccattactttttacattttttacgt

SEQ ID NO: 26488 - DNA, 75 bp, Artificial Sequence
  Synthetic
gtttttatattgctatggcgcgagctaaacgagtcaaacgcgactctgtaacacatatatatcaaacctgcaagc

SEQ ID NO: 26489 - DNA, 75 bp, Artificial Sequence
  Synthetic
aagcaggtacctgcccccccgatgttcttaataaagttgaacaaacaacagttgctgacaatattttaaaatatg

SEQ ID NO: 26490 - DNA, 75 bp, Artificial Sequence
  Synthetic
gcagtgctggtgttttctttggaggccttggcattagcaccggccgtggtaccgggggcatcacgggatataccc

SEQ ID NO: 26491 - DNA, 75 bp, Artificial Sequence
  Synthetic
cacttggtgaaggtcctggcgtctgtgttggaaatactcccacggtggtaaggccttcccttgttcctgaaactg

SEQ ID NO: 26492 - DNA, 75 bp, Artificial Sequence
  Synthetic
ttgggcctatgaatatattaccaattgatactctcaatcctgtggaacctactgcatcctctgtggtcccactca

SEQ ID NO: 26493 - DNA, 75 bp, Artificial Sequence
  Synthetic
ctgaatcctctgcatctgatctccttccaggggagatcgaaactattgctgagattcatccagttcctgagggtc

SEQ ID NO: 26494 - DNA, 75 bp, Artificial Sequence
  Synthetic
cagtggttgattctcctgttgtcaccacaagcaagggctccagtgccattttagaggttgcaccagaaccaagtc

SEQ ID NO: 26495 - DNA, 75 bp, Artificial Sequence
  Synthetic
caccaacacgtgttagggtgtcacgtacacagtatcacaatccatcttttcagagcatcacagagtctacacctg

SEQ ID NO: 26496 - DNA, 75 bp, Artificial Sequence
  Synthetic
cacagggtgaaagttctttagctgatcatgtgttggtcacttctggagccggtgggcaatccataggcagtgaga

SEQ ID NO: 26497 - DNA, 75 bp, Artificial Sequence
  Synthetic
tcacagatattatagaattacaggaatttcccagtaggtattcctttgaaattgaggaacctactccaccacgac

SEQ ID NO: 26498 - DNA, 75 bp, Artificial Sequence
  Synthetic
gtactagtactccatctcaaaggccacaagtattagggcaacgtagagggctgtcattgaccaacagaaggctag

SEQ ID NO: 26499 - DNA, 75 bp, Artificial Sequence
  Synthetic
ttcagcaagtaccagtagacaactctttatttttaactcagccatctaaattggttcgttttgcttttgataatc

SEQ ID NO: 26500 - DNA, 75 bp, Artificial Sequence
  Synthetic
ctgtatttgaagaggaggtcactaatatttttgaacaggatattgatgagttcgaggagccgcctgacagagatt

SEQ ID NO: 26501 - DNA, 75 bp, Artificial Sequence
  Synthetic
ttcttgatgtgcgtcagctaggccgccctcaatattctactaccccagcaggatacgtgcgggtcagcaggctag

SEQ ID NO: 26502 - DNA, 75 bp, Artificial Sequence
  Synthetic
gcacacgtgggaccattcgcacacgctcgggagcacaaatagggtctcaagttcatttctatagggacctgagtt

SEQ ID NO: 26503 - DNA, 75 bp, Artificial Sequence
  Synthetic
ctattaatacagaagatcctattgaattacaattcctaggtcaacactctggggatgccacaatagtgcaaggtc

SEQ ID NO: 26504 - DNA, 75 bp, Artificial Sequence
  Synthetic
cagtggaaagcacctttatagatgtagatatgtcagaaaatcctttgtcagagactgttgacgctggatccgaag

SEQ ID NO: 26505 - DNA, 75 bp, Artificial Sequence
  Synthetic
atttcttattagatgaggctgttgaggacttcagtggatcccaattagtgataggtaatagacggagtacaacat

SEQ ID NO: 26506 - DNA, 75 bp, Artificial Sequence
  Synthetic
cctatactgtaccccgttttgaaacaacaaggaacagctcatattatgtgcaggacacaaagggctattatgtgg

SEQ ID NO: 26507 - DNA, 75 bp, Artificial Sequence
  Synthetic
catatcctgagagtcgcgatactgcagagatcatctatccaactcctgatatacccatagttgttatacataccc

SEQ ID NO: 26508 - DNA, 75 bp, Artificial Sequence
  Synthetic
atgatagcagtggcgatttttatttacatcccagccttcgcaaacggaagcgtaaaagaaaatatttatgatttt

SEQ ID NO: 26509 - DNA, 75 bp, Artificial Sequence
  Synthetic
gcattcacagatggcagtgtggcaatcggcacatggtaaggtatacttgccaccatcaacaccagtggccagggt

SEQ ID NO: 26510 - DNA, 75 bp, Artificial Sequence
  Synthetic
gcaaagcacggacgaatacatacaaaggactaacatctactatcatgcaaatactgacagaccccttactgtagg

SEQ ID NO: 26511 - DNA, 75 bp, Artificial Sequence
  Synthetic
tcatccatattttaatgtatataacaacactggtgagacattacaggttcctaaggtatcaggcaatcaacacag

SEQ ID NO: 26512 - DNA, 75 bp, Artificial Sequence
  Synthetic
ggtgtttcgtctgaagttgcctgatccaaacagatttgcattagctgacatgtcagtttataatccagataagga

SEQ ID NO: 26513 - DNA, 75 bp, Artificial Sequence
  Synthetic
gcgtttggtgtgggcctgtagaggtttggaaataagtagagggcaacccttaggtgtcggcagcacaggtcaccc

SEQ ID NO: 26514 - DNA, 75 bp, Artificial Sequence
  Synthetic
ttactttaataaactgaaggatactgaaaacagtaatcaatattccaccacttccaaagatgacagacaaaatac

SEQ ID NO: 26515 - DNA, 75 bp, Artificial Sequence
  Synthetic
ctcttttgacccaaaacaaatacagatgttcatagttggatgtacaccttgtattggggaacattgggaaaaggc

SEQ ID NO: 26516 - DNA, 75 bp, Artificial Sequence
  Synthetic
tttgccatgtgcaggacaggcgcaggacaatggagcctgtcctcctatagaattaaagaacactgttatccagga

SEQ ID NO: 26517 - DNA, 75 bp, Artificial Sequence
  Synthetic
tggggatatggcagatattggctttggtaatataaactttaaaacattacaacaaaataggtcagatgtcagttt

SEQ ID NO: 26518 - DNA, 75 bp, Artificial Sequence
  Synthetic
agatattgtagatgaaatttgcaaatatccagattttctaaaaatgcaaaatgatatatatggagacgcatgctt

SEQ ID NO: 26519 - DNA, 75 bp, Artificial Sequence
  Synthetic
cttttatgctcgaagagaacagtgttatgctagacacttttttgttagaggaggtaaaacaggtgacgatattcc

SEQ ID NO: 26520 - DNA, 75 bp, Artificial Sequence
  Synthetic
tgctgcacaaaccgatgatggcaatatgaaaaatcaatattacattcctgcagcacaggatcaggctcaaaagga

SEQ ID NO: 26521 - DNA, 75 bp, Artificial Sequence
  Synthetic
ccttgggaatgccatgtatttcccaactgttagtggctcattagtttcaagtgatgcccaattgtttaacaggcc

SEQ ID NO: 26522 - DNA, 75 bp, Artificial Sequence
  Synthetic
cttctggctacagcgagctcaaggtcataataatggcatcttgtgggccaaccaaatgtttgtcactgtggtaga

SEQ ID NO: 26523 - DNA, 75 bp, Artificial Sequence
  Synthetic
caacacacgaaacaccaatttcagtatttcagtttatagtgaaggtggacaaataaaagatatcagggactacac

SEQ ID NO: 26524 - DNA, 75 bp, Artificial Sequence
  Synthetic
atctacacagttcagggaatatttaaggcatgtggaggaatatgaaatatctgtcatattgcagttatgtaaaat

SEQ ID NO: 26525 - DNA, 75 bp, Artificial Sequence
  Synthetic
acctttaaaagcagaagtcttggctcagataaatgccatgaaccccttattattggaggactggcaattaggatt

SEQ ID NO: 26526 - DNA, 75 bp, Artificial Sequence
  Synthetic
tgtccctacacctgacaatccaattcatgatacctacagatttattgactctttggctacccgtgccctgacaaa

SEQ ID NO: 26527 - DNA, 75 bp, Artificial Sequence
  Synthetic
tcccccaaaagaaaaacctgacccttatgaaggcttaaacttttggaatgtagatttatcagaacgtttgtcatt

SEQ ID NO: 26528 - DNA, 75 bp, Artificial Sequence
  Synthetic
agatttggatcaatactctttgggacgcaaatttttgtttcaagctgggttacaacaaacgaccgttaacggtac

SEQ ID NO: 26529 - DNA, 75 bp, Artificial Sequence
  Synthetic
aaaaactacaatgcggggttctttaaggggaaccaaacgcaaaagaaaaaattaacttaagaccgatatcggtac

SEQ ID NO: 26530 - DNA, 75 bp, Artificial Sequence
  Synthetic
atctccctcaacttttacacagtattcaaggaatgtttgtgttactctgactaagcataacgctgcctaggaaat

SEQ ID NO: 26531 - DNA, 75 bp, Artificial Sequence
  Synthetic
taaccgcgcccggtacataaaaggtgagttggtgccaaatgagattcagtttggtgccaggacagaccttgtagg

SEQ ID NO: 26532 - DNA, 75 bp, Artificial Sequence
  Synthetic
ttctaacatgctcggattagggtattcgccaaggaagttttagcttgccaagtttcttttggcactcttatttgg

SEQ ID NO: 26533 - DNA, 75 bp, Artificial Sequence
  Synthetic
tagggtattcgccaaggaagttttagcttgccaagtttcttttggcactcttatttggcacagtcgcagaccgat

SEQ ID NO: 26534 - DNA, 75 bp, Artificial Sequence
  Synthetic
atggagagctatcctcagtcagtggcaggtttggctagtcttttagatataccagtagaagatttattaattcct

SEQ ID NO: 26535 - DNA, 75 bp, Artificial Sequence
  Synthetic
tgcaatttttgcggcacctttctcactttcctggagcttcaggaatttgatgcgaaggttttaacattgatttgg

SEQ ID NO: 26536 - DNA, 75 bp, Artificial Sequence
  Synthetic
aaggagcatttagtatatgcttgttgtagatgttgctgtacagcaagtggcttttttgaatttcaacatttctat

SEQ ID NO: 26537 - DNA, 75 bp, Artificial Sequence
  Synthetic
gagcagtcagttttgggaagagatatagaaactgtagcaaatgcaacaatttttcaaattgttgttagatgccat

SEQ ID NO: 26538 - DNA, 75 bp, Artificial Sequence
  Synthetic
cagtgtttaagactacttgatcaaatagataagttagatatttgtggacgcagacaacattttcataaagtcaga

SEQ ID NO: 26539 - DNA, 75 bp, Artificial Sequence
  Synthetic
ggaggttggagaggtcgttgcaggttttgcaaataatgatagggaatcaggtcactatacaagacgtagtcttag

SEQ ID NO: 26540 - DNA, 75 bp, Artificial Sequence
  Synthetic
gtcactatacaagacgtagtcttagagttagaaccttatcctattgacctgttttgcgaagaagaggagttacca

SEQ ID NO: 26541 - DNA, 75 bp, Artificial Sequence
  Synthetic
accgagcaggatattgaggcggaggaggagtcagagaaaataccttacaaagttgttgcaccttgcggctgctgt

SEQ ID NO: 26542 - DNA, 75 bp, Artificial Sequence
  Synthetic
gaatcaagacttcgtctgtatatatttgctacaaaccttggaattcgaaccttgcaaacgcttttattagaagaa

SEQ ID NO: 26543 - DNA, 75 bp, Artificial Sequence
  Synthetic
ttgctacaaaccttggaattcgaaccttgcaaacgcttttattagaagaaatcaacttgttgtgtcctacctgcc

SEQ ID NO: 26544 - DNA, 75 bp, Artificial Sequence
  Synthetic
gtcagcgcatccagtatggcggagaataataaaggtactataaatgctaaagaagggtgcagtaattggtttatt

SEQ ID NO: 26545 - DNA, 75 bp, Artificial Sequence
  Synthetic
ttggaagcagactgtagtgacttagaaaacgatttggaaaacttatttgatgaaagtactaattctgatatttct

SEQ ID NO: 26546 - DNA, 75 bp, Artificial Sequence
  Synthetic
aaaacgatttggaaaacttatttgatgaaagtactaattctgatatttctgggttaattgatgatggggacgtgg

SEQ ID NO: 26547 - DNA, 75 bp, Artificial Sequence
  Synthetic
agcaggggaattcccgggaactatttcagcaacaggagagtgaggacagcgaagagcaattacaaaaactaaaac

SEQ ID NO: 26548 - DNA, 75 bp, Artificial Sequence
  Synthetic
gaagagcaattacaaaaactaaaacgaaagtatttgagtccaattgctgttgcacagcttagtccgcgacttcag

SEQ ID NO: 26549 - DNA, 75 bp, Artificial Sequence
  Synthetic
tgtatttcactatctcctcagcaaaaaagtaaaagacgtctttttactgagcaggacagcgggcttgagctgact

SEQ ID NO: 26550 - DNA, 75 bp, Artificial Sequence
  Synthetic
cttacaaatgaagctgaagatatttctcctgaaaaagtggaggtaccaagaactgacaatactcctccgcctgcc

SEQ ID NO: 26551 - DNA, 75 bp, Artificial Sequence
  Synthetic
gaaagcagtgtgaggacagggaattatcattttaaagagttgttgcgatgcagcaacattagagctacattgctt

SEQ ID NO: 26552 - DNA, 75 bp, Artificial Sequence
  Synthetic
gcaaagtttaaagtagcatatgaagttgggtttaatgatttgactcgacaatttaaaagtcataaaacatgctgt

SEQ ID NO: 26553 - DNA, 75 bp, Artificial Sequence
  Synthetic
aatgattgggtagcaactgtatacggtgtaaatgatgatttgtatgaaagtgcaaaacaattatttcaacagcat

SEQ ID NO: 26554 - DNA, 75 bp, Artificial Sequence
  Synthetic
tgccaatatgtgtgggctttaagatctaatgcgatgtcattgtttctattgtgttttaaggcgggaaaaaatcgc

SEQ ID NO: 26555 - DNA, 75 bp, Artificial Sequence
  Synthetic
tgcactgtgttgaaactgctgactagcattttatgtgttcgtgaagagcagatattggcagagccacctaagctt

SEQ ID NO: 26556 - DNA, 75 bp, Artificial Sequence
  Synthetic
agaagtgctgtagctgcactattctggtatcaaggcagtaatatgtctggtgcttttacgcatggaacactgcca

SEQ ID NO: 26557 - DNA, 75 bp, Artificial Sequence
  Synthetic
tcatggattgtacaacaaactatgatagggcatcaaatggcagatgctacaacgtttgatttatcaaaaatggtt

SEQ ID NO: 26558 - DNA, 75 bp, Artificial Sequence
  Synthetic
caatgggcatttgacaataatcacacagaggaatcagatattgcatatcactatgcaaagttagcaccagaagat

SEQ ID NO: 26559 - DNA, 75 bp, Artificial Sequence
  Synthetic
attaatgctgtggcatggctcgctcataatagtcaggcacggtttgttagggaatgtgcagcaatggttaggtat

SEQ ID NO: 26560 - DNA, 75 bp, Artificial Sequence
  Synthetic
tataaaagggggcaaatgcgagatatgtctatctcagagtggatatataaccgtcttgaagaagtagaaggtgtt

SEQ ID NO: 26561 - DNA, 75 bp, Artificial Sequence
  Synthetic
ggacattggtcaaccattgtaaagtttattaggtatcaggaaattaattttataatgtttatggctaccttaaag

SEQ ID NO: 26562 - DNA, 75 bp, Artificial Sequence
  Synthetic
gatttcttgcattcagtgccaaaacataattgtattttaatacatggtcctcccaatacaggtaaatctgcattt

SEQ ID NO: 26563 - DNA, 75 bp, Artificial Sequence
  Synthetic
acaatgtcattaattagggtgctacgtggaagggtcatatcatttgtaaattctaaaagtcaattttggctgcaa

SEQ ID NO: 26564 - DNA, 75 bp, Artificial Sequence
  Synthetic
ccgttaggtgattgtaaaatagcattgttggacgatgcaactgatccatgttggatatatatggatcaatattta

SEQ ID NO: 26565 - DNA, 75 bp, Artificial Sequence
  Synthetic
cgaaatggattagatggccatccggtatcgttggattgtaaacatagagctccaatacaaattaagtttcctcca

SEQ ID NO: 26566 - DNA, 75 bp, Artificial Sequence
  Synthetic
ttgttagtaacatctaacattgatgtacacagtgaagtacaatataaatatttacatagtagaatacagtcattt

SEQ ID NO: 26567 - DNA, 75 bp, Artificial Sequence
  Synthetic
tttacatagtagaatacagtcatttaaatttccaaataaatttcccttaaatgctgacaatacaccacaatttga

SEQ ID NO: 26568 - DNA, 75 bp, Artificial Sequence
  Synthetic
atttactgaccaaagctggaaatctttttttaaaaggctttggaatcaattagagctcagtgaccacgaagagga

SEQ ID NO: 26569 - DNA, 75 bp, Artificial Sequence
  Synthetic
ggaggatggagacactcagcgagcgtttcaatgctctgcaagaccttctaatgaacatttatgaagcagctaaaa

SEQ ID NO: 26570 - DNA, 75 bp, Artificial Sequence
  Synthetic
acacccttgaagcacaaattgagcattggcaattattgagacgagaagcagtattgttatttgttgccagacaaa

SEQ ID NO: 26571 - DNA, 75 bp, Artificial Sequence
  Synthetic
agggtgttttaagacttggatatcagcctgtacctccacaggccatttccgaaagtaaagcaaaagatgctataa

SEQ ID NO: 26572 - DNA, 75 bp, Artificial Sequence
  Synthetic
tgatggtgctgcaattacaatcactccagaactctaaatttaaggatgagccatggacattggtagataccagtt

SEQ ID NO: 26573 - DNA, 75 bp, Artificial Sequence
  Synthetic
tggaaacctatagaaaccgacctgaaaatactttcaaaaaaggacctgtaagtgtggaggtcatgtatgataatg

SEQ ID NO: 26574 - DNA, 75 bp, Artificial Sequence
  Synthetic
accccacaaacaccaacatatacacaatgtggagacatgtgtattatttggatacagatgatgtgtggcaaaaaa

SEQ ID NO: 26575 - DNA, 75 bp, Artificial Sequence
  Synthetic
cggagagtggagtaaaccacacaggcatatattatctacaaggaacatttaaacattattatacattatttgctg

SEQ ID NO: 26576 - DNA, 75 bp, Artificial Sequence
  Synthetic
atgatgcgcctagatttagtaccaccggacaatgggaagttatgattaataaggaaactgtgtttgctcctgtta

SEQ ID NO: 26577 - DNA, 75 bp, Artificial Sequence
  Synthetic
ctagctccaccccgccggactcccccggaagacaagtatccggacaaagcaccgggactaccgccaccaacaccg

SEQ ID NO: 26578 - DNA, 75 bp, Artificial Sequence
  Synthetic
agaccacctacattaccaccacagagaccacaaccaccaccaagcagcaacgacgaccaagatacagacggaaag

SEQ ID NO: 26579 - DNA, 75 bp, Artificial Sequence
  Synthetic
attctagtcctacaaccaccaccacccaaacgagatccaggcaagcgaagcagagaagacgaaccagatccaggt

SEQ ID NO: 26580 - DNA, 75 bp, Artificial Sequence
  Synthetic
ccgtcgggtcccaagaaaggagaactaggtccagatctcgatcagcatccagtagaggggtccgaaaacgacagc

SEQ ID NO: 26581 - DNA, 75 bp, Artificial Sequence
  Synthetic
gaagcagaagtacccacagagggagggggaggaggtcccgatcaacctcccaaggaaggtgccctaggagaagga

SEQ ID NO: 26582 - DNA, 75 bp, Artificial Sequence
  Synthetic
gacgtagaaggtcatcctcctcttcatccatctccacctcctgctctacctcctccgtgtcctcctcctcacaac

SEQ ID NO: 26583 - DNA, 75 bp, Artificial Sequence
  Synthetic
ggcgaaagcggggacgaggaggttcacggcctagctcataccgtggcatctctcctagcgatgtgggaaaatcag

SEQ ID NO: 26584 - DNA, 75 bp, Artificial Sequence
  Synthetic
ttcaatcagttagtggaagacataaaggacgacttggaagattattggaggaagcttatgaccccccagtaattt

SEQ ID NO: 26585 - DNA, 75 bp, Artificial Sequence
  Synthetic
tgcttaagggtgcagctaacacgctcaaatgctttaggaaccgcactaaaattaagcataaggatttgtttaaat

SEQ ID NO: 26586 - DNA, 75 bp, Artificial Sequence
  Synthetic
gcatttctaccacattttcatgggtggctaatgacggctgtgagcgattgggtagacatagaatgcttattagtt

SEQ ID NO: 26587 - DNA, 75 bp, Artificial Sequence
  Synthetic
ttacatccatagagcaaagaaacaaatttgataatagtataaagtatcctaaagctgttgaaaggacatttggaa

SEQ ID NO: 26588 - DNA, 75 bp, Artificial Sequence
  Synthetic
gcttagacagtttataatactaacaaacttgcttaacttatgctgcttttgctactaacacactaatattttttt

SEQ ID NO: 26589 - DNA, 75 bp, Artificial Sequence
  Synthetic
ttacttttatattttgctatggtgcgtgccaaaagggtcaaacgtgactctgctacccatatttaccaaacctgc

SEQ ID NO: 26590 - DNA, 75 bp, Artificial Sequence
  Synthetic
aaacaagcaggtacctgccctcccgatgtagttaataaagtggagcaaactactgttgctgacaacattttaaaa

SEQ ID NO: 26591 - DNA, 75 bp, Artificial Sequence
  Synthetic
tatgggagtgctgctgtgttttttggtggtttgggcataggaacaggccgtggcaccggtggcacaacgggttat

SEQ ID NO: 26592 - DNA, 75 bp, Artificial Sequence
  Synthetic
gtccctcttggggaaggaccaggagtgcgagtaggtaatacacctacagtggtacgaccctccattgtcccagag

SEQ ID NO: 26593 - DNA, 75 bp, Artificial Sequence
  Synthetic
acaataggtcctgctgaaataactcctattgataccattaatcctattgatccttcagcatcttctgttgtgcca

SEQ ID NO: 26594 - DNA, 75 bp, Artificial Sequence
  Synthetic
ttgacagaagcaccatcagttgatttattacctggtgaggtggaaactattgctgaaattcatcctgtaccagaa

SEQ ID NO: 26595 - DNA, 75 bp, Artificial Sequence
  Synthetic
gcgccatccacagactcaccagtagttactactagtagagggccaagtgctgtattagaagttgcgcctgaaccc

SEQ ID NO: 26596 - DNA, 75 bp, Artificial Sequence
  Synthetic
acccctcccacacgggttagagtgtcccgtagtcaataccacaatccttcttttcaaattataacagaatctact

SEQ ID NO: 26597 - DNA, 75 bp, Artificial Sequence
  Synthetic
ccaacacagggggaaagttcactggcagatcatgtattagtgacctctggttctggaggtcaaattataggcggc

SEQ ID NO: 26598 - DNA, 75 bp, Artificial Sequence
  Synthetic
tcgtctactgaagttatagagctacaggaattcccaaataggtacagttttgaaatagaagaacctactcctccg

SEQ ID NO: 26599 - DNA, 75 bp, Artificial Sequence
  Synthetic
cggcgtagtagtacacctgtacaccgcccaacaaatgttcgcagaggtagaggaccatcattaacaaatagacgt

SEQ ID NO: 26600 - DNA, 75 bp, Artificial Sequence
  Synthetic
ttagttcagcaggtgcaagttgagaatcctttgtttttaacacagccatcccgtttggtacgttttgcatttgat

SEQ ID NO: 26601 - DNA, 75 bp, Artificial Sequence
  Synthetic
aatcctgtgtttgaagaggaagtaacaaatatatttgagcaagatgttagtaattttgaagagccgccagacaga

SEQ ID NO: 26602 - DNA, 75 bp, Artificial Sequence
  Synthetic
gattttttagatgtagctaaattaggtaggcctcagtattctgaaacaccagctggatatgttcgtgttagtcgc

SEQ ID NO: 26603 - DNA, 75 bp, Artificial Sequence
  Synthetic
ctggggcaaagacagacaattagaactcgttctggagctagcattggtagtcaggtgcatttctatagagaccta

SEQ ID NO: 26604 - DNA, 75 bp, Artificial Sequence
  Synthetic
agtacaattaattctgaagatcctatagagttacaactgctaggacagcattcaggcgatgccactatagtacaa

SEQ ID NO: 26605 - DNA, 75 bp, Artificial Sequence
  Synthetic
ggggcatcagctgaaagtacatttgtagatatggatttgggcataaatcctatatctgaaagtgaagaagctttt

SEQ ID NO: 26606 - DNA, 75 bp, Artificial Sequence
  Synthetic
tcccatgacttattgttggatgaagctgtagaagatttttctggttctcagttagttataggcaacagacggagc

SEQ ID NO: 26607 - DNA, 75 bp, Artificial Sequence
  Synthetic
actgtaagttatacagtaccacgctttgaaacgccacgtagtgcttcctattatgttcaagatactaaagggtat

SEQ ID NO: 26608 - DNA, 75 bp, Artificial Sequence
  Synthetic
tatgttgcatatccagagtctagaaataatatggaaattatatatcctagtcctgaattacctgttgtaattatc

SEQ ID NO: 26609 - DNA, 75 bp, Artificial Sequence
  Synthetic
cacacacatgacaccacaggagacttttatttacatcccagtttaactttacgtaaacgacgcaaaagaaaatat

SEQ ID NO: 26610 - DNA, 75 bp, Artificial Sequence
  Synthetic
tttatttacatcccagtttaactttacgtaaacgacgcaaaagaaaatatttgtgatttttgtttacagatggct

SEQ ID NO: 26611 - DNA, 75 bp, Artificial Sequence
  Synthetic
gtctggcaatcggctagtggtaaggtctatctaccgccttctacaccagttgcaagggtccaaggcacggatgaa

SEQ ID NO: 26612 - DNA, 75 bp, Artificial Sequence
  Synthetic
tatgttgagcgcaccaacatctattaccatgcatatagtgatcgcttgctcacagttgggcacccatattttaac

SEQ ID NO: 26613 - DNA, 75 bp, Artificial Sequence
  Synthetic
atttacaacaatgcaggcacacgtttggaagtacctaaagtctctggaaatcaacatagggtctttaggctgaaa

SEQ ID NO: 26614 - DNA, 75 bp, Artificial Sequence
  Synthetic
ttgcctgaccccaatagatttgcattagcggacatgtctgtctataatccagacaaagaaagattagtgtggggc

SEQ ID NO: 26615 - DNA, 75 bp, Artificial Sequence
  Synthetic
ctaaagggtatagaaataggcaggggacaaccattaggtataggcagtagtggacatcccttatttaataaggtt

SEQ ID NO: 26616 - DNA, 75 bp, Artificial Sequence
  Synthetic
aatgacacggaaaatgggaacacatataaaactacctctaaagatgacagacagaatatctcatttgatcccaaa

SEQ ID NO: 26617 - DNA, 75 bp, Artificial Sequence
  Synthetic
caactacagatgtttattattggctgcaccccatgcatcggcgaacattgggacagagcccctgcttgtgtggct

SEQ ID NO: 26618 - DNA, 75 bp, Artificial Sequence
  Synthetic
gatgatcagcctggtagatgtcccccaatagaattagtaaactcatatattcaggatggtgatatggcagacatt

SEQ ID NO: 26619 - DNA, 75 bp, Artificial Sequence
  Synthetic
ggatatggcaatattaattttaaaaacttacaacaaaacagatcagatgttagcttagatatagttgatgaaatt

SEQ ID NO: 26620 - DNA, 75 bp, Artificial Sequence
  Synthetic
tgcaagtatccagactttttaaaaatgcaaaatgatgtttatggagatgcttgctttttttatgccagacgggag

SEQ ID NO: 26621 - DNA, 75 bp, Artificial Sequence
  Synthetic
caatgttatgctagacattttttcgtgagaggggggaaaccaggtgatgacattcctgcatctcaaatagacgat

SEQ ID NO: 26622 - DNA, 75 bp, Artificial Sequence
  Synthetic
ggcaatttaaaaaatgaatattacattcctgctgactcagcacagccacaaaacaaacttggaaattccatgtat

SEQ ID NO: 26623 - DNA, 75 bp, Artificial Sequence
  Synthetic
aaacaaacttggaaattccatgtatttcccaactataagtggttcattggtgtcaagtgatgcccaattatttaa

SEQ ID NO: 26624 - DNA, 75 bp, Artificial Sequence
  Synthetic
caggcccttctggctacaaagagcacagggtcataataatggcatcttatggggtaatcaattgtttgtgactgt

SEQ ID NO: 26625 - DNA, 75 bp, Artificial Sequence
  Synthetic
attggataatactagaaacaccaactttagtattgctgtttatcaggaacagaagaaggtaaaagaaatagagag

SEQ ID NO: 26626 - DNA, 75 bp, Artificial Sequence
  Synthetic
ttacgattctaccaagtttaatgaattccaaaggcatgttgaagaatatgaagtatcacttattttacagctttg

SEQ ID NO: 26627 - DNA, 75 bp, Artificial Sequence
  Synthetic
taaaattccactaaaggctgaggtgctagcacaaattaatgcaatgaactctgacattctggagaattggcagtt

SEQ ID NO: 26628 - DNA, 75 bp, Artificial Sequence
  Synthetic
agggttcgtacctacaccagataatcctattcacgacacatacagatatttagactctttggccacacgctgccc

SEQ ID NO: 26629 - DNA, 75 bp, Artificial Sequence
  Synthetic
agaaaaagtgccagcaaaagaaaaggaggacccctatgctaaatatgtattttggaatgttgatttgtctgaacg

SEQ ID NO: 26630 - DNA, 75 bp, Artificial Sequence
  Synthetic
attatctttggatttggatcaatattctttgggacgcaaatttctgtttcaagcagggctaacccaaaagtcctc

SEQ ID NO: 26631 - DNA, 75 bp, Artificial Sequence
  Synthetic
tctttgggacgcaaatttctgtttcaagcagggctaacccaaaagtcctctaatggctctatatctcgtgcagtg

SEQ ID NO: 26632 - DNA, 75 bp, Artificial Sequence
  Synthetic
tccagaggtactaaaagaaaaagaaaataaactgtaccagtttcggtctttgaactttgtccaaggaatgtgtta

SEQ ID NO: 26633 - DNA, 75 bp, Artificial Sequence
  Synthetic
ttcatagtgactaacatgaactttatacatgccaatgaccgcacccggtcttatatctaaagatctgtatcgatc

SEQ ID NO: 26634 - DNA, 75 bp, Artificial Sequence
  Synthetic
ttggcattaaatcgccatgttcgttcgcacacgctcggtatagctgccaacattttcgcgccaagaactctggcg

SEQ ID NO: 26635 - DNA, 75 bp, Artificial Sequence
  Synthetic
gctgcccaggaccgttaacggtaagtactgtgttgttttgcaccaggtgcggtacaagctgttattactcacggt

SEQ ID NO: 26636 - DNA, 75 bp, Artificial Sequence
  Synthetic
cattgttgccaacaaccatccttctcttcttatacgtgtctgaacagtattgtatttgtatatatatatatataa

SEQ ID NO: 26637 - DNA, 75 bp, Artificial Sequence
  Synthetic
ttgtatatatatatatataaatatatatatatatatatattgggtctttagcacatcaggagatttagagaacca

SEQ ID NO: 26638 - DNA, 75 bp, Artificial Sequence
  Synthetic
aacggtaagtagcaagttccttgtaccaggtgcggtattgggattttgcaattgtaatggttgttgccaactacc

SEQ ID NO: 26639 - DNA, 75 bp, Artificial Sequence
  Synthetic
ccaggtgcggtattgggattttgcaattgtaatggttgttgccaactaccataggcacattcaagtttttgcctg

SEQ ID NO: 26640 - DNA, 75 bp, Artificial Sequence
  Synthetic
tatcgttttcgtatcctgttaacaatatctaatatatgtatacataaataaatatatatatatataagtgtctaa

SEQ ID NO: 26641 - DNA, 75 bp, Artificial Sequence
  Synthetic
agaattaccttcaactattagagacttagctgaaaccttaggcatccctcttattgattgtataataccttgcaa

SEQ ID NO: 26642 - DNA, 75 bp, Artificial Sequence
  Synthetic
tttttgtggtaaatttttaaattatttggaagcctgtgaattcgactacaaaaaacttagcctaatttggaaaga

SEQ ID NO: 26643 - DNA, 75 bp, Artificial Sequence
  Synthetic
ttattgtgtgtttgcgtgttgtcgcgtatgctgtggcgccactgcaacatacgaatttaatcaattttatgagca

SEQ ID NO: 26644 - DNA, 75 bp, Artificial Sequence
  Synthetic
gacagtgttaggaagagatattgagttagcttcaggactctcgatttttgatattgatatcaggtgtcaaacttg

SEQ ID NO: 26645 - DNA, 75 bp, Artificial Sequence
  Synthetic
aaggatctcttacaaagttatagctccgtgcggttgcaggcactgtgaggtcaagcttcgcatttttgtccacgc

SEQ ID NO: 26646 - DNA, 75 bp, Artificial Sequence
  Synthetic
caacagctattgaccggagatctgcagctcctgtgtcctgactgtcgcggaaactgcaaacatgacggatcctaa

SEQ ID NO: 26647 - DNA, 75 bp, Artificial Sequence
  Synthetic
caacaggagtgtgagcagagcgaggagcaattacaaaaactaaaacgaaagtatcttagtccaaaagctgtcgca

SEQ ID NO: 26648 - DNA, 75 bp, Artificial Sequence
  Synthetic
cagcttagtccgcgacttgagtcaatttcattgtcacctcagcagaagtctaagcgaaggctctttgcagagcag

SEQ ID NO: 26649 - DNA, 75 bp, Artificial Sequence
  Synthetic
tctcggccggatgacgagggaggttcaggggatgtagatatacattatacagcactgttgcgttctagcaacaaa

SEQ ID NO: 26650 - DNA, 75 bp, Artificial Sequence
  Synthetic
gagccgccaaaattgagaaatacagcagctgcattgttctggtataaaggttgtatgggatcgggggcgtttagc

SEQ ID NO: 26651 - DNA, 75 bp, Artificial Sequence
  Synthetic
aagtgctgaggcaagtacttttgatttttcagcaatggtccaatgggcatttgataatcatttattagacgaacc

SEQ ID NO: 26652 - DNA, 75 bp, Artificial Sequence
  Synthetic
agatatagcataccagtatgcaaggcttgcacctgaagatgcaaatgcagtagcttggcttgcacataacaacca

SEQ ID NO: 26653 - DNA, 75 bp, Artificial Sequence
  Synthetic
ggccaaatttgtgagagaatgtgcagctatggtacgattttataaaaagggacaaatgagagacatgagcatatc

SEQ ID NO: 26654 - DNA, 75 bp, Artificial Sequence
  Synthetic
gacaaatgagagacatgagcatatctgaatggatatacacgaaaattaatgaagtagaaggtgaagggcactggt

SEQ ID NO: 26655 - DNA, 75 bp, Artificial Sequence
  Synthetic
ctaactgcattaaaagaattcctacactcagtgccaaaaaaaaattgtattttaatatatggtcctccaaattct

SEQ ID NO: 26656 - DNA, 75 bp, Artificial Sequence
  Synthetic
ggaaagtcatcatttgcaatgtctttaataagagtgttaaagggtagggtgttgtcatttgtaaactctaagagt

SEQ ID NO: 26657 - DNA, 75 bp, Artificial Sequence
  Synthetic
cagttttggctgcaacccctttcagaatgcaagatagctctattggatgatgtaacagacccttgttgggtatac

SEQ ID NO: 26658 - DNA, 75 bp, Artificial Sequence
  Synthetic
catctaacatcaatgtgcatggggaagccaattatagatatttacacagtagaataagaggatttgaatttccaa

SEQ ID NO: 26659 - DNA, 75 bp, Artificial Sequence
  Synthetic
taatgccaatttgtatacaatgtggacttatgtgtattatatggatacggatgataagtggcataaggcaagaag

SEQ ID NO: 26660 - DNA, 75 bp, Artificial Sequence
  Synthetic
tatttacaaggaacttttaaaaactattatgtactgtttgctgacgatgcaaaacgatatggtacaactggagaa

SEQ ID NO: 26661 - DNA, 75 bp, Artificial Sequence
  Synthetic
cacgcctccagggtcgccaggaagacaagcagacacagacaccaccgccaagacccccaccacctccacaaccgc

SEQ ID NO: 26662 - DNA, 75 bp, Artificial Sequence
  Synthetic
caaggtcccgacaccggtcccggtctcggtcccggtcgcgctccaagtcccaaacccacaccacttggtccacca

SEQ ID NO: 26663 - DNA, 75 bp, Artificial Sequence
  Synthetic
ccaggtcccggtccacgtcggtcggcaagactcgggcccttacaagcagatcgcgatccaggggaaggtccccaa

SEQ ID NO: 26664 - DNA, 75 bp, Artificial Sequence
  Synthetic
caagactcgggcccttacaagcagatcgcgatccaggggaaggtccccaagtacctgcagaaggggaggtggaag

SEQ ID NO: 26665 - DNA, 75 bp, Artificial Sequence
  Synthetic
gtcacccaggcggcgatcaaggtcaccctccacctactcctcctgcaccacacaacggtcacagcgggcacgggc

SEQ ID NO: 26666 - DNA, 75 bp, Artificial Sequence
  Synthetic
cgaaagtccaacaaccagaggggcccgagggtcgagagggtcacgaggagggagccgtggggggagattgcggcg

SEQ ID NO: 26667 - DNA, 75 bp, Artificial Sequence
  Synthetic
cgagggtcgagagggtcacgaggagggagccgtggggggagattgcggcgacgaggaaggtcatcctcctcctcc

SEQ ID NO: 26668 - DNA, 75 bp, Artificial Sequence
  Synthetic
attgtcaaaggggcggctaacacactaaaatgcttccgcaacagagctaaaattaaatacacgggactgtttagg

SEQ ID NO: 26669 - DNA, 75 bp, Artificial Sequence
  Synthetic
tggcaggagatggcactgagcgtctaggcaggcccagaatgctcattagcttttcttcctatagtcaaagaagag

SEQ ID NO: 26670 - DNA, 75 bp, Artificial Sequence
  Synthetic
attttgatgaagcagtgcgatacccaaagggagttgataaggcctatggcaaccttgacagtctttaacatttac

SEQ ID NO: 26671 - DNA, 75 bp, Artificial Sequence
  Synthetic
aaccttgacagtctttaacatttactaatgctgcttctgctactaacatactaacataccctagcgttttatact

SEQ ID NO: 26672 - DNA, 75 bp, Artificial Sequence
  Synthetic
ctgtaaacaggcaggtacttgcccccctgatgttattaataaagtggaacagacaacagttgctgacaatattct

SEQ ID NO: 26673 - DNA, 75 bp, Artificial Sequence
  Synthetic
tgaaacggttgggcccgttgatattttgcccattgatacagttaaccccgtggaacctacagcatcatccgtggt

SEQ ID NO: 26674 - DNA, 75 bp, Artificial Sequence
  Synthetic
tcctttaactgagtccacaggcgctgatttacttccaggtgaagtagaaacgattgctgaaatccatcctgtacc

SEQ ID NO: 26675 - DNA, 75 bp, Artificial Sequence
  Synthetic
tgaagggccatcagtagatacccctgtggttaccactagcacaggttccagtgctgttttagaggttgcccccga

SEQ ID NO: 26676 - DNA, 75 bp, Artificial Sequence
  Synthetic
gcctattcctccaacacgggtcagagtttcacgcacacattatcacaatccatcattccaaataataactgagtc

SEQ ID NO: 26677 - DNA, 75 bp, Artificial Sequence
  Synthetic
tactccagcacaaggggaatcgtctcttgcagatcacgtgttggtgacatcaggttctggggggcagcaaatagg

SEQ ID NO: 26678 - DNA, 75 bp, Artificial Sequence
  Synthetic
cttgcagatcacgtgttggtgacatcaggttctggggggcagcaaatagggggtgatataactgacattattgag

SEQ ID NO: 26679 - DNA, 75 bp, Artificial Sequence
  Synthetic
ccacgcaatcaatctgtaggccgcaggaggggtttctccttgactaatagacgtttggtacagcaagtacaagtg

SEQ ID NO: 26680 - DNA, 75 bp, Artificial Sequence
  Synthetic
gtaactaatatatttgaaaatgatctggatgtatttgaagaacctccagacagagattttcttgatgttagggaa

SEQ ID NO: 26681 - DNA, 75 bp, Artificial Sequence
  Synthetic
ttaagacgtccacaatattctacaacaccagcgggatatgtcagggtaagcagattggggacccgagccactatt

SEQ ID NO: 26682 - DNA, 75 bp, Artificial Sequence
  Synthetic
caccagcgggatatgtcagggtaagcagattggggacccgagccactattcgcactcgctcgggtgcacaaatag

SEQ ID NO: 26683 - DNA, 75 bp, Artificial Sequence
  Synthetic
cattatcagaaagcattgaagcatattcacatgatttattactagatgaggcggtggaagattttagtgggtctc

SEQ ID NO: 26684 - DNA, 75 bp, Artificial Sequence
  Synthetic
agcttgttataggtaatcgaaggagcacaacctcttacactgttcctaggtttgaaactacaaggaatggttcat

SEQ ID NO: 26685 - DNA, 75 bp, Artificial Sequence
  Synthetic
attatacccaagacacaaagggatattatgttgcttatccggagtcacgtaataatgcagaaatcatttatccta

SEQ ID NO: 26686 - DNA, 75 bp, Artificial Sequence
  Synthetic
cacctgacattcctgtggtcattatacacactcatgacaatacaggggacttttatttacatcccagtcttcgca

SEQ ID NO: 26687 - DNA, 75 bp, Artificial Sequence
  Synthetic
ttttatttacatcccagtcttcgcaggcgcaaacgtaaaagaaaatatttgtgatttgcattgcagatggcagtg

SEQ ID NO: 26688 - DNA, 75 bp, Artificial Sequence
  Synthetic
tgtaggtcatccttatttcaatgtatataatattactggtgataagcttgaggtccctaaggtttcaggaaatca

SEQ ID NO: 26689 - DNA, 75 bp, Artificial Sequence
  Synthetic
agccattgggtgtagggagcactggtcacccttatttcaataaagtaaaagatacagaaaacagtaatgcataca

SEQ ID NO: 26690 - DNA, 75 bp, Artificial Sequence
  Synthetic
ggatacatcctttgatcctaaacaaatccaaatgttcattgtaggatgcacaccttgcataggagagcattggga

SEQ ID NO: 26691 - DNA, 75 bp, Artificial Sequence
  Synthetic
atccaaatgttcattgtaggatgcacaccttgcataggagagcattgggataaggctgtgccttgtgcaaaaaat

SEQ ID NO: 26692 - DNA, 75 bp, Artificial Sequence
  Synthetic
gagcagcaaactggcctttgtcctcctattgaattaaaaaatacatatatagaagatggtgatatggcagatata

SEQ ID NO: 26693 - DNA, 75 bp, Artificial Sequence
  Synthetic
ggttttggaaatatgaactttaaggcacttcaagatagtagatcagatgtcagtttggatattgtcaatgaaact

SEQ ID NO: 26694 - DNA, 75 bp, Artificial Sequence
  Synthetic
tgcaaatatccagattttttaaagatgcaaaacgatatctatggcgatgcctgctttttttatgctcgtagggag

SEQ ID NO: 26695 - DNA, 75 bp, Artificial Sequence
  Synthetic
tgcaaaacgatatctatggcgatgcctgctttttttatgctcgtagggagcaatgttatgctagacacttttttg

SEQ ID NO: 26696 - DNA, 75 bp, Artificial Sequence
  Synthetic
ggtacatacaaaaatcaattttacattccaggagctgatggccaagctcaaaagactataggaaatgccatgtat

SEQ ID NO: 26697 - DNA, 75 bp, Artificial Sequence
  Synthetic
ctataatgcagagcaatttagagaatatcaaagacatgtagaagaatatgaaatatctttaattttacaactttg

SEQ ID NO: 26698 - DNA, 75 bp, Artificial Sequence
  Synthetic
taaggttcccttaaaggcggaggtattggcacagatcaatgcaatgaactcctctttattggaagattggcagtt

SEQ ID NO: 26699 - DNA, 75 bp, Artificial Sequence
  Synthetic
aggatttgttcccactcctgataatccaattcaggatacctacaggtatattgactctttggctacacggtgtcc

SEQ ID NO: 26700 - DNA, 75 bp, Artificial Sequence
  Synthetic
ccaattcaggatacctacaggtatattgactctttggctacacggtgtccagataaaaatcctccaaaagaaaag

SEQ ID NO: 26701 - DNA, 75 bp, Artificial Sequence
  Synthetic
attgtcattagatttagatcaatattccttaggcaggaaatttttattccaagctggtttacaacaaacgaccgt

SEQ ID NO: 26702 - DNA, 75 bp, Artificial Sequence
  Synthetic
ttagagacttcgccaaagaagatttaatctacaatcgcttttggcaatcacatttggcactgctaaaggaccgtt

SEQ ID NO: 26703 - DNA, 75 bp, Artificial Sequence
  Synthetic
aacggtaagttattctgcaccgggtgcggtcactgtattactcactatgtggttgttgttgccaactaccattgc

SEQ ID NO: 26704 - DNA, 75 bp, Artificial Sequence
  Synthetic
tgatagcatgtttttgcctgtaacgttatcgacacatacatatctatgtatatatatatatatatatatatatat

SEQ ID NO: 26705 - DNA, 75 bp, Artificial Sequence
  Synthetic
atatatatatatatatactacagaaaaaacagagaatgcagactcatggcgacaactgactcttcaacagacagt

SEQ ID NO: 26706 - DNA, 75 bp, Artificial Sequence
  Synthetic
gcagatgaaggtccttctcctaagagtaactattgtgatagcacagaaaccaaatcttcttttatagagccacca

SEQ ID NO: 26707 - DNA, 75 bp, Artificial Sequence
  Synthetic
ttacctgcaactatatttggcttagcaaacctattggaaataccactagatgattgtttagtaccttgtaacttt

SEQ ID NO: 26708 - DNA, 75 bp, Artificial Sequence
  Synthetic
tgtggtaattttttgactcatttagaagtctgtgaatttgatgagaaaaaactaagtctaatttggaaaggtcat

SEQ ID NO: 26709 - DNA, 75 bp, Artificial Sequence
  Synthetic
tgtgtatttgcttgttgccgtgtatgctgcacagcaacagcaacgtatgagtttaatgaattttatgagagtact

SEQ ID NO: 26710 - DNA, 75 bp, Artificial Sequence
  Synthetic
gttgaaggcagagaaatagagagtgtaacaggcaaatctatttttgatgttgatgtcaggtgctatacctgcatg

SEQ ID NO: 26711 - DNA, 75 bp, Artificial Sequence
  Synthetic
aaatttttagattcaattgaaaagcttcgcatctttataactgctacagaatttgctcttagaaccttccagaac

SEQ ID NO: 26712 - DNA, 75 bp, Artificial Sequence
  Synthetic
atttgctcttagaaccttccagaacctgttatttgaacaactgcagctgttgtgtcctgagtgccgtgggaactg

SEQ ID NO: 26713 - DNA, 75 bp, Artificial Sequence
  Synthetic
caaacatggcggatcctaaaggtagtacatctaaagacgggttggatgattggtgtattgtggaagctgaatgta

SEQ ID NO: 26714 - DNA, 75 bp, Artificial Sequence
  Synthetic
gcgatatagaaaatgatttggaagaattatttgacagagatacagactcagatatttcagaattattagatgata

SEQ ID NO: 26715 - DNA, 75 bp, Artificial Sequence
  Synthetic
atgatgacttggaccagggaaattctcgggaactatttcatcaacaagagagtaaggaaagcgaggagcacttgc

SEQ ID NO: 26716 - DNA, 75 bp, Artificial Sequence
  Synthetic
aaaaactaaaacgaaagtacttgagtcctcaagctatcgcacagcttagtccgcgacttgaaagtataacattgt

SEQ ID NO: 26717 - DNA, 75 bp, Artificial Sequence
  Synthetic
cacctcagcagaagtctaaacgaaggctctttgcagagcaggacagcgggttggagttaactcttacaaatgaag

SEQ ID NO: 26718 - DNA, 75 bp, Artificial Sequence
  Synthetic
gctctttgcagagcaggacagcgggttggagttaactcttacaaatgaagctgaagatgtttcttctgaggtgga

SEQ ID NO: 26719 - DNA, 75 bp, Artificial Sequence
  Synthetic
ggtaccggctctagactctcagccggttgctgaggcacaaataggaacagtagacattcattatacagaattatt

SEQ ID NO: 26720 - DNA, 75 bp, Artificial Sequence
  Synthetic
acgtgccagcaacaataaggcaattcttatggcaaaatttaaggaggcttttggggtaggctttaatgatttgac

SEQ ID NO: 26721 - DNA, 75 bp, Artificial Sequence
  Synthetic
acgtcagtttaaaagttacaaaacctgctgtaatcattgggttctgtctgtatatgcagtgcatgatgatcttct

SEQ ID NO: 26722 - DNA, 75 bp, Artificial Sequence
  Synthetic
tgaaagctcaaagaagttattgcaacagcattgtgattatgtatggatacgtgggatagctgctatgtcattatt

SEQ ID NO: 26723 - DNA, 75 bp, Artificial Sequence
  Synthetic
tttattgtgtttcaaagtgggaaaaaatcgtgggacagtacataaattaatgacctcaatgttaaatgtgcatga

SEQ ID NO: 26724 - DNA, 75 bp, Artificial Sequence
  Synthetic
aaagcaaatattgtctgagcctccaaagctacgaaatgttgctgctgcattgttctggtataaaggtgcaatggg

SEQ ID NO: 26725 - DNA, 75 bp, Artificial Sequence
  Synthetic
gtcagggacatttacttatggtccctaccctgattggatggcacatcaaactattgttggccatcaaagtacaga

SEQ ID NO: 26726 - DNA, 75 bp, Artificial Sequence
  Synthetic
agcaaatgcatttgatatgtctgttatggtgcagtgggcatttgataacaattatttagatgaagctgatatagc

SEQ ID NO: 26727 - DNA, 75 bp, Artificial Sequence
  Synthetic
ctatcaatatgctaagttagcaccagaagatagtaatgctgtggcctggcttgcccataataatcaggccaggtt

SEQ ID NO: 26728 - DNA, 75 bp, Artificial Sequence
  Synthetic
tgttagagaatgtgcatctatggttagattttataaaaaaggtcaaatgaaagaaatgtctatgtcagaatggat

SEQ ID NO: 26729 - DNA, 75 bp, Artificial Sequence
  Synthetic
acatactagaataactgaagtagaaggagaaggtcattggtcaacaatagcaaaatttcttagatatcaacaagt

SEQ ID NO: 26730 - DNA, 75 bp, Artificial Sequence
  Synthetic
aaactttataatgtttttagctgctttgaaagatatgctacattcagttcccaaacgtaattgtatattaatata

SEQ ID NO: 26731 - DNA, 75 bp, Artificial Sequence
  Synthetic
tggtcctccaaatactgggaagtcagcatttaccatgtctttaattcgtgtgttaagaggaagggtgctttcatt

SEQ ID NO: 26732 - DNA, 75 bp, Artificial Sequence
  Synthetic
tgttaattctaaaagccaattttggctgcaaccaatgtcagagtgtaaaatagctttaattgatgatgtcacaga

SEQ ID NO: 26733 - DNA, 75 bp, Artificial Sequence
  Synthetic
tccatgttggttgtatatggacacttatttgaggaatggccttgatggtcattatgtttctttagattgcaaaca

SEQ ID NO: 26734 - DNA, 75 bp, Artificial Sequence
  Synthetic
taaagcaccgatacaaactaaatttcctgcactattacttacatctaatattaatgtacacaatgaaataacgta

SEQ ID NO: 26735 - DNA, 75 bp, Artificial Sequence
  Synthetic
tagatatttgcatagtagaattaagggatttgaatttccaaatccatttccaatgaaagcagacaatacacctga

SEQ ID NO: 26736 - DNA, 75 bp, Artificial Sequence
  Synthetic
atttgaactcactgaccaaagctggaaatctttctttacaaggctttggaatcaattagagctgagtgaccaaga

SEQ ID NO: 26737 - DNA, 75 bp, Artificial Sequence
  Synthetic
agacgagggagacaatggagaatctcagcgaccgtttcaatgctctgcaagatcagctaatgaacatttatgaga

SEQ ID NO: 26738 - DNA, 75 bp, Artificial Sequence
  Synthetic
ctgcagcaaacacacttgagtcgcaaattgagcattggcaaactcttcgaaaagaagctgtgctactatattttg

SEQ ID NO: 26739 - DNA, 75 bp, Artificial Sequence
  Synthetic
ctaggcaaaatggtgtgacacgacttggataccaagttgtgcctacattagccatttcagaagcaaaagccaagc

SEQ ID NO: 26740 - DNA, 75 bp, Artificial Sequence
  Synthetic
aggccatagggatggtgctgcagttgcaatcactgcaaaagtctcagtttggcagtgaaccatggtcactggttg

SEQ ID NO: 26741 - DNA, 75 bp, Artificial Sequence
  Synthetic
ataccagtggagaaacatttagaagtgctccagaaaatcatttcaaaaagggtccagtatcagtagaggtgattt

SEQ ID NO: 26742 - DNA, 75 bp, Artificial Sequence
  Synthetic
atgataacgataaagacaatgcaaatgcttatactatgtggaagcacatatattaccaggatgatgacgaacagt

SEQ ID NO: 26743 - DNA, 75 bp, Artificial Sequence
  Synthetic
ggcataaaagtgcaagcggggtcaaccacacaggcatatattatatgcaaggaacctttagaaactactatgttt

SEQ ID NO: 26744 - DNA, 75 bp, Artificial Sequence
  Synthetic
tgtttgctgatgatgcaactagatatagtaaaactggacattgggaagttaaagttaataaggaaactgtgttta

SEQ ID NO: 26745 - DNA, 75 bp, Artificial Sequence
  Synthetic
ctcctgtcaccagctccacccctcccgagtcaccaggaggacaagcagactcaaacacctcctccaagaccccca

SEQ ID NO: 26746 - DNA, 75 bp, Artificial Sequence
  Synthetic
ccaccgccactgactccacgtccagactctcgcccgcagattccagaaaacagtcacaacaagccaacaccaaag

SEQ ID NO: 26747 - DNA, 75 bp, Artificial Sequence
  Synthetic
gaagaaggtacggacgcagaccgtccagtaggacccggcgaacgaccgaaacgcggcagaggcggagatcgaggt

SEQ ID NO: 26748 - DNA, 75 bp, Artificial Sequence
  Synthetic
ccaagtccaggtcgcggtcgaggtcgcggtctcggctccgatctagatcccggtcgcaatcgtctgagcggcggt

SEQ ID NO: 26749 - DNA, 75 bp, Artificial Sequence
  Synthetic
ctcggtaccgatcaagatccagatccagacaaaaagaagtgtccagaatcacaaccaccaccagagggagaggtc

SEQ ID NO: 26750 - DNA, 75 bp, Artificial Sequence
  Synthetic
gagggtcatcctccacctcctccaaacggtcacaacgggcacgaggaaggggccgtggggggagcagggggagac

SEQ ID NO: 26751 - DNA, 75 bp, Artificial Sequence
  Synthetic
ggtcatcctccacctcccccacctcctccaaacggtcacgacgagagtcagagtcttctaggcagcgtggcatct

SEQ ID NO: 26752 - DNA, 75 bp, Artificial Sequence
  Synthetic
ctcctagtgacgtgggaaagtcacttcaatcagttagttcaagaaatacaggaagacttggaaggttactggacg

SEQ ID NO: 26753 - DNA, 75 bp, Artificial Sequence
  Synthetic
aagctctcgatcccccagtaatcttagtcaggggggaccctaacacgctacgatgctttcgcaatagagctaagc

SEQ ID NO: 26754 - DNA, 75 bp, Artificial Sequence
  Synthetic
aaaagtttacagggctttacagggcctttagcacggcttggtcgtgggtggctggagatggcactgagcgtctag

SEQ ID NO: 26755 - DNA, 75 bp, Artificial Sequence
  Synthetic
gcaggtccagaatgctcattagctttttctcctttaaccagagaagagattttgatcagactgttaagtacccga

SEQ ID NO: 26756 - DNA, 75 bp, Artificial Sequence
  Synthetic
aaggagtggaccggtcgtttggctcatttgatagcctataacacccctaacatactaacataatagcttgctact

SEQ ID NO: 26757 - DNA, 75 bp, Artificial Sequence
  Synthetic
aacatctaacatttattgcatttttgctttttgtttgcattattttaatgctatggcgcgtgctaggcgagtcaa

SEQ ID NO: 26758 - DNA, 75 bp, Artificial Sequence
  Synthetic
gcgtgactctgctactaacatttacagaacctgcaagcaagcaggcacgtgtcctcctgatgtcattaataaagt

SEQ ID NO: 26759 - DNA, 75 bp, Artificial Sequence
  Synthetic
tgaaagcacaactattgctgataaaattttgcagtatggtagtgctggtgttttttttgggggtttgggcataag

SEQ ID NO: 26760 - DNA, 75 bp, Artificial Sequence
  Synthetic
cactggaaaaggtacaggaggtaccacaggctatgtgcctttgggagagggcccagcagtacgtgttggtggtgc

SEQ ID NO: 26761 - DNA, 75 bp, Artificial Sequence
  Synthetic
gccaacaattatcagacctgctctggtcccagacaccattggtccatcagatattatacctgtggacaccttaga

SEQ ID NO: 26762 - DNA, 75 bp, Artificial Sequence
  Synthetic
tccagtggagcctacgacctcttctattgttccactcacggattccacaggaccagaccttttgcctggcgaggt

SEQ ID NO: 26763 - DNA, 75 bp, Artificial Sequence
  Synthetic
ggaaactattgcagaggtgcatcctggcccgtctaggcctcctactgacactcctgtcacaactagtacaggagg

SEQ ID NO: 26764 - DNA, 75 bp, Artificial Sequence
  Synthetic
ctccagtgctatattagaagtagcaccggaacctactccgccctcacgtgttagggtgacccggacacaatatca

SEQ ID NO: 26765 - DNA, 75 bp, Artificial Sequence
  Synthetic
taatccctcctttcaagtaattaccgaatccacccctaccacaggtgaaagttcattagcagacaatatattggt

SEQ ID NO: 26766 - DNA, 75 bp, Artificial Sequence
  Synthetic
tacctctggttctgggggacaaactattggaggcgctacacctgaacttatagaacttcaagagttaccatctag

SEQ ID NO: 26767 - DNA, 75 bp, Artificial Sequence
  Synthetic
atattcatttgaaatcgaagaaccaacaccccctagaagaactagtaccccattacaaaggatacagacagctat

SEQ ID NO: 26768 - DNA, 75 bp, Artificial Sequence
  Synthetic
aagaaggaggggtgggcttacaaataggcgcttagtccaacaagtttctgtagaaaaccccttatttttaacaag

SEQ ID NO: 26769 - DNA, 75 bp, Artificial Sequence
  Synthetic
accatctagactagtgcaatttcagtttgataatccagcatttgaggaggaagtaacacaaatatttgaacaaga

SEQ ID NO: 26770 - DNA, 75 bp, Artificial Sequence
  Synthetic
tattgaagattttaatgagcctccagacagagattttctagatgttcaaaggctgggtaggccccaatattcaga

SEQ ID NO: 26771 - DNA, 75 bp, Artificial Sequence
  Synthetic
aactccagcagggtatctccgagttagtcgtcttgggcaaaggcggactatacgcactcgttctggagcacaaat

SEQ ID NO: 26772 - DNA, 75 bp, Artificial Sequence
  Synthetic
tgggtctcaagttcatttttatagagatctaagtagtataaacacagaagatcctattgagcttcaattattagg

SEQ ID NO: 26773 - DNA, 75 bp, Artificial Sequence
  Synthetic
tcagcattctggggatgctactattgtccaaggtccagttgaaagcacatttgtagacataaatgtagatgaaaa

SEQ ID NO: 26774 - DNA, 75 bp, Artificial Sequence
  Synthetic
tccactttctgaggattttagtgcacattctgatgacttgcttttagatgaagctaatgaagactttagtggctc

SEQ ID NO: 26775 - DNA, 75 bp, Artificial Sequence
  Synthetic
tcaattagttgtgggtaatcgacgctcaacatcttcatataccgtccctcgttttgaaacaaccagatctgggtc

SEQ ID NO: 26776 - DNA, 75 bp, Artificial Sequence
  Synthetic
atattatgcacaggatacaaaaggttattatgtagcttatcctgaggatagggacattagcatggatattattta

SEQ ID NO: 26777 - DNA, 75 bp, Artificial Sequence
  Synthetic
tcctaccccagagttgcctgttgtcattattcacacatatgatacaagtggtgatttttacctgcatcctagtct

SEQ ID NO: 26778 - DNA, 75 bp, Artificial Sequence
  Synthetic
gtgatttttacctgcatcctagtcttcacaaaagactcaaaagaaaacgaaaatatttgtaactttttcttttac

SEQ ID NO: 26779 - DNA, 75 bp, Artificial Sequence
  Synthetic
agatggcagtttggcaagcagctagtggtaaggtttaccttccaccatctacaccagttgccagggtccaaagta

SEQ ID NO: 26780 - DNA, 75 bp, Artificial Sequence
  Synthetic
cggacgaatatgtgcaaaggactaacatctattatcatgcatacagtgacagattattaactgttggtcatccat

SEQ ID NO: 26781 - DNA, 75 bp, Artificial Sequence
  Synthetic
atttcaatatatatgacgtgcaaagtgctaagataaaagtaccaaaagtatctggaaatcaacatagggttttca

SEQ ID NO: 26782 - DNA, 75 bp, Artificial Sequence
  Synthetic
gactaaagttgccagaccctaatcgatttgcattagctgacatgtctgtttataatccagataaagaaagactgg

SEQ ID NO: 26783 - DNA, 75 bp, Artificial Sequence
  Synthetic
tttgggcatgcagaggtatagaaataggcagaggacaacctttaggtgtaggtagtgtaggacatccattattta

SEQ ID NO: 26784 - DNA, 75 bp, Artificial Sequence
  Synthetic
ataaggttggtgatacagaaaatcccaactcatacaggcaacaagctaactccactgatgacagacaaaatgtgt

SEQ ID NO: 26785 - DNA, 75 bp, Artificial Sequence
  Synthetic
catttgatcctaagcaactgcaaatgtttataataggctgtgcaccttgcatgggggaacattgggatagggcct

SEQ ID NO: 26786 - DNA, 75 bp, Artificial Sequence
  Synthetic
tgccatgtgtagaagataaaccaccccctggttcttgccctccaattgaattaaaaaatacagtgattgaagatg

SEQ ID NO: 26787 - DNA, 75 bp, Artificial Sequence
  Synthetic
gtgacatggcagatataggctatggaaatttaaattttaaggcattacaagaaaatagatctgatgtaagtttgg

SEQ ID NO: 26788 - DNA, 75 bp, Artificial Sequence
  Synthetic
atatagttaatgaaatttgcaaatatccagactttctgaaaatgcaaaatgatgtatatggagattcctgctttt

SEQ ID NO: 26789 - DNA, 75 bp, Artificial Sequence
  Synthetic
tttatgcacgcagggaacaatgttatgccagacacttttttgttagagggggtaagacaggagatgacataccag

SEQ ID NO: 26790 - DNA, 75 bp, Artificial Sequence
  Synthetic
cagcacaagttgatgagggtagcctaaagaatgtttattacattccaccaatgacaaatcaaccacaaaacaata

SEQ ID NO: 26791 - DNA, 75 bp, Artificial Sequence
  Synthetic
ttggcaatgccatgtatttcccaactgtcagtggctcattggtatccagtgatgctcaactgttcaatagaccat

SEQ ID NO: 26792 - DNA, 75 bp, Artificial Sequence
  Synthetic
tttggttacagcgcgcacaaggccacaataatggtatttgttggtttaatcagttatttgttactgttgtggaca

SEQ ID NO: 26793 - DNA, 75 bp, Artificial Sequence
  Synthetic
acacacgtaacacaaattttagtatatcagttagttcagaaaacactgaggtatccaaaattgacaattatacct

SEQ ID NO: 26794 - DNA, 75 bp, Artificial Sequence
  Synthetic
ctcagaaatttcaagaatatttaagacatgtagaagaatatgaaatgtctctaattttacaactatgtaaaatac

SEQ ID NO: 26795 - DNA, 75 bp, Artificial Sequence
  Synthetic
ctttaacagctgaagtcttagctcaaattaatgcaatgaattctaatattttagaggagtggcaattaggatttg

SEQ ID NO: 26796 - DNA, 75 bp, Artificial Sequence
  Synthetic
tacctgcaccagacaatcctattcatgatacatacagatatattgagtctgcagcgactaggtgtcctgataaaa

SEQ ID NO: 26797 - DNA, 75 bp, Artificial Sequence
  Synthetic
atcctcctaaagaaagagaagatccttataaaaactttaacttttggaatgtagatttaacagagagactatctt

SEQ ID NO: 26798 - DNA, 75 bp, Artificial Sequence
  Synthetic
tagacctagatcaatattctcttgggagaaaatttttatttcaggcaggtttgcagcaatcgaccgttaacggta

SEQ ID NO: 26799 - DNA, 75 bp, Artificial Sequence
  Synthetic
caaaaacagtttcgactaggggatccatcaagggtattaaacgaaaacgcaagaattagacattatcgatttcgg

SEQ ID NO: 26800 - DNA, 75 bp, Artificial Sequence
  Synthetic
tgcaataaagtcaacttttacacagtattcaaggaatgtttattcactctgactaagcaaatatgagccgcgccc

SEQ ID NO: 26801 - DNA, 75 bp, Artificial Sequence
  Synthetic
gatacataaaggtgccaaatgaggtgagttgtttgccagaagaggtcagagccaactcaggtttgcgccagatca

SEQ ID NO: 26802 - DNA, 75 bp, Artificial Sequence
  Synthetic
gatacagcgcgagccgcgttggatcaagctacatcgtctgaacacgcaaaagactcaaggaaatgtaagtgtgcc

SEQ ID NO: 26803 - DNA, 75 bp, Artificial Sequence
  Synthetic
gaacacgcaaaagactcaaggaaatgtaagtgtgccagtctattgtgttcgaatttggcaaagttgaagaccgtt

SEQ ID NO: 26804 - DNA, 75 bp, Artificial Sequence
  Synthetic
tttcacaatgaccaggtgcggtatgaaaatttcttaatcatatattgttgttgccaacaaccatcctctcttgca

SEQ ID NO: 26805 - DNA, 75 bp, Artificial Sequence
  Synthetic
agtttttgcctgtatcgttttcgatcacaccatagtgtattgtaattaaataaataaatattttatatgtaagac

SEQ ID NO: 26806 - DNA, 75 bp, Artificial Sequence
  Synthetic
tgctgtgttgtgcacaatcaataaagcaaatggaaggtcaggctgaacagaacaaaatctctaatacattatctg

SEQ ID NO: 26807 - DNA, 75 bp, Artificial Sequence
  Synthetic
agttaccttctactattaaaggcttagctcaagcgttaggtatacctttagtggattgtttattgccttgcaatt

SEQ ID NO: 26808 - DNA, 75 bp, Artificial Sequence
  Synthetic
tttgtggaaaatttttagattttttggaggtttgtgattttgataagaaacagttgaatttgatttggaaagatt

SEQ ID NO: 26809 - DNA, 75 bp, Artificial Sequence
  Synthetic
atgttgtaactgcctgttgtaggtgctgtagtgtagcaactgctacgtttgaatttaatgaattttatgagcaaa

SEQ ID NO: 26810 - DNA, 75 bp, Artificial Sequence
  Synthetic
cagtactcggcagagatattgaattggctacaggacgttctatttttgagatagatgtcagatgtcaaaattgct

SEQ ID NO: 26811 - DNA, 75 bp, Artificial Sequence
  Synthetic
taagctttcttgacataatagagaaattggattgttgtggcagaggacgtccttttcacaaagtaagaggagcat

SEQ ID NO: 26812 - DNA, 75 bp, Artificial Sequence
  Synthetic
ggaaagcagtctgtaggctgtgtaagcatttgtataatgattggtaaagaggtcactgtgcaagacattgttttg

SEQ ID NO: 26813 - DNA, 75 bp, Artificial Sequence
  Synthetic
gagctaagtgtaatacagcctgaagtattaccagttgacctgttttgtgaagaggaattaccaaccgagcaggaa

SEQ ID NO: 26814 - DNA, 75 bp, Artificial Sequence
  Synthetic
acggaggaggagtcagacatcgagagaactgtgttcaaaatcactgcaccgtgtggctgcagcaattgtaaggtc

SEQ ID NO: 26815 - DNA, 75 bp, Artificial Sequence
  Synthetic
aagctacgtctttttgtgaacgccaccgagttgggcatcagaacgtttcagcaactgctgacccaggacctgcag

SEQ ID NO: 26816 - DNA, 75 bp, Artificial Sequence
  Synthetic
ctcctctgtccagagtgtcgcggtaactgcaaccatgacggatcctaaaggtagtacatctaaagaagggttagc

SEQ ID NO: 26817 - DNA, 75 bp, Artificial Sequence
  Synthetic
agaatggtgtattgtggaagcagaatgtagtgatgtagaaaatgattttgaacaattatttgagcgagatacaga

SEQ ID NO: 26818 - DNA, 75 bp, Artificial Sequence
  Synthetic
ctccgatatatcggacttgttagataattgtgacttggagcagggcaattccctggaactatttcatcaacagga

SEQ ID NO: 26819 - DNA, 75 bp, Artificial Sequence
  Synthetic
aattgtgacttggagcagggcaattccctggaactatttcatcaacaggagtgtaaagagagcgaggagcaatta

SEQ ID NO: 26820 - DNA, 75 bp, Artificial Sequence
  Synthetic
caaaaactaaaacgaaagtatcttagtcctaaagctgtcgcgcagcttagtccgcggcttgagtcgatttcgttg

SEQ ID NO: 26821 - DNA, 75 bp, Artificial Sequence
  Synthetic
tcacctcagcagaaatctaagcgaaggctctttgcagagcaggacagcggactcgagctaactcttaacaatgaa

SEQ ID NO: 26822 - DNA, 75 bp, Artificial Sequence
  Synthetic
gctgaggatgtttcttcagaggtggaggtaccggctatagacacccggccggaagatgagggaggatcaggggct

SEQ ID NO: 26823 - DNA, 75 bp, Artificial Sequence
  Synthetic
gtggatcttgactacacagcgttgttgcgttccagcaacaaaaaagccacattgatggcaaaatttaaagagtca

SEQ ID NO: 26824 - DNA, 75 bp, Artificial Sequence
  Synthetic
tttggggtaggctttaatgagctaacacgccaatttaaaagttacaaaacgtgctgtaaccattgggttgtagct

SEQ ID NO: 26825 - DNA, 75 bp, Artificial Sequence
  Synthetic
gcttatgcagtgaatgatgatttatttgaaagctcaaagcagttattgcaacagcattgtgactatatttggatt

SEQ ID NO: 26826 - DNA, 75 bp, Artificial Sequence
  Synthetic
aaggcgataggtgcaatgtcattgtatctattgtcttttaaggcgggaaaaaatcgcggaactgttcataaattg

SEQ ID NO: 26827 - DNA, 75 bp, Artificial Sequence
  Synthetic
attacctcagtgttaaatgtgcatgaacagcaaatattgtctgagcctcctaagttaagaaatactgcttctgca

SEQ ID NO: 26828 - DNA, 75 bp, Artificial Sequence
  Synthetic
ttgttctggtacaagggggcaatgggatcgggaacatttacttatggctcatatcctgattggattgcacatcaa

SEQ ID NO: 26829 - DNA, 75 bp, Artificial Sequence
  Synthetic
acaattattggtcatcaaagtgctgaagcaagcacatttgatttttctgcaatggtccaatgggcatttgataac

SEQ ID NO: 26830 - DNA, 75 bp, Artificial Sequence
  Synthetic
aattacttagaggaatctgatattgcttaccaatttgcaaaatgtgcaccagaagacagcaatgctgttgcttgg

SEQ ID NO: 26831 - DNA, 75 bp, Artificial Sequence
  Synthetic
ctggctcacaacaaccaagctaaatttgtcaaagattgtgcatcaatggtgcggtattataaaaggggacaaatg

SEQ ID NO: 26832 - DNA, 75 bp, Artificial Sequence
  Synthetic
agagaaatgagtatatcagaatggatttatacaagaatcaatgaagttgaaggagagggtcattggtcatccatc

SEQ ID NO: 26833 - DNA, 75 bp, Artificial Sequence
  Synthetic
gcaaagtttttgagatatcaaggtgtaaatttcataatatttcttgctgctttaaaagaccttttacattctgtt

SEQ ID NO: 26834 - DNA, 75 bp, Artificial Sequence
  Synthetic
ccaaaacgtaattgcttattaatatatggcccacctaattctggaaagtctacatttgccatgtcattgatacat

SEQ ID NO: 26835 - DNA, 75 bp, Artificial Sequence
  Synthetic
gtattgaaaggcagagtattatcgtatgtaaattcaaaaagtcagttttggttacaacccttaggagactgtaaa

SEQ ID NO: 26836 - DNA, 75 bp, Artificial Sequence
  Synthetic
gtagcattattagatgatgtaacagatccatgctgggtatacatggatacctatttaagaaatggccttgatggc

SEQ ID NO: 26837 - DNA, 75 bp, Artificial Sequence
  Synthetic
cattttgtttcattagactgcaaatataaagcaccaatgcaaattaagtttcccccgctgttattgacctccaat

SEQ ID NO: 26838 - DNA, 75 bp, Artificial Sequence
  Synthetic
attaatgtacatcaggaagcaaattatagatatttgcatagcagaattaaaggatttgagtttccaaatcctttt

SEQ ID NO: 26839 - DNA, 75 bp, Artificial Sequence
  Synthetic
ccaatgaaaggagataaaacacctgaattcgaattaactgaccaaagctggaaatctttttttacaaggctttgg

SEQ ID NO: 26840 - DNA, 75 bp, Artificial Sequence
  Synthetic
aagacgagggcgaaaatggagaatctcagcgagcgtttcaatgttctgcaagatcagctaatgaacatttatgaa

SEQ ID NO: 26841 - DNA, 75 bp, Artificial Sequence
  Synthetic
gctgcagaacacacacttgagtcacagattgtacattggcaactcctaagaaaagaagctgtattgctacattat

SEQ ID NO: 26842 - DNA, 75 bp, Artificial Sequence
  Synthetic
gctagacaaaagggtgttttgaggcttggacatcaacctgtgcctactttagcagtttctgaagcaaaggccaaa

SEQ ID NO: 26843 - DNA, 75 bp, Artificial Sequence
  Synthetic
caagcaataggcatggtactgcatctgcagacactgcaaaaatctgagtatgcaactgagccatggacattagtt

SEQ ID NO: 26844 - DNA, 75 bp, Artificial Sequence
  Synthetic
gacacaagtatagagacatttaagagtgctccagaaaattgttttaaaaaaggcgccactcctgtggaggtgata

SEQ ID NO: 26845 - DNA, 75 bp, Artificial Sequence
  Synthetic
tatgataagcagcctgaaaatgctaatcaatacaccatgtggaaatctgtttactaccttgatgcagacgataac

SEQ ID NO: 26846 - DNA, 75 bp, Artificial Sequence
  Synthetic
tggcagaaaaccaccagtggggtcaatcaaactggcatatactatatgcatggcaactttaaacattattacgtg

SEQ ID NO: 26847 - DNA, 75 bp, Artificial Sequence
  Synthetic
gtgtttgctgatgatgctagtagatttagttctactggacattgggaagtaaaagttaataaggaacttatgttt

SEQ ID NO: 26848 - DNA, 75 bp, Artificial Sequence
  Synthetic
gctcctgtcaccagctccacacctcccggatcaccaagacaagcagacacagacagcaccaccaagacccccacc

SEQ ID NO: 26849 - DNA, 75 bp, Artificial Sequence
  Synthetic
acctccactgactccacgtccagacagcaaccaaccacccacaaacagccacaacaaaccgaaaccaaagggaga

SEQ ID NO: 26850 - DNA, 75 bp, Artificial Sequence
  Synthetic
aggtacgggagacgagcctccagtagatcacggcgaccgcaaacggagcaaaggcgatcaaggtcgcgacaccgc

SEQ ID NO: 26851 - DNA, 75 bp, Artificial Sequence
  Synthetic
acccgatcccgctcccggtcgcaatcccagtccaaaaccaggaccgttggctccaccaccgtatccaggtcccgg

SEQ ID NO: 26852 - DNA, 75 bp, Artificial Sequence
  Synthetic
tcgtcgtcgctctccacgactgggagatcccgatccaaatccagatcgcgatctagaggagtctcaacaagaagg

SEQ ID NO: 26853 - DNA, 75 bp, Artificial Sequence
  Synthetic
ggaggtcgagggtcacccacgaaagccaccaagcaccggcgatcgtactccagatcaccctccacctccgccttc

SEQ ID NO: 26854 - DNA, 75 bp, Artificial Sequence
  Synthetic
caacggccacaacaaagagcagaagggagacggggacgaggagggagcagtagggggcgcgacaggagaaagggg

SEQ ID NO: 26855 - DNA, 75 bp, Artificial Sequence
  Synthetic
ggatcacccacctccccctccagaaaacggtcacgggcagagtctgttaggttgcgtggagtctctcctggggaa

SEQ ID NO: 26856 - DNA, 75 bp, Artificial Sequence
  Synthetic
gtggggagatcagttcgatcagttagttctaaacatacagggcgacttggaagattattggaggaagctctcgat

SEQ ID NO: 26857 - DNA, 75 bp, Artificial Sequence
  Synthetic
cccccagtaattcttgttcggggggacgcaaacacgttaaaatgctttcgcaatagaaccaaaggtaaatacaga

SEQ ID NO: 26858 - DNA, 75 bp, Artificial Sequence
  Synthetic
gggctgttcagggcctttagcacgacgtggtcctgggtggctggagatagcactgagcgtctaggcaggcccaga

SEQ ID NO: 26859 - DNA, 75 bp, Artificial Sequence
  Synthetic
atgctcatcagcttttcttccgatagccaaagacaggattttgatgagactgttaaatatccgaaaggtgttgaa

SEQ ID NO: 26860 - DNA, 75 bp, Artificial Sequence
  Synthetic
aggtcttatgggaacctggacagcctgtaactaactactaatgctgccttgctactaattgcatactaacaccac

SEQ ID NO: 26861 - DNA, 75 bp, Artificial Sequence
  Synthetic
atatagagtgttttttgctacatttttacttttatactgccatggcgcgcgccaaacgggtcaagcgagactctg

SEQ ID NO: 26862 - DNA, 75 bp, Artificial Sequence
  Synthetic
taacacacatttatcaaacctgcaaacaagcaggtacatgtccccctgatgttgttaataaagttgaaaacacca

SEQ ID NO: 26863 - DNA, 75 bp, Artificial Sequence
  Synthetic
cagttgctgataatattttaaaatatggcagtgctggcgttttttttggaggccttggcataggtactggtcgtg

SEQ ID NO: 26864 - DNA, 75 bp, Artificial Sequence
  Synthetic
gtactgggggtgttactgggtacactccattgagtgaagggcctgccattcgtgttggaaatactccaacagttg

SEQ ID NO: 26865 - DNA, 75 bp, Artificial Sequence
  Synthetic
tgcggccttcactgatacctgaggcaattgggccaatggacatattgcccattgacactatcgatcctgtgcagc

SEQ ID NO: 26866 - DNA, 75 bp, Artificial Sequence
  Synthetic
cttcagtttcatctgtggtacccctcactgaatcatcaggagcggacttacttccaggagaagttgaaacaatag

SEQ ID NO: 26867 - DNA, 75 bp, Artificial Sequence
  Synthetic
ctgaaatacaccctgtacctgagggccccactgttgattctcctgtagtaactaccagcagaggctccagtgcca

SEQ ID NO: 26868 - DNA, 75 bp, Artificial Sequence
  Synthetic
ttttggaagttgctcctgaccccacacctcctactcgtgtcagggtctcacgtacacagtatcacaacccatctt

SEQ ID NO: 26869 - DNA, 75 bp, Artificial Sequence
  Synthetic
ttcaaattataactgagtctacacctgcacaaggtgaaagttcattggcagatcatgttttagttacatctggat

SEQ ID NO: 26870 - DNA, 75 bp, Artificial Sequence
  Synthetic
ccgggggtcagactattggtggggacacctctgatgttatcgagctgcaggaaattcctagtagatactcatttg

SEQ ID NO: 26871 - DNA, 75 bp, Artificial Sequence
  Synthetic
aaattgaagagtctactccaccaaggaaaagcagcacacctgttcaaagggtacagcaacctggtaggcgtagag

SEQ ID NO: 26872 - DNA, 75 bp, Artificial Sequence
  Synthetic
gaatctcactaactaataggcgactggtccaacaggtgcctgttgaaaaccctttgtttttatcacagccctcta

SEQ ID NO: 26873 - DNA, 75 bp, Artificial Sequence
  Synthetic
aattagtacgattcactttcgataatcctgtttttgaagatgaggttactaatatttttgagcaggatttggatt

SEQ ID NO: 26874 - DNA, 75 bp, Artificial Sequence
  Synthetic
tagttgaagaacctcctgacagggattttcttgatgtcagacgactaggccgtccacagtattcgactacaccag

SEQ ID NO: 26875 - DNA, 75 bp, Artificial Sequence
  Synthetic
cagggtacgttagggtcagtagattaggcacacgtggcactattcgcacgcggtctggtgcacaaataggctcac

SEQ ID NO: 26876 - DNA, 75 bp, Artificial Sequence
  Synthetic
aggttcatttctatagggatttaagctccattaatactgatgatgcattggagttacaattgctggggcaacatt

SEQ ID NO: 26877 - DNA, 75 bp, Artificial Sequence
  Synthetic
ctggagattctactatagtgcaaggccctgtagaaagtacttttgtgaacattgatgttacagaaaatccattat

SEQ ID NO: 26878 - DNA, 75 bp, Artificial Sequence
  Synthetic
ctgaaagtatagatgccttttcagatgatttattacttgatgaagctgtagaagattttagtgggtctcaattgg

SEQ ID NO: 26879 - DNA, 75 bp, Artificial Sequence
  Synthetic
tgattggcaatagacgcagcacaacctcatacacagttcctagatttgaaacaacaaggaatagctcttactata

SEQ ID NO: 26880 - DNA, 75 bp, Artificial Sequence
  Synthetic
ttcaagacactaaagggtattatgtggcatatcctgaaagtcggaataatgaggaaataatttatcccacccctg

SEQ ID NO: 26881 - DNA, 75 bp, Artificial Sequence
  Synthetic
aaattccagtggttgttattcatacacatgattacagtggtgatttttacttacatcccagccttcgtaaacgca

SEQ ID NO: 26882 - DNA, 75 bp, Artificial Sequence
  Synthetic
acatgattacagtggtgatttttacttacatcccagccttcgtaaacgcaggcgtaaaagaaaatatttgtgatt

SEQ ID NO: 26883 - DNA, 75 bp, Artificial Sequence
  Synthetic
tgcaaagcacggatgaatatattcaaagaacaaacatctactatcacgccaatactgacagacttctcactgtag

SEQ ID NO: 26884 - DNA, 75 bp, Artificial Sequence
  Synthetic
gacacccatactttaatatttatagtaacagcagtggaactttagaagttccaaaggtatcgggaaatcaacaca

SEQ ID NO: 26885 - DNA, 75 bp, Artificial Sequence
  Synthetic
gagtgtttcgcctcaaattgccagatcccaatcgatttgcattagctgatatgtccgtgtacaatccagataagg

SEQ ID NO: 26886 - DNA, 75 bp, Artificial Sequence
  Synthetic
agcgattggtttgggcctgtaggggtttggaaatcagtagaggtcaaccattaggggttggaactacgggacatc

SEQ ID NO: 26887 - DNA, 75 bp, Artificial Sequence
  Synthetic
cttatttcaataaggtaaaagatacagaaaatagtaattcatatatcacaacaaccaaagatgacagattgaaca

SEQ ID NO: 26888 - DNA, 75 bp, Artificial Sequence
  Synthetic
catcgtttgatcctaaacaaatacaaatgtttattgttggctgcacaccttgtattggtgaacattgggaaaaag

SEQ ID NO: 26889 - DNA, 75 bp, Artificial Sequence
  Synthetic
cccttccttgtgaagaaaaccagcgacaggctggcttgtgccctcctattgagttaaaaaatactatcatagagg

SEQ ID NO: 26890 - DNA, 75 bp, Artificial Sequence
  Synthetic
atggggatatggcagatattggctttggtaatttgaattttaaatctttacaaaataccaggtctgatgttagcc

SEQ ID NO: 26891 - DNA, 75 bp, Artificial Sequence
  Synthetic
ttgatatagtgaatgaaacatgcaagtatccagactttttaaaaatgcaaaatgatgtgtatggcgatgcttgct

SEQ ID NO: 26892 - DNA, 75 bp, Artificial Sequence
  Synthetic
tcttttatgctcgcagagagcagtgttatgcacgacacttttttgttagaggaggcacaactggagatgacatac

SEQ ID NO: 26893 - DNA, 75 bp, Artificial Sequence
  Synthetic
ctggtgcacaaattggtaatggcaacatgaaaaatgaatattacattcccgggacatctgatcagggtcgaaata

SEQ ID NO: 26894 - DNA, 75 bp, Artificial Sequence
  Synthetic
ctataggcaatgccatgtatttcccaactgtaagtggctcattggtttcaagtgatgctcaattgtttaacaggc

SEQ ID NO: 26895 - DNA, 75 bp, Artificial Sequence
  Synthetic
ctttctggctgcaacgagctcagggtcataataatggcattctgtgggccaatcaaatgttcgtcactgttgtag

SEQ ID NO: 26896 - DNA, 75 bp, Artificial Sequence
  Synthetic
acaacacacgcaacacaaattttagtatatcagttcacacagaaaatcaagatatatctaaaattgacagttttg

SEQ ID NO: 26897 - DNA, 75 bp, Artificial Sequence
  Synthetic
atgcaactcagtttagggaatacttaagacatgtagaggaatatgagatttctataatattacagttatgtaaga

SEQ ID NO: 26898 - DNA, 75 bp, Artificial Sequence
  Synthetic
ttcctctgaaagcagaagtcttagcacaaattaatgcaatgaattcttcattacttgaagactggcaacttggct

SEQ ID NO: 26899 - DNA, 75 bp, Artificial Sequence
  Synthetic
ttgtgccgacgcctgataatccaattcatgatacgtacagatatattgattctttggcaacacggtgccctgata

SEQ ID NO: 26900 - DNA, 75 bp, Artificial Sequence
  Synthetic
agacgcctccaaaggaaaaacctgatccatatgaaaagttacatttttggaatgtggaccttaccgaacgtctgt

SEQ ID NO: 26901 - DNA, 75 bp, Artificial Sequence
  Synthetic
ctttagatttagatcaatattctctggggagaaaatttttatttcaggcgggtttacaacaaacgaccgtaaacg

SEQ ID NO: 26902 - DNA, 75 bp, Artificial Sequence
  Synthetic
gtacaaaggcgacccatagaagttcattaaggggcacgaaacgaaaacggaaaaattagcacattaccgttttcg

SEQ ID NO: 26903 - DNA, 75 bp, Artificial Sequence
  Synthetic
gtacataaaagtcaacttttacacagtattcaaggaatgtttgtttactctgactaagcataagtctgcttagga

SEQ ID NO: 26904 - DNA, 75 bp, Artificial Sequence
  Synthetic
taccgaccgcacccggtacataaaggtgagtagttgccaaaatagattcggtttagtgccagaagagaccgtgtt

SEQ ID NO: 26905 - DNA, 75 bp, Artificial Sequence
  Synthetic
cgttccaacatgctcggattagttcagctgccaaggaacctctaatcttgccagggaacgtgtaatcttgccaat

SEQ ID NO: 26906 - DNA, 75 bp, Artificial Sequence
  Synthetic
tgccagggaacgtgtaatcttgccaatcagtgttggcagcgcttttggcacagtcaagggaccgataacggtaag

SEQ ID NO: 26907 - DNA, 75 bp, Artificial Sequence
  Synthetic
aacggtaagtctcgcccttgtaccaggtgcggtacgatttctcaatagctccttcaataacaggttgttattgcc

SEQ ID NO: 26908 - DNA, 75 bp, Artificial Sequence
  Synthetic
aactaccatcatcactttcaagtttttgcttgtatcgttttcgtatcatctcctatttgtatataattaaataaa

SEQ ID NO: 26909 - DNA, 75 bp, Artificial Sequence
  Synthetic
taaatatatataatgtttgaggcttggttattttgcaactgtgattgggacaaatggctcagcagactacaccag

SEQ ID NO: 26910 - DNA, 75 bp, Artificial Sequence
  Synthetic
accaacagaaacctaaagaggaaacatttgaactgcccacaactattaaagagttagctgacctcttacaaattc

SEQ ID NO: 26911 - DNA, 75 bp, Artificial Sequence
  Synthetic
ctttagttgattgcttagtgccttgcaacttctgtggaaggttcttagattttttggaggtttgcgagtttgaca

SEQ ID NO: 26912 - DNA, 75 bp, Artificial Sequence
  Synthetic
aaaagcagctaacattgatttggaaagactactttgtttctgcttgctgtcgaagttgttgtgtagctactgcaa

SEQ ID NO: 26913 - DNA, 75 bp, Artificial Sequence
  Synthetic
ctttcgaattcaatgaatattaccagcaaacagttttaggtagagatatagagctagctacaggaaagtcaatat

SEQ ID NO: 26914 - DNA, 75 bp, Artificial Sequence
  Synthetic
ttgaattgaaaatcaggtgtcagacttgcttatcatttttgagcaccattgaaaaattagatagctgtggtcgag

SEQ ID NO: 26915 - DNA, 75 bp, Artificial Sequence
  Synthetic
gccttccgttccacaaagtgagagacggctggaaaggagtgtgcaggcactgtaagcatttgtataatgatcggt

SEQ ID NO: 26916 - DNA, 75 bp, Artificial Sequence
  Synthetic
aaagaggtcactgtgcaagactttattttggagcttagtgaggtgcagcctgaagtgataccagttgacctgctt

SEQ ID NO: 26917 - DNA, 75 bp, Artificial Sequence
  Synthetic
tgtgaagaggaattaccaaacgaacaggaaacggaggaggagtcaaatatcgacagaaccgtgttcaaagtcatt

SEQ ID NO: 26918 - DNA, 75 bp, Artificial Sequence
  Synthetic
gcaccgtgtggctgcagcttctgtgaggtcaatcttcgtgtttttgtcaacgcaactgaacttggtattagaacc

SEQ ID NO: 26919 - DNA, 75 bp, Artificial Sequence
  Synthetic
ctgcaggaactactgaccagcgatctgcagctgctgtgtccagagtgccgtggtaactgcaagcatggcggatcc

SEQ ID NO: 26920 - DNA, 75 bp, Artificial Sequence
  Synthetic
taaaggtagtacatctaaagaagggttaggtgattggtgtattttggaagctgactgtagtgatttagaaaatga

SEQ ID NO: 26921 - DNA, 75 bp, Artificial Sequence
  Synthetic
ttttgaacagttatttgagcaagatgcagactcagatgtatcggacttgctagataatggtgaactggaacaggg

SEQ ID NO: 26922 - DNA, 75 bp, Artificial Sequence
  Synthetic
caattccctggaactatttcatcaacaagagtgtaagcagagcgaggagcaattacaaatactaaaacgaaagta

SEQ ID NO: 26923 - DNA, 75 bp, Artificial Sequence
  Synthetic
tcttagtccaaaagctgtcgcgcagcttagtccgcgtcttgagttgatgtcattgtcacctcagcagaaatccaa

SEQ ID NO: 26924 - DNA, 75 bp, Artificial Sequence
  Synthetic
gcgaaggctctttgcagagcaggacagcggactcgagctatctctaaacaatgaagctgaagataatgctcctga

SEQ ID NO: 26925 - DNA, 75 bp, Artificial Sequence
  Synthetic
ggtggaggtaccggctctagactctgggccggtagacgagggaggaacaggggatgtagatattgattatttagc

SEQ ID NO: 26926 - DNA, 75 bp, Artificial Sequence
  Synthetic
cttgttgcgttccagcaacagaaaagccacattaatggcgaaatttaaagacgcgtttggggtaggctttaatga

SEQ ID NO: 26927 - DNA, 75 bp, Artificial Sequence
  Synthetic
actaactcgccagtttaaaagctacaaaacctgttgtaatcatcgggttttagctgtgtatgcagttcatgatga

SEQ ID NO: 26928 - DNA, 75 bp, Artificial Sequence
  Synthetic
tctatttgaaagctcaaagcagctgttgcaacagcactgtgactatatctgggtccgtgggatagcagctatgac

SEQ ID NO: 26929 - DNA, 75 bp, Artificial Sequence
  Synthetic
actttacctattgtgttttaaggcgggaaagaatcgcggtactgtgcataagttacttacgtcaatgttaaatgt

SEQ ID NO: 26930 - DNA, 75 bp, Artificial Sequence
  Synthetic
gcaagagcagcaaatattgtctgagcctcctaagttaagaaatacagctgcggcattgttttggtataaaggtgg

SEQ ID NO: 26931 - DNA, 75 bp, Artificial Sequence
  Synthetic
tatggggtcaggagcatttacatatggtaaatatcctgattggattgcgcagcaaacagtacttggccaccaaaa

SEQ ID NO: 26932 - DNA, 75 bp, Artificial Sequence
  Synthetic
tgcggaggcaagcacatttgatttttcagtgatggtacaatgggcatttgataataatcacgtagacgaagcaga

SEQ ID NO: 26933 - DNA, 75 bp, Artificial Sequence
  Synthetic
tattgcttaccaatatgcaaggcttgcaccagaagatagtaatgcagtagcctggcttgctcataatagccaagc

SEQ ID NO: 26934 - DNA, 75 bp, Artificial Sequence
  Synthetic
aaagtttgtgcgagactgtgcagcaatggtacgcttttataaaaatttacaaatgagagaaatgtccatgtctga

SEQ ID NO: 26935 - DNA, 75 bp, Artificial Sequence
  Synthetic
atggatatacacaaggataaacgaggtggaaggagaaggacattggtcatctattgttaaatttttaggatatca

SEQ ID NO: 26936 - DNA, 75 bp, Artificial Sequence
  Synthetic
aggagttaattttataatgtttttagcagcattgaaaaattttttgcatgctgtaccaaaacagaattgcatatt

SEQ ID NO: 26937 - DNA, 75 bp, Artificial Sequence
  Synthetic
aatacatgggcctcctaactctggaaagtcatcttttgctatgtcattgataaaagtattgaaagggagagtatt

SEQ ID NO: 26938 - DNA, 75 bp, Artificial Sequence
  Synthetic
gtcttttgtaaattccagaagtcaattttggttacaacctcttggagagtgtaaaattgccttgatagatgatgt

SEQ ID NO: 26939 - DNA, 75 bp, Artificial Sequence
  Synthetic
aacagatccttgttggctatatatggacacatatttacgaaatggtttggatggccattttgtgtcactagactg

SEQ ID NO: 26940 - DNA, 75 bp, Artificial Sequence
  Synthetic
taaatacaaagcgcctgtgcaaacgaagtttcttccattattgctcacatcaaatattaatgtgcatgaggaaac

SEQ ID NO: 26941 - DNA, 75 bp, Artificial Sequence
  Synthetic
aaattacagatatttacatagtagaataaaaggatttgaatttccaaatccttttccaatgaaatcagacaacac

SEQ ID NO: 26942 - DNA, 75 bp, Artificial Sequence
  Synthetic
ataaaaggatttgaatttccaaatccttttccaatgaaatcagacaacacacctcaatttgagttaactgaccaa

SEQ ID NO: 26943 - DNA, 75 bp, Artificial Sequence
  Synthetic
tttggacacaattagaactgagtgaccaagaagaggaggaggagggcgaacatggagaaactcagcgagcgtttc

SEQ ID NO: 26944 - DNA, 75 bp, Artificial Sequence
  Synthetic
aatgttctgcaagatcagctaatgaacatatatgaagctgcagaacacacacttgagacacaaattgcacattgg

SEQ ID NO: 26945 - DNA, 75 bp, Artificial Sequence
  Synthetic
acacttttgcgaagagaagctgtattgctttacgttgctaggcaaaagggtatcacaaggcttggataccaacct

SEQ ID NO: 26946 - DNA, 75 bp, Artificial Sequence
  Synthetic
gtgcctccattggcagtctctgaaggaaaagcaaaggaggccatagggataatgctgcaactgcaatctctgcaa

SEQ ID NO: 26947 - DNA, 75 bp, Artificial Sequence
  Synthetic
aagtctgagtatgcttcagagccctggacattagtggacacaagtgcagaaacttataggaatgctccagaacaa

SEQ ID NO: 26948 - DNA, 75 bp, Artificial Sequence
  Synthetic
cattttaaaaaaggcccaatacctgtggaggtcatttatgataaggagtccggaaatgcaaatgtttatactatg

SEQ ID NO: 26949 - DNA, 75 bp, Artificial Sequence
  Synthetic
tggaagtttgtatattacatggatccagaggatgtatggcataaaactacaagtggtgtaaaccacaatggtatc

SEQ ID NO: 26950 - DNA, 75 bp, Artificial Sequence
  Synthetic
cactatttacatggtgactttaaacactattatgtgttgtttgctgatggtgcacgtacatatagtaaaacagga

SEQ ID NO: 26951 - DNA, 75 bp, Artificial Sequence
  Synthetic
tattgggaagtgaaagttaataaggaaactgtgtttgctcctgtcaccagctccacacctcccggatctccagga

SEQ ID NO: 26952 - DNA, 75 bp, Artificial Sequence
  Synthetic
caaacagacacaaacaccaccaccaaggcccccgccacctcctctgactccacgaccagatccagtgacaaacag

SEQ ID NO: 26953 - DNA, 75 bp, Artificial Sequence
  Synthetic
tcacaacaagccgcaaccaagaggaaaggattcggacgacgaccatccagtagaacaaggcgacaagaaacgcag

SEQ ID NO: 26954 - DNA, 75 bp, Artificial Sequence
  Synthetic
caaaggcgatcaaggtcgcgataccgctcccggtctcactcccggtcgcactcccagtccgataccagggccatt

SEQ ID NO: 26955 - DNA, 75 bp, Artificial Sequence
  Synthetic
gccacctccctatccaggtcctccaggtccccgtcggtctccaagactaggagtcggaggtcagaatccagatca

SEQ ID NO: 26956 - DNA, 75 bp, Artificial Sequence
  Synthetic
caatcccagaagtacctccagccgaaggcaggtcgagggtcacccaccgacaccaccaccaggcgtcggagatcc

SEQ ID NO: 26957 - DNA, 75 bp, Artificial Sequence
  Synthetic
cgatcaaagtcatcctccacctccacctcttcctcctcccaacggtcacaacggggagggagagacagaggggaa

SEQ ID NO: 26958 - DNA, 75 bp, Artificial Sequence
  Synthetic
agaggaagtaggagctgtagggggtgcggtaggggaacaggaaagcgacggggtagatcatcctccacctcccca

SEQ ID NO: 26959 - DNA, 75 bp, Artificial Sequence
  Synthetic
ccctcaaaacggtctcgaccaaagtctagcaggctccgtggcgtgtctcctgacgaagtgggaagatctcttcaa

SEQ ID NO: 26960 - DNA, 75 bp, Artificial Sequence
  Synthetic
tctgttagttcaaaacatagaggaagacttgggagattattggaagaggctctcgaccccccagtaatactttgc

SEQ ID NO: 26961 - DNA, 75 bp, Artificial Sequence
  Synthetic
aaggggggggcaaacacattaaaatgctttcgcaacagaactagagggaaatacacggggctgttcagagccatt

SEQ ID NO: 26962 - DNA, 75 bp, Artificial Sequence
  Synthetic
agcacaacatggtcttgggtggctggagatagcactgagcgtctaggcaggcccagaatgctcattagcttttct

SEQ ID NO: 26963 - DNA, 75 bp, Artificial Sequence
  Synthetic
tcagatggtcagagaaaacattttgatgagactgtgaaatatccgaaaggggttgagacatcatatggcaacttg

SEQ ID NO: 26964 - DNA, 75 bp, Artificial Sequence
  Synthetic
gacagcctataacactactaacattgctttgctactaacaccactaacattacagaaatagtatagtttaacatt

SEQ ID NO: 26965 - DNA, 75 bp, Artificial Sequence
  Synthetic
tttttacttttttattgctatggtgcgtgctaagcgggtcaagcgggtcaagcgtgactctgtaactcatatata

SEQ ID NO: 26966 - DNA, 75 bp, Artificial Sequence
  Synthetic
cgtgctaagcgggtcaagcgggtcaagcgtgactctgtaactcatatataccaaacctgcaaacaagcaggcact

SEQ ID NO: 26967 - DNA, 75 bp, Artificial Sequence
  Synthetic
tgcccccctgatgttcttaataaagtggagcaaacaacagttgctgacaatattcttaaatatggcagtgctggt

SEQ ID NO: 26968 - DNA, 75 bp, Artificial Sequence
  Synthetic
gtattttttggaggcctgggcataggaaccggccgtggtacaggaggcgtgacagggtacacgccactgtctgaa

SEQ ID NO: 26969 - DNA, 75 bp, Artificial Sequence
  Synthetic
gggcctggtatccgtgttggtggtacccccacagttgtacggccctcacttgttcctgaaagtattggtccagca

SEQ ID NO: 26970 - DNA, 75 bp, Artificial Sequence
  Synthetic
gatttgctgccaatagacactatcaatcctgtggagtccactgcatcatcggtggtcccattgactgaatcttca

SEQ ID NO: 26971 - DNA, 75 bp, Artificial Sequence
  Synthetic
gcagctgatttgcttccaggggaagttgaaacaatagctgagatacatcctgttcctgaaggtcccatagttgac

SEQ ID NO: 26972 - DNA, 75 bp, Artificial Sequence
  Synthetic
tcgcctgttgtgaccaccagcagaggctcaagtgccatactagaggttgctccagagcctacaccacctacacgt

SEQ ID NO: 26973 - DNA, 75 bp, Artificial Sequence
  Synthetic
gttcgtgtggcacgcacacaatatcataacccatcttttcaaatattaacagaatcaacacctactcagggtgaa

SEQ ID NO: 26974 - DNA, 75 bp, Artificial Sequence
  Synthetic
agttctttagcagatcatatattagttacatctggttcagggggtcaaaccataggtggtaatgttacagacatt

SEQ ID NO: 26975 - DNA, 75 bp, Artificial Sequence
  Synthetic
attgagttacaagaattacccagtagatattcttttgaaatagaagagccaactccaccacggcgcagtagcaca

SEQ ID NO: 26976 - DNA, 75 bp, Artificial Sequence
  Synthetic
ccacttcaaagagcactatccattggcaggcgtagggggccttctctaacaaatagaaggttagttcagcaagta

SEQ ID NO: 26977 - DNA, 75 bp, Artificial Sequence
  Synthetic
caagtagacaatcctttatttgtttctcgaccatccaaattagtaaggtttgcttttgataatcctgtatttgag

SEQ ID NO: 26978 - DNA, 75 bp, Artificial Sequence
  Synthetic
gaggatgttacaaatatttttgagcaggatgtagatacgtttgaagagccccctgatagggattttttagacatt

SEQ ID NO: 26979 - DNA, 75 bp, Artificial Sequence
  Synthetic
cgcaaactgggacgaccccaatactcaacaacacctgcaggttatgttagggtaagtcgactcggcacccgggcc

SEQ ID NO: 26980 - DNA, 75 bp, Artificial Sequence
  Synthetic
actattcgcacacgttcaggtgctcaaataggatctcaagtacatttctatagagatttaagttcaatagattct

SEQ ID NO: 26981 - DNA, 75 bp, Artificial Sequence
  Synthetic
gaggaccctattgagctacagttattaggtcaacattctggggatgcgaccatcatacaaggtactgtggaaagt

SEQ ID NO: 26982 - DNA, 75 bp, Artificial Sequence
  Synthetic
acgttcatagacatggatacagcagaaaatcctttgtctgagagtattgaggcgcattctaatgatctgctactt

SEQ ID NO: 26983 - DNA, 75 bp, Artificial Sequence
  Synthetic
gatgaagctgttgaggattttagtggctctcaattagttataggaaatagacgtagtactacatcatatactgtc

SEQ ID NO: 26984 - DNA, 75 bp, Artificial Sequence
  Synthetic
ccatggtttgaaacaacaagaaacagctcctattatgtgcaggacacacaaggttattatgtggcttatcctgag

SEQ ID NO: 26985 - DNA, 75 bp, Artificial Sequence
  Synthetic
agtcgagatactgcagaaataatttatcctacaccagacattcccgtggtggtcattcatacccatgatagcagt

SEQ ID NO: 26986 - DNA, 75 bp, Artificial Sequence
  Synthetic
ggtgacttttatttgcatcctagtcttcgacgggcaagggtaagagaaaatatttgtgatttgcttacagatggc

SEQ ID NO: 26987 - DNA, 75 bp, Artificial Sequence
  Synthetic
tgtgtggcattcggctaacggtaaggtctatctaccaccatcaacaccagtggccagggtgcaaagcacggatga

SEQ ID NO: 26988 - DNA, 75 bp, Artificial Sequence
  Synthetic
atacattcaaagaacaaacatctactatcatgccaatactgacagactgctcactgtaggccatccatattttaa

SEQ ID NO: 26989 - DNA, 75 bp, Artificial Sequence
  Synthetic
tgtgtatgataatactgggaaaaaattggaagttcctaaagtatcaggaaaccaacatagggtatttcgtttgaa

SEQ ID NO: 26990 - DNA, 75 bp, Artificial Sequence
  Synthetic
attaccagatccaaacagatttgctttggctgacaagtctgtatacaaccccgataaagaaaggctggtatgggg

SEQ ID NO: 26991 - DNA, 75 bp, Artificial Sequence
  Synthetic
ttgcagagggttggaaatcagtagaggacagcctttgggagttggcagtactggacatccatattttaataaggt

SEQ ID NO: 26992 - DNA, 75 bp, Artificial Sequence
  Synthetic
aaaagacacggaaaacactaacaattataccacaggctctacagatgataggcagaacacatcttttgaccccaa

SEQ ID NO: 26993 - DNA, 75 bp, Artificial Sequence
  Synthetic
acaaattcagatgtttatagtaggttgtacaccttgtgtgggagagcattgggaaaaggccttaccttgtggaga

SEQ ID NO: 26994 - DNA, 75 bp, Artificial Sequence
  Synthetic
tgcgcctgcagataatggtatttgccctccaattgaattaaaaaacacttttattgaagatggagacatggcaga

SEQ ID NO: 26995 - DNA, 75 bp, Artificial Sequence
  Synthetic
tattggttttggcaatatgaatttcaaaactttacagcagaatagggctgatgtcagtctggatatagttaatga

SEQ ID NO: 26996 - DNA, 75 bp, Artificial Sequence
  Synthetic
aacttgcaaatatccagactttttgaaaatgcaaaatgatgtctatggcgatgcgtgttttttctatgctcgcag

SEQ ID NO: 26997 - DNA, 75 bp, Artificial Sequence
  Synthetic
ggagcagtgttatgccagacatttttttgttagggggcgcaagacaggtgacaatattcctgacgcatatattga

SEQ ID NO: 26998 - DNA, 75 bp, Artificial Sequence
  Synthetic
tgatggcaatatgaaaaattctttttacataccagcagcttcaaatcaatctcaaaaggatattggtaatgctat

SEQ ID NO: 26999 - DNA, 75 bp, Artificial Sequence
  Synthetic
gtatttcccaacagtcagtggctcactagtctctagtgatgctcaattgtttaacaggcccttctggctgcaaag

SEQ ID NO: 27000 - DNA, 75 bp, Artificial Sequence
  Synthetic
agcacagggtcataataatggcattctgtgggctaatcagatgtttgtcacagttgtagacaacacgcgaaacac

SEQ ID NO: 27001 - DNA, 75 bp, Artificial Sequence
  Synthetic
caatttcagtatatctatatctagtgaaaatcaagatatacagcaaatacaatcatatgactcacaaaagtttag

SEQ ID NO: 27002 - DNA, 75 bp, Artificial Sequence
  Synthetic
ggaatatttaaggcacgtagaagaatatgaaatttctattattttacagttgtgtaagattccactacaagcaga

SEQ ID NO: 27003 - DNA, 75 bp, Artificial Sequence
  Synthetic
agttttagcacaaataaatgcaatgaacccctccttactagaggattggcagttaggatttgtgccaactcccga

SEQ ID NO: 27004 - DNA, 75 bp, Artificial Sequence
  Synthetic
taatcctatccaggacacatacagatttattgattccttagctaccaggtgtcccgataaaaatccaccaaagga

SEQ ID NO: 27005 - DNA, 75 bp, Artificial Sequence
  Synthetic
aaaacctgatccttatgaaaaattaacattctggaatgtagacctaactgaaagattatctttagacttggatca

SEQ ID NO: 27006 - DNA, 75 bp, Artificial Sequence
  Synthetic
atattctttaggtcgcaagtttttgttccaagctggattgcagcaaacgaccgttaacggtacaaagccttcaac

SEQ ID NO: 27007 - DNA, 75 bp, Artificial Sequence
  Synthetic
gtatagaagttctgtacgggggatcaaaagaaaacgcaaaaactaacaattaccgaattcggtacatttgtatca

SEQ ID NO: 27008 - DNA, 75 bp, Artificial Sequence
  Synthetic
acttttacacagtattcaaggaatgtctgtttactctgactaagtataactctacctaggaaaccaaccgcgccc

SEQ ID NO: 27009 - DNA, 75 bp, Artificial Sequence
  Synthetic
ggtacataaaggtgagttggtgccaaattagattcagtgtggtgccaagacataccgtgttggttctaacatgct

SEQ ID NO: 27010 - DNA, 75 bp, Artificial Sequence
  Synthetic
cggattaggtcgaccgccaaggaacctttagtgtgccaatagcttacagcagtccagatttggcacattttgtgg

SEQ ID NO: 27011 - DNA, 75 bp, Artificial Sequence
  Synthetic
aggtcgaccgccaaggaacctttagtgtgccaatagcttacagcagtccagatttggcacattttgtggaccgat

SEQ ID NO: 27012 - DNA, 75 bp, Artificial Sequence
  Synthetic
taacggtaagtctattgatacgggcgcggttaaattattactcattcgtacttgttgctgccaacaatcagcatt

SEQ ID NO: 27013 - DNA, 75 bp, Artificial Sequence
  Synthetic
agtaacttgtttctgcctgtatcgttatcgacacaggtgtgttatacatatatatatatatatatatatatatat

SEQ ID NO: 27014 - DNA, 75 bp, Artificial Sequence
  Synthetic
atatatatatattatatatatacacgtagacactgcagcattaggacttatggcaactgcaaatgctgaacagag

SEQ ID NO: 27015 - DNA, 75 bp, Artificial Sequence
  Synthetic
cataggaccaccagagcaagcgcaggttatacagccaccattgccagcaacaattactgatctagcagctttatt

SEQ ID NO: 27016 - DNA, 75 bp, Artificial Sequence
  Synthetic
ggaaattccattagatgattgcttagtaccttgcaacttctgtggcaactttctaacatatttagagatctgtga

SEQ ID NO: 27017 - DNA, 75 bp, Artificial Sequence
  Synthetic
gtttgatgagaaaagacttagtttgatttggaaagaatatcttgtgtatgcctgctgtcgctgttgttgcacagc

SEQ ID NO: 27018 - DNA, 75 bp, Artificial Sequence
  Synthetic
aactgccacatttgaatttaatgaattttacgaaagcactgtaacaggtagggaaattgaagacgttacaggtaa

SEQ ID NO: 27019 - DNA, 75 bp, Artificial Sequence
  Synthetic
atcaatttttgacatagatgttagatgtcaaacgtgcatgaaatatcttgatgcaattgaaaagcttgatatttg

SEQ ID NO: 27020 - DNA, 75 bp, Artificial Sequence
  Synthetic
tggcagaagacgtcctttccatctagtaagaggctcttggaaaggaatctgtaggctgtgtaagcatttctataa

SEQ ID NO: 27021 - DNA, 75 bp, Artificial Sequence
  Synthetic
tgattggtaaggaggtcacattgcaagattttacattagagttaagtgaattgcagcctgaggtacaaccagttg

SEQ ID NO: 27022 - DNA, 75 bp, Artificial Sequence
  Synthetic
acctgttttgtgaagaggagttgccggctgagcatcaggaaacagaggaggagcctgctattgacagaactccat

SEQ ID NO: 27023 - DNA, 75 bp, Artificial Sequence
  Synthetic
acaaagttgttgcgccttgtggttgctgcgaggtcaagcttcgcatctttgtgaaagccactgattttggtatta

SEQ ID NO: 27024 - DNA, 75 bp, Artificial Sequence
  Synthetic
gaacactacaaaaccttctaattgaagaactgcagctgttgtgtccggagtgtcgcgggaactgcaaacatggcg

SEQ ID NO: 27025 - DNA, 75 bp, Artificial Sequence
  Synthetic
gatcctaaaggtagtacatctaaagaagggtttaatgattggtgtattttggaagctgaatgtagtgatatagac

SEQ ID NO: 27026 - DNA, 75 bp, Artificial Sequence
  Synthetic
aatgatttggaacaattatttgatcaagatacagactcagatatttcagacttattagatgagaatgacgtggaa

SEQ ID NO: 27027 - DNA, 75 bp, Artificial Sequence
  Synthetic
cagggcaattctcgggaactatttcatctacaagagtgtcaggaaagcgaggagcaattgcaaaaactaaaacga

SEQ ID NO: 27028 - DNA, 75 bp, Artificial Sequence
  Synthetic
aagtacttaagtccaaaagctgtcgcacagcttagtccgcgattcgaaagtatttctttgtcacctcagcagaag

SEQ ID NO: 27029 - DNA, 75 bp, Artificial Sequence
  Synthetic
tctaaacgaaggctctttgcagagcaggacagcgggctcgaattgactttaacaaatgaagctgaagatgtttct

SEQ ID NO: 27030 - DNA, 75 bp, Artificial Sequence
  Synthetic
cctgaggtggaggtaccggctttaaactctcagccggtagctgagggacaatcaggggacatagacataagttat

SEQ ID NO: 27031 - DNA, 75 bp, Artificial Sequence
  Synthetic
acagcattattgcgtgccagcaataataaagcaatattaatggcaaaatttaaagaggcttttggggtagggttt

SEQ ID NO: 27032 - DNA, 75 bp, Artificial Sequence
  Synthetic
aatgatctgacacgtcaatttaagagttacaaaacctgttgtaatgcttgggttatttctgtatatgcagtgcat

SEQ ID NO: 27033 - DNA, 75 bp, Artificial Sequence
  Synthetic
gatgaccttatagaaagttcaaagcagcttttgcaacagcattgtgactatgtgtggatccgtgggataggagcc

SEQ ID NO: 27034 - DNA, 75 bp, Artificial Sequence
  Synthetic
atgtcattgtttttagtttgttttaaggcgggaaaaaatcgtggtactgttcataaattgatgacaactatgtta

SEQ ID NO: 27035 - DNA, 75 bp, Artificial Sequence
  Synthetic
aatgtgcatgaaaagcaaatattatcggaaccaccaaaattaagaaatgttgctgcagcactgttttggtataaa

SEQ ID NO: 27036 - DNA, 75 bp, Artificial Sequence
  Synthetic
ggatcaatgggttccggagtatttacatatggctcatatccagattggatagcccaccaaacaatattgggccat

SEQ ID NO: 27037 - DNA, 75 bp, Artificial Sequence
  Synthetic
caaagcgctgaagctagtacatttgatctatcggacatggttcaatgggcatttgataacaattatttagacgaa

SEQ ID NO: 27038 - DNA, 75 bp, Artificial Sequence
  Synthetic
gcagatattgcatatcaatatgctaaattggcgccagacaatagcaatgctgttgcatggctcgcacataataat

SEQ ID NO: 27039 - DNA, 75 bp, Artificial Sequence
  Synthetic
caagccaaatttgtgcgagaatgtgcatccatggtgagattttataaaaagggtcagatgaaagaaatgagtatg

SEQ ID NO: 27040 - DNA, 75 bp, Artificial Sequence
  Synthetic
tctgaatggatttatactaaaattcatgaagtggaaggagagggtcaatggtccaccattgtacaatttttaagg

SEQ ID NO: 27041 - DNA, 75 bp, Artificial Sequence
  Synthetic
tatcagcaagtcaactttataatgtttttagctgccttaaaagatttactgcactctgttccgaaacgaaattgt

SEQ ID NO: 27042 - DNA, 75 bp, Artificial Sequence
  Synthetic
atacttttttatggaccccccaatacggggaaatcagcttttactatgtcattgataaaagtgttaaagggtagg

SEQ ID NO: 27043 - DNA, 75 bp, Artificial Sequence
  Synthetic
gtattatcattctgtaattccaaaagtcaattttggttacaaccgttgtcagaatgtaaaatagctttgctagat

SEQ ID NO: 27044 - DNA, 75 bp, Artificial Sequence
  Synthetic
gatgtcacagacccctgttgggtgtacatggacacatatctgagaaatggcttagatggacattatgtgtcatta

SEQ ID NO: 27045 - DNA, 75 bp, Artificial Sequence
  Synthetic
gattgtaaacacaaggcaccaatgcagacaaaatttcctgcactattgcttacatccaatataaatgtgcacaat

SEQ ID NO: 27046 - DNA, 75 bp, Artificial Sequence
  Synthetic
gaagtgaattatagatatctgcacagtagaataaaaggatttgagtttccaaatccttttccaatgaaagcagac

SEQ ID NO: 27047 - DNA, 75 bp, Artificial Sequence
  Synthetic
aatactccccagtttgatttaactgaccaaagctggaaatctttttttacaaggctttggcatcaattagacctg

SEQ ID NO: 27048 - DNA, 75 bp, Artificial Sequence
  Synthetic
accaaagctggaaatctttttttacaaggctttggcatcaattagacctgagtgaccaagaagacgagggcgaaa

SEQ ID NO: 27049 - DNA, 75 bp, Artificial Sequence
  Synthetic
atggagaatctcagcgagcgtttcaatgttctacaagatcagctaatgaacatttatgaaactgcagcacaaacc

SEQ ID NO: 27050 - DNA, 75 bp, Artificial Sequence
  Synthetic
cttgaggcacaaattgagcattggcagattttgcgaagagaagctgtgctactatattttgctaggcaaaagggt

SEQ ID NO: 27051 - DNA, 75 bp, Artificial Sequence
  Synthetic
gttacacggcttggatatcaacctgtacctgccttaatggtgtctgaagcaaaagctaaggaagctatagggatg

SEQ ID NO: 27052 - DNA, 75 bp, Artificial Sequence
  Synthetic
gtgctgcaactgcagtcattacaaaagtctgaatttggaaaagagccatggtcattggttgacaccagtacagag

SEQ ID NO: 27053 - DNA, 75 bp, Artificial Sequence
  Synthetic
acttataaaagtccaccagaaaaccatttcaaaaaaggcccaatgcctatagaggtcatttatgacaaagatgca

SEQ ID NO: 27054 - DNA, 75 bp, Artificial Sequence
  Synthetic
gataatgccaatgcttataccatgtggagatatatttattatgtggatgatgatgacaaatggcataaaagtgca

SEQ ID NO: 27055 - DNA, 75 bp, Artificial Sequence
  Synthetic
agcggggtgaaccacacaggcatatattttatgcacggaagctttagacactattatgtgttatttgctgatgat

SEQ ID NO: 27056 - DNA, 75 bp, Artificial Sequence
  Synthetic
gctcgtagatatagcaatactggacattgggaagtaaaagttaataaggacactgtgtttactcctgtcaccagc

SEQ ID NO: 27057 - DNA, 75 bp, Artificial Sequence
  Synthetic
tccaccccccccgagtcaccaggaggacaagcagactcaaacacctcctccaagacccccaccactgacaccgcg

SEQ ID NO: 27058 - DNA, 75 bp, Artificial Sequence
  Synthetic
tccagactctcgcccacaggctccggagaacggtcacaacaaaccagcaccaagggacggaggtacgaacggagg

SEQ ID NO: 27059 - DNA, 75 bp, Artificial Sequence
  Synthetic
ccctccagcaggacacgacgacagcaagcccaagcgcgccagaggcgatcaaggtccaagtcccggtcccggtcc

SEQ ID NO: 27060 - DNA, 75 bp, Artificial Sequence
  Synthetic
cggtcccagtcccgctcccgtatccgatcgaggtcgcggtcgcggtcgcggtctgaatctcagtcgtctaagcgg

SEQ ID NO: 27061 - DNA, 75 bp, Artificial Sequence
  Synthetic
cgatcaagatccagatccagaagaaaaacctcagccaccagagggagaggtccagggtcacccacaaccaccacc

SEQ ID NO: 27062 - DNA, 75 bp, Artificial Sequence
  Synthetic
agtgaccgagccgcaaggtcaccttccaccacctcctctgccacctcccaacggtcacaacgatcgcgatccagg

SEQ ID NO: 27063 - DNA, 75 bp, Artificial Sequence
  Synthetic
gcagggagcagcagggggggccgcggcaggggcgggagacgacgacacagattgtctgaatcccccacctccaag

SEQ ID NO: 27064 - DNA, 75 bp, Artificial Sequence
  Synthetic
cgatcacgaagagagtcagggtctgttaggctccatggcgtctctgctgacgcagtgggaacatcagttcacaca

SEQ ID NO: 27065 - DNA, 75 bp, Artificial Sequence
  Synthetic
gttagttcaagacatacaggaagacttggaagattattggaagaggctcttgatcccccagtaattttagttaga

SEQ ID NO: 27066 - DNA, 75 bp, Artificial Sequence
  Synthetic
ggggatgctaacacgcttcgaagctttcgcaacagggcaaagcatatgtatactgggctatttagctcatttagt

SEQ ID NO: 27067 - DNA, 75 bp, Artificial Sequence
  Synthetic
acggcctggtcgtgggtggctggagatggcattgagcgtctaggcaggtccagaatgctcattagctttatttcc

SEQ ID NO: 27068 - DNA, 75 bp, Artificial Sequence
  Synthetic
aacagtcagagaaaacattttgatgatgctgtgagatatccgaagggagttgaccggtcatttggatcatttgat

SEQ ID NO: 27069 - DNA, 75 bp, Artificial Sequence
  Synthetic
agcctttaacctactaacattaggctttgctactaacacactaacatatcttaaccatttatttttgtttttata

SEQ ID NO: 27070 - DNA, 75 bp, Artificial Sequence
  Synthetic
tttttatgctatggcgcgcgccaggcgggttaagcgagactctgccaccaatatatacagaacctgcaaacaagc

SEQ ID NO: 27071 - DNA, 75 bp, Artificial Sequence
  Synthetic
aggcacttgtcctcctgatgtactaaataaagtggaaaatactacaatagctgacaaaattttacaatatggcag

SEQ ID NO: 27072 - DNA, 75 bp, Artificial Sequence
  Synthetic
tgctggtgtgtttttcgggggtttgggcataagcactggaaaaggcacaggaggaacaacagggtatgtaccttt

SEQ ID NO: 27073 - DNA, 75 bp, Artificial Sequence
  Synthetic
gggagaaggtccgatacgtgttggtggaacccccacggttattagaccttctttagtcccagacactattggacc

SEQ ID NO: 27074 - DNA, 75 bp, Artificial Sequence
  Synthetic
atctgacataatacctgttgacactcttaatccagtggaacccacatcctcgtctattgtcccactcacagagtc

SEQ ID NO: 27075 - DNA, 75 bp, Artificial Sequence
  Synthetic
ttcaggtcctgaccttttgcctggtgaggtggagacaatcgcagaaatacatcctgggcctgttgtaccctccac

SEQ ID NO: 27076 - DNA, 75 bp, Artificial Sequence
  Synthetic
tgacaccccggtgacaacaacttctagaggtgccagcgcagttttagaggttgcaccagagcccaccccgccatc

SEQ ID NO: 27077 - DNA, 75 bp, Artificial Sequence
  Synthetic
gcgcgtcagagttagtggcacacaatatcataatccatcatttcaggttataactgaatccacacctgctcaagg

SEQ ID NO: 27078 - DNA, 75 bp, Artificial Sequence
  Synthetic
tgaaagttcactggctgatcacattttggttacttctggttctggagggcaaacaattggtggcactgccagtga

SEQ ID NO: 27079 - DNA, 75 bp, Artificial Sequence
  Synthetic
cctaattgaactacaagagtttcccactcgctattcatttgaaatagatgaacccacacctccaagacaaagtag

SEQ ID NO: 27080 - DNA, 75 bp, Artificial Sequence
  Synthetic
tacacctcttcaaaggattaggactgcattaagacgtagaggaggattaacaaatagacgattggtgcaacaggt

SEQ ID NO: 27081 - DNA, 75 bp, Artificial Sequence
  Synthetic
acctgtagaagaccctttatttttgtctcagccatcacggctagtacggtttcagtttgacaatccagtatttga

SEQ ID NO: 27082 - DNA, 75 bp, Artificial Sequence
  Synthetic
ggacgaagttacacaaatttttgagcaggatttaaatgattttcaggagcctcctgacagggattttttagatat

SEQ ID NO: 27083 - DNA, 75 bp, Artificial Sequence
  Synthetic
tcgctcattaggaaggccacaatattctgaaactccggctggctatgtacgggtcagtcgccttggtcaaagacg

SEQ ID NO: 27084 - DNA, 75 bp, Artificial Sequence
  Synthetic
taccattcgcactcgatctggggctcaaataggctcacaagttcatttttatagagacttaagcagtataaatac

SEQ ID NO: 27085 - DNA, 75 bp, Artificial Sequence
  Synthetic
tgaagatcctattgagctacagttgttaggtcagcattcgggtgatgctacaatagttcaaggcctcacagaaag

SEQ ID NO: 27086 - DNA, 75 bp, Artificial Sequence
  Synthetic
tacctttgtagatgttaatgtagatgaaaatccattagctgaagattttagtatttctgcacactctgatgattt

SEQ ID NO: 27087 - DNA, 75 bp, Artificial Sequence
  Synthetic
acttttggatgaagctaatgaagattttagtggttcccagttggttgtgggtggtcggcgctccacttctactta

SEQ ID NO: 27088 - DNA, 75 bp, Artificial Sequence
  Synthetic
cactgtgcctcgtgttgaaactacacgctctgcatcatattatacccaagatattcagggatactatgtgtccta

SEQ ID NO: 27089 - DNA, 75 bp, Artificial Sequence
  Synthetic
tcctgaggatagagatactagtaaggacattatttaccctatgcctgacctcccggtggtcattatacacacata

SEQ ID NO: 27090 - DNA, 75 bp, Artificial Sequence
  Synthetic
tgacaccagtggtgatttttatttgcatcccagtctgactacaaggcgcagacgcaaaagaaaatatttataatt

SEQ ID NO: 27091 - DNA, 75 bp, Artificial Sequence
  Synthetic
ttttcttttacagatggcagtttggcaagcagctagtggtaaagtgtaccttccaccatctacacctgttgccag

SEQ ID NO: 27092 - DNA, 75 bp, Artificial Sequence
  Synthetic
ggtacaaagcacggatgaatatgtgcaaagaactaacatctattatcatgcctatagtgaccgcctattaactgt

SEQ ID NO: 27093 - DNA, 75 bp, Artificial Sequence
  Synthetic
tggtcacccatattttaatgtgtacaacgtccaaggctctaaattgcaaattccaaaagtgtcaggaaatcaaca

SEQ ID NO: 27094 - DNA, 75 bp, Artificial Sequence
  Synthetic
cagagtttttaggttaaaattaccagatcccaatcgttttgctcttgcagacatgtcagtttacaatcctgacaa

SEQ ID NO: 27095 - DNA, 75 bp, Artificial Sequence
  Synthetic
agaaaggctggtttgggcctgcagaggtattgaaataggacgtgggcaacctttaggtgtgggaagtgtgggtca

SEQ ID NO: 27096 - DNA, 75 bp, Artificial Sequence
  Synthetic
cccattgtttaacaaggttggcgacacagaaaatccaaattcttataaagctagttctacagatgacaggcaaaa

SEQ ID NO: 27097 - DNA, 75 bp, Artificial Sequence
  Synthetic
tgtatcatttgaccccaaacaactacagatgtttattataggctgtgctccatgtataggggaacattgggataa

SEQ ID NO: 27098 - DNA, 75 bp, Artificial Sequence
  Synthetic
agcattaccttgtgatgatggcaatattcaacaagggtcatgccctccaatagaattaattaattctgtcattga

SEQ ID NO: 27099 - DNA, 75 bp, Artificial Sequence
  Synthetic
agatggggatatggcagacattggctatggtaatttaaattttaaagcattacagcaaaacagagctgacgtaag

SEQ ID NO: 27100 - DNA, 75 bp, Artificial Sequence
  Synthetic
tctggatatagttaacgaaacctgtaaatatccagactttcttaaaatgcaaaatgatgtgtatggggattcctg

SEQ ID NO: 27101 - DNA, 75 bp, Artificial Sequence
  Synthetic
ctttttttatgcacggcgggaacaatgttatgccagacatttttttgttagagggggcaaaacgggtgacgatat

SEQ ID NO: 27102 - DNA, 75 bp, Artificial Sequence
  Synthetic
tccagctggacaaattgatgaaggaagcatgaaaaatgcattttacataccacctaacagtagtcaggctcaata

SEQ ID NO: 27103 - DNA, 75 bp, Artificial Sequence
  Synthetic
taataatctaggtaactcaatgtatttcccaacagtcagtggctcattggtatccagtgatgctcaattattcaa

SEQ ID NO: 27104 - DNA, 75 bp, Artificial Sequence
  Synthetic
taggccattttggttacagcgagcacaaggtcataacaatggtatatgctggtttaatcagctatttgtcactgt

SEQ ID NO: 27105 - DNA, 75 bp, Artificial Sequence
  Synthetic
ggtagacaacacacgcaacactaatttcagcatatcaatcaattcagatggaacagatgtttccaaaatcactga

SEQ ID NO: 27106 - DNA, 75 bp, Artificial Sequence
  Synthetic
ttataattctcaaaaatttacagaatatttgagacatgtagaagaatatgagttatcattaatattacaactttg

SEQ ID NO: 27107 - DNA, 75 bp, Artificial Sequence
  Synthetic
caaagtaccgttgaaggcagaaatattggctcagattaatgcaatgaattccaacattttagaagaatggcaatt

SEQ ID NO: 27108 - DNA, 75 bp, Artificial Sequence
  Synthetic
aggattcgttcctgcaccggacaattctattcaggatacttatcgctacattgattctttagccacacgttgtcc

SEQ ID NO: 27109 - DNA, 75 bp, Artificial Sequence
  Synthetic
agataaaaatcctcctaaggaaaaagtagatccttataaaaatttacacttttgggatgtagatttaacagaacg

SEQ ID NO: 27110 - DNA, 75 bp, Artificial Sequence
  Synthetic
cctttctttagatttagatcaatattcactgggacgtaagtttttatttcaggctggtttgcagcaaacaaccgt

SEQ ID NO: 27111 - DNA, 75 bp, Artificial Sequence
  Synthetic
aaacggtacaaaaacagtttcctcccgaatatctactaggggaataaaaagaaaacgtaaaaattagaaattacc

SEQ ID NO: 27112 - DNA, 75 bp, Artificial Sequence
  Synthetic
gctttcgatacaataaagtcaacttttgcacagtattcaaggaatgtttatttgtgctgactaactaggatacca

SEQ ID NO: 27113 - DNA, 75 bp, Artificial Sequence
  Synthetic
accgcacccgatacataaaaggtgagttatgtgccaaatcagatacagtctgtgccaaactcaggcagctgctcg

SEQ ID NO: 27114 - DNA, 75 bp, Artificial Sequence
  Synthetic
ccagatgcgtatcgtctttagtgttttgacacgctcggattaggacgttcgccaatggaatactaatattgccaa

SEQ ID NO: 27115 - DNA, 75 bp, Artificial Sequence
  Synthetic
attaggacgttcgccaatggaatactaatattgccaatcgctttcggctctttgtttggcagagctcaagaccgt

SEQ ID NO: 27116 - DNA, 75 bp, Artificial Sequence
  Synthetic
tcgggcgcggtcatacattactcatttggtagttgttgttgccagctaccatcaagcatagcatgtttttgcctg

SEQ ID NO: 27117 - DNA, 75 bp, Artificial Sequence
  Synthetic
taacgttatcggcacagtgattaatatatatatatatatatatatatatatatatatatatatatatatatatat

SEQ ID NO: 27118 - DNA, 75 bp, Artificial Sequence
  Synthetic
agatacatatagacagatatcatagagctaatgcagagagtgcaggcacatggctacacctccttcttcagaaga

SEQ ID NO: 27119 - DNA, 75 bp, Artificial Sequence
  Synthetic
cagcgctgatgaaggaccatctaatattggagaggcaaaacctccaatcttagagccaccattgcctgcaacaat

SEQ ID NO: 27120 - DNA, 75 bp, Artificial Sequence
  Synthetic
ctgtggcctagcaaaacttttagaaataccgctagatgattgtttgataccttgtaacttctgcggtaatttcct

SEQ ID NO: 27121 - DNA, 75 bp, Artificial Sequence
  Synthetic
tacacatttagaagtttgtgagtttgatgagaagaagcttactttaatttggaaagatcatttggtttttgcatg

SEQ ID NO: 27122 - DNA, 75 bp, Artificial Sequence
  Synthetic
ctgtcgtgtttgctgctcggcaacagcgacatatgagtttaatcaattttatgagagtactgttttaggcagaga

SEQ ID NO: 27123 - DNA, 75 bp, Artificial Sequence
  Synthetic
catagagcaagtaacaggcaaatctgtttttgatatagatgtcaggtgctacacctgtatgaaatttttagactc

SEQ ID NO: 27124 - DNA, 75 bp, Artificial Sequence
  Synthetic
aattgaaaagctagacatctgtggcagaaagcgtccattttatttagtgagaggctcttggaaaggaatctgtag

SEQ ID NO: 27125 - DNA, 75 bp, Artificial Sequence
  Synthetic
gctgtgtaagcattttcaataatgattggtaaagaggtcacattgcaagatattgtgctggagttaaatgaattg

SEQ ID NO: 27126 - DNA, 75 bp, Artificial Sequence
  Synthetic
cagcctgaggttcaaccagttgacctgttttgtgaagaggagttaccgaacgagcagcaggagagagaggaggag

SEQ ID NO: 27127 - DNA, 75 bp, Artificial Sequence
  Synthetic
cctcagattgaaagagcctcatacaaagttgttgcaccttgcggctgctgcaaggtgaaacttcgcatctttata

SEQ ID NO: 27128 - DNA, 75 bp, Artificial Sequence
  Synthetic
agcgctacagaatttgctattagaagctttcaacaattgctgattgacgagctgcagctgttgtgtcctgactgt

SEQ ID NO: 27129 - DNA, 75 bp, Artificial Sequence
  Synthetic
gctttcaacaattgctgattgacgagctgcagctgttgtgtcctgactgtcgcgggaactgcaaacatggcggat

SEQ ID NO: 27130 - DNA, 75 bp, Artificial Sequence
  Synthetic
cctaaaggtagtacatctaaagacgggttggatgattggtgtattgttgaagctgaatgtagcgatgtagacaat

SEQ ID NO: 27131 - DNA, 75 bp, Artificial Sequence
  Synthetic
gatttggaagaattatttgacagagatacagactcagatatttcagaattattagatgataatgacctcgagcag

SEQ ID NO: 27132 - DNA, 75 bp, Artificial Sequence
  Synthetic
ggcaattctcgggaactatttcatcaacaagagtgtaaggacagcgaggagcaattacaaaaactaaaacgaaag

SEQ ID NO: 27133 - DNA, 75 bp, Artificial Sequence
  Synthetic
tacataagtccaaaagctattgcacagcttagtccgcgacttgaaagtatttcactgtcaccacagcagaagtca

SEQ ID NO: 27134 - DNA, 75 bp, Artificial Sequence
  Synthetic
aaacgaaggctttttgcagagcaggacagcgggctcgagttaactcttacaaatgaagctgaagatgtttcttct

SEQ ID NO: 27135 - DNA, 75 bp, Artificial Sequence
  Synthetic
gaggtggaggaggtaccggccctagactctcagccggttgctgagggacacttaggaacagtagacattcattat

SEQ ID NO: 27136 - DNA, 75 bp, Artificial Sequence
  Synthetic
acagaattattgcgtgccagtaaccataaggcaattttgttggcaaaatttaaggaggcttttgggatagggttt

SEQ ID NO: 27137 - DNA, 75 bp, Artificial Sequence
  Synthetic
aatgatttgacacgtcaatttaaaagttacaaaacctgctgtaatgattgggttctatctgtgtatgcagttcat

SEQ ID NO: 27138 - DNA, 75 bp, Artificial Sequence
  Synthetic
gaggatcttcttgaaagctcaaagcagttattgcaacagcattgtgattatatatggatccgtgggatagcagca

SEQ ID NO: 27139 - DNA, 75 bp, Artificial Sequence
  Synthetic
atgtcattgtttctattgtgttttaaagcaggaaaaaatcgtgggactgtgcataaattaatgacatcaatgttg

SEQ ID NO: 27140 - DNA, 75 bp, Artificial Sequence
  Synthetic
aatgtgcatgaaaagcaaatattgtctgagcctccaaaattaagaaatgttgctgctgctttattttggtataaa

SEQ ID NO: 27141 - DNA, 75 bp, Artificial Sequence
  Synthetic
ggtgcaatggggtccggagcattttctcatggtccatatcctaactggatggcacagcaaactattgttggtcat

SEQ ID NO: 27142 - DNA, 75 bp, Artificial Sequence
  Synthetic
cagagcacagaagccagtgcttttgacttgtctgaaatgattcagtgggcatttgaccataattatctagatgag

SEQ ID NO: 27143 - DNA, 75 bp, Artificial Sequence
  Synthetic
gctgatatagcctttcagtatgctaagctagcaccagaaaatagtaatgctgtagcatggcttgcacataataac

SEQ ID NO: 27144 - DNA, 75 bp, Artificial Sequence
  Synthetic
caagcaaggtttgttagagaatgtgcatcaatggtcaggttttataaaaaaggtcaaatgaaagaaatgagcatg

SEQ ID NO: 27145 - DNA, 75 bp, Artificial Sequence
  Synthetic
tcagaatggatttatgccagaattaatgaagtagaaggcgaaggacattggtcatctattgctaaatttcttaga

SEQ ID NO: 27146 - DNA, 75 bp, Artificial Sequence
  Synthetic
tatcagcaagtaaatgttataatgtttttagctgctttgaaagatatgctgcattctgtacctaaacataactgt

SEQ ID NO: 27147 - DNA, 75 bp, Artificial Sequence
  Synthetic
atattaatacatggcccacctaatactggaaaatctgcattcactatgtcattgatacatgtgttaaagggaagg

SEQ ID NO: 27148 - DNA, 75 bp, Artificial Sequence
  Synthetic
gtattgtcctttgtaaattctaaaagccaattctggttacaaccaatgtcagaaactaaaatagcattaattgat

SEQ ID NO: 27149 - DNA, 75 bp, Artificial Sequence
  Synthetic
gacgtaactgatccttgctgggtttatatggatacatatttaagaaatggcttagatggacattatgtctcacta

SEQ ID NO: 27150 - DNA, 75 bp, Artificial Sequence
  Synthetic
gattgcaagcataaagcaccaattcaaacaaaatttcctgcattactgcttacctctaatattaatgttcataat

SEQ ID NO: 27151 - DNA, 75 bp, Artificial Sequence
  Synthetic
gaagttaactatagatatttacatagtagaattaaaggatttgaatttccaaatccatttccaatgaaaccagac

SEQ ID NO: 27152 - DNA, 75 bp, Artificial Sequence
  Synthetic
gtagaattaaaggatttgaatttccaaatccatttccaatgaaaccagacaatacccctgagtttgagcttactg

SEQ ID NO: 27153 - DNA, 75 bp, Artificial Sequence
  Synthetic
atggagaatctcagcaagcgtttcaatgctctgcaagatcagctaatgaacatttatgagtctgcaccagacact

SEQ ID NO: 27154 - DNA, 75 bp, Artificial Sequence
  Synthetic
cttgagtcgcaaattgagcactggcaaaccctgcgaaaagaagctgtgctactatattttgctaggcaacatggt

SEQ ID NO: 27155 - DNA, 75 bp, Artificial Sequence
  Synthetic
atcagcagggttggatatcaacctgtgcctgtattagctgtgtcagaagccaaagctaaacaggctataggaatg

SEQ ID NO: 27156 - DNA, 75 bp, Artificial Sequence
  Synthetic
gtattaaggttacaatcattgcaaaaatctgaatatggaagtgaaccatggtctttggtagatgcaagtgcagag

SEQ ID NO: 27157 - DNA, 75 bp, Artificial Sequence
  Synthetic
acatttagaagcccgccagaaaatcactttaaaaaaggtccgatttcagtagaggtcatatatgacaaagataaa

SEQ ID NO: 27158 - DNA, 75 bp, Artificial Sequence
  Synthetic
gacaatgccaatgcttataccatgtggagatttgtttattaccaagatgatgacgacaagtggcacaaaagtgct

SEQ ID NO: 27159 - DNA, 75 bp, Artificial Sequence
  Synthetic
agtggtgttaaccaaacaggcatatattttatgcaaggaacatttagacactactatgttttgtttgctgatgat

SEQ ID NO: 27160 - DNA, 75 bp, Artificial Sequence
  Synthetic
gcgagtagatatagtacaactggacaatgggaagtgaaagttaataaggaaactgtgtttgctcctgtcaccagc

SEQ ID NO: 27161 - DNA, 75 bp, Artificial Sequence
  Synthetic
tccaccccccccgactcaccaggaggacaagcagactcaaacgcctcctcccagacccccgccaccaccactgac

SEQ ID NO: 27162 - DNA, 75 bp, Artificial Sequence
  Synthetic
tccacgaccagacagtcgcccagaaaacagtcacaacaaaccaacaccaaagggagaaggtacggacggagacct

SEQ ID NO: 27163 - DNA, 75 bp, Artificial Sequence
  Synthetic
tccagtaggacaaggcgaacaacccaaacgcgccagaggcgacggtccaggtcaaagtccaagtccaagtccagg

SEQ ID NO: 27164 - DNA, 75 bp, Artificial Sequence
  Synthetic
tcgcggtcgaggtcgcggcaccggtctcggtctcggtctcggtctgaatcgccgcgccggcggtctcggtaccga

SEQ ID NO: 27165 - DNA, 75 bp, Artificial Sequence
  Synthetic
tcacgatccggatccagagggagagtcgccctccgcgccattaccaccaccaccacaaccaccaccagacgggca

SEQ ID NO: 27166 - DNA, 75 bp, Artificial Sequence
  Synthetic
ggtggagggtcacccacctccacctcctccaccacctcacaacggtcgcgacagctgcggggagggggccgtggg

SEQ ID NO: 27167 - DNA, 75 bp, Artificial Sequence
  Synthetic
gggagcagacaaagagcaaggggaaggcgatcatcatccacctcccccaccccctcaaaacggtcacgaggggag

SEQ ID NO: 27168 - DNA, 75 bp, Artificial Sequence
  Synthetic
tcagagtctgttaggcaacatggcatctctccttctgacgtgggaacagcagtttacacagttagttcaagacat

SEQ ID NO: 27169 - DNA, 75 bp, Artificial Sequence
  Synthetic
acaggaagacttggaagattactggatgaagctctcgatcccccagtgattttagttaggggagagcctaatacg

SEQ ID NO: 27170 - DNA, 75 bp, Artificial Sequence
  Synthetic
cttaagtgctttcgcaatagggccaaacaaagatatacagggctgtataagtcttttagcacggcctggtcgtgg

SEQ ID NO: 27171 - DNA, 75 bp, Artificial Sequence
  Synthetic
gtggctggagatggcacggagcgtctaggcaggtccagaatgctcattagctttatatccttcagtcaaagaaaa

SEQ ID NO: 27172 - DNA, 75 bp, Artificial Sequence
  Synthetic
gattttgatgagactgtgaaatatccgaagggggttgaccggtcgtttggttcatttgacagcttatagcaacct

SEQ ID NO: 27173 - DNA, 75 bp, Artificial Sequence
  Synthetic
aaccttctaaccactgcatgctactaacacactaacattttttaatttttattaatattttttatttgctatggc

SEQ ID NO: 27174 - DNA, 75 bp, Artificial Sequence
  Synthetic
gcgcgctaagcgagtcaagcgggactctgctactaacatatacagaacctgcaaacaagcaggtacttgtcctcc

SEQ ID NO: 27175 - DNA, 75 bp, Artificial Sequence
  Synthetic
tgatgttataaataaagtggaaagcacaactattgctgataaaattttgcagtatggtagtgctggtgttttttt

SEQ ID NO: 27176 - DNA, 75 bp, Artificial Sequence
  Synthetic
tgggggattaggcataagcactggaaaaggtacaggaggaaccacaggttatgtgcctttgggagaaggcccatc

SEQ ID NO: 27177 - DNA, 75 bp, Artificial Sequence
  Synthetic
ggtgcgtgttggtggtacacctacagtcatacgacctgctttggtcccagacaccatcggcccctccgatattat

SEQ ID NO: 27178 - DNA, 75 bp, Artificial Sequence
  Synthetic
acctgtggacaccttaaatccggtggagccttctacctcttctattgttccacttacagaatccacaggaccaga

SEQ ID NO: 27179 - DNA, 75 bp, Artificial Sequence
  Synthetic
tcttttacctggtgaagtggaaactattgcagaaatacatccaggcccctcaaggccaccaactgatacaccagt

SEQ ID NO: 27180 - DNA, 75 bp, Artificial Sequence
  Synthetic
tacatctactaccagtggttctagtgcagttctagaggtagcaccagaaccaacacctccagctcgtgtcagagt

SEQ ID NO: 27181 - DNA, 75 bp, Artificial Sequence
  Synthetic
cagccgcacccagtatcataacccatcatttcaaataataactgaatcaacaccaacattgggggaaagctcatt

SEQ ID NO: 27182 - DNA, 75 bp, Artificial Sequence
  Synthetic
agcggatcatatagtagtgacatctggttctgggggccaagcaattggggggatgacacctgaacttatagagct

SEQ ID NO: 27183 - DNA, 75 bp, Artificial Sequence
  Synthetic
tcaggatttcccatcaaggtattcatttgaaatagaagagccaacccctcctagaagaactagcacacctatgca

SEQ ID NO: 27184 - DNA, 75 bp, Artificial Sequence
  Synthetic
aagacttcaaaatgtgttcaggcgtagaggaggccttactaacagaagattagttcaacaagtgcctgtagacaa

SEQ ID NO: 27185 - DNA, 75 bp, Artificial Sequence
  Synthetic
tccattatttttgacacaaccttctagattggtccggtttcagtttgataacccggtttttgaggaagaagttac

SEQ ID NO: 27186 - DNA, 75 bp, Artificial Sequence
  Synthetic
tcaaatatttgaacaagatttagacacttttaatgagcccccagacagagactttttggatgttcagagtttagg

SEQ ID NO: 27187 - DNA, 75 bp, Artificial Sequence
  Synthetic
caggcctcaatactcagaaactcctgcaggttatgtgcgggtcagccgtgcaggtcaacgaaggactatcagaac

SEQ ID NO: 27188 - DNA, 75 bp, Artificial Sequence
  Synthetic
tcgttctggagcacaaatagggtctcaagtgcacttttatagagatctcagtagtattgatacagaagatcctat

SEQ ID NO: 27189 - DNA, 75 bp, Artificial Sequence
  Synthetic
tgaactgcagttgttgggtcagcattctggcgatgcaactattgtccaaggtccagtagaaagcacttttgttga

SEQ ID NO: 27190 - DNA, 75 bp, Artificial Sequence
  Synthetic
tatcaatgtagatgaaaacccactttcagaaatcagtgcatattctgatgatttacttttagatgaagctaatga

SEQ ID NO: 27191 - DNA, 75 bp, Artificial Sequence
  Synthetic
agactttagtggctctcagttagttgtagggggaaggcgttctacatctacatacactgttcctcactttgaaac

SEQ ID NO: 27192 - DNA, 75 bp, Artificial Sequence
  Synthetic
tactagatctagctcttactatgtacaagatacaaaggggtattatgtagcatatcctgaagatagagatgttag

SEQ ID NO: 27193 - DNA, 75 bp, Artificial Sequence
  Synthetic
taaggacattatttatcctaatccagatttaccagtggtcattattcacacatatgacacaagtggagattttta

SEQ ID NO: 27194 - DNA, 75 bp, Artificial Sequence
  Synthetic
tttacatccaagtcttactaaaagattaaaaagaaaaaggaaatatttgtaactttttcttttgcagatggcagt

SEQ ID NO: 27195 - DNA, 75 bp, Artificial Sequence
  Synthetic
ttggcaagcagctagtggtaaggtgtaccttccaccatctacaccagttgccagggtccaaagtacggatgaata

SEQ ID NO: 27196 - DNA, 75 bp, Artificial Sequence
  Synthetic
tgtgcaaaggactaacatatactatcatgcatacagtgatcgcctactaactgttggtcatccatattttaatat

SEQ ID NO: 27197 - DNA, 75 bp, Artificial Sequence
  Synthetic
atatgacatccaaggcactaagataaaagtccctaaggtttctggaaatcagcacagagtgtttaggttaaaact

SEQ ID NO: 27198 - DNA, 75 bp, Artificial Sequence
  Synthetic
accagatcccaacagatttgcattagcagatatgtctgtgtataacccagataaagaaagattggtctggggctg

SEQ ID NO: 27199 - DNA, 75 bp, Artificial Sequence
  Synthetic
tagaggtatagaaataggtagaggacagccattaggcgttggaagtgtaggtcatccattatttaataaacttgg

SEQ ID NO: 27200 - DNA, 75 bp, Artificial Sequence
  Synthetic
tgacacagaaaaccctaattcatataaagggaattcaactgatgatagacaaaatgtatcttttgaccctaaaca

SEQ ID NO: 27201 - DNA, 75 bp, Artificial Sequence
  Synthetic
actacaaatgtttataataggctgtgccccatgtttaggagaacattgggacagggctttaccatgtgcagacga

SEQ ID NO: 27202 - DNA, 75 bp, Artificial Sequence
  Synthetic
cgttccaaacccaggttcatgccctccaatagaattaaaaaatacagcaatacaagatggcgatatggcagatat

SEQ ID NO: 27203 - DNA, 75 bp, Artificial Sequence
  Synthetic
aggatatggcaacctaaattttaaagcattacaagaaaacagagcagatgtaagtttggatattgttaatgagac

SEQ ID NO: 27204 - DNA, 75 bp, Artificial Sequence
  Synthetic
ctgtaaatatccagactttttaaaaatgcagaatgatgtttatggagattcctgctttttttatgctcggcggga

SEQ ID NO: 27205 - DNA, 75 bp, Artificial Sequence
  Synthetic
acaatgttatgctagacacttttttgtacgtgggggcaaaacaggagatgatatacctgcaggacaaattgatga

SEQ ID NO: 27206 - DNA, 75 bp, Artificial Sequence
  Synthetic
aggtagcatgaagaatgcattctacattccacctgtgaataatcaggcacagaacaacctaggtaattcaatgta

SEQ ID NO: 27207 - DNA, 75 bp, Artificial Sequence
  Synthetic
tttcccaactgtcagtggctcattggtgtctagtgatgctcaattgtttaataggccattttggctgcagcgcgc

SEQ ID NO: 27208 - DNA, 75 bp, Artificial Sequence
  Synthetic
acagggccacaacaatggcatctgctggttcaatcaactatttgttactgtagtagataatactcgaaatacaaa

SEQ ID NO: 27209 - DNA, 75 bp, Artificial Sequence
  Synthetic
ttttagcatatcagttcattcagaaaacactgatgtttctaaaattcaaaattatgattctcagaaatttcaaga

SEQ ID NO: 27210 - DNA, 75 bp, Artificial Sequence
  Synthetic
atatttaagacacgtagaagaatatgaaatttcattaattttacagctctgtaaagttcctttaacagctgaagt

SEQ ID NO: 27211 - DNA, 75 bp, Artificial Sequence
  Synthetic
tttagctcaaattaatgctatgaattcaaatatattagaggagtggcagttaggattcgttcctgcaccggataa

SEQ ID NO: 27212 - DNA, 75 bp, Artificial Sequence
  Synthetic
tcctatccacgatacatacagatatattaattctgcagctactagatgtcctgataaaaatcctccaaaagaaag

SEQ ID NO: 27213 - DNA, 75 bp, Artificial Sequence
  Synthetic
agaagatccttacaaggatctaaacttttggaatgttgacctatcagaaagattatccttagaattggatcaata

SEQ ID NO: 27214 - DNA, 75 bp, Artificial Sequence
  Synthetic
ttctttaggacgcaaattcttatttcaagcaggtttacaacaagcgaccgtaaacggtacaaaaactgtatcttc

SEQ ID NO: 27215 - DNA, 75 bp, Artificial Sequence
  Synthetic
aaagttatctactaggggcgtcaaacgaaaacgcaaacaataaacccgaccgttttcggtacaataaagtcaact

SEQ ID NO: 27216 - DNA, 75 bp, Artificial Sequence
  Synthetic
tttacacggtattcaaggaatgtttatttactctgactaactaagataccaaccgcacccgacacataaaggtga

SEQ ID NO: 27217 - DNA, 75 bp, Artificial Sequence
  Synthetic
gttgtgtgccaaatgaggtgagttgtgagccagaagagatcacagccaagtcaggcttgagccagatcagataca

SEQ ID NO: 27218 - DNA, 75 bp, Artificial Sequence
  Synthetic
ctgcgtgccagagttggctcaaacttcatcgtcccaacacgttcggaacaggaggaaatgtaaggctgccaacgc

SEQ ID NO: 27219 - DNA, 75 bp, Artificial Sequence
  Synthetic
atgtaaggctgccaacgcttttggctcttctttttggcacagcagaagaccgttaacggtaagtttttatttgta

SEQ ID NO: 27220 - DNA, 75 bp, Artificial Sequence
  Synthetic
aacggtaagtttgcattaatgtaccaggtgcggtacagatcatttcacaatggatattattgttgccaactacca

SEQ ID NO: 27221 - DNA, 75 bp, Artificial Sequence
  Synthetic
tagtcataatcaagttcttgcctgtatcgttttcgtaccttacctacagtattttatattaatatataaataaat

SEQ ID NO: 27222 - DNA, 75 bp, Artificial Sequence
  Synthetic
aaatatataaatgtgtatttatttctcaggctcagttctttgcaattattaagacaaatggctcagaaggctttg

SEQ ID NO: 27223 - DNA, 75 bp, Artificial Sequence
  Synthetic
gaacagactacagttaaagaggaaaagctagaactacctactactattagaggcttagctcaattgttagacata

SEQ ID NO: 27224 - DNA, 75 bp, Artificial Sequence
  Synthetic
cctttagtagattgtttgctaccttgcaacttttgtggcagatttcttgactatttagaagtttgtgaatttgat

SEQ ID NO: 27225 - DNA, 75 bp, Artificial Sequence
  Synthetic
tataaaaagcttactttaatttggaaagactacagtgtttatgcctgctgccgtttgtgctgctcagcaactgcc

SEQ ID NO: 27226 - DNA, 75 bp, Artificial Sequence
  Synthetic
acatatgaatttaatgttttttatcaacaaacagtgttaggtagagatattgagctagctacaggcctttccatt

SEQ ID NO: 27227 - DNA, 75 bp, Artificial Sequence
  Synthetic
tttgagattgacataaggtgtcatacctgcctgtcatttcttgacattattgaaaagttagatagctgtggaaga

SEQ ID NO: 27228 - DNA, 75 bp, Artificial Sequence
  Synthetic
ggacttccctttcacaaagtaagaaacgcctggaagggtgtttgtaggcagtgtaagcatttttacaatgattgg

SEQ ID NO: 27229 - DNA, 75 bp, Artificial Sequence
  Synthetic
taaagaggtcaccgtgcgagatattgttctggagttaagtgaggttcaacctgaagtattaccagttgacctgtt

SEQ ID NO: 27230 - DNA, 75 bp, Artificial Sequence
  Synthetic
ttgcgacgaggaattaccaaatgaacaacaggcggaggaggagctagacatcgacagagtcgttttcaaagtgat

SEQ ID NO: 27231 - DNA, 75 bp, Artificial Sequence
  Synthetic
tgcaccgtgcggttgcagctgctgcgaggtcaagcttcgcatttttgtgaacgcaacaaaccgtggcatcaggac

SEQ ID NO: 27232 - DNA, 75 bp, Artificial Sequence
  Synthetic
atttcaggaacttttgactggtgatctgcagctcctctgcccagagtgccgtgggaactgcaaacatggcggatt

SEQ ID NO: 27233 - DNA, 75 bp, Artificial Sequence
  Synthetic
ctaaaggtagtacatctaaagaagggtttggtgattggtgtattttggaagctgactgtagtgatgttgaggatg

SEQ ID NO: 27234 - DNA, 75 bp, Artificial Sequence
  Synthetic
atttgggacaattatttgagagagatacagactcagatatctcggacctgttagacaattgtgacctggatcagg

SEQ ID NO: 27235 - DNA, 75 bp, Artificial Sequence
  Synthetic
gcaattcacgggaactatttcatcaacaggagtgtaagcaaagcgaggagcaattacaaaaactaaaacgaaagt

SEQ ID NO: 27236 - DNA, 75 bp, Artificial Sequence
  Synthetic
atcttagtccaaaagctgtcgcgcagcttagtccgcgtcttgagtcaatttcattgtcacctcagcagaaatcca

SEQ ID NO: 27237 - DNA, 75 bp, Artificial Sequence
  Synthetic
agagaaggctctttgcagagcaagacagcggactcgagttaacctttaacaatgaagctgaagatgttactcctg

SEQ ID NO: 27238 - DNA, 75 bp, Artificial Sequence
  Synthetic
aggtggaggtaccggctatagactctcggccggatgatgatgagggaggatcaggggatgtagatattcattata

SEQ ID NO: 27239 - DNA, 75 bp, Artificial Sequence
  Synthetic
cagcattgttgcgttccagcaaccaaaaggccacattactggcaaaattcaaacaagcgtttggggtaggcttta

SEQ ID NO: 27240 - DNA, 75 bp, Artificial Sequence
  Synthetic
atgaattgacaagacaattcaaaagctacaaaacctgctgtaatcattgggttgtatccgtatatgcagtccatg

SEQ ID NO: 27241 - DNA, 75 bp, Artificial Sequence
  Synthetic
atgatctatttgaaagctcaaagcagctgttgcaacagcattgtgactatatatgggtccgtgggatagatgcaa

SEQ ID NO: 27242 - DNA, 75 bp, Artificial Sequence
  Synthetic
tgtcattatatctattgtgttttaaggcgggaaaaaatcgtgggacagttcataagctaattaccacaatgttaa

SEQ ID NO: 27243 - DNA, 75 bp, Artificial Sequence
  Synthetic
atgtgcatgagcaacagatattgtctgagcctccaaagttaagaaatacagctgctgcattattttggtacaaag

SEQ ID NO: 27244 - DNA, 75 bp, Artificial Sequence
  Synthetic
gatgtatgggacctggagtgttcacccacggtccttaccctgaatggattgcacaattaaccattttgggccata

SEQ ID NO: 27245 - DNA, 75 bp, Artificial Sequence
  Synthetic
agagtgctgaggcaagtgcgtttgatctgtcagtcatggttcaatgggcatttgataacaatctgtttgaggagg

SEQ ID NO: 27246 - DNA, 75 bp, Artificial Sequence
  Synthetic
cagacattgcatacggatatgcaagactggcaccagaggatagcaatgcagttgcatggcttgcacataataacc

SEQ ID NO: 27247 - DNA, 75 bp, Artificial Sequence
  Synthetic
aagctaaatatgttagagaatgtgctatgatggttcgatactacaaaaaggggcaaatgagagatatgagcatgt

SEQ ID NO: 27248 - DNA, 75 bp, Artificial Sequence
  Synthetic
ctgagtggatatatacaaggatacatgaagtagagggagaaggacagtggtctagcattgttaaatttttaagat

SEQ ID NO: 27249 - DNA, 75 bp, Artificial Sequence
  Synthetic
atcaagaaataaattttatttcatttttggctgctttaaaagatttattacattcagtacctaaacgcaattgta

SEQ ID NO: 27250 - DNA, 75 bp, Artificial Sequence
  Synthetic
ttttattccatggccctccaaatacaggaaagtcatcgtttggaatgtccttaataaaagttctaagggggagag

SEQ ID NO: 27251 - DNA, 75 bp, Artificial Sequence
  Synthetic
tattatcatttgtaaactccaaaagtcagttttggttgcagcctcttggagaatgtaaaatagcattattagatg

SEQ ID NO: 27252 - DNA, 75 bp, Artificial Sequence
  Synthetic
atgttacagatccatgttgggtgtatatggatcaatatttaagaaatgggttagatgggcattttgtgtctttgg

SEQ ID NO: 27253 - DNA, 75 bp, Artificial Sequence
  Synthetic
attgtaaatatagagcacccatgcaaacaaagtttccacctttaatacttacatctaatattaatgtacatgcag

SEQ ID NO: 27254 - DNA, 75 bp, Artificial Sequence
  Synthetic
agaccaattatagatacctacatagtagaattaagggttttgaatttaaaaatccatttcctatgaaagcagata

SEQ ID NO: 27255 - DNA, 75 bp, Artificial Sequence
  Synthetic
atacacctcaatttgagttaactgaccaaagctggaaatctttttttacaaggctttggacacacttagacctga

SEQ ID NO: 27256 - DNA, 75 bp, Artificial Sequence
  Synthetic
gtgaccaagaagacgagggcgaacatggagaatctcagcgagcgtttcaatgctctgcaagaacagctaatgaac

SEQ ID NO: 27257 - DNA, 75 bp, Artificial Sequence
  Synthetic
atttatgaagctgcagaacagacattaaaggcacaaattttacattggcagacattgcgaaaagaagctgtgaca

SEQ ID NO: 27258 - DNA, 75 bp, Artificial Sequence
  Synthetic
ctctactttgctaggcagaaaggcataaataggttgggataccaaccagtgcctgcattagcaatatctgaggca

SEQ ID NO: 27259 - DNA, 75 bp, Artificial Sequence
  Synthetic
agggccaaagaggctatatatatggtgttgcagttagagtcgctacaaaaatcagcgtttgctttggagccttgg

SEQ ID NO: 27260 - DNA, 75 bp, Artificial Sequence
  Synthetic
accttagtggacactagtacagagacttttaagagtgctccagaaaatcattttaaaaaggggcctgtacctgtg

SEQ ID NO: 27261 - DNA, 75 bp, Artificial Sequence
  Synthetic
gaggtgatatatgacaaagatgaagcaaatgctaatttgtatactatgtggacatttgtgtattacatggattca

SEQ ID NO: 27262 - DNA, 75 bp, Artificial Sequence
  Synthetic
gatgatgtgtggcataagacaacaagtggggtcaatcaaactggcatttactacctatatggaacatttaaacac

SEQ ID NO: 27263 - DNA, 75 bp, Artificial Sequence
  Synthetic
tattatgtgttatttgctgatgatgcaaagagatatagtgctactggagaatgggaagttaaagttaataaggaa

SEQ ID NO: 27264 - DNA, 75 bp, Artificial Sequence
  Synthetic
actgtgtttactcctgtcactagctccacaccaccagggtcaccaggaggacaaacagacccagacacctcctcc

SEQ ID NO: 27265 - DNA, 75 bp, Artificial Sequence
  Synthetic
aagacccccaccaccaccacagccgccactgacacctcgcccagacgccaatccatcaataaacagtcacaacaa

SEQ ID NO: 27266 - DNA, 75 bp, Artificial Sequence
  Synthetic
accgaaaccaaacgaagagggtacggacggagaccatcaagcagaacaaggcgaccgcaaacgcaccaaaggcga

SEQ ID NO: 27267 - DNA, 75 bp, Artificial Sequence
  Synthetic
tccagatccagatcccggtcgcggtccagttctcaaacccactcttccaccaccaccaccaccaccacctacagg

SEQ ID NO: 27268 - DNA, 75 bp, Artificial Sequence
  Synthetic
tccaggtctacgtcgctcaacaagactcgtgctcgttccaggtcaaggtccacctccagatctaccagcaccacc

SEQ ID NO: 27269 - DNA, 75 bp, Artificial Sequence
  Synthetic
agtagaaggggaggtagagggtcatccacaaggcaaagatcgcgatcaccctccacctacacctcaaaacggtca

SEQ ID NO: 27270 - DNA, 75 bp, Artificial Sequence
  Synthetic
cgggaaggaaacacaaggggcagagggagggggagacaagggagagcagggagcagtggggggagagagcagcga

SEQ ID NO: 27271 - DNA, 75 bp, Artificial Sequence
  Synthetic
cggagaaggagatcattctcaacctcccctgactcctccaaacgagtcagacgggagtctcctaaataccgtggc

SEQ ID NO: 27272 - DNA, 75 bp, Artificial Sequence
  Synthetic
gtgtctcctagcgaggtgggaaagcaacttcgatcagttggtgcaaaacattcagggcgacttggaaggttattg

SEQ ID NO: 27273 - DNA, 75 bp, Artificial Sequence
  Synthetic
gaggaagctagggaccccccagtaattcttgtgcgaggggacgcaaacacattaaaatgctttcgcaacagagca

SEQ ID NO: 27274 - DNA, 75 bp, Artificial Sequence
  Synthetic
aggaacaaatatagagggctttttagatcattcagcactacattttcctgggtagctggagatagcattgagcgt

SEQ ID NO: 27275 - DNA, 75 bp, Artificial Sequence
  Synthetic
ctaggcaggtccagaatgctcattagcttttcctgcctcactcagagaagggattttgatgatgctgtcaaatat

SEQ ID NO: 27276 - DNA, 75 bp, Artificial Sequence
  Synthetic
ccaaaaggagtcgagtggtcatatggtagtcttgatagcctttaacaagcattaacgctgctttgctactaactg

SEQ ID NO: 27277 - DNA, 75 bp, Artificial Sequence
  Synthetic
ctattaacaaccacagctttttttttacgtttttttattttactgattttgtactgcaatggcgcgtgctagaag

SEQ ID NO: 27278 - DNA, 75 bp, Artificial Sequence
  Synthetic
ggtcaaacgtgactctgtaacacatatatatcagacctgcaaacaggcaggcacttgcccctcggacgttgttaa

SEQ ID NO: 27279 - DNA, 75 bp, Artificial Sequence
  Synthetic
taaagttgagcaaacaacagttgctgacaatattttgaaatatggcagtgctggtgtcttttttggaggccttgg

SEQ ID NO: 27280 - DNA, 75 bp, Artificial Sequence
  Synthetic
cataggaacaggccgagggactgggggtgctactgggtacgtgccacttggggaaggtcctggtgtccgtgtggg

SEQ ID NO: 27281 - DNA, 75 bp, Artificial Sequence
  Synthetic
aggaaccccaacggttgtaaggccttctcttgttcctgaagcaattggaccagttgatattttacccattgacac

SEQ ID NO: 27282 - DNA, 75 bp, Artificial Sequence
  Synthetic
aatcgcacctgtcgagcctactgcttcatctttagtcccattaacagagtcgtctggtgctgatttacttcccgg

SEQ ID NO: 27283 - DNA, 75 bp, Artificial Sequence
  Synthetic
tgaagttgaaactatagccgaaatacatcctattcctgaaggtccgacaatcgactcccctgtagtcaccacaac

SEQ ID NO: 27284 - DNA, 75 bp, Artificial Sequence
  Synthetic
gacaggttccagtgctgttctggaagtggctccagaacctgtaccccctacacgtgttagaattgctagaacaca

SEQ ID NO: 27285 - DNA, 75 bp, Artificial Sequence
  Synthetic
atatcataatccctcttttcagatactcactgaatcaacacctgcgcagggcgagagttctcttgctgaccatat

SEQ ID NO: 27286 - DNA, 75 bp, Artificial Sequence
  Synthetic
tttggtcacctcagggtctggtggacaaaggataggcggtgatataacagacgaaattgaacttactgagtttcc

SEQ ID NO: 27287 - DNA, 75 bp, Artificial Sequence
  Synthetic
aagcagatatacatttgaaatagaagaacccacccctccacgaaaaagtagcacaccattacaaactgtagcctc

SEQ ID NO: 27288 - DNA, 75 bp, Artificial Sequence
  Synthetic
tgcagtaaggcgacggggcttctcattaacaaatagaagattggtacaacaagtagctgtagacaatcctttatt

SEQ ID NO: 27289 - DNA, 75 bp, Artificial Sequence
  Synthetic
tttaagtcaaccttctaagatggtaagattctcatttgacaatccagcttttgaagaagaggttaccaatatttt

SEQ ID NO: 27290 - DNA, 75 bp, Artificial Sequence
  Synthetic
tgaacaggatgttaacagctttgaagaacctccagacagggattttcttgatattaaacaattgggccgtcctca

SEQ ID NO: 27291 - DNA, 75 bp, Artificial Sequence
  Synthetic
atattctacaacaccagcaggttatattagggtaagcagactaggaactcgaggcaccattcgcactcgttctgg

SEQ ID NO: 27292 - DNA, 75 bp, Artificial Sequence
  Synthetic
tgcacaaataggttctcaggtacacttttatagagatttaagttctataaatactgaggatccaatagaactaca

SEQ ID NO: 27293 - DNA, 75 bp, Artificial Sequence
  Synthetic
gcttttagggcagcattctggagatgctactattgttcaaggtcctgtagaaagcacatttatagatatggacat

SEQ ID NO: 27294 - DNA, 75 bp, Artificial Sequence
  Synthetic
tgctgaaaaccctttatctgaaacaatagatgcttcatctaatgatttacttttggatgagactgtggaggattt

SEQ ID NO: 27295 - DNA, 75 bp, Artificial Sequence
  Synthetic
tagtgggtcccaattagtaattggaaatcgaaggagtacaacatcatatactgttcccagatttgagactactag

SEQ ID NO: 27296 - DNA, 75 bp, Artificial Sequence
  Synthetic
aagtagttcctattatgttcaagacacagatggttattatgttgcttacccagagtcacgggacactattgatat

SEQ ID NO: 27297 - DNA, 75 bp, Artificial Sequence
  Synthetic
tatttaccctacacctgaattacctgtagttgtcattcacacccatgacaattctggagacttttacttacatcc

SEQ ID NO: 27298 - DNA, 75 bp, Artificial Sequence
  Synthetic
tagtcttagaaggcgtaagcgtaaaagaaaatatttgtgatttgcattgcagatggcagtgtggcactcggctaa

SEQ ID NO: 27299 - DNA, 75 bp, Artificial Sequence
  Synthetic
cggtaaagtataccttcctccatcaacaccagtggccagggttcaaagcacggatgaatacatacaaaggactaa

SEQ ID NO: 27300 - DNA, 75 bp, Artificial Sequence
  Synthetic
tatctattatcatgcaaatactgaccgccttttaacagtaggacatccatatttcaatgtatacaataataatgg

SEQ ID NO: 27301 - DNA, 75 bp, Artificial Sequence
  Synthetic
aactacattagaggttccaaaagtatcaggtaatcagcatagggtgtttcgcttaaaattgccagatcctaatag

SEQ ID NO: 27302 - DNA, 75 bp, Artificial Sequence
  Synthetic
atttgctctagcggacatgtctgtatacaaccctgacaaagaacgcttggtgtgggcctgcaggggtctagaaat

SEQ ID NO: 27303 - DNA, 75 bp, Artificial Sequence
  Synthetic
tggaaggggtcaacctttaggtgttggcagtactggtcacccatattttaataaggtaaaagatacagaaaacag

SEQ ID NO: 27304 - DNA, 75 bp, Artificial Sequence
  Synthetic
taattcctatatcacaaactcaaaagatgacagacaagacacctcttttgatcctaaacaaatacagatgtttat

SEQ ID NO: 27305 - DNA, 75 bp, Artificial Sequence
  Synthetic
tgtgggctgcactccatgtattggcgaacactgggataaggcagagccttgtggggaacagcaaactggtctttg

SEQ ID NO: 27306 - DNA, 75 bp, Artificial Sequence
  Synthetic
tcctcctattgaattaaaaaacacatacattcaggatggcgacatggcagacattggttttggcaacattaattt

SEQ ID NO: 27307 - DNA, 75 bp, Artificial Sequence
  Synthetic
caaggccttacaacacagtaggtctgatgttagtcttgacattgtaaatgaaacttgcaagtacccggattttct

SEQ ID NO: 27308 - DNA, 75 bp, Artificial Sequence
  Synthetic
caaaatgcaaaatgatgtttatggggatgcttgctttttttatgctcgtagagagcaatgttatgccagacattt

SEQ ID NO: 27309 - DNA, 75 bp, Artificial Sequence
  Synthetic
ttttgttagagggggaaaaacaggtgatgacataccaggagcacaggttggcaatggtaatatgaaaaatcaatt

SEQ ID NO: 27310 - DNA, 75 bp, Artificial Sequence
  Synthetic
ttacattcctggtgctacgggtcaggctcagagcactataggtaatgccatgtatttcccaactgtcagtggctc

SEQ ID NO: 27311 - DNA, 75 bp, Artificial Sequence
  Synthetic
actagtctctagtgatgctcaactgtttaacaggccattctggctccaaagggctcagggtcataataatggcat

SEQ ID NO: 27312 - DNA, 75 bp, Artificial Sequence
  Synthetic
tctgtgggctaatcaaatgtttgtcacagttgtagacaacacaagaaatacaaatttcagcatctctgtttactc

SEQ ID NO: 27313 - DNA, 75 bp, Artificial Sequence
  Synthetic
tcaggcaggggacataaaggatatacaggattataatgcagacaattttagagagtatcaaagacatgtggagga

SEQ ID NO: 27314 - DNA, 75 bp, Artificial Sequence
  Synthetic
atatgaaatttctgtaatattacaattgtgcaaagttcctttaaaagcagaagttttagcacaaattaatgccat

SEQ ID NO: 27315 - DNA, 75 bp, Artificial Sequence
  Synthetic
gaattcgtctcttttagaggaatggcagttaggatttgtgcctactccagacaaccctattcaggatacatatag

SEQ ID NO: 27316 - DNA, 75 bp, Artificial Sequence
  Synthetic
atatctagaatctttggccactaggtgtcctgaaaagtctcctccaaaagagaaggttgacccctacaaaggttt

SEQ ID NO: 27317 - DNA, 75 bp, Artificial Sequence
  Synthetic
aaacttttgggatgtcgatatgacagagcgcctttccctggatttagatcaatattcattaggtagaaagttctt

SEQ ID NO: 27318 - DNA, 75 bp, Artificial Sequence
  Synthetic
attccaggctggattacagcagacgaccgtaaacggtacaaaaacaactccttacagggggtccatcagaggaac

SEQ ID NO: 27319 - DNA, 75 bp, Artificial Sequence
  Synthetic
aaagcgcaaacgaaaaaattgaagatgaccgttttcggtacagattgtttaacttttacacagtattcaaggaat

SEQ ID NO: 27320 - DNA, 75 bp, Artificial Sequence
  Synthetic
gtctgtttactgtgactaagtgtaactctgccaaagaaacaaccgcacccggtacacgtattcagcttgttgcca

SEQ ID NO: 27321 - DNA, 75 bp, Artificial Sequence
  Synthetic
aaacagataagcttggcagtcagaacacaccgtgttcgtcgcaacacgctcggattaggtcttctgccaaaagaa

SEQ ID NO: 27322 - DNA, 75 bp, Artificial Sequence
  Synthetic
atttaatcttgttatcgtttttggcgatcacatttggcaccgcgggcagctgttttggcactacaagacaaccgt

SEQ ID NO: 27323 - DNA, 75 bp, Artificial Sequence
  Synthetic
tttaatcttgttatcgtttttggcgatcacatttggcaccgcgggcagctgttttggcactacaagacaaccgtt

SEQ ID NO: 27324 - DNA, 75 bp, Artificial Sequence
  Synthetic
aacggtaagtagcaagttccttgttccttgtaccaggtgcggtattgggattttgcaattgtaatggttgttgcc

SEQ ID NO: 27325 - DNA, 75 bp, Artificial Sequence
  Synthetic
ttgcctgtatcgttttcgtatcctgttaacaatatccaatgtatgtatacataaataaatatatatatatataag

SEQ ID NO: 27326 - DNA, 75 bp, Artificial Sequence
  Synthetic
atttcatcaacaggagtgtgagcagagcgaggagcaattacaaaaactaaaacgaaagtatcttagtccaaaagc

SEQ ID NO: 27327 - DNA, 75 bp, Artificial Sequence
  Synthetic
ttactcctgaggtggaggtaccggctattgactctcggccggatgacgagggaggttcaggggatgtagatatac

SEQ ID NO: 27328 - DNA, 75 bp, Artificial Sequence
  Synthetic
tattgactctcggccggatgacgagggaggttcaggggatgtagatatacattatacatcattgttgcgttctag

SEQ ID NO: 27329 - DNA, 75 bp, Artificial Sequence
  Synthetic
caacaaaaaagccacattaatggctaaatttaaagagtcgtttggagtaggttttaatgaattgacacggcaatt

SEQ ID NO: 27330 - DNA, 75 bp, Artificial Sequence
  Synthetic
gtcacaaaagtgctgaggcaagtacttttgatttttcagcaatggtccaatgggcatttgataatcatttattag

SEQ ID NO: 27331 - DNA, 75 bp, Artificial Sequence
  Synthetic
cctgtagaagttatttatgacaatgatccagataatgccaatttgtatacaatgtggacttatgtgtattatatg

SEQ ID NO: 27332 - DNA, 75 bp, Artificial Sequence
  Synthetic
tggagaatgggaagtaaaagttaataaggatactgtgtttgctcctgtcaccagctccacgcctccagggtcgcc

SEQ ID NO: 27333 - DNA, 75 bp, Artificial Sequence
  Synthetic
gtggaaggtcacccaggcggcgatcaaggtcaccctccacctactcctcctgcaccacacaacggtcacagcggg

SEQ ID NO: 27334 - DNA, 75 bp, Artificial Sequence
  Synthetic
tcatgggtggcaggagatggcactgagcgtctaggcaggcccagaatgctcattagcttttcttcctatagtcaa

SEQ ID NO: 27335 - DNA, 75 bp, Artificial Sequence
  Synthetic
agcgagactctgtaactcatatttaccaaacctgcaaacaggcaggtacttgcccccctgatgttattaataaag

SEQ ID NO: 27336 - DNA, 75 bp, Artificial Sequence
  Synthetic
catacataacattttctaaagatggacagaatacagcattttctaaagatgacagactgaatacatcctttgatc

SEQ ID NO: 27337 - DNA, 75 bp, Artificial Sequence
  Synthetic
cttttttgttagagggggtaaaactggtgatgacattccaggtgcacaaattgacaatggtacatacaaaaatca

SEQ ID NO: 27338 - DNA, 75 bp, Artificial Sequence
  Synthetic
atcacagtggttgacaacacaagaaatactaatttcagtatttctgtatataatcaagctggaccactaaaagat

SEQ ID NO: 27339 - DNA, 75 bp, Artificial Sequence
  Synthetic
gttgcagactataatgcagagcaatttagagaatatcaaagacatgtagaagaatatgaaatatctttaatttta

SEQ ID NO: 27340 - DNA, 75 bp, Artificial Sequence
  Synthetic
acgaccgttaacggtacaaaagcagtgtcttataaagggtctaatagaggaacaaagcgcaaacgtaaaaattga

SEQ ID NO: 27341 - DNA, 75 bp, Artificial Sequence
  Synthetic
atggagagctaccctgagtcagtggcaggattagctgtgctcctagatataccaatagaagatttgttgattcct

SEQ ID NO: 27342 - DNA, 75 bp, Artificial Sequence
  Synthetic
tgtaatttttgtggtaacttcttatcctttctagagcttaatgagtttgatgctaaacatttaacattaatttgg

SEQ ID NO: 27343 - DNA, 75 bp, Artificial Sequence
  Synthetic
aaggagcatttagtgtttgcgtgttgtagatgttgttgtaccgcaagtggtttttttgaatttcaaaatttttat

SEQ ID NO: 27344 - DNA, 75 bp, Artificial Sequence
  Synthetic
gaaggttcagttataggaagagacatagaaacagtagaacataaatcaatttttgacattactgtgagatgtcat

SEQ ID NO: 27345 - DNA, 75 bp, Artificial Sequence
  Synthetic
cagtgtttaagactacttgacctaatagataaattagatatttgtggacgtagccaacattttcataaagtaaga

SEQ ID NO: 27346 - DNA, 75 bp, Artificial Sequence
  Synthetic
ggagcttggagaggtcgttgcaagtactgtaaataatgatagggaatcaggtcactattcaagacattgtcttgg

SEQ ID NO: 27347 - DNA, 75 bp, Artificial Sequence
  Synthetic
gtcactattcaagacattgtcttggagttagagccgtaccccattgacctgtattgcgaagaagaggagttacca

SEQ ID NO: 27348 - DNA, 75 bp, Artificial Sequence
  Synthetic
gaatcaagactccgtctgtatatttttgctacaaactttggaattcgaactctgcaaactctgttattagaagac

SEQ ID NO: 27349 - DNA, 75 bp, Artificial Sequence
  Synthetic
ttgctacaaactttggaattcgaactctgcaaactctgttattagaagacatcaacctattgtgtcctacctgcc

SEQ ID NO: 27350 - DNA, 75 bp, Artificial Sequence
  Synthetic
ttggaagctgaatgtagtgacttagaaaacgatttggaaaaactgtttgatgaaagtactgattctgatatttct

SEQ ID NO: 27351 - DNA, 75 bp, Artificial Sequence
  Synthetic
aaaacgatttggaaaaactgtttgatgaaagtactgattctgatatttctgagttaattgatgatggggacgtgg

SEQ ID NO: 27352 - DNA, 75 bp, Artificial Sequence
  Synthetic
tgtatttcactatctcccaagcaaaaaagtaaaagacgtctttttactgagcaggacagcgggcttgagctgact

SEQ ID NO: 27353 - DNA, 75 bp, Artificial Sequence
  Synthetic
cttacaaatgaagctgaagattatccttctgaaaaagtggaggtaccaagaactgacattactcctccgcctgcg

SEQ ID NO: 27354 - DNA, 75 bp, Artificial Sequence
  Synthetic
gaaagcagtgtggggacagggaattgtcattttaaagaattgttgcgatgcagcaatattaaagctacattgcta

SEQ ID NO: 27355 - DNA, 75 bp, Artificial Sequence
  Synthetic
gcaaagtttaaagtagcatatgaagttgggtttaatgatttgactcggcagtttaaaagtcataaaacatgctgt

SEQ ID NO: 27356 - DNA, 75 bp, Artificial Sequence
  Synthetic
aatgattgggtagccactgtatatggtgtaaatgatgatttatatgaaagtgcaaaacaattatttcaacagcat

SEQ ID NO: 27357 - DNA, 75 bp, Artificial Sequence
  Synthetic
tgccaatatgtgtgggctcttagatctaatgcgatgtcattgtttctattgtgttttaaggcgggaaagaatcgt

SEQ ID NO: 27358 - DNA, 75 bp, Artificial Sequence
  Synthetic
tgtactgtgttgaaactgctgactagtattttatgtgttcgtgaagagcaaatattggcggagcctccaaagctt

SEQ ID NO: 27359 - DNA, 75 bp, Artificial Sequence
  Synthetic
agaagtacagtagctgcactgttttggtatcaaggcagtaatatatctggtgctttcacgcatggtacattacca

SEQ ID NO: 27360 - DNA, 75 bp, Artificial Sequence
  Synthetic
tcatggattgtacaacaaactgtaataggacatcaaacagcagatgctacaacgtttgatttctctaaaatggtt

SEQ ID NO: 27361 - DNA, 75 bp, Artificial Sequence
  Synthetic
caatgggcatttgataacaatcatgtagatgaatcagatatcgcctatcactatgctaggttagcaccagaagat

SEQ ID NO: 27362 - DNA, 75 bp, Artificial Sequence
  Synthetic
attaatgctgtagcatggcttgcacataatagtcaagcacgatttgttagagagtgtgcagcaatggtaagatat

SEQ ID NO: 27363 - DNA, 75 bp, Artificial Sequence
  Synthetic
tataaaagaggacaaatgcgggatatgtctatatctgaatggatttataatcgcctagaggaagttgatggggtc

SEQ ID NO: 27364 - DNA, 75 bp, Artificial Sequence
  Synthetic
ggacattggtccactattgtgaaatttattaggtatcaggaaattaattttataatgttcttagctactctaaag

SEQ ID NO: 27365 - DNA, 75 bp, Artificial Sequence
  Synthetic
gattttttacattcagttcctaaacataattgtatattaatacatgggcctccaaacacaggtaaatctgcattt

SEQ ID NO: 27366 - DNA, 75 bp, Artificial Sequence
  Synthetic
acaatgtcattaattagggtactacgtggtaaggttatctcatttgtaaactccaaaagtcaattttggttgcag

SEQ ID NO: 27367 - DNA, 75 bp, Artificial Sequence
  Synthetic
cctttgggagactgtaaaattgcattattagatgatgcaactgatccatgttggatttatatggatcagtattta

SEQ ID NO: 27368 - DNA, 75 bp, Artificial Sequence
  Synthetic
aggaatggattagacgggcatccagtatcattggattgtaaacataaggctcccatacaaattaaattccctcca

SEQ ID NO: 27369 - DNA, 75 bp, Artificial Sequence
  Synthetic
ttgttagtaacatctaatattgatgtacacagtgaaatacaatacaaatatctacatagtagaattcattcattt

SEQ ID NO: 27370 - DNA, 75 bp, Artificial Sequence
  Synthetic
tctacatagtagaattcattcatttaaatttccaaataaatttccgttaaatgctgacaacacaccgcaatttga

SEQ ID NO: 27371 - DNA, 75 bp, Artificial Sequence
  Synthetic
ggaggatggagacactcagcgagcgtttcaatgctctgcaagaccacctaatgaacatatatgaagcagctaaaa

SEQ ID NO: 27372 - DNA, 75 bp, Artificial Sequence
  Synthetic
acactcttgaagcacagattgagcattggcaattattgagacgagaagcagtattattatttgttgccagacaaa

SEQ ID NO: 27373 - DNA, 75 bp, Artificial Sequence
  Synthetic
agggtgttttaagactgggatatcagcctgtacctccacaggcagtgtctgaaagtaaagcaaaagatgctataa

SEQ ID NO: 27374 - DNA, 75 bp, Artificial Sequence
  Synthetic
tgatggttctacagttgcaatcacttcaaaactctaaattcaaagatgaaccatggactttggtagataccagtt

SEQ ID NO: 27375 - DNA, 75 bp, Artificial Sequence
  Synthetic
tggaaacctatagaaaccaacctgaaaatacattcaaaaaaggacctgtaagtgtggaggttatgtatgacaatg

SEQ ID NO: 27376 - DNA, 75 bp, Artificial Sequence
  Synthetic
accccacaaacacaaatgtatacacattgtggaagtatgtttattatttggatgccgatgatgagtggcagaaaa

SEQ ID NO: 27377 - DNA, 75 bp, Artificial Sequence
  Synthetic
cggaaagtggagtaaatcaaacaggcatatattacctacaaggagcatttaaacattactatacactgtttgcag

SEQ ID NO: 27378 - DNA, 75 bp, Artificial Sequence
  Synthetic
atgatgcacctagatttagctccactggacaatgggaagttatgattaataaagaaactgtgtttgctcctgtta

SEQ ID NO: 27379 - DNA, 75 bp, Artificial Sequence
  Synthetic
ctagctccaccccgccggactcccccggaagacaaatatccggacaaggcaccggggctaccaccaccaacaccg

SEQ ID NO: 27380 - DNA, 75 bp, Artificial Sequence
  Synthetic
agaccgaccacactgccaccacagagaccacaaccacctccaaccagcagcgacgaccaagatacggacggaaag

SEQ ID NO: 27381 - DNA, 75 bp, Artificial Sequence
  Synthetic
actctagtcctacaaccaccaccagccggcaaagatccaggaaagcgcagcagagacgacgaaccagatccaggt

SEQ ID NO: 27382 - DNA, 75 bp, Artificial Sequence
  Synthetic
ccgtcgggtcccaagaaaggcggattaggtccagatcccgatcggcatcccgtagagggggccacaaacgacagc

SEQ ID NO: 27383 - DNA, 75 bp, Artificial Sequence
  Synthetic
gaagcagaagtacccacagggggagggggagaaggtcccgctcatcctccagagggaagtgcacaaggagacgga

SEQ ID NO: 27384 - DNA, 75 bp, Artificial Sequence
  Synthetic
gacgtggaaggtcatcctcctcctcatccatctccacgtcctgctcagcctcctctgcctcctccgtgtcctcct

SEQ ID NO: 27385 - DNA, 75 bp, Artificial Sequence
  Synthetic
cctcacaacggcgaaagcggggacgaggagggtcaaggtctagctcctaccgtggcatctctcctggcgatgtgg

SEQ ID NO: 27386 - DNA, 75 bp, Artificial Sequence
  Synthetic
gaaaatcagttcaaacagttagtagaagatataaaggaagacttggaagattattggcagaagctcatgaccccc

SEQ ID NO: 27387 - DNA, 75 bp, Artificial Sequence
  Synthetic
cagtaattttgctaaagggtgcagcaaacacgcttaaatgctttcgaaaccgcactaagattaagtataaggatt

SEQ ID NO: 27388 - DNA, 75 bp, Artificial Sequence
  Synthetic
tgtttaaatgcatttcaaccacattttcttgggtggctaatgacggctgcgagcggttgggaagacatagaatgc

SEQ ID NO: 27389 - DNA, 75 bp, Artificial Sequence
  Synthetic
ttattagtttcatatcagtagagcaaagaaacaaatttgacactagtgttaagtatcctaaaactgttgaacgaa

SEQ ID NO: 27390 - DNA, 75 bp, Artificial Sequence
  Synthetic
catatggaagcctagacagcttataataataactaacctgcttatttatgctgcttttgctactaatatactaat

SEQ ID NO: 27391 - DNA, 75 bp, Artificial Sequence
  Synthetic
atatttttttatttttatattttacaatggtgcgtgccaaaagggtcaaacgagactctgttacccatatttacc

SEQ ID NO: 27392 - DNA, 75 bp, Artificial Sequence
  Synthetic
aaacctgcaagcaagcaggtaactgccctcccgatgttgttaataaagtggagcaaactacagttgctgacagca

SEQ ID NO: 27393 - DNA, 75 bp, Artificial Sequence
  Synthetic
ttttaaaatatgggagtgctggtgtgttttttggtggtttgggtataggatctggccgtggcaccggtggcacaa

SEQ ID NO: 27394 - DNA, 75 bp, Artificial Sequence
  Synthetic
caggctatagaccccttggagaagggcctggagtccgagtaggtaatacacctacaattgtaagaccctctgtta

SEQ ID NO: 27395 - DNA, 75 bp, Artificial Sequence
  Synthetic
tcccagagacgataggcccagctgacataactcctattgatactgtaaaccctgttgacccttcagcttcttctg

SEQ ID NO: 27396 - DNA, 75 bp, Artificial Sequence
  Synthetic
ttgtgccattaactgaagcaccttcagtagatttattacctggtgaagtggaaacaatagctgaaattcatcctt

SEQ ID NO: 27397 - DNA, 75 bp, Artificial Sequence
  Synthetic
tgccagatgctccatctacagattccccagtggtaactactagtagaggatccagtgctgtactagaggtggcac

SEQ ID NO: 27398 - DNA, 75 bp, Artificial Sequence
  Synthetic
cggaacctacccctccaacgcgggttagagtttctcgcagccaataccataatccttcctttcaaattataacac

SEQ ID NO: 27399 - DNA, 75 bp, Artificial Sequence
  Synthetic
aatccactccaacccaaggtgaaagttcattagcagatcatgtattagtgacctctggttctggaggtcaaatca

SEQ ID NO: 27400 - DNA, 75 bp, Artificial Sequence
  Synthetic
taggaggatcatccacagaagttatagagctacaggaatttccaagtagatatagtttcgaaatagaggaaccca

SEQ ID NO: 27401 - DNA, 75 bp, Artificial Sequence
  Synthetic
ctccaccgcgacgtagcagtacccctgtgcaacgaccaacaactgcacgtcggggtaggggaccatctttaacta

SEQ ID NO: 27402 - DNA, 75 bp, Artificial Sequence
  Synthetic
ataggcgcttagtacaacaagtacaagtagataatcctttatttttaacacaaccatcccgtcttgtacgttttg

SEQ ID NO: 27403 - DNA, 75 bp, Artificial Sequence
  Synthetic
catttgataatcctgtatttgaagaagaagtgacaaacatctttgagcaagatgttaataattttgaagaaccac

SEQ ID NO: 27404 - DNA, 75 bp, Artificial Sequence
  Synthetic
ctgatagggactttttagatgttgctaggttaggtaggcctcaatattctgaaacaccagctggttatgttcgag

SEQ ID NO: 27405 - DNA, 75 bp, Artificial Sequence
  Synthetic
ttagtcgcctcgggcaaagacagacaattagaacacgctctggtaccagtattggaagtcaggtgcacttctata

SEQ ID NO: 27406 - DNA, 75 bp, Artificial Sequence
  Synthetic
gggatctcagtactattaacactgaagatcctattgaattacagcttttaggacagcactctggtgatgctacta

SEQ ID NO: 27407 - DNA, 75 bp, Artificial Sequence
  Synthetic
tcgtgcaggggtcatcagcagaaagtacatttataaatatggatataggtataaatccactagctgaaggtgggt

SEQ ID NO: 27408 - DNA, 75 bp, Artificial Sequence
  Synthetic
tacaatctatatctgaaagtgcagaacccatgtcccatgacttactgttagatgaagctgtagaggatttttctg

SEQ ID NO: 27409 - DNA, 75 bp, Artificial Sequence
  Synthetic
gctcacagttggttataggaaacaggcgaaacactgttagttatacagttccacgttttgagacccctagaagtg

SEQ ID NO: 27410 - DNA, 75 bp, Artificial Sequence
  Synthetic
cttcttattatgttcaagatactaaaggatactatgttgcatatccagagtctagaaacaatatggagataattt

SEQ ID NO: 27411 - DNA, 75 bp, Artificial Sequence
  Synthetic
accccagtcctgagttacctgttgtagttatacatacacatgatgccactggagacttttatttacatcccagtt

SEQ ID NO: 27412 - DNA, 75 bp, Artificial Sequence
  Synthetic
taaccttacgcaaacgacgcaaaagaaaatatttatgatttctgtttacagatggctgtctggcaatcggctagt

SEQ ID NO: 27413 - DNA, 75 bp, Artificial Sequence
  Synthetic
ggtaaggtctatctgccgccttctacaccagttgcaagggtccaaggcacggatgaatatgttgaacgcaccaac

SEQ ID NO: 27414 - DNA, 75 bp, Artificial Sequence
  Synthetic
atttattaccatgcatatagtgaccgcctgctaacagttgggcatccatatttcaacatttacaacaatcagggc

SEQ ID NO: 27415 - DNA, 75 bp, Artificial Sequence
  Synthetic
acacgcttggaggtacctaaagtatctggaaatcaacacagagtgtttagattaaaattacctgatccaaataga

SEQ ID NO: 27416 - DNA, 75 bp, Artificial Sequence
  Synthetic
tttgcattagctgacatgtctgtgtataacccagacaaagaaagattggtgtggggcctaaaaggtatagaaata

SEQ ID NO: 27417 - DNA, 75 bp, Artificial Sequence
  Synthetic
ggcagaggtcaaccattgggaataggtagtagcgggcatccattatttaacaaggtaaatgatacagaaaatgga

SEQ ID NO: 27418 - DNA, 75 bp, Artificial Sequence
  Synthetic
aatacatataagacttcctctaaggatgacagacaaaacatttcctttgatcccaaacagttacaaatgtttatt

SEQ ID NO: 27419 - DNA, 75 bp, Artificial Sequence
  Synthetic
attggctgtacaccatgtataggtgaacattgggacaaggcccctgcttgtgttgctgatgatcaacctggcagg

SEQ ID NO: 27420 - DNA, 75 bp, Artificial Sequence
  Synthetic
tgtcctcctatagagcttgtaaattcatacatacaggatggtgatatggctgacattggatatggaaatattaat

SEQ ID NO: 27421 - DNA, 75 bp, Artificial Sequence
  Synthetic
tttaaaactttacaacaaaatagatcagatgttagcttagatattgttgatgaaatttgcaagtatccagatttt

SEQ ID NO: 27422 - DNA, 75 bp, Artificial Sequence
  Synthetic
ttgaaaatgcaaaacgatgtttatggagatgcttgctttttttatgcacgacgtgaacagtgttatgctagacat

SEQ ID NO: 27423 - DNA, 75 bp, Artificial Sequence
  Synthetic
ttttttgttaggggtggaaagccaggtgatgatattcctgcatcccaaatagatgatggtaatttaaaaaatgaa

SEQ ID NO: 27424 - DNA, 75 bp, Artificial Sequence
  Synthetic
tattacattccagctgagtcaggacagccacaaaacaaacttggaaattccatgtatttcccaactataagtgga

SEQ ID NO: 27425 - DNA, 75 bp, Artificial Sequence
  Synthetic
catgtatttcccaactataagtggatcattggtgtcaagtgatgctcaattatttaacaggcccttctggctaca

SEQ ID NO: 27426 - DNA, 75 bp, Artificial Sequence
  Synthetic
aagagcgcagggtcataataatggcatcttatggggtaatcaattgtttgtgactgtattagataatactagaaa

SEQ ID NO: 27427 - DNA, 75 bp, Artificial Sequence
  Synthetic
tacaaactttagtattgctgtacatcaagagcagaagcaggttaaagaaatacaaaattatgattctgcaaagtt

SEQ ID NO: 27428 - DNA, 75 bp, Artificial Sequence
  Synthetic
taatgaatttcaaagacatgttgaggaatatgaagtgtctctcattttacaattgtgtaaaattccattgaaagc

SEQ ID NO: 27429 - DNA, 75 bp, Artificial Sequence
  Synthetic
tgaggttcttgcacagattaatgcaatgaactctgatattttagaaaactggcagttaggttttgtaccaacgcc

SEQ ID NO: 27430 - DNA, 75 bp, Artificial Sequence
  Synthetic
ggacaatcctattcatgatacttacagatacttagactcattagcaacacgctgtccagaaaaagttcccgcaaa

SEQ ID NO: 27431 - DNA, 75 bp, Artificial Sequence
  Synthetic
ggaaaaggtagacccttatgctaaatatgtattttggaatgttgatttatccgaacggttgtcattagatttaga

SEQ ID NO: 27432 - DNA, 75 bp, Artificial Sequence
  Synthetic
tcaatattctttgggacgtaaatttttgtttcaagcagggctacaacaaaaatctgctaatgggtctatatcttg

SEQ ID NO: 27433 - DNA, 75 bp, Artificial Sequence
  Synthetic
ttgtttcaagcagggctacaacaaaaatctgctaatgggtctatatcttgtgcagtgtccagaggtactaaaaga

SEQ ID NO: 27434 - DNA, 75 bp, Artificial Sequence
  Synthetic
aactttatacatgccaacgaccgcacccggtcttatatctaaagatctgtatcgatcttggcattatatcgccgt

SEQ ID NO: 27435 - DNA, 75 bp, Artificial Sequence
  Synthetic
cttggttcgtacacgctcggtatagctgccaacattttggcgccaagaacgctggcggctgcccaggaccgttaa

SEQ ID NO: 27436 - DNA, 75 bp, Artificial Sequence
  Synthetic
cggtaagtgttttgttgttttgtaccaggtgcggtacaactgttattactcacggtcattgttgccaacaaccat

SEQ ID NO: 27437 - DNA, 75 bp, Artificial Sequence
  Synthetic
tattctctgctaatacttgtctgaactactgtatatatatatatatatatatattgggtgtttagcacatcagga

SEQ ID NO: 27438 - DNA, 75 bp, Artificial Sequence
  Synthetic
acttgtctgaactactgtatatatatatatatatatatattgggtgtttagcacatcaggagatttgaagaacca

SEQ ID NO: 27439 - DNA, 75 bp, Artificial Sequence
  Synthetic
gcgccaagtttcttggcactcgcacagcaccgttaacggtaagtgttttgtatactgtaccgggcgcgataccaa

SEQ ID NO: 27440 - DNA, 75 bp, Artificial Sequence
  Synthetic
atatgccacctgcgcaattgttgttagcaactactttcattacctaacaagtattttcatgcaccgtttccgtat

SEQ ID NO: 27441 - DNA, 75 bp, Artificial Sequence
  Synthetic
cactgtgaatgtatttattgattagacatataaaaaggaagacatcttgatggctcaaccaggtaaacctcagtc

SEQ ID NO: 27442 - DNA, 75 bp, Artificial Sequence
  Synthetic
agtgttagaacttagtagattattaaatataccattagacgattgtgttgtaccatgtaacttttgcaaaagatt

SEQ ID NO: 27443 - DNA, 75 bp, Artificial Sequence
  Synthetic
tctaagttatacagagttaactgactttgacaccaaatgcttaagtttgatttggaaagacgattttgtgtttgc

SEQ ID NO: 27444 - DNA, 75 bp, Artificial Sequence
  Synthetic
atgttgtagatattgttgtgttgctacagcagcatttgaatttgaaaattattttgtagagagtgtgataggttg

SEQ ID NO: 27445 - DNA, 75 bp, Artificial Sequence
  Synthetic
ggaaatagaacaaaaagaaaatacacctctttcggacattattgtaaggtgtcaccattgcttaaaattacttaa

SEQ ID NO: 27446 - DNA, 75 bp, Artificial Sequence
  Synthetic
tcaaattgaaaagcttgatatctgtggaagatctgaattatttcataaagtgaggaggggctggaaaggactctg

SEQ ID NO: 27447 - DNA, 75 bp, Artificial Sequence
  Synthetic
taggcagtgtaagcagatataatgattggaaaagaggtcactctacaagacattgtcttagagttgactgagcca

SEQ ID NO: 27448 - DNA, 75 bp, Artificial Sequence
  Synthetic
cagactgttgatttgcactgtgaagaggagttgccagagcaggatacggaggtggagcctgaaagaagagcttac

SEQ ID NO: 27449 - DNA, 75 bp, Artificial Sequence
  Synthetic
aaaataatactttgttgcggcggcggttgtggaacccggcttcgattatttgtagcagcaacacagtttggaata

SEQ ID NO: 27450 - DNA, 75 bp, Artificial Sequence
  Synthetic
cgtggcctgcaagacttactgctagaagaggtggtcattttgtgtcccgactgccgtaacagcgatctgcagcat

SEQ ID NO: 27451 - DNA, 75 bp, Artificial Sequence
  Synthetic
ggcggacaataaaggtagtgaaacagacgggttgcatgaatggtgcttattagaagctgactgtagtgatattga

SEQ ID NO: 27452 - DNA, 75 bp, Artificial Sequence
  Synthetic
aaatgatttggacacattgcttgagcaaaattcagattctgatgtatcagatcttataagtaatgatggggactt

SEQ ID NO: 27453 - DNA, 75 bp, Artificial Sequence
  Synthetic
ggaacagggaaactcccgagaactgtttcaacagcaggagttagaggagagcaatgctttgttgcaaagtctaaa

SEQ ID NO: 27454 - DNA, 75 bp, Artificial Sequence
  Synthetic
acgaaagtatattagtcctaaagctgtattacagctgagtccacaacttgaatccatttcgctgtcatcagacca

SEQ ID NO: 27455 - DNA, 75 bp, Artificial Sequence
  Synthetic
taaaactaagaggaaattgtttgctgagcaggacagtggagtagaattgacccttacaaatgaaactgaagatgt

SEQ ID NO: 27456 - DNA, 75 bp, Artificial Sequence
  Synthetic
tactacattggtgcagcaggaggaagaggtaccagctttagagacatcttccaccagtaacttaaggaaggaaga

SEQ ID NO: 27457 - DNA, 75 bp, Artificial Sequence
  Synthetic
taatgcacattataaagaacttatgcgatgcagtaacttaaaagctaccttactatcaaaatttaaaaatgcttt

SEQ ID NO: 27458 - DNA, 75 bp, Artificial Sequence
  Synthetic
tggtgtaagctttgttgaactgactcgccagttcagaagtaataagacttgttgtaatgattgggtggtagcaat

SEQ ID NO: 27459 - DNA, 75 bp, Artificial Sequence
  Synthetic
atatggtgtaaattatgatttatttgaaagttctaagcaattactacaacagcattgtgattatatttgggttac

SEQ ID NO: 27460 - DNA, 75 bp, Artificial Sequence
  Synthetic
agaaatgtctgcaatgtttttatatctgttgtgtttcaaggctggcaaaaatagacaaactgttataaggttatt

SEQ ID NO: 27461 - DNA, 75 bp, Artificial Sequence
  Synthetic
agtgtctatgttatatgtggcagaggagcaaattttatcagaacctccaaaattgcgaagtacagtgtcagcttt

SEQ ID NO: 27462 - DNA, 75 bp, Artificial Sequence
  Synthetic
attttggtataaaggtagctcaaatgctgctacctttacacatgggtcttatcctaaatggattatagaacaaac

SEQ ID NO: 27463 - DNA, 75 bp, Artificial Sequence
  Synthetic
actgataggacatcaaacaggagaagctgcaacgtttgacatgtccacaatggtacaatgggcttttgataatga

SEQ ID NO: 27464 - DNA, 75 bp, Artificial Sequence
  Synthetic
tctcacagaggaagctgacatagcttttcaatatgcaaagctggcacctgatgatgtaaatgcaactgcttggtt

SEQ ID NO: 27465 - DNA, 75 bp, Artificial Sequence
  Synthetic
ggctcacaataatcaggcgcgttttgtaagagaatgtgctaatatggttagatattataaaaaaggtcagatgcg

SEQ ID NO: 27466 - DNA, 75 bp, Artificial Sequence
  Synthetic
agaaatgtctatgtcggcatggatccactttaaattagagcaagtagaaggggaagggcagtggtcaactattgt

SEQ ID NO: 27467 - DNA, 75 bp, Artificial Sequence
  Synthetic
aaaatttattaggtatcagggtataaattttattagttttttaagtgctttaaaagattttttacatggtaaacc

SEQ ID NO: 27468 - DNA, 75 bp, Artificial Sequence
  Synthetic
taaaaagaattgtttattaatatatggccctccaaatactggaaaatcagcatttactatgtcattaattaaagt

SEQ ID NO: 27469 - DNA, 75 bp, Artificial Sequence
  Synthetic
gttgcatggcagagtaatatcatttgtaaattctaaaagtcacttttggttgcaaccaatgtctgaagccaaaat

SEQ ID NO: 27470 - DNA, 75 bp, Artificial Sequence
  Synthetic
agctttacttgatgatgctactgatccatgttggatatatatggatacatatttaagaaatggtcttgatggaca

SEQ ID NO: 27471 - DNA, 75 bp, Artificial Sequence
  Synthetic
cttagtttcattagattgtaagcataaagcacctatacaaatacgctttcctccattacttataacatctaatat

SEQ ID NO: 27472 - DNA, 75 bp, Artificial Sequence
  Synthetic
taatgcaatggcagaacctaactatagatatttacacagtaggttagtagcgtttgaatttcctaatccctttcc

SEQ ID NO: 27473 - DNA, 75 bp, Artificial Sequence
  Synthetic
tatgaaagatgacgatacccctgaatttgaacttactgaccaaagctggaaatctttttttaaaaggctttggag

SEQ ID NO: 27474 - DNA, 75 bp, Artificial Sequence
  Synthetic
acaattagacctcagtgaccaagaagacgagggagaggatggagaacctgaaaaagcgtttcgatgtgttgcaag

SEQ ID NO: 27475 - DNA, 75 bp, Artificial Sequence
  Synthetic
atctactaatgaacatttatgaacaaggcagtgatacactagaatcacaaattgaacattggcaggccttgcgaa

SEQ ID NO: 27476 - DNA, 75 bp, Artificial Sequence
  Synthetic
gagaggcagtgttactttattatgctagacaaaatggggtgctgcggctgggttacttaccagttccaccactag

SEQ ID NO: 27477 - DNA, 75 bp, Artificial Sequence
  Synthetic
ctacctcagaagccaaagctaaacaggctattagtatggtgttgcagctgcaatctttacaacaatctccttatg

SEQ ID NO: 27478 - DNA, 75 bp, Artificial Sequence
  Synthetic
gcacagaaaagtggacactggtggacacaagcatagaaacctttaaaaatactccagagaaccattttaaaaaag

SEQ ID NO: 27479 - DNA, 75 bp, Artificial Sequence
  Synthetic
gacctataaatgtggaggttatatatgatggtgatccggacaatgccaatttgtatactatgtggaaatatgtat

SEQ ID NO: 27480 - DNA, 75 bp, Artificial Sequence
  Synthetic
attatatggatgataatgaccagtggcaaaaaactgaaagtggcgccaatcatacaggcatatattatttaatag

SEQ ID NO: 27481 - DNA, 75 bp, Artificial Sequence
  Synthetic
gggagtttaaacattattatgtgctgtttgctgatgatgccaatagatacagtaaatctggccaatgggaggtca

SEQ ID NO: 27482 - DNA, 75 bp, Artificial Sequence
  Synthetic
ggattaataaggaaactgtgtttgcccctgtcaccagctccacaccacccgactccccaggagggtcccgagaac

SEQ ID NO: 27483 - DNA, 75 bp, Artificial Sequence
  Synthetic
tacccggatccaccgctaactccaaggcctcaagcccaacccaacagccacaacaagcctgtagtgacgaaacaa

SEQ ID NO: 27484 - DNA, 75 bp, Artificial Sequence
  Synthetic
ccaagcggaagaggtacgggcgaagggagtcaagccccactgactccagatgcagacgacgatcctcgtcccggc

SEQ ID NO: 27485 - DNA, 75 bp, Artificial Sequence
  Synthetic
aaaagaagcaagggcgacgagcacggtcccgcacccggtcgcgctgcagctccactcaaactcgatctagatcca

SEQ ID NO: 27486 - DNA, 75 bp, Artificial Sequence
  Synthetic
cctcaaggaggtccagatcaacctccaggggcaacaggaggtgtaggggagacacccccagagggcaacgaggag

SEQ ID NO: 27487 - DNA, 75 bp, Artificial Sequence
  Synthetic
tctcaacctcctccaggggaaggggaaggggcagtagaaggtcatcctcctcctcctcccccacccccagaacca

SEQ ID NO: 27488 - DNA, 75 bp, Artificial Sequence
  Synthetic
aagcctcacaacggggatgcgacacacggtctgttagggacagtggcatctctcctggggacgtgggaagaaagc

SEQ ID NO: 27489 - DNA, 75 bp, Artificial Sequence
  Synthetic
ttcagacagttagtggaagaaattcaggaagacttggacgattattggaggaggctctcgatcccccagtaattt

SEQ ID NO: 27490 - DNA, 75 bp, Artificial Sequence
  Synthetic
tacttcgtgggggtgctaacacattaaaatgttttcgcaacagggcaaagcttagatatagaggacattataaag

SEQ ID NO: 27491 - DNA, 75 bp, Artificial Sequence
  Synthetic
catttagcacatcttggtcatgggtagctgcagatggcacagagcgtctaggcaggtccagattgctcgtcagtt

SEQ ID NO: 27492 - DNA, 75 bp, Artificial Sequence
  Synthetic
ttaccagttttaagcagcgaagtgggtttctcgacctagtaagatttcctaagggtgtagattggtcactgggaa

SEQ ID NO: 27493 - DNA, 75 bp, Artificial Sequence
  Synthetic
gttttgataaactgtaagtactaacatagcttttgctactaacacacatataacctatttttactttttgtatgc

SEQ ID NO: 27494 - DNA, 75 bp, Artificial Sequence
  Synthetic
tttgcaatggtgcgtgctaaaagaacaaaacgagattctgctactaatatttacagaacatgcaagcaggcgggc

SEQ ID NO: 27495 - DNA, 75 bp, Artificial Sequence
  Synthetic
acatgtccacctgatgttattaataaagtggaacagtcaaccattgctgataatatacttaaatatggaagtgct

SEQ ID NO: 27496 - DNA, 75 bp, Artificial Sequence
  Synthetic
ggtgtcttttttggtggcctgggtattagtacaggccgagggactggaggcaccacaggatatgtgccattgggt

SEQ ID NO: 27497 - DNA, 75 bp, Artificial Sequence
  Synthetic
gaaggtactggagttcgtgtgggcagtacacccacagtcgttcggcctgcccttgtgcctgaagtaataggtcct

SEQ ID NO: 27498 - DNA, 75 bp, Artificial Sequence
  Synthetic
gctgacttattacctgttgatacaatagcccctgttgacccagcatcgtcatctatagttcctcttactgaatca

SEQ ID NO: 27499 - DNA, 75 bp, Artificial Sequence
  Synthetic
tcaggtgtagaccttttacctggtgaaatagaaacaatagcagaagtacatcctatacctgatgtgcccacattt

SEQ ID NO: 27500 - DNA, 75 bp, Artificial Sequence
  Synthetic
gatactccagtagtgacaacaagcaaaggctctagtgccattttagaagtagctcctgagcctactccaccgaca

SEQ ID NO: 27501 - DNA, 75 bp, Artificial Sequence
  Synthetic
cgtgttcgtgtcagcagaacacaataccataatccagcatttcatattattacagaatctacaccaagtcaaggt

SEQ ID NO: 27502 - DNA, 75 bp, Artificial Sequence
  Synthetic
gagagttcattgtcagacgaaataattgtcgcctctggtgcaggtggacaatcagtaggcgtttctgaaaatata

SEQ ID NO: 27503 - DNA, 75 bp, Artificial Sequence
  Synthetic
gaactgcaggatttatcaaatagatattcttttgaaatagaaacaccaacaccaccaaggcgtagcagtacccca

SEQ ID NO: 27504 - DNA, 75 bp, Artificial Sequence
  Synthetic
ttacaaagagctacacaagcatttagacaaagatcacttacaaataggagactgttacaacaagtgcctgttgaa

SEQ ID NO: 27505 - DNA, 75 bp, Artificial Sequence
  Synthetic
gaccctttgtttttaactcaaccatctaaattggttagatttgcatttgagaatccagcttttgaagaggaagta

SEQ ID NO: 27506 - DNA, 75 bp, Artificial Sequence
  Synthetic
acacaggtatttgaacaagaccttgcaggttttgtagagcctcctaacagagattttttagatattgcagaactg

SEQ ID NO: 27507 - DNA, 75 bp, Artificial Sequence
  Synthetic
ggaaggcctagattttctgaaacacgcgagggttatgttaggttaagcagattgggtcgtagagcaactattaga

SEQ ID NO: 27508 - DNA, 75 bp, Artificial Sequence
  Synthetic
acaagggcaggaacacaaataggagcacaagtacatttttataaagatctaagttctattaatactgaagctcct

SEQ ID NO: 27509 - DNA, 75 bp, Artificial Sequence
  Synthetic
attgagttggatcttttagggcagcattctggggatgcaactatagttcatgggactgtagaaagcacatttata

SEQ ID NO: 27510 - DNA, 75 bp, Artificial Sequence
  Synthetic
gatactaatatagaggaaaatcctttagctgaacaaatggagttggaaattgatacttatcctgaagctcattca

SEQ ID NO: 27511 - DNA, 75 bp, Artificial Sequence
  Synthetic
tttgatgctttgttagatgaagcaacagacgattttagtggttcacagttagttataggcaatagaagatccact

SEQ ID NO: 27512 - DNA, 75 bp, Artificial Sequence
  Synthetic
acatcatatactgttcctagatttgaatccccaagaaattcttcttattatgtacaggatttgcagggatattat

SEQ ID NO: 27513 - DNA, 75 bp, Artificial Sequence
  Synthetic
gtagcctatcctgaatctcgcgataaaatagaacttatttatccctcacccacattacctgcagttgtcatacat

SEQ ID NO: 27514 - DNA, 75 bp, Artificial Sequence
  Synthetic
acagaagatagtagtggggacttttatttacatcctagtttattgcaaaggcgcagacgcaaacgaaaatatttg

SEQ ID NO: 27515 - DNA, 75 bp, Artificial Sequence
  Synthetic
tgatttttacagatgtcggtgtggttgccagccagtggtaaggtatatttgccaccatcaacacctgttgcgaaa

SEQ ID NO: 27516 - DNA, 75 bp, Artificial Sequence
  Synthetic
gttcaaagcacggatgaatacatacagagaacaaacatcttctatcatgcttatagtgaccgcctattaactgta

SEQ ID NO: 27517 - DNA, 75 bp, Artificial Sequence
  Synthetic
ggacacccatatttcaatgtttacaacaatgatggcacagtattagaggtccctaaggtttcaggaaatcaacac

SEQ ID NO: 27518 - DNA, 75 bp, Artificial Sequence
  Synthetic
agagtttttaggcttaaattaccagaccctaatagatttgctttagcagatatgtccgtatataatccagagaag

SEQ ID NO: 27519 - DNA, 75 bp, Artificial Sequence
  Synthetic
gaaagattggtatggggttgcagaggagtagaaataggtagaggacaaccattaggtgttgggacaagtggacat

SEQ ID NO: 27520 - DNA, 75 bp, Artificial Sequence
  Synthetic
ccattatttaacaaagtgaatgacacagaaaaccctgtatcatataggacacaagcatcgtccacagatgataga

SEQ ID NO: 27521 - DNA, 75 bp, Artificial Sequence
  Synthetic
caaaatacctcatttgatcctaaacaaattcaaatgtttattataggttgtgcaccctgcataggagaacattgg

SEQ ID NO: 27522 - DNA, 75 bp, Artificial Sequence
  Synthetic
gaagtagctgagaggtgtgctggtgataataatgatgctggtagatgtccacctattaagttagtaaattcagta

SEQ ID NO: 27523 - DNA, 75 bp, Artificial Sequence
  Synthetic
attcaagatggtgatatggcagatattggttatgggaatttaaattttagaacactacaacaaagtagatcagac

SEQ ID NO: 27524 - DNA, 75 bp, Artificial Sequence
  Synthetic
gtaagtttggatattgtaaatgaaacctgtaaatatccagactttttaaaaatgcaaaatgatgtttatggagat

SEQ ID NO: 27525 - DNA, 75 bp, Artificial Sequence
  Synthetic
tcttgttttttctttgctcgccgtgagcaatgttatgcaagacatttttttgtacgaggaggtaaaccaggggat

SEQ ID NO: 27526 - DNA, 75 bp, Artificial Sequence
  Synthetic
gacatacctggtgagcaaattgatgcagggacctacaaaaatgacttttacattccagcagccacaggtcagaca

SEQ ID NO: 27527 - DNA, 75 bp, Artificial Sequence
  Synthetic
caaaaaaatattggcaactcaatgtatttcccaacagtcagtggctcattggtatctagtgatgctcaattattt

SEQ ID NO: 27528 - DNA, 75 bp, Artificial Sequence
  Synthetic
aatagaccattttggttacagcgtgcacaaggtcataataatggaatttgttgggctaatcaattgttcattacg

SEQ ID NO: 27529 - DNA, 75 bp, Artificial Sequence
  Synthetic
gtagtagataacaccaggaacaccaattttagtataagtgtatacactgaaaatggcaaagtaacagatattaac

SEQ ID NO: 27530 - DNA, 75 bp, Artificial Sequence
  Synthetic
gagtatgatgctaataaatttagggaatatcagagacatgtagaagagtatgaaatttcacttatactgcagcta

SEQ ID NO: 27531 - DNA, 75 bp, Artificial Sequence
  Synthetic
tgtaaaatccctttaaaagcagatgtgttagcacagatcaatgctatgaatccatctctattggaagagtggcag

SEQ ID NO: 27532 - DNA, 75 bp, Artificial Sequence
  Synthetic
ttaggatttgtgcctgcaccagacaatcctcttcaaagtacctacagatatatagaaagtttggcaacaccttgt

SEQ ID NO: 27533 - DNA, 75 bp, Artificial Sequence
  Synthetic
ccagataaagtagctccaaaagaaagagaagatccttatgccccttatacgttttggaatgtagatttatctgaa

SEQ ID NO: 27534 - DNA, 75 bp, Artificial Sequence
  Synthetic
cgcttatctttggaactggatcaatattccttaggacgaaagttcctgtttcaagcgggtcttgtacaaaaaaca

SEQ ID NO: 27535 - DNA, 75 bp, Artificial Sequence
  Synthetic
tctaaaaaaacatctaatgtatccaaggggaccaaacgaaaacgcacgtaaaataaaggctgtttaccgttttcg

SEQ ID NO: 27536 - DNA, 75 bp, Artificial Sequence
  Synthetic
gtacaatatatgtgtattccaagaatgcttgttattcatgtgcgtgactaatttgaactttggcttgaatgtcaa

SEQ ID NO: 27537 - DNA, 75 bp, Artificial Sequence
  Synthetic
ccgcacccggtacaagtagataaaatcttgctaccacagcagacacaaaggaatcactgtcggtctcaacacgct

SEQ ID NO: 27538 - DNA, 75 bp, Artificial Sequence
  Synthetic
ttgctaccacagcagacacaaaggaatcactgtcggtctcaacacgctcggatttggcgcattcaaccgtttttg

SEQ ID NO: 27539 - DNA, 75 bp, Artificial Sequence
  Synthetic
catctttggcagacgaagtgcaccgataacggtaagacttttcttttttaaccgtaggcgttggtttattatgcc

SEQ ID NO: 27540 - DNA, 75 bp, Artificial Sequence
  Synthetic
tggcaacaatggtggttaacaactatcacacgtaatcggtacaagcaaccgcttgtggtagtaaaatgaattaaa

SEQ ID NO: 27541 - DNA, 75 bp, Artificial Sequence
  Synthetic
gcttgtggtagtaaaatgaattaaaaaaaatagaagagatatatttaaggggcctgtacgcctgggatttattca

SEQ ID NO: 27542 - DNA, 75 bp, Artificial Sequence
  Synthetic
tggaactaccaaaacctcaaactgtgcagcagctcagtgataagttaacagttcctgtagaggatctgttattac

SEQ ID NO: 27543 - DNA, 75 bp, Artificial Sequence
  Synthetic
cctgtagattctgcaacagttttctcacgtatattgaattacgtgagtttgattacaaaagcttacaattaatct

SEQ ID NO: 27544 - DNA, 75 bp, Artificial Sequence
  Synthetic
ggactcaagaggattttgtttttgcatgttgtagcagttgtgcttatgcttctgctcaatatgaatgtcagcagt

SEQ ID NO: 27545 - DNA, 75 bp, Artificial Sequence
  Synthetic
acaataggccttattgttataaggtgtcagtattgtttaaagtgtctcgatttgatagaaaaattagatatctgt

SEQ ID NO: 27546 - DNA, 75 bp, Artificial Sequence
  Synthetic
tgctctcatcaagcatttcacaaggttagaggcaattggaaaggaaggtgcaggcattgcaaagcactagaatga

SEQ ID NO: 27547 - DNA, 75 bp, Artificial Sequence
  Synthetic
ttagaggcaattggaaaggaaggtgcaggcattgcaaagcactagaatgattgggaaacaagctactcttcgtga

SEQ ID NO: 27548 - DNA, 75 bp, Artificial Sequence
  Synthetic
tatagttcttgaagagcttgtccagcccattgacctgcattgccacgaggagttgcctgatcttccagaggatat

SEQ ID NO: 27549 - DNA, 75 bp, Artificial Sequence
  Synthetic
tgaagcatcagtggtagaggaggagccagcatacaccccatacaaaatcatagttctttgtgggggttgtgaagt

SEQ ID NO: 27550 - DNA, 75 bp, Artificial Sequence
  Synthetic
ccagcatacaccccatacaaaatcatagttctttgtgggggttgtgaagtaaggctaaaactatacgtgtgggcc

SEQ ID NO: 27551 - DNA, 75 bp, Artificial Sequence
  Synthetic
tagttctttgtgggggttgtgaagtaaggctaaaactatacgtgtgggccaccgacactgggattcggaatctac

SEQ ID NO: 27552 - DNA, 75 bp, Artificial Sequence
  Synthetic
aagattgtttgctgggcgacgtaaggcttctgtgtcccacctgtcgagaagacattcgcaatggcggacgataaa

SEQ ID NO: 27553 - DNA, 75 bp, Artificial Sequence
  Synthetic
ggtactgatcctaaagaaggctgtagtgattttatatatttagaagctgaatgctctgacattagtgacttagat

SEQ ID NO: 27554 - DNA, 75 bp, Artificial Sequence
  Synthetic
atgctctgacattagtgacttagataatgatttggaaacattattggaagaaggtgcgggatccgatatttctga

SEQ ID NO: 27555 - DNA, 75 bp, Artificial Sequence
  Synthetic
cttaataaatgatgaggttgttgagcagggaaattcccgcgaattattatgtcaacaagagagagaggagagcga

SEQ ID NO: 27556 - DNA, 75 bp, Artificial Sequence
  Synthetic
actgcaggttcaatatctaaaacgaaagtgtttcagtccaaaagctgttcaggagcttagtcctcgtctgcagtc

SEQ ID NO: 27557 - DNA, 75 bp, Artificial Sequence
  Synthetic
aagtgtttcagtccaaaagctgttcaggagcttagtcctcgtctgcagtctatgaatttatcttcagagcataaa

SEQ ID NO: 27558 - DNA, 75 bp, Artificial Sequence
  Synthetic
tctaaaaggagattatttgtgcagcaagacagtggactggagctatctctaaatgaagctgaagattctactcaa

SEQ ID NO: 27559 - DNA, 75 bp, Artificial Sequence
  Synthetic
gagttggaggtaccggcgagcgctccagcgccggcagcagagggtgatatagggctgggtactgtaagagatctt

SEQ ID NO: 27560 - DNA, 75 bp, Artificial Sequence
  Synthetic
ttaaggagcagtaacagcagagcaacactgttaagcaaatttaaagactcgtttggggtcagctttacagaacta

SEQ ID NO: 27561 - DNA, 75 bp, Artificial Sequence
  Synthetic
acaagacaatataaaagcaataaaacgtgttgccaccattgggtcttggcagtgtatgctgctaaggatgacttg

SEQ ID NO: 27562 - DNA, 75 bp, Artificial Sequence
  Synthetic
atagatgcgtccaaacaattgttacagcagcattgtttttatatatggcttcaatccttttgtcccatgtcactt

SEQ ID NO: 27563 - DNA, 75 bp, Artificial Sequence
  Synthetic
tatttatgttgctttaatgttggtaaaagtagagacactgttgtaagactaatagctacattattacaggtgcat

SEQ ID NO: 27564 - DNA, 75 bp, Artificial Sequence
  Synthetic
gttattttggtataagggaagtttaaatactaatgtgttctgttttggtgaagctcctgattggattgtctcaca

SEQ ID NO: 27565 - DNA, 75 bp, Artificial Sequence
  Synthetic
tgactatatggacgaaagcactatagcttatcaatatgctaaactagcagatattgataataatgctaaagcttt

SEQ ID NO: 27566 - DNA, 75 bp, Artificial Sequence
  Synthetic
tttagctcataatagccaagttaaatatgttaaagagtgtgctttaatggtaagatattataaaagaggagagat

SEQ ID NO: 27567 - DNA, 75 bp, Artificial Sequence
  Synthetic
gaaagaaatgtctatttctgcttggattcatcactgtatatctaaggttgaaggagaaggcaattggcagcatat

SEQ ID NO: 27568 - DNA, 75 bp, Artificial Sequence
  Synthetic
tgttaaatttattagataccaaaatttgaattttattatgtttctagacaagtttcgaaccttcttacaaaattt

SEQ ID NO: 27569 - DNA, 75 bp, Artificial Sequence
  Synthetic
ttgaattttattatgtttctagacaagtttcgaaccttcttacaaaatttaccaaaaaaaaattgtttattaata

SEQ ID NO: 27570 - DNA, 75 bp, Artificial Sequence
  Synthetic
tatggtcctcctgacacaggaaagtctatgtttgcaatgtctcttattaaagtattgaaaggtagtgtagtatct

SEQ ID NO: 27571 - DNA, 75 bp, Artificial Sequence
  Synthetic
ctatgtttgcaatgtctcttattaaagtattgaaaggtagtgtagtatcttttgctaattctaaaagtcaatttt

SEQ ID NO: 27572 - DNA, 75 bp, Artificial Sequence
  Synthetic
agtattgaaaggtagtgtagtatcttttgctaattctaaaagtcaattttggttacagccactagccgatgggaa

SEQ ID NO: 27573 - DNA, 75 bp, Artificial Sequence
  Synthetic
aattggtttattggatgatgcaacagatgtgtgttggcagtatattgattcttttcttaggaatggtttagatgg

SEQ ID NO: 27574 - DNA, 75 bp, Artificial Sequence
  Synthetic
taatttagtgtcgttagatatgaaacataaagcaccttgtcaaatgaaatttcctccattaattattacttccaa

SEQ ID NO: 27575 - DNA, 75 bp, Artificial Sequence
  Synthetic
tattaatttattaaaggaggaaagatacagatatttacacagtagagtaacacaaattgattttccaaataagtt

SEQ ID NO: 27576 - DNA, 75 bp, Artificial Sequence
  Synthetic
tacagatatttacacagtagagtaacacaaattgattttccaaataagtttccctttgactcagataataagcct

SEQ ID NO: 27577 - DNA, 75 bp, Artificial Sequence
  Synthetic
cacaaattgattttccaaataagtttccctttgactcagataataagcctgtgtttgaacttactgatcaaagct

SEQ ID NO: 27578 - DNA, 75 bp, Artificial Sequence
  Synthetic
gggcatctttctttaaaaggctgtggagacaattagagctcagtgatcaagaagacgagggagacaatggaaact

SEQ ID NO: 27579 - DNA, 75 bp, Artificial Sequence
  Synthetic
ctcagcgcacgtttcactgtactgcaagagaagttaatggacatatatgaatcaggtgtagaggacctggataca

SEQ ID NO: 27580 - DNA, 75 bp, Artificial Sequence
  Synthetic
caaattcagcattggcagcttttaagacaagagcaaattatttatcactatgcaaggagacatggtgttactcga

SEQ ID NO: 27581 - DNA, 75 bp, Artificial Sequence
  Synthetic
ttgggctatcaaccggtgccttctttggcaagttcagaagccaaagcaaaggatgctatttctatggtgctttta

SEQ ID NO: 27582 - DNA, 75 bp, Artificial Sequence
  Synthetic
cttgaaagcctgaacaaatccaattatgcagatgaacaatggactttaggtcaaactagtttggaggctgttcgc

SEQ ID NO: 27583 - DNA, 75 bp, Artificial Sequence
  Synthetic
aaggacctaaaaatattgaagttatatttgatggtgaccctgaaaatcttatgtcatatactgtgtggacatata

SEQ ID NO: 27584 - DNA, 75 bp, Artificial Sequence
  Synthetic
atttgatggtgaccctgaaaatcttatgtcatatactgtgtggacatatatatactacatgacagatgaggatac

SEQ ID NO: 27585 - DNA, 75 bp, Artificial Sequence
  Synthetic
atgggaaaaagtggaaggccatgtggattatacaggagcctattattatgagggcaatttaaaggtgtattattt

SEQ ID NO: 27586 - DNA, 75 bp, Artificial Sequence
  Synthetic
gattatacaggagcctattattatgagggcaatttaaaggtgtattatttaaaatttgaaaatgatgctaagcga

SEQ ID NO: 27587 - DNA, 75 bp, Artificial Sequence
  Synthetic
tacgtgttaataaagacactgtgtttacccccgttaccagttctacgccgccagttggagactccaccgactccg

SEQ ID NO: 27588 - DNA, 75 bp, Artificial Sequence
  Synthetic
ttccacctccgtgtcccccgaacggccacgatcccaaacagcacggcgatacggaagaaaagcatctagcccttc

SEQ ID NO: 27589 - DNA, 75 bp, Artificial Sequence
  Synthetic
aaccacctcccgcaggcaaaggaaaggacaaagagaaaccacacgcacccaaaggagaagaaaaagcagatcaag

SEQ ID NO: 27590 - DNA, 75 bp, Artificial Sequence
  Synthetic
aaaggagaagaaaaagcagatcaaggtcccgaagcaccaacaggggagggagggacacccggcgatcctcctcca

SEQ ID NO: 27591 - DNA, 75 bp, Artificial Sequence
  Synthetic
gaggatcctcagtctcccccatcaggggaaggagaaggggaggaggggacagcagaaggcgggggccggtcaccc

SEQ ID NO: 27592 - DNA, 75 bp, Artificial Sequence
  Synthetic
agcagaaggcgggggccggtcacccgctcgagatcaagatccctctcgcgagcctcttctgcagggggtggcata

SEQ ID NO: 27593 - DNA, 75 bp, Artificial Sequence
  Synthetic
gctcgagatcaagatccctctcgcgagcctcttctgcagggggtggcataccgcctgacaaagtgggaacggcag

SEQ ID NO: 27594 - DNA, 75 bp, Artificial Sequence
  Synthetic
ttcgatcagttggtagatcaagtggtggaagacttacgcggctactggcagacgctgcagaccccccagtaatat

SEQ ID NO: 27595 - DNA, 75 bp, Artificial Sequence
  Synthetic
tgttacgtggagatgctaataccctaaaatgctatcgctatcgatttagaaggaaacatgctggtggctttcgct

SEQ ID NO: 27596 - DNA, 75 bp, Artificial Sequence
  Synthetic
ttgttagcacaacatggtcatggataggagatgcatcaaatgatcgcatagggcgctcacgaatgcttttagctt

SEQ ID NO: 27597 - DNA, 75 bp, Artificial Sequence
  Synthetic
tttattcagaatcacaaagggaaaagttcatacacactatgaaattacctacaggtgtagagtggtcattaggac

SEQ ID NO: 27598 - DNA, 75 bp, Artificial Sequence
  Synthetic
acaggtgtagagtggtcattaggacaatttgatgatttatagaacagtgtctaagtaatattttttatatgtcat

SEQ ID NO: 27599 - DNA, 75 bp, Artificial Sequence
  Synthetic
gtaaccttttttactaacaatactgctttgctactaacactatggttcgagcacgtagaaccaaacgtgcatctg

SEQ ID NO: 27600 - DNA, 75 bp, Artificial Sequence
  Synthetic
gcacgtagaaccaaacgtgcatctgttactgatatatacaggggttgcaaggcgtctaatacttgccctcctgat

SEQ ID NO: 27601 - DNA, 75 bp, Artificial Sequence
  Synthetic
gtaatcaataaagtggaacaatcaacaatagcagataagattttaaagtatggtagtgctgctgtcttttttggt

SEQ ID NO: 27602 - DNA, 75 bp, Artificial Sequence
  Synthetic
caatagcagataagattttaaagtatggtagtgctgctgtcttttttggtgggctgggtataggcactggtcgtg

SEQ ID NO: 27603 - DNA, 75 bp, Artificial Sequence
  Synthetic
gtacaggcggtgctacaggctatgtgcctctggggcaaggacctggagtgcgagtgggtggcgcccccacagtgg

SEQ ID NO: 27604 - DNA, 75 bp, Artificial Sequence
  Synthetic
tccgccccggggtgatacctgaagtaattggaccaactgaactgatacctattgactcagtcacaccaattgacc

SEQ ID NO: 27605 - DNA, 75 bp, Artificial Sequence
  Synthetic
ctacagcaccttccattgtgtcattaactgacagtagtgctgttgaccttttacctggagaggttgaaactattg

SEQ ID NO: 27606 - DNA, 75 bp, Artificial Sequence
  Synthetic
gtgagtggaggccgcaataccaatgctatattggaagtggctgaccctcatccacctactagagctactgttagc

SEQ ID NO: 27607 - DNA, 75 bp, Artificial Sequence
  Synthetic
aggactcaatataataatcctgcttttcaaataatttctgaaatgattcctacctctggagagtcttctcttgga

SEQ ID NO: 27608 - DNA, 75 bp, Artificial Sequence
  Synthetic
gatcacgtggtagtgtctgaagggtctggtggccagcagataggaggtaccagaccaacagaagaaattgagtta

SEQ ID NO: 27609 - DNA, 75 bp, Artificial Sequence
  Synthetic
ctggtggccagcagataggaggtaccagaccaacagaagaaattgagttacagcctttattatctagatatagtt

SEQ ID NO: 27610 - DNA, 75 bp, Artificial Sequence
  Synthetic
ttgaaattgaggagccaacaccaccgcgaagaactagcacccctttacaaagagcaagacaacagttttcatcat

SEQ ID NO: 27611 - DNA, 75 bp, Artificial Sequence
  Synthetic
agagcaagacaacagttttcatcattacgcagagcattatataatagaaggctaactgagcaagtgggtgttact

SEQ ID NO: 27612 - DNA, 75 bp, Artificial Sequence
  Synthetic
gaccctttatttttcacatctccttccaaattggtgcgtttccaatttgacaatcctgcatttgatgaacaagta

SEQ ID NO: 27613 - DNA, 75 bp, Artificial Sequence
  Synthetic
acacagatatttgagcaagacatagcagactttgaggagccacccgatagacagtttttggatgtagttaaatta

SEQ ID NO: 27614 - DNA, 75 bp, Artificial Sequence
  Synthetic
ggtaggccaacattatctgagtctgcagaaggctatgttagagtgagtcgcttgggaagacggggaacgatacga

SEQ ID NO: 27615 - DNA, 75 bp, Artificial Sequence
  Synthetic
acacgcagtggtgcacaagtagggtcacaggtacatttttatagagatttaagtacaataaacacagaggaacct

SEQ ID NO: 27616 - DNA, 75 bp, Artificial Sequence
  Synthetic
ttagaaatgcagttactgggtgagcattccggtgatgcttcaatagtacaaggttctgtagaaagcactttagtg

SEQ ID NO: 27617 - DNA, 75 bp, Artificial Sequence
  Synthetic
gatgtaaatatgactgaggtccctgaaggtgttcttacagaaactcctaatccagatacttttaattcagaggat

SEQ ID NO: 27618 - DNA, 75 bp, Artificial Sequence
  Synthetic
ttgttactggatgatactatagaagacttcagcggatctcagttagttgtaggaaatccacgaagatctactatg

SEQ ID NO: 27619 - DNA, 75 bp, Artificial Sequence
  Synthetic
tcaatcactgtacctagatttcagactcctcaaaatcctactatttattatcaagatatacaggggtatcacgtt

SEQ ID NO: 27620 - DNA, 75 bp, Artificial Sequence
  Synthetic
ctcctcaaaatcctactatttattatcaagatatacaggggtatcacgtttcatatcccgaaagtagagaaagac

SEQ ID NO: 27621 - DNA, 75 bp, Artificial Sequence
  Synthetic
tattcctacagtggttatacatgttgctgattcctctggagatttttatttacatcccagtttacgatggcgacg

SEQ ID NO: 27622 - DNA, 75 bp, Artificial Sequence
  Synthetic
gcgcaaacgcaaatatttataatgtttttcagatgacactttggcttcctgcatctggtaaaatatacttgccac

SEQ ID NO: 27623 - DNA, 75 bp, Artificial Sequence
  Synthetic
caacacctccagttgcgcgcgttcaaagcacggatgaatatgtggaacgaacagacatctattaccatgcaacta

SEQ ID NO: 27624 - DNA, 75 bp, Artificial Sequence
  Synthetic
aagcacggatgaatatgtggaacgaacagacatctattaccatgcaactagcgatcgcctattaacagtaggcca

SEQ ID NO: 27625 - DNA, 75 bp, Artificial Sequence
  Synthetic
tccatattttgatgtcagatcacaggacggtcaaaaaattgaagttcctaaggtgtcaggaaatcaatataggtc

SEQ ID NO: 27626 - DNA, 75 bp, Artificial Sequence
  Synthetic
atttcgggtaacctttccagatcccaataagtttgctttggcagacatgtctgtttatgatccagataaatatag

SEQ ID NO: 27627 - DNA, 75 bp, Artificial Sequence
  Synthetic
gagttggaactacaggtcatcccttatttaataaagtaagagatactgaaaactccagtaattatcaaggaacct

SEQ ID NO: 27628 - DNA, 75 bp, Artificial Sequence
  Synthetic
ctactgatgatagacaaaatacctcttttgaccctaaacaggtgcaaatgtttataataggttgcaccccttgtc

SEQ ID NO: 27629 - DNA, 75 bp, Artificial Sequence
  Synthetic
tgggagaatactgggataaagcacctgtatgtgataatgcaggggatcagacaggtctatgtcctccactagaat

SEQ ID NO: 27630 - DNA, 75 bp, Artificial Sequence
  Synthetic
tgtatgtgataatgcaggggatcagacaggtctatgtcctccactagaattgaaaaatagtgttattgaagatgg

SEQ ID NO: 27631 - DNA, 75 bp, Artificial Sequence
  Synthetic
agacatgtttgatataggatttggcaatataaacaacaaaacactatcctttaatagatctgatgtaagtttgga

SEQ ID NO: 27632 - DNA, 75 bp, Artificial Sequence
  Synthetic
cattgttaatgaaacctgcaaatatccagatttccttaccatgtctaatgatgtttatggggattcctgcttctt

SEQ ID NO: 27633 - DNA, 75 bp, Artificial Sequence
  Synthetic
atgtttatggggattcctgcttcttttttgtgcgaagggagcaatgttatgctaggcattattttgttcgaggtg

SEQ ID NO: 27634 - DNA, 75 bp, Artificial Sequence
  Synthetic
gtgcagtgggcgacgctattccagatggtactgtcaatcaaaatcataattattatctacctgcaaaaactggac

SEQ ID NO: 27635 - DNA, 75 bp, Artificial Sequence
  Synthetic
agggtcaacgcactttagggaactctacgtattttccaacagtaagtggatccttggtgacgtccgatgctcagt

SEQ ID NO: 27636 - DNA, 75 bp, Artificial Sequence
  Synthetic
tatttaatagaccattttggttacaaagagcacaaggccacaacaatggtattttatggggtaatcaaatgtttg

SEQ ID NO: 27637 - DNA, 75 bp, Artificial Sequence
  Synthetic
attttatggggtaatcaaatgtttgttacagtcgctgataatactcgtaatacaaactttacaatcagtgtatct

SEQ ID NO: 27638 - DNA, 75 bp, Artificial Sequence
  Synthetic
actgacaacgggggtgctcaagaatatgattctgcaaatattagagaatatttaagacatgttgaggaataccaa

SEQ ID NO: 27639 - DNA, 75 bp, Artificial Sequence
  Synthetic
ttgtcttttatattgcaattgtgtaaggttcctttaaatgctgaagtgctgacacagattaatgctatgaattct

SEQ ID NO: 27640 - DNA, 75 bp, Artificial Sequence
  Synthetic
aggttcctttaaatgctgaagtgctgacacagattaatgctatgaattctggcatattagaaaactggcaattag

SEQ ID NO: 27641 - DNA, 75 bp, Artificial Sequence
  Synthetic
gctttgtacctaccccagacaattctgtacacgacacatatcgttacataacatccaaagcaactaaatgtccag

SEQ ID NO: 27642 - DNA, 75 bp, Artificial Sequence
  Synthetic
tgtacacgacacatatcgttacataacatccaaagcaactaaatgtccagacgcagtgcctgaaacagaaaaaga

SEQ ID NO: 27643 - DNA, 75 bp, Artificial Sequence
  Synthetic
tggaatgtggacatgactgaaaaattgtctctagatttggatcaatatcctttagggcgcaaatttttattccaa

SEQ ID NO: 27644 - DNA, 75 bp, Artificial Sequence
  Synthetic
tgtctctagatttggatcaatatcctttagggcgcaaatttttattccaagcaggtttacaaactgcaagaacac

SEQ ID NO: 27645 - DNA, 75 bp, Artificial Sequence
  Synthetic
gtgctgtcaaacgaccgttagtaagaaaatcttccaaatctgtaaaacgcaaaaggacccagtaaccgttttcgg

SEQ ID NO: 27646 - DNA, 75 bp, Artificial Sequence
  Synthetic
tcgcccaataaaatttattaactaatgtggtatgtgaagcattttttgaccttctttgtgactaaaccgaacaag

SEQ ID NO: 27647 - DNA, 75 bp, Artificial Sequence
  Synthetic
cttctttgtgactaaaccgaacaagtcaacaccagcaaccgcgcccggttaatcagattataaattcctgaaggg

SEQ ID NO: 27648 - DNA, 75 bp, Artificial Sequence
  Synthetic
gggcagatttcaatcagtgcagataccatctagcacctgcagcaaccgccaaaactttgccaagacttggcagaa

SEQ ID NO: 27649 - DNA, 75 bp, Artificial Sequence
  Synthetic
ccgccaaagctttgcagtcttggcaagacatcttttggcacctttactgcaccgataacggtaagacttttattt

SEQ ID NO: 27650 - DNA, 75 bp, Artificial Sequence
  Synthetic
tctgaccgtaggcgttcatttgttattcatagtaacgattgtggttcacaacaatcatcagccaaaaatacatgc

SEQ ID NO: 27651 - DNA, 75 bp, Artificial Sequence
  Synthetic
aaccgcttgtggtaatttatgcttcaggaactacattatgtatttaagaaggatgtgctgtgctaaggtattcat

SEQ ID NO: 27652 - DNA, 75 bp, Artificial Sequence
  Synthetic
ggagccacgaccactgaccgtacaacatctcagtgataaactcactgtaccaatagaagatttattagtgccttg

SEQ ID NO: 27653 - DNA, 75 bp, Artificial Sequence
  Synthetic
cagattttgcaaccggtttctaacctatttagagttgagacaatttgactataaatttcttcacttaatttggac

SEQ ID NO: 27654 - DNA, 75 bp, Artificial Sequence
  Synthetic
tgaagaagattttgtatttgcttgctgtggtggttgtgcatttgcatctgcacaatttgagtatcaacaatatta

SEQ ID NO: 27655 - DNA, 75 bp, Artificial Sequence
  Synthetic
ccaaggaactgtttatggtagagatatagagcagttggagcaaaaacctataggtgaaattcctattcgctgcca

SEQ ID NO: 27656 - DNA, 75 bp, Artificial Sequence
  Synthetic
atactgcttaaagtttcttgatttgacagaaaaattggatatctgttgcttaaatcaggcatttcacaaggttag

SEQ ID NO: 27657 - DNA, 75 bp, Artificial Sequence
  Synthetic
aaaccattggaagggaaggtgcaggcattgtaaggcaatagaatgattgggaaacaagctaccctttgtgatata

SEQ ID NO: 27658 - DNA, 75 bp, Artificial Sequence
  Synthetic
gttcttgaagagcttgtcctgcccattgacctgcattgcaacgaagagctgcctgaccttccagaagaagtacaa

SEQ ID NO: 27659 - DNA, 75 bp, Artificial Sequence
  Synthetic
gaatcagtggtagaggaggagcctgtgtatactccttacaagattgtagtgttttgtgggggttgtgatgcaaaa

SEQ ID NO: 27660 - DNA, 75 bp, Artificial Sequence
  Synthetic
ctgaagctttatgtactagccaccgatacatccattcgagattttcaaagtttgctcctgggagaactgaagctt

SEQ ID NO: 27661 - DNA, 75 bp, Artificial Sequence
  Synthetic
gtgtgtcctagctgccgagaggagattcgcaatggcggacgataaaggtactgatgctaaagaaggctgtagtga

SEQ ID NO: 27662 - DNA, 75 bp, Artificial Sequence
  Synthetic
atggtttatattagaagctgcgtgttcagatgatagtgacttagatgatagtttggaaaaattatttgaagaagg

SEQ ID NO: 27663 - DNA, 75 bp, Artificial Sequence
  Synthetic
tgcagacacagatgtgtctgatttaataaatgatgaggaggatgctgctcagggaaattcccgcgaattgctatg

SEQ ID NO: 27664 - DNA, 75 bp, Artificial Sequence
  Synthetic
tcaacaggagagtgaggaatgtgagcagcaaatacagtacctaaaacgaaagtatttcagtccgaaagctgttga

SEQ ID NO: 27665 - DNA, 75 bp, Artificial Sequence
  Synthetic
gcagcttagtccacgtttgcagtctatcaatctgtcgcctgggcataagtctaaaaggaggttatttgtggagca

SEQ ID NO: 27666 - DNA, 75 bp, Artificial Sequence
  Synthetic
agacagcggactggagttatccctaaatgaagttgaagattttactcaagaggtggaggtaccggcgagcgctcc

SEQ ID NO: 27667 - DNA, 75 bp, Artificial Sequence
  Synthetic
agcgccggcatcccagggtggtgtagaaccgggacattataaagacttgttaagatgcaataatgttaaagcagt

SEQ ID NO: 27668 - DNA, 75 bp, Artificial Sequence
  Synthetic
tttgttaagtaaatttaaagcagcgtatggggttagctatacggaactaacacggcagtttaaaagtaacaaaac

SEQ ID NO: 27669 - DNA, 75 bp, Artificial Sequence
  Synthetic
atgctgtaagcattgggttgtgactgtttatgctgctaaagatgacctcatagacgcgtctaagcaattgctaca

SEQ ID NO: 27670 - DNA, 75 bp, Artificial Sequence
  Synthetic
acaacattgttcttatttatggttacaaacatatactccaatgtctttgtatttgtgttgttttaatgttggtaa

SEQ ID NO: 27671 - DNA, 75 bp, Artificial Sequence
  Synthetic
aagtagagagacagttgaaagattgctggtttctatgttgcaagttaatgaaaagcacatgctgctggaaccacc

SEQ ID NO: 27672 - DNA, 75 bp, Artificial Sequence
  Synthetic
taaaataagaagcactccagcggctgtattttggtataaaggaagtataaatcctaatgtttatactgttggaga

SEQ ID NO: 27673 - DNA, 75 bp, Artificial Sequence
  Synthetic
ctatcctgactggattttagcacagactatgatacagcatcaaactgctgacagtgtgcaatttgacctatctac

SEQ ID NO: 27674 - DNA, 75 bp, Artificial Sequence
  Synthetic
tatgattcaatgggcttatgatcaagattatcttgatgaaagtcttattgcatacaattatgctaaaatggctga

SEQ ID NO: 27675 - DNA, 75 bp, Artificial Sequence
  Synthetic
cacagatagtaatgcacaagcatttttagctcataatagtcaggctaaatatgttaaagaatgtgcattaatggt

SEQ ID NO: 27676 - DNA, 75 bp, Artificial Sequence
  Synthetic
tagatattataaaacaggggaaatgcgagatatgtcaatgtctgcttgggtacatcattgtatttctaagataga

SEQ ID NO: 27677 - DNA, 75 bp, Artificial Sequence
  Synthetic
aggagatgggcgatggcaagatatttgtaaatttttaagatatcaaggcataaattttattattttcctagacaa

SEQ ID NO: 27678 - DNA, 75 bp, Artificial Sequence
  Synthetic
atttaaaacatttttacaaaactttccaaaaaaaaattgtttacttatacatggaccgccagatacaggcaaatc

SEQ ID NO: 27679 - DNA, 75 bp, Artificial Sequence
  Synthetic
tatgtttactatgtcattaatacaggctctaaaaggtaatgtagtttcttttgctaattacaaaagtcaattttg

SEQ ID NO: 27680 - DNA, 75 bp, Artificial Sequence
  Synthetic
gttgcaacctttatcgaatgcaaaaatagccctattagatgatgccacagatgtttgttggcattacattgataa

SEQ ID NO: 27681 - DNA, 75 bp, Artificial Sequence
  Synthetic
gtttctgagaaatgggctggatggtaatactgtatgtttggatattaaacatagggctccatgtcaaatgaagtt

SEQ ID NO: 27682 - DNA, 75 bp, Artificial Sequence
  Synthetic
tcctccattacttattacatccaatatgagtcttaaaaaagaaaataaatatccatatttgcatagtagaatata

SEQ ID NO: 27683 - DNA, 75 bp, Artificial Sequence
  Synthetic
tgaatttgaatttcctaacaaattcccgtttgatacaaataataaaccaatgtttaatcttactgaccaaagctg

SEQ ID NO: 27684 - DNA, 75 bp, Artificial Sequence
  Synthetic
ggcatcttttttcaaaaggctttggacacaattagagctaagtgaccaagaagacgagggagaaaatggaagcac

SEQ ID NO: 27685 - DNA, 75 bp, Artificial Sequence
  Synthetic
tcagcgcccgtttcaatgcactacaagagactttaatggacttgtatgaatcaggtgtagagactttggaaacac

SEQ ID NO: 27686 - DNA, 75 bp, Artificial Sequence
  Synthetic
aaattcagcattggacacttttaagacaagaacaaattttatttcattatgcaaggaaacacggcatcatgcgtt

SEQ ID NO: 27687 - DNA, 75 bp, Artificial Sequence
  Synthetic
tgggctatcaaccggtccctccactggccacatcagaaataaaagcaaaagatgctatagctatgggactattat

SEQ ID NO: 27688 - DNA, 75 bp, Artificial Sequence
  Synthetic
tggaaagtttacaaaaatctaagtatgcagaggagccttggacattagtggagactagtttggaaacagttagga

SEQ ID NO: 27689 - DNA, 75 bp, Artificial Sequence
  Synthetic
gtcctcctatggattgttttaaaaaaggacctaaaagtgtggaagtatattttgatggcaatccagaaaatctta

SEQ ID NO: 27690 - DNA, 75 bp, Artificial Sequence
  Synthetic
tgctgtatactgtatggacatatatctattatcagacagaggaggatacatgggaaaaagtagaaggacaagtgg

SEQ ID NO: 27691 - DNA, 75 bp, Artificial Sequence
  Synthetic
attataccggagcctattatatggagggacattttaagaattattatatacgtttcgaggaagatgctaaaaggg

SEQ ID NO: 27692 - DNA, 75 bp, Artificial Sequence
  Synthetic
ttagtactacaaaccagtgggaagtgcatgttaataaagatgttgtgtttacccctgttactagttctacgccgc

SEQ ID NO: 27693 - DNA, 75 bp, Artificial Sequence
  Synthetic
cagttggagacgcggagccctccaacaactccgtatccgggccgacgcttcggtctcccacccccgtgcccaacc

SEQ ID NO: 27694 - DNA, 75 bp, Artificial Sequence
  Synthetic
aacggacatcaaacagacgattcggacgaaaagcatctagccctacagccaccaccaggcggcaaaaacaccgag

SEQ ID NO: 27695 - DNA, 75 bp, Artificial Sequence
  Synthetic
aaacacaaagacaaaaaacagcaacaaggaggagaaaaagcagatcaaggtcccgaagctccaggcgtcggggag

SEQ ID NO: 27696 - DNA, 75 bp, Artificial Sequence
  Synthetic
gggagggaacccgaagatcctcctccagaggatcctccagttcccccaacagggacaggggagggcgcagtggag

SEQ ID NO: 27697 - DNA, 75 bp, Artificial Sequence
  Synthetic
gggggcccatcaccaggtcccggtcacggtcaaggtccagaacaagagggtattctaccgggggcggcgttgctc

SEQ ID NO: 27698 - DNA, 75 bp, Artificial Sequence
  Synthetic
ctgacgaagtgggaacagcagttcgatctgttggtagacaacatagtgggagaattgcgcgattattggcagaag

SEQ ID NO: 27699 - DNA, 75 bp, Artificial Sequence
  Synthetic
ctaaggaccccccagtaattctattgcgtggagatgcaaacactttaaaatgctttcgctatagatttaggaaaa

SEQ ID NO: 27700 - DNA, 75 bp, Artificial Sequence
  Synthetic
aacatgctggtggctttcgctttgtcagtacaacatggtcctgggttgaaggagattctaatgatagggtgggcc

SEQ ID NO: 27701 - DNA, 75 bp, Artificial Sequence
  Synthetic
gctcaagaatgcttatagcattttacacagaggaggagagagagttatgtttagaaaagattaaattaccatatg

SEQ ID NO: 27702 - DNA, 75 bp, Artificial Sequence
  Synthetic
gtgtagaatggtcctatggacaatttgatgatttataaattttataacacactaacagtgctatacatttcatac

SEQ ID NO: 27703 - DNA, 75 bp, Artificial Sequence
  Synthetic
taacttatatgctttgctactaacaaaatggcgcgggcgcgaagagttaaacgggcgtctgtgacagatatttat

SEQ ID NO: 27704 - DNA, 75 bp, Artificial Sequence
  Synthetic
agaggctgcaaagcctctggcacttgccctcctgatgttattaataaagtcgagcaaaataccttggctgacaaa

SEQ ID NO: 27705 - DNA, 75 bp, Artificial Sequence
  Synthetic
atattaaaatatggcagtgttggtgtgttttttggtgggcttggaataagtacaggtaaaggtacaggtggtgcc

SEQ ID NO: 27706 - DNA, 75 bp, Artificial Sequence
  Synthetic
acaggatatgtccccttgggtgaaggcccaggtgtgcgtgtgggcgcaacacctacagtggtccgctccggggtc

SEQ ID NO: 27707 - DNA, 75 bp, Artificial Sequence
  Synthetic
atacctgaagtaattggtccagctgaattaataccagttgactcagtggcaccaattgaccctgcagcaccatca

SEQ ID NO: 27708 - DNA, 75 bp, Artificial Sequence
  Synthetic
atagtatcattaacagagactggtagcacagctgaccttttacctggtgagatagaaactatagctgaaatacac

SEQ ID NO: 27709 - DNA, 75 bp, Artificial Sequence
  Synthetic
cctgtacctactgatactgttgaaatagataccccaattgtttctggtggccgacactcaagtgctatattggag

SEQ ID NO: 27710 - DNA, 75 bp, Artificial Sequence
  Synthetic
gtagcagatcctagtccaccagtacgaacacgtgtcactcgtacccagtatcataatccctcctttcagattata

SEQ ID NO: 27711 - DNA, 75 bp, Artificial Sequence
  Synthetic
tctcagtctacaccaacatcaggtgaatcctctcttgcagaccaggtattagtttttgaaggttcaggaggtcaa

SEQ ID NO: 27712 - DNA, 75 bp, Artificial Sequence
  Synthetic
caaataggtggatcacgagaggaaattgaattgcagcctttgtcacctagatacagctttgaaatagaggaacct

SEQ ID NO: 27713 - DNA, 75 bp, Artificial Sequence
  Synthetic
acaccaccacgtagaacaagcacacctttacaaacacttggaagacaatttagaaatctacgcagaactttatac

SEQ ID NO: 27714 - DNA, 75 bp, Artificial Sequence
  Synthetic
aataagcgtctaactcaacaagttaatgttgaggatcctttatttctgtccgcaccttcaaaattggttcgtttc

SEQ ID NO: 27715 - DNA, 75 bp, Artificial Sequence
  Synthetic
cagttcgataaccctgtatttgatgaggaagttacccaaatatttgatagagacattgctgaaatagaagaacca

SEQ ID NO: 27716 - DNA, 75 bp, Artificial Sequence
  Synthetic
ccaaatagagattttttggatatagcagaattgggaaggcctgtattatctgaatctgctgagggccgtgtccgt

SEQ ID NO: 27717 - DNA, 75 bp, Artificial Sequence
  Synthetic
gttagtagattgggtcgccgagctactatggcaactcgcagtggcactcaaattggctctagagtgcattttttt

SEQ ID NO: 27718 - DNA, 75 bp, Artificial Sequence
  Synthetic
agagatgttagtagtataaatatggaagatccaatagaaatgcagctactaggtgaacattcaggtgatgcttct

SEQ ID NO: 27719 - DNA, 75 bp, Artificial Sequence
  Synthetic
ataatccaagagcccttagaaacgactattgcagacgttaatattgataatattccagaagatattgtatcagaa

SEQ ID NO: 27720 - DNA, 75 bp, Artificial Sequence
  Synthetic
gatgttgcagaggataccaatattagtgactttaattctgctgatttattactagataatggtatagaggacttt

SEQ ID NO: 27721 - DNA, 75 bp, Artificial Sequence
  Synthetic
tcgaattcacaattagtatttgggtcacctcaaaggggtaatacttccattaccatacctaggtttgagtcacct

SEQ ID NO: 27722 - DNA, 75 bp, Artificial Sequence
  Synthetic
agagacactgtagtgtatatacaagatacacaaggttttcaagttgtatatcctgaatcatatgacagaccaact

SEQ ID NO: 27723 - DNA, 75 bp, Artificial Sequence
  Synthetic
ataatatatcctacaccagatgtacctgctgttattgtacatattacagatacctctggtgacttttatttacat

SEQ ID NO: 27724 - DNA, 75 bp, Artificial Sequence
  Synthetic
cctagtttacggtggaaaaagcgcaaacgcaaatatttataatgtttttcagatgaccctgtggcttccagcatc

SEQ ID NO: 27725 - DNA, 75 bp, Artificial Sequence
  Synthetic
tggtaagatatatttgcctcccacaccaccggtagctcgagtgcaaagtacggacgagtatgtggaaagaactga

SEQ ID NO: 27726 - DNA, 75 bp, Artificial Sequence
  Synthetic
catctattaccatgcaaccagtgatagattgttaactgtaggccatccctattttgatgttcgctcccaagaagg

SEQ ID NO: 27727 - DNA, 75 bp, Artificial Sequence
  Synthetic
cgacacgattgaagtaccaaaggtttcaggcaatcagtatagggcctttagagttacatttcctgaccctaacaa

SEQ ID NO: 27728 - DNA, 75 bp, Artificial Sequence
  Synthetic
atttgcattagcagacatgacaatacatgatccagacaaatatcgtttggtgtgggcctgtaaaggtattgaaat

SEQ ID NO: 27729 - DNA, 75 bp, Artificial Sequence
  Synthetic
aggaagaggccaacctttaggtgtaggcaccacaggacatccactgtttaataaacttagagattcagaaaattc

SEQ ID NO: 27730 - DNA, 75 bp, Artificial Sequence
  Synthetic
tgcagaacgtctggaaggaacaagtgatgataggaggaatatatcatttgatcctaagcaagtgcaaatgtttgt

SEQ ID NO: 27731 - DNA, 75 bp, Artificial Sequence
  Synthetic
gataggctgcaccccctgtttaggggagtattgggatacagctccagtatgtaaagatgcaggaagtcaattagg

SEQ ID NO: 27732 - DNA, 75 bp, Artificial Sequence
  Synthetic
cctttgccctccattagaattaaaaaacagtgttatagaagatggcgatatgtttgatataggatttggcaatat

SEQ ID NO: 27733 - DNA, 75 bp, Artificial Sequence
  Synthetic
taacaacaaaacattaagttttaataagtcagacgttagtgtggacattgttaatgaaatttgtaaatatcctga

SEQ ID NO: 27734 - DNA, 75 bp, Artificial Sequence
  Synthetic
ttttttaactatgtccaatgatgtttatggagactcttgctttttctttgctcgcagagagcaatgttatgcaag

SEQ ID NO: 27735 - DNA, 75 bp, Artificial Sequence
  Synthetic
gcattattttgtacgcggaggggcagtgggtgatttaataccagatgctacagttaatcaggaccataaatatta

SEQ ID NO: 27736 - DNA, 75 bp, Artificial Sequence
  Synthetic
cttaccagcaaatccacctgccacattggaaaactctacgtactttccgactgttagtggctccttagtgacatc

SEQ ID NO: 27737 - DNA, 75 bp, Artificial Sequence
  Synthetic
tgatgcacaattatttaataggcccttttggttaaaacgtgcacaaggtcataataatggtattctgtggagtaa

SEQ ID NO: 27738 - DNA, 75 bp, Artificial Sequence
  Synthetic
tcagatgtttgttactgtagcagacaacacccgtaatactaattttacaatcagtgttactagtgaagacttaag

SEQ ID NO: 27739 - DNA, 75 bp, Artificial Sequence
  Synthetic
tacagcaaaatatgatgctaaaaatatcagggaatatatgagacatgtagaagaatatcaactatcatttatatt

SEQ ID NO: 27740 - DNA, 75 bp, Artificial Sequence
  Synthetic
acagttatgtagggtacccttagaggctgaggtgctaacccagattaatgctacgaattcaggtatattagaaaa

SEQ ID NO: 27741 - DNA, 75 bp, Artificial Sequence
  Synthetic
ctggcaactagggtttgttccaacaccagataatgcagtgcatgacacatatcgttaccttaattcaaaagctac

SEQ ID NO: 27742 - DNA, 75 bp, Artificial Sequence
  Synthetic
aaaatgtccagatgcagttcaagaaacagaaaaggaagatccttttggtggatattcattttggaatgttgatat

SEQ ID NO: 27743 - DNA, 75 bp, Artificial Sequence
  Synthetic
gacagaaaaattatcattagatttggatcaatatcctctaggacgtaaatttttgtttcaagcagggttacgtac

SEQ ID NO: 27744 - DNA, 75 bp, Artificial Sequence
  Synthetic
agctagaacacgtactttgaaacgatctctacctcgcaaaagttctaaaactgtaaaaagaagaaaagtttaact

SEQ ID NO: 27745 - DNA, 75 bp, Artificial Sequence
  Synthetic
gcaaccgttttcggtctttcaataaaatttgttaactaatttggtatgtgaagtattttttgaacttcttcgtga

SEQ ID NO: 27746 - DNA, 75 bp, Artificial Sequence
  Synthetic
ctaaaccgaacaagtcaacacagcgaccgcacccggttaatcagattataaattccttgaggtaagattggaatc

SEQ ID NO: 27747 - DNA, 75 bp, Artificial Sequence
  Synthetic
acccggttaatcagattataaattccttgaggtaagattggaatcagtgcagataccatcttgcacctggagcaa

SEQ ID NO: 27748 - DNA, 75 bp, Artificial Sequence
  Synthetic
atggataggccaaagcctagaacagttagggaactagcagacacattgtctattcccttgatagatcttttgcta

SEQ ID NO: 27749 - DNA, 75 bp, Artificial Sequence
  Synthetic
ccctgtaccttttgcaatagatttttatcttattttgaactacttaattttgatcataaagacttgcagcttatt

SEQ ID NO: 27750 - DNA, 75 bp, Artificial Sequence
  Synthetic
tggactgtagatgatttagtgtttgctttatgcagtagttgtgcttacgcgtcagcacagtttgaatttacaaga

SEQ ID NO: 27751 - DNA, 75 bp, Artificial Sequence
  Synthetic
tattttcagttttcagtcacaggcaaagatattgaaaaggtagaaaataaaataataggggaaatagtagtaagg

SEQ ID NO: 27752 - DNA, 75 bp, Artificial Sequence
  Synthetic
tgtcaatattgtctaaagaaattagatttagtagaaaaattatcaacttgctacaaacatcaaagctttcataga

SEQ ID NO: 27753 - DNA, 75 bp, Artificial Sequence
  Synthetic
ctacaaacatcaaagctttcatagagtaaggaataggtggaaaggactttgcagacattgtgggtcgatagaatg

SEQ ID NO: 27754 - DNA, 75 bp, Artificial Sequence
  Synthetic
attgggaaacaacccactataccagacgtagttctggagctgcaagagcttgtccaacccactgacctgcattgc

SEQ ID NO: 27755 - DNA, 75 bp, Artificial Sequence
  Synthetic
tacgaagaattgacagaagaacctgcagaggaggagcagtgtctcactccttacaagattatagtggcctgcaat

SEQ ID NO: 27756 - DNA, 75 bp, Artificial Sequence
  Synthetic
tgtggtacacggcttcgtctatacgtgtttgctacggacctgggaataagagcacaacaggagcttttgctggga

SEQ ID NO: 27757 - DNA, 75 bp, Artificial Sequence
  Synthetic
gaggtgcaacttgtgtgtccagagtgtcgagagaagcttcgtcgccatgagtgatgataaaggtattaactttga

SEQ ID NO: 27758 - DNA, 75 bp, Artificial Sequence
  Synthetic
tgctaaagaaggatgtagtgaatggttttcgttagaagcagagtgttctgattctagtttagatggtgatttgga

SEQ ID NO: 27759 - DNA, 75 bp, Artificial Sequence
  Synthetic
aagactgtttgacgaaggtacagactctgatttttcagacctaatagatgatggagatgctattcagggaaactc

SEQ ID NO: 27760 - DNA, 75 bp, Artificial Sequence
  Synthetic
aattgctaaaacgaaagtatatcagtcccacagctgtttcgcagcttagcccacgactggagtctatctctttgt

SEQ ID NO: 27761 - DNA, 75 bp, Artificial Sequence
  Synthetic
ctccacaacataaaactaaaaggagattatttgaacaagacagcggactagagtgttcaataaatgaagctgaag

SEQ ID NO: 27762 - DNA, 75 bp, Artificial Sequence
  Synthetic
atcattctgaaacacaggtggaagaggtacccgccattgttccaccgacagcagctcagggacctaagggtttgg

SEQ ID NO: 27763 - DNA, 75 bp, Artificial Sequence
  Synthetic
aacttgttaaggatctactgaaagctaataatgcaaaagctgtactattggctaaatttaaagaagcctatggag

SEQ ID NO: 27764 - DNA, 75 bp, Artificial Sequence
  Synthetic
taggctttgcggaacttactagacaatataagagcaacaaaacatgctgtagagattgggtgatcagtatatata

SEQ ID NO: 27765 - DNA, 75 bp, Artificial Sequence
  Synthetic
ctgttaatgaagagttaatagaaagttcaaagcagcttttattacagcattgtgcgtatatttggttgcaacaaa

SEQ ID NO: 27766 - DNA, 75 bp, Artificial Sequence
  Synthetic
tgcctccaatgtgtttatatttattgtgttttaatgtaggcaaaagtagagaaactgtaataagattacttggaa

SEQ ID NO: 27767 - DNA, 75 bp, Artificial Sequence
  Synthetic
atttgttacaggttgttgaagtgcaaatattagcggagccgccaaagttacgaagtgttttagctgctttatttt

SEQ ID NO: 27768 - DNA, 75 bp, Artificial Sequence
  Synthetic
ggtataaagggagcatgaatccaaatgtatatgctcatggagcatatcctgattggattcttgcacaaactatga

SEQ ID NO: 27769 - DNA, 75 bp, Artificial Sequence
  Synthetic
taaatcatcaaactgctgatgctacacaatttgatttgtctactatgatacagtttgcttatgataatgattatg

SEQ ID NO: 27770 - DNA, 75 bp, Artificial Sequence
  Synthetic
tggaagaagctataatagcatatcagtatgccaagttagctgacacagattctaatgctagagcatttttacaaa

SEQ ID NO: 27771 - DNA, 75 bp, Artificial Sequence
  Synthetic
gtaattgtcaagcacgtatagtaagagaatgtgcaacaatggtgagacactacattagaggagaaatgagagaaa

SEQ ID NO: 27772 - DNA, 75 bp, Artificial Sequence
  Synthetic
tgagtatttctacatggatacatagaaaattactacctgtagaaggtgaaggtcattggtcacatatagttaaat

SEQ ID NO: 27773 - DNA, 75 bp, Artificial Sequence
  Synthetic
ttattagatatcaaggtataaacttcattgactttctatcttcttttaagagttttttacataactgtccgaagc

SEQ ID NO: 27774 - DNA, 75 bp, Artificial Sequence
  Synthetic
aaaactgtttactctttcatggtccacctgacactggcaagtctatgtttacaatgtctttaattaatgtgctta

SEQ ID NO: 27775 - DNA, 75 bp, Artificial Sequence
  Synthetic
aaggcaaagtgctatcatttgcaaattgtagaagcaccttttggatgcaaccattaattgatactaagattgcat

SEQ ID NO: 27776 - DNA, 75 bp, Artificial Sequence
  Synthetic
taattgatgatgtgacagaagtatgttgggactatatagaccaatatctgcgaaatggtttagatggaaattatg

SEQ ID NO: 27777 - DNA, 75 bp, Artificial Sequence
  Synthetic
tatgtttagatataaaacataaagcgccatgtcaagtaaagtttccacctttaatgctaacttctaatttagaca

SEQ ID NO: 27778 - DNA, 75 bp, Artificial Sequence
  Synthetic
tatctaaagagcataagtacagattcttacacagcagaattaagtgctttgcatttactaacaaatttccacttg

SEQ ID NO: 27779 - DNA, 75 bp, Artificial Sequence
  Synthetic
cttacacagcagaattaagtgctttgcatttactaacaaatttccacttgatgctgatcataaaccacaattcca

SEQ ID NO: 27780 - DNA, 75 bp, Artificial Sequence
  Synthetic
acttactgaccaaagctggaaatctttttttgaaaggctttggacacagttagagctcagtgatcaagaagacga

SEQ ID NO: 27781 - DNA, 75 bp, Artificial Sequence
  Synthetic
gggagaggatggagtcactcagcgaacgtttcaatgcactgcaagagactttaatggacctgtatgaatcaggtc

SEQ ID NO: 27782 - DNA, 75 bp, Artificial Sequence
  Synthetic
gtgaggatctacaaagtcaaattgaccattggcagacgttaagacaagagcaagtgttattgtactttgctcgaa

SEQ ID NO: 27783 - DNA, 75 bp, Artificial Sequence
  Synthetic
aacacggagtaatgcggttggggtaccaacctgtgcctcctttagcaaccagtgaaagcaaagctaaagatgcta

SEQ ID NO: 27784 - DNA, 75 bp, Artificial Sequence
  Synthetic
ttggcatggttttgttgttgcaaagccttcagaagtcctcttatggccaggagccatggacacttgtacaaacta

SEQ ID NO: 27785 - DNA, 75 bp, Artificial Sequence
  Synthetic
gtctggagactgtgcgcagtcctcctgctaactgtttcaagaaagggccacaaaatattgaagtaatgtttgatg

SEQ ID NO: 27786 - DNA, 75 bp, Artificial Sequence
  Synthetic
gcgatccagaaaatataatgagctatacagtttggacatacatttattatcaaactaacaatgacacatgggaaa

SEQ ID NO: 27787 - DNA, 75 bp, Artificial Sequence
  Synthetic
aggttgaaggtcaagtggattattttggagcctattattttgaagggacgttgaaaacttattacattaattttg

SEQ ID NO: 27788 - DNA, 75 bp, Artificial Sequence
  Synthetic
aaactgatgctgccagatttagcaaaactaacaaatgggaagttcatgttaacaagaacattgtgtttgcccctg

SEQ ID NO: 27789 - DNA, 75 bp, Artificial Sequence
  Synthetic
tcactagctcttcgccacctactggagacgggggagaagcctccagcaacaccgtttccaggagcaggtcgcact

SEQ ID NO: 27790 - DNA, 75 bp, Artificial Sequence
  Synthetic
ctccgcagctctctgcccccaccttgtcctccgtccagcaacggccactctccacaacatccagacggtacagac

SEQ ID NO: 27791 - DNA, 75 bp, Artificial Sequence
  Synthetic
gaaaagcctctagccccacctccacgcggcagaaaagacaaagacaaaaagccactacaaggagatcaaggtcca

SEQ ID NO: 27792 - DNA, 75 bp, Artificial Sequence
  Synthetic
gatcaaggggtcgaacagccaccgagaggggagggcgaggtggaagggcatcctcggcagactccgacagctcca

SEQ ID NO: 27793 - DNA, 75 bp, Artificial Sequence
  Synthetic
ccgggcggagaaggggaaggggaggtggaagggggcccacaacaaggtcccaatcccgttcccgatcccgatccc

SEQ ID NO: 27794 - DNA, 75 bp, Artificial Sequence
  Synthetic
ggtcgcgatcccaagcccgagggtcttctaccaggggtggcattgcgcctgcatcagtgggagcaagcgttcgat

SEQ ID NO: 27795 - DNA, 75 bp, Artificial Sequence
  Synthetic
cggttggtcgagagcatcatggacgacttgaacggttactggcagaggctcaagaccccccaatagtcatattgc

SEQ ID NO: 27796 - DNA, 75 bp, Artificial Sequence
  Synthetic
gtggagaggctaatgttttaaaatgctatcgctatagggctcgcaaaaggcatttaggcttagtaaaatattata

SEQ ID NO: 27797 - DNA, 75 bp, Artificial Sequence
  Synthetic
gtacaacatggtcatgggtaggtggggactgctgtgatagagtaggtaggtcaagaatgcttttagcttttgaca

SEQ ID NO: 27798 - DNA, 75 bp, Artificial Sequence
  Synthetic
catataaacaacgagagcagtttataactacaatgaaattaccaccaaatgtagattggtcatttggacatttag

SEQ ID NO: 27799 - DNA, 75 bp, Artificial Sequence
  Synthetic
atgatttataataaccttactaactttgcattgctactaacatactaactcatataatggctcgtgcaaaacgtg

SEQ ID NO: 27800 - DNA, 75 bp, Artificial Sequence
  Synthetic
ttaaacgtgcctcagttactgatatttacaaagggtgcaaggcgtttggcacctgtcctccagatgtacttaata

SEQ ID NO: 27801 - DNA, 75 bp, Artificial Sequence
  Synthetic
aagtggaacaaactactatagcagatcaaattcttaagtatggaagtgctggtgttttttttggagggttgggaa

SEQ ID NO: 27802 - DNA, 75 bp, Artificial Sequence
  Synthetic
tcagcaccggacgtggttctggtggagctgcaggatatgttcctttgggtgaaggccccggggtgcgcataggcg

SEQ ID NO: 27803 - DNA, 75 bp, Artificial Sequence
  Synthetic
gtactcccactgtgctgcgccctggggtcattcctgaggtaattgggcctgcagacataatacctattgacacag

SEQ ID NO: 27804 - DNA, 75 bp, Artificial Sequence
  Synthetic
tcaggccaattgatcccacagcaccaagtattgttacaggtgctgacagcactgttgaccttttacctggtgaaa

SEQ ID NO: 27805 - DNA, 75 bp, Artificial Sequence
  Synthetic
tagaatccattgctgagatacacccagtgcctgttgataatatagaaattgacactcctattgttgcaggcggtg

SEQ ID NO: 27806 - DNA, 75 bp, Artificial Sequence
  Synthetic
gtacaggtaatcgaggcacagcagccattttagaagttgctgaccctagtcctccaatacgaacccgtgtcacac

SEQ ID NO: 27807 - DNA, 75 bp, Artificial Sequence
  Synthetic
gtacacaatatcacaatcctgcgtttcaaattatttcagaatctacaccaactagtggagaatcttctttagcag

SEQ ID NO: 27808 - DNA, 75 bp, Artificial Sequence
  Synthetic
atcatataattgtatttgaaggttctggtgggcaattggttggtggtgcacgagaaccatcctctgctacagagt

SEQ ID NO: 27809 - DNA, 75 bp, Artificial Sequence
  Synthetic
caatagagttgcaagaatttccatcacggtatagctttgaaattgaggaaggcacaccaccacgtaccagcactc

SEQ ID NO: 27810 - DNA, 75 bp, Artificial Sequence
  Synthetic
ctgtgcaaagggcagtacaatcattaagcagtttaagaagggcattatataataggcgtttgactgaacaagtag

SEQ ID NO: 27811 - DNA, 75 bp, Artificial Sequence
  Synthetic
cagttactgatcctttatttttaagtaggccttcgcggcttgtacaatttcaatttgataatcctacttttgagg

SEQ ID NO: 27812 - DNA, 75 bp, Artificial Sequence
  Synthetic
aggaggtgactcagatatttgaaagagatgtaaatgaggtggaagaacctccagatagacaatttttagatgtgg

SEQ ID NO: 27813 - DNA, 75 bp, Artificial Sequence
  Synthetic
ctagattgggcaggcctacttattctgaaactcctcaaggatatgttagagtaagtagactgggacgacgagcca

SEQ ID NO: 27814 - DNA, 75 bp, Artificial Sequence
  Synthetic
caattagaacccgtagtggggcacaggttggcactcaagtacatttttacagagatttaagtagtatagatgctg

SEQ ID NO: 27815 - DNA, 75 bp, Artificial Sequence
  Synthetic
aagccccaattgaaatggaattattaggtgaacattctggtgatagtactataatacagggccctattgaaagtt

SEQ ID NO: 27816 - DNA, 75 bp, Artificial Sequence
  Synthetic
caatagtagatactaatatagatgaaccagatgctgtggatgtgggaagacaagaaactccatcattagaagata

SEQ ID NO: 27817 - DNA, 75 bp, Artificial Sequence
  Synthetic
ttgattttaactccgaagacttattattggatgagggagttgaagattttagtggttcacaattagtagtgggca

SEQ ID NO: 27818 - DNA, 75 bp, Artificial Sequence
  Synthetic
cacgtcgtagtctaaataccttgacggttccacgctttgaaaccccaagaaacactagtgtttatattcaagatg

SEQ ID NO: 27819 - DNA, 75 bp, Artificial Sequence
  Synthetic
tacaaggatataccgtgtcctatccagaatcacgtgataccaccaatattatttttccacatcctgacaccccga

SEQ ID NO: 27820 - DNA, 75 bp, Artificial Sequence
  Synthetic
ctgtagtcattcatattgcagacacatctggggattattatttgcatcccagtcttcaaaaacgaaaaagacgca

SEQ ID NO: 27821 - DNA, 75 bp, Artificial Sequence
  Synthetic
aacgcaaatatttataattgttttacagatgtcattgtggcttcctgcaaccggtaaagtatacttgccaccatc

SEQ ID NO: 27822 - DNA, 75 bp, Artificial Sequence
  Synthetic
tacaccagtggctcgagtacaaagcaccgatgaatatgtggaaagaaccaatatattttatcatgcagttagtga

SEQ ID NO: 27823 - DNA, 75 bp, Artificial Sequence
  Synthetic
tcggcttttaacagtaggacatccatatttcgatgtccgatctcaagatgggcaacgtatagaggtccctaaggt

SEQ ID NO: 27824 - DNA, 75 bp, Artificial Sequence
  Synthetic
gtctggcaatcagtatagatcatttagaataacatttccggatcctaatagatttgctttagcagatatgtctgt

SEQ ID NO: 27825 - DNA, 75 bp, Artificial Sequence
  Synthetic
gtacaatcctgaaaaggaaagattagtgtgggcctgtagaggcctggagataggcaggggtcagcctttgggtgt

SEQ ID NO: 27826 - DNA, 75 bp, Artificial Sequence
  Synthetic
aggaacatcaggtcatcctttatttaacaaagtcagggatactgaaaactcaggtaactatcaagcagtttctca

SEQ ID NO: 27827 - DNA, 75 bp, Artificial Sequence
  Synthetic
ggatgacagacaaaatacatcttttgatcctaaacaagtgcaaatgtttgtcattggctgtgtgccgtgtatggg

SEQ ID NO: 27828 - DNA, 75 bp, Artificial Sequence
  Synthetic
tgaacattgggacaaagctaaggtttgtgaatcagaagcaaataatcaacaaggcttatgtccacccatagagtt

SEQ ID NO: 27829 - DNA, 75 bp, Artificial Sequence
  Synthetic
aaaaaattcagtaattgaagatggagatatgtttgatataggctttggaaatattaataacaaagcactatctta

SEQ ID NO: 27830 - DNA, 75 bp, Artificial Sequence
  Synthetic
taacaagtcagatgttagtttagatatagttaatgaagtgtgcaaatatccagactttttaaccatggctaatga

SEQ ID NO: 27831 - DNA, 75 bp, Artificial Sequence
  Synthetic
tgtgtatggagatgcttgttttttctttgctagacgagaacaatgttatgccagacattattttgttaggggagg

SEQ ID NO: 27832 - DNA, 75 bp, Artificial Sequence
  Synthetic
caatgttggcgatgcaatccctgatggagcagtacaacaggatcacaactattatttacctgcacaaaatgcaca

SEQ ID NO: 27833 - DNA, 75 bp, Artificial Sequence
  Synthetic
gcaacaacacaccttgggaaattctatatattatccaactgttagtgggtctcttgtaacatctgatgctcagtt

SEQ ID NO: 27834 - DNA, 75 bp, Artificial Sequence
  Synthetic
atttaatagaccattttggttacaacgtgctcaaggacataataatggaattttgtggggtaatcagatgtttgt

SEQ ID NO: 27835 - DNA, 75 bp, Artificial Sequence
  Synthetic
aacagtagctgataataccagaaacactaattttactattagtgtgtctaatgaagcacagccagcagaagaata

SEQ ID NO: 27836 - DNA, 75 bp, Artificial Sequence
  Synthetic
taatgccaacaatattagagaatatttgagacatgtagaggaatatcaattgtcttttatattacagttgtgtaa

SEQ ID NO: 27837 - DNA, 75 bp, Artificial Sequence
  Synthetic
aattcccttaattccagaagtactctcacaaattaatgcaatgaattctggaattttagaggaatggcagctagg

SEQ ID NO: 27838 - DNA, 75 bp, Artificial Sequence
  Synthetic
ctttgtaccaacaccagataactcagtacatgatacttacagatatattaactcaaaagcaacaaaatgtcctga

SEQ ID NO: 27839 - DNA, 75 bp, Artificial Sequence
  Synthetic
tgcagtggaaccaacagaaaaggaagatccgtttgccaaatataacttttggaacgtggatctaaccgaaaaatt

SEQ ID NO: 27840 - DNA, 75 bp, Artificial Sequence
  Synthetic
atctttagatttggatcaatatcctctaggtcgaaaatttttatttcaagctgggctgcaaacacgaaaacggac

SEQ ID NO: 27841 - DNA, 75 bp, Artificial Sequence
  Synthetic
tctaaaacccagtgctgtaaaatcaacaaaaagtgcaaaacgcaggcgaatgtaaccgaaatcgatttcaataaa

SEQ ID NO: 27842 - DNA, 75 bp, Artificial Sequence
  Synthetic
acaaaaagtgcaaaacgcaggcgaatgtaaccgaaatcgatttcaataaaaatgtaagtaatccatcttggtatg

SEQ ID NO: 27843 - DNA, 75 bp, Artificial Sequence
  Synthetic
tgaagcattttttaaccatcttcgtgactaaaccgaacaagtcaacacagggcaaccgcgcccggttttatctga

SEQ ID NO: 27844 - DNA, 75 bp, Artificial Sequence
  Synthetic
tataaaaccgcaccaggtgcacttttaacaatgctatcgcggaatcaccggaggcgcccgccaattttgactgcc

SEQ ID NO: 27845 - DNA, 75 bp, Artificial Sequence
  Synthetic
aagttcatttggcagtacaccgaattggctccagaagcgaccgataacggtaagttttggcacgtaggtggttgg

SEQ ID NO: 27846 - DNA, 75 bp, Artificial Sequence
  Synthetic
ttgatcgtttcagtgattgtggttaacaacaatcaacatatctagttacatgtgaccgcatgcgttatattattc

SEQ ID NO: 27847 - DNA, 75 bp, Artificial Sequence
  Synthetic
acatgtgaccgcatgcgttatattattcatatatatacataaatatacacctctgtatttaatctgcacagctca

SEQ ID NO: 27848 - DNA, 75 bp, Artificial Sequence
  Synthetic
caagacacttggcagtacattttcttggaacacagcaccgataacggtaagattatatctgtgaaccgtaggcgg

SEQ ID NO: 27849 - DNA, 75 bp, Artificial Sequence
  Synthetic
tactttctgattggtttggatgatagtagttaacaacaatcactctttataaataaatgtaaccgcctgcgttac

SEQ ID NO: 27850 - DNA, 75 bp, Artificial Sequence
  Synthetic
cttacttgatctaaatacaatatgctgactaaactttttagagagctatatggataggccaaagccttcttctgt

SEQ ID NO: 27851 - DNA, 75 bp, Artificial Sequence
  Synthetic
gcaggagcttgcagacactctttgtatacctttagtagatattttattgccgtgtaggttttgtcaaagattttt

SEQ ID NO: 27852 - DNA, 75 bp, Artificial Sequence
  Synthetic
aacttatatagagttagtaagttttgatcgcaaatgtttgcagttgatttggactgaagaagactttgtctttgc

SEQ ID NO: 27853 - DNA, 75 bp, Artificial Sequence
  Synthetic
ttgttgtagcagttgtgcttttgctactgcacaatttgaattttctacattttatgaacagtcagtgtgtggttg

SEQ ID NO: 27854 - DNA, 75 bp, Artificial Sequence
  Synthetic
ggagattgaggtagttgagcgaaaagctgttggagacattactattcgttgcaaattttgtttaaagaaattaga

SEQ ID NO: 27855 - DNA, 75 bp, Artificial Sequence
  Synthetic
tttaatagaaaagttaaatatttgttacaaccagcagcaattccataaggtaaggcgcaattggaaaggattgtg

SEQ ID NO: 27856 - DNA, 75 bp, Artificial Sequence
  Synthetic
taaggcgcaattggaaaggattgtgtagacattgtgggtcgatagaatgattgggaaagaagctactataccaga

SEQ ID NO: 27857 - DNA, 75 bp, Artificial Sequence
  Synthetic
tatagagcttgagctgcaagagcttgtccagcccactgacctgcattgctacgaagagttaagtgaagaagagac

SEQ ID NO: 27858 - DNA, 75 bp, Artificial Sequence
  Synthetic
agaggaggagccacaacatattccatacaagattgtagctccgtgttgcttctgtgaatccaagcttcgactaat

SEQ ID NO: 27859 - DNA, 75 bp, Artificial Sequence
  Synthetic
agtggttgcaacttcttttggaattcgcgcacaagaagagttactatttggagaagttaagttggtgtgtccagg

SEQ ID NO: 27860 - DNA, 75 bp, Artificial Sequence
  Synthetic
gtgtcgagagaaacttcgccatgtctgacgaaaaaggtactaaatatgatcctaaggaaggatgtagtgaatggt

SEQ ID NO: 27861 - DNA, 75 bp, Artificial Sequence
  Synthetic
ttgatctagaagcagaatgctctgatgctagtttagatggtgatttggaaaagttatttgaagaaaatacagata

SEQ ID NO: 27862 - DNA, 75 bp, Artificial Sequence
  Synthetic
ctgacatttctgacttaatagataatgaggacactatacaggggaactcccgcgaattattatgccagcaagaaa

SEQ ID NO: 27863 - DNA, 75 bp, Artificial Sequence
  Synthetic
gtgaggaaagcgagcaacagatacactggctaaaacgaaagtatatcagttcacaagaggttttgcagcttagtc

SEQ ID NO: 27864 - DNA, 75 bp, Artificial Sequence
  Synthetic
ctcgtctgcagtctatttccatttcgccacagcataaatctaaaaggagattatttgaacaagacagcggactag

SEQ ID NO: 27865 - DNA, 75 bp, Artificial Sequence
  Synthetic
aactgtcatttaatgaagctcaagattttactcagcagactgtggaggtaccggcgaccgattctgtgccgccag

SEQ ID NO: 27866 - DNA, 75 bp, Artificial Sequence
  Synthetic
aacagggtgccaagggactgggaattgttaaagatcttctaaaatgtagcaatgtaaaagcaatgttattagcta

SEQ ID NO: 27867 - DNA, 75 bp, Artificial Sequence
  Synthetic
agtttaaagaagcttttggagtgggatatatggaattaactagacaatatagaagcagcaagacatgctgcagag

SEQ ID NO: 27868 - DNA, 75 bp, Artificial Sequence
  Synthetic
actgggtattaactgtgtatgctgtacaagacgaactattagaaagttccaaacaacttttaattcagcattgtg

SEQ ID NO: 27869 - DNA, 75 bp, Artificial Sequence
  Synthetic
cttatatttggttgcatcaaatacctcctatgtgtttatatttattgtgttttaatgttggaaaaagtagagaaa

SEQ ID NO: 27870 - DNA, 75 bp, Artificial Sequence
  Synthetic
cagtattaagattgctaactaatcttttgcaagtatcagaagtacaaataatagctgaaccgccaaaacttagaa

SEQ ID NO: 27871 - DNA, 75 bp, Artificial Sequence
  Synthetic
gtacattgtcagcattattttggtataaaggtagtatgaatcctaatgtttatgctcatggagagtatcctgaat

SEQ ID NO: 27872 - DNA, 75 bp, Artificial Sequence
  Synthetic
ggataatgacgcagacaatgataagccatcatacagcagaagctacacagtttgatttatctactatggtacagt

SEQ ID NO: 27873 - DNA, 75 bp, Artificial Sequence
  Synthetic
atgcatatgataatgagttaacagatgaagcagaaattgcctatcattatgccaagcttgcagatacagatgcta

SEQ ID NO: 27874 - DNA, 75 bp, Artificial Sequence
  Synthetic
atgctagagcatttttacaacataatagtcaggcaagattggtaaaggactgtgcaattatggttagacattata

SEQ ID NO: 27875 - DNA, 75 bp, Artificial Sequence
  Synthetic
gacgaggtgaaatgaaagaaatgtcaatgtctgcatggatacataaaaaattagcggttgtggaaggggaaggac

SEQ ID NO: 27876 - DNA, 75 bp, Artificial Sequence
  Synthetic
attggtcagatattgtaaagtttattagatatcaagagattaattttattcagtttttaaatgcgtttaaattgt

SEQ ID NO: 27877 - DNA, 75 bp, Artificial Sequence
  Synthetic
ttttacacaatactccaaagaaaagctgcttgctattttatgggcctcctgacacagggaaatctatgtttacta

SEQ ID NO: 27878 - DNA, 75 bp, Artificial Sequence
  Synthetic
tgtctttaataaagcttttaaagggaaaggttttgtcatttgcgaattataaaagtaccttttggcttcagcctg

SEQ ID NO: 27879 - DNA, 75 bp, Artificial Sequence
  Synthetic
ttgcagacacaaaagtggcattgatagatgatgtaacatatgtatgttgggattatatagaacagtatttaagaa

SEQ ID NO: 27880 - DNA, 75 bp, Artificial Sequence
  Synthetic
atgcattagatggtaatactgtttgtttagatatgaaacatagggcgccatgtcaaattaggtttccaccattaa

SEQ ID NO: 27881 - DNA, 75 bp, Artificial Sequence
  Synthetic
tgttaacgtccaacattgatattatgaaagaagaaaaatatagatatttatacagcaggattcaagcgtttgcat

SEQ ID NO: 27882 - DNA, 75 bp, Artificial Sequence
  Synthetic
ttccacataagtttccttttgatagtgataataagcctcaatttaaacttactgaccaaagctggaaatcttttt

SEQ ID NO: 27883 - DNA, 75 bp, Artificial Sequence
  Synthetic
actgaccaaagctggaaatctttttttgaaaggctttggagacagttagatctcagtgatcacgaagacgaggga

SEQ ID NO: 27884 - DNA, 75 bp, Artificial Sequence
  Synthetic
gacgatggatactctcagcgaacgtttcaatgcactacaagagaatctcatggacatttatgagtcaggtcgaga

SEQ ID NO: 27885 - DNA, 75 bp, Artificial Sequence
  Synthetic
cgacatagaaactcaaataatgcattggcaatatttgaggcaggaacaagtcttattttattttgccagacagca

SEQ ID NO: 27886 - DNA, 75 bp, Artificial Sequence
  Synthetic
tggagttatgcgtttaggatatcaacctgtaccccctttagccaccagtgaggctaaagctaaagacgctattgg

SEQ ID NO: 27887 - DNA, 75 bp, Artificial Sequence
  Synthetic
catggtgatcttattgcaaagtttacaaaaatcacagtatggcaaggagccatggacattaacacaaactagttt

SEQ ID NO: 27888 - DNA, 75 bp, Artificial Sequence
  Synthetic
ggagactgtaagaagcgcacctgcaaactgctttaaaaaaggtccacaaaatattgaggtcatgtttgacaatga

SEQ ID NO: 27889 - DNA, 75 bp, Artificial Sequence
  Synthetic
tcctgaaaaccttatggtttatactgtctggtcccacatttattatcagactttagatgatacatggaagaaagt

SEQ ID NO: 27890 - DNA, 75 bp, Artificial Sequence
  Synthetic
tgaggggaaagttgactatcatggtgcatattacttggaaggaacttataaaaactattacattcagtttgaaat

SEQ ID NO: 27891 - DNA, 75 bp, Artificial Sequence
  Synthetic
tgatgctgccagatttggcaaaactggaatctgggaagtgcatgttaatgaggacactatctttgctcctgttac

SEQ ID NO: 27892 - DNA, 75 bp, Artificial Sequence
  Synthetic
tagctcttcgccggcagctggagaggggacagcaacctccatcaaccccgcatcccaatcgccggccaacggaca

SEQ ID NO: 27893 - DNA, 75 bp, Artificial Sequence
  Synthetic
gcccactgccactgccacctccgtgtccaccagaaaacggacaccaccacgaaccgaaagcagacggtacaagcg

SEQ ID NO: 27894 - DNA, 75 bp, Artificial Sequence
  Synthetic
aaaagcatctagccctacaaccaccaccacccggaggcaaaagagacaaggacaaagacaagaagactcaacaag

SEQ ID NO: 27895 - DNA, 75 bp, Artificial Sequence
  Synthetic
gcgatcaaggtccacctcaagggggagacaacaaatccccaggggaggggaccggcgcagacggcgacgatcccg

SEQ ID NO: 27896 - DNA, 75 bp, Artificial Sequence
  Synthetic
agaaacctccacctcctccgagcggggaaggggagggagaagtagaagggggcccacaacacgatcccaatcaag

SEQ ID NO: 27897 - DNA, 75 bp, Artificial Sequence
  Synthetic
gtccctctcaagatccagatcccgatccaaatcgagatcaggagggtcttcttcagggggtggcattgcgcctgc

SEQ ID NO: 27898 - DNA, 75 bp, Artificial Sequence
  Synthetic
agacgtgggaagttcagttcaatcacttggtagacaacataatgggcgacttgaaagattactggaagacgctag

SEQ ID NO: 27899 - DNA, 75 bp, Artificial Sequence
  Synthetic
ggaccccccagtaattgtgctacgtggagatgctaacaaattgaaatgctttcgcttcagagctaagaaaaagta

SEQ ID NO: 27900 - DNA, 75 bp, Artificial Sequence
  Synthetic
tagggacttagttaaatattatagtaccacatggtcatgggtagggggtacaactaatgatagaattggacgttc

SEQ ID NO: 27901 - DNA, 75 bp, Artificial Sequence
  Synthetic
acggatgttacttgcatttacttcaaacactgagagacagctttttattaacataatgaaattaccaccaggtgt

SEQ ID NO: 27902 - DNA, 75 bp, Artificial Sequence
  Synthetic
tgattggtcattaggatctttagatgatttgtagcccatgtgcctgtaattaactaacaagcgctattttttgct

SEQ ID NO: 27903 - DNA, 75 bp, Artificial Sequence
  Synthetic
tttgctactaacatttactaacattcctcatggcccgtgcacgtagagtaaaacgtgcatctgtaactgacatct

SEQ ID NO: 27904 - DNA, 75 bp, Artificial Sequence
  Synthetic
acaggggttgcaagcaagcaggtacttgcccccctgatgttattaataaagtggaacaaacaaccattgcagatc

SEQ ID NO: 27905 - DNA, 75 bp, Artificial Sequence
  Synthetic
aaattttaaagtatggaagtggtgctgttttttttggtgggctgggaatcagtacaggccgtggttcaggtggtg

SEQ ID NO: 27906 - DNA, 75 bp, Artificial Sequence
  Synthetic
caacaggatatattcctttgggagaaggccctggggtgcgcgtaggaggcgcccccaccataattcgccctgggg

SEQ ID NO: 27907 - DNA, 75 bp, Artificial Sequence
  Synthetic
tcacacctgaacttattggtccagcggatgtaataccaattgacacagtcacaccaattgaccctacagcaccta

SEQ ID NO: 27908 - DNA, 75 bp, Artificial Sequence
  Synthetic
gtattgtcacaataactgacagcagtgctgttgaccttttacctgaattagaaacaattgcagaaatacaccctg

SEQ ID NO: 27909 - DNA, 75 bp, Artificial Sequence
  Synthetic
tgccaacagatactgtggatattgatactcctgttgttacaggaggtcgggattccagcgctattttggaggttg

SEQ ID NO: 27910 - DNA, 75 bp, Artificial Sequence
  Synthetic
ctgatcccagtcctcctgcacgaacaagagtgtctcgcacacaataccataaccctgcatttcaggttctaactg

SEQ ID NO: 27911 - DNA, 75 bp, Artificial Sequence
  Synthetic
agtctacacctttatctggtgaatctgctttatcagaccatgttattgtttttgaaggcactggaggccaaaata

SEQ ID NO: 27912 - DNA, 75 bp, Artificial Sequence
  Synthetic
taggtggttctcgcagcacagctatagaaccagcacaagaaagttttgaaatgcaaacatggcctagtagatata

SEQ ID NO: 27913 - DNA, 75 bp, Artificial Sequence
  Synthetic
gttttgaaatagaggaaggtacaccacctaggtctagcactcctgttcaaagagcagttcagtctctttcaagtc

SEQ ID NO: 27914 - DNA, 75 bp, Artificial Sequence
  Synthetic
ttcgaagagctttatataaccgaagattaactgaacaagtagctgttacagatccactgtttttaggaaggccat

SEQ ID NO: 27915 - DNA, 75 bp, Artificial Sequence
  Synthetic
cacgcttggtacgatttcagtttgacaaccctgcctttgaggaggaggttacacaaacatttgaaagagatttag

SEQ ID NO: 27916 - DNA, 75 bp, Artificial Sequence
  Synthetic
agtcatttgaggagccacctgatagacagtttctagatgtagttcgtttgggtagacctacatattctgaaactc

SEQ ID NO: 27917 - DNA, 75 bp, Artificial Sequence
  Synthetic
ctgaaggctatgtccgtgtcagtagacttggtagaagagccactataaggaccagaagcggtgcacaagttggag

SEQ ID NO: 27918 - DNA, 75 bp, Artificial Sequence
  Synthetic
ctcaggttcatttttatagagatcttagcactatagactctgaagcattggaaatgcaattgttaggagaacact

SEQ ID NO: 27919 - DNA, 75 bp, Artificial Sequence
  Synthetic
caggggatagcaccattgtacaggctcctatggagagttcatttattgatataaatattgatgagcctgagccat

SEQ ID NO: 27920 - DNA, 75 bp, Artificial Sequence
  Synthetic
taaatgtaggcctgcaggaaacaactgaagcagatgatatagattataattctgctgatttattactagaagatc

SEQ ID NO: 27921 - DNA, 75 bp, Artificial Sequence
  Synthetic
atatagaagattttagcgggtctcaattagtatttggtaatgcaaggcgtagtactactacatacacagttcctc

SEQ ID NO: 27922 - DNA, 75 bp, Artificial Sequence
  Synthetic
gatttgagtctcctagaaatactggattttatattcaggatgttcagggctataatgtagcttatccagagtccc

SEQ ID NO: 27923 - DNA, 75 bp, Artificial Sequence
  Synthetic
gtgacaccacagaaataattttaccacaatcagacacaccaactgtagtgattaattttgaagatgctggtggag

SEQ ID NO: 27924 - DNA, 75 bp, Artificial Sequence
  Synthetic
attattatttacacccaagtttaaaaagacgtaaacgaaaacgcaaatatttgtaattgttttacagatgacctt

SEQ ID NO: 27925 - DNA, 75 bp, Artificial Sequence
  Synthetic
gtggcttccggcgacgggtaaagtgtatttaccaccaacaccacctgtagcacgtgtacaaagcaccgatgaata

SEQ ID NO: 27926 - DNA, 75 bp, Artificial Sequence
  Synthetic
tgtggaaagaactaatgtattttaccatgccatgagtgatcgccttttaacagttgggcatccctattttgatgt

SEQ ID NO: 27927 - DNA, 75 bp, Artificial Sequence
  Synthetic
tagatcttctgatggagctaaaattgatgttcccaaagtgtctggaaatcaatacagggcatttagggttacatt

SEQ ID NO: 27928 - DNA, 75 bp, Artificial Sequence
  Synthetic
tcctgatccaaatagatttgctttagcagatatgtctgtttataatccagaaaaagaaaggttggtttgggcctg

SEQ ID NO: 27929 - DNA, 75 bp, Artificial Sequence
  Synthetic
tgcaggcctagaaataggcagaggacaaccattaggtgtaggcacatcaggccaccctttatttaataaagttaa

SEQ ID NO: 27930 - DNA, 75 bp, Artificial Sequence
  Synthetic
ggacacagaaaataatagtggctaccagggaggttctactgatgacagacagaatacttcctttgatccaaaaca

SEQ ID NO: 27931 - DNA, 75 bp, Artificial Sequence
  Synthetic
ggttcaaatgtttatagtaggatgtgttccctgtttaggggaacattgggatagagctcctgtttgtgcatcaga

SEQ ID NO: 27932 - DNA, 75 bp, Artificial Sequence
  Synthetic
agaaaataaccaagctggaaaatgtcctccattagaacttaaaaatactgtgattgaagatggagacatgtttga

SEQ ID NO: 27933 - DNA, 75 bp, Artificial Sequence
  Synthetic
tataggctttggtaatataaataacaaagtgttatcggttactaagtcagatgtcagtttagacatagtgaatga

SEQ ID NO: 27934 - DNA, 75 bp, Artificial Sequence
  Synthetic
aacctgcaaatatccagattttttaactatggccaatgatgtatatggcgatgcatgtttcttttttgcaagacg

SEQ ID NO: 27935 - DNA, 75 bp, Artificial Sequence
  Synthetic
agagcaatgttatgctagacattattttgttagaggaggtgcagtaggcgatgctattcctgacgaagctgtcaa

SEQ ID NO: 27936 - DNA, 75 bp, Artificial Sequence
  Synthetic
tcaggatcataacttttatttaccagcacaaacaggccagcaacaacgtgttttagcaaattccacatattttcc

SEQ ID NO: 27937 - DNA, 75 bp, Artificial Sequence
  Synthetic
tactgttagtggctctttagtaacttcagatgctcaattatttaacagaccgttttggttacgaagggcacaagg

SEQ ID NO: 27938 - DNA, 75 bp, Artificial Sequence
  Synthetic
ccacaacaatggaatattgtgggggaatcaaatgtttattactgttgctgataatacaagaaacactaatttcac

SEQ ID NO: 27939 - DNA, 75 bp, Artificial Sequence
  Synthetic
cataagtgttacttctgatggtagtactataactgaatataatacacaaaatattagagaatttttaaggcatgt

SEQ ID NO: 27940 - DNA, 75 bp, Artificial Sequence
  Synthetic
agaagaatatcaattagctattatattacaactatgtaaagtgcctttaaaggctgaggtattaacacagataaa

SEQ ID NO: 27941 - DNA, 75 bp, Artificial Sequence
  Synthetic
tgcaatgaatgcaggtattttagaagagtggcaactagggtttgttcccacaccagacaatgctgtgcatgatat

SEQ ID NO: 27942 - DNA, 75 bp, Artificial Sequence
  Synthetic
ttacagatatattgactctaaagctactaaatgtcctgatgcagttgctccaaaggacaaagaagacccatttgg

SEQ ID NO: 27943 - DNA, 75 bp, Artificial Sequence
  Synthetic
aaaatatacattttggaacgtagatttaacagaaaaattgtctttagatttagatcagtatcctttaggaaggaa

SEQ ID NO: 27944 - DNA, 75 bp, Artificial Sequence
  Synthetic
atttatatttcaggcaggtttacaaagacgtcccaaaaccatcagatcttctgtaaaagtttctaaaggtaccaa

SEQ ID NO: 27945 - DNA, 75 bp, Artificial Sequence
  Synthetic
ctgtaaaagtttctaaaggtaccaaacgcaaacgcacatgaccgatttcggtttctaataaacaaataaactaat

SEQ ID NO: 27946 - DNA, 75 bp, Artificial Sequence
  Synthetic
aaggtatgtgaagtattttttaccatgttcgtgactaaaccgtataggtcattgccaacaaccgcacccggttaa

SEQ ID NO: 27947 - DNA, 75 bp, Artificial Sequence
  Synthetic
tcagatataaagtgcacctggtgcgattttatcaccgcttttgtggaagcacccgaggcgcccgccagaactgct

SEQ ID NO: 27948 - DNA, 75 bp, Artificial Sequence
  Synthetic
agatataaagtgcacctggtgcgattttatcaccgcttttgtggaagcacccgaggcgcccgccagaactgctgc

SEQ ID NO: 27949 - DNA, 75 bp, Artificial Sequence
  Synthetic
agtagataccatcagcacctggagcgaccgccaagactttgccaagttggcagaacatctgctggcaagcaagtg

SEQ ID NO: 27950 - DNA, 75 bp, Artificial Sequence
  Synthetic
caccgataacggtaagaactcttaattttcaaccgtaggcgttcatttataatgcatggcaacaattgtggttaa

SEQ ID NO: 27951 - DNA, 75 bp, Artificial Sequence
  Synthetic
ttttcaaccgtaggcgttcatttataatgcatggcaacaattgtggttaacaacaatcatatgccaaaaatacat

SEQ ID NO: 27952 - DNA, 75 bp, Artificial Sequence
  Synthetic
gtcgcgaccactgacggtgcagcaacttagtgataagttgacagtacctgtagtggacctattgctaccttgcaa

SEQ ID NO: 27953 - DNA, 75 bp, Artificial Sequence
  Synthetic
attttgctatagatttctaacatatttagaattacgtgaatttgactataaacgtttgcaactgatttggacaga

SEQ ID NO: 27954 - DNA, 75 bp, Artificial Sequence
  Synthetic
agaagattttgtatttgcgtgttgcagtggttgtgcttacgcctctgcacaatatgaatatcaacaattttatca

SEQ ID NO: 27955 - DNA, 75 bp, Artificial Sequence
  Synthetic
gataactgtttatggccgtgaaattgagcaggaagagcaacgacctataggccaaatttgtgtcaggtgtcagta

SEQ ID NO: 27956 - DNA, 75 bp, Artificial Sequence
  Synthetic
gccaaatttgtgtcaggtgtcagtattgtttaaagtttcttgatttgatagaaaaattagatatctgctgtttga

SEQ ID NO: 27957 - DNA, 75 bp, Artificial Sequence
  Synthetic
atcaaccatttcacaaggttagaaatcattggaagggaaggtgcaggcattgtaaggcaatagaatgattgggaa

SEQ ID NO: 27958 - DNA, 75 bp, Artificial Sequence
  Synthetic
acaagctactcttcgtgatattgttcttgaagagcttgtccaacccattgacctgcattgccatgaggagctgct

SEQ ID NO: 27959 - DNA, 75 bp, Artificial Sequence
  Synthetic
tgaagaggtagaagaagcagtggtagaggaggagccagaatacactccttacaagatcattgtgaattgtggagg

SEQ ID NO: 27960 - DNA, 75 bp, Artificial Sequence
  Synthetic
ttgtgacacaaagctgaaactcttcgtgctagctacagattttggaatccgagcgtttcaggcatctttgctaga

SEQ ID NO: 27961 - DNA, 75 bp, Artificial Sequence
  Synthetic
aaacgtgaggctggtgtgtcctagctgtcgggaagatattcgcgatggacgacgataaaggtactgatggtccta

SEQ ID NO: 27962 - DNA, 75 bp, Artificial Sequence
  Synthetic
aagaaggatgtagttcttggtgtttattagaagctgcttgctctgatgatagtgacttagatgatagtttggaaa

SEQ ID NO: 27963 - DNA, 75 bp, Artificial Sequence
  Synthetic
agtgacttagatgatagtttggaaaaattgtttgaagatggtgcagagtcagatatatctgatttaataaatgat

SEQ ID NO: 27964 - DNA, 75 bp, Artificial Sequence
  Synthetic
gatgataatgctgctcagggaaattcccgcgaattgctatgtcaacaggagagcgaggaatgcgagcagcagatc

SEQ ID NO: 27965 - DNA, 75 bp, Artificial Sequence
  Synthetic
caatacctaaaacgaaagtatctaagtccagaagctgttcagcagcttagtccacgtctgcaatctatgaatttg

SEQ ID NO: 27966 - DNA, 75 bp, Artificial Sequence
  Synthetic
tcgcctgggcataaatctaaaaggagattatttgtggagcaagacagcggactggagttatctctaaatgaagtt

SEQ ID NO: 27967 - DNA, 75 bp, Artificial Sequence
  Synthetic
gattatttgtggagcaagacagcggactggagttatctctaaatgaagttgaagattttactcaagagttggagg

SEQ ID NO: 27968 - DNA, 75 bp, Artificial Sequence
  Synthetic
gaagattttactcaagagttggaggtaccggcgagcgctccagcgccggcagcccagggtggagtgggacatatt

SEQ ID NO: 27969 - DNA, 75 bp, Artificial Sequence
  Synthetic
gacagtttgttaagatgtaataatgtaaaagcagtattgttgcataaatttaaggaagcgtatggagtcagttat

SEQ ID NO: 27970 - DNA, 75 bp, Artificial Sequence
  Synthetic
aacgaactcaccagacaattcaaaagtaataagacatgctgcaaacattgggtattggccatatatggtgcaaaa

SEQ ID NO: 27971 - DNA, 75 bp, Artificial Sequence
  Synthetic
gaagaactaatagatgcgtctaagcaattgttacaacagcattgttcttatatttgggttcaaacatatacacca

SEQ ID NO: 27972 - DNA, 75 bp, Artificial Sequence
  Synthetic
atgtcactatatttgtgttgttttaacgttgcgaaaagtagagaaacagttataaagttaataatttcaatgctg

SEQ ID NO: 27973 - DNA, 75 bp, Artificial Sequence
  Synthetic
caaattaatgaaaataatattttatcagaacctccaaaaaatagaagcgtacctgtagctttattttggtacaaa

SEQ ID NO: 27974 - DNA, 75 bp, Artificial Sequence
  Synthetic
ggcagcatgaatccaaatgtatatgcatttggagaatatcctgaatggattgtgacacaaactatgatacagcat

SEQ ID NO: 27975 - DNA, 75 bp, Artificial Sequence
  Synthetic
caaactgctgacagtttacaatttgacttgtctcgtatgattcaatgggcctacgataatgatcatgttgatgaa

SEQ ID NO: 27976 - DNA, 75 bp, Artificial Sequence
  Synthetic
tgtagtattgcttataactatgctaaattagctgatatagatagcaatgcaagagcttttttagctcaaaacagt

SEQ ID NO: 27977 - DNA, 75 bp, Artificial Sequence
  Synthetic
caagcaaaacatgtaagagattgtgcacagatggttagacactataaaagaggtgaaatgcgagagatgtcaatc

SEQ ID NO: 27978 - DNA, 75 bp, Artificial Sequence
  Synthetic
tctgcttggattcatcattgtatatctaagatcgaaggcgatggacagtggcaagacattgttcgatttttgcga

SEQ ID NO: 27979 - DNA, 75 bp, Artificial Sequence
  Synthetic
tttcagggattgaattttatagtatttttagacaaatttcgatcatttatacaaaactttccaaagaaaaactgt

SEQ ID NO: 27980 - DNA, 75 bp, Artificial Sequence
  Synthetic
atattgatatatgggccgccagacacagggaagtcaatgtttactatgtcattaatgaaagctcttaaaggacag

SEQ ID NO: 27981 - DNA, 75 bp, Artificial Sequence
  Synthetic
gtgctatcatttgcaaattctaaaagccaattttggctgcaacctttagcagatgccaaaatagctctattggat

SEQ ID NO: 27982 - DNA, 75 bp, Artificial Sequence
  Synthetic
gacgcgacagaggtatgctggcaatacattgatatgtttttacgaaatggattggatggaaatatagtatctcta

SEQ ID NO: 27983 - DNA, 75 bp, Artificial Sequence
  Synthetic
gatatgaaacacagagcaccttgtcaaatgaaatttccaccattaataattacatctaacataagtttaaaaaaa

SEQ ID NO: 27984 - DNA, 75 bp, Artificial Sequence
  Synthetic
gaaaagaagtacccttatttgcatagtagaatttatgaatttgaatttccaaacacatttccctttgattcaaat

SEQ ID NO: 27985 - DNA, 75 bp, Artificial Sequence
  Synthetic
gataaacctttgtttaaacttactgaccaaagctgggcgtctttttttaaaaggctttggatacaattaggactc

SEQ ID NO: 27986 - DNA, 75 bp, Artificial Sequence
  Synthetic
accaaagctgggcgtctttttttaaaaggctttggatacaattaggactcagtgatcaagaagacgagggagagg

SEQ ID NO: 27987 - DNA, 75 bp, Artificial Sequence
  Synthetic
atggaagcactcagcgaacgtttcagtgcactacaagagaagttaatggacctgtatgaatcaggtttagaggat

SEQ ID NO: 27988 - DNA, 75 bp, Artificial Sequence
  Synthetic
cttgaaacacaaatactacattggaaacttttaagacaagaacagattatattttactatgcaaagaaacgtgga

SEQ ID NO: 27989 - DNA, 75 bp, Artificial Sequence
  Synthetic
atcacccgtttggggtaccagccagttccatctttagcatcatcagagactaaagcaaaagatgctatagcaatt

SEQ ID NO: 27990 - DNA, 75 bp, Artificial Sequence
  Synthetic
gggcttttgctggagagtctgcaaaagtcacaatatgcaaacgagccatggacattagtagaaactagcttggag

SEQ ID NO: 27991 - DNA, 75 bp, Artificial Sequence
  Synthetic
acaataaagagtcctccagtagattgttttaaaaaaggccctaaaactgtggaagtatattttgatggaaatcct

SEQ ID NO: 27992 - DNA, 75 bp, Artificial Sequence
  Synthetic
gcaaatgttatgccatacacagtatggtcatatatatactatcagactgatgaggacacatgggaaaaggttgaa

SEQ ID NO: 27993 - DNA, 75 bp, Artificial Sequence
  Synthetic
ggacaagtggattatacaggagcatatttttttgagggcaactttaaaaactattatataaaatttgaaaatgat

SEQ ID NO: 27994 - DNA, 75 bp, Artificial Sequence
  Synthetic
gcaaagcgctatggtactacaggaatatgggaagtgcatgttgataaagatactgtctttacccctgttactagc

SEQ ID NO: 27995 - DNA, 75 bp, Artificial Sequence
  Synthetic
tcaacgccgccagttggagacgcctccaacaacaccgttcccgaagccgtttccgcctccgtgtcctccccccaa

SEQ ID NO: 27996 - DNA, 75 bp, Artificial Sequence
  Synthetic
cggtcaccatccaccaaccgccgatacggccgaaaagcgtctagccctacaaccacctccaggaggcaaaaaagg

SEQ ID NO: 27997 - DNA, 75 bp, Artificial Sequence
  Synthetic
caaagagaagaaaccaggcgaagaaaaaccagatcaaggtcccgaagcagagagcaacggggagggagggaaacc

SEQ ID NO: 27998 - DNA, 75 bp, Artificial Sequence
  Synthetic
agacgatcctcctccagaggatcctcaaaatcccccaggcggggagggaacggtggaggggggcccctcacccgg

SEQ ID NO: 27999 - DNA, 75 bp, Artificial Sequence
  Synthetic
caaaatcccccaggcggggagggaacggtggaggggggcccctcacccggtcacggtcccgatcccgaacccgaa

SEQ ID NO: 28000 - DNA, 75 bp, Artificial Sequence
  Synthetic
tcacggtcccgatcccgaacccgaaaagaatctgttggagggggtggcgttgcgcctagtgaagtgggagcaaca

SEQ ID NO: 28001 - DNA, 75 bp, Artificial Sequence
  Synthetic
aagaatctgttggagggggtggcgttgcgcctagtgaagtgggagcaacagttcgatcacttagtagacacaata

SEQ ID NO: 28002 - DNA, 75 bp, Artificial Sequence
  Synthetic
gtggtcgacttgcgcaattattggatgcagctaaagaccccccagtaatcctactacgcggtaatgctaatacct

SEQ ID NO: 28003 - DNA, 75 bp, Artificial Sequence
  Synthetic
taaagtgctatcgctggagatttagaaagaagcatgctggcacctttcgctttgttagtacaacgtggtcgtggg

SEQ ID NO: 28004 - DNA, 75 bp, Artificial Sequence
  Synthetic
ttgggggtaattctaatgacagaatagggcgtgctaggatgctaatagcatttgatactgatcttgaaagagata

SEQ ID NO: 28005 - DNA, 75 bp, Artificial Sequence
  Synthetic
aatgtattcaacaaatgaaattacctttaggtgtagattggtcctatgggcagtttgatgatttatgatatgctt

SEQ ID NO: 28006 - DNA, 75 bp, Artificial Sequence
  Synthetic
ttctatttaacacactaacattgcctataactaattttatactaacttatattgctactaacacaatggtgcggg

SEQ ID NO: 28007 - DNA, 75 bp, Artificial Sequence
  Synthetic
cgcaaagaactaagcgagcgtctgttactgatatctacagaggctgtaaagcctctgggacatgtcctcctgatg

SEQ ID NO: 28008 - DNA, 75 bp, Artificial Sequence
  Synthetic
ttattaataaagtggagcaaaatacacttgctgataaaatactaaaatatggcagtgttggtgtgttttttggtg

SEQ ID NO: 28009 - DNA, 75 bp, Artificial Sequence
  Synthetic
gacttggaataggtactggtaagggtaccggtggagccacaggctatgtcccattaagacctggagtcagagtgg

SEQ ID NO: 28010 - DNA, 75 bp, Artificial Sequence
  Synthetic
taccggtggagccacaggctatgtcccattaagacctggagtcagagtgggtggtactcctacagtggtccgccc

SEQ ID NO: 28011 - DNA, 75 bp, Artificial Sequence
  Synthetic
tgcagtcatacctgaaataattggtccaactgaattaataccagttgactcaatagcaccaattgaccccgaagc

SEQ ID NO: 28012 - DNA, 75 bp, Artificial Sequence
  Synthetic
ccaactgaattaataccagttgactcaatagcaccaattgaccccgaagcaccatcaatagtctcattaacagat

SEQ ID NO: 28013 - DNA, 75 bp, Artificial Sequence
  Synthetic
accatcaatagtctcattaacagatagcaatgcagctgctgaccttttccccactgaggtagaaactattgcaga

SEQ ID NO: 28014 - DNA, 75 bp, Artificial Sequence
  Synthetic
agtacatccggtccctgtggatgtaggtatagatacacctattgtagctggaggtcgcgacgccattttggaagt

SEQ ID NO: 28015 - DNA, 75 bp, Artificial Sequence
  Synthetic
tgagtccacgccaataacaggagaggcatctcttgctgaccatgttttagtgtttgaaggatccggaggtcagca

SEQ ID NO: 28016 - DNA, 75 bp, Artificial Sequence
  Synthetic
agtaggtgcagcaacagaagacatagaattagatacatttccctcaaggtattctttcgaaattgaggaggctac

SEQ ID NO: 28017 - DNA, 75 bp, Artificial Sequence
  Synthetic
accaccacgtaaaatcagcacacctattgaaaggataagtcaagaattcaggaatttacgtagagcactatataa

SEQ ID NO: 28018 - DNA, 75 bp, Artificial Sequence
  Synthetic
taggagattaactgaacaggtacaaataaagaaccctttatttttaaccaccccatctcgactggtgcgtttcca

SEQ ID NO: 28019 - DNA, 75 bp, Artificial Sequence
  Synthetic
gtttgataatcctgcgtttgatgaggaagttacacagattttcgaaagagatgttgctgcagtagaggaacctcc

SEQ ID NO: 28020 - DNA, 75 bp, Artificial Sequence
  Synthetic
agatagagattttttagatattgaacgcttaggaaggcctctttttacagaatctgcagaaggtcgtgttcgagt

SEQ ID NO: 28021 - DNA, 75 bp, Artificial Sequence
  Synthetic
aagtagattaggacaacgtgccactattgaaacacgtagtggagcacgtattggctcccgtgtacatttttacac

SEQ ID NO: 28022 - DNA, 75 bp, Artificial Sequence
  Synthetic
agatttaagtacaattaacacagaagaatctttagaattgcagttactgggtgagcattctggggatgcctcaat

SEQ ID NO: 28023 - DNA, 75 bp, Artificial Sequence
  Synthetic
aattcaagaaccatttgaaagtacagtgatagatatgaatatggacaatcttgaagatattgcagacactttgga

SEQ ID NO: 28024 - DNA, 75 bp, Artificial Sequence
  Synthetic
ttgaagatattgcagacactttggacagtgcttctgattacaattctgcagatttgttgctagatcatgcaattg

SEQ ID NO: 28025 - DNA, 75 bp, Artificial Sequence
  Synthetic
aagaatttaataactctcagttagtatttgactcttctactgggcctacaacttcatacactgtaccaaggtttg

SEQ ID NO: 28026 - DNA, 75 bp, Artificial Sequence
  Synthetic
agtctccaagggaaacaattgtctatgtgcaagatattgaaggcaatcacgtagtgtatcctgaacccactgaaa

SEQ ID NO: 28027 - DNA, 75 bp, Artificial Sequence
  Synthetic
ggcctgcaataatatttccagcacctaatattcctgcggtaattgtacacataatagacacgtcttttgactatt

SEQ ID NO: 28028 - DNA, 75 bp, Artificial Sequence
  Synthetic
acttacatcccagtttaagaaccaaaaggcgcaaacgcaaatatttataatgtttttcagatgaccctctggctg

SEQ ID NO: 28029 - DNA, 75 bp, Artificial Sequence
  Synthetic
ccaacatctggtaagatttatttaccacctacaccacctgtggcccgagtgcaaagtacggatgaatatgtggaa

SEQ ID NO: 28030 - DNA, 75 bp, Artificial Sequence
  Synthetic
agaactgacatctattatcatgcaactagtgatcgattactaactgtaggccatccatattttgatgtaagatca

SEQ ID NO: 28031 - DNA, 75 bp, Artificial Sequence
  Synthetic
caagatggcgccaaaattgatgtgcctaaagtttcaggaaatcaatacagagcctttagggtaacatttccagat

SEQ ID NO: 28032 - DNA, 75 bp, Artificial Sequence
  Synthetic
cctaataaatttgcactaggagacatgacagtacatgatcctgataagtacagattagtatgggcttgcaagggt

SEQ ID NO: 28033 - DNA, 75 bp, Artificial Sequence
  Synthetic
ctggaaattggtcgaggtcaacctttaggaataggcagtacaggccacccactatttaacaggctacgtgattct

SEQ ID NO: 28034 - DNA, 75 bp, Artificial Sequence
  Synthetic
gaaaatcctagtgaacggcaggaaggcacaccagatgacagacaaaatgtttcatttgatcccaaacaagtacaa

SEQ ID NO: 28035 - DNA, 75 bp, Artificial Sequence
  Synthetic
atgtttataataggatgtacaccatgtgtaggggaatactgggatacagcccctgtatgtaaggatgcaggtagt

SEQ ID NO: 28036 - DNA, 75 bp, Artificial Sequence
  Synthetic
caattgggcttatgtcctcctctggaattaaaaaacagtgttatagaggatggggacatgtttgatataggtttt

SEQ ID NO: 28037 - DNA, 75 bp, Artificial Sequence
  Synthetic
ggtaatattaacaataaaactctatcttataataagtctgatgtaagtttagacattgttaatgaagtatgcaaa

SEQ ID NO: 28038 - DNA, 75 bp, Artificial Sequence
  Synthetic
tatccagattttttaacaatgtctaatgatgtgtatggagacgcatgctttttctgtgcccgaagagagcaatgt

SEQ ID NO: 28039 - DNA, 75 bp, Artificial Sequence
  Synthetic
tatgctagacattattttgttcggggaggtcaggttggagatgcaatacctgacgaggcagtccaacaagatcac

SEQ ID NO: 28040 - DNA, 75 bp, Artificial Sequence
  Synthetic
aaatattatttaccttctgatacacgacgcactttagaaaactccacctattttcccaccgtaagcgggtcgttg

SEQ ID NO: 28041 - DNA, 75 bp, Artificial Sequence
  Synthetic
gtgacctctgatgcccaactatttaataggcccttttggttaaaacgtgcacaaggacataataatggcatatta

SEQ ID NO: 28042 - DNA, 75 bp, Artificial Sequence
  Synthetic
tggaataaccaaatttttgtaactgtagcagataatacacgcaatactaattttagtatcagtgttaaaagtgag

SEQ ID NO: 28043 - DNA, 75 bp, Artificial Sequence
  Synthetic
gatagcttagcaaattataatgctagtaatattagagaatatatgagacatgttgaagagtatcagttgtctttt

SEQ ID NO: 28044 - DNA, 75 bp, Artificial Sequence
  Synthetic
atattacaattgtgcagaatacctttaaaggctgaagttttaacacaaatcaatgcaatgaactctgatatttta

SEQ ID NO: 28045 - DNA, 75 bp, Artificial Sequence
  Synthetic
gagaattggcaattgggctttgtacctacaccagataatgcagtacacgatacatataggtatttagcctcaaag

SEQ ID NO: 28046 - DNA, 75 bp, Artificial Sequence
  Synthetic
gccactaagtgtcctgatgcagtacctgaaacccaaaaagaggatccttttggaaagtattcattctggaatgtt

SEQ ID NO: 28047 - DNA, 75 bp, Artificial Sequence
  Synthetic
gatatgaaagaaaaattgtcgctggatttagatcagtatcctttgggccgtaaatttctgtttcaaattgggtta

SEQ ID NO: 28048 - DNA, 75 bp, Artificial Sequence
  Synthetic
cagcgtgttaggtccggtattaaacgacctgcacctaagaaagtgaccaaaactgtgaaaaaaagaagagtgcaa

SEQ ID NO: 28049 - DNA, 75 bp, Artificial Sequence
  Synthetic
ttgtaaccgttttcggtcgcctcaataaaaatatattaactaatctggtatgtgaagtattttttgaccacgatt

SEQ ID NO: 28050 - DNA, 75 bp, Artificial Sequence
  Synthetic
gtgactaaaccgaacaagtcaacaccggcaaccgcacccgtttttctcattataaattcctcgaggtaagattag

SEQ ID NO: 28051 - DNA, 75 bp, Artificial Sequence
  Synthetic
ctaaaccgaacaagtcaacaccggcaaccgcacccgtttttctcattataaattcctcgaggtaagattagcatc

SEQ ID NO: 28052 - DNA, 75 bp, Artificial Sequence
  Synthetic
tagatcgtttctgtgattgtggttaacaacaatcattatacagaattacatgtgaccgcttgcgttttcacttac

SEQ ID NO: 28053 - DNA, 75 bp, Artificial Sequence
  Synthetic
atatatacataaatatacacccttgtatgtatttaacagagcagagctcaatggataggccaaagcctaagactg

SEQ ID NO: 28054 - DNA, 75 bp, Artificial Sequence
  Synthetic
taaaggaacttgcagacactttagcgattcctgtaatagatttattattaccttgcaacttctgcaatagatttt

SEQ ID NO: 28055 - DNA, 75 bp, Artificial Sequence
  Synthetic
tatcttattttgaattactaagttttgattacaagaacttacaactaatttggactgtggaggatttagtctatg

SEQ ID NO: 28056 - DNA, 75 bp, Artificial Sequence
  Synthetic
ctttatgtagcagttgtgcttatgcttcagcacaatttgaatttattcagtattttcaattttcagttgaaggga

SEQ ID NO: 28057 - DNA, 75 bp, Artificial Sequence
  Synthetic
aacaaatagaaagtgtagaacgcaaacctattggtgatattattattaggtgtcagtattgtttaaagaagttag

SEQ ID NO: 28058 - DNA, 75 bp, Artificial Sequence
  Synthetic
atttagtggagaagttaggagtttgctacaaacagcaacagcttcataaagtaagggagaattggaaaggattgt

SEQ ID NO: 28059 - DNA, 75 bp, Artificial Sequence
  Synthetic
ctacaaacagcaacagcttcataaagtaagggagaattggaaaggattgtgtagacattgtgggtcgatagaatg

SEQ ID NO: 28060 - DNA, 75 bp, Artificial Sequence
  Synthetic
tgtccaacccactgacctgcattgctacgaagagttgacagaagagcctgcagaggaggagcagtgcctcgctcc

SEQ ID NO: 28061 - DNA, 75 bp, Artificial Sequence
  Synthetic
ttacaagattgtagttgcttgcaattgtggtgtgaggcttcggctgtacgtttttgccacagaccttggaataag

SEQ ID NO: 28062 - DNA, 75 bp, Artificial Sequence
  Synthetic
agctcaacaagaacttctactcggtgaagtacaacttgtgtgtcctgagtgtcgtgagaagcttcgacatgagtg

SEQ ID NO: 28063 - DNA, 75 bp, Artificial Sequence
  Synthetic
atgataaaggtactaaatatgatgctaaagaaggatgtagtgaatggttttcgttagaagcagagtgctctgatt

SEQ ID NO: 28064 - DNA, 75 bp, Artificial Sequence
  Synthetic
ctagcttagatggtgatttggaaaaactgtttgacgaagggacagactctgatatttctgacttaatagatgatg

SEQ ID NO: 28065 - DNA, 75 bp, Artificial Sequence
  Synthetic
gagatgctattcagggaaactcccgcgaactgttttgccagcaagagagtgaggaaagcgaacagcaaacacaat

SEQ ID NO: 28066 - DNA, 75 bp, Artificial Sequence
  Synthetic
cgaactgttttgccagcaagagagtgaggaaagcgaacagcaaacacaattgctaaaacgaaagtatatcagtcc

SEQ ID NO: 28067 - DNA, 75 bp, Artificial Sequence
  Synthetic
cgactggagtctatctctttgtcgccacagcataaaactaaaaggagattatttgaacaaggcagcggactagag

SEQ ID NO: 28068 - DNA, 75 bp, Artificial Sequence
  Synthetic
agttcaataaatgaagctgaagatctttctcaaacacaggtggaagaggtaccagccattgttccaccaacaaca

SEQ ID NO: 28069 - DNA, 75 bp, Artificial Sequence
  Synthetic
gctcagggaactaagggtttgggacttgtggaagacttacttaaagccaataatgcaaaagctgttttaatggct

SEQ ID NO: 28070 - DNA, 75 bp, Artificial Sequence
  Synthetic
aaatttaaagaatcatttggtgttgggtttgcggaacttactagaacatataaaagcaataaaacatgttgcaaa

SEQ ID NO: 28071 - DNA, 75 bp, Artificial Sequence
  Synthetic
gattgggtaataagtgcatatgcagttaatgatgatcttatagaaagttctaagcaattgttagtacagcattgt

SEQ ID NO: 28072 - DNA, 75 bp, Artificial Sequence
  Synthetic
atttatatttggctacagcagatgcctcctatgtgtttatatttactatgctttaatgttgggaaaagtagagat

SEQ ID NO: 28073 - DNA, 75 bp, Artificial Sequence
  Synthetic
actgtgatgagactgttaagtacgttgttgcaagtagcagatgtgcaggtattggcagatcctcctaaattgcga

SEQ ID NO: 28074 - DNA, 75 bp, Artificial Sequence
  Synthetic
agtgtattggctgctttattttggtataaaggcagcatgaatcctaatgtatatgctcatggcacctatccagat

SEQ ID NO: 28075 - DNA, 75 bp, Artificial Sequence
  Synthetic
tggatacttgctcaaactatgataaaccatcaaaatgcggacgccacacagtttgacttatctactatgattcaa

SEQ ID NO: 28076 - DNA, 75 bp, Artificial Sequence
  Synthetic
tttgcttatgataatgagtttattgatgaagctgtgattgcctatcagtatgctaaattagctgaaacggactct

SEQ ID NO: 28077 - DNA, 75 bp, Artificial Sequence
  Synthetic
aatgccagagcctttttgcaaagtaacagtcaagcacgcattgtaagagagtgtgctactatggtaaggcattat

SEQ ID NO: 28078 - DNA, 75 bp, Artificial Sequence
  Synthetic
atgagaggtgaaatgaaggaaatgagcatttcaacatggatacatagaaagttattatctgttgaaggggaaggt

SEQ ID NO: 28079 - DNA, 75 bp, Artificial Sequence
  Synthetic
cattggtctcatattgtgaaatttatacgttatcaagggataaattttatagaatttctatctgcatttaacagc

SEQ ID NO: 28080 - DNA, 75 bp, Artificial Sequence
  Synthetic
tttttgcataataaacctaaacaaaattgcttattatttcatggtcctcctgatactggtaaatcaatgtttaca

SEQ ID NO: 28081 - DNA, 75 bp, Artificial Sequence
  Synthetic
atgtctcttattaatgttctgaaaggtaaagtactctcatttgcaaattgtaaaagtacattttggttgcaacca

SEQ ID NO: 28082 - DNA, 75 bp, Artificial Sequence
  Synthetic
ataattgacactaaaattgctttaattgacgatgtgacagaagtctgttgggattatatagatcaatatcttcga

SEQ ID NO: 28083 - DNA, 75 bp, Artificial Sequence
  Synthetic
aatggattagatggtacctatgtgtgtatagatgtaaaacatagagctccctgtcaagtcaaatttcccccatta

SEQ ID NO: 28084 - DNA, 75 bp, Artificial Sequence
  Synthetic
ttactaacatctaatacagatatttccaaagacacaaagtataagtatttgtatagtagaattaaaagctttgcc

SEQ ID NO: 28085 - DNA, 75 bp, Artificial Sequence
  Synthetic
tttactaacaaatttccctttgatgctgatcataatccacaatttcaacttactgaccaaagctggaaatctttt

SEQ ID NO: 28086 - DNA, 75 bp, Artificial Sequence
  Synthetic
tttgcaaggctttggacacagttagaactcagtgatcaagaagacgagggagaggatggaaacactcagcgaacg

SEQ ID NO: 28087 - DNA, 75 bp, Artificial Sequence
  Synthetic
tttcagtgcactgcaagagactttaatggacctgtatgaatcaggtcgtgaggatctacagagtcagattgatca

SEQ ID NO: 28088 - DNA, 75 bp, Artificial Sequence
  Synthetic
ctggcaagcattgagacaagagcaaattttattacactttgctcgaaaacatggagtcttgcgattaggttacca

SEQ ID NO: 28089 - DNA, 75 bp, Artificial Sequence
  Synthetic
acctgtgcctcctttagctaccagtgaaagcaaggctaaagatgctattggcatggttatactgttacaaagtct

SEQ ID NO: 28090 - DNA, 75 bp, Artificial Sequence
  Synthetic
gcaaaaatctaaatatggccaggaaccatggactcttttacaaactagtctggaggctgttcgcagtcctcctgc

SEQ ID NO: 28091 - DNA, 75 bp, Artificial Sequence
  Synthetic
aaactgctttaaaaaaggccctcaaaatattgaagtgatatttgatggagatccaggaaacctaatgagctatac

SEQ ID NO: 28092 - DNA, 75 bp, Artificial Sequence
  Synthetic
agtttggaaacatatatattatcaaacactgaatgactcttgggaaaaagtagaaggtcaagtggactattttgg

SEQ ID NO: 28093 - DNA, 75 bp, Artificial Sequence
  Synthetic
agccttttactatgaagggactcttaaaacatattatattgattttgaaactgaggctgccagatatggcactac

SEQ ID NO: 28094 - DNA, 75 bp, Artificial Sequence
  Synthetic
tggcaaatgggaagtacatgttaacaagaatgttgtgtttgcccctattactagttcttcgccacctgctggaga

SEQ ID NO: 28095 - DNA, 75 bp, Artificial Sequence
  Synthetic
cggggccggtggagaggcctccagcaacaccacatccaggtcggaatcacatccggtcgtcacagcctccacctt

SEQ ID NO: 28096 - DNA, 75 bp, Artificial Sequence
  Synthetic
gtcctcccagcaacggccactcaccacaacatcccgacgataccgaagaaaagcctctagccccaccgccgcgcg

SEQ ID NO: 28097 - DNA, 75 bp, Artificial Sequence
  Synthetic
gcaaaaaagacaaagacaaaaagccattacaaggagatcaaggtccagatccaggggtcgaacagaaaccacaag

SEQ ID NO: 28098 - DNA, 75 bp, Artificial Sequence
  Synthetic
gggagggagaggtggaagggcatcctccgcagactccgacagctccaccaccgggaggggaaggggaagtggaag

SEQ ID NO: 28099 - DNA, 75 bp, Artificial Sequence
  Synthetic
gcggcccacaacaaggtcccaatcccggtcccagtcccgctcccgctcccgctcccgctcccgatcccgatcaca

SEQ ID NO: 28100 - DNA, 75 bp, Artificial Sequence
  Synthetic
atctagatcaggaagggttgcttccagcagtggcatttcgcctgctgaggtgggaacgggagttcgatcagttgg

SEQ ID NO: 28101 - DNA, 75 bp, Artificial Sequence
  Synthetic
tcaaggacatcacggaagacttgcacggttattggcagaggctaaggaccccccagtaattatcttgcgtggaga

SEQ ID NO: 28102 - DNA, 75 bp, Artificial Sequence
  Synthetic
tgctaatgtgctgaaatgctatcgctatagagctcgcaaaaagcatcagggcttagttaaatattacagtactac

SEQ ID NO: 28103 - DNA, 75 bp, Artificial Sequence
  Synthetic
atggtcatgggtaggcggtgactgctgtgatagggtaggcagatcaagaatgcttttagcttttgacacaaataa

SEQ ID NO: 28104 - DNA, 75 bp, Artificial Sequence
  Synthetic
acatagggaacagtttatatcaactatgaaattaccaccaaaggttgattggtcctttggcaatctagatgaatt

SEQ ID NO: 28105 - DNA, 75 bp, Artificial Sequence
  Synthetic
ataacacatactaacttttgcattgctactaacatactaacttcattatggttcaggcaaagcgtgtaaaacgtg

SEQ ID NO: 28106 - DNA, 75 bp, Artificial Sequence
  Synthetic
cttctgtcactgacatatataaaggctgcaaagcagctggaacatgccctccagatgtacttaataaagtggaac

SEQ ID NO: 28107 - DNA, 75 bp, Artificial Sequence
  Synthetic
aaactacaatagcagatcaaattttgaagtttggaagtgctggtgttttttttggtgggttgggaataagcacag

SEQ ID NO: 28108 - DNA, 75 bp, Artificial Sequence
  Synthetic
ggcgcggcactggtggtgctactggatatgttcctttgggtgaaggcccaggagtgcgcataggcggtactccca

SEQ ID NO: 28109 - DNA, 75 bp, Artificial Sequence
  Synthetic
ctgtggttcgccctggggtcataccagaggtaatcggccctgcagagttaataccaatagatacagtcagaccca

SEQ ID NO: 28110 - DNA, 75 bp, Artificial Sequence
  Synthetic
ttgaccccacagcaccaagtattgtcacaggcgctgacagcaccattgaccttttacctggtgaaatagaatcta

SEQ ID NO: 28111 - DNA, 75 bp, Artificial Sequence
  Synthetic
ttgctgagatacacccagttcctattgacaatgtagaaattgatacacctgttgttactggaggccgtggatctt

SEQ ID NO: 28112 - DNA, 75 bp, Artificial Sequence
  Synthetic
cagccattttagaagtagctgatccaagtccccctgtcagaacccgtgtaacacgaactcaataccataatcctt

SEQ ID NO: 28113 - DNA, 75 bp, Artificial Sequence
  Synthetic
cttttcaaatcatttctgagtcaactccaacaagtggagagtcatctttagcagatcacataatagtttttgaag

SEQ ID NO: 28114 - DNA, 75 bp, Artificial Sequence
  Synthetic
gctctggaggtcaattggttggtggcgctagggagccttcaattgcaacagaaagtattgaactgcaagaatttc

SEQ ID NO: 28115 - DNA, 75 bp, Artificial Sequence
  Synthetic
catctcgctacagttttgaaattgaggaaggcactccaccacggactagcacaccagtgcaacgtgcagtgcagt

SEQ ID NO: 28116 - DNA, 75 bp, Artificial Sequence
  Synthetic
ctcttggtagtttaagaagagctttatataatagacggttgacagaacaggtagcagttacagatcctttgtttt

SEQ ID NO: 28117 - DNA, 75 bp, Artificial Sequence
  Synthetic
tgaccagaccctcacgcctagtgcagtttcaatttgataatccagcatttgaagaaaaagtaactcaaatatttg

SEQ ID NO: 28118 - DNA, 75 bp, Artificial Sequence
  Synthetic
aaagagatcttaatgagtttgaggaacctccagatagacaatttttagatgtagctagattaggaaggcctacat

SEQ ID NO: 28119 - DNA, 75 bp, Artificial Sequence
  Synthetic
atactgaaacacctcaaggatatgttagagtcagcagattaggccgcagagctactattcgcacacgtagtggtg

SEQ ID NO: 28120 - DNA, 75 bp, Artificial Sequence
  Synthetic
cccaagttggaacacaggttcatttttatagagatattagtagtattaatgctgaagcaccaatagaaatggaat

SEQ ID NO: 28121 - DNA, 75 bp, Artificial Sequence
  Synthetic
tattgggagagcactcaggagatactactattatacaaggacctgtggaaagctctttaatagatgttaacatag

SEQ ID NO: 28122 - DNA, 75 bp, Artificial Sequence
  Synthetic
atgagcctgatgtgttacatgtgggtagaatagaaacccccactatagaagaagaggaagacatagattttaatt

SEQ ID NO: 28123 - DNA, 75 bp, Artificial Sequence
  Synthetic
ctgaagatttactattagatgacaatgttgaagactttagtggctctcaattggttgtaggaaccaggcgcagca

SEQ ID NO: 28124 - DNA, 75 bp, Artificial Sequence
  Synthetic
ttaatacattaacagttccacgctttgaaactcctagaaacactagtttttatctacaagatatacaaggttaca

SEQ ID NO: 28125 - DNA, 75 bp, Artificial Sequence
  Synthetic
ctgtggcctatccagaatcacgtgacactacaaatattgtatttccacatcctgaagctccttcagttgtctttc

SEQ ID NO: 28126 - DNA, 75 bp, Artificial Sequence
  Synthetic
atatcactgatacttctggtgatttttatttacatcccagcctacgaaaacgaaaacgaaaacgcaaatatttat

SEQ ID NO: 28127 - DNA, 75 bp, Artificial Sequence
  Synthetic
aattgttttacagatgtcattgtggctgccaacaaccggtaaggtatatttgccaccatctactccagtggctcg

SEQ ID NO: 28128 - DNA, 75 bp, Artificial Sequence
  Synthetic
agtacaaagcaccgatgaatatgtggaaagaaccaatatattttatcatgcagttagtgaccgcctcctaacagt

SEQ ID NO: 28129 - DNA, 75 bp, Artificial Sequence
  Synthetic
agggcatccatattttgatgtacgctccacggatgggcaacgcattgaaattcctaaggtctcagggaatcagta

SEQ ID NO: 28130 - DNA, 75 bp, Artificial Sequence
  Synthetic
tagagcatttcgtttaacattgccagatccaaatcggtttgcattagctgatatgtctgtatacaatcctgagaa

SEQ ID NO: 28131 - DNA, 75 bp, Artificial Sequence
  Synthetic
agagaggttagtatggggttgtaaaggaatagaaataggaagaggtcaaccattaggtgttggtacatcaggaca

SEQ ID NO: 28132 - DNA, 75 bp, Artificial Sequence
  Synthetic
tccattattcaataaagtcagagatactgaaaactcaggcaactatcaacccgtctcacaagatgatagacaaaa

SEQ ID NO: 28133 - DNA, 75 bp, Artificial Sequence
  Synthetic
cacatcatttgaccctaaacaggtgcaaatgtttattataggttgtgtgccttgtatgggtgaacactgggataa

SEQ ID NO: 28134 - DNA, 75 bp, Artificial Sequence
  Synthetic
ggcaaaagtatgtgactctgaagcaggcaaccagcagggtaaatgcccacctattgaacttaaaaatactgtaat

SEQ ID NO: 28135 - DNA, 75 bp, Artificial Sequence
  Synthetic
agaagatggtgacatgtttgatataggctttggcaatataaacaataaggaattatcctttaataaatcagatgt

SEQ ID NO: 28136 - DNA, 75 bp, Artificial Sequence
  Synthetic
tagtttagatattgttaatgaagtctgtaagtatccagacttcttaacaatggctaatgatgtttatggagatgc

SEQ ID NO: 28137 - DNA, 75 bp, Artificial Sequence
  Synthetic
ctgcttcctttttgctaggcgagagcaatgttatgccagacactattttgttagaggaggcaatgtaggggatgc

SEQ ID NO: 28138 - DNA, 75 bp, Artificial Sequence
  Synthetic
tatcccggatggagcagtacagcaaaatcataattactacttaccagcacaaaacaatcaacagcagtacacact

SEQ ID NO: 28139 - DNA, 75 bp, Artificial Sequence
  Synthetic
aggtaactccatttattatccaactgtcagtggatctttagttacatctgatgcacaattatttaacagaccatt

SEQ ID NO: 28140 - DNA, 75 bp, Artificial Sequence
  Synthetic
ttggttacaacgtgctcagggccataataatggcatattatggggaaatcaaatgtttgtgacagtagcagataa

SEQ ID NO: 28141 - DNA, 75 bp, Artificial Sequence
  Synthetic
cactagaaataccaactttactattagtgtaacaacagaaaatccaggggcacaagaatataatgctactaatat

SEQ ID NO: 28142 - DNA, 75 bp, Artificial Sequence
  Synthetic
aagagaatatttacgacatgtagaggagtatcaaatatcattaatcttacaattgtgcaaggttcccttaacttc

SEQ ID NO: 28143 - DNA, 75 bp, Artificial Sequence
  Synthetic
agaagtactatcacaaattaatgccatgaactctggtattttagaagaatggcaactagggtttgtgccaacccc

SEQ ID NO: 28144 - DNA, 75 bp, Artificial Sequence
  Synthetic
agacaatgctgttcatgatatgtatagatatattaattctaaagcaactaaatgtcctgatgctgtagaacctac

SEQ ID NO: 28145 - DNA, 75 bp, Artificial Sequence
  Synthetic
agaaagagaggatccatttgctaaatatactttttggaatgttgatttatctgaaaaattatccttagacttaga

SEQ ID NO: 28146 - DNA, 75 bp, Artificial Sequence
  Synthetic
ccaatatcccttgggacgcaaatttttatttcaagctggattacaaacgcgaaaacgctctttgaaaccttcttc

SEQ ID NO: 28147 - DNA, 75 bp, Artificial Sequence
  Synthetic
tgttaaacccactaaatctgcaaaacgcaggcgcaagtgaccgattccggtcttcaataaaatgtaagtaatcct

SEQ ID NO: 28148 - DNA, 75 bp, Artificial Sequence
  Synthetic
tattggtatgtgaagcattttttaaccatcttcgtgactaaaccgtgcaagtcaacacagggcaaccgcgcccgt

SEQ ID NO: 28149 - DNA, 75 bp, Artificial Sequence
  Synthetic
tttatctgactataaatcgcaccaggtgcacttttaaacaatactatcgcggaatcaccgaaggcgcccgccact

SEQ ID NO: 28150 - DNA, 75 bp, Artificial Sequence
  Synthetic
ttgactgccaagattaacttggctgaacaccgaattggcttcaacaacgaccgataacggtaagtttttggctcg

SEQ ID NO: 28151 - DNA, 75 bp, Artificial Sequence
  Synthetic
attaacttggctgaacaccgaattggcttcaacaacgaccgataacggtaagtttttggctcgtaggtggttgga

SEQ ID NO: 28152 - DNA, 75 bp, Artificial Sequence
  Synthetic
catctttggcagacgaagtgcaccgataacggtaagacttttctcttttaaccgtaggcgttggtttattattcc

SEQ ID NO: 28153 - DNA, 75 bp, Artificial Sequence
  Synthetic
gcttgtggtagtaaaatgaattaaaaaaaaaaacaaggatatatttaaggggcctgtaagcttgggatgtattca

SEQ ID NO: 28154 - DNA, 75 bp, Artificial Sequence
  Synthetic
cctgtagattctgcaacagtttcctcacgtacattgaattacgtgagtttgattacaagaacttacagttaatct

SEQ ID NO: 28155 - DNA, 75 bp, Artificial Sequence
  Synthetic
tctgctcaatatgaatgtcagcagttttatgaattaactgtctttggccgtgaaattgaacaggtggagcaacag

SEQ ID NO: 28156 - DNA, 75 bp, Artificial Sequence
  Synthetic
accgacgctgggattcggaatctgcaagattgtttgctgggcgacgtaaggcttctgtgtcccacctgtcgagaa

SEQ ID NO: 28157 - DNA, 75 bp, Artificial Sequence
  Synthetic
aagtgtttcagtccgaaagctgttcaggagcttagtcctcgtctgcagtctatgaatatatcttcagagcataaa

SEQ ID NO: 28158 - DNA, 75 bp, Artificial Sequence
  Synthetic
gttattttggtataaaggaagtttgaatagtaatgtgttttgttttggtgaagctcctgattggattctatcaca

SEQ ID NO: 28159 - DNA, 75 bp, Artificial Sequence
  Synthetic
aacaatgatacagcatcaaactgctgacactttgcagtttgacttgtctcgaatgattcaatgggcctatgataa

SEQ ID NO: 28160 - DNA, 75 bp, Artificial Sequence
  Synthetic
tgatcatatagacgaaagcattatagcttatcaatatgctaaattagcagatattgatagtaatgctaaagcttt

SEQ ID NO: 28161 - DNA, 75 bp, Artificial Sequence
  Synthetic
gaaagaaatgtctatttctgcttggattcatcactgcatatctaaagttgaaggagaaggcaattggcagcatat

SEQ ID NO: 28162 - DNA, 75 bp, Artificial Sequence
  Synthetic
tgttaggtttattagataccaaaatttgaattttattatgtttctagataagtttcggacctttttaaaaaatct

SEQ ID NO: 28163 - DNA, 75 bp, Artificial Sequence
  Synthetic
gccaaaaaaaaattgtttattaatatatggtcctcctgacacaggaaagtctatgtttgcaatgtcacttattaa

SEQ ID NO: 28164 - DNA, 75 bp, Artificial Sequence
  Synthetic
actattgaaaggtagtgtagtatcttttgctaattcgaaaagtcaattttggttacagccactagctgatgggaa

SEQ ID NO: 28165 - DNA, 75 bp, Artificial Sequence
  Synthetic
aattggtttattggatgatgcaactgatgtgtgttggcagtatatagattcttttcttagaaatggtttagatgg

SEQ ID NO: 28166 - DNA, 75 bp, Artificial Sequence
  Synthetic
cataaagcaccttgtcaaatgaaatttcctccattaattattacttccaatattaatttattaaaagaggaacga

SEQ ID NO: 28167 - DNA, 75 bp, Artificial Sequence
  Synthetic
tgcaaggagacatggtgttactcgattgggctatcaacctgtaccttctttggcaagttcagaagccaaagcaaa

SEQ ID NO: 28168 - DNA, 75 bp, Artificial Sequence
  Synthetic
agatgccatttctatggtccttttacttgaaagcctgaaaaaatccaaatatgcagatgaacaatggacattagc

SEQ ID NO: 28169 - DNA, 75 bp, Artificial Sequence
  Synthetic
cttgaaagcctgaaaaaatccaaatatgcagatgaacaatggacattagctcaaactagcctggaggctgttcgc

SEQ ID NO: 28170 - DNA, 75 bp, Artificial Sequence
  Synthetic
agccctcctgcagactgttttaaaaaaggacctaaaaatattgaagttgtatttgatggtgaccctgaaaatctt

SEQ ID NO: 28171 - DNA, 75 bp, Artificial Sequence
  Synthetic
atttgatggtgaccctgaaaatcttatgtcatatactgtgtggacatatatatattacctgacagatgaggacat

SEQ ID NO: 28172 - DNA, 75 bp, Artificial Sequence
  Synthetic
gattatacaggagcctattattatgagggcaaattaaaggtgtattatttaaaatttgaaaatgatgctaaacga

SEQ ID NO: 28173 - DNA, 75 bp, Artificial Sequence
  Synthetic
tatggtgtcacaggattatgggaagtacatgttaataaagacactgtgtttacccccgttaccagttctacgccg

SEQ ID NO: 28174 - DNA, 75 bp, Artificial Sequence
  Synthetic
ccagttggagactccaccgactccgcatccagggcggcactccccgagccttccacctccgtgtcccccgaacgg

SEQ ID NO: 28175 - DNA, 75 bp, Artificial Sequence
  Synthetic
ttccacctccgtgtcccccgaacggccaccatcccaaacagcacggcgatacgggagaaaagcatctagcccttc

SEQ ID NO: 28176 - DNA, 75 bp, Artificial Sequence
  Synthetic
tcgcctgacaaagtgggaacggcagttcgatcagttggtagacaaagtggtggaagacttacgcggctactggca

SEQ ID NO: 28177 - DNA, 75 bp, Artificial Sequence
  Synthetic
gacgctgcagaccccccagtaatattgttacgtggagatgccaataccttaaaatgctatcgctatcgatttaga

SEQ ID NO: 28178 - DNA, 75 bp, Artificial Sequence
  Synthetic
tgttacgtggagatgccaataccttaaaatgctatcgctatcgatttagaaaaaaacatgctggtggctttcgct

SEQ ID NO: 28179 - DNA, 75 bp, Artificial Sequence
  Synthetic
tttattcagaatcacaaagagaaaagtttatacagactatgaaattacctacaggtgtagagtggtcattaggac

SEQ ID NO: 28180 - DNA, 75 bp, Artificial Sequence
  Synthetic
acaggtgtagagtggtcattaggacaatttgatgatttatagaataatctataagagatattttttatatattat

SEQ ID NO: 28181 - DNA, 75 bp, Artificial Sequence
  Synthetic
gcacgtagaaccaaacgtgcatctgttactgatatatacaggggctgcaaggcttctaatacttgccctcctgat

SEQ ID NO: 28182 - DNA, 75 bp, Artificial Sequence
  Synthetic
caatagcagataagattttaaaatatggtagtgctgctgtcttttttggtgggctgggtattagcactggtcgtg

SEQ ID NO: 28183 - DNA, 75 bp, Artificial Sequence
  Synthetic
cagaagttcatcctggccctatagaccctatagaaattgatacccctgttgtgagtggaggccgcaataccaatg

SEQ ID NO: 28184 - DNA, 75 bp, Artificial Sequence
  Synthetic
tccacccactagagctactgttagcagaactcaatataataatcctgctttccaaataatttctgaagtaatccc

SEQ ID NO: 28185 - DNA, 75 bp, Artificial Sequence
  Synthetic
tacctctggagagtcttctcttgcagatcacgtgttagtgtctgaagggtctggtggccagcagataggaggtac

SEQ ID NO: 28186 - DNA, 75 bp, Artificial Sequence
  Synthetic
gatcacgtgttagtgtctgaagggtctggtggccagcagataggaggtaccagaacagcagaagaaattgagttg

SEQ ID NO: 28187 - DNA, 75 bp, Artificial Sequence
  Synthetic
cagcctttgttatctagatatagttttgaaattgaggagccaacaccaccgcgaagaactagcacccccttacaa

SEQ ID NO: 28188 - DNA, 75 bp, Artificial Sequence
  Synthetic
gaccctttatttttcacatcaccttccaaattggtgcgtttccaatttgacaatcctgtatttgatgaacaagta

SEQ ID NO: 28189 - DNA, 75 bp, Artificial Sequence
  Synthetic
ccaaattggtgcgtttccaatttgacaatcctgtatttgatgaacaagtaacacagatatttgagcaggacatag

SEQ ID NO: 28190 - DNA, 75 bp, Artificial Sequence
  Synthetic
cagactttgaggaaccacccgatagacagtttttggatgtggttaaattaggtaggccaacattaactgagtctg

SEQ ID NO: 28191 - DNA, 75 bp, Artificial Sequence
  Synthetic
cagagggatatgttagagtgagtcgtttgggaagacggggaacgatccgaacacgcagtggtacacaaataggat

SEQ ID NO: 28192 - DNA, 75 bp, Artificial Sequence
  Synthetic
cacaagtacatttctatagggatttaagtacaattaatacagaagaacccttagaaatgcagttattgggtgagc

SEQ ID NO: 28193 - DNA, 75 bp, Artificial Sequence
  Synthetic
ttagaaatgcagttattgggtgagcattcaggtgatgcttcaattgtacaaggtcctgtagaaagcactttagtg

SEQ ID NO: 28194 - DNA, 75 bp, Artificial Sequence
  Synthetic
gatgtaaatgtgactgaggttcctgaaggtgttcttacagaaacttctatggatccagatacttttaattcagag

SEQ ID NO: 28195 - DNA, 75 bp, Artificial Sequence
  Synthetic
gatttattactggatgatgctatagaagacttcagcggatctcagttagttgtaggaactccacgcagatccact

SEQ ID NO: 28196 - DNA, 75 bp, Artificial Sequence
  Synthetic
acgtcaatcactgtacctagatttcagactcctcaaaatcctaccatatattatcaggatatacaggggtatcat

SEQ ID NO: 28197 - DNA, 75 bp, Artificial Sequence
  Synthetic
gtttcatatcccgaaagcagagaaagacccgccattatttatcctacacccgatattcctacagtagttatacat

SEQ ID NO: 28198 - DNA, 75 bp, Artificial Sequence
  Synthetic
ccatccatattttgatgtcagatcacaggatggtcaaaaaattgaagttcctaaggtgtcaggaaatcaatatag

SEQ ID NO: 28199 - DNA, 75 bp, Artificial Sequence
  Synthetic
taggctggtgtgggcctgcaaaggccttgaaataggccgaggacagccattaggagttggaactacaggacatcc

SEQ ID NO: 28200 - DNA, 75 bp, Artificial Sequence
  Synthetic
taggagttggaactacaggacatcctctatttaataaagtaagagatactgaaaactccagtaattatcaaaaca

SEQ ID NO: 28201 - DNA, 75 bp, Artificial Sequence
  Synthetic
catctactgatgacagacaaaatacctcttttgatcctaaacaggtgcaaatgtttataataggctgcactcctt

SEQ ID NO: 28202 - DNA, 75 bp, Artificial Sequence
  Synthetic
gtctaggagaatactgggataaagcacctgtatgtgataatgcaggggaccagacaggcctatgtcctccactag

SEQ ID NO: 28203 - DNA, 75 bp, Artificial Sequence
  Synthetic
cagacaggcctatgtcctccactagaattgaaaaatagtgtaattgaagacggagacatgtttgatataggattt

SEQ ID NO: 28204 - DNA, 75 bp, Artificial Sequence
  Synthetic
ggcaatataaacaacaaaactctatcctttaatagatctgatgtaagtttggatattgttaatgaaacctgcaaa

SEQ ID NO: 28205 - DNA, 75 bp, Artificial Sequence
  Synthetic
tacccagattttcttaccatgtctaatgatgtttatggtgattcctgcttcttttttgtgcgacgggagcaatgc

SEQ ID NO: 28206 - DNA, 75 bp, Artificial Sequence
  Synthetic
tatgccagacattattttgttcgaggtggtgcagtgggtgacgctattccagatggtactgtcaaccaaaatcat

SEQ ID NO: 28207 - DNA, 75 bp, Artificial Sequence
  Synthetic
aattattatttacctgcaaaaaatggacagggtcaacgcactttagggaactctacgtattttccaacagttagt

SEQ ID NO: 28208 - DNA, 75 bp, Artificial Sequence
  Synthetic
ggatccttggtgacgtctgatgctcagttatttaatagaccattttggttacaaagagcacaaggccacaataat

SEQ ID NO: 28209 - DNA, 75 bp, Artificial Sequence
  Synthetic
ggtattttatggggcaatcaaatgtttgttacagtcgctgataatacccgaaatacaaactttacaatcagtgta

SEQ ID NO: 28210 - DNA, 75 bp, Artificial Sequence
  Synthetic
ttgttacagtcgctgataatacccgaaatacaaactttacaatcagtgtatccactgaaaacgggggtgctcaag

SEQ ID NO: 28211 - DNA, 75 bp, Artificial Sequence
  Synthetic
gctgacacagattaatgctatgaattctggaatattagaaaattggcaattaggctttgtacccaccccagacaa

SEQ ID NO: 28212 - DNA, 75 bp, Artificial Sequence
  Synthetic
ttctgtacacgatacatatcgttacataacatctaaagcaactaaatgtccagatgcagtgcctgaaacagaaaa

SEQ ID NO: 28213 - DNA, 75 bp, Artificial Sequence
  Synthetic
cagatgcagtgcctgaaacagaaaaagaagatccctttggtcaatatacattttggaatgtggacatgactgaaa

SEQ ID NO: 28214 - DNA, 75 bp, Artificial Sequence
  Synthetic
tcctttggggcgcaaatttttattccaagcaggtttacaaacagcacgaacacgtgctgtcaaacggccgttagt

SEQ ID NO: 28215 - DNA, 75 bp, Artificial Sequence
  Synthetic
gttaatcagattataaattcctgaagggcagatttcaatcagtgcagatatcatctagcacctgcagcaaccgcc

SEQ ID NO: 28216 - DNA, 75 bp, Artificial Sequence
  Synthetic
gggcagatttcaatcagtgcagatatcatctagcacctgcagcaaccgccaagactttgccaggacttggcagaa

SEQ ID NO: 28217 - DNA, 75 bp, Artificial Sequence
  Synthetic
ctggagccaaggttttggcagaacaccatcttggaacagcaccgataacggtaagattatatcttggaaccgtag

SEQ ID NO: 28218 - DNA, 75 bp, Artificial Sequence
  Synthetic
ccatcttggaacagcaccgataacggtaagattatatcttggaaccgtaggcggtactttctgattggtttggct

SEQ ID NO: 28219 - DNA, 75 bp, Artificial Sequence
  Synthetic
gatagtagttaacaacaatcttctctcataaatatatgtgaccgccttcgttaccttaaatgatctacatacaat

SEQ ID NO: 28220 - DNA, 75 bp, Artificial Sequence
  Synthetic
atgagagctcttacttaagagcatatggataggccaaaacctcaaacagtgagggagcttgctgataccttgtgt

SEQ ID NO: 28221 - DNA, 75 bp, Artificial Sequence
  Synthetic
tggataggccaaaacctcaaacagtgagggagcttgctgataccttgtgtattccattagtggatattttattac

SEQ ID NO: 28222 - DNA, 75 bp, Artificial Sequence
  Synthetic
cttgcagattttgtaataggtttttagcttacatagaattggtggcgtttgatttaaaaggtttgcagttaattt

SEQ ID NO: 28223 - DNA, 75 bp, Artificial Sequence
  Synthetic
ggactgaagaagattttgtgtttgcctgttgcagtagttgtgcgtatgctacagcacagtatgaattttctaagt

SEQ ID NO: 28224 - DNA, 75 bp, Artificial Sequence
  Synthetic
tttatgaacaatcagtgagtggaagggagttagaggaaatagagcacaagccaataggggaaatacctattcgct

SEQ ID NO: 28225 - DNA, 75 bp, Artificial Sequence
  Synthetic
gcaagttttgtttaaagaaattggatttactagagaagttagacacttgttatagacatcagcagtttcataagg

SEQ ID NO: 28226 - DNA, 75 bp, Artificial Sequence
  Synthetic
ttagacgcaattggaaaggcttgtgcagacattgtgggtcgataggatgattgggaaagaagctacaataccaga

SEQ ID NO: 28227 - DNA, 75 bp, Artificial Sequence
  Synthetic
ttgggaaagaagctacaataccagatatagtgcttgagctgcaacagcttgtccagcccactgacctgcattgct

SEQ ID NO: 28228 - DNA, 75 bp, Artificial Sequence
  Synthetic
acgaagagttaagtgaagaagagacagagacagaggaggagcctcgtcgtataccatacaagattgtagctccgt

SEQ ID NO: 28229 - DNA, 75 bp, Artificial Sequence
  Synthetic
gctgcttttgtggttctaagctacggcttattgttcttgcaacgcacgctggaattcgttcacaagaggagcttt

SEQ ID NO: 28230 - DNA, 75 bp, Artificial Sequence
  Synthetic
tattaggtgaagtacagttggtgtgtcctaactgcagagagaagcttcgccatgactgacgacaacaaaggtacc

SEQ ID NO: 28231 - DNA, 75 bp, Artificial Sequence
  Synthetic
aaatttgatcctaaagaaggatgtagtcagtggtgtatactagaagcagaatgttctgacaatagtttagatggt

SEQ ID NO: 28232 - DNA, 75 bp, Artificial Sequence
  Synthetic
atgttctgacaatagtttagatggtgatttggaaaagttatttgaagaaggtacagatactgaaatttctgactt

SEQ ID NO: 28233 - DNA, 75 bp, Artificial Sequence
  Synthetic
aatagatgatgaggacattatacagggaaactcccgcgaattgttatgccagcaagaaagtgaggaaagcgagca

SEQ ID NO: 28234 - DNA, 75 bp, Artificial Sequence
  Synthetic
acagatacaattgctaaaacgaaagtatttgagttcacaagaggttttgcagctcagtccgcgcctgcagtctat

SEQ ID NO: 28235 - DNA, 75 bp, Artificial Sequence
  Synthetic
tatttgagttcacaagaggttttgcagctcagtccgcgcctgcagtctatcactatatcgccacagcataagtct

SEQ ID NO: 28236 - DNA, 75 bp, Artificial Sequence
  Synthetic
ttggaggtgcaggaggtatcggcgaccggttctgtaccggcagaacagggtgtcaagggattgggaattgttaaa

SEQ ID NO: 28237 - DNA, 75 bp, Artificial Sequence
  Synthetic
ccggttctgtaccggcagaacagggtgtcaagggattgggaattgttaaagaccttttaaaatgtagtaatgtga

SEQ ID NO: 28238 - DNA, 75 bp, Artificial Sequence
  Synthetic
tgtcaagggattgggaattgttaaagaccttttaaaatgtagtaatgtgaaagctatgttattggccaaattcaa

SEQ ID NO: 28239 - DNA, 75 bp, Artificial Sequence
  Synthetic
agaagcatttggagtgggatatatggatttaaccagacagtataaaagtagtaagacatgctgtagagattgggt

SEQ ID NO: 28240 - DNA, 75 bp, Artificial Sequence
  Synthetic
agttacattgtatgcagtacaggatgagttgatagaaagctccaaacaattgctgctgcaacattgtgcttatat

SEQ ID NO: 28241 - DNA, 75 bp, Artificial Sequence
  Synthetic
atggctacaacatatgtcacctatgtgtttatatttattatgttttaatgtcggaaaaagtagggaaactgtatc

SEQ ID NO: 28242 - DNA, 75 bp, Artificial Sequence
  Synthetic
acgattgcttatgaatattctgcaagtagcagaggtacaaatgttagcagaacctccaaaattgagaagcatgtt

SEQ ID NO: 28243 - DNA, 75 bp, Artificial Sequence
  Synthetic
gtcagcattattttggtataaaggaagtatgaatccaaatgtgtatgcccacggtgaatatcctgagtggatttt

SEQ ID NO: 28244 - DNA, 75 bp, Artificial Sequence
  Synthetic
aacacaaactatgattaatcatcaaacagcacaggcaacacaattcgatctatctaccatgatacaatttgctta

SEQ ID NO: 28245 - DNA, 75 bp, Artificial Sequence
  Synthetic
tgataacgaataccttcaagaagatgaaatagcttatcattatgctaaattagcagatacagatgctaatgcacg

SEQ ID NO: 28246 - DNA, 75 bp, Artificial Sequence
  Synthetic
agcatttttacagcataatagtcaagcacggtttgtaaaagaatgtgcaataatggtgagacattataagcgtgg

SEQ ID NO: 28247 - DNA, 75 bp, Artificial Sequence
  Synthetic
taatggtgagacattataagcgtggagaaatgaaggaaatgagcatttctacgtgggtacatagaaaattattag

SEQ ID NO: 28248 - DNA, 75 bp, Artificial Sequence
  Synthetic
ttgttgaaggagatggacattggtctgatatagtaaaatttattagatatcaggacattaattttattaggtttt

SEQ ID NO: 28249 - DNA, 75 bp, Artificial Sequence
  Synthetic
tagatatatttaaatcatttctgcacaataaaccaaaaaaaaactgtatattaattcatggcccaccagatacag

SEQ ID NO: 28250 - DNA, 75 bp, Artificial Sequence
  Synthetic
ttaattcatggcccaccagatacaggtaaatctatgtttacaatgtctcttataaaagtgttgaaaggcaaagtg

SEQ ID NO: 28251 - DNA, 75 bp, Artificial Sequence
  Synthetic
ttatcatttgcaaattgtagaagcaatttctggcttcagccattagcagacactaagcttgcattaattgatgat

SEQ ID NO: 28252 - DNA, 75 bp, Artificial Sequence
  Synthetic
gtgacatttgtatgttgggactatatagatcaatatttaagaaatggattggatggtaatgttgtgtgtttagat

SEQ ID NO: 28253 - DNA, 75 bp, Artificial Sequence
  Synthetic
ttgaaacatagagcgccatgtcaaattaaatttccaccattactattaacatctaatattgatgtaatgaaagaa

SEQ ID NO: 28254 - DNA, 75 bp, Artificial Sequence
  Synthetic
gacaaatatagatatttacacagtagaattcaaagctttgcttttccaaataagtttccgtttgataataacaat

SEQ ID NO: 28255 - DNA, 75 bp, Artificial Sequence
  Synthetic
atgccacaatttcgacttactgaccaaagctggaaatctttttttgaaaggctttggcatcagttagatctgagt

SEQ ID NO: 28256 - DNA, 75 bp, Artificial Sequence
  Synthetic
aaagctggaaatctttttttgaaaggctttggcatcagttagatctgagtgatcaagaagaagagggagacgatg

SEQ ID NO: 28257 - DNA, 75 bp, Artificial Sequence
  Synthetic
gacaatctcagcgaacgtttcaatgtactgcaagagaacctaatggacatttatgagtcaggtcaagaagatata

SEQ ID NO: 28258 - DNA, 75 bp, Artificial Sequence
  Synthetic
ttatgagtcaggtcaagaagatatagagactcaaataaaacactggcaattattaagacaggaacaagtactgtt

SEQ ID NO: 28259 - DNA, 75 bp, Artificial Sequence
  Synthetic
ttactatgccagaaaaaatggagtgatgcgtgtaggttatcaacctgtgcctcctttagccaccagtgaggctaa

SEQ ID NO: 28260 - DNA, 75 bp, Artificial Sequence
  Synthetic
agcaaaggatgctattggcatggttttgttattgcagagcttgcaaaaatcaccgtatggcaaagagccatggac

SEQ ID NO: 28261 - DNA, 75 bp, Artificial Sequence
  Synthetic
gctaacacaaactagtttggagactgtgcgaagtccacccgcaaactgttttaaaaagggtcctcaaaacattga

SEQ ID NO: 28262 - DNA, 75 bp, Artificial Sequence
  Synthetic
ttaaaaagggtcctcaaaacattgaagttatgtttgacaatgaccctgaaaatcttatgtcatatacagtgtggt

SEQ ID NO: 28263 - DNA, 75 bp, Artificial Sequence
  Synthetic
catttatttattaccaaaatttagatgacacctggaataaagttgagggccgtgttgactatcatggtgcatatt

SEQ ID NO: 28264 - DNA, 75 bp, Artificial Sequence
  Synthetic
cgtgttgactatcatggtgcatattatatggaaggctctctaaaagtgtattatattcaatttgaagtggatgct

SEQ ID NO: 28265 - DNA, 75 bp, Artificial Sequence
  Synthetic
ttatattcaatttgaagtggatgctgccaggtttggcaaaactggacgttgggaagtgcatgttaatgaggacac

SEQ ID NO: 28266 - DNA, 75 bp, Artificial Sequence
  Synthetic
tatctttgctcctgttactagctcttcgccggcagctggagaagggaccgacgcgtcccccatcaacgccgcatc

SEQ ID NO: 28267 - DNA, 75 bp, Artificial Sequence
  Synthetic
ccggtcgtcaccagcaaggggactctctgccacctccgtgtccacccgaaccacacaacggacatcaccacggcg

SEQ ID NO: 28268 - DNA, 75 bp, Artificial Sequence
  Synthetic
tctgccacctccgtgtccacccgaaccacacaacggacatcaccacggcgatacaggcggaaagcgtctagccct

SEQ ID NO: 28269 - DNA, 75 bp, Artificial Sequence
  Synthetic
acagccaccaccacccggcacaaaagacaagacatcagacgatcaaggtccacctcacgggggagacaagcaatc

SEQ ID NO: 28270 - DNA, 75 bp, Artificial Sequence
  Synthetic
tccaggggaggggagcgacgccagcggagacgagaacgctcctactcccgagactcctcaagatcccccaacagg

SEQ ID NO: 28271 - DNA, 75 bp, Artificial Sequence
  Synthetic
ggaaggggagggagcagtggggggcccacaacacggtcccagtcgcggtccctctcccgatcccgatcgcggtca

SEQ ID NO: 28272 - DNA, 75 bp, Artificial Sequence
  Synthetic
cgatcgcgatccagagggtcttctgccgggggtggcgttgcgcctgagcaagtgggaaaatcagttcgatcagtt

SEQ ID NO: 28273 - DNA, 75 bp, Artificial Sequence
  Synthetic
ggtagaaaccctggtgggcgacttacaagattattggaagaagctagggatcccccagtaattttgctgcgcggc

SEQ ID NO: 28274 - DNA, 75 bp, Artificial Sequence
  Synthetic
tcccccagtaattttgctgcgcggcgaagctaacaaactgaaatgctttcgatatagagcaaaaaagcgatatgg

SEQ ID NO: 28275 - DNA, 75 bp, Artificial Sequence
  Synthetic
gaagctaacaaactgaaatgctttcgatatagagcaaaaaagcgatatggcagtttagttaaatattacagcact

SEQ ID NO: 28276 - DNA, 75 bp, Artificial Sequence
  Synthetic
acatggtcatgggtgggtgcaaatactaatgacagaataggtagatcaagaatgttactagcatttaacacatat

SEQ ID NO: 28277 - DNA, 75 bp, Artificial Sequence
  Synthetic
gatgaaagagaattgtttatccaaaaaatgaagctaccaccaggtgttgattggtcactaggacatctagatgat

SEQ ID NO: 28278 - DNA, 75 bp, Artificial Sequence
  Synthetic
ttggtcactaggacatctagatgatttataggcattacttttttaacattactaaccttgctaaagcttgctttt

SEQ ID NO: 28279 - DNA, 75 bp, Artificial Sequence
  Synthetic
gctactaacactttttaacgttcccatggctcgctcaagacgcataaagcgtgcctctgtaactgacatctacag

SEQ ID NO: 28280 - DNA, 75 bp, Artificial Sequence
  Synthetic
gggttgcaagcaggctggtacttgcccccctgatgttattaataaagtggaacagactacaatagcagataaaat

SEQ ID NO: 28281 - DNA, 75 bp, Artificial Sequence
  Synthetic
ccccctgatgttattaataaagtggaacagactacaatagcagataaaattttaaaatatggtagttctggtgtt

SEQ ID NO: 28282 - DNA, 75 bp, Artificial Sequence
  Synthetic
aacagactacaatagcagataaaattttaaaatatggtagttctggtgttttttttggtgggctgggcattagca

SEQ ID NO: 28283 - DNA, 75 bp, Artificial Sequence
  Synthetic
caggtcgtggcacgggtggggcaacaggttatttccctttgggtgaagggcctggggtacgcgtaggtggcgccc

SEQ ID NO: 28284 - DNA, 75 bp, Artificial Sequence
  Synthetic
aggttatttccctttgggtgaagggcctggggtacgcgtaggtggcgcccccactatagttcgccctggggtcat

SEQ ID NO: 28285 - DNA, 75 bp, Artificial Sequence
  Synthetic
acctgaactcattggcccagcggatgtaatacctattgatacagtcactccaattgaccccgcagcacctagtat

SEQ ID NO: 28286 - DNA, 75 bp, Artificial Sequence
  Synthetic
tgttacaatcacagacagcagtgctgttgacctattacccactgaattggaaaccattgcagaaatacatcctgt

SEQ ID NO: 28287 - DNA, 75 bp, Artificial Sequence
  Synthetic
gttgacctattacccactgaattggaaaccattgcagaaatacatcctgtgcctacagataatttagatattgac

SEQ ID NO: 28288 - DNA, 75 bp, Artificial Sequence
  Synthetic
actcctgttgtttcaggaggcagggattccagtgctgttttagaggttgctgatcctagtccccctgtaagaaca

SEQ ID NO: 28289 - DNA, 75 bp, Artificial Sequence
  Synthetic
attccagtgctgttttagaggttgctgatcctagtccccctgtaagaacaagggtgtctcgaacacagtatcaca

SEQ ID NO: 28290 - DNA, 75 bp, Artificial Sequence
  Synthetic
acccatcatttcaagtaattactgaatctacacctttatctggagaatcagctatggcggatcatgttttagtgt

SEQ ID NO: 28291 - DNA, 75 bp, Artificial Sequence
  Synthetic
tcgaaggttttggtggacaaaacataggaggttccaggaatgcagccattgatacagcacaggagagctttgaaa

SEQ ID NO: 28292 - DNA, 75 bp, Artificial Sequence
  Synthetic
tgcaatcctggcctagcagatatagctttgaattagaagaaggcacacctcctagaacaagtactccagttcaac

SEQ ID NO: 28293 - DNA, 75 bp, Artificial Sequence
  Synthetic
gtgcagtagaatcactatcaagcttaagaagagctttatacaatagacgattgactgaacaagttgcagtgacag

SEQ ID NO: 28294 - DNA, 75 bp, Artificial Sequence
  Synthetic
atccactttttttaagtaggccttcacgcttggtccaatttcagttcgataatcctgcctttgaggaagaagtta

SEQ ID NO: 28295 - DNA, 75 bp, Artificial Sequence
  Synthetic
cacagctgtttgaaagagatattgaagcagtggaggaacctcctgatagacagtttttagatgttgtgcgcctag

SEQ ID NO: 28296 - DNA, 75 bp, Artificial Sequence
  Synthetic
gaaggcctacatattctgaaacacctcagggttatttacgagtcagtagactaggtagaagagccagcattcgta

SEQ ID NO: 28297 - DNA, 75 bp, Artificial Sequence
  Synthetic
ctcgcagtggagcacaagtaggagctcaggtacatttttatagagatgttagcaccatcgattcagatgccttag

SEQ ID NO: 28298 - DNA, 75 bp, Artificial Sequence
  Synthetic
aaatgcagttattgggggaacattctggtgacactaccatagttcagggtcctgtagaaagttcctttgtagaca

SEQ ID NO: 28299 - DNA, 75 bp, Artificial Sequence
  Synthetic
ttaatattgatgaaccagggcctttgaatgtaggcatccaagaatcaccactggctgacactatagaagaagatt

SEQ ID NO: 28300 - DNA, 75 bp, Artificial Sequence
  Synthetic
tcaattctgcagatttgttactggaagatgctgtagatgactttagtgggtctcagctggtatttggcaatcctc

SEQ ID NO: 28301 - DNA, 75 bp, Artificial Sequence
  Synthetic
gccgcagcacaacatctgtaactgtcccccggtttgaaacacctagggacactggcttttacatacatgacactc

SEQ ID NO: 28302 - DNA, 75 bp, Artificial Sequence
  Synthetic
agggatacacagtagcatatccagagtcacgtgacaccactgaaataattcttccacatcctgatacaccaactg

SEQ ID NO: 28303 - DNA, 75 bp, Artificial Sequence
  Synthetic
cttccacatcctgatacaccaactgtagtaattaaatttgcagaagcaggaggcagatttttatttacaccctag

SEQ ID NO: 28304 - DNA, 75 bp, Artificial Sequence
  Synthetic
tttaaagaaacgaaaaagaaaacgaaaatatttgtaattgttttgcagatgacattgtggctgccaacgaccggt

SEQ ID NO: 28305 - DNA, 75 bp, Artificial Sequence
  Synthetic
aaagtatacttgcctccaacaccaccagtagcccgagtacaaagcacggatgagtatgtggaaagaacaaatatt

SEQ ID NO: 28306 - DNA, 75 bp, Artificial Sequence
  Synthetic
cagtagcccgagtacaaagcacggatgagtatgtggaaagaacaaatattttttaccatgctatgagtgatcgtc

SEQ ID NO: 28307 - DNA, 75 bp, Artificial Sequence
  Synthetic
tcctaactgtgggacacccattttatgatgtaagatctactgatggattaagaatagaagtccctaaagtttctg

SEQ ID NO: 28308 - DNA, 75 bp, Artificial Sequence
  Synthetic
tgatgtaagatctactgatggattaagaatagaagtccctaaagtttctggaaatcagtatagagccttcagagt

SEQ ID NO: 28309 - DNA, 75 bp, Artificial Sequence
  Synthetic
cacattaccagatcctaataagtttgccttggcagatatgtcagtttacaatcctgaaaaggaaagattagtttg

SEQ ID NO: 28310 - DNA, 75 bp, Artificial Sequence
  Synthetic
ggcatgtgcaggccttgagataggacgaggacagccattaggtgtaggcactacaggacatcccttgtttaataa

SEQ ID NO: 28311 - DNA, 75 bp, Artificial Sequence
  Synthetic
gttaagagacactgaaaataacagtagctatcaaggtggatctactgatgatagacaaaacacgtcatttgaccc

SEQ ID NO: 28312 - DNA, 75 bp, Artificial Sequence
  Synthetic
agctatcaaggtggatctactgatgatagacaaaacacgtcatttgaccctaaacaagtgcagatgtttgttgta

SEQ ID NO: 28313 - DNA, 75 bp, Artificial Sequence
  Synthetic
ggctgtgtaccttgtattggagaacattgggacagggctcctgtatgtgaaaatgaacaaaacaatcaaacaggc

SEQ ID NO: 28314 - DNA, 75 bp, Artificial Sequence
  Synthetic
aaatgaacaaaacaatcaaacaggcctgtgtccaccattggaattaaaaaacactgttatcgaagatggtgacat

SEQ ID NO: 28315 - DNA, 75 bp, Artificial Sequence
  Synthetic
ggttgacataggctttggaaacattaataacaaagtgctttcatttaataaatcagatgtaagtttagatatagt

SEQ ID NO: 28316 - DNA, 75 bp, Artificial Sequence
  Synthetic
taatgaaacatgcaaatatcctgattttttaagcatggcaaatgatgtttatggtgatgcatgtttctttttcgc

SEQ ID NO: 28317 - DNA, 75 bp, Artificial Sequence
  Synthetic
cagacgagagcagtgctatgctaggcattattttgtgaggggaggtaatgtaggtgatgctgttccagatggttc

SEQ ID NO: 28318 - DNA, 75 bp, Artificial Sequence
  Synthetic
tgtaaatcaggatcacaaattttatttaccagctcaaactggccaacaacagcgcactttgggtaattccactta

SEQ ID NO: 28319 - DNA, 75 bp, Artificial Sequence
  Synthetic
ttttccaactgtaagtggttctttagtaacatctgatgcccagctttttaatagaccattctggttacgtagagc

SEQ ID NO: 28320 - DNA, 75 bp, Artificial Sequence
  Synthetic
acaaggacacaataatggtattttatgggggaatcagatatttgtgactgtagctgacaacactaggaacacaaa

SEQ ID NO: 28321 - DNA, 75 bp, Artificial Sequence
  Synthetic
tttttctattagcgtgtctacagaagctggggctgttacagaatataattctcaaaatatcagagagtatttaag

SEQ ID NO: 28322 - DNA, 75 bp, Artificial Sequence
  Synthetic
acatgtagaagagtatcagctatcttttattttacaattatgtaaaatacctttaaaagctgaagttttaactca

SEQ ID NO: 28323 - DNA, 75 bp, Artificial Sequence
  Synthetic
ctttaaaagctgaagttttaactcaaattaatgcaatgaactcaggaattctggaagactggcagttaggatttg

SEQ ID NO: 28324 - DNA, 75 bp, Artificial Sequence
  Synthetic
tgcctacaccagataacccagtgcatgatatatataggtacattaattctaaagccacaaaatgtcctgatgcag

SEQ ID NO: 28325 - DNA, 75 bp, Artificial Sequence
  Synthetic
ttgtagagaaagaaaaagaagacccttttgcaaagtatacattttggaatgtaaatcttactgagaaattatcat

SEQ ID NO: 28326 - DNA, 75 bp, Artificial Sequence
  Synthetic
tagatttagatcagtatcccctaggacgaaaatttatttttcagtcaggtttgcaggcaaggcccagaactattc

SEQ ID NO: 28327 - DNA, 75 bp, Artificial Sequence
  Synthetic
ttgcaggcaaggcccagaactattcggacctctgtaaaagtgcccaagggtattaaacgcaaacgttcatgaccg

SEQ ID NO: 28328 - DNA, 75 bp, Artificial Sequence
  Synthetic
ctttcggtctctcaataaacaaataaaccaaaatggtatgtgaagtattttttaccatgttcgtgactaaaccgt

SEQ ID NO: 28329 - DNA, 75 bp, Artificial Sequence
  Synthetic
cttcgtcaacgccagaaaccgcacccggttaatcagattataaatgcacctggtgcgattttatcactgcttttg

SEQ ID NO: 28330 - DNA, 75 bp, Artificial Sequence
  Synthetic
gttaatcagattataaatgcacctggtgcgattttatcactgcttttgtggaagcaccgcaggcgcccgccgaaa

SEQ ID NO: 28331 - DNA, 75 bp, Artificial Sequence
  Synthetic
gttaatcagattatatatcgctgtcggtgccaaacaagacaaagacttggctggatctcgaggaaacaccgcagg

SEQ ID NO: 28332 - DNA, 75 bp, Artificial Sequence
  Synthetic
cgcccgccaaaagtctgccaagttttcttggcagaacatccatttggctgcaactgtcaccgataacggtaagta

SEQ ID NO: 28333 - DNA, 75 bp, Artificial Sequence
  Synthetic
tttgttttgagcaccggtgccggttgctaaattactcatatggtgattgtggtttacaaccatcatcttgacata

SEQ ID NO: 28334 - DNA, 75 bp, Artificial Sequence
  Synthetic
ttacatgtaaccgcatgtgtagtatctaatataaaaatattttgtgcttctacaactgttcagatgctcatggac

SEQ ID NO: 28335 - DNA, 75 bp, Artificial Sequence
  Synthetic
aggccaaggacaatcgtacagcttacacagcatcttaatataccagtggaagacttactggtaccttgcaaattt

SEQ ID NO: 28336 - DNA, 75 bp, Artificial Sequence
  Synthetic
tgcaaacgattcttaacttttatagaacttttacaatttgattataaaaatttacaattaatttggcatgaaaat

SEQ ID NO: 28337 - DNA, 75 bp, Artificial Sequence
  Synthetic
ttagtatatggttgttgttgcagctgtgcttatgcatcagcagcgtttgaatttaaaaatcattttgaatttcag

SEQ ID NO: 28338 - DNA, 75 bp, Artificial Sequence
  Synthetic
gttgtaggtaagcagattgaggagatcactcagcaaagtattggatttattaatattagatgtgtgttttgttta

SEQ ID NO: 28339 - DNA, 75 bp, Artificial Sequence
  Synthetic
aagaatttggatttgttggagaagttagacaattgtgctaggcatcagcagttttttaaggtgagaggtaattgg

SEQ ID NO: 28340 - DNA, 75 bp, Artificial Sequence
  Synthetic
aagggattgtgtagacattgtgaggcgatagaatgattgggaaagaagtaactattccagatatagttctggaag

SEQ ID NO: 28341 - DNA, 75 bp, Artificial Sequence
  Synthetic
agctgcaagagcttgctcagcccattgacctgcattgttacgaagagttaccagagcttccagatgctactagtg

SEQ ID NO: 28342 - DNA, 75 bp, Artificial Sequence
  Synthetic
aagaatcagaggaggagcctgaacgcatcccttacaaaattgtagtaccttgttctgggtgtccagtgaaacttc

SEQ ID NO: 28343 - DNA, 75 bp, Artificial Sequence
  Synthetic
gtctctacgtttttgcaacccattttggcattcgggcattgcaggatcttttgcttcaagaagtccaactgatct

SEQ ID NO: 28344 - DNA, 75 bp, Artificial Sequence
  Synthetic
gtccacagtgtcgagaggctattcgccatggaggacaataaaggtactgatgcaggtgcaggatgtagtgattgg

SEQ ID NO: 28345 - DNA, 75 bp, Artificial Sequence
  Synthetic
tttttggtagaagctgactgttccgatactagtgatttagaaaacgatttagaaaaactgtttaatgaagagaca

SEQ ID NO: 28346 - DNA, 75 bp, Artificial Sequence
  Synthetic
gattcagatatttctgatttaattgatgatggggatattgagcagggaaactcccgcgaattgctatgccagcaa

SEQ ID NO: 28347 - DNA, 75 bp, Artificial Sequence
  Synthetic
gaaacagaggagagcgagcaacaagtgcaattgctaaaacgaaagtatttcagtcctaaagctatttcacagctt

SEQ ID NO: 28348 - DNA, 75 bp, Artificial Sequence
  Synthetic
agtccgcggctgcagtccatctccctgtcgccccaacataaatctaaaaaacgtctgtttgtggagcaggacagc

SEQ ID NO: 28349 - DNA, 75 bp, Artificial Sequence
  Synthetic
ggcttagagctctcactaaatgaagttgaagatattactgaagaggtggaggtaccggcgagtgcttcagtgccg

SEQ ID NO: 28350 - DNA, 75 bp, Artificial Sequence
  Synthetic
gcagcacagggtggaaagggagtgggagagatgcattttaaacagctgttaaaatctagtaatgttaaagctact

SEQ ID NO: 28351 - DNA, 75 bp, Artificial Sequence
  Synthetic
ttaatgggaaaatttaaggacgcgtttggggtaggattcaatgaactgactagacaatataagagcaataagacg

SEQ ID NO: 28352 - DNA, 75 bp, Artificial Sequence
  Synthetic
tgttgcaaagattgggttgtaaccatatactgtgttcaagatgatttattagaagcttctaagatattgttacaa

SEQ ID NO: 28353 - DNA, 75 bp, Artificial Sequence
  Synthetic
aaacattgtaattatatatggatgcatgtactacagcctatgacattatatttattatgttttaatgctggtaaa

SEQ ID NO: 28354 - DNA, 75 bp, Artificial Sequence
  Synthetic
agcagagaaactgtatgtagattattaagttccattctgcaaattgatgatatgcaggcattattagagcctccc

SEQ ID NO: 28355 - DNA, 75 bp, Artificial Sequence
  Synthetic
agattgcgaagtgtgttgtctgcattattttggtacaaaggcagtatgaatcccaatgtatattcatttggtacg

SEQ ID NO: 28356 - DNA, 75 bp, Artificial Sequence
  Synthetic
tatccagactggatagtagctcaaactatgataagtcatcaagcagcagaggctacacagttttcattatcaaga

SEQ ID NO: 28357 - DNA, 75 bp, Artificial Sequence
  Synthetic
atggtacagtgggcttttgacaatgagcatttagaagaggctgatatagcatacaattatgctaaattagctgaa

SEQ ID NO: 28358 - DNA, 75 bp, Artificial Sequence
  Synthetic
actgatagtaatgcaaaagcctttttggatagtaatagtcaagccaactttgtaagacagtgtgctttgatggtg

SEQ ID NO: 28359 - DNA, 75 bp, Artificial Sequence
  Synthetic
aggcattataaacgagggcaaatgagagatatgtcaatgtcatgttggattcatacccgtcttatgtctgtagaa

SEQ ID NO: 28360 - DNA, 75 bp, Artificial Sequence
  Synthetic
ggagaaggacattggtcagaaatagtaaaatttataagatatcaaaacttaaattttataatgtttttggataaa

SEQ ID NO: 28361 - DNA, 75 bp, Artificial Sequence
  Synthetic
tttcgtacgtttttaaagaatactccaaaaagaaattgtatgtgcttttatggtccaccagattctggtaaatct

SEQ ID NO: 28362 - DNA, 75 bp, Artificial Sequence
  Synthetic
atgtttactatgtccttaataaatgtattgaaaggaagagtactttcctttgcaaactccagaagccagttttgg

SEQ ID NO: 28363 - DNA, 75 bp, Artificial Sequence
  Synthetic
ttgcagcctttgtcagaaactaagcttgctttgctagatgatgctacacaagaatgctggaattatattgataca

SEQ ID NO: 28364 - DNA, 75 bp, Artificial Sequence
  Synthetic
tttttaagaaatggtgtagatggtaattatgtatctttagacattaaacacagggctccgttacagatcaaattt

SEQ ID NO: 28365 - DNA, 75 bp, Artificial Sequence
  Synthetic
cctccattaatgattaccacaaatatgaatatactaaaggaggaaaagtacaggtatctacatactagaatagaa

SEQ ID NO: 28366 - DNA, 75 bp, Artificial Sequence
  Synthetic
ttttttgaattcccaaacaaatttccatttgataataataacaagccacaatttcacctaactgaccaaagctgg

SEQ ID NO: 28367 - DNA, 75 bp, Artificial Sequence
  Synthetic
aaatctttttttgaaaggctttggacacaattagagctgagtgaccaagaagacgagggagaggaggatggagac

SEQ ID NO: 28368 - DNA, 75 bp, Artificial Sequence
  Synthetic
tctgagcgaacgtttcactgcactgcaagacaagttaatggacatatatgaatcaggcctagaaacattggaagt

SEQ ID NO: 28369 - DNA, 75 bp, Artificial Sequence
  Synthetic
ccaaattgagcactggcaactcttaagacaagagcaggtgcttctgaactttgctaggcgaaatggtattttgcg

SEQ ID NO: 28370 - DNA, 75 bp, Artificial Sequence
  Synthetic
actgggatatcaaccagtcccaagtcttgcaacttcagagaccaaagccaaagatgcaattggcatggtacttat

SEQ ID NO: 28371 - DNA, 75 bp, Artificial Sequence
  Synthetic
gttacaaagtttgcagaactccaaatatgccgaggaaacatggagtttggtgcaaactagccttgaaactgttcg

SEQ ID NO: 28372 - DNA, 75 bp, Artificial Sequence
  Synthetic
aagtcctcctgaaaattgctttaaaaaggaaccacagactattgaagtggtgtttgatggagatcctgaaaatcg

SEQ ID NO: 28373 - DNA, 75 bp, Artificial Sequence
  Synthetic
tatgatatacacagtatggaactggatttattttcagaatacagaggacatatggcaaaaagttaaaggacatgt

SEQ ID NO: 28374 - DNA, 75 bp, Artificial Sequence
  Synthetic
ggactatgagggtgccttttacatggaaggcacacacaaacattattatataaagtttgaaaatgatgctaacag

SEQ ID NO: 28375 - DNA, 75 bp, Artificial Sequence
  Synthetic
atttagcgctacaggactttgggaagttcatgttaaccaagatactgtgtttactcctgttactagctctacgtc

SEQ ID NO: 28376 - DNA, 75 bp, Artificial Sequence
  Synthetic
gcaagctggaagcagactatccccgctgccctctgaccccacatcccgacggcccagcccatccatctccacagt

SEQ ID NO: 28377 - DNA, 75 bp, Artificial Sequence
  Synthetic
caccaccaagcagcgacggtacgggcgaaaaagatctagccctacagccaccaccaccgggaggcagaggcagag

SEQ ID NO: 28378 - DNA, 75 bp, Artificial Sequence
  Synthetic
aacgcgagagacacagcaaaaaaccaaaagaaccagaagcaggagcagaacaaaatcaagcacccgttcaagaaa

SEQ ID NO: 28379 - DNA, 75 bp, Artificial Sequence
  Synthetic
ccgcagccgcagccgcagccgcagcagcggaaggcaagacaccgacgccaccaaagggcgagggcaaggtggaag

SEQ ID NO: 28380 - DNA, 75 bp, Artificial Sequence
  Synthetic
gggacgggaacgggaacgggaacgggaacgagaacgggaacgagcagacacctctaacagaacctcccgaggggg

SEQ ID NO: 28381 - DNA, 75 bp, Artificial Sequence
  Synthetic
agggcgaagtggaaggaggccgcaaacccggtcaagatccagatccggaggatctcccgacagggttggcattgc

SEQ ID NO: 28382 - DNA, 75 bp, Artificial Sequence
  Synthetic
gccttctgaagtgggaagaacattacaatctgttggtacaacaggtcatgggcgacttggaaggttactggatga

SEQ ID NO: 28383 - DNA, 75 bp, Artificial Sequence
  Synthetic
ggctaaagaccccccagtaattttgttaagaggggaagcaaaccagcttaaatgctatcgctttagagcacgcaa

SEQ ID NO: 28384 - DNA, 75 bp, Artificial Sequence
  Synthetic
aaagcacaaaggaaactataagtattttagtagtacctggtcctggataggggaacatagtaatgatagaatagg

SEQ ID NO: 28385 - DNA, 75 bp, Artificial Sequence
  Synthetic
tagagcccgaatgttagttagttttacatccacacaccaacgtgaaatgtttttagatactatgaaattaccaca

SEQ ID NO: 28386 - DNA, 75 bp, Artificial Sequence
  Synthetic
aggtgtagactggtcatatgggaattttgacagcttataatactaacctttttgctatttttaactgctgcctag

SEQ ID NO: 28387 - DNA, 75 bp, Artificial Sequence
  Synthetic
ctactaacatactaacatggcgcgtgcgcgcagaactaaacgtgcctctgtcacagatatatacaaaggctgcaa

SEQ ID NO: 28388 - DNA, 75 bp, Artificial Sequence
  Synthetic
agctgctggcacatgccctccagatgttattaataaagttgaaaacaaaactatagcagataaaatattgcaata

SEQ ID NO: 28389 - DNA, 75 bp, Artificial Sequence
  Synthetic
tggtagtgcagctgttttttttgggggcctgggtataagcacaggtaaaggcactggtggaacaacaggttatgt

SEQ ID NO: 28390 - DNA, 75 bp, Artificial Sequence
  Synthetic
gcctttgggagaaggccctggtgtgcgtgtaggtggcactccaacagtggttcgccctggggtcatacctgaagt

SEQ ID NO: 28391 - DNA, 75 bp, Artificial Sequence
  Synthetic
tattggtcccactgaagtaataccaattgatacagtcactccaattgaccctgcagcaccttccatagttaatct

SEQ ID NO: 28392 - DNA, 75 bp, Artificial Sequence
  Synthetic
gactgacagctctgcagttgaccttttacctggtgaaatagaaactattgcagaagtgcatcctgttcctgtgcc

SEQ ID NO: 28393 - DNA, 75 bp, Artificial Sequence
  Synthetic
agatacagaaatagacacacctgttgtaacaggcggtcgaggttcctctgctgtcctagaggtggcagaccccag

SEQ ID NO: 28394 - DNA, 75 bp, Artificial Sequence
  Synthetic
ccccccaatacgcacacgtgtgtcacgtacccagtatcacaatccatcctttcagataatatccgaatctacacc

SEQ ID NO: 28395 - DNA, 75 bp, Artificial Sequence
  Synthetic
tattgctggtgaggcatccctgtcagaccaagtgttagtgtttgaaaatactggaggacaaacaatcggtgggat

SEQ ID NO: 28396 - DNA, 75 bp, Artificial Sequence
  Synthetic
tcgggaagaaattgaattgcaacccttaccttctaggtatagttttgaaatagaagaagcaacaccaccaagaca

SEQ ID NO: 28397 - DNA, 75 bp, Artificial Sequence
  Synthetic
aaccagcacacctattgaaagaggtaggcaagcgctttcctccattcgaagagccctgtataataggcgcttaac

SEQ ID NO: 28398 - DNA, 75 bp, Artificial Sequence
  Synthetic
acagcaggtgccggtggaagatccattattttttagtaggccatctaaacttgtaagatttcaatttgataatcc

SEQ ID NO: 28399 - DNA, 75 bp, Artificial Sequence
  Synthetic
aacatttgaggaggaagtaacacaaatatttgaaagggatttagaatctgttgaagaacctcctgacaggcaatt

SEQ ID NO: 28400 - DNA, 75 bp, Artificial Sequence
  Synthetic
tttggatgttgccaagttaggtaggcctctatattccgaaaccccacaaggctatatacgggtcagtagattagg

SEQ ID NO: 28401 - DNA, 75 bp, Artificial Sequence
  Synthetic
caacagagcctctttacgaaccagaagcggtgcacaagtaggggcacaagtacacttttataaagatgttagtac

SEQ ID NO: 28402 - DNA, 75 bp, Artificial Sequence
  Synthetic
cattgattctgaagctcctattgaactacaattactgggggaacattcaggagacaccagtattatccaagggcc

SEQ ID NO: 28403 - DNA, 75 bp, Artificial Sequence
  Synthetic
tgttgaaagtacactggtggatattaatgtaagggatactccagaattgcttgaaagttctgaatttaactctca

SEQ ID NO: 28404 - DNA, 75 bp, Artificial Sequence
  Synthetic
ggatctacttattgatgatgctatagaggattttagtgggtcacagctagtgtttggcaaccctagacggtctac

SEQ ID NO: 28405 - DNA, 75 bp, Artificial Sequence
  Synthetic
cacttctgtcactgtacccagatttagttctccaagggaaactactttatatgtgcaggatatacaaggttacac

SEQ ID NO: 28406 - DNA, 75 bp, Artificial Sequence
  Synthetic
tgtagcatacccagaatcacgtgataggccagtaataatttatcctcaacctgagattcctgcagttgttatcca

SEQ ID NO: 28407 - DNA, 75 bp, Artificial Sequence
  Synthetic
ttttggggaatcaggtgctgattactatttacatccccatttacagcgacgcaagcgcaagcgagcttatttata

SEQ ID NO: 28408 - DNA, 75 bp, Artificial Sequence
  Synthetic
attgtttttcagatgtctttgtggcttcctgcaactggtaaagtatatttgccaccatcaactccggtggcacgg

SEQ ID NO: 28409 - DNA, 75 bp, Artificial Sequence
  Synthetic
gtgctaagtaccgatgagtacgtggagcggaccaatatattttatcacgccactagtgacagattattaacagta

SEQ ID NO: 28410 - DNA, 75 bp, Artificial Sequence
  Synthetic
ggacatccatattttgatgttcggtcgtctgatggctctaaagtagaagtacctaaagtgtcaggaaatcaattt

SEQ ID NO: 28411 - DNA, 75 bp, Artificial Sequence
  Synthetic
agggcatttcgaatgctgtttccagatcccaatcgatttgcattagcagacatgtcagtatacaatcctgacaag

SEQ ID NO: 28412 - DNA, 75 bp, Artificial Sequence
  Synthetic
gaaaggctggtatgggcctgtgcaggtatagaaattaatcgaggacaaccattaggtgttggtacaactggtcat

SEQ ID NO: 28413 - DNA, 75 bp, Artificial Sequence
  Synthetic
cctttgttcaataaggtaaaggacactgaaaatacaaatagctatcaaaacagttcaacagatgatagacaaaac

SEQ ID NO: 28414 - DNA, 75 bp, Artificial Sequence
  Synthetic
atttcatttgaccctaaacaagtacagatgtttgttataggatgcacaccatgtttaggggaatattgggatagg

SEQ ID NO: 28415 - DNA, 75 bp, Artificial Sequence
  Synthetic
gcactgccatgcgatgatgctggtgaccaacaaggtaaatgtccgcccattgaattaaaaaattcttttatagaa

SEQ ID NO: 28416 - DNA, 75 bp, Artificial Sequence
  Synthetic
gatggggatatgatagatattgggtttggcaatataaataacaagacattatcagtaaacaaatcagatgttagt

SEQ ID NO: 28417 - DNA, 75 bp, Artificial Sequence
  Synthetic
ttagatttagtaaatgaaatagctaaatatccagattttttaacaatggctaatgatgtgtatggcgattcttgc

SEQ ID NO: 28418 - DNA, 75 bp, Artificial Sequence
  Synthetic
tttttttttgccaggagagaacaatgttatgctagacattatttcactagaggaggagctgtgggtgatgctata

SEQ ID NO: 28419 - DNA, 75 bp, Artificial Sequence
  Synthetic
cctgatacaacaactaatcaagatcacaaatactatatagcacctaagagtggacaatcccaaagtcctttgggt

SEQ ID NO: 28420 - DNA, 75 bp, Artificial Sequence
  Synthetic
aattctatttactatcccaccgttagtggctccttagtttcttctgatgcacagctctttaacagacccttctgg

SEQ ID NO: 28421 - DNA, 75 bp, Artificial Sequence
  Synthetic
ttgaaacgtgcacaaggccacaataatggtattctatggggaaaccaaatgtttgttactgttgcagacaataca

SEQ ID NO: 28422 - DNA, 75 bp, Artificial Sequence
  Synthetic
aggaacaccaattttactataagtgtgcctagtcaaaatggaccccttacagaatatgatgccaataatatcagg

SEQ ID NO: 28423 - DNA, 75 bp, Artificial Sequence
  Synthetic
gaatttttaaggcatgttgaggaatatcaaatatctgtaatactgcaactttgtaaagtgtctttacaaccagat

SEQ ID NO: 28424 - DNA, 75 bp, Artificial Sequence
  Synthetic
gtgttagcccaaattaatgctatgaattcaggcattttggaagactggcaattaggttttgtaccaacaccagat

SEQ ID NO: 28425 - DNA, 75 bp, Artificial Sequence
  Synthetic
aattcagttcatgacacttatagatttattaattctgctgctactaaatgtcctgacaaggttgctcctaaagaa

SEQ ID NO: 28426 - DNA, 75 bp, Artificial Sequence
  Synthetic
aaggaagatccttttgctcaatactttttctggagagttgatatgacagaaaaattatctttggatttagatcag

SEQ ID NO: 28427 - DNA, 75 bp, Artificial Sequence
  Synthetic
tatcctttaggacgtaaattcctattccaaacaacactacctgcctctcgaaaacgtgcagcgccgaccaccaaa

SEQ ID NO: 28428 - DNA, 75 bp, Artificial Sequence
  Synthetic
tcggttgcaaagcatagcaaacgaaaacgtacttgaccgaaatcggtccctctcaataaacaagtattctaacta

SEQ ID NO: 28429 - DNA, 75 bp, Artificial Sequence
  Synthetic
aagtggtatgtgaagcattttttaaccgtgttcgtgactaaaccgaacaagtcaacaccagcaaccgcacccggt

SEQ ID NO: 28430 - DNA, 75 bp, Artificial Sequence
  Synthetic
aacaccgcagcgcccgccaaaagtctgccaagttttcttggcagaacatccatttggctgcaactgtcaccgata

SEQ ID NO: 28431 - DNA, 75 bp, Artificial Sequence
  Synthetic
agccaagaatatttggcagaacattttcttggaagacaaccgataacggtaagattgtaatctttcaaccgtagg

SEQ ID NO: 28432 - DNA, 75 bp, Artificial Sequence
  Synthetic
cggtactttctgattggtttggccgattgtagctaacaacaatctttcttcataaatacatgtaaccgcctgcgt

SEQ ID NO: 28433 - DNA, 75 bp, Artificial Sequence
  Synthetic
taacttacatgatctaaataaatatgatgagcaatacttaagagaatatatggctaggcctaagcctcaatctgt

SEQ ID NO: 28434 - DNA, 75 bp, Artificial Sequence
  Synthetic
tcaacagcttgcagatactttatgtatacctttagtagatgttttactgccttgcagattttgttatagattctt

SEQ ID NO: 28435 - DNA, 75 bp, Artificial Sequence
  Synthetic
agcatatatagaattgatcgcatttgatcgaaaaggtcttcaactaatttggaccgaagaagatttagtgtatgc

SEQ ID NO: 28436 - DNA, 75 bp, Artificial Sequence
  Synthetic
gtgctgtactagctgtgcctatgctacagcacagtttgaatttaccagtttctatgagcactcagttagtgggag

SEQ ID NO: 28437 - DNA, 75 bp, Artificial Sequence
  Synthetic
ggagatagaagagatagagcaaaagccaataggagaaatagccatacgctgcaaattttgcttaaagttattgga

SEQ ID NO: 28438 - DNA, 75 bp, Artificial Sequence
  Synthetic
tttgttagagaagttggagacttgctatactcagcaacaatttcacaaggttaggcgcaattggaaaggcttgtg

SEQ ID NO: 28439 - DNA, 75 bp, Artificial Sequence
  Synthetic
tagacattgtgggtcgataggatgattgggaaagaagctacaataccagaaatagtgcttgagctgcaagagctt

SEQ ID NO: 28440 - DNA, 75 bp, Artificial Sequence
  Synthetic
gtccagcccactgctgacctgcattgttacgaagagttgagtgaagaagagacagaggaggagcgtcctcacatc

SEQ ID NO: 28441 - DNA, 75 bp, Artificial Sequence
  Synthetic
ccttacaagattgtagctccgtgctgcttttgtggttctaaactacgactgatagttgttgcaacgcctattgga

SEQ ID NO: 28442 - DNA, 75 bp, Artificial Sequence
  Synthetic
attagatcacaagaagagctattacttggtgaagtgcagctggtttgtccaaactgtcgggggaagcttcgccat

SEQ ID NO: 28443 - DNA, 75 bp, Artificial Sequence
  Synthetic
gactgacgacacgaaaggtacaaaatttgatcctaaagaaggatgtagtgattggtttgtgctagaagcagaatg

SEQ ID NO: 28444 - DNA, 75 bp, Artificial Sequence
  Synthetic
ctctgacaatagtttagatggtgatttggaaaagttatttgaagaagggaatgatactgacatttctgatttaat

SEQ ID NO: 28445 - DNA, 75 bp, Artificial Sequence
  Synthetic
agatgatgaggacactgttcagggaaattcccgcgaattgttatgccagcaacaaagtgaggaaagcgagcaaca

SEQ ID NO: 28446 - DNA, 75 bp, Artificial Sequence
  Synthetic
aatacatttgctaaaacgaaagtatttcagttcacaagagattctgcagttaagtcctcgtctgcagtctattac

SEQ ID NO: 28447 - DNA, 75 bp, Artificial Sequence
  Synthetic
ttcagttcacaagagattctgcagttaagtcctcgtctgcagtctattactatttcgccacagcataagtctaaa

SEQ ID NO: 28448 - DNA, 75 bp, Artificial Sequence
  Synthetic
aggagattatttgaaggagacagcggactagaactgtcatttaatgaagctgaagattttactcagcagactttg

SEQ ID NO: 28449 - DNA, 75 bp, Artificial Sequence
  Synthetic
gaggtgcaggaggtatcggcatccggctctgagccggcagaccagggtgccaagggactgggcattgttaaagac

SEQ ID NO: 28450 - DNA, 75 bp, Artificial Sequence
  Synthetic
cttcttaaatgtagtaatgttaaagctatgttgttagcaaaatttaaagaagcatttggagttggctttatggaa

SEQ ID NO: 28451 - DNA, 75 bp, Artificial Sequence
  Synthetic
cttactaggcaatataaaagttgtaaaacatgttgcagagattgggttgtaacgttgtatgcagttcaagatgaa

SEQ ID NO: 28452 - DNA, 75 bp, Artificial Sequence
  Synthetic
ctgatagaaagctccaaacagctgttgcttcaacactgtgcttatatatggttgcagcatatgcctccaatgtgt

SEQ ID NO: 28453 - DNA, 75 bp, Artificial Sequence
  Synthetic
ttatatttattgtgttttaatgtgggtaaaagtagagaaactgtttttagactgctaatgaatttattgcaagta

SEQ ID NO: 28454 - DNA, 75 bp, Artificial Sequence
  Synthetic
gcagaagtacaaatattggctgaacctccaaagcttcggagcacattatctgcactgttttggtataaaggtagc

SEQ ID NO: 28455 - DNA, 75 bp, Artificial Sequence
  Synthetic
atgaatccaaatgtctatgcacatggtgaatatcctgagtggattatgacacaaaccatgatcaatcaccaatca

SEQ ID NO: 28456 - DNA, 75 bp, Artificial Sequence
  Synthetic
gcagaagctacacaatttgatttatccactatgatacaatatgcatatgacaatgatttaataaatgaagatgaa

SEQ ID NO: 28457 - DNA, 75 bp, Artificial Sequence
  Synthetic
attgcttataattatgccaaattagcagatacagacgctaatgccagagcttttttacagcacaatagtcaagcc

SEQ ID NO: 28458 - DNA, 75 bp, Artificial Sequence
  Synthetic
agattcgttagagaatgtgcactaatggttagatattacaaacgaggtgaaatgaaagatatgagcatatctgcc

SEQ ID NO: 28459 - DNA, 75 bp, Artificial Sequence
  Synthetic
tggatacataataaaatgttagttgtggaaggcgaaggacattggtctgatattgtaaagtttgtaagattccaa

SEQ ID NO: 28460 - DNA, 75 bp, Artificial Sequence
  Synthetic
gatatcaattttataaggtttctagatgtctttaaatcatttttgcataacactcctaaaaagaattgtctttta

SEQ ID NO: 28461 - DNA, 75 bp, Artificial Sequence
  Synthetic
ttttatggtccacctgatacaggcaaatcaatgtttactatgtctttaattaaagtgttaaaaggaaaagtttta

SEQ ID NO: 28462 - DNA, 75 bp, Artificial Sequence
  Synthetic
tcctttgcaaattataaaagtaatttttggttgcagccgttggcagatactaaaattgctttaatagatgacgtc

SEQ ID NO: 28463 - DNA, 75 bp, Artificial Sequence
  Synthetic
acgcatgtgtgttgggattacatagatcaatatttaagaaatggattggatggtaattttgtttgtttagaccta

SEQ ID NO: 28464 - DNA, 75 bp, Artificial Sequence
  Synthetic
aaacatagagcgccatgtcaaattaagtttccaccattattactgacttccaatatggatattatgaaggaagaa

SEQ ID NO: 28465 - DNA, 75 bp, Artificial Sequence
  Synthetic
aggtatagatatttacatagcagggtgcatgcttttgcatttccaaataagtttccttttgatagtaacaataag

SEQ ID NO: 28466 - DNA, 75 bp, Artificial Sequence
  Synthetic
ccacaatttcgacttactgaccaaagctggaaatctttttttgaaaggctttggaaacagttagatctcagtgac

SEQ ID NO: 28467 - DNA, 75 bp, Artificial Sequence
  Synthetic
caagaagacgagggagacgatggacacactcagcgatcgtttcaatgcactgcaagagaacctaatggacattta

SEQ ID NO: 28468 - DNA, 75 bp, Artificial Sequence
  Synthetic
tgagtcaggtcgagatgacctagagacccaaattatgcattggcaacttctaaggcaggagcagatcctgtttca

SEQ ID NO: 28469 - DNA, 75 bp, Artificial Sequence
  Synthetic
ttatgccagaaaaaatggagtcatgcgtttaggatatcaacctgtacctcctttagccaccagtgaagctaaagc

SEQ ID NO: 28470 - DNA, 75 bp, Artificial Sequence
  Synthetic
aaaagatgcaattggcatggttatattattagaaagtttacaacagtctgcttatggtaaagagtcctggacact

SEQ ID NO: 28471 - DNA, 75 bp, Artificial Sequence
  Synthetic
tacacaaactagtttggagaccgtgaggagtccacctgcaaattgttttaaaaagggccctcagaacattgaagt

SEQ ID NO: 28472 - DNA, 75 bp, Artificial Sequence
  Synthetic
gatgtttgacaatgaccctgaaaatctaatggtgtatactgcctggtcatttatttattatcagactgtagatga

SEQ ID NO: 28473 - DNA, 75 bp, Artificial Sequence
  Synthetic
cacgtggaacaaggttgagggacatgttgactactatggtgcatattattttgaaggagatttaaaagtctatta

SEQ ID NO: 28474 - DNA, 75 bp, Artificial Sequence
  Synthetic
tatacaatttgaaggtgatgctgccaggtttagcaaaactggacgctgggaagtacatgttaacaaggacactat

SEQ ID NO: 28475 - DNA, 75 bp, Artificial Sequence
  Synthetic
ctttgctcctgttactagctcttcgccggcagctggagaagggacagacggggcagcctccgtccacaccgtatc

SEQ ID NO: 28476 - DNA, 75 bp, Artificial Sequence
  Synthetic
cgggtcgccgctcgcacggggattctctaccacctccgtgtccaccagaaaacggacaccaccacggcgatacag

SEQ ID NO: 28477 - DNA, 75 bp, Artificial Sequence
  Synthetic
aagaaaagcatctagccctacaaccaccgccgcccggcaaaaaagacaaggagaagacaccgcaacaaggcgatc

SEQ ID NO: 28478 - DNA, 75 bp, Artificial Sequence
  Synthetic
aaggtccacctcccgggggaaacaagcaacctccaggggaggggaccgacgcagacggagacgagaacgctccta

SEQ ID NO: 28479 - DNA, 75 bp, Artificial Sequence
  Synthetic
ctcccgagacacctccagttcccccgacaggggaaggggagggagaagtagaggggggcccgagacacgatccca

SEQ ID NO: 28480 - DNA, 75 bp, Artificial Sequence
  Synthetic
atcaaggtccctctcacgatcccggtcgcggtcgcgatccagagggtcttcttccaggggtggcgttgcgcctga

SEQ ID NO: 28481 - DNA, 75 bp, Artificial Sequence
  Synthetic
cgcagtgggaaagtcagttcgaacagttggtagagaccatagtggacgacttaaaagattactggacgaagctag

SEQ ID NO: 28482 - DNA, 75 bp, Artificial Sequence
  Synthetic
ggatcccccagtaattgtgctgcgtggtgatgctaacaaattaaaatgctatcgctatagagctaagaaaaagca

SEQ ID NO: 28483 - DNA, 75 bp, Artificial Sequence
  Synthetic
tggaaacctagttaagtactacagtaccacgtggtcatgggttgggggcagcaccaatgatagaattggaaggtc

SEQ ID NO: 28484 - DNA, 75 bp, Artificial Sequence
  Synthetic
acgcatgttacttgcatttcaatccaatacagaaagagagttgtttttaaaaactatgaaattaccaccaggagt

SEQ ID NO: 28485 - DNA, 75 bp, Artificial Sequence
  Synthetic
tgattggtcactgggtcatttagatgaattgtgaaaacagcttttttataacaaactaacattgcttttgctttt

SEQ ID NO: 28486 - DNA, 75 bp, Artificial Sequence
  Synthetic
gctactaacctactaacgttccaatggctcgcgcacgtcgtaccaaacgtgcgtctgtaactgacatttacaggg

SEQ ID NO: 28487 - DNA, 75 bp, Artificial Sequence
  Synthetic
gttgcaagcaggccggcacttgcccccccgatgtaattaataaagtggaacaaacaacaattgcagacaaaattt

SEQ ID NO: 28488 - DNA, 75 bp, Artificial Sequence
  Synthetic
tgaagtatggtggtgctggtgttttttttggtgggcttgggattagcaccggccgaggaacaggtggtgctacag

SEQ ID NO: 28489 - DNA, 75 bp, Artificial Sequence
  Synthetic
gatatgtccctttgggggaaggccctggagtgcgcgtaggaggcgcacccaccattgttcgccctggggtcatac

SEQ ID NO: 28490 - DNA, 75 bp, Artificial Sequence
  Synthetic
ctgaattgattgggccagcagatgtaatacctattgacacagtcactccaattgaccccgcagcacccagtattg

SEQ ID NO: 28491 - DNA, 75 bp, Artificial Sequence
  Synthetic
tcacaattacagacagtagtgctgttgaccttttacctaatgaaatagaaacaattgcagaagtgcatcctgtgc

SEQ ID NO: 28492 - DNA, 75 bp, Artificial Sequence
  Synthetic
caacagacaatttggatattgatactcctgtagttacaggaggccgggattccagcgctgttttggaagttgctg

SEQ ID NO: 28493 - DNA, 75 bp, Artificial Sequence
  Synthetic
atcctagtccccctgtgcgaacaagagtttccagaacacaatatcataatccttcttttcaaataataactgaat

SEQ ID NO: 28494 - DNA, 75 bp, Artificial Sequence
  Synthetic
ctacacctttagcaggagaatctgctttagctgaccatgttattgtttttgaaggcactggaggacaaaatatag

SEQ ID NO: 28495 - DNA, 75 bp, Artificial Sequence
  Synthetic
gtggttctcgaaatgcaactatagaaacagctcaagaaagttttgaaatgcaaagttggccgagtaggtatagtt

SEQ ID NO: 28496 - DNA, 75 bp, Artificial Sequence
  Synthetic
ttgaaatagaagaaggaacacctcctagatctagcacaccagtacaaagagcagtacaatcactctctagtttaa

SEQ ID NO: 28497 - DNA, 75 bp, Artificial Sequence
  Synthetic
gacgggcattgtataataggagattaacagaacaggtagcagtcacggatcctttattcttgagtagaccctcac

SEQ ID NO: 28498 - DNA, 75 bp, Artificial Sequence
  Synthetic
aattagtacagtttcagtttgacaatcctgcatttgaagaagaagtaactcaaatatttgagagggatttagagg

SEQ ID NO: 28499 - DNA, 75 bp, Artificial Sequence
  Synthetic
ctgtagaagaacctccagatagacagtttttggatgttattcgcttaggtagacctactgttgctgaaacaccac

SEQ ID NO: 28500 - DNA, 75 bp, Artificial Sequence
  Synthetic
aagcgtatttaagagtaagcagattaggacgtcgtgctaccatccgtactcgtagtggagcacaggtgggggctc

SEQ ID NO: 28501 - DNA, 75 bp, Artificial Sequence
  Synthetic
aggtacatttttatagagatttaagtactatagattctgatgccctagaaatgcaattattaggagaacattcag

SEQ ID NO: 28502 - DNA, 75 bp, Artificial Sequence
  Synthetic
gtgatactactatagtacaaggacctgtagaaagttcatttgttgatataaatattgatgaaccaggtcccttaa

SEQ ID NO: 28503 - DNA, 75 bp, Artificial Sequence
  Synthetic
atatagggcaacaagagtctactatggcagatgacacagattttaattctgcagatttattgttagaggatgctg

SEQ ID NO: 28504 - DNA, 75 bp, Artificial Sequence
  Synthetic
tagaagacttctcaggatctcagttggtttttggaacctcacgccgcagtacaaattctatcacaatacctagat

SEQ ID NO: 28505 - DNA, 75 bp, Artificial Sequence
  Synthetic
ttgaaactccaagagatactggattttatatacaagatattcaaggttacaatgtagcctatcctgagtcacgtg

SEQ ID NO: 28506 - DNA, 75 bp, Artificial Sequence
  Synthetic
acacaacacaagttatcttgccacaacctgaaacaccaactgtagttattagatttggagaggcaggtacagact

SEQ ID NO: 28507 - DNA, 75 bp, Artificial Sequence
  Synthetic
attatttacatcctagcttaaaaaagaaaaagagaaaacgcaaatatttataattgtttttacagatgactttgt

SEQ ID NO: 28508 - DNA, 75 bp, Artificial Sequence
  Synthetic
ggctgccagcgacgggtaaagtatacttgcctccaacaccaccagtagcccgggtgcaaagcacggatgattatg

SEQ ID NO: 28509 - DNA, 75 bp, Artificial Sequence
  Synthetic
tggaaagaacaaatgtattctatcatgccatgagcgatcgtctcctaactgtaggacacccatattatgatgtaa

SEQ ID NO: 28510 - DNA, 75 bp, Artificial Sequence
  Synthetic
gatctagtgatggcttaaaaatcgaggttcctaaagtatctggaaatcaatacagagcttttagggttaggttgc

SEQ ID NO: 28511 - DNA, 75 bp, Artificial Sequence
  Synthetic
cagatccaaataaatttgctttagcagatatgtcagtatataatccagaaaaggaaaggttggtgtgggcctgtg

SEQ ID NO: 28512 - DNA, 75 bp, Artificial Sequence
  Synthetic
cgggcttggagataggccgagggcaaccacttggagtaggaacgacaggtcaccctttatttaataaattaaggg

SEQ ID NO: 28513 - DNA, 75 bp, Artificial Sequence
  Synthetic
acactgagaataatagtaattaccaaggggggtcacgggatgatagacaaaacacatcatttgatccaaaacaag

SEQ ID NO: 28514 - DNA, 75 bp, Artificial Sequence
  Synthetic
tacagatgtttgtggttggatgtgtgccatgcatgggtgaacattgggataaagcaccagtttgtgcatcagagg

SEQ ID NO: 28515 - DNA, 75 bp, Artificial Sequence
  Synthetic
aaaataatcagacaggacagtgtccaccacttgaattaaaaaacacagtgattgaagatggggacatgtttgata

SEQ ID NO: 28516 - DNA, 75 bp, Artificial Sequence
  Synthetic
tagggttcggaaatattaacaataaggttctctctactaataaatcagatgttagtttagatatagtaaatgaaa

SEQ ID NO: 28517 - DNA, 75 bp, Artificial Sequence
  Synthetic
tatgcaaataccctgattttttaacaatggctaatgatgtttatggggatgcatgtttcttttttgctaggagag

SEQ ID NO: 28518 - DNA, 75 bp, Artificial Sequence
  Synthetic
aacaatgttatgccagacattattttgtaagagggggaaatgtaggtgatgctattcccgatggcactgttaatc

SEQ ID NO: 28519 - DNA, 75 bp, Artificial Sequence
  Synthetic
aggaccacaaatattacttacctgccaaatcagaccagcagcagtatctgttaggcaattctacctattttccca

SEQ ID NO: 28520 - DNA, 75 bp, Artificial Sequence
  Synthetic
ctgttagtggatctttagtaacatctgatgctcagctctttaacaggcctttttggttacgcagagctcaaggtc

SEQ ID NO: 28521 - DNA, 75 bp, Artificial Sequence
  Synthetic
acaacaatggcattttatggggtaatcaaatgtttatcacagttgctgataatacacggaacacaaacttttcta

SEQ ID NO: 28522 - DNA, 75 bp, Artificial Sequence
  Synthetic
ttagtgtgtctactgacaatggcgaagttacagaatataattctcaaacactcagagaatacctaagacatgttg

SEQ ID NO: 28523 - DNA, 75 bp, Artificial Sequence
  Synthetic
aagaataccagctttcaattattttacaactttgtaaagttcctttaaaggctgaggttttaactcagataaatg

SEQ ID NO: 28524 - DNA, 75 bp, Artificial Sequence
  Synthetic
caatgaattctggtatattggaagagtggcaattaggatttgtacctactccagataattcagtacatgaccttt

SEQ ID NO: 28525 - DNA, 75 bp, Artificial Sequence
  Synthetic
ataggtacattaattcaaaggctaccaagtgtcctgatgcagttgttgaaaaagaaaaggaagatccctttgcaa

SEQ ID NO: 28526 - DNA, 75 bp, Artificial Sequence
  Synthetic
aatatacattttggaatgtagatttaactgaaaaattatcattggatttagatcaatatcctttagggaggaaat

SEQ ID NO: 28527 - DNA, 75 bp, Artificial Sequence
  Synthetic
tcatctttcagtcgggattgcaaagtagacctagaattgttcgatcgtctgtaaaagtgtctaaaggtacaaagc

SEQ ID NO: 28528 - DNA, 75 bp, Artificial Sequence
  Synthetic
gtaaacggtcgtgaccgttttcggtttccaataaacaaataaaccaataaggtatgtgaagcattttttaccatg

SEQ ID NO: 28529 - DNA, 75 bp, Artificial Sequence
  Synthetic
ttcgtgactaaaccatataagtcaacgccaacaaccgcacccggtttaatcagatataaaacacctggtgcgatt

SEQ ID NO: 28530 - DNA, 75 bp, Artificial Sequence
  Synthetic
taatcagatataaaacacctggtgcgattttatcagagcttttgtggaagcacctgaggcgaccgccagaactgc

SEQ ID NO: 28531 - DNA, 75 bp, Artificial Sequence
  Synthetic
aacggtaagatttttatctattaaccgtaggcgttactttctgattggtaagactgattgtagttaacaacaatc

SEQ ID NO: 28532 - DNA, 75 bp, Artificial Sequence
  Synthetic
ttgatttatagctacatgtaaccgcatgcgttacaatttaggtacatctacataaatatatttctcacacctatc

SEQ ID NO: 28533 - DNA, 75 bp, Artificial Sequence
  Synthetic
acatactatttaagaggttagatggccaggccaaagcctttgacagtacaacagcttgcagatacattatgcatt

SEQ ID NO: 28534 - DNA, 75 bp, Artificial Sequence
  Synthetic
cctgttttagacatattaataccgtgtagattttgtactaggtttttatcatatatagaattattaggttttgat

SEQ ID NO: 28535 - DNA, 75 bp, Artificial Sequence
  Synthetic
tataaagggttacaacttatttggactgaggaagattttgtttttgcatgctgtagtagttgtgctcatgctaca

SEQ ID NO: 28536 - DNA, 75 bp, Artificial Sequence
  Synthetic
gcgcaatatgaatttacaaggttttatgaacattctgtaaatggacgtgaaatagaaatagtagagcaaaaagga

SEQ ID NO: 28537 - DNA, 75 bp, Artificial Sequence
  Synthetic
attggggaagtggttgtgcgttgccaatattgtttaaaacgtctagatctaatagagaagctagaagtttgttgt

SEQ ID NO: 28538 - DNA, 75 bp, Artificial Sequence
  Synthetic
aagcatcagcaatttcatagggtaagaggcaattggaaaggagtgtgcagacattgtgggtcgataggatgattg

SEQ ID NO: 28539 - DNA, 75 bp, Artificial Sequence
  Synthetic
ggaaacaagctactataccagacattgttctggaattgcaagagcttgttcagcccactgctgacctgcattgct

SEQ ID NO: 28540 - DNA, 75 bp, Artificial Sequence
  Synthetic
acgaggagttaactgaagaagaaacagaggaggagtcacgtcatacaccttacaagattgttgctgcttgtggcc

SEQ ID NO: 28541 - DNA, 75 bp, Artificial Sequence
  Synthetic
tttgtggtgcgcgacttcggctttttgtgcttgcaacagtttttggaattcgtactcagcaagaaattttgcttg

SEQ ID NO: 28542 - DNA, 75 bp, Artificial Sequence
  Synthetic
gtgaagtacagctgctgtgtccagagtgtcgggagaagcttcgccatgagtaacgataaaggtacagaaaatgat

SEQ ID NO: 28543 - DNA, 75 bp, Artificial Sequence
  Synthetic
gccaaacaaggatgtagtgattggtttttagaggaagcagagtgctctgatgctagtttagatggtgatttggaa

SEQ ID NO: 28544 - DNA, 75 bp, Artificial Sequence
  Synthetic
aagttatttgaagaaggtgcagatacagacatttctgattttatagatgatgaaaacactattcagggaaactcc

SEQ ID NO: 28545 - DNA, 75 bp, Artificial Sequence
  Synthetic
cgcgaattgttatgcctgcaggaaagcgaggagagcgagcaacagatacaattgctaaaacgaaagtatttcagt

SEQ ID NO: 28546 - DNA, 75 bp, Artificial Sequence
  Synthetic
tcacaagaggttttgcagcttagcccacgactgcagtctatcagtatatcgccacagcataaatctaaaaggaga

SEQ ID NO: 28547 - DNA, 75 bp, Artificial Sequence
  Synthetic
ttatttgaacaagacagcggactagatctttctctaaatgaagctgaagataattctcagacattggaggtggcg

SEQ ID NO: 28548 - DNA, 75 bp, Artificial Sequence
  Synthetic
gaggtaccggcgtccatagttgcgccggcagctcaaagtgctgagggtttgggtattgttaaagacttacttaaa

SEQ ID NO: 28549 - DNA, 75 bp, Artificial Sequence
  Synthetic
tgcagcaatgtaaaggctgtattattggccaaatttaaggaatcatttggtgtaggatttatggaattgacaaga

SEQ ID NO: 28550 - DNA, 75 bp, Artificial Sequence
  Synthetic
caatataaaagtaataagacttgttgtagagactgggtagttacagcttatgctgtgaaggatgaactaatagaa

SEQ ID NO: 28551 - DNA, 75 bp, Artificial Sequence
  Synthetic
agctctaaacaattgcttctgcagcattgtgcttatatatggctacaaaatatgccacctatgactttatattta

SEQ ID NO: 28552 - DNA, 75 bp, Artificial Sequence
  Synthetic
ttgtgttttaatgtaggtaaaagcagagacactgtttgtagattgctaatgagtctcttgcaaattggagagatt

SEQ ID NO: 28553 - DNA, 75 bp, Artificial Sequence
  Synthetic
caattaatagctgagccaccaaagttaagaagtgtattggcagcactattttggtataaaggaagcatgaatcct

SEQ ID NO: 28554 - DNA, 75 bp, Artificial Sequence
  Synthetic
aatgtatatgctcatggtgaatatccagagtggataatggcacaaactatgataaatcatcaaactgcagacgct

SEQ ID NO: 28555 - DNA, 75 bp, Artificial Sequence
  Synthetic
actcaatttgatttgtctagtatgatacaatttgcttatgataatgaatatttaaatgaagatgaaatagcatac

SEQ ID NO: 28556 - DNA, 75 bp, Artificial Sequence
  Synthetic
cattatgctaaattggctgatacagacgcaaatgctagagcttttctgcaacataatagccaagctcgttttgtt

SEQ ID NO: 28557 - DNA, 75 bp, Artificial Sequence
  Synthetic
agagaatgtgctattatggtgagacattataaacgtggtgaaatgaaagaaatgtcaatgtctacctggatacat

SEQ ID NO: 28558 - DNA, 75 bp, Artificial Sequence
  Synthetic
agaaaattactaacagtagaaggcgaaggtcattggtcgcatatagttaaatttttacggtttcaggaaattaat

SEQ ID NO: 28559 - DNA, 75 bp, Artificial Sequence
  Synthetic
tttatttactttcttgatgtatttaaagcttttttgcataatactcctaaacaaaattgtatactaatacatgga

SEQ ID NO: 28560 - DNA, 75 bp, Artificial Sequence
  Synthetic
cctccagacacaggaaagtctatgtttactatgtctttattaagagtactgaaaggtaaagtgttatcatttgta

SEQ ID NO: 28561 - DNA, 75 bp, Artificial Sequence
  Synthetic
aattgtaaaagtacattttggttgcaacctgtagcagacacaaaacttgcattgatagatgatgttacagatgta

SEQ ID NO: 28562 - DNA, 75 bp, Artificial Sequence
  Synthetic
tgttgggactatatagataaatatcttagaaatgtattagatgggaatgttgtttgtctggatatgaaacataaa

SEQ ID NO: 28563 - DNA, 75 bp, Artificial Sequence
  Synthetic
gctccatgccaattaaaatttcctcctttattattaacatccaatatggatataatgaaagaagaaaaatataga

SEQ ID NO: 28564 - DNA, 75 bp, Artificial Sequence
  Synthetic
tatttgcatagtagacttaggagctttgcatttccaaataagtttccttttgataatgaccataaaccacaattt

SEQ ID NO: 28565 - DNA, 75 bp, Artificial Sequence
  Synthetic
caacttactgaccaaagctggaaatctttttttgaaaggctttggaaacagttagatctcagtgatcaagaagaa

SEQ ID NO: 28566 - DNA, 75 bp, Artificial Sequence
  Synthetic
gagggagacgatggaaactctcagcgatcgtttcaatgcactgcaagacaaattaatggacatttatgagtctgg

SEQ ID NO: 28567 - DNA, 75 bp, Artificial Sequence
  Synthetic
tcaagatgacctagaaactcaaatattgcattggaaatatttaagagaggagcaagtgcttttgtattatgccag

SEQ ID NO: 28568 - DNA, 75 bp, Artificial Sequence
  Synthetic
gagaaatggcataatgagattggggtatcagttggtaccaccattagctaccagtgaagctaaagcaaaagatgc

SEQ ID NO: 28569 - DNA, 75 bp, Artificial Sequence
  Synthetic
aattggcatgatgctccttttgcaaagtctgcaaaggtctccttatgcttctgagtcatggacattaatgcagac

SEQ ID NO: 28570 - DNA, 75 bp, Artificial Sequence
  Synthetic
tagtttggaagcagtgagaagtccacctgcgaactgctttaagaaaggtccatacaatattgaagtaatgtatga

SEQ ID NO: 28571 - DNA, 75 bp, Artificial Sequence
  Synthetic
cagtgatccagagaatctaatgtcatacacattatggtcattcatttattatcaaagagtagatgatacttggaa

SEQ ID NO: 28572 - DNA, 75 bp, Artificial Sequence
  Synthetic
caaagtggaaggccatgtggactataatggtgcttattattatgaaggcaatttaaaaacctattatattgagtt

SEQ ID NO: 28573 - DNA, 75 bp, Artificial Sequence
  Synthetic
tgaaagtgatgctgccagatatggcaaaactggacaatgggaagtgcatgttaacaaggacactatctttgctcc

SEQ ID NO: 28574 - DNA, 75 bp, Artificial Sequence
  Synthetic
tgtcactagcacttcgccgggaactggaggaggggactccgaccaaacctccgtccactccgtatcccgggcgtc

SEQ ID NO: 28575 - DNA, 75 bp, Artificial Sequence
  Synthetic
atcaaccgtcgcgcgacggtctgcctcccccctgcccacccgaaccaccacacaacggtcacgaaccgaaagcag

SEQ ID NO: 28576 - DNA, 75 bp, Artificial Sequence
  Synthetic
acggtaccaacgaaaagaatctagccctacatccaccgccacccggcaacaaaaaagacagcgagaagaagaaac

SEQ ID NO: 28577 - DNA, 75 bp, Artificial Sequence
  Synthetic
caacaggcgatcaaggtccagctcccgggggcaagaagcagactggggaggggatcgacgcagaaggaggggagg

SEQ ID NO: 28578 - DNA, 75 bp, Artificial Sequence
  Synthetic
agactcctccaccaggagccactcctccaacagggcaaggggagggagaagtggagggaggcccagaacaaggtc

SEQ ID NO: 28579 - DNA, 75 bp, Artificial Sequence
  Synthetic
ccaatctcgctccaaatcaaggtcgagatccagaggcccttctaccaggcgtggcgtctcgcctgctgaggtggg

SEQ ID NO: 28580 - DNA, 75 bp, Artificial Sequence
  Synthetic
agagtcacttcgatcagttggtcgacgacatcatgaccgacttgaaaggctactggacgaggctaaagacccccc

SEQ ID NO: 28581 - DNA, 75 bp, Artificial Sequence
  Synthetic
agtagttttgttgcgcggcgctgctaacaccttaaagtgctatcgctacagagctaaaaagaagtatagtgcttt

SEQ ID NO: 28582 - DNA, 75 bp, Artificial Sequence
  Synthetic
agtgaaatactttagcactacatggtcttgggttgggggcgacaataatgatagaatagggcgtgctagaatgct

SEQ ID NO: 28583 - DNA, 75 bp, Artificial Sequence
  Synthetic
attagcttttagctcaaatacacaaagagaattgtttttaaaagtaatgaaattgccacctaatgtagattggtc

SEQ ID NO: 28584 - DNA, 75 bp, Artificial Sequence
  Synthetic
tttaggatctttagatgatttataaactactaataacctactaacttgctttgctactaacacaactaatgttcc

SEQ ID NO: 28585 - DNA, 75 bp, Artificial Sequence
  Synthetic
atggctcgtgcacgtagaacaaagcgtgcatctgtaacagacatctacaggggctgcaagcaagctggtacttgc

SEQ ID NO: 28586 - DNA, 75 bp, Artificial Sequence
  Synthetic
cctcctgatgttattaataaagtggaacaaactactatagcagataaaattttaaaatatggcagtgctggtgtc

SEQ ID NO: 28587 - DNA, 75 bp, Artificial Sequence
  Synthetic
ttttttggcgggttgggaattggcacaggccgtggaacaggcggtgccacaggatatgtccctttgggggaagga

SEQ ID NO: 28588 - DNA, 75 bp, Artificial Sequence
  Synthetic
cctggtgtacgtgtgggcggcactcccaccatagtccgccctggggtcattcctgaattgattggaccaacagat

SEQ ID NO: 28589 - DNA, 75 bp, Artificial Sequence
  Synthetic
gtaataccaattgacacagtcacaccaattgaccctacagcacccagtattgtcacaataactgacactacagct

SEQ ID NO: 28590 - DNA, 75 bp, Artificial Sequence
  Synthetic
gttgaccttttacccagtgaaatagaaactattgctgaggtgcatcctgtccctacagataatgtgccagtagac

SEQ ID NO: 28591 - DNA, 75 bp, Artificial Sequence
  Synthetic
acaccagttgtttcaggtggccgcggttctgcagctgtactagaagttgcagatcctagccctcctgtgcgttca

SEQ ID NO: 28592 - DNA, 75 bp, Artificial Sequence
  Synthetic
agaatttctcggacacaataccagaatccatcctttcaaattattacagaatctacaccattgctaggcgaatct

SEQ ID NO: 28593 - DNA, 75 bp, Artificial Sequence
  Synthetic
tctatggcagatcatgttttagtatttgaaggtgcaggtggacaaagtattggtggcactagacaggctgccatt

SEQ ID NO: 28594 - DNA, 75 bp, Artificial Sequence
  Synthetic
gatacagcacaggaaagtattgagctacaatcatggcctagcagatatagctttgaaattgaggaaggtactcca

SEQ ID NO: 28595 - DNA, 75 bp, Artificial Sequence
  Synthetic
ccacgaacaagtacaccagtacaacgtgcagtagaatctctgtctaaccttagaagggctttatacaacagaaga

SEQ ID NO: 28596 - DNA, 75 bp, Artificial Sequence
  Synthetic
ttaactgaacaggtagcagtaacagatcctttatttttaagcaggccttctcgtttggtgcaatttcaatttgat

SEQ ID NO: 28597 - DNA, 75 bp, Artificial Sequence
  Synthetic
aatcctgcttttgatgaagaagtgacacaattgtttgaaagagatgtagaaaattttgaggagccacctgataga

SEQ ID NO: 28598 - DNA, 75 bp, Artificial Sequence
  Synthetic
caatttttagatgtggtaagattaggccgtcccacagtcgctgaaacacctcaaggttatttaagagtcagtcgg

SEQ ID NO: 28599 - DNA, 75 bp, Artificial Sequence
  Synthetic
cttggacggcgtgcaaccattagaactcgcagtggtgctcaagtaggaacacaagtacacttttacagagattta

SEQ ID NO: 28600 - DNA, 75 bp, Artificial Sequence
  Synthetic
agcacaattgattctgaagctcctattgaaatgcaaatacttggtgaacattcaggagacagcacaattattcag

SEQ ID NO: 28601 - DNA, 75 bp, Artificial Sequence
  Synthetic
ggtcccgtggaaagttcctttgtagatgttaatatagacgagccagatcctttaaatgttgggcagtttgaatca

SEQ ID NO: 28602 - DNA, 75 bp, Artificial Sequence
  Synthetic
atggaaatagaagaaccagattataattctgctgattttttactagatgaccatgtagatgattttagtggttca

SEQ ID NO: 28603 - DNA, 75 bp, Artificial Sequence
  Synthetic
caattggtatttggaaatcctagacgcagcacaacttcagtgactgtaccgcgatttgaaactccaagagataca

SEQ ID NO: 28604 - DNA, 75 bp, Artificial Sequence
  Synthetic
ggtttttatatacaagatattcaaggccatactgttgcttacccagaatctagagacaacactgaaattatactc

SEQ ID NO: 28605 - DNA, 75 bp, Artificial Sequence
  Synthetic
ccactacctgatactccaactgtggtcatacacatcagtgacactagtggtgattattatttacatcccagttta

SEQ ID NO: 28606 - DNA, 75 bp, Artificial Sequence
  Synthetic
caaacacgaaaacgaagacgcaaacgcaaatatttgtaattgttttacagatgaccttgtggcttcctgcttcgg

SEQ ID NO: 28607 - DNA, 75 bp, Artificial Sequence
  Synthetic
gtaaagtatacttgccaccatcgccaccggtagcacgtgtccaaagcaccgatgaatatgtggagcgaacaaatg

SEQ ID NO: 28608 - DNA, 75 bp, Artificial Sequence
  Synthetic
tgttttatcatgcaagcagtgatcgcttgttaatagtgggacacccttattatgatgttagatcaggagatggcg

SEQ ID NO: 28609 - DNA, 75 bp, Artificial Sequence
  Synthetic
caaaaatagaagtccctaaggtatcaggaaatcaatacagagcattccgggtgcaattgcctgatcctaataggt

SEQ ID NO: 28610 - DNA, 75 bp, Artificial Sequence
  Synthetic
ttgcattagcagacatgtctgtatataatccagataaagaacgtttagtgtgggcctgtaggggtgttgaaatag

SEQ ID NO: 28611 - DNA, 75 bp, Artificial Sequence
  Synthetic
gccgtgggcaacctttaggggtaggtaccagtggtcatcccttatttaataaagttagagatactgaaaattcta

SEQ ID NO: 28612 - DNA, 75 bp, Artificial Sequence
  Synthetic
gcaattatcaagcaggctctactgatgacaggcagaatacttcatttgatcctaaacaggttcaaatgtttgtta

SEQ ID NO: 28613 - DNA, 75 bp, Artificial Sequence
  Synthetic
ttggttgtgtgccctgtatgggagagcattgggacaaagctcctgtttgtgaatcagaagcaggtaatcagttag

SEQ ID NO: 28614 - DNA, 75 bp, Artificial Sequence
  Synthetic
gtttatgtcctccattagaattaaaaaactcagtaatagaagatggagatatgtttgacataggctttggaaaca

SEQ ID NO: 28615 - DNA, 75 bp, Artificial Sequence
  Synthetic
tcaataataaagtgctatcatttaataggtcagatgttagtttagatatagttaatgaaatttgcaaatatcctg

SEQ ID NO: 28616 - DNA, 75 bp, Artificial Sequence
  Synthetic
attttttaactatggcaaatgatgtttatggagatgcctgctttttctttgctagacgagaacagtgttatgcta

SEQ ID NO: 28617 - DNA, 75 bp, Artificial Sequence
  Synthetic
ggcattactttgttagagggggtgctgtaggggatgcaatacctgatggtgcagtgaatcaaaatcataactatt

SEQ ID NO: 28618 - DNA, 75 bp, Artificial Sequence
  Synthetic
tcttgccagcaaagcaagatcaacaacaacgcacactagcaaactctacatattttccaacagtaagtggttctc

SEQ ID NO: 28619 - DNA, 75 bp, Artificial Sequence
  Synthetic
tagttacttcagatgctcagttatttaatagaccattttggttacaaagagcacaaggccataataatggcatat

SEQ ID NO: 28620 - DNA, 75 bp, Artificial Sequence
  Synthetic
tgtggggaaatcaaatgtttataactgttgctgataatactcgtaatactaatttttcaattagtgttactacag

SEQ ID NO: 28621 - DNA, 75 bp, Artificial Sequence
  Synthetic
aagctggagcaactgaatacaattcacaaaatataagagaatttcttagacatgtagaggaatatcaactttctt

SEQ ID NO: 28622 - DNA, 75 bp, Artificial Sequence
  Synthetic
taatactgcaattatgtaaggtacccttaaaagcagaggttttaacacaaattaatgcaatgaactcaggtatct

SEQ ID NO: 28623 - DNA, 75 bp, Artificial Sequence
  Synthetic
tagaagagtggcagttaggatttgttcctacaccagataattcagtacatgatacttataggtatataaactcaa

SEQ ID NO: 28624 - DNA, 75 bp, Artificial Sequence
  Synthetic
aagctacaaaatgtccagatgctgtagttcctaaggaaaaagaagatccatttgctaaatattctttttggcacg

SEQ ID NO: 28625 - DNA, 75 bp, Artificial Sequence
  Synthetic
tagatttaactgaaaaactatcattagatttagatcagtatcctcttggtagaaaatttttatttcaggctggtt

SEQ ID NO: 28626 - DNA, 75 bp, Artificial Sequence
  Synthetic
tacaaagtcgacctcgctctgtaaggacatctgttaaggtctctaagggtaccaaacgcaaacggtcgtgaccga

SEQ ID NO: 28627 - DNA, 75 bp, Artificial Sequence
  Synthetic
tatcggtgtcaataaattttataaccaatctggtatgtgaagtatgttttttaccgtgttcgtgactaaaccgtg

SEQ ID NO: 28628 - DNA, 75 bp, Artificial Sequence
  Synthetic
attgttactgccaagaccgcgcccggttaatcagattataaagtgcacctggtgcgattggatctagcttttgtg

SEQ ID NO: 28629 - DNA, 75 bp, Artificial Sequence
  Synthetic
tggaagcaccgcaggcaaccgccaaaaccagtgccaagtctcttggcagaacattttcttggaagacgcaccgct

SEQ ID NO: 28630 - DNA, 75 bp, Artificial Sequence
  Synthetic
caagtaacttggcagaacattttcttggaagacagcaccgataacggtaagattatatctttgaaccgtaggcgg

SEQ ID NO: 28631 - DNA, 75 bp, Artificial Sequence
  Synthetic
ttctttctgattggtttggctgatagtagttaacaacaatcactctttataaatatatgtaaccgcctgcgttac

SEQ ID NO: 28632 - DNA, 75 bp, Artificial Sequence
  Synthetic
tttatttaatctacatacaatatgctgagtaaactatttagagagctatatggataggccaaagcctttttctgt

SEQ ID NO: 28633 - DNA, 75 bp, Artificial Sequence
  Synthetic
gcagcagcttgcagacactctgtgtatacctttagtagatatattattgccttgtagattttgtcagagattttt

SEQ ID NO: 28634 - DNA, 75 bp, Artificial Sequence
  Synthetic
aacatatatagaattagtaagtttgaatcgtaaaggtctgcagttaatttggactgaggaagattttgtttttgc

SEQ ID NO: 28635 - DNA, 75 bp, Artificial Sequence
  Synthetic
ctgttgttctagttgtgcatttgctacagcgcagtttgaattttctaacttttatgaacagtcggtgtgtagttg

SEQ ID NO: 28636 - DNA, 75 bp, Artificial Sequence
  Synthetic
ggaaatagagatagtagaacagaagcctgttggagatattattattcgctgcaaattttgtctgaagaaattaga

SEQ ID NO: 28637 - DNA, 75 bp, Artificial Sequence
  Synthetic
tttaattgaaaagttagatatttgttacaaagaggagcaattccacaaggttagacgcaattggaaaggattgtg

SEQ ID NO: 28638 - DNA, 75 bp, Artificial Sequence
  Synthetic
ttagacgcaattggaaaggattgtgtagacattgtagggcgatagaatgattgggaaagaagctactataccaga

SEQ ID NO: 28639 - DNA, 75 bp, Artificial Sequence
  Synthetic
agaggaggagccacgatttattccttacaagattgtagttccgtgttgcttttgtgattccaagcttcgacttat

SEQ ID NO: 28640 - DNA, 75 bp, Artificial Sequence
  Synthetic
agtggttgcaactccatttggaattcgctcacaacaagacttattattggaagaagttaagttggtgtgtccagg

SEQ ID NO: 28641 - DNA, 75 bp, Artificial Sequence
  Synthetic
gtgtcgagagaagcttcgccatgtctgatgacaaaggtacatatgatcctaaagaaggctgtagtgattggtttg

SEQ ID NO: 28642 - DNA, 75 bp, Artificial Sequence
  Synthetic
ttctagaagcagaatgctctgatgctagtttagatggtgatttggaaaagttatttgaagaaggtacagatactg

SEQ ID NO: 28643 - DNA, 75 bp, Artificial Sequence
  Synthetic
gaattattatgccagcaagaaagtgaggaaagcgagcaacaaatacactggctaaaacgaaagtatatcagttca

SEQ ID NO: 28644 - DNA, 75 bp, Artificial Sequence
  Synthetic
caagaggttttgcagcttagccctcgcctgcagtgtatatctatttcgccacagcataagtctaaaaggagatta

SEQ ID NO: 28645 - DNA, 75 bp, Artificial Sequence
  Synthetic
tttgaacaagacagcggactagaactatcatttaatgaagctcaagattttactcagcagactttggaggtaccg

SEQ ID NO: 28646 - DNA, 75 bp, Artificial Sequence
  Synthetic
gcgaccgatgttgtgccgcagggtgccaagggactgggcattgttaaagatcttcttaaatgtaacaatgtgaaa

SEQ ID NO: 28647 - DNA, 75 bp, Artificial Sequence
  Synthetic
gcaatgttattagctaaatttaaagaagcgtttggagtggggtttatggaattaactagacaatataaaagcagc

SEQ ID NO: 28648 - DNA, 75 bp, Artificial Sequence
  Synthetic
aaaacatgctgtagagactgggtactgactgtttatgctgtacaagatgagctgttagaaagttctaaacaattg

SEQ ID NO: 28649 - DNA, 75 bp, Artificial Sequence
  Synthetic
ttgattcaacactgtgcatatatttggttacatcaaataccccctatgtgcttatatttattgtgctttaatgtt

SEQ ID NO: 28650 - DNA, 75 bp, Artificial Sequence
  Synthetic
ggtaaaagtagagaaacagtattaagattacttacgaatttgttacaagtatctgaaatacaaataatagcagaa

SEQ ID NO: 28651 - DNA, 75 bp, Artificial Sequence
  Synthetic
ccaccaaagcttcgaagtacactgtcagcattattttggtataaaggaagtatgaatccaaatgtttatgctcat

SEQ ID NO: 28652 - DNA, 75 bp, Artificial Sequence
  Synthetic
ggagaatatcctgagtggataatgacacaaacaatgataaatcaccaaacagcagaagctacacagtttgattta

SEQ ID NO: 28653 - DNA, 75 bp, Artificial Sequence
  Synthetic
tctactatggtacaatatgcatatgataatgaattgtcagaagaagcagaaattgcttggcattatgcaaaatta

SEQ ID NO: 28654 - DNA, 75 bp, Artificial Sequence
  Synthetic
gcagatacagatgcaaacgcgagagcatttttacagcataacagtcaggcaagacttgtcaaagactgtgcaata

SEQ ID NO: 28655 - DNA, 75 bp, Artificial Sequence
  Synthetic
atggttagacactatagacggggagaaatgaaagaaatgtctatgtcatcatggatacataaaaagttattggtt

SEQ ID NO: 28656 - DNA, 75 bp, Artificial Sequence
  Synthetic
gttgaaggagaaggacattggtcagatattgtaaagtttgtcagataccaagatataaattttatacaattttta

SEQ ID NO: 28657 - DNA, 75 bp, Artificial Sequence
  Synthetic
gattcatttaaaagctttttacataatactcctaaaaaaagttgtatgttaatatatggtccacctgacacagga

SEQ ID NO: 28658 - DNA, 75 bp, Artificial Sequence
  Synthetic
aaatccatgtttactatgtcattaataaaagtcttaaagggtaaagttttgtcatttgcaaattataaaagtaca

SEQ ID NO: 28659 - DNA, 75 bp, Artificial Sequence
  Synthetic
ttttggcttcaacctgtggcagatacaaaaatagctttaatagatgatgtaacttatgtttgttgggattatata

SEQ ID NO: 28660 - DNA, 75 bp, Artificial Sequence
  Synthetic
gatcaatatttaagaaatgcattggacggtggtgttgtttgtttagatatgaaacacagggcgccatgtcaaata

SEQ ID NO: 28661 - DNA, 75 bp, Artificial Sequence
  Synthetic
aggtttccaccattaatgctaacttctaacattgatatcatgaaagaagaaaggtataaatatttacgcagtaga

SEQ ID NO: 28662 - DNA, 75 bp, Artificial Sequence
  Synthetic
gtgcaagcttttgcatttccacataagtttccttttgatagtgataataatccacaatttaaacttactgaccaa

SEQ ID NO: 28663 - DNA, 75 bp, Artificial Sequence
  Synthetic
agctggaaatctttttttgaaaggctttggagacagttagagctcagtgatcaagaagacgagggagacgatgga

SEQ ID NO: 28664 - DNA, 75 bp, Artificial Sequence
  Synthetic
tactctcagcgaacgtttcaatgcactacaagagaatctaatggacatttatgagtcaggtcgagacgacataga

SEQ ID NO: 28665 - DNA, 75 bp, Artificial Sequence
  Synthetic
aactcaaatattgcactggcaatatttgaggcaagaacaagtattattctattttgccaggaaacatggagttat

SEQ ID NO: 28666 - DNA, 75 bp, Artificial Sequence
  Synthetic
gcgtttagatatcagcctgtaccccctttagccaccagtgagaccaaagcgaaagatgctattggtatggtgatt

SEQ ID NO: 28667 - DNA, 75 bp, Artificial Sequence
  Synthetic
ctgttacaaagtttgcagaagtcagcatatggcaaggagccatggacactaacacagactagtttggagactgtg

SEQ ID NO: 28668 - DNA, 75 bp, Artificial Sequence
  Synthetic
agaagtgcacctgcaaactgctttaaaaaagggccacagaatattgaagttatgtttgataaggatcctgaaaac

SEQ ID NO: 28669 - DNA, 75 bp, Artificial Sequence
  Synthetic
attatggtatacactgtttggacatacatttattaccagactttagatgacacatggaacaaggtggaaggaaaa

SEQ ID NO: 28670 - DNA, 75 bp, Artificial Sequence
  Synthetic
attgactatcatggcgcatattatttggaaggaactcttaaagtttattacatacagtttgaagttgatgcagcc

SEQ ID NO: 28671 - DNA, 75 bp, Artificial Sequence
  Synthetic
aggtttggcaaaactggaatctgggaggtgcatgttaatgaggacactatctttgctcctgttactagctcttcg

SEQ ID NO: 28672 - DNA, 75 bp, Artificial Sequence
  Synthetic
ccggcagctggagaaggggcaacctccatcgactccgcacccgaatcgccggccaacagacagctttcttccacc

SEQ ID NO: 28673 - DNA, 75 bp, Artificial Sequence
  Synthetic
tccgtgtcctccagaaaacggacaccaccacgaaccgaagccagacgctacaaccgaaaagaatctagccctaca

SEQ ID NO: 28674 - DNA, 75 bp, Artificial Sequence
  Synthetic
accaccaccacccggaggcagaaaagacaaggacaaagacaagaagacacagcaaggcgatcaaggtccacctca

SEQ ID NO: 28675 - DNA, 75 bp, Artificial Sequence
  Synthetic
agggggagacaagaaatctccaggggagggaaccagcgccgacggcgacgatcccgagaaacctccatctccccc

SEQ ID NO: 28676 - DNA, 75 bp, Artificial Sequence
  Synthetic
gcctggggaaggggagggagaagtagaagggggcccacaacaaggtcccaatcgaagtccctctcacgatcccga

SEQ ID NO: 28677 - DNA, 75 bp, Artificial Sequence
  Synthetic
tcccgatccaagtcgagatcacgagggtcttctccacggggtggcatctcgcctgcagacgtgggaagctcagtt

SEQ ID NO: 28678 - DNA, 75 bp, Artificial Sequence
  Synthetic
cgatcacttggtagaaaacatactgggcgacttgaaagattactggaagaggctagggaccccccagtaatcttg

SEQ ID NO: 28679 - DNA, 75 bp, Artificial Sequence
  Synthetic
ctgcgcggtgatgctaacaaattaaaatgctttcgctttagggcaaagaaaaagtatcaggatttagtaaaatac

SEQ ID NO: 28680 - DNA, 75 bp, Artificial Sequence
  Synthetic
tatagcaccacgtggtcctgggtagggggtacaagtaatgatagaattggacgctcacgattgttactggcattc

SEQ ID NO: 28681 - DNA, 75 bp, Artificial Sequence
  Synthetic
tcttccaacaccgaaagagagctctttatcaaaataatgaaactgccaccaggcgttgattggtcgctaggatat

SEQ ID NO: 28682 - DNA, 75 bp, Artificial Sequence
  Synthetic
ttagatgatttatgatttttgtgctttttaatcaactaacagtagtgtttttttattgcttttgctactaacact

SEQ ID NO: 28683 - DNA, 75 bp, Artificial Sequence
  Synthetic
atactaacattcccatggcccgtgcacgcagagtaaaacgtgcatctgtaactgacatttacagggggtgcaaac

SEQ ID NO: 28684 - DNA, 75 bp, Artificial Sequence
  Synthetic
aagcaggtacctgcccccctgatgttcttaataaagtggaacaaacaactattgcagataaaattttgaaatatg

SEQ ID NO: 28685 - DNA, 75 bp, Artificial Sequence
  Synthetic
gaagtgctgctgtattttttggtgggctgggaattggtacaggccgtggttcaggtggtgctacaggttatgttc

SEQ ID NO: 28686 - DNA, 75 bp, Artificial Sequence
  Synthetic
ctttgggagaaggccctggtgtgcgcgtaggaggcacccctaccattgttcgccctggggtcacacctgaactta

SEQ ID NO: 28687 - DNA, 75 bp, Artificial Sequence
  Synthetic
ttggtccagcggatgtaataccaattgatacagtcacaccaattgaccccgcagcacctagtattgtcacaataa

SEQ ID NO: 28688 - DNA, 75 bp, Artificial Sequence
  Synthetic
ctgacagcagcgctgttgaccttttacctgaattggagacaattgcagaaatacatcctgtaccaacagataatg

SEQ ID NO: 28689 - DNA, 75 bp, Artificial Sequence
  Synthetic
tagatattgatactcctgttgttacaggaggtcgggattccagcgctattttagaagttgctgatcccagtcctc

SEQ ID NO: 28690 - DNA, 75 bp, Artificial Sequence
  Synthetic
ctgtacgaacaagagtgtctcgcacacaatatcataacccatcatttcaaattattactgagtctacacctttgt

SEQ ID NO: 28691 - DNA, 75 bp, Artificial Sequence
  Synthetic
ctggcgaatctgcactagcagatcacgttattgtttttgaaggtagtggaggtcaaaatataggcggttctcgca

SEQ ID NO: 28692 - DNA, 75 bp, Artificial Sequence
  Synthetic
gtgctgctttggatgcagcacaggaaagttttgaaatgcaaacatggcctagtagatacagttttgaaatacaag

SEQ ID NO: 28693 - DNA, 75 bp, Artificial Sequence
  Synthetic
aaggtacaccaccaagatctagcactcctgttcaaagagcagtacaatccctttctagtcttagaagggctttat

SEQ ID NO: 28694 - DNA, 75 bp, Artificial Sequence
  Synthetic
ataacagacggctgactgaacaagtagctgtaacagaccctttattcttgggacgaccctcacgcttggtgcaat

SEQ ID NO: 28695 - DNA, 75 bp, Artificial Sequence
  Synthetic
ttcaatttgacaatccaacatttgaagaagaagtaacacaaacttttgaaagagatgttgaagcatttgaagagc

SEQ ID NO: 28696 - DNA, 75 bp, Artificial Sequence
  Synthetic
ctccagataggcaatttctagatgtagttcgcctaggaaggcctacttattctgaaacaccacaaggttatgtgc

SEQ ID NO: 28697 - DNA, 75 bp, Artificial Sequence
  Synthetic
gtgtaagtagacttggtagacgggccacaattagaaccagaagtggtgcacaagttggtgctcaagtacatttct

SEQ ID NO: 28698 - DNA, 75 bp, Artificial Sequence
  Synthetic
atagggatttaagtacaattgattctgaagcattagaaatgcaattactaggagaacattcaggtgatagtacca

SEQ ID NO: 28699 - DNA, 75 bp, Artificial Sequence
  Synthetic
ttgttcaggctcctatggaaagttcatttatagatataaatattgatgagcctgattcattacatgtgggcctac

SEQ ID NO: 28700 - DNA, 75 bp, Artificial Sequence
  Synthetic
aggacagtactgaagcagatgacattgattacaattctgctgatcttcttttagaagataatatagaagatttta

SEQ ID NO: 28701 - DNA, 75 bp, Artificial Sequence
  Synthetic
gtggttctcatttggtgtttggcaatacacggcgcagcactacaacatatacagtacctagatttgaatcaccta

SEQ ID NO: 28702 - DNA, 75 bp, Artificial Sequence
  Synthetic
gaaatactgggttttacatacaagatgtgcatgggtataatgtagcctatccggagtcccgtgatactaccgaaa

SEQ ID NO: 28703 - DNA, 75 bp, Artificial Sequence
  Synthetic
taatattaccacaatctgacacgccaactgtagttataaattttgaagaggcaggtggagactattatttacatc

SEQ ID NO: 28704 - DNA, 75 bp, Artificial Sequence
  Synthetic
caagcttaaaaacacgtaaacgaaaacgcaaatatttgtaattgttttacagatgacattgtggctaccgacgac

SEQ ID NO: 28705 - DNA, 75 bp, Artificial Sequence
  Synthetic
gggtaaagtatatttgccaccaacaccacctgtagcacgtgtacaaagcaccgatgaatatgtggagagaactaa

SEQ ID NO: 28706 - DNA, 75 bp, Artificial Sequence
  Synthetic
tgtattttaccatgcaatgagtgaccgtctgttaacagtagggcatccctactttgatgttagatctgttaatgg

SEQ ID NO: 28707 - DNA, 75 bp, Artificial Sequence
  Synthetic
aggtagcatagaagttcctaaagtgtctggaaatcaatatagagcatttagggttacttttccagatcctaatag

SEQ ID NO: 28708 - DNA, 75 bp, Artificial Sequence
  Synthetic
atttgcattagcagacatgtctgtctataatccagaaaaagaaaggttggtttgggcctgtgtaggccttgaaat

SEQ ID NO: 28709 - DNA, 75 bp, Artificial Sequence
  Synthetic
aggtagaggacaaccattaggagttggtacttcaggccatcctttattcaacaaagtaaaagatacagagaataa

SEQ ID NO: 28710 - DNA, 75 bp, Artificial Sequence
  Synthetic
cagtaattatcaaggcaactctactgatgacaggcaaaatacatcttttgacccaaagcaggttcaaatgtttgt

SEQ ID NO: 28711 - DNA, 75 bp, Artificial Sequence
  Synthetic
agtaggctgtgttccatgtttaggcgaacactgggatagagctcttgtttgtgaatcagagagaaataatcaggc

SEQ ID NO: 28712 - DNA, 75 bp, Artificial Sequence
  Synthetic
gggaaaatgtcctcctttggaacttaaaaatacagttattgaagatggcgacatgtttgatataggttttggtaa

SEQ ID NO: 28713 - DNA, 75 bp, Artificial Sequence
  Synthetic
cattaataacaaggccttatcagttactaagtcagatgtgagtctggatatagtgaatgaaacttgcaaatatcc

SEQ ID NO: 28714 - DNA, 75 bp, Artificial Sequence
  Synthetic
agattttttaactatggcaaatgatgtgtatggagacgcttgttttttttttgcaagacgagaacagtgctatgc

SEQ ID NO: 28715 - DNA, 75 bp, Artificial Sequence
  Synthetic
tagacattactttgtcagaggaggtgcagtaggtgatgctcttcctgatgcagctgtcaatcaagatcataattt

SEQ ID NO: 28716 - DNA, 75 bp, Artificial Sequence
  Synthetic
ttatttaccagcacaatcaacccaacaacaaaataacttagcaaattctacttactttcccacagttagtggttc

SEQ ID NO: 28717 - DNA, 75 bp, Artificial Sequence
  Synthetic
tttagtgacatctgatgctcagctgtttaatagaccgttttggttaagaagagctcaagggcataacaatggcat

SEQ ID NO: 28718 - DNA, 75 bp, Artificial Sequence
  Synthetic
actttggggtaatcagatgtttattactgttgcagataacacaaggaatacaaattttactattagtgttacctc

SEQ ID NO: 28719 - DNA, 75 bp, Artificial Sequence
  Synthetic
tgatggtaatgccataaatgaatataattcacaaaatatcagagaatttttaagacatgtggaagaatatcagtt

SEQ ID NO: 28720 - DNA, 75 bp, Artificial Sequence
  Synthetic
atctattattttgcaattgtgtaaaatacctttaaaagctgaggtattaacacaaattaatgctatgaattcagg

SEQ ID NO: 28721 - DNA, 75 bp, Artificial Sequence
  Synthetic
tattttagaagactggcaactagggtttgttcctacaccagacaacgctgtacaagatatttatagatatattga

SEQ ID NO: 28722 - DNA, 75 bp, Artificial Sequence
  Synthetic
ctctaaggcaactaaatgtcctgatgctgtacaaccaaaggacaaagaagacccatttggaaagtatacattttg

SEQ ID NO: 28723 - DNA, 75 bp, Artificial Sequence
  Synthetic
gaatgtagatttaacagaaaagttatctttagatttggatcaatatcctttgggaagaaaatttatatttcaagc

SEQ ID NO: 28724 - DNA, 75 bp, Artificial Sequence
  Synthetic
aggtttgcaacgtcgccccagaactattaaatcctctgtaaaagtttctaaaggtactaaacgcaaacgtacatg

SEQ ID NO: 28725 - DNA, 75 bp, Artificial Sequence
  Synthetic
aaggtactaaacgcaaacgtacatgaccgatttcggtcgctaataaacaagtaaaccaataaggtatgtgaagta

SEQ ID NO: 28726 - DNA, 75 bp, Artificial Sequence
  Synthetic
ccgcaggcaaccgccaatttcactgccaaggttcgttggcagaccgtcctggcttcaaaacgaccgataacggta

SEQ ID NO: 28727 - DNA, 75 bp, Artificial Sequence
  Synthetic
agtcttggcacgtaggtggttatttgatcgttgggatgattgtggttaacaacaatctacatacacattttcata

SEQ ID NO: 28728 - DNA, 75 bp, Artificial Sequence
  Synthetic
tgaccgccttcgttaataagcttatatagacataaatatataaggtgccatgtatttaacagagcagattatgga

SEQ ID NO: 28729 - DNA, 75 bp, Artificial Sequence
  Synthetic
caggccaaaacctagaacagtaaaggaactagcagacactcttgtgattcctttaatagatttgttgataccttg

SEQ ID NO: 28730 - DNA, 75 bp, Artificial Sequence
  Synthetic
taaattttgcaatagatttttatcttattttgagctacttaattttgatcacaagtgtttacagcttatttggac

SEQ ID NO: 28731 - DNA, 75 bp, Artificial Sequence
  Synthetic
agaggaggatttggtgtatggactctgtagtagctgtgcttatgcgtctgcacagttagaatttacacatttttt

SEQ ID NO: 28732 - DNA, 75 bp, Artificial Sequence
  Synthetic
tcaatttgctgtagttggaaaagatatagaaactgtagaaggaacagctattggaaatatttgtattaggtgtcg

SEQ ID NO: 28733 - DNA, 75 bp, Artificial Sequence
  Synthetic
ctactgttttaagttattagacttagtggagaagttagctacatgctataagtttgagcagttttataaggtcag

SEQ ID NO: 28734 - DNA, 75 bp, Artificial Sequence
  Synthetic
aaacagctggaaaggattgtgcagacactgtgggtcggtagaatgattgggaaagaagctactataccagaggtg

SEQ ID NO: 28735 - DNA, 75 bp, Artificial Sequence
  Synthetic
gttctagaactgcaagagcttgtccaacccactgctgacctgcattgttacgaagaattgacagaagaacctgca

SEQ ID NO: 28736 - DNA, 75 bp, Artificial Sequence
  Synthetic
gaggaggagcagtgtctcactccctacaagatcgtagctggctgtggttgcggtgcaagacttcgtttatacgtg

SEQ ID NO: 28737 - DNA, 75 bp, Artificial Sequence
  Synthetic
cttgctacaaatttaggaattcgagcgcaacaggaacttttgctgggtgatatacaactggtgtgtccggagtgc

SEQ ID NO: 28738 - DNA, 75 bp, Artificial Sequence
  Synthetic
cgaggcagacttcgccatgagtgacaataaaggtactaaattagatcctaaagaatgctgtagtgcttggttatc

SEQ ID NO: 28739 - DNA, 75 bp, Artificial Sequence
  Synthetic
gttagaagcagaatgctctgattctagtttagatggtgatttggaaaaattatttgacgaagggacagactctga

SEQ ID NO: 28740 - DNA, 75 bp, Artificial Sequence
  Synthetic
tatttcagacctaatagatgatggagatgctgtacagggaaactcccgcgaactgttttgccagcaagagagtga

SEQ ID NO: 28741 - DNA, 75 bp, Artificial Sequence
  Synthetic
ggaaagcgagcaacaaacacaattgctaaaacgaaagtatatcagtccccaagctgttttgcagcttagccctca

SEQ ID NO: 28742 - DNA, 75 bp, Artificial Sequence
  Synthetic
actggagtctatctctttgtcgcctcagcataaacctaaaaggagattatttgaacaagacagcggactagaatg

SEQ ID NO: 28743 - DNA, 75 bp, Artificial Sequence
  Synthetic
ttctgtaaatgaagctgaagatctttctgaaacacaggtggaagaggtaccggccaatccaccaacaacagctca

SEQ ID NO: 28744 - DNA, 75 bp, Artificial Sequence
  Synthetic
gggaactaagggcttgggaattgttaaagatttacttaaacatagcaatgtgaaagctgtattaatggctaagtt

SEQ ID NO: 28745 - DNA, 75 bp, Artificial Sequence
  Synthetic
taaagaggcgtttggtgtggggtttgctgagctaacaagacaatataaaagtaacaaaacatgctgtagagattg

SEQ ID NO: 28746 - DNA, 75 bp, Artificial Sequence
  Synthetic
ggtaattgctgtgtatgctgtgaatgatgacttaattgaaagctctaaacaattgttattgcagcattgtgctta

SEQ ID NO: 28747 - DNA, 75 bp, Artificial Sequence
  Synthetic
tatttggctacattatatgccaccaatgtgtttatatttattatgttttaacgtaggcaaaagtagagaaactgt

SEQ ID NO: 28748 - DNA, 75 bp, Artificial Sequence
  Synthetic
atgtagactattaagcactttgctgcaagtatctgaagtgcaattattaagtgagcctccaaagttgcgaagtgt

SEQ ID NO: 28749 - DNA, 75 bp, Artificial Sequence
  Synthetic
gtgtgctgcattattttggtataaaggaagtatgaaccctaatgtatacgcacatggtgcgtatcctgaatggat

SEQ ID NO: 28750 - DNA, 75 bp, Artificial Sequence
  Synthetic
acttacacaaacactaattaatcaccaatctgcaaatgctacacaatttgacttatcgacaatgatacaatttgc

SEQ ID NO: 28751 - DNA, 75 bp, Artificial Sequence
  Synthetic
ctatgatcatgaatattttgatgaagctaccattgcatatcaatatgcaaagctggctgaaacagatgctaatgc

SEQ ID NO: 28752 - DNA, 75 bp, Artificial Sequence
  Synthetic
cagggcttttttacaaagtaacagtcaagccagactagtaaaagaatgtgcaaccatggtgagacattacatgag

SEQ ID NO: 28753 - DNA, 75 bp, Artificial Sequence
  Synthetic
gggagagatgaaagaaatgagtatgtccacatggatacatagaaaactgcttacagtggaaagcaatgggcaatg

SEQ ID NO: 28754 - DNA, 75 bp, Artificial Sequence
  Synthetic
gtcagatatagtacggtttattagataccaggatattaattttattgaatttctaacagtatttaaagcatttct

SEQ ID NO: 28755 - DNA, 75 bp, Artificial Sequence
  Synthetic
gcaaaacaaaccaaagcaaaactgtttattatttcatggaccacctgacacgggaaaatcaatgtttacaatgtc

SEQ ID NO: 28756 - DNA, 75 bp, Artificial Sequence
  Synthetic
actaatatctgtgttaaaaggaaaggtactgtcatttgccaattgcaaaagtactttttggctacaacctatagc

SEQ ID NO: 28757 - DNA, 75 bp, Artificial Sequence
  Synthetic
tgatactaaacttgctttaattgatgatgtaacacatgtgtgttgggaatatatagatcagtacttaaggaatgg

SEQ ID NO: 28758 - DNA, 75 bp, Artificial Sequence
  Synthetic
attggatggcaattatgtatgtttagatatgaaacatagagcaccttgtcaaatgaaatttccaccccttatgtt

SEQ ID NO: 28759 - DNA, 75 bp, Artificial Sequence
  Synthetic
aacgtctaacatagatattactaaagaccaaaagtacaaatatttgcacagcagagttaaatcctttgctttcaa

SEQ ID NO: 28760 - DNA, 75 bp, Artificial Sequence
  Synthetic
taacaaatttccacttgatgctaatcacaaaccacaatttgaacttactgaccaaagctggaaatctttttttaa

SEQ ID NO: 28761 - DNA, 75 bp, Artificial Sequence
  Synthetic
aaggctttggacacagttagatctgagtgatcaagaagacgagggagaggatggaaactctcagcgcacgtttca

SEQ ID NO: 28762 - DNA, 75 bp, Artificial Sequence
  Synthetic
atgcactgcaagagactttaatggacctgtatgaatcaggtcgagaggatctacaaagtcagattgaccactggc

SEQ ID NO: 28763 - DNA, 75 bp, Artificial Sequence
  Synthetic
agactttaagacaagagcaaatacttttgcattatgccaggaaaaatggagttatgcgattggggtaccaacctg

SEQ ID NO: 28764 - DNA, 75 bp, Artificial Sequence
  Synthetic
tacctccgttggctaccagtgaacagaaagctaaagatgctattggcatggttttactattgcaaagccttcaaa

SEQ ID NO: 28765 - DNA, 75 bp, Artificial Sequence
  Synthetic
gatcagcttatggacaggaaccttggacactggcacaaactagtcttgaggcggtacgcagtccacctgcatatg

SEQ ID NO: 28766 - DNA, 75 bp, Artificial Sequence
  Synthetic
cctttaaaaagggtccacaaaatattgaagtagtttatgatggagatcctgataatgttatgagctatactatat

SEQ ID NO: 28767 - DNA, 75 bp, Artificial Sequence
  Synthetic
ggaactttatatattatcagactgttaatgatacttgggaaaaagttcaaggtcacgtggattattttggagcct

SEQ ID NO: 28768 - DNA, 75 bp, Artificial Sequence
  Synthetic
attactttgaagggactgtaaaaacatattatattaactttgacaaagatgcagccaggtatggcagaactggcg

SEQ ID NO: 28769 - DNA, 75 bp, Artificial Sequence
  Synthetic
tttgggaagtgcatgttaacaaggacattgtgtttgcccctgttactagctcttcgccaccaactggagacgggg

SEQ ID NO: 28770 - DNA, 75 bp, Artificial Sequence
  Synthetic
gagagacctccaagcacaccctttccaggtcggggtcgccaacaacatcgcgactccctgccaccaccgtgccca

SEQ ID NO: 28771 - DNA, 75 bp, Artificial Sequence
  Synthetic
ccggaggatccaggacatcatcccgacgataccaacgaaaagcctctagccccaccaccaggaagaaaagacaga

SEQ ID NO: 28772 - DNA, 75 bp, Artificial Sequence
  Synthetic
gacaaggagaaggagaaggagaaggagaaggagaagaaaccaactacaggagacaaaggtccagatccaagggtc

SEQ ID NO: 28773 - DNA, 75 bp, Artificial Sequence
  Synthetic
gaacagaaaccgaaaggggaggggagcgacggagacgaggaaggtcctcctccgcagactccactacccccaccg

SEQ ID NO: 28774 - DNA, 75 bp, Artificial Sequence
  Synthetic
acaggcgaaggggaaggggaggtggaagggggcccacgaccaggtcccagtcccgttcccgttcccgctcccact

SEQ ID NO: 28775 - DNA, 75 bp, Artificial Sequence
  Synthetic
cccggtcgcggtcccgaggagggactgcttccagggttggcgtctcgcctgatgaagtgggaacacgagttcgat

SEQ ID NO: 28776 - DNA, 75 bp, Artificial Sequence
  Synthetic
cagttggtgcaggacatcacgggagacttgcacgattactggctgaggctaaagaccccccattaatgctgttgc

SEQ ID NO: 28777 - DNA, 75 bp, Artificial Sequence
  Synthetic
gtggcgacgccaatgtgcttaagtgctatcgctttcgggaacgcaaaaaaaaaagaggcttagtaaaatattata

SEQ ID NO: 28778 - DNA, 75 bp, Artificial Sequence
  Synthetic
gtactacgtggtcatgggtaggggaagacagttgtgatagagttggaagagcgcgaatgattttagcctttgaca

SEQ ID NO: 28779 - DNA, 75 bp, Artificial Sequence
  Synthetic
catatgagcacagacaacaattcattaggactatgaaattaccacctacagtagattggtctttaggaaatgttg

SEQ ID NO: 28780 - DNA, 75 bp, Artificial Sequence
  Synthetic
atgatctgtaagctttactaacgctaacgctggcattgctactaacccatactaactaacaaacccatactaact

SEQ ID NO: 28781 - DNA, 75 bp, Artificial Sequence
  Synthetic
aacatggttcgtgcaaaacgtactaaacgtgcctctgttacagatatatacagaggctgcaaagctgctggtaca

SEQ ID NO: 28782 - DNA, 75 bp, Artificial Sequence
  Synthetic
tgtccaccagatgtaattaataaagtggagcacacaactattgctgataaaattttgcaatatggaagtgctggt

SEQ ID NO: 28783 - DNA, 75 bp, Artificial Sequence
  Synthetic
gtgtttttcgggggcttgggaataagtacaggccgtggcactggtggtgccactggctatgttccattaggggaa

SEQ ID NO: 28784 - DNA, 75 bp, Artificial Sequence
  Synthetic
gggccaggagtccgtgtaggtggcacccccactatagttcgccctggggtgatacctgaaataattggcccaact

SEQ ID NO: 28785 - DNA, 75 bp, Artificial Sequence
  Synthetic
gatctaattcctttagacacagtcagaccaattgaccccacagcacccagtattgtcacaggcactgacagcact

SEQ ID NO: 28786 - DNA, 75 bp, Artificial Sequence
  Synthetic
gttgaccttttacctggtgaaatagaatcaattgctgagatacacccagtaccagtggacaatgctgtagtagat

SEQ ID NO: 28787 - DNA, 75 bp, Artificial Sequence
  Synthetic
actccagttgtaacagaaggtagaagaggctcgtctgccattttagaggtggctgacccaagccctcctatgcga

SEQ ID NO: 28788 - DNA, 75 bp, Artificial Sequence
  Synthetic
acccgtgttgcacgaactcaataccataatccagcttttcaaattatttctgagtctacacctatgtcaggtgaa

SEQ ID NO: 28789 - DNA, 75 bp, Artificial Sequence
  Synthetic
tcttccttagcagatcatattatagtttttgaaggatctgggggccagctagtaggtggtcctagggaatcatac

SEQ ID NO: 28790 - DNA, 75 bp, Artificial Sequence
  Synthetic
acagcatcttctgaaaacatagaattacaagaatttcctagtagatatagttttgaaatagatgaaggaacacct

SEQ ID NO: 28791 - DNA, 75 bp, Artificial Sequence
  Synthetic
cctcggactagtacacctgtccaaagagcagtacaatcattatctagtctgcgtagagctctatataacagacgt

SEQ ID NO: 28792 - DNA, 75 bp, Artificial Sequence
  Synthetic
cttacagaacaagtggctgtgacagatccattatttttaagtaggccttctcgtttagttcaatttcagtttgat

SEQ ID NO: 28793 - DNA, 75 bp, Artificial Sequence
  Synthetic
aatccagcatttgaagatgaggtcacacaaatatttgaaagagatctaagtactgttgaggagcctccagatagg

SEQ ID NO: 28794 - DNA, 75 bp, Artificial Sequence
  Synthetic
caatttttagatgtacaacgccttagtaggcctttatatacagaaacacctcagggatatgttcgggttagtaga

SEQ ID NO: 28795 - DNA, 75 bp, Artificial Sequence
  Synthetic
ctaggccgaagagcaacaatccgcacacgtagtggtgcacaggtgggcgcacaggttcatttctacagggactta

SEQ ID NO: 28796 - DNA, 75 bp, Artificial Sequence
  Synthetic
agcaccattaacacagaagaacctatagaaatgcaattattgggggaacactcaggtgacagtaccatagtacaa

SEQ ID NO: 28797 - DNA, 75 bp, Artificial Sequence
  Synthetic
ggcccagttgaaagttcaattgttgatgttaatattgatgaacctgatggtttggaggtgggaagacaggaaacc

SEQ ID NO: 28798 - DNA, 75 bp, Artificial Sequence
  Synthetic
ccttctgttgaagatgtggattttaattctgaagacttactgttagatgagggtgtagaagattttagtgggtct

SEQ ID NO: 28799 - DNA, 75 bp, Artificial Sequence
  Synthetic
cagctagtcgttggcacacgccgcagtacaaatacattaacagtgccacgctttgaaactccaagggacactagt

SEQ ID NO: 28800 - DNA, 75 bp, Artificial Sequence
  Synthetic
ttttatattcaggatatacaaggctacacagtgtcctatcccgagtctagacaaaccacagatataatttttcca

SEQ ID NO: 28801 - DNA, 75 bp, Artificial Sequence
  Synthetic
catcctgacacccccacagtagtaatccacatcaatgatacatcaggagattattatttacacccaagtctccaa

SEQ ID NO: 28802 - DNA, 75 bp, Artificial Sequence
  Synthetic
aggaaaaaacgcaaacgcaaatatttataattttgtttttgcagatgtcattgtggcttccagcaagtggtaagg

SEQ ID NO: 28803 - DNA, 75 bp, Artificial Sequence
  Synthetic
tatatttgccaccagcaacaccagtggcgagagttcaaagcaccgatgaatatgtggaaagaacaaatatttttt

SEQ ID NO: 28804 - DNA, 75 bp, Artificial Sequence
  Synthetic
atcatgcaattagtgaccgtttgctaacagtgggtcatccatattatgatgtccgctcaggcgacggacaaagga

SEQ ID NO: 28805 - DNA, 75 bp, Artificial Sequence
  Synthetic
ttgaagtccctaaagtgtctggtaatcagtatcgggcctttagaattagcttacctgatccaaataggtttgctt

SEQ ID NO: 28806 - DNA, 75 bp, Artificial Sequence
  Synthetic
tagcagatatgtcagtttataatcctgataaggaacgtctagtttgggcctgtagaggtattgaaataggcagag

SEQ ID NO: 28807 - DNA, 75 bp, Artificial Sequence
  Synthetic
gacaacctttaggggttggaacatcaggtcacccattatttaataaggttagagacacagaaaactctagcaatt

SEQ ID NO: 28808 - DNA, 75 bp, Artificial Sequence
  Synthetic
atcaaggcacaacaatggatgacaggcaaaacacatcttttgaccccaaacaggtacaaatgttcattataggat

SEQ ID NO: 28809 - DNA, 75 bp, Artificial Sequence
  Synthetic
gtattccatgcttaggagaacactgggataaagccaaagtgtgtgaaaaggatgctaataatcaactaggcttat

SEQ ID NO: 28810 - DNA, 75 bp, Artificial Sequence
  Synthetic
gtcctcctatagaattaagaaacacagtaattgaggatggggacatgtttgatattggatttggaaatatcaaca

SEQ ID NO: 28811 - DNA, 75 bp, Artificial Sequence
  Synthetic
ataaggaactgtcctttaataagtctgatgtaagcttagatattgttgatgaaacctgcaaatatccagactttc

SEQ ID NO: 28812 - DNA, 75 bp, Artificial Sequence
  Synthetic
taacaatggcaaatgatgtttatggagatgcatgtttcttttttgcaagaagagaacaatgttatgccaggcatt

SEQ ID NO: 28813 - DNA, 75 bp, Artificial Sequence
  Synthetic
attatgttagaggaggttcagttggtgacgctgttcctgatggtgcagtaaaccaggatcataatttctttttgc

SEQ ID NO: 28814 - DNA, 75 bp, Artificial Sequence
  Synthetic
cagcaaaaagtgatcaacaacaacgaacaatagctaattccacctactatcctacagtaagtgggtcattagtaa

SEQ ID NO: 28815 - DNA, 75 bp, Artificial Sequence
  Synthetic
cttcagatgctcaattgtttaataggccattttggctccaaagagcacaaggtcacaacaatggcattttatggg

SEQ ID NO: 28816 - DNA, 75 bp, Artificial Sequence
  Synthetic
gtaatcagatatttgttacagtggcagacaatacacgtaacaccaattttaccattagtgtgtctacagaggcag

SEQ ID NO: 28817 - DNA, 75 bp, Artificial Sequence
  Synthetic
ctcaaacagaagaatataatgccaataatattagagaatatttaagacatgttgaagaatatcagatttcattaa

SEQ ID NO: 28818 - DNA, 75 bp, Artificial Sequence
  Synthetic
tcttacagttgtgtaaagtgcctttagtagctgaagtattatcccagataaatgcaatgaactcaggtattttag

SEQ ID NO: 28819 - DNA, 75 bp, Artificial Sequence
  Synthetic
aggattggcaattagggtttgttccaactcctgaaaatgctgttcatgatatctacagatatattgattcaaaag

SEQ ID NO: 28820 - DNA, 75 bp, Artificial Sequence
  Synthetic
ccacaaaatgcccagatgctgttgagcctacagaaaaagaagatccctttgccaaatactcattttggaaagtgg

SEQ ID NO: 28821 - DNA, 75 bp, Artificial Sequence
  Synthetic
atctaactgaaagattatcgttggatcttgatcaatatcctttaggtagaaaatttctttttcaagctggtttgc

SEQ ID NO: 28822 - DNA, 75 bp, Artificial Sequence
  Synthetic
aaacacgaaaacgtcctattaaaacatctgttaaaacatctaaaaatgctaagagaaggcgaacctaaccgatat

SEQ ID NO: 28823 - DNA, 75 bp, Artificial Sequence
  Synthetic
cggtttccaataaaatttaagttatccaatttggtatgtgaagcattttttaaccatcttcgtgactaaaccgta

SEQ ID NO: 28824 - DNA, 75 bp, Artificial Sequence
  Synthetic
caagtcaacacagagcgaccgcacccggtttatctgattataaagtgcacctggtgcaatttgaacaatactatc

SEQ ID NO: 28825 - DNA, 75 bp, Artificial Sequence
  Synthetic
acagagcgaccgcacccggtttatctgattataaagtgcacctggtgcaatttgaacaatactatcgtggaatca

SEQ ID NO: 28826 - DNA, 75 bp, Artificial Sequence
  Synthetic
gaagatatcttggcagaacatcaatttggcctcacttctacaccgataacggtaagtttttatttgtttgaaccg

SEQ ID NO: 28827 - DNA, 75 bp, Artificial Sequence
  Synthetic
ggtaagtttttatttgtttgaaccgctgccggttgctatattactcatttatctgattgtggtttacaacaacca

SEQ ID NO: 28828 - DNA, 75 bp, Artificial Sequence
  Synthetic
ttccttaattaaatacatgtgaccgcttgcgttagatgtaaacctataaaattactggaagaatattagagacac

SEQ ID NO: 28829 - DNA, 75 bp, Artificial Sequence
  Synthetic
atatactgatggagaggcctagaacagtacaagttctgagtcggcatttagaaataccaatagaagatttattgg

SEQ ID NO: 28830 - DNA, 75 bp, Artificial Sequence
  Synthetic
taccatgcaagttttgtgagcgctttttaacatatattgaacttttgcaatttgattacaaacaattgcaactca

SEQ ID NO: 28831 - DNA, 75 bp, Artificial Sequence
  Synthetic
tttggattgaagagttagtgtatgctctttgctctagttgtgcatatgcatctgctgcatttgaatacaaaaatt

SEQ ID NO: 28832 - DNA, 75 bp, Artificial Sequence
  Synthetic
atttagaaggcacagtcaaaggcagagaaatagagcaggtgactcaacagtctgtaggctttattactatcagat

SEQ ID NO: 28833 - DNA, 75 bp, Artificial Sequence
  Synthetic
agaaatagagcaggtgactcaacagtctgtaggctttattactatcagatgcatttattgtttaaagcatctgga

SEQ ID NO: 28834 - DNA, 75 bp, Artificial Sequence
  Synthetic
ccttttagaaaagttagacaattgtgctaggcatcagcagttttacaaggtgagaggtaattggaagggattgtg

SEQ ID NO: 28835 - DNA, 75 bp, Artificial Sequence
  Synthetic
cagacattgttggtcgatagaatgattgggaaagaagttactattccagatattgttctggaactgcaagagctt

SEQ ID NO: 28836 - DNA, 75 bp, Artificial Sequence
  Synthetic
gtccagcccattgacctgcattgctacgaagacttaccagagcttccagatgttcctagtgaagattcagaggag

SEQ ID NO: 28837 - DNA, 75 bp, Artificial Sequence
  Synthetic
gagcaagtagagcgcatcccatacaagatagttgctccttgtggtggttgtggcgctcgccttcggctatttgtg

SEQ ID NO: 28838 - DNA, 75 bp, Artificial Sequence
  Synthetic
attgctaccttctttggaatccgcacacagcaagaacttttaattcaagaagtgcaacttgtgtgtcctcagtgc

SEQ ID NO: 28839 - DNA, 75 bp, Artificial Sequence
  Synthetic
cgagaggtcattcgcaatggcggacaaggaccataaaggtattgatgctaaggaaggctgtagtgattggttttt

SEQ ID NO: 28840 - DNA, 75 bp, Artificial Sequence
  Synthetic
agtagaagctgaatgttcagatactagtgatctagaaaatgatttagaaaacttatttaatgaaggggcagactc

SEQ ID NO: 28841 - DNA, 75 bp, Artificial Sequence
  Synthetic
agatatttctgatttaattgatgatggggacattgaacaggggaattcccgcgaattgctatgccagcaagaagc

SEQ ID NO: 28842 - DNA, 75 bp, Artificial Sequence
  Synthetic
agaggaaagcgagcaacagacacaattgctaaaacgaaagtacctcagtcctaaagagaaagagatcctgcagct

SEQ ID NO: 28843 - DNA, 75 bp, Artificial Sequence
  Synthetic
cagtccgcagctggagtcaatctccctgtcgccccatcataaatctaaaaaacggctgtttgtggagcaagatag

SEQ ID NO: 28844 - DNA, 75 bp, Artificial Sequence
  Synthetic
tggactagagctttcactaaatgaagttgaagatctttctgaagaggtggaggtaccggcgattactccagcgcc

SEQ ID NO: 28845 - DNA, 75 bp, Artificial Sequence
  Synthetic
ggcagcgcagggtggtgagggagagggaaacttgcattataaagcgctgttaaagtgcagcaatgcaaaagcaac

SEQ ID NO: 28846 - DNA, 75 bp, Artificial Sequence
  Synthetic
attgttaagtaaatttaaggatgcgtatggagtgagttttaatgagctcacaaggcactatcaaagtaataagac

SEQ ID NO: 28847 - DNA, 75 bp, Artificial Sequence
  Synthetic
atgttgtagggattgggttgttagtatttatgcagtgaaagatgatctgttagaagggtctaagcatttattaca

SEQ ID NO: 28848 - DNA, 75 bp, Artificial Sequence
  Synthetic
aaagcattgttcatatatttggatgcatgttttacaaccaatgtcattatttttactgtgttttaatgctgggaa

SEQ ID NO: 28849 - DNA, 75 bp, Artificial Sequence
  Synthetic
aagtagagaaactgtatttagattactatcttctattttgcaagtaaatgaaattcaaacattgtctgaaccacc

SEQ ID NO: 28850 - DNA, 75 bp, Artificial Sequence
  Synthetic
taagtggcgtagtgtattagcggcattgtattggtataaaggaagtatgaatccaaatatttatacttttggaac

SEQ ID NO: 28851 - DNA, 75 bp, Artificial Sequence
  Synthetic
atatcctgattggatagtgacacaaactatgattagccatcaatctttggaggccacacaattttctttatctga

SEQ ID NO: 28852 - DNA, 75 bp, Artificial Sequence
  Synthetic
catgatacagtgggcatttgataatgattatatagaagatgcagatatagcttacaactatgctaaactgtctga

SEQ ID NO: 28853 - DNA, 75 bp, Artificial Sequence
  Synthetic
tacaaatagtaatgcaaaagcatttttagatagtaatagtcaagcaaagtatgttagagaatgtgctttaatggt

SEQ ID NO: 28854 - DNA, 75 bp, Artificial Sequence
  Synthetic
taaacattataaacgtgggcaaatgagggaaatgtcaatatcaagttggattcatacacgccttttatcagtaga

SEQ ID NO: 28855 - DNA, 75 bp, Artificial Sequence
  Synthetic
ttcatacacgccttttatcagtagaaggagaaggtcattggtctcatattgtaaaatttatcagatatcaaaact

SEQ ID NO: 28856 - DNA, 75 bp, Artificial Sequence
  Synthetic
aggagaaggtcattggtctcatattgtaaaatttatcagatatcaaaacttaaattttattgtatttttagataa

SEQ ID NO: 28857 - DNA, 75 bp, Artificial Sequence
  Synthetic
gtttaagacatttttgcagaatacacctaaaaggaattgcattttatttcatgggcctcctgattcagggaaatc

SEQ ID NO: 28858 - DNA, 75 bp, Artificial Sequence
  Synthetic
tatgtttacaatgtctttaattcgtgtgttaaaaggaaaagtgttatcatttgctaattctagaagtcatttttg

SEQ ID NO: 28859 - DNA, 75 bp, Artificial Sequence
  Synthetic
gttgcaaccactgtcagatgctaaaatagcactgctagacgatgctacatatgagtgttggaattattttgatac

SEQ ID NO: 28860 - DNA, 75 bp, Artificial Sequence
  Synthetic
attcttaagaaatggcattgatggaaacccagtcagtctagatataaaacacaaagctcctctgcaaatacaatt

SEQ ID NO: 28861 - DNA, 75 bp, Artificial Sequence
  Synthetic
tccacctttaatgataacatctaatatagatattaataaagaagatagatataggtatttgcaaagtagaatcat

SEQ ID NO: 28862 - DNA, 75 bp, Artificial Sequence
  Synthetic
gtcatttgaatttcctaataaatttccttttgatagtaataataaacctcaatttcttttaactgaccaaagctg

SEQ ID NO: 28863 - DNA, 75 bp, Artificial Sequence
  Synthetic
gaaatctttttttgaaaggctttggacacaattagagctcagtgatcaagaagacgagggagaggatggaaactc

SEQ ID NO: 28864 - DNA, 75 bp, Artificial Sequence
  Synthetic
tcagcgcacgtttcaatgcactgcaagagaagttaatggacatttatgaatcaggtgtagaaacgttggaagcac

SEQ ID NO: 28865 - DNA, 75 bp, Artificial Sequence
  Synthetic
aaattgagcactggcaattattaagacaagagcaggtgcttttaaattatgcaaggaggaatggtgttatgcgcc

SEQ ID NO: 28866 - DNA, 75 bp, Artificial Sequence
  Synthetic
taggatatcaacctgtaccaaatctagcaacgtcagagactaaagccaaggatgcaattcgcatggttatacttt

SEQ ID NO: 28867 - DNA, 75 bp, Artificial Sequence
  Synthetic
tacaaagtttacaaacttctgagtatgctgatgaaccgtggaacttggtgcagactagccttgaaactgttagaa

SEQ ID NO: 28868 - DNA, 75 bp, Artificial Sequence
  Synthetic
gtcctcctgaaaattgttttaaaaagggaccaaaaaatattgaggttatttttgatggaaatcctgaaaatctta

SEQ ID NO: 28869 - DNA, 75 bp, Artificial Sequence
  Synthetic
tgatttatactgtatggacatggatatattatcaaaactcagatgataagtggcaaaaggtagaaggtgctgtgg

SEQ ID NO: 28870 - DNA, 75 bp, Artificial Sequence
  Synthetic
actatgagggtgcttactatacagagggaaaacataagcactactaccttagatttgaagcagatgctaacagat

SEQ ID NO: 28871 - DNA, 75 bp, Artificial Sequence
  Synthetic
ttagcactactggactgtgggaagtgcatgttaaccaagatactgtgtttactcctgtcactagctcttcgccgc

SEQ ID NO: 28872 - DNA, 75 bp, Artificial Sequence
  Synthetic
catctggaagcagggtatcccttctgccctccgacaccacatccctccagccctcgtccagcgtctccaccacac

SEQ ID NO: 28873 - DNA, 75 bp, Artificial Sequence
  Synthetic
aaaaacgatacgcacgaaccggatctagccctacagccaccgcccggcggcagaggaaaagagaaagacaagaag

SEQ ID NO: 28874 - DNA, 75 bp, Artificial Sequence
  Synthetic
gagacggagaaggaacgcaggcgacatcgagacaacgtgtcagatcaagatcaagaagctccagcagagggagga

SEQ ID NO: 28875 - DNA, 75 bp, Artificial Sequence
  Synthetic
ggcaagaaacctcagtcaaacgagggaaagggcgaggaggagggtcacgagggagaagagaacccacccaacgag

SEQ ID NO: 28876 - DNA, 75 bp, Artificial Sequence
  Synthetic
acacctcctccaggggagggagaagtagaaggcggccccaaacacggtccaggtccagatcaagagggtcttcta

SEQ ID NO: 28877 - DNA, 75 bp, Artificial Sequence
  Synthetic
atgagcgtggcctcttgccttcagaagtgggaagatcagtacaatcagttggttcaaaacatcttggtagacttg

SEQ ID NO: 28878 - DNA, 75 bp, Artificial Sequence
  Synthetic
agcgattattggaagaggctgcagatcccccagtaattctgtttcgtggggaggctaatcagcttaaatgctatc

SEQ ID NO: 28879 - DNA, 75 bp, Artificial Sequence
  Synthetic
gctacagggtgcataaaaggcataagggtggctacaaatatgtcagtagtacttggtcatggatcacagaacata

SEQ ID NO: 28880 - DNA, 75 bp, Artificial Sequence
  Synthetic
acaatgacagagtgggacgcgctcggatgcttgttctgttttcatcaacagaacaaagggaagcatttctagaca

SEQ ID NO: 28881 - DNA, 75 bp, Artificial Sequence
  Synthetic
ctatgaaattacctcagggtgttgattggtcctatgggaattttgataatttttaattaactaaccctttttact

SEQ ID NO: 28882 - DNA, 75 bp, Artificial Sequence
  Synthetic
aattgcatgcttttacactaatatactaatctgctaatctgctatggctcgtgcacgcagaacaaaacgtgcttc

SEQ ID NO: 28883 - DNA, 75 bp, Artificial Sequence
  Synthetic
tgttactgatatttacaggggttgcaaggctgcaggtacttgccctcctgatgttgtacataaagttgaacaaag

SEQ ID NO: 28884 - DNA, 75 bp, Artificial Sequence
  Synthetic
cacaatagcagataaaattttacaatatggaagtgctgctgtgttttttggtgggttgggaataagtacaggccg

SEQ ID NO: 28885 - DNA, 75 bp, Artificial Sequence
  Synthetic
cggtactggtggcacaacaggatatgtacctcttggagaaggccctggggtgcgcgttggtggtgcgcccacagt

SEQ ID NO: 28886 - DNA, 75 bp, Artificial Sequence
  Synthetic
ggtacgccccggggtcatacctgaagttattggtccaactgagttaatacctattgatacagtcactccaattga

SEQ ID NO: 28887 - DNA, 75 bp, Artificial Sequence
  Synthetic
ccctacagcaccctctgtagtcaccttaactgacagctctgctgttgaccttttacctggtgaaatagagacaat

SEQ ID NO: 28888 - DNA, 75 bp, Artificial Sequence
  Synthetic
tgcagaagtgcatccagtcccagttccaagtgcaccagaaattgacactcctgtggtcactggcgggcgaaattc

SEQ ID NO: 28889 - DNA, 75 bp, Artificial Sequence
  Synthetic
ccaagtgcaccagaaattgacactcctgtggtcactggcgggcgaaattcatctgctgtgttggaggtggctgat

SEQ ID NO: 28890 - DNA, 75 bp, Artificial Sequence
  Synthetic
cctagtcctcccacacgtactagagtgtctagaacacaataccataacccatcttttcaaataatatctgagtct

SEQ ID NO: 28891 - DNA, 75 bp, Artificial Sequence
  Synthetic
acaccaatagctggggagtcttcattatcagatcatatattggtgtttgaagacacagggggtcaagctataggt

SEQ ID NO: 28892 - DNA, 75 bp, Artificial Sequence
  Synthetic
ggtacaagagaagacattgaactacaatcattaccttccaggtatagctttgaaatagaagaggccactcctact

SEQ ID NO: 28893 - DNA, 75 bp, Artificial Sequence
  Synthetic
cgtcaaaccagcacacctattcaaagaggtaggcaagctgtttctgctttacgtagggccttgtacaatcgaaga

SEQ ID NO: 28894 - DNA, 75 bp, Artificial Sequence
  Synthetic
ttaactcaacagatagctgtagaagaccctttatttttatccaaaccatctaagctagtaaaatttcagtttgat

SEQ ID NO: 28895 - DNA, 75 bp, Artificial Sequence
  Synthetic
aatcctgtatttgaagaagatgttacccagatatttgaaagggatatagaacaagttgaagaacctcctgacaga

SEQ ID NO: 28896 - DNA, 75 bp, Artificial Sequence
  Synthetic
cagtttctggatgtagcaaaattaggtaggcctacatattctgaaactcctcaaggctatgttagggtaagtagg

SEQ ID NO: 28897 - DNA, 75 bp, Artificial Sequence
  Synthetic
ctagggcgacgcgcttccctaaggactaggagtggtactcaggttggtgcacaggttcatttctacagggacctt

SEQ ID NO: 28898 - DNA, 75 bp, Artificial Sequence
  Synthetic
agtacaattaacactgaggagcccatagaattacaacttttaggagaacattctggggattctacaattgtacaa

SEQ ID NO: 28899 - DNA, 75 bp, Artificial Sequence
  Synthetic
gggcctgttgaaagtacacttatagatgttaatattaatgaaacacctagccttttggaaacttcagaatttaat

SEQ ID NO: 28900 - DNA, 75 bp, Artificial Sequence
  Synthetic
ccttttggaaacttcagaatttaattctgaagatttattacttgatgatgctgtgcaggactttagtgggtctca

SEQ ID NO: 28901 - DNA, 75 bp, Artificial Sequence
  Synthetic
tctgaagatttattacttgatgatgctgtgcaggactttagtgggtctcaattagtgtttggtacacctagaagg

SEQ ID NO: 28902 - DNA, 75 bp, Artificial Sequence
  Synthetic
tcaacctcatctgttactgtacctagattcagttctcctagggaaacaagtttatatattcaagatattgaaggt

SEQ ID NO: 28903 - DNA, 75 bp, Artificial Sequence
  Synthetic
tataatgtagcttatccagagtcacgagaagtacctgaaataatttatccacagcctgatattccagctgttgtt

SEQ ID NO: 28904 - DNA, 75 bp, Artificial Sequence
  Synthetic
atacatatagcagatgcttctggggatttttatttacatcccagtttacagaaacgaaaacgcaagcgagcttat

SEQ ID NO: 28905 - DNA, 75 bp, Artificial Sequence
  Synthetic
ttataatttttttcagatgtctctctggcttcctgcaagtggtaaggtatatttgccaccatcaactccagtagc

SEQ ID NO: 28906 - DNA, 75 bp, Artificial Sequence
  Synthetic
taaggtgttaagcactgatgaatatgtagaaagaactaacatattttatcacgcaactagtgatcgccttttaac

SEQ ID NO: 28907 - DNA, 75 bp, Artificial Sequence
  Synthetic
agtaggacatccatattttgatgttacaaattctgatggctccaaaatagaagttcccaaagtgtcaggaaatca

SEQ ID NO: 28908 - DNA, 75 bp, Artificial Sequence
  Synthetic
atttagggcctttagaatgttatttcctgatccaaatagatttgcattagcagatatgtccatatataacccaga

SEQ ID NO: 28909 - DNA, 75 bp, Artificial Sequence
  Synthetic
aaaggaaagattggtttgggcttgtaaaggaatagaaattagcagaggtcagcctttaggtgtaggtacatgtgg

SEQ ID NO: 28910 - DNA, 75 bp, Artificial Sequence
  Synthetic
tcatccattatttaataaagtgaaagatacagaaaatagcaatagctatcagacagggtccacagatgacagaca

SEQ ID NO: 28911 - DNA, 75 bp, Artificial Sequence
  Synthetic
aaatacatcctttgatcctaaacaagttcaaatgttcattattggatgtacaccatgtttaggagaatactggga

SEQ ID NO: 28912 - DNA, 75 bp, Artificial Sequence
  Synthetic
taaagctgagccatgtgaaaatgcaggagatcaacagggaaaatgtccacctatagaactgaaaaattctgtggt

SEQ ID NO: 28913 - DNA, 75 bp, Artificial Sequence
  Synthetic
tcaagatggcgatatgatggacattggatttggaaatataaattttaaaactctatccctgaatagatcagatgt

SEQ ID NO: 28914 - DNA, 75 bp, Artificial Sequence
  Synthetic
tagcttagatttagtagacgaaattgctaaatatccagattttctaactatggcaaatgatgtgtatggagactc

SEQ ID NO: 28915 - DNA, 75 bp, Artificial Sequence
  Synthetic
atgtttcttttttgcaagaagggaacagtgctatgcaagacattattttaccagaggaggtaatgttggagacgc

SEQ ID NO: 28916 - DNA, 75 bp, Artificial Sequence
  Synthetic
cagtgctatgcaagacattattttaccagaggaggtaatgttggagacgctattccagatggagcaaataatcag

SEQ ID NO: 28917 - DNA, 75 bp, Artificial Sequence
  Synthetic
gatcataaattttatttacctcctaagtcatcacaaagtcaaacactaggaaattcaatttattttcctactgtt

SEQ ID NO: 28918 - DNA, 75 bp, Artificial Sequence
  Synthetic
agtggttctctagtctcttcagatgctcagttatttaataggcctttttggttacaaaaagctcaaggccataac

SEQ ID NO: 28919 - DNA, 75 bp, Artificial Sequence
  Synthetic
aatggtatactatggggaaatcaaatgtttgtcactgttgctgataacactagaaacactaactttaccatttgt

SEQ ID NO: 28920 - DNA, 75 bp, Artificial Sequence
  Synthetic
gtaccttcagataatggtgctataactgagtatgattctagcaaatttagagaatttttaaggcacgtggaagag

SEQ ID NO: 28921 - DNA, 75 bp, Artificial Sequence
  Synthetic
tatcaaatatctgtaatattacaactgtgtaaagtatcactgcaacctgatgtgctagcccagatcaatgcaatg

SEQ ID NO: 28922 - DNA, 75 bp, Artificial Sequence
  Synthetic
tgtgctagcccagatcaatgcaatgaattcaggtatattagaagattggcagttaggatttgtaccaactcctga

SEQ ID NO: 28923 - DNA, 75 bp, Artificial Sequence
  Synthetic
aattcaggtatattagaagattggcagttaggatttgtaccaactcctgacaatgcagtacatgacacctcctca

SEQ ID NO: 28924 - DNA, 75 bp, Artificial Sequence
  Synthetic
gccactaaatgtccagataaggttcctgctaaagatagagaggatccatttgctcaatatttcttttggagagta

SEQ ID NO: 28925 - DNA, 75 bp, Artificial Sequence
  Synthetic
gatatgactgaaaaattatcattagatttagatcaatatcctttaggaagaaagtttttgttccaagcaggatta

SEQ ID NO: 28926 - DNA, 75 bp, Artificial Sequence
  Synthetic
cagaacaccagggtcaaatcattaaagcgtagcagatctgtttctcggggtactgcaaaacgaagacggacataa

SEQ ID NO: 28927 - DNA, 75 bp, Artificial Sequence
  Synthetic
cgaccgaaatcggtttgtatttaataaataaatattctaaccaaaatggtatgtgaagcattttttaaaccgtct

SEQ ID NO: 28928 - DNA, 75 bp, Artificial Sequence
  Synthetic
tcgtgactaaaccgaacaagtcaacaccagcaaccgcgcccggtttaatctgcttataaatcgcagccggtactt

SEQ ID NO: 28929 - DNA, 75 bp, Artificial Sequence
  Synthetic
cgcagccggtacttcacctaacaaagacttggcagtctgtttaggaacaccgcaggcgcccgccaagattctatt

SEQ ID NO: 28930 - DNA, 75 bp, Artificial Sequence
  Synthetic
atggactcgtcgcgaccactgacggtgcagcaacttagtgataagttgacagtacctgtagtggacctattgcta

SEQ ID NO: 28931 - DNA, 75 bp, Artificial Sequence
  Synthetic
taaatgatgatgataatgctgctcagggaaattcccgcgaattgctatgtcaacaggagagcgaggaatgcgagc

SEQ ID NO: 28932 - DNA, 75 bp, Artificial Sequence
  Synthetic
tgaatttgtcgcctgggcataaatctaaaaggagattatttgtggagcaagacagcggactggagttatctctaa

SEQ ID NO: 28933 - DNA, 75 bp, Artificial Sequence
  Synthetic
ttggaagtggtggataccaatcctccaacaagatttactgttacaagaacacaatatgataatccttcatttcaa

SEQ ID NO: 28934 - DNA, 75 bp, Artificial Sequence
  Synthetic
caacaagatttactgttacaagaacacaatatgataatccttcatttcaaattatttctgagtccacgccaataa

SEQ ID NO: 28935 - DNA, 75 bp, Artificial Sequence
  Synthetic
ccaaaaatacatgcaaccgcttgtgttaatgtattctgcacagtattatttaagtaggatgtgctgtattaaatt

SEQ ID NO: 28936 - DNA, 75 bp, Artificial Sequence
  Synthetic
aaatacatgcaaccgcttgtgttaatgtattctgcacagtattatttaagtaggatgtgctgtattaaattattc

SEQ ID NO: 28937 - DNA, 75 bp, Artificial Sequence
  Synthetic
aacggtaagtttttatttgtttgaaccgctgccggttgctatattactcatttatctgattgtggtttacaacaa

SEQ ID NO: 28938 - DNA, 75 bp, Artificial Sequence
  Synthetic
attgtaaaatttatcagatatcaaaacttaaattttattatgtttttagataagtttaggacatttttgcagaat

SEQ ID NO: 28939 - DNA, 75 bp, Artificial Sequence
  Synthetic
atgctgtgcaggactttagtgggtctcaattagtgtttggtacatctaggaggtcaacttcatctgttactgtac

SEQ ID NO: 28940 - DNA, 75 bp, Artificial Sequence
  Synthetic
gaacagtgctatgcaagacattattttaccagaggaggtaatgttggagacgctactccagatggagcaaataat

SEQ ID NO: 28941 - DNA, 75 bp, Artificial Sequence
  Synthetic
ttaccagaggaggtaatgttggagacgctactccagatggagcaaataatcaagatcataaattttatttacctc

SEQ ID NO: 28942 - DNA, 75 bp, Artificial Sequence
  Synthetic
ggcagttaggatttgtaccaactcctgacaatgcagtacatgacacctatagatttataaattcctcagccacta

SEQ ID NO: 28943 - DNA, 75 bp, Artificial Sequence
  Synthetic
taaaccgaacaagtcaacaccagcaaccgcgcccggtataatctgcttataaatcgcagccggtacttcacctta

SEQ ID NO: 28944 - DNA, 75 bp, Artificial Sequence
  Synthetic
caaagacttggcagtctgtctaggaacaccgcaggcgcccgccaagattctattgaagatatcttggcagaacat

SEQ ID NO: 28945 - DNA, 75 bp, Artificial Sequence
  Synthetic
caccgcaggcgcccgccaagattctattgaagatatcttggcagaacatcaatttggcctcacttctacaccgat

SEQ ID NO: 28946 - DNA, 75 bp, Artificial Sequence
  Synthetic
atggaagggccaaaacctaggacagttaaggagcttgcagataccttgactattcctttaatagatttattaata

SEQ ID NO: 28947 - DNA, 75 bp, Artificial Sequence
  Synthetic
ccgtgcagattttgtgatagatttttaacctactttgaattacttaattttgattataaacacttgcagctgatt

SEQ ID NO: 28948 - DNA, 75 bp, Artificial Sequence
  Synthetic
tggactgtagaagatttagtatatgcgtgttgcagtagttgtgcatttgcgtcagcacaatttgaatttactaac

SEQ ID NO: 28949 - DNA, 75 bp, Artificial Sequence
  Synthetic
tactacgaaggttctgtacaggggaaagcaatagaagctatagaaaatagtcctataggtactattcctattaga

SEQ ID NO: 28950 - DNA, 75 bp, Artificial Sequence
  Synthetic
tgtcagtattgcttgaagtcattagacctggttgaaaagcttgggaattgctacaatcagcaaccttttcacaaa

SEQ ID NO: 28951 - DNA, 75 bp, Artificial Sequence
  Synthetic
gtcaggggcggttggaagggactgtgtagacattgtgggtcgatagaatgattgggaaacaagctactataccag

SEQ ID NO: 28952 - DNA, 75 bp, Artificial Sequence
  Synthetic
acgttgttctggagctgcaagagcttgtccaacccactgacctgcattgctacgaagaattgacagaagaaacag

SEQ ID NO: 28953 - DNA, 75 bp, Artificial Sequence
  Synthetic
cagaggaggagcagtgtctcactccttacaagatcacagttgcttgcagttgtggtacaaggctgcgcttatttg

SEQ ID NO: 28954 - DNA, 75 bp, Artificial Sequence
  Synthetic
tacttgctaccgactctggaatacgagcacagcaagaattgctgctgacagaagttcaactggtgtgtcctgagt

SEQ ID NO: 28955 - DNA, 75 bp, Artificial Sequence
  Synthetic
gccgtgaaaaacttcgacatgggtgatgacaaaggtactatatatgatcctaaggaaggatgtagtgaatggttg

SEQ ID NO: 28956 - DNA, 75 bp, Artificial Sequence
  Synthetic
tgcttagaagcagagtgctcagatactagtctagatggtgatttggagagactatttgacgaaggtacagattct

SEQ ID NO: 28957 - DNA, 75 bp, Artificial Sequence
  Synthetic
gatatttcagaccttatagatgatggagatgctattcagggaaactcccgcgaactgttttgccagcaagagagt

SEQ ID NO: 28958 - DNA, 75 bp, Artificial Sequence
  Synthetic
gaggaaagcgagctacagacacaattgctaaaacgaaagtatatcagtcctaaagcagtgcagcagcttagtcct

SEQ ID NO: 28959 - DNA, 75 bp, Artificial Sequence
  Synthetic
caacttgagtctatctcaatatcgccacaacataaatctaaaaggagattgtttgaacaagacagcggacttgat

SEQ ID NO: 28960 - DNA, 75 bp, Artificial Sequence
  Synthetic
tgttcaataaatgaagctgaagatatttctcaaacaccggtggaagaggtaccgcctgttgttccaccggcagca

SEQ ID NO: 28961 - DNA, 75 bp, Artificial Sequence
  Synthetic
gcgcagggaacaaaagggttggggattgttaaagacttacttaaagcaaataatgtaaaagcagtactattggct

SEQ ID NO: 28962 - DNA, 75 bp, Artificial Sequence
  Synthetic
aaatttaaagaagcttttggtgtgggttttatggagttaaccagacaatataagagtaataaaacgtgctgtaga

SEQ ID NO: 28963 - DNA, 75 bp, Artificial Sequence
  Synthetic
gattgggtagttacggtgtacgctgtaaatgaagatttatttgaaagttctaaacagttgctgttgcagcattgt

SEQ ID NO: 28964 - DNA, 75 bp, Artificial Sequence
  Synthetic
gggtatatgtggcttcagcaaatgccacccatgtgtttgtactcgttgtgttttaatgttggaaaaagtagagaa

SEQ ID NO: 28965 - DNA, 75 bp, Artificial Sequence
  Synthetic
acagtaactcgcttgctaataaatttgttacaggtatctgaaatacaaataatagcagagcctccaaagcttcgt

SEQ ID NO: 28966 - DNA, 75 bp, Artificial Sequence
  Synthetic
agtgttttagcagctttgttttggtataaaggcagtatgaatccgaatgtgtatgctcatggggcttatccagaa

SEQ ID NO: 28967 - DNA, 75 bp, Artificial Sequence
  Synthetic
tggattgttgcacaaactatgataaaccatcaaacttcagatgccacacaatttgacttgtcaacaatgatccag

SEQ ID NO: 28968 - DNA, 75 bp, Artificial Sequence
  Synthetic
tttgcttatgacaatgattatttagaagaggctgtaattgcttaccagtatgcaaaattagctgacaccgatgca

SEQ ID NO: 28969 - DNA, 75 bp, Artificial Sequence
  Synthetic
aatgcaagagcatttttacaaagtaatagccaagctcgtttagtaaaggaatgtgcaacaatggttagacattat

SEQ ID NO: 28970 - DNA, 75 bp, Artificial Sequence
  Synthetic
aaacgaggagaaatgaaggatatgagtatatctgcttggatacataaaaagttaatatctgtggagggcgaaggt

SEQ ID NO: 28971 - DNA, 75 bp, Artificial Sequence
  Synthetic
cattggtcagacatagtcaaatttatcaggtttcaagatataaattttattgaatttttaactgcattcaaagag

SEQ ID NO: 28972 - DNA, 75 bp, Artificial Sequence
  Synthetic
tttcttcacaatacacctaaacataattgcatacttatttatggaccaccagacacaggaaaatctatgtttact

SEQ ID NO: 28973 - DNA, 75 bp, Artificial Sequence
  Synthetic
atgtctttaattagtacattgaaaggtaaagtgttatcatttgcaaattataaaagtaatttttggctgcagccc

SEQ ID NO: 28974 - DNA, 75 bp, Artificial Sequence
  Synthetic
ttaactgagaccaagcttgcattaattgatgatgtaacacctgtgtgttgggattatatagaccactatttacga

SEQ ID NO: 28975 - DNA, 75 bp, Artificial Sequence
  Synthetic
aatggattggatggtaattatgtctgtttcgatatgaaacacagggctccatgccaaatgaagtttcctccttta

SEQ ID NO: 28976 - DNA, 75 bp, Artificial Sequence
  Synthetic
atcctaacgtctaatattgatatatctaaggaacaaaagtatagatatttacatagtagaataaaatgtttccca

SEQ ID NO: 28977 - DNA, 75 bp, Artificial Sequence
  Synthetic
tttgctaataaatttccctttgatgcccagaataaaccacagtttcaactaactgaccaaagctggaaatctttt

SEQ ID NO: 28978 - DNA, 75 bp, Artificial Sequence
  Synthetic
cttaaaaggctttggacacagttagagctcagtgatcaagaagacgagggggacgatggaaaccctcagcgaccg

SEQ ID NO: 28979 - DNA, 75 bp, Artificial Sequence
  Synthetic
tttcaatgcactgcaagagactttaatggaactttatgaggcaggtcgtgaggatctacaaagccaaataacgca

SEQ ID NO: 28980 - DNA, 75 bp, Artificial Sequence
  Synthetic
ctggcaaacgctaagacaagagcaagtgctgttgtactttgctagaaagcatggagtaatgcgattggggtacca

SEQ ID NO: 28981 - DNA, 75 bp, Artificial Sequence
  Synthetic
acctgtgccgccattagctaccagtgaaagcaaagcaaaagatgctattggtatggtactcatgttgcagagcct

SEQ ID NO: 28982 - DNA, 75 bp, Artificial Sequence
  Synthetic
gcaaaaatctccatttggccaagagccttggacattggtgcaaaccagtctcgaaactgttcgtagtcctccagc

SEQ ID NO: 28983 - DNA, 75 bp, Artificial Sequence
  Synthetic
aaattgctttaaaaaaggtccacaaaatattgaagtgttgcttgatggcgatccagaaaatattatgagctatac

SEQ ID NO: 28984 - DNA, 75 bp, Artificial Sequence
  Synthetic
tgtttggaaatttatttattatcaaactgtaacagacacgtgggaaaaagttgaaggtcacgtagattactttgg

SEQ ID NO: 28985 - DNA, 75 bp, Artificial Sequence
  Synthetic
agcctaccattttgaagggactgtaaaaacttattatatcaattttgaaactgatgctgccagatatagcaaaac

SEQ ID NO: 28986 - DNA, 75 bp, Artificial Sequence
  Synthetic
tggcaaatgggaagtgcatgttaataaggacattgtgtttgctcctgtcactagttcttcgccaccttctggaga

SEQ ID NO: 28987 - DNA, 75 bp, Artificial Sequence
  Synthetic
cgggggagaagcctccatcaacaccgtatccgggtcgcggtcgcccacccgtacgcgacctacctcccccttgcc

SEQ ID NO: 28988 - DNA, 75 bp, Artificial Sequence
  Synthetic
ctccgaccaacggccactcaccacagcaccgagacgatacacaagaaaagcctctagcccgacctccaccaggaa

SEQ ID NO: 28989 - DNA, 75 bp, Artificial Sequence
  Synthetic
gaaaagacaaagagaaagagaaagagaaaaagcctctaccaggagatcaaggtccacctcacgggggcgaacaca

SEQ ID NO: 28990 - DNA, 75 bp, Artificial Sequence
  Synthetic
aaccaaaaggggagggcgccgacggagaggacgatccttttcctccgactccatcagctccaccgacgggagaag

SEQ ID NO: 28991 - DNA, 75 bp, Artificial Sequence
  Synthetic
gggaaggggaggtggaggggggcccacaacacgatcccaatcaagatcccaatcccgctcccgctcccgctcccg

SEQ ID NO: 28992 - DNA, 75 bp, Artificial Sequence
  Synthetic
ctcccactcccaatcccgaggggctacttccacaggtggcgtctcgccttctgaagtgggaacaggagttcgatc

SEQ ID NO: 28993 - DNA, 75 bp, Artificial Sequence
  Synthetic
agttggtcgcggacatcatgggagacttgaacgattattggcagaggctaaggaccccccagtaatgctattgcg

SEQ ID NO: 28994 - DNA, 75 bp, Artificial Sequence
  Synthetic
tggtgacgctaatgtgttgaaatgctatcgctacagggctcgcaaaaagcatagaggcctagtaaaatattatag

SEQ ID NO: 28995 - DNA, 75 bp, Artificial Sequence
  Synthetic
caccacatggtcatgggttggggaagatagttgtgatagagtaggtagagctagaatgttattagcatttagtac

SEQ ID NO: 28996 - DNA, 75 bp, Artificial Sequence
  Synthetic
atctaaacataggcagcagtttattaatacaatgaaattacctcctaacgtagactggtcccttggtagtcttga

SEQ ID NO: 28997 - DNA, 75 bp, Artificial Sequence
  Synthetic
tgattattgatttataattaactaatactaacttacctgcactgctactaacaaactaacctattttacaataat

SEQ ID NO: 28998 - DNA, 75 bp, Artificial Sequence
  Synthetic
ggctcgcgcacggcgtactaagcgtgcatctgtcactgatatttacagaggctgtaaggcttctggcacttgccc

SEQ ID NO: 28999 - DNA, 75 bp, Artificial Sequence
  Synthetic
tccagatgtaatcaataaagttgagcaaactactattgcagatcaaattttaaaatatggaggtgctggtgtctt

SEQ ID NO: 29000 - DNA, 75 bp, Artificial Sequence
  Synthetic
ttttggtgggttgggtattggtactggtagaggttcaggaggcacttcaggttacatccctttgggggaaggccc

SEQ ID NO: 29001 - DNA, 75 bp, Artificial Sequence
  Synthetic
tggagttcgtataggcggcactcctactgtgcttcgccctggggttataccagaagtaattggtccaacagacct

SEQ ID NO: 29002 - DNA, 75 bp, Artificial Sequence
  Synthetic
aatacctatagatacagtcaggcctattgatccaactgcacctagcattgtcactggtactgacagtgctgttga

SEQ ID NO: 29003 - DNA, 75 bp, Artificial Sequence
  Synthetic
ccttttacctggtgaagtagaatctattgcagagatccacccagtaccagtggatactgtagaaatagacactcc

SEQ ID NO: 29004 - DNA, 75 bp, Artificial Sequence
  Synthetic
agctgttagtggtggaaggacatcgtcagccattttggaagtggcagaccctagtccaccagtacgcacacgtgt

SEQ ID NO: 29005 - DNA, 75 bp, Artificial Sequence
  Synthetic
gtctcgaacacaataccataacccagcatttcaaataatctctgagtccactccaacatctggggagtcctcaat

SEQ ID NO: 29006 - DNA, 75 bp, Artificial Sequence
  Synthetic
ggctgatcacataattgtatttgagggttctggaggtcaattggttggtggtccaagacctaccgaatccattga

SEQ ID NO: 29007 - DNA, 75 bp, Artificial Sequence
  Synthetic
gttacaagatttgtcaaacagatacagttttgaaatagatgaaggaacacctcctagaacaagtacacctgtgca

SEQ ID NO: 29008 - DNA, 75 bp, Artificial Sequence
  Synthetic
acgtgcagtgcaatcacttagtaccctcagacgagctttgtataataggagattaacagaacaagtagcagttac

SEQ ID NO: 29009 - DNA, 75 bp, Artificial Sequence
  Synthetic
tgatcctttatttttatcaaggccttcacgtcttgtacaatttcaatttgataatcctgcatttgaagaagaagt

SEQ ID NO: 29010 - DNA, 75 bp, Artificial Sequence
  Synthetic
cactcaaatctttgaaagggatgttagtgctgtggaagaacctcctgatagacaatttttagatgtagcgcgttt

SEQ ID NO: 29011 - DNA, 75 bp, Artificial Sequence
  Synthetic
aggacgtccactatattctgagacacctcaaggttatatcagagttagcagattaggtagaagagctaccatacg

SEQ ID NO: 29012 - DNA, 75 bp, Artificial Sequence
  Synthetic
cacacgtagtggtgcccaggtaggtacgcaagtacatttttatagagatttaagtagtatagatgcagaagcacc

SEQ ID NO: 29013 - DNA, 75 bp, Artificial Sequence
  Synthetic
tatagaaatggaattattgggagagcattcaggtgatagcactattatacaagggcctgttgaaagttctctggt

SEQ ID NO: 29014 - DNA, 75 bp, Artificial Sequence
  Synthetic
tgatacaaatatagatgaacctgatgcattggaggtgggtcgtcaggggacacctgaactagaagatatggatat

SEQ ID NO: 29015 - DNA, 75 bp, Artificial Sequence
  Synthetic
agattttaactcagaagatttgttgatagatgatggtgtagaagattttagtggttcacaactgatagtgggatc

SEQ ID NO: 29016 - DNA, 75 bp, Artificial Sequence
  Synthetic
tcgaagagctacaaacacattgacagtaccacgatttgaaactccacgagacactagtttttatatacaagatat

SEQ ID NO: 29017 - DNA, 75 bp, Artificial Sequence
  Synthetic
tcaaggatatactgtatcttatcctgaatccagggacaccaataatattatatttccacatcctgaagcacctac

SEQ ID NO: 29018 - DNA, 75 bp, Artificial Sequence
  Synthetic
tgttgtaatccatatccatgacacgtcaggtgattattatttacatcctagcttacaaaaacgcaaatgcaaacg

SEQ ID NO: 29019 - DNA, 75 bp, Artificial Sequence
  Synthetic
taaacatagatatttataattgttttgcagatgacattgtggctaccaacgtctggtaaggtatatttgccacca

SEQ ID NO: 29020 - DNA, 75 bp, Artificial Sequence
  Synthetic
acaccacctgtggctcgagttcaaagcacggatgaatatgtggagagaaccaatatattttatcatgctgttagt

SEQ ID NO: 29021 - DNA, 75 bp, Artificial Sequence
  Synthetic
gatcgtttgctgacagtaggacatccatattttgatgttcgctctcaggatggacaaactattgaggtgcctaaa

SEQ ID NO: 29022 - DNA, 75 bp, Artificial Sequence
  Synthetic
gtatcaggcaatcagtatagagcatttagggtgtccttaccagatcccaataaatttgctttagctgacatgtca

SEQ ID NO: 29023 - DNA, 75 bp, Artificial Sequence
  Synthetic
gtatacaatcctgaaaaggaaaggctagtgtgggcttgtagaggccttgaaattggtagaggccagccattaggt

SEQ ID NO: 29024 - DNA, 75 bp, Artificial Sequence
  Synthetic
gtaggtacttctggtcatcctttatttaataaggttagagacactgaaaattctagtaactatcaacccaccact

SEQ ID NO: 29025 - DNA, 75 bp, Artificial Sequence
  Synthetic
gttgatgatagacagaacacatcatttgatcctaagcaggtacaaatgtttgtcatcggttgtataccttgctta

SEQ ID NO: 29026 - DNA, 75 bp, Artificial Sequence
  Synthetic
ggagaacactgggataaagcagcagtctgtgagtctgaagcaaataatcagcagggtaaatgccctccaatagaa

SEQ ID NO: 29027 - DNA, 75 bp, Artificial Sequence
  Synthetic
ttaaaaaacactgttatagaagatggtgatatgtttgatataggctttggtaacatcaataataagattttgtct

SEQ ID NO: 29028 - DNA, 75 bp, Artificial Sequence
  Synthetic
gttaataaatcagatgttagtttagacatagttaatgaaacatgtaaatatccagattttttaactatggcaaat

SEQ ID NO: 29029 - DNA, 75 bp, Artificial Sequence
  Synthetic
gatatttacggagatgcatgtttcttttttgctagacgggagcaatgctatgccaggcattactttgttagagga

SEQ ID NO: 29030 - DNA, 75 bp, Artificial Sequence
  Synthetic
ggtaatgttggagatgcagtaccagatgggcttgtaaatcaaaatcataatttttatctgccagctcaaaataat

SEQ ID NO: 29031 - DNA, 75 bp, Artificial Sequence
  Synthetic
caacagcaaagacagttgggtaattctacttattatcccactgttagtggatctctggtaacatcagatgcccaa

SEQ ID NO: 29032 - DNA, 75 bp, Artificial Sequence
  Synthetic
ttgtttaatagaccattttggttacaaagagcccaaggccacaataatggcattttatggggtaatcaaatgttt

SEQ ID NO: 29033 - DNA, 75 bp, Artificial Sequence
  Synthetic
ataacagttgctgacaatactagaaacactaatttttcgattagtgtcagcacagaagacacacctcctcaagaa

SEQ ID NO: 29034 - DNA, 75 bp, Artificial Sequence
  Synthetic
tatgatgccacgaaaataagagagtatttaagacatgttgaagaatatcaaatatcattaattttacaattatgt

SEQ ID NO: 29035 - DNA, 75 bp, Artificial Sequence
  Synthetic
aaagttgctctagttcctgaagtactttcacagattaatgctatgaatgcaggtatcttagaagactggcaacta

SEQ ID NO: 29036 - DNA, 75 bp, Artificial Sequence
  Synthetic
gggtttgtaccaactcctgaaaatgcagttcatgacatgtatagatacataaattcaaaagctactaaatgtcca

SEQ ID NO: 29037 - DNA, 75 bp, Artificial Sequence
  Synthetic
gatgctgtggagcctacagaacgtgaagatccttttgggaagtatacattttggaaagtagatatgacagaaaaa

SEQ ID NO: 29038 - DNA, 75 bp, Artificial Sequence
  Synthetic
ctatctttggagctagatcaatttcctcttggtcgtaagtttttatttcaagctggtttacaaacacgcaaacgt

SEQ ID NO: 29039 - DNA, 75 bp, Artificial Sequence
  Synthetic
agcattcgaacaacatctgtaaaagcccccaaaagtgcaaaacgaaaacgtacatgaccgatagcggtgctcaat

SEQ ID NO: 29040 - DNA, 75 bp, Artificial Sequence
  Synthetic
aaaaatgtaagtaatccattttggtatgtgaaacattttttaaccatcttagtgactaaaccatacaagtcaaca

SEQ ID NO: 29041 - DNA, 75 bp, Artificial Sequence
  Synthetic
caaggtaaccgcgcccggtttatctgattataaatcgcacctggtgcagtttagacaatgccatcgcggaataac

SEQ ID NO: 29042 - DNA, 75 bp, Artificial Sequence
  Synthetic
ctgaggcgcgcgccattttactgcctgccaaaacaacttggcagtacaccgaattggcttggcagtacaccgact

SEQ ID NO: 29043 - DNA, 75 bp, Artificial Sequence
  Synthetic
tggctacagaacgaccgataacggtaagttttggctcgtaggtggttatctgatcttaacagtagttgtggttaa

SEQ ID NO: 29044 - DNA, 75 bp, Artificial Sequence
  Synthetic
caacaatcatcatacacaaaaacatgtgaccgcttgcgttatctactatatatatataaatatataatttgcttg

SEQ ID NO: 29045 - DNA, 75 bp, Artificial Sequence
  Synthetic
aaaacatgtgaccgcttgcgttatctactatatatatataaatatataatttgcttgtatattaaaggcagctca

SEQ ID NO: 29046 - DNA, 75 bp, Artificial Sequence
  Synthetic
aacccgaaaaacagaatctgttggagggggtggcgttgcgcctagtgaagtgggagcaacagttcgatcacttag

SEQ ID NO: 29047 - DNA, 75 bp, Artificial Sequence
  Synthetic
gggggtggcgttgcgcctagtgaagtgggagcaacagttcgatcacttagtagacacagtagtggccgacttgcg

SEQ ID NO: 29048 - DNA, 75 bp, Artificial Sequence
  Synthetic
ccgccaaagctttgccaggtcttggcagaacatttgctggcaaaaactgcaccgataacggtaagaacttttaat

SEQ ID NO: 29049 - DNA, 75 bp, Artificial Sequence
  Synthetic
ttttaaccgtaggcgttcatttgttattcatggcaacaattgtggttaacaacaatcttctgccaatagttacat

SEQ ID NO: 29050 - DNA, 75 bp, Artificial Sequence
  Synthetic
gcaaccgcttgtggtaatttatgcactgcttgcagattatttaagtaggatgggctattatgtggtattcatggc

SEQ ID NO: 29051 - DNA, 75 bp, Artificial Sequence
  Synthetic
tttgcaaagaccactgacggtgcagcaacttagtgataagttgacagtacctgtagtagatcttttactaccttg

SEQ ID NO: 29052 - DNA, 75 bp, Artificial Sequence
  Synthetic
taatttctgcaataggtttttaacctatttggaattacggcaatttgattataaaaatctacaattaatttggac

SEQ ID NO: 29053 - DNA, 75 bp, Artificial Sequence
  Synthetic
agaagaagaccttgtgtttgcttgttgcagtgggtgtgcgtatgcttcagctcaatttgagtttcagcaatttta

SEQ ID NO: 29054 - DNA, 75 bp, Artificial Sequence
  Synthetic
tcaagtaactgtgtatggtcgcgagattgagcaagaagagcaacgacctgtaggccaaatctttattagatgcca

SEQ ID NO: 29055 - DNA, 75 bp, Artificial Sequence
  Synthetic
atattgtttgaagtctcttgatttgctagaaaagttagatatctgctgttccaatcaaccatttcacaaggttag

SEQ ID NO: 29056 - DNA, 75 bp, Artificial Sequence
  Synthetic
agatcattggaagggaaggtgcaggcattgtaaggcaatagaatgattgggaaacaagctactttgtgtgatata

SEQ ID NO: 29057 - DNA, 75 bp, Artificial Sequence
  Synthetic
gttcttgaagagcttgtcctgcccattgacctgcattaccacgaagagctgcctgaacttccagaagagttagaa

SEQ ID NO: 29058 - DNA, 75 bp, Artificial Sequence
  Synthetic
gaagtagaggaggagcctgagtacactccttacaagatcattgtatattgtgggggttgtgatacaaagttaaag

SEQ ID NO: 29059 - DNA, 75 bp, Artificial Sequence
  Synthetic
ctgcatgttctagctactctgtctggaattcgagattttcaagcgtccctccttggacctgtaaagcttttgtgt

SEQ ID NO: 29060 - DNA, 75 bp, Artificial Sequence
  Synthetic
gaattcgagattttcaagcgtccctccttggacctgtaaagcttttgtgtcccagctgtcgagaggagatccgca

SEQ ID NO: 29061 - DNA, 75 bp, Artificial Sequence
  Synthetic
atggacgacgataaaggtactgacacaactgatgctaaagaaggatgtagtggttggtttatgttagaagccgcg

SEQ ID NO: 29062 - DNA, 75 bp, Artificial Sequence
  Synthetic
tgctcagatgatagtgacttagataatagtttggaaaagttatttgaagatggtgcagagtcagatgtatctgat

SEQ ID NO: 29063 - DNA, 75 bp, Artificial Sequence
  Synthetic
tggtgcagagtcagatgtatctgatttaataaatgatgatgatattgctgctcaggaaaattcccgcgaattgct

SEQ ID NO: 29064 - DNA, 75 bp, Artificial Sequence
  Synthetic
atgtcaacagcaaagtgaggaatgtgagcagcagattcaatacctaaaacgaaagtatttcagtccaaaggctgt

SEQ ID NO: 29065 - DNA, 75 bp, Artificial Sequence
  Synthetic
gagcagcagattcaatacctaaaacgaaagtatttcagtccaaaggctgttcagcagttaagtccacgtcttcag

SEQ ID NO: 29066 - DNA, 75 bp, Artificial Sequence
  Synthetic
tctatgaatatttcgcctgggcataaatctaaaaggagattatttgtggagcacgacagcggactggagtgttca

SEQ ID NO: 29067 - DNA, 75 bp, Artificial Sequence
  Synthetic
ctaaatgaagctgaagatcttactgaagaggtggaggtaccggcgagcgctccagcgccggcagcacagggtggt

SEQ ID NO: 29068 - DNA, 75 bp, Artificial Sequence
  Synthetic
gtagggtcgggacatcatataagtttgttgagatgcaacaatgtaaaggcagtactattgggtaaatttaaagac

SEQ ID NO: 29069 - DNA, 75 bp, Artificial Sequence
  Synthetic
gcatatggagtaagctataatgagctaactagacaatttaaaagtaataagacttgctgcaagcattgggtattg

SEQ ID NO: 29070 - DNA, 75 bp, Artificial Sequence
  Synthetic
gctgtttatgctgctaaagatgaactaatagatgcgtccaaacaattgttacaacagcattgttcctatatatgg

SEQ ID NO: 29071 - DNA, 75 bp, Artificial Sequence
  Synthetic
ttgcaaacattttcacccatgtcattatatttatgttgttttaatgttggtaaaagtagagagactgtaatgcga

SEQ ID NO: 29072 - DNA, 75 bp, Artificial Sequence
  Synthetic
ctgatgtcttccattttacaagtacatgaaaaccatatattatcagaaccccccaaaataagaagtatgatagct

SEQ ID NO: 29073 - DNA, 75 bp, Artificial Sequence
  Synthetic
gcattattttggtataaaggcagtatgaatccaaatgtatatgcatttggagagtatcctgactggattatgaca

SEQ ID NO: 29074 - DNA, 75 bp, Artificial Sequence
  Synthetic
caaactatgatacatcatcaaactgctgacagtttacaatttgatttgtctcagatgatacaatgggcttatgat

SEQ ID NO: 29075 - DNA, 75 bp, Artificial Sequence
  Synthetic
caagattatgttgatgaatgtacggttgcttacaattatgctagactggctgatagagatagtaatgctagagca

SEQ ID NO: 29076 - DNA, 75 bp, Artificial Sequence
  Synthetic
tttttagctcataatagtcaagcaaaatatgtaagagaatgtgcacaaatggttagatattacaaacgtggagaa

SEQ ID NO: 29077 - DNA, 75 bp, Artificial Sequence
  Synthetic
atgcgagatatgtctatttcagcatggatacaccactgtatttcgaaaatagagggcgatggacactggcaggac

SEQ ID NO: 29078 - DNA, 75 bp, Artificial Sequence
  Synthetic
attgtgagatttttgcgtttccaaggtttaaactttatagtgtttttagataaatttagaacatttttacaaaat

SEQ ID NO: 29079 - DNA, 75 bp, Artificial Sequence
  Synthetic
tttcccaaaaaaaattgcttgctaatacatggtcctcctgacacaggaaagtctatgttcagcatgtccctaatg

SEQ ID NO: 29080 - DNA, 75 bp, Artificial Sequence
  Synthetic
aaagcattaaaaggacaggttgtatcgtttgcaaactctaaaagtcatttctggttacaacctttaacggatgca

SEQ ID NO: 29081 - DNA, 75 bp, Artificial Sequence
  Synthetic
aaacttgcccttttagatgatgcaacagatgtctgctggcaatatattgattcgtttttacgaaatggggtagat

SEQ ID NO: 29082 - DNA, 75 bp, Artificial Sequence
  Synthetic
ggtaatattgtgtctatagatatgaaacatagagcaccatgtcaaatgaaatttccacccttaatcattacatct

SEQ ID NO: 29083 - DNA, 75 bp, Artificial Sequence
  Synthetic
aatataagtttgaaaaaagaaaagaagtttccatatttacatagtagaatctatgaatttgaatttcctaacaaa

SEQ ID NO: 29084 - DNA, 75 bp, Artificial Sequence
  Synthetic
ctatgaatttgaatttcctaacaaattcccctttgacgcaaatgataaacctttgtttaaactaactgaccaaag

SEQ ID NO: 29085 - DNA, 75 bp, Artificial Sequence
  Synthetic
ctgggcgtctttttttaaaaggctttggacacaattagaactgagtgatcaagaagaagagggtgaaaatggaga

SEQ ID NO: 29086 - DNA, 75 bp, Artificial Sequence
  Synthetic
aactcaacgaacgtttcagtgcactgcaagagaagttaatggacttatatgaatcaggtgtagaggatcttgaaa

SEQ ID NO: 29087 - DNA, 75 bp, Artificial Sequence
  Synthetic
ctcagattcaacattggaaattattaagacaagaacaaataatattttattatgcaaggcgacatgggattatgc

SEQ ID NO: 29088 - DNA, 75 bp, Artificial Sequence
  Synthetic
gtttggggtaccagccagtgccccccttggcaacatcagagagtaaagcaaaagatgcaatagctatgggactgt

SEQ ID NO: 29089 - DNA, 75 bp, Artificial Sequence
  Synthetic
tgctggaaagtttacaaaaatctaaattttctgaggaaccctggactttagtagaaaccagtttggagacagtta

SEQ ID NO: 29090 - DNA, 75 bp, Artificial Sequence
  Synthetic
gaagtcctccagcagactgttttgaaaaaggacctaaatctgtggaagtgtattttgatggagatcctgaaaatg

SEQ ID NO: 29091 - DNA, 75 bp, Artificial Sequence
  Synthetic
taatgtcctatacagtgtggacatatatttattatcagactgatgatgagacatgggcaaaggtggaaggacatg

SEQ ID NO: 29092 - DNA, 75 bp, Artificial Sequence
  Synthetic
tggactatgcaggagcttattatatggagggaacctttaaaacatattatattaagtttgaaacagatgctaaac

SEQ ID NO: 29093 - DNA, 75 bp, Artificial Sequence
  Synthetic
gatatggtacaacaggatattgggaggtgcatgttaataaagatactgtgtttactcctgttaccagttcaacgc

SEQ ID NO: 29094 - DNA, 75 bp, Artificial Sequence
  Synthetic
cgccagctggagtcgcctcccagaaccccgcatccgaaccggtttccacctccgaccccgcaaaacggacatcac

SEQ ID NO: 29095 - DNA, 75 bp, Artificial Sequence
  Synthetic
aagccacccatcagcgatacggaagaaaagcgtctagccctacagttacctccatcagggcgcaaaaaagaagac

SEQ ID NO: 29096 - DNA, 75 bp, Artificial Sequence
  Synthetic
aaagacaaagacaagaaacccctacaaggcaaagaacaaacagatcaaggtcccgaagcaccgagcgtcggggag

SEQ ID NO: 29097 - DNA, 75 bp, Artificial Sequence
  Synthetic
ggagggccaccagacgatccctctccagaggatcctcaaaatcccccaggcggggagggagaagcggaggggggc

SEQ ID NO: 29098 - DNA, 75 bp, Artificial Sequence
  Synthetic
ccctcaccaggtcccgctcccgatcgcgatcccttacacgaaagtctgctaacgggggtggcgtcgcgcctgacg

SEQ ID NO: 29099 - DNA, 75 bp, Artificial Sequence
  Synthetic
aagtgggagcaacagttcgatcgattagtagacagcatagtgggcgacttgcgcagctactggatgcagctaaag

SEQ ID NO: 29100 - DNA, 75 bp, Artificial Sequence
  Synthetic
accccccagtaatattgctaagaggggcatccaacacattaaaatgctatcgctatagattcagaaaaaagcatg

SEQ ID NO: 29101 - DNA, 75 bp, Artificial Sequence
  Synthetic
ctggcaattttcaacttatcagcacaacctggtcctgggtgggggggcatacaactgacagaataggtcgcgcta

SEQ ID NO: 29102 - DNA, 75 bp, Artificial Sequence
  Synthetic
gaatgctcatatcatttcattcaaatagtgagagagaaacatgcttgcaacaaatgaaacttcctttaggtgtag

SEQ ID NO: 29103 - DNA, 75 bp, Artificial Sequence
  Synthetic
aatggtcatatggacagtttgatgatttatgatatgcttttttaataacttatatctaattttttactaacacac

SEQ ID NO: 29104 - DNA, 75 bp, Artificial Sequence
  Synthetic
taacagtgccttaactaacccattcgcttgctactaacaaaatggcgcgagcacgaagaactaagcgagcgtcag

SEQ ID NO: 29105 - DNA, 75 bp, Artificial Sequence
  Synthetic
ttactgacatttatagaggctgtaaggcctctgggacttgtcccccggatgtcattgataaagtggaacaaaata

SEQ ID NO: 29106 - DNA, 75 bp, Artificial Sequence
  Synthetic
cacttgctgataaaattttaaaatatggcagtgttggtgtgttttttggcggtcttggaatcagtacaggtaaag

SEQ ID NO: 29107 - DNA, 75 bp, Artificial Sequence
  Synthetic
gtactggtggtcctacaggatatgttccattaggtcaaggtcctggagttcgtgtgggcgccactcctacagtgg

SEQ ID NO: 29108 - DNA, 75 bp, Artificial Sequence
  Synthetic
tccgccccggggtcatacctgaaataattggaccaactgaattagtgccagttgactcagtaacaccaattgatc

SEQ ID NO: 29109 - DNA, 75 bp, Artificial Sequence
  Synthetic
ctacagcaccatcaatagtgacattaacagatagtagtgcagctgctgaccttttacctggagaagttgaaacta

SEQ ID NO: 29110 - DNA, 75 bp, Artificial Sequence
  Synthetic
ttgcagaaatccatccggttccaacagacactttagaggttgacacacctatggtgtctggagatcgtcacgcca

SEQ ID NO: 29111 - DNA, 75 bp, Artificial Sequence
  Synthetic
ttttggaagtgacagattcaaatcctccatttagacgtagtgttacccgtacccaataccataaccctgcttttg

SEQ ID NO: 29112 - DNA, 75 bp, Artificial Sequence
  Synthetic
aaattatttctgaatctacacctctaataggtgaatctacacccactgatcatgtgtttgtatttgaaggctcag

SEQ ID NO: 29113 - DNA, 75 bp, Artificial Sequence
  Synthetic
gaggtttggaggttggaggtgcaagggaaaatattgagttggatacatttccttcaacatatagttttgaaatag

SEQ ID NO: 29114 - DNA, 75 bp, Artificial Sequence
  Synthetic
aagaacccacaccacctcgtagagttagtacaccaattgagagaattagtcaagaatttagaaccctacgtagag

SEQ ID NO: 29115 - DNA, 75 bp, Artificial Sequence
  Synthetic
ctttatacaatagaagattaacagagcaagttaatgtgcgggatcctttgtttatccaatctccctctaaactag

SEQ ID NO: 29116 - DNA, 75 bp, Artificial Sequence
  Synthetic
taaggtttcaatttgataatccaacatttgatgaagaagtcacacaaatatttgaaagagatgtagctgctatag

SEQ ID NO: 29117 - DNA, 75 bp, Artificial Sequence
  Synthetic
aggagccacccgacagagactttttagatattgaaagacttggtaggcctttgttcacagaaactgcagagggcc

SEQ ID NO: 29118 - DNA, 75 bp, Artificial Sequence
  Synthetic
atgtgcgtgtcagtcgattgggacagcgtgcctcactaagcacacgtagtggggcgcgtgttggtgctagggtac

SEQ ID NO: 29119 - DNA, 75 bp, Artificial Sequence
  Synthetic
atttttatactgatcttagtactataaatgcagaagaaccaattgaattagaattattaggggaacattctggag

SEQ ID NO: 29120 - DNA, 75 bp, Artificial Sequence
  Synthetic
atagctctataattcaggaaccatttgaaagcacaatcatggatgctaatattgacaacatccctgaaagtttaa

SEQ ID NO: 29121 - DNA, 75 bp, Artificial Sequence
  Synthetic
atccagatgtaacacaattatctatagagaacacttctgctgattggttattggaagattatgttgaagatttta

SEQ ID NO: 29122 - DNA, 75 bp, Artificial Sequence
  Synthetic
gtaggtctcaattggttataggctcctctgatagatcagctacttcatttactattccacaatttgaatccccca

SEQ ID NO: 29123 - DNA, 75 bp, Artificial Sequence
  Synthetic
gagagaccattgtatatattcaagatatagaaggtaatacagttgtatatccaaaatttgcagataggccaacta

SEQ ID NO: 29124 - DNA, 75 bp, Artificial Sequence
  Synthetic
taatactacctactccatcggggcctgctatagttcaatcacttacacatacttcccttgattattatttacatc

SEQ ID NO: 29125 - DNA, 75 bp, Artificial Sequence
  Synthetic
tgctatagttcaatcacttacacatacttcccttgattattatttacatcctagcttgcgaagaagaaaacgcaa

SEQ ID NO: 29126 - DNA, 75 bp, Artificial Sequence
  Synthetic
acgcaaatatttataatgtttttcagatgaccctctggcttccaacttcgggtaagatatatttgcctcctacgc

SEQ ID NO: 29127 - DNA, 75 bp, Artificial Sequence
  Synthetic
ggtaagatatatttgcctcctacgccaccggtagctcgagtacaaaacacggacgagtatgtggagagaactgac

SEQ ID NO: 29128 - DNA, 75 bp, Artificial Sequence
  Synthetic
atctattaccatgccatgagtgatcgtttattaactgtaggtcatccgtattttgatgtaagatcagcaacagat

SEQ ID NO: 29129 - DNA, 75 bp, Artificial Sequence
  Synthetic
ggagcaaaaatagaagtcccaaaggtgtcagggaaccagtatagagcatttagagtaacctttccagatcctaat

SEQ ID NO: 29130 - DNA, 75 bp, Artificial Sequence
  Synthetic
aaatttgctctagcagatatgacaattcatgatcctgagaggtacagattagtatgggcttgcaaaggcttagaa

SEQ ID NO: 29131 - DNA, 75 bp, Artificial Sequence
  Synthetic
atcgggagaggacagcccataggtgtaggtaccacaggtcatccattatttaataaattacatgacactgaaaat

SEQ ID NO: 29132 - DNA, 75 bp, Artificial Sequence
  Synthetic
cctagtgaacgccagacaggcacagcagatgatagaagaaatgtttcttttgatcctaaacaggtacaaatgttt

SEQ ID NO: 29133 - DNA, 75 bp, Artificial Sequence
  Synthetic
attattggttgcataccttgtttaggggaacgttgggataaagcaccagtgtgtgaagatgcagggagtcaggag

SEQ ID NO: 29134 - DNA, 75 bp, Artificial Sequence
  Synthetic
ggcttatgtcctccactagagttaaaaaatagtgttatagaggatggtgatatgtttgatataggttttggaaat

SEQ ID NO: 29135 - DNA, 75 bp, Artificial Sequence
  Synthetic
ataaataacaaaacattatcatttaataaatcagatgttagtttagacattgtgaatgaaatctgtaaatatcca

SEQ ID NO: 29136 - DNA, 75 bp, Artificial Sequence
  Synthetic
gattttctgacaatgtctaatgatgtgtatggcgactcttgttttttttgtgcacgtagagagcaatgttatgca

SEQ ID NO: 29137 - DNA, 75 bp, Artificial Sequence
  Synthetic
agacataattttgtacgtggtggtgtagttggagatattatacctgatggcacagttcagcaagatcataagtat

SEQ ID NO: 29138 - DNA, 75 bp, Artificial Sequence
  Synthetic
tatttgccagctgcttcaccaccttctttagaaaactctgtgtatttcccaacacttagtgggtcattggtaacg

SEQ ID NO: 29139 - DNA, 75 bp, Artificial Sequence
  Synthetic
tctgatgctcaactatttaataggccattttggctaaagcgagcacagggacataataatggtattttgtggaac

SEQ ID NO: 29140 - DNA, 75 bp, Artificial Sequence
  Synthetic
aatcaaatatttgttacagtggctgataacacacgtaacactaattttactattagtgttgccagtgatagtagc

SEQ ID NO: 29141 - DNA, 75 bp, Artificial Sequence
  Synthetic
acagtgaattatgatgctggaaaaatcagagaatacatgcgtcatgttgaagaatatcagttatcatttatttta

SEQ ID NO: 29142 - DNA, 75 bp, Artificial Sequence
  Synthetic
caattatgtagaatacctttagaagcagaagtgttaacacaacttaatgctatgaatcatgggatattagaaaat

SEQ ID NO: 29143 - DNA, 75 bp, Artificial Sequence
  Synthetic
tggcaattggggtttgtacctacaccagacaatgctgtgcacgatacctacaggtatatatcttccaaagctaca

SEQ ID NO: 29144 - DNA, 75 bp, Artificial Sequence
  Synthetic
aaatgtcctgatgcagtacccgaaacacaaaaagaagacccttttggtcaatacactttttggaatgtagatatg

SEQ ID NO: 29145 - DNA, 75 bp, Artificial Sequence
  Synthetic
actgaaaaattatctttagatttggatcaatatcctttaggtcgtaaatttttattccaatctgggttacagcgt

SEQ ID NO: 29146 - DNA, 75 bp, Artificial Sequence
  Synthetic
gcaagggctagtgccaggatcagtataaaacgaccagcatcacggaaaacgtctaaatctgtaaaacgacgaaaa

SEQ ID NO: 29147 - DNA, 75 bp, Artificial Sequence
  Synthetic
gtctaaatctgtaaaacgacgaaaaatgaactcataaccgttttcggttgccttaataaaatttattaactaatc

SEQ ID NO: 29148 - DNA, 75 bp, Artificial Sequence
  Synthetic
tggtatgtgaagcattttttgaccacctttgtgactaaaccgaacaagtcaacaccagtaaccgcacccggtttt

SEQ ID NO: 29149 - DNA, 75 bp, Artificial Sequence
  Synthetic
ccgcacccggttttcacattataaattcctcgaggtaagattatgatcagtagataccatcggcgcctggagcaa

SEQ ID NO: 29150 - DNA, 75 bp, Artificial Sequence
  Synthetic
catctttggcagaagaagtgcaccgataacggtaagacttttcgtttttaaccgtaggcgttggtttattattcc

SEQ ID NO: 29151 - DNA, 75 bp, Artificial Sequence
  Synthetic
aaaaaacacaagggatatatttaaggggcctgtaaacttcagctttattcatggaactaccaaaacctcaaactg

SEQ ID NO: 29152 - DNA, 75 bp, Artificial Sequence
  Synthetic
gccagcatacaccccatacaaaatcatagttctttgtgggggttgtgaagtaaggctaaaactttacgtgtgggc

SEQ ID NO: 29153 - DNA, 75 bp, Artificial Sequence
  Synthetic
atagttctttgtgggggttgtgaagtaaggctaaaactttacgtgtgggcaaccgacgctgggattcggaatttg

SEQ ID NO: 29154 - DNA, 75 bp, Artificial Sequence
  Synthetic
caggagcttagtcctcgtctgcagtctatgaatttatcgtcagagcataaatctaaaaggagattatttgtggag

SEQ ID NO: 29155 - DNA, 75 bp, Artificial Sequence
  Synthetic
gatagatgcgtccaaacaattgttacagcagcactgtttttatatatggatccaatcttattgtcccatgtcact

SEQ ID NO: 29156 - DNA, 75 bp, Artificial Sequence
  Synthetic
cagcagcactgtttttatatatggatccaatcttattgtcccatgtcactttatttatgttgctttaatgttggt

SEQ ID NO: 29157 - DNA, 75 bp, Artificial Sequence
  Synthetic
tgaaaatcatatattgtcagagccaccaaaaaatagaagtattccagcagcgttattttggtataaaggaagttt

SEQ ID NO: 29158 - DNA, 75 bp, Artificial Sequence
  Synthetic
aaatagtaatgtgttctgttttggtgaagctcctgattggattctgtcacaaacaatgatacagcatcaaactgc

SEQ ID NO: 29159 - DNA, 75 bp, Artificial Sequence
  Synthetic
tgacactttgcagtttgatttgtctcgaatgattcaatgggcctatgataatgaccatatggacgaaagcactat

SEQ ID NO: 29160 - DNA, 75 bp, Artificial Sequence
  Synthetic
agcttatcaatatgctaagttagcagatattgatagtaatgctaaagcatttttagctcataacagccaagttaa

SEQ ID NO: 29161 - DNA, 75 bp, Artificial Sequence
  Synthetic
atatgttaaagagtgcgctttaatggtaagatattataaaagaggggaaatgaaagaaatgtctatttctgcttg

SEQ ID NO: 29162 - DNA, 75 bp, Artificial Sequence
  Synthetic
gatccatcactgtatatctaaggttgaaggagagggtaattggcagcatattgttaggtttatcagataccaaaa

SEQ ID NO: 29163 - DNA, 75 bp, Artificial Sequence
  Synthetic
tttaaatttcattatgtttctagataagtttcggaccttcttaaaaaatcttccaaaaaaaaattgtttgttaat

SEQ ID NO: 29164 - DNA, 75 bp, Artificial Sequence
  Synthetic
aagtttcggaccttcttaaaaaatcttccaaaaaaaaattgtttgttaatatatggtcctcctgacacaggaaag

SEQ ID NO: 29165 - DNA, 75 bp, Artificial Sequence
  Synthetic
ttttgctaattctaaaagtcaattttggttacagccactagctgatggaaaaattggtttattggatgatgcaac

SEQ ID NO: 29166 - DNA, 75 bp, Artificial Sequence
  Synthetic
attgggctatcaacctgtaccttctttggcaagttcagaagccaaagcaaaagatgctatttctatggtcctgtt

SEQ ID NO: 29167 - DNA, 75 bp, Artificial Sequence
  Synthetic
acttgaaagcttgaaaaaatccaaatatgcagatgaacaatggactttagctcaaactagcttggaggctgttcg

SEQ ID NO: 29168 - DNA, 75 bp, Artificial Sequence
  Synthetic
tatgcagatgaacaatggactttagctcaaactagcttggaggctgttcgcagtcctcctgcagactgttttaaa

SEQ ID NO: 29169 - DNA, 75 bp, Artificial Sequence
  Synthetic
tatttgatggtgaccctgaaaatcttatgtcatatactgtgtggacatatatatactaccagacagatgaggaca

SEQ ID NO: 29170 - DNA, 75 bp, Artificial Sequence
  Synthetic
tttgggaaaaagtggaaggccatgtggattatacaggagcctattattatgagggcaatttaaaggtgtattact

SEQ ID NO: 29171 - DNA, 75 bp, Artificial Sequence
  Synthetic
gagggcaatttaaaggtgtattacttaaaatttgagaatgatgctaaacgatttggtgtcacaggattatgggaa

SEQ ID NO: 29172 - DNA, 75 bp, Artificial Sequence
  Synthetic
caaccacctcccggaggcaaaggaaaggacagagagaaaccacaggcacccaaaggagaagaaaaagcagatcaa

SEQ ID NO: 29173 - DNA, 75 bp, Artificial Sequence
  Synthetic
cgttcgagatcaagatccgtctcacgaacctcttatgcagggggtggcatatcgcctgataaagtgggaacggca

SEQ ID NO: 29174 - DNA, 75 bp, Artificial Sequence
  Synthetic
gaacctcttatgcagggggtggcatatcgcctgataaagtgggaacggcagttcgatcagttggtagatcaagtg

SEQ ID NO: 29175 - DNA, 75 bp, Artificial Sequence
  Synthetic
gtggaagacttacgcggctactggcagaggctgcagaccccccagtaatattgttacgtggagatgctaatacct

SEQ ID NO: 29176 - DNA, 75 bp, Artificial Sequence
  Synthetic
tgaaatgctatcgctatcgatttagaaagaaacatgctggtggctttcgctttgtcagcacaacatggccatgga

SEQ ID NO: 29177 - DNA, 75 bp, Artificial Sequence
  Synthetic
taggagatgcatcaaatgatcgcatagggcgctcgcgaatgcttttagctttttattcagaatcacaaagggaga

SEQ ID NO: 29178 - DNA, 75 bp, Artificial Sequence
  Synthetic
agttcatacacactatgaaattacctacaggtgtagaatggtcattaggacaatttgatgatttatagaatactt

SEQ ID NO: 29179 - DNA, 75 bp, Artificial Sequence
  Synthetic
tacaggtgtagaatggtcattaggacaatttgatgatttatagaatactttataggtaatatttttatattttat

SEQ ID NO: 29180 - DNA, 75 bp, Artificial Sequence
  Synthetic
ctatattggaagtggctgaccctcatccgcctactagagctactgtaagcagaactcaatataataatcctgctt

SEQ ID NO: 29181 - DNA, 75 bp, Artificial Sequence
  Synthetic
tccgcctactagagctactgtaagcagaactcaatataataatcctgctttccaaatcatttttgaagtaattcc

SEQ ID NO: 29182 - DNA, 75 bp, Artificial Sequence
  Synthetic
gatcacgtattagtgtctgaagggtctggtggccagcagataggaggtaccagaacaacagaagaaattgagtta

SEQ ID NO: 29183 - DNA, 75 bp, Artificial Sequence
  Synthetic
agggcaagacaacaattttcatcactacgcagagcattatataatagaaggttaactgagcaagttggtgtcact

SEQ ID NO: 29184 - DNA, 75 bp, Artificial Sequence
  Synthetic
ccaaattggtgcgtttccaatttgacaatcctgtatttgatgaacaagtaacacagatatttgaacaagacattg

SEQ ID NO: 29185 - DNA, 75 bp, Artificial Sequence
  Synthetic
cagagggatatgttagagtaagtcgtttagggagacgaggaacaatacgaacacgcagtggtgcacaaatagggt

SEQ ID NO: 29186 - DNA, 75 bp, Artificial Sequence
  Synthetic
cacaggtacatttttatagggatttaagtacaataaatacagaggaacccttagaaatgcagctattaggtgagc

SEQ ID NO: 29187 - DNA, 75 bp, Artificial Sequence
  Synthetic
ttagaaatgcagctattaggtgagcattcaggtgatgcttcaattgtacagggtcctgtagaaagcactttagta

SEQ ID NO: 29188 - DNA, 75 bp, Artificial Sequence
  Synthetic
gatttattactggatgaggctatagaagatttcagtggatctcagttggttgtaggaactccacgaagatccact

SEQ ID NO: 29189 - DNA, 75 bp, Artificial Sequence
  Synthetic
gtatcagtcactgtacctagatttcagactcctcaaaatcctactatatattatcaagatatacaggggtaccat

SEQ ID NO: 29190 - DNA, 75 bp, Artificial Sequence
  Synthetic
agactcctcaaaatcctactatatattatcaagatatacaggggtaccatgtttcatatcccgaaagcagagaac

SEQ ID NO: 29191 - DNA, 75 bp, Artificial Sequence
  Synthetic
gacccgccattatttatcctactcccgatattcctacagtggttatacatgttgctgattcctctggagattttt

SEQ ID NO: 29192 - DNA, 75 bp, Artificial Sequence
  Synthetic
gtcattccgggtaacctttccagatccaaataagtttgctttagcagacatgtctgtttatgatccagataaaca

SEQ ID NO: 29193 - DNA, 75 bp, Artificial Sequence
  Synthetic
tgtctgtttatgatccagataaacataggttggtgtgggcctgcaaaggccttgaaataggccggggacagccat

SEQ ID NO: 29194 - DNA, 75 bp, Artificial Sequence
  Synthetic
taggagttggaactacaggtcatcccttatttaacaaagtaagagatactgaaaactccagtaattatcaaggaa

SEQ ID NO: 29195 - DNA, 75 bp, Artificial Sequence
  Synthetic
gtctgggagaatactgggataaagcacctgtatgtgataatgcaggggatcagacaggcctatgtccaccattag

SEQ ID NO: 29196 - DNA, 75 bp, Artificial Sequence
  Synthetic
aattaaaaaatagtgttattgaagatggagacatgtttgatatagggtttggcaacataaacaacaaaacacttt

SEQ ID NO: 29197 - DNA, 75 bp, Artificial Sequence
  Synthetic
cttttaacagatctgatgtaagtttggatatcgttaatgaaacctgcaaatatccagatttcctaaccatgtcta

SEQ ID NO: 29198 - DNA, 75 bp, Artificial Sequence
  Synthetic
atgatgtatatggtgattcctgctttttctttgtgcgaagagagcaatgctatgccagacattattttgttcgag

SEQ ID NO: 29199 - DNA, 75 bp, Artificial Sequence
  Synthetic
tttctttgtgcgaagagagcaatgctatgccagacattattttgttcgaggtggtgcagtgggcgacgctattcc

SEQ ID NO: 29200 - DNA, 75 bp, Artificial Sequence
  Synthetic
gacaggcccaacgcactttagggaactctacgtattttccaacagttagtggatctttagtgacatctgacgctc

SEQ ID NO: 29201 - DNA, 75 bp, Artificial Sequence
  Synthetic
ctctacgtattttccaacagttagtggatctttagtgacatctgacgctcagttatttaatagaccattttggtt

SEQ ID NO: 29202 - DNA, 75 bp, Artificial Sequence
  Synthetic
acaaagagctcaaggccacaacaatggtattttatggggtaatcaaatgtttgttacagtcgctgataatactcg

SEQ ID NO: 29203 - DNA, 75 bp, Artificial Sequence
  Synthetic
aaatacaaattttacaattagtgtatccactgaaaacggaggtgctcaggaatatgatgctacaaatattagaga

SEQ ID NO: 29204 - DNA, 75 bp, Artificial Sequence
  Synthetic
atatttaagacatgttgaggaataccaattgtcatttatattgcaattgtgtaaggttcctttgactgctgaagt

SEQ ID NO: 29205 - DNA, 75 bp, Artificial Sequence
  Synthetic
gctgacacagataaatgctatgaattctggcatattagaaaattggcaattgggctttgtacctaccccagacaa

SEQ ID NO: 29206 - DNA, 75 bp, Artificial Sequence
  Synthetic
agaagatccatttggacaatatacattttggaatgtggacatgactgaaaaattgtctctagatttggatcaata

SEQ ID NO: 29207 - DNA, 75 bp, Artificial Sequence
  Synthetic
gggcagattttaatcagtgcagatatcatctagcacctgcagcaaccgccaaaactttgccaggacttggcagaa

SEQ ID NO: 29208 - DNA, 75 bp, Artificial Sequence
  Synthetic
ctggagccaagtctttggcagaacaccatcttggaacagcaccgataacggtaagattatatcttggaaccgtag

SEQ ID NO: 29209 - DNA, 75 bp, Artificial Sequence
  Synthetic
ataagagctcttacttaagagtatatggataggccaaaacctgcaacagtgagggagcttgctgataccttgtgt

SEQ ID NO: 29210 - DNA, 75 bp, Artificial Sequence
  Synthetic
tggataggccaaaacctgcaacagtgagggagcttgctgataccttgtgtattcctttagttgacattttattgc

SEQ ID NO: 29211 - DNA, 75 bp, Artificial Sequence
  Synthetic
ggacagaagaagattttgtgtttgcctgttgcaccagttgtgcgtatgcctcagcacagtatgaattttctcagt

SEQ ID NO: 29212 - DNA, 75 bp, Artificial Sequence
  Synthetic
tttatgaacaatcagtcagtggaagggagttagaggaaatagaacacaaaccaataggggaaatatctattcgct

SEQ ID NO: 29213 - DNA, 75 bp, Artificial Sequence
  Synthetic
gcaagttttgtttaaagaaattggatttactagagaagttagacagttgttatagagatcaacaatttcataagg

SEQ ID NO: 29214 - DNA, 75 bp, Artificial Sequence
  Synthetic
gctgtttttgtgattctaaactacggcttattgttcttgcaacgcacgctggaattcgttctcaggaagagcttt

SEQ ID NO: 29215 - DNA, 75 bp, Artificial Sequence
  Synthetic
aaaaggagattatttgaacgagacagcggactagaactgtcatttaatgaagctgaagattttactcagcagact

SEQ ID NO: 29216 - DNA, 75 bp, Artificial Sequence
  Synthetic
tgtcaagggattgggaattgttaaagaccttttaaaatgtagtaatgtaaaagctatgttattggccaaatttaa

SEQ ID NO: 29217 - DNA, 75 bp, Artificial Sequence
  Synthetic
agttacactgtatgcagtacaggatgagctaatagaaagctccaaacaattgctgctgcaacattgtgcttatat

SEQ ID NO: 29218 - DNA, 75 bp, Artificial Sequence
  Synthetic
atggctacaacatatgccacctatgtgtttatatttattatgttttaacgttggaaaaagtagggaaactgtatc

SEQ ID NO: 29219 - DNA, 75 bp, Artificial Sequence
  Synthetic
acggctgcttatgaatatactgcaagtagcagaagtacaaatgttagcagagcctccaaagttaagaagcatgtt

SEQ ID NO: 29220 - DNA, 75 bp, Artificial Sequence
  Synthetic
gacacaaactatgattaatcatcaaacagcacaggcaactcaatttgatctatccaccatgatacaatttgctta

SEQ ID NO: 29221 - DNA, 75 bp, Artificial Sequence
  Synthetic
agcatttttacagcataacagtcaagcacgatttgtaaaagaatgtgcaataatggtgagacattataagcgtgg

SEQ ID NO: 29222 - DNA, 75 bp, Artificial Sequence
  Synthetic
taatggtgagacattataagcgtggagaaatgaaagaaatgagtatttctacgtggatacatagaaaattattag

SEQ ID NO: 29223 - DNA, 75 bp, Artificial Sequence
  Synthetic
tagatatatttaaatcgtttttgcacaataaaccaaaaaaaaactgtatattaattcatggcccaccagatacag

SEQ ID NO: 29224 - DNA, 75 bp, Artificial Sequence
  Synthetic
ttaattcatggcccaccagatacaggtaaatcgatgtttacaatgtcccttataaaagtgatgaaaggtaaagtg

SEQ ID NO: 29225 - DNA, 75 bp, Artificial Sequence
  Synthetic
gtgacatttgtatgttgggattacatagatcagtatttaagaaatggattagatggtaatgttgtgtgtttagat

SEQ ID NO: 29226 - DNA, 75 bp, Artificial Sequence
  Synthetic
ttattatgccaggaaacatggagtgatgcgtgtaggttatcaacctgtacctcctttagccaccagtgaggctaa

SEQ ID NO: 29227 - DNA, 75 bp, Artificial Sequence
  Synthetic
agcaaaggatgccattggcatggttctcttattgcagagcttgcaaaaatcaccgtatggcaaagagccatggac

SEQ ID NO: 29228 - DNA, 75 bp, Artificial Sequence
  Synthetic
acttacacagactagtttggagactgtccgaagcgcacccgcaaactgttttaaaaaaggtcctcaaaacattga

SEQ ID NO: 29229 - DNA, 75 bp, Artificial Sequence
  Synthetic
ttaaaaaaggtcctcaaaacattgaagttatgtttgacaatgaccctgaaaatcttatggtatatacagtgtggt

SEQ ID NO: 29230 - DNA, 75 bp, Artificial Sequence
  Synthetic
ggaaggggagggagcagtggggggcccaggacacggtcccagtcgcggtccctctcccgatcccgatcgcgatca

SEQ ID NO: 29231 - DNA, 75 bp, Artificial Sequence
  Synthetic
gaagctaacaaagtgaaatgctttcgatatagagcaaaaaagcgatatggcaacttagttaaatattacagcact

SEQ ID NO: 29232 - DNA, 75 bp, Artificial Sequence
  Synthetic
ttggtcattaggacatctagatgatttataggccttaacttttttaacctactaacactgctaaagcttgctttt

SEQ ID NO: 29233 - DNA, 75 bp, Artificial Sequence
  Synthetic
aacaaactacaatagcagataaaattttaaaatatggtagttctggtgttttttttggtgggctgggcattagta

SEQ ID NO: 29234 - DNA, 75 bp, Artificial Sequence
  Synthetic
gttgacctattacctactgaattggaaaccattgcagaaatacatcctgtgcctactgacaatttagatattgac

SEQ ID NO: 29235 - DNA, 75 bp, Artificial Sequence
  Synthetic
attccagtgctgttttagaggttgctgatcctagtccccctgtaagaacaagggtgtctcgtactcagtaccaca

SEQ ID NO: 29236 - DNA, 75 bp, Artificial Sequence
  Synthetic
ttgaaggttttggtggacaaaacataggtggttccaggaatgcagctatcgacacagcacaggaaagctttgaaa

SEQ ID NO: 29237 - DNA, 75 bp, Artificial Sequence
  Synthetic
tgcaatcctggcccagcagatacagctttgagatagaggaaggtacacctcctagaacaagtactcctgttcaac

SEQ ID NO: 29238 - DNA, 75 bp, Artificial Sequence
  Synthetic
gtgcagtacaatcactatcaagcttaagaagagctttatacaatagacgattaactgaacaagttgcagtgacag

SEQ ID NO: 29239 - DNA, 75 bp, Artificial Sequence
  Synthetic
atccactctttttaagtaggccctcacacttggttcaatttcagtttgataatcctgcgtttgaagaagaagtta

SEQ ID NO: 29240 - DNA, 75 bp, Artificial Sequence
  Synthetic
cacagctgtttgaaagagatattgaagcagtggaggaacctcctgatagacagtttttagatgttgtacgcttag

SEQ ID NO: 29241 - DNA, 75 bp, Artificial Sequence
  Synthetic
gaaggcctacatattcagaaacaccacagggttatttacgagtcagtagactaggtagaagagccagtattcgta

SEQ ID NO: 29242 - DNA, 75 bp, Artificial Sequence
  Synthetic
ctcgcagtggagcacaagtaggagctcaggtacatttttatagagatattagcactattgattcagatgctttag

SEQ ID NO: 29243 - DNA, 75 bp, Artificial Sequence
  Synthetic
aaatgcaattattgggggaacattcaggtgacactactatagtacaaggtcctgtagaaagctcctttgtagaca

SEQ ID NO: 29244 - DNA, 75 bp, Artificial Sequence
  Synthetic
ttaatattgatgacccagggcctttaaatgtaggcatccaagaatcaccactggttgatactatagaagaagatt

SEQ ID NO: 29245 - DNA, 75 bp, Artificial Sequence
  Synthetic
ttaattctgcagatttgttactggaagatgctatagatgattttagcgggtctcagctggtatttggtaatcctc

SEQ ID NO: 29246 - DNA, 75 bp, Artificial Sequence
  Synthetic
gccgcagcacaacatctgtaactgtaccccggtttgaaacaccaagggatactggattttacatacatgacactc

SEQ ID NO: 29247 - DNA, 75 bp, Artificial Sequence
  Synthetic
agggatacacagtagcatatccagaatcacgtgataccactgaaatcattcttccacaccctgatacaccaactg

SEQ ID NO: 29248 - DNA, 75 bp, Artificial Sequence
  Synthetic
cttccacaccctgatacaccaactgtagtaattaaatttgcagaagcaggggcagatttttatttacaccctagt

SEQ ID NO: 29249 - DNA, 75 bp, Artificial Sequence
  Synthetic
gatgtaagatcaactgatggattaagaatagaagtccctaaagtttctggaaatcagtatagagcctttagggtc

SEQ ID NO: 29250 - DNA, 75 bp, Artificial Sequence
  Synthetic
acattaccagatcctaataagtttgccttggcagatatgtcagtttacaatccagaaaaggaaagattagtttgg

SEQ ID NO: 29251 - DNA, 75 bp, Artificial Sequence
  Synthetic
gcgtgtgcaggccttgaaattggacgagggcagccattaggtgtaggtactacagggcatcctttatttaataag

SEQ ID NO: 29252 - DNA, 75 bp, Artificial Sequence
  Synthetic
ctaagagacactgaaaataacagcagctatcaaggtggatctactgatgatagacaaaacacttcatttgaccct

SEQ ID NO: 29253 - DNA, 75 bp, Artificial Sequence
  Synthetic
gctatcaaggtggatctactgatgatagacaaaacacttcatttgaccctaaacaagtgcaaatgtttgttgtag

SEQ ID NO: 29254 - DNA, 75 bp, Artificial Sequence
  Synthetic
aatgaacaaaacaatcaaacaggcctgtgtccaccattggagttaaaaaacactgttattgaagatggtgatatg

SEQ ID NO: 29255 - DNA, 75 bp, Artificial Sequence
  Synthetic
gttgacataggctttggaaacattaataacaaggtgctttcatttaataaatcagatgtaagtttagatatagtt

SEQ ID NO: 29256 - DNA, 75 bp, Artificial Sequence
  Synthetic
aatgaaacatgcaaatatcctgactttttaagcatggcaaatgatatttatggtgatgcatgtttcttttttgcc

SEQ ID NO: 29257 - DNA, 75 bp, Artificial Sequence
  Synthetic
agacgggagcagtgctatgccaggcattattttgtgaggggaggtaatgtaggcgatgctgtcccagatggttct

SEQ ID NO: 29258 - DNA, 75 bp, Artificial Sequence
  Synthetic
gtaaatcaggatcataaattctatttaccagcacaaactggccaacaacagcgtactttaggtaattccacttat

SEQ ID NO: 29259 - DNA, 75 bp, Artificial Sequence
  Synthetic
tttccaactgtaagtggttctttagtaacatctgatgcccagcttttcaataggccattctggttacgtagagca

SEQ ID NO: 29260 - DNA, 75 bp, Artificial Sequence
  Synthetic
caaggacacaataatggcattttatggggtaatcaaatatttgttactgtggctgacaacactagaaacacaaat

SEQ ID NO: 29261 - DNA, 75 bp, Artificial Sequence
  Synthetic
ttttctattagcgtgtctacagaagctggggctgttacagaatataattctcaaaacatcagagagtatttaaga

SEQ ID NO: 29262 - DNA, 75 bp, Artificial Sequence
  Synthetic
catgtagaagaatatcagctatctttcattttacaattgtgtaaaatacctttaaaggctgaagttttaacgcaa

SEQ ID NO: 29263 - DNA, 75 bp, Artificial Sequence
  Synthetic
tttaaaggctgaagttttaacgcaaattaatgcaatgaactcaggaattttggaagactggcagttgggatttgt

SEQ ID NO: 29264 - DNA, 75 bp, Artificial Sequence
  Synthetic
gcctacaccagataatccagtgcatgatatatataggtacattaattctaaagccacaaaatgtcctgatgcagt

SEQ ID NO: 29265 - DNA, 75 bp, Artificial Sequence
  Synthetic
tgtagaaaaagagaaagaagacccctttgcaaaatatacattctggaatgtaaatcttactgaaaaattatcatt

SEQ ID NO: 29266 - DNA, 75 bp, Artificial Sequence
  Synthetic
agatttagatcagtatcccctaggacgaaagtttatttttcagtcgggtttgcaggcaaggcccagaagtattcg

SEQ ID NO: 29267 - DNA, 75 bp, Artificial Sequence
  Synthetic
tgcaggcaaggcccagaagtattcggacctctgtaaaagtgcctaagggaacgaaacgcaaacggtcatgaccgc

SEQ ID NO: 29268 - DNA, 75 bp, Artificial Sequence
  Synthetic
agcagataccatcagcacctggagcgaccgccaagacttcgccaacttggcagaacatttgttggcaagaaaaga

SEQ ID NO: 29269 - DNA, 75 bp, Artificial Sequence
  Synthetic
gcaccgataacggtaagaacttttattttttgaccgtaggcgttcatttactaaccttggcaacaattgtggtta

SEQ ID NO: 29270 - DNA, 75 bp, Artificial Sequence
  Synthetic
acaacaatcataagccaataatacatgcaaccgcttgtggtaatttattatgcagactgtgcattatttaagtag

SEQ ID NO: 29271 - DNA, 75 bp, Artificial Sequence
  Synthetic
gatgtgctacaccaaattattgatggactcgacgcgaccactgacggtacagcaacttagtgataagttgacagt

SEQ ID NO: 29272 - DNA, 75 bp, Artificial Sequence
  Synthetic
accagtggtagatctcttgctaccttgcagattttgttctaggtttcttacctatttagagttgcgagaatttga

SEQ ID NO: 29273 - DNA, 75 bp, Artificial Sequence
  Synthetic
ttataaacatttgcagttaatctggacagaagaagattttgtatttgcatgctgcagtggctgtgcttatgcttc

SEQ ID NO: 29274 - DNA, 75 bp, Artificial Sequence
  Synthetic
tgctcaatttgaaattcaacaattttatcagctaactgtgtatggtcgtgaaattgagcaggaggagcaacgacc

SEQ ID NO: 29275 - DNA, 75 bp, Artificial Sequence
  Synthetic
tataggccaaatttgtattaggtgtcagtattgtttgaagtctctcgatttgatagaaaagctagatatctgtag

SEQ ID NO: 29276 - DNA, 75 bp, Artificial Sequence
  Synthetic
cagtattgtttgaagtctctcgatttgatagaaaagctagatatctgtagttttaatcaaccatttcacaaggtt

SEQ ID NO: 29277 - DNA, 75 bp, Artificial Sequence
  Synthetic
gggaaacaagctactcttcgtgatatagttcttgaagagcttgtccagcccattgacctgcattgccacgaggag

SEQ ID NO: 29278 - DNA, 75 bp, Artificial Sequence
  Synthetic
ctcactgaagaggtagaagaagcagtcgtagaggaggagcctgaatacactccttacaagatcatcgtagtttgt

SEQ ID NO: 29279 - DNA, 75 bp, Artificial Sequence
  Synthetic
ggaggctgtgagacacagttaaagctttacgtgctagccacagattttggaattcgctcgttccaagcatctttg

SEQ ID NO: 29280 - DNA, 75 bp, Artificial Sequence
  Synthetic
ctagaaaacgtgaagctggtgtgtcctgcctgtcgagaagacattcgcaatggacgacgataaaggtactgatac

SEQ ID NO: 29281 - DNA, 75 bp, Artificial Sequence
  Synthetic
tgctaaagaaggctgtagtacttggtgcttattagaggctgcttgttctgatgatagtgacctagatgatagttt

SEQ ID NO: 29282 - DNA, 75 bp, Artificial Sequence
  Synthetic
atgatagtgacctagatgatagtttggagaaattatttgaagagaatgcagagtcagatgtgtctgatttaataa

SEQ ID NO: 29283 - DNA, 75 bp, Artificial Sequence
  Synthetic
atgatgatgataatgctgctcagggaaattcccgcgaattgctatgtcaacaggagagtgaggaatgcgagcagc

SEQ ID NO: 29284 - DNA, 75 bp, Artificial Sequence
  Synthetic
aaatacaatacctaaaacgaaagtataatatcagtccagaggctgttcagcagcttagtccacgtctacagtctt

SEQ ID NO: 29285 - DNA, 75 bp, Artificial Sequence
  Synthetic
gttggaggtaccggcgagcgctccagggccggcagcccagggtggagtagggctgggacatattgaaagtttgtt

SEQ ID NO: 29286 - DNA, 75 bp, Artificial Sequence
  Synthetic
aagatgtaaaaatgctaaagcagtgttgctacataaatttaaggaaggttttggaattagttataatgagcttac

SEQ ID NO: 29287 - DNA, 75 bp, Artificial Sequence
  Synthetic
cagacagtttaaaagcaataagacctgctgtaaacattgggtattggccatatatggtgcaaaagaagagctcat

SEQ ID NO: 29288 - DNA, 75 bp, Artificial Sequence
  Synthetic
agatgcgtctaagcaattgttacaacagcactgttcttatatttggttgcagacatacacacctatgtcacttta

SEQ ID NO: 29289 - DNA, 75 bp, Artificial Sequence
  Synthetic
tttatgttgctttaatgttgcaaaaagtagagaaacagttgtaaaattattgatttctatgctgcaaatacatga

SEQ ID NO: 29290 - DNA, 75 bp, Artificial Sequence
  Synthetic
aaatcatatattatcagaacctccgaaaaacagaagtgtacctgtagctttattttggtataaaggcagtatgaa

SEQ ID NO: 29291 - DNA, 75 bp, Artificial Sequence
  Synthetic
ccctaatgtatatgcatttggtgagtatcctgagtggattgtgacacaaaccatgatacaacatcaaactgctga

SEQ ID NO: 29292 - DNA, 75 bp, Artificial Sequence
  Synthetic
cagtatacaatttgatttgtctcgtatgattcaatgggcctacgataatgatcatcttgacgaatgtagtattgc

SEQ ID NO: 29293 - DNA, 75 bp, Artificial Sequence
  Synthetic
ttataactatgcaaaattggctgacacagacagcaatgcaagagcttttttagctcaaaatagccaagcaaaaca

SEQ ID NO: 29294 - DNA, 75 bp, Artificial Sequence
  Synthetic
tgtaagagattgtgcacagatggttaagcattataaaagaggtgaaatgcgagaaatgactatttctgcatgggt

SEQ ID NO: 29295 - DNA, 75 bp, Artificial Sequence
  Synthetic
acatcattgcatatctagaattgaaggtgatggacaatggcaagatattgttaaatttttgcgctatcagggatt

SEQ ID NO: 29296 - DNA, 75 bp, Artificial Sequence
  Synthetic
aaacttcattgtatttttagataaatttagaacgtttttacagaattttccaaaaaaaaattgtttgttaatata

SEQ ID NO: 29297 - DNA, 75 bp, Artificial Sequence
  Synthetic
tgggcctccagacacaggcaaatcaatgtttactatgtctttaatgaaagcactaagaggtcaagtaatatcgtt

SEQ ID NO: 29298 - DNA, 75 bp, Artificial Sequence
  Synthetic
tgcaaattctaaaagccaattttggctgcaaccattagctgatgcaaagatcgccttattagatgatgcaacaga

SEQ ID NO: 29299 - DNA, 75 bp, Artificial Sequence
  Synthetic
agtttgttggcaatatattgatatgtttcttcgaaatggattggatggtaatgtagtgtcgttggatatgaaaca

SEQ ID NO: 29300 - DNA, 75 bp, Artificial Sequence
  Synthetic
tagagcaccatgtcaaatgaaatttccaccattaattattacatctaatattagccttaagaaagaaaagaagtt

SEQ ID NO: 29301 - DNA, 75 bp, Artificial Sequence
  Synthetic
tccttacttgcatagtagaatatatgaatttgaatttccaaacagatttccatttgattcagatgataaaccttt

SEQ ID NO: 29302 - DNA, 75 bp, Artificial Sequence
  Synthetic
gcgtctttttttaaaaggctttggatacaattaggactcagtgaccaagaggacgagggagaggatggaagcact

SEQ ID NO: 29303 - DNA, 75 bp, Artificial Sequence
  Synthetic
cagcgaacgtttcagtgcactacaagacaagttaatggacctgtatgaatcaggtttagaggatcttgaaactca

SEQ ID NO: 29304 - DNA, 75 bp, Artificial Sequence
  Synthetic
aatacagcattggaaactcttaagacaagaacaaattttattgtattatgctcgaaaacgtggaattatgcgttt

SEQ ID NO: 29305 - DNA, 75 bp, Artificial Sequence
  Synthetic
ggggtaccagccggtacctcctctggcaacatcagaaattaaagcaaaagatgctatagcaattggaattttgct

SEQ ID NO: 29306 - DNA, 75 bp, Artificial Sequence
  Synthetic
ggaaagtttacaaaaatccaaatatgcagatgagccatggacattagttgagactagcttggagacaattagaag

SEQ ID NO: 29307 - DNA, 75 bp, Artificial Sequence
  Synthetic
tccaccagtagattgctttaaaaagggacctaaaacagtggaggtgtattttgatggagatcctgaaaatgttat

SEQ ID NO: 29308 - DNA, 75 bp, Artificial Sequence
  Synthetic
gccatatacagtatggtcttatatttactatcaaactgatgaggacacttgggaaaaggttgaaggacatgtgga

SEQ ID NO: 29309 - DNA, 75 bp, Artificial Sequence
  Synthetic
ttatacaggagcttatttttatgagggccaacttaaaaactattacattaaatttgaagcagatgcaaagcgctt

SEQ ID NO: 29310 - DNA, 75 bp, Artificial Sequence
  Synthetic
tggtactacaggaatgtgggaagtacatgttaataaagatactgtctttacccctgttactagttctacgccgcc

SEQ ID NO: 29311 - DNA, 75 bp, Artificial Sequence
  Synthetic
agttggagacgcctccaacaacgccgttcccgaagcatctaccacctccttgtcctccccacaacggtcaccatc

SEQ ID NO: 29312 - DNA, 75 bp, Artificial Sequence
  Synthetic
caccaaccgccgatacggccgaaaagcatctagccctacagccaccaccaggaggcaaaaaagacaaggaaaaga

SEQ ID NO: 29313 - DNA, 75 bp, Artificial Sequence
  Synthetic
aaccctcaccaggcgaagaaaaaccagatcaaggtcccggagcagagagcaacggggggggagggaaacccaaag

SEQ ID NO: 29314 - DNA, 75 bp, Artificial Sequence
  Synthetic
atcctcctccagaggagcctcaaaatccccccggcggggagggagaagtggaggggggcccctcacccgctccag

SEQ ID NO: 29315 - DNA, 75 bp, Artificial Sequence
  Synthetic
atcaagatccagatcaccagagtctgttacagggggtggcgttgcacctagtgaagtgggagcgtcacttcgatc

SEQ ID NO: 29316 - DNA, 75 bp, Artificial Sequence
  Synthetic
agttagtagacacagtagtggaagacttgcgcaactattggatgcagctaaagaccccccagtaatattgctgcg

SEQ ID NO: 29317 - DNA, 75 bp, Artificial Sequence
  Synthetic
cggcggtgcaaatacattaaaatgctatcgctataggtttagaaaaaagcatgctggtaaattttattatgttag

SEQ ID NO: 29318 - DNA, 75 bp, Artificial Sequence
  Synthetic
cacaacgtggtcatggattgggggtcattctactgatagagtagggcgtgcaaggatgttaatagcatttcattc

SEQ ID NO: 29319 - DNA, 75 bp, Artificial Sequence
  Synthetic
taatcatgaaagggaaaaatgtattcaagaaatgaagttacctttaggagtagattggtcctatggacaatttga

SEQ ID NO: 29320 - DNA, 75 bp, Artificial Sequence
  Synthetic
tgatttataacctgctttttatttaacacactaacattgcctattgctatttttttactaacttatattgctata

SEQ ID NO: 29321 - DNA, 75 bp, Artificial Sequence
  Synthetic
ttgctactaacattatggtacgggcgcaaagaactaagcgagcgtctgttactgatatatacaaaggctgtaaag

SEQ ID NO: 29322 - DNA, 75 bp, Artificial Sequence
  Synthetic
cctctgggacttgtccccctgatgtactaaataaagtggaacaaaatacacttgctgataaaatacttaaatatg

SEQ ID NO: 29323 - DNA, 75 bp, Artificial Sequence
  Synthetic
gcagtgttggtgtgttttttggtggacttggaattggtacaggtaagggtaccggtggtgccacggggtacgtcc

SEQ ID NO: 29324 - DNA, 75 bp, Artificial Sequence
  Synthetic
accggtggtgccacggggtacgtcccattgcgacctggagtacgagtgggcggtactcctacagtggtccgccct

SEQ ID NO: 29325 - DNA, 75 bp, Artificial Sequence
  Synthetic
ccatcaatagtctcattaacagacagtggcgcagctgctgaccttttccccagtgaagcagaaactattgcagag

SEQ ID NO: 29326 - DNA, 75 bp, Artificial Sequence
  Synthetic
gtacatcctacacctgtagacataggaattgatacacctattgtagctggaggccgtgacgccattttagaggtg

SEQ ID NO: 29327 - DNA, 75 bp, Artificial Sequence
  Synthetic
gtagatactaatcctccaacaaggttcagtgtaacaagaacacaatatgataatccatcttttcaaataatttca

SEQ ID NO: 29328 - DNA, 75 bp, Artificial Sequence
  Synthetic
gaatccacacctatcacaggtgaggcatcccttgctgatcatgtatttgtgtttgaaggttctggaggtcagcac

SEQ ID NO: 29329 - DNA, 75 bp, Artificial Sequence
  Synthetic
gtaggagcggtaactgaagagattgaattagatacatatccttccagatattcctttgaaattgaggaagctaca

SEQ ID NO: 29330 - DNA, 75 bp, Artificial Sequence
  Synthetic
ccaccacgcagaactagtactcccattgaaagaataagtcaggaattcaggaacctacgtagagcactgtataac

SEQ ID NO: 29331 - DNA, 75 bp, Artificial Sequence
  Synthetic
aggcgcttaacagaacaggttcaagtaaaaaaccctttatttttaactactccatctaaacttgtaagatttcaa

SEQ ID NO: 29332 - DNA, 75 bp, Artificial Sequence
  Synthetic
tttgataatcctgtgtttgatgaagaggtcacacaaatatttgaaagagatgttgctgaagtggaggaacctcca

SEQ ID NO: 29333 - DNA, 75 bp, Artificial Sequence
  Synthetic
gatagggactttttagatatagacagattaggaagaccattattaacagaatccactgaaggccgtattagatta

SEQ ID NO: 29334 - DNA, 75 bp, Artificial Sequence
  Synthetic
agtaggttaggtcaaagggcttccattcaaacacgcagtggaacacgtgttggttcacgtgtacacttctataca

SEQ ID NO: 29335 - DNA, 75 bp, Artificial Sequence
  Synthetic
gatttaagcactattaatacagaagaacctatagaattagaattattaggcgagcattctggagatgcatcagtt

SEQ ID NO: 29336 - DNA, 75 bp, Artificial Sequence
  Synthetic
attgaggaacctctgcaaagcactgtaatagatatgaacttagatgatgttgaggctattcaggatactatagat

SEQ ID NO: 29337 - DNA, 75 bp, Artificial Sequence
  Synthetic
actgcagatgattataactctgcagatcttttattggacaatgcaattgaagaatttaataattctcaattagtg

SEQ ID NO: 29338 - DNA, 75 bp, Artificial Sequence
  Synthetic
tttggcacttctgatagatcttcgtctgcatattctataccacggtttgaatcccctagagaaacaattgtatat

SEQ ID NO: 29339 - DNA, 75 bp, Artificial Sequence
  Synthetic
gttcaagatatagaaggtaatcaggtaatttatcctgggcccacagaaaggccaactataatatttcccttacct

SEQ ID NO: 29340 - DNA, 75 bp, Artificial Sequence
  Synthetic
agtgcccctgctgtagtcatacacacattggacaagtcttttgattattacttacatcccagcttaagaaagaaa

SEQ ID NO: 29341 - DNA, 75 bp, Artificial Sequence
  Synthetic
aggcgcaaacgcaaatatttataatgtttttcagatgaccctctggcttccagcttctggtaagatatatttacc

SEQ ID NO: 29342 - DNA, 75 bp, Artificial Sequence
  Synthetic
tcctacgccacctgtagcccgagtgcagagtacggatgaatatgtggaaagaactgacatctattaccatgcaac

SEQ ID NO: 29343 - DNA, 75 bp, Artificial Sequence
  Synthetic
tagtgatcgattactaactgtaggccacccatattttgatgttagatcaccggatggtagtaaaatagatgtacc

SEQ ID NO: 29344 - DNA, 75 bp, Artificial Sequence
  Synthetic
aaaggtttcagggaatcaattcagggcctttagagttacatttccagaccctaataagtttgcattagcagacat

SEQ ID NO: 29345 - DNA, 75 bp, Artificial Sequence
  Synthetic
gactatctatgatcctgataaatacaggttggtgtgggcctgcgcaggacttgaaatcggccgcggccaaccttt

SEQ ID NO: 29346 - DNA, 75 bp, Artificial Sequence
  Synthetic
aggggtcggcagtacaggacacccgctatttaataagctccgtgatgcagaaaattctagtgaacgtcaggaagg

SEQ ID NO: 29347 - DNA, 75 bp, Artificial Sequence
  Synthetic
tactgtagatgacagaagaaatatctcatttgatcctaagcaagtacagatgtttataattggttgcacaccgtg

SEQ ID NO: 29348 - DNA, 75 bp, Artificial Sequence
  Synthetic
cttaggtgaatattgggatacagctcctgtctgtaaagatgcaggtagccaactagggttgtgtcctcctttaga

SEQ ID NO: 29349 - DNA, 75 bp, Artificial Sequence
  Synthetic
attaaaaaacagtgttatagaagatggggacatgttcgacattggctttggtaatatcaataataaaacattatc

SEQ ID NO: 29350 - DNA, 75 bp, Artificial Sequence
  Synthetic
ctttaatagatcagatgttagtttagatcttgtaaatgaggtttgcaaatatccagactttttgactatgtcaaa

SEQ ID NO: 29351 - DNA, 75 bp, Artificial Sequence
  Synthetic
tgatgtatatggagatgcctgttttttttgtgcccgaagagagcaatgctatgccaggcactattttgttcgagg

SEQ ID NO: 29352 - DNA, 75 bp, Artificial Sequence
  Synthetic
cggtgtagtaggagatgcaatacctgatggtgcagttcaacaggatcacaaatattatttacctgcagaccaaca

SEQ ID NO: 29353 - DNA, 75 bp, Artificial Sequence
  Synthetic
aaacactttagaaaactcactttattttcctactgtcagtggatctttggtaacttctgattctcaactttttaa

SEQ ID NO: 29354 - DNA, 75 bp, Artificial Sequence
  Synthetic
tagaccattttggttaaaacgtgctcaaggccataacaatggtattttatggaacaaccagatgtttgtgactgt

SEQ ID NO: 29355 - DNA, 75 bp, Artificial Sequence
  Synthetic
agcagataatacacgtaatacaaactttagtatcagtgttaccaatgacagcagtttagaaaagtatgatgccac

SEQ ID NO: 29356 - DNA, 75 bp, Artificial Sequence
  Synthetic
taaaattagagagtttacaagacatgttgaagaataccaactttcttttatactacagttgtgcaggataccttt

SEQ ID NO: 29357 - DNA, 75 bp, Artificial Sequence
  Synthetic
aaaggccgaggtcttaacacaaattaatgccatgaattcagatattttagagaattggcagttagggtttgttcc

SEQ ID NO: 29358 - DNA, 75 bp, Artificial Sequence
  Synthetic
tacaccagataatgcagttcatgacacatacagatatttggcttcaaaggccacaaaatgtccagatgcagtacc

SEQ ID NO: 29359 - DNA, 75 bp, Artificial Sequence
  Synthetic
tgacacgcaaaaagaggatccttttggaaagtattcattttggaatgttgatatgacagaaaaattgtctctaga

SEQ ID NO: 29360 - DNA, 75 bp, Artificial Sequence
  Synthetic
cctagatcaatatcccttaggccgtaagtttctgtttcaaattggagtgcagcgtgtacggtccggtaccaaacg

SEQ ID NO: 29361 - DNA, 75 bp, Artificial Sequence
  Synthetic
gcctgcaactcgaaaagtgaccaaaactgtcaaaaggaaaaaagtgcaattgtaaccgatatcggtcgccaataa

SEQ ID NO: 29362 - DNA, 75 bp, Artificial Sequence
  Synthetic
aatatgttaactaatctggtatgtgaagtattttttaaccgtctttgtgactaaaccgaacaagtcaacaccagc

SEQ ID NO: 29363 - DNA, 75 bp, Artificial Sequence
  Synthetic
actaaaccgaacaagtcaacaccagcaaccgcacccgtttccacattataaattcctcgaggtaagattatgatc

SEQ ID NO: 29364 - DNA, 75 bp, Artificial Sequence
  Synthetic
ttttaaccgtaggcggttatttgttattcgtagcaacaattgtggttaacaacaatctcctgccagaatatacat

SEQ ID NO: 29365 - DNA, 75 bp, Artificial Sequence
  Synthetic
gcaaccgcttgtggtaatttatgcactgcttgcatattatttaagtaggatgggctgctattctgtattcatggc

SEQ ID NO: 29366 - DNA, 75 bp, Artificial Sequence
  Synthetic
tttgcaaagaccactgacagtacagcaacttagtgataagttgactgtacctgtagtagatcttttgctaccttg

SEQ ID NO: 29367 - DNA, 75 bp, Artificial Sequence
  Synthetic
tagattctgcagtaggtttttaacctatttggaattgcggcaatttgattataagaatttgcaattaatttggac

SEQ ID NO: 29368 - DNA, 75 bp, Artificial Sequence
  Synthetic
agacgaggactttgtgtttgcatgttgcagcggctgtgcctacgcttcagcccaatttgaatttcagcagtatta

SEQ ID NO: 29369 - DNA, 75 bp, Artificial Sequence
  Synthetic
tcaagttactttgtatggtcgtgaaattgagcaagaagaacaacgacctgtaggccaaatttatatgagatgtca

SEQ ID NO: 29370 - DNA, 75 bp, Artificial Sequence
  Synthetic
agatcattggaagggaaggtgcaggcactgtaaagcaatagaatgattgggaaacaagctactctgtgtgatata

SEQ ID NO: 29371 - DNA, 75 bp, Artificial Sequence
  Synthetic
gttcttgaagagcttgtcctgcccattgacctgcattgccacgaggagctgcctgaacttccagaagagttagaa

SEQ ID NO: 29372 - DNA, 75 bp, Artificial Sequence
  Synthetic
gaatcagtggtagaggaggagcctgagtacactccttacaagattgtagtatattgtgggggttgtgatacaaag

SEQ ID NO: 29373 - DNA, 75 bp, Artificial Sequence
  Synthetic
ctgaagctgtatatactagcaactctctctggaattcgcgactttcaaacatctctacttggacctgtaaaactt

SEQ ID NO: 29374 - DNA, 75 bp, Artificial Sequence
  Synthetic
atctctacttggacctgtaaaacttttgtgtcccacctgtcgagaagagattcgcaatggacgacgataaaggta

SEQ ID NO: 29375 - DNA, 75 bp, Artificial Sequence
  Synthetic
tctgatttaataaatgatgatgatactgctgctcagggaaattcccgcgaattgctatgtcaacagcaaagtgag

SEQ ID NO: 29376 - DNA, 75 bp, Artificial Sequence
  Synthetic
taaaacgaaagtatttcagtccaaaggctgttcagcagctaagtccacgtctgcagtctatgaatatttcgcctg

SEQ ID NO: 29377 - DNA, 75 bp, Artificial Sequence
  Synthetic
ttactgaagaggtggaggtaccggcgagcgctccagcgccggcagcacagggtggtgtagggtcgggacattaca

SEQ ID NO: 29378 - DNA, 75 bp, Artificial Sequence
  Synthetic
ccagtttgttaagatgcaacaatgtaaaggcagtattgctgggaaaatttaaagacgcatttggagtgagctata

SEQ ID NO: 29379 - DNA, 75 bp, Artificial Sequence
  Synthetic
atgagctgactagacaatttagaagtaataagacttgctgtaagcattgggtattggccatatatgctgctaaag

SEQ ID NO: 29380 - DNA, 75 bp, Artificial Sequence
  Synthetic
atgaattaatagatgcgtccaaacaattgttacaacagcattgtacctatttgtggttgcaaacattctcaccca

SEQ ID NO: 29381 - DNA, 75 bp, Artificial Sequence
  Synthetic
tgtcattatatttatgttgttttaatgttgggaaaagtagagaaactgtgatgcgattgttatcttccatgttac

SEQ ID NO: 29382 - DNA, 75 bp, Artificial Sequence
  Synthetic
aagttaatgagaatcatattttatcagaacctccaaaaatcagaagtatgatagctgctttattttggtataaag

SEQ ID NO: 29383 - DNA, 75 bp, Artificial Sequence
  Synthetic
gtagtatgaatccaaatgtctatgcatttggagagtatcctgagtggattatgacacagactatgatacatcacc

SEQ ID NO: 29384 - DNA, 75 bp, Artificial Sequence
  Synthetic
aaactgctgacagtgtacaatttgacctgtctgaaatgatacaatgggcttatgatcaagattatgttgatgaat

SEQ ID NO: 29385 - DNA, 75 bp, Artificial Sequence
  Synthetic
gtactattgcataccagtatgctagattggctgatagtaatagtaatgccagagcatttttagctcataatagtc

SEQ ID NO: 29386 - DNA, 75 bp, Artificial Sequence
  Synthetic
aagccaaatatgttagagaatgtgctcaaatggttagatattataaacgtggagaaatgcgagatatgtcaattt

SEQ ID NO: 29387 - DNA, 75 bp, Artificial Sequence
  Synthetic
ctgcatggatacatcattgtatatcaaagatagaaggcgatggtcactggcaagatattgttaaatttttgcgat

SEQ ID NO: 29388 - DNA, 75 bp, Artificial Sequence
  Synthetic
accaagggttaaattttatagtgtttttagataaatttagaacatttctaaaaaattttccaaagaaaaattgtt

SEQ ID NO: 29389 - DNA, 75 bp, Artificial Sequence
  Synthetic
tgttaatatgtggtcctccggatacaggaaaatctatgtttagcatgtcattaatgaaagcattaagaggacagg

SEQ ID NO: 29390 - DNA, 75 bp, Artificial Sequence
  Synthetic
tagtttcatttgcaaattctaaaagtcatttttggctacagcctttagcagatgcaaaactggctttattagatg

SEQ ID NO: 29391 - DNA, 75 bp, Artificial Sequence
  Synthetic
atgctacagaagtttgctggcaatatattgatgctttcttaagaaatggattagatggtaacatggtatctttag

SEQ ID NO: 29392 - DNA, 75 bp, Artificial Sequence
  Synthetic
atatgaaacatagagctccatgtcaaatgaaatttccacctcttattataacatctaacattagtttaaaaaaag

SEQ ID NO: 29393 - DNA, 75 bp, Artificial Sequence
  Synthetic
aaaaaaaatttccctatttacatagtagaatatatgaatttgagtttcctaacaaatttccctttgacgcaaatg

SEQ ID NO: 29394 - DNA, 75 bp, Artificial Sequence
  Synthetic
aacaaatttccctttgacgcaaatgatacacctctgtttaaacttactgaccaaagctgggcgtctttttttaaa

SEQ ID NO: 29395 - DNA, 75 bp, Artificial Sequence
  Synthetic
aggctttggacacaattagaactgagtgatcaagaagaagagggagaaaatggagaaactcagcgaacgtttcag

SEQ ID NO: 29396 - DNA, 75 bp, Artificial Sequence
  Synthetic
tgcactacaagagaagttaatggacttatatgaatcaggtgtagaggatcttgaaacccaaattcaacattggaa

SEQ ID NO: 29397 - DNA, 75 bp, Artificial Sequence
  Synthetic
attattaagacaagaacaagtgttattttattatgcaaggagacatgggatattgcgtttggggtaccaaccagt

SEQ ID NO: 29398 - DNA, 75 bp, Artificial Sequence
  Synthetic
acccactctggcaacttcagagagtaaagcaaaagatgctatagccatgggactattgctggaaagcttacaaaa

SEQ ID NO: 29399 - DNA, 75 bp, Artificial Sequence
  Synthetic
atcacaatatgcagaggaaccgtggaccttagtagaaactagtttggagacagttaaaagccctccagcagactg

SEQ ID NO: 29400 - DNA, 75 bp, Artificial Sequence
  Synthetic
ttttaaaaaaggacctaaatctgtggaagtgtactttgatggagatcctgaaaatgtaatgtcttatacagtgtg

SEQ ID NO: 29401 - DNA, 75 bp, Artificial Sequence
  Synthetic
gtcatacatttattatcagactgatgatgagtcatgggaaaaggtggaaggtcatgtggactatacaggagctta

SEQ ID NO: 29402 - DNA, 75 bp, Artificial Sequence
  Synthetic
ctatatagaagggacctttaaaacctattatattaaatttgaaacagatgctaaacgatatggtacaacaggaca

SEQ ID NO: 29403 - DNA, 75 bp, Artificial Sequence
  Synthetic
ttgggaggtgcatgttaataaagatactgtgtttacccctgttaccagttctacgccgccagttggagtcgcctc

SEQ ID NO: 29404 - DNA, 75 bp, Artificial Sequence
  Synthetic
ccagaactccgcacccgaaccggcatccacctccgactccccacaacggtcatcacaagtcacccaccgatacgg

SEQ ID NO: 29405 - DNA, 75 bp, Artificial Sequence
  Synthetic
ccgaaaagcatctagtcctacaatcaccaccatcaggaggcaaaaaaggcgagagagacaaagacaagaaacccc

SEQ ID NO: 29406 - DNA, 75 bp, Artificial Sequence
  Synthetic
aacaaggcgaagaaaaaccagatcaaggtcccgaagcaccgagcagcggggagggagggccaccagacgatccct

SEQ ID NO: 29407 - DNA, 75 bp, Artificial Sequence
  Synthetic
ctccagagaatccgcagaatcccccaggcggggagggagaggtggagggggccccctcaccaggtcccgctcaag

SEQ ID NO: 29408 - DNA, 75 bp, Artificial Sequence
  Synthetic
gtcgcgatcccgtacacgagagtctgttgacgggggtggcgtcgcgcctgacgaagtgggagcaacacttcgatc

SEQ ID NO: 29409 - DNA, 75 bp, Artificial Sequence
  Synthetic
aattggtagacagcatagtgggcgacttgcgcaattactggacgcagctaaagaccccccagtaattctgctacg

SEQ ID NO: 29410 - DNA, 75 bp, Artificial Sequence
  Synthetic
cggtgcagcaaatacattaaaatgctatcgctatagatttagaaagaaacatgctggaagcttccaatttattag

SEQ ID NO: 29411 - DNA, 75 bp, Artificial Sequence
  Synthetic
tacaacgtggtcctgggtaggggggcatacaaccgatagaatcgggcgctctaggatactaatatcatttcatac

SEQ ID NO: 29412 - DNA, 75 bp, Artificial Sequence
  Synthetic
agatagggaaagagagaagtgcttgcaacaaatgaaacttcctttaggtgtagaatggtcatatggccagtttga

SEQ ID NO: 29413 - DNA, 75 bp, Artificial Sequence
  Synthetic
tgatttataaactgcttttttactaacacactaacattgcctatttatactaacctatttgcttgctactaacaa

SEQ ID NO: 29414 - DNA, 75 bp, Artificial Sequence
  Synthetic
aatggcgcgagcgcgaagaacaaagcgagcgtcagtaactgacatttataaaggctgtaaggcctctgggacttg

SEQ ID NO: 29415 - DNA, 75 bp, Artificial Sequence
  Synthetic
tccccctgatgttattaataaagtggaacaaaatacacttgctgataaaattttaaagtatggcagtgttggtgt

SEQ ID NO: 29416 - DNA, 75 bp, Artificial Sequence
  Synthetic
gttttttggtggtcttggtataagtacaggtaagggtaccggtggtcctacaggctatattcctttaggtcaagg

SEQ ID NO: 29417 - DNA, 75 bp, Artificial Sequence
  Synthetic
tcctggagtgcgtgtgggcgccactcccacagtggtccgccccggggtcatacctgaaataattggaccaactga

SEQ ID NO: 29418 - DNA, 75 bp, Artificial Sequence
  Synthetic
attaataccagttgactcagtaacaccaattgaccctgcagcaccatccatagtgacattaacagacagtagtgc

SEQ ID NO: 29419 - DNA, 75 bp, Artificial Sequence
  Synthetic
aggtgctgaccttttacctggtgaagttgaaactattgcagaagtacatccggtcccaatagacaatgtggaact

SEQ ID NO: 29420 - DNA, 75 bp, Artificial Sequence
  Synthetic
tgacacacctttagtttctggggaccgtcacgccattttggaggtgactgatgctaatcccccttttaggcgcac

SEQ ID NO: 29421 - DNA, 75 bp, Artificial Sequence
  Synthetic
ggttacccggacacaatatcataatcctgcttttgaaattatttcagagtctacaccattaataggtgaatctac

SEQ ID NO: 29422 - DNA, 75 bp, Artificial Sequence
  Synthetic
accctctgaccatgtttttgtttttgaaggctcgggaggtgtacaggtaggggatgctaatgaaagcattgaatt

SEQ ID NO: 29423 - DNA, 75 bp, Artificial Sequence
  Synthetic
ggatacttttccttctagatatagttttgacattgaggagccaacccctcctcgtagagttagtacaccaattga

SEQ ID NO: 29424 - DNA, 75 bp, Artificial Sequence
  Synthetic
aagaatcagtcaggaatttagaactttaagaagagccttatacaacagaagattaacagaacaggtccaagtaag

SEQ ID NO: 29425 - DNA, 75 bp, Artificial Sequence
  Synthetic
agaccccttgtttattcgatccccgtccaggcttgtgagatttcaatttgataatccagtattcgatgaggaagt

SEQ ID NO: 29426 - DNA, 75 bp, Artificial Sequence
  Synthetic
tacacaaatatttgaaagagatgtagctgcagtagaagaaccaccagacagggattttttagatattgaaagact

SEQ ID NO: 29427 - DNA, 75 bp, Artificial Sequence
  Synthetic
tggaaggcctatactaacagaaactgcagaaggccgtgttcgtgtcagcaggttagggcaacgtgcatcgctgag

SEQ ID NO: 29428 - DNA, 75 bp, Artificial Sequence
  Synthetic
cacacgcagcggcgcacgtgtaggtgctagagtgcatttctttacagatattagcactattaatgcagaagagcc

SEQ ID NO: 29429 - DNA, 75 bp, Artificial Sequence
  Synthetic
cattgaattagaattattaggtgagcattctggcgacagctctgtagtacaagaaccatttgaaagcacaatatt

SEQ ID NO: 29430 - DNA, 75 bp, Artificial Sequence
  Synthetic
ggatgtcaatattgacaacatacctgaaagtttggatacaaacatagcagaaacatctgtagactatgattctgc

SEQ ID NO: 29431 - DNA, 75 bp, Artificial Sequence
  Synthetic
tgatttgttattagacaacggtgtggaggactttagtaggtcacaattggtaataggtccttcagatagatcact

SEQ ID NO: 29432 - DNA, 75 bp, Artificial Sequence
  Synthetic
tccatctattactgttccacaatttgaatcccctagagaaaccattgtgtacatacaagacatagagggtaatac

SEQ ID NO: 29433 - DNA, 75 bp, Artificial Sequence
  Synthetic
agttgtatatcctaaatatgaagaaaggccaactattatattacctacaccctcggggcctgctataattcaatc

SEQ ID NO: 29434 - DNA, 75 bp, Artificial Sequence
  Synthetic
acctacacattcctcctttgactattatttacatcctagcttgcgaaggaaaaaacgcaaacgcaaatatttata

SEQ ID NO: 29435 - DNA, 75 bp, Artificial Sequence
  Synthetic
tccaacttcgggtaagatatatttgcctcctacgccaccggtagcccgagtacaaaacacggacgagtatgtgga

SEQ ID NO: 29436 - DNA, 75 bp, Artificial Sequence
  Synthetic
gaggactgacatctattaccatgctataagtgaccgtttattaactgtaggacatccttactttgatgttagatc

SEQ ID NO: 29437 - DNA, 75 bp, Artificial Sequence
  Synthetic
atcagatggagcaaaaatagaggtccctaaagtgtctggaaatcagtttagggcttttagagtaacatttccaga

SEQ ID NO: 29438 - DNA, 75 bp, Artificial Sequence
  Synthetic
tcctaacaaatttgctttgggagatatgacaatccatgatcccgaaaggtatagattagtatgggcttgtaaagg

SEQ ID NO: 29439 - DNA, 75 bp, Artificial Sequence
  Synthetic
gttagaaataggaagaggacagcccttaggtgtaggtaccacaggtcatccattatttaataaattacatgatac

SEQ ID NO: 29440 - DNA, 75 bp, Artificial Sequence
  Synthetic
tgaaaaccctactgaacgccaggaaggaacatcagatgatagaagaaatgtttcttttgatcctaaacaggttca

SEQ ID NO: 29441 - DNA, 75 bp, Artificial Sequence
  Synthetic
aatgtttatcattggatgtataccgtgtttaggtgaatattgggataaagctcctgtttgtgaagatgcaggcag

SEQ ID NO: 29442 - DNA, 75 bp, Artificial Sequence
  Synthetic
tcaggtaggattatgtcctccactagaattaaaaaatggtgttatagaggatggagatatgtttgatataggatt

SEQ ID NO: 29443 - DNA, 75 bp, Artificial Sequence
  Synthetic
tggaaatataaataataaaacactatcatttaatagatctgatgtaagcttagacattgtaaatgaaatctgtaa

SEQ ID NO: 29444 - DNA, 75 bp, Artificial Sequence
  Synthetic
atatcctgattttcttacaatgtcaaatgatgtctatggcgactcatgctttttttgtgcacgtagggagcaatg

SEQ ID NO: 29445 - DNA, 75 bp, Artificial Sequence
  Synthetic
ttatgcacgacacaattttgtacgtggtggtcttgttggtgatgctataccagatgatgcagttcaacaagatca

SEQ ID NO: 29446 - DNA, 75 bp, Artificial Sequence
  Synthetic
taaatattacttgcctgcagcttcacagactgctttagaaaactccacttactttccaaccgttagtggttcttt

SEQ ID NO: 29447 - DNA, 75 bp, Artificial Sequence
  Synthetic
agtaacctctgatgcccaactattcaacaggcctttttggttgaagcgcgcgcagggccataataatggtatttt

SEQ ID NO: 29448 - DNA, 75 bp, Artificial Sequence
  Synthetic
gtggaacaaccaaatgtttgtaacagtagctgataatacccgtaacactaatttttctattagtgtggcaagtga

SEQ ID NO: 29449 - DNA, 75 bp, Artificial Sequence
  Synthetic
cggcaccacagttaattatgatgctaaaaaaatcagagaatttatgcgccatgtggaagaataccaattatcctt

SEQ ID NO: 29450 - DNA, 75 bp, Artificial Sequence
  Synthetic
tattttgcagctatgtagaataccattagaagcagaggtattaactcaaattaatgccatgaatcatggcatttt

SEQ ID NO: 29451 - DNA, 75 bp, Artificial Sequence
  Synthetic
agaaaattggcaactaggctttgtacctacaccagacaattctgtccatgatacttataggtatttacaatctaa

SEQ ID NO: 29452 - DNA, 75 bp, Artificial Sequence
  Synthetic
agctacaaaatgtcctgatgctgtacctgacacacaaaaggaagatccctttggtcaatatactttttggaatgt

SEQ ID NO: 29453 - DNA, 75 bp, Artificial Sequence
  Synthetic
agacatgtctgaaaagttatcattggatttagatcagtatccactgggtcgtaaatttttatttcaatctgggtt

SEQ ID NO: 29454 - DNA, 75 bp, Artificial Sequence
  Synthetic
acaacgtgcaagggccagtgccagggtcagtgtgaaacgttctgctacgcggaaaacgtctaaaactgtaaaacg

SEQ ID NO: 29455 - DNA, 75 bp, Artificial Sequence
  Synthetic
aaggaaacttacctcttaaccgttttcggttgctttaataaaatctattaactaatctggtatgtgaagcatttt

SEQ ID NO: 29456 - DNA, 75 bp, Artificial Sequence
  Synthetic
ccgcacccggtttttacattataaattcctcgaggtaagataaccatcagtagataccatcggcacctggagcaa

SEQ ID NO: 29457 - DNA, 75 bp, Artificial Sequence
  Synthetic
aacggtaagctttggcacgtaggtggttggttgatcgtaagagtgattgtggttaacaacaatcagagtttacac

SEQ ID NO: 29458 - DNA, 75 bp, Artificial Sequence
  Synthetic
ttacatgtgaccgcttgcgttttcttttacatatatacataaatatacaccctatggttgtatttaatagggaga

SEQ ID NO: 29459 - DNA, 75 bp, Artificial Sequence
  Synthetic
gctcaatggataggccaaagcctaggacagtaaaggaactagcagacacactagcaattcctgtaatagatttat

SEQ ID NO: 29460 - DNA, 75 bp, Artificial Sequence
  Synthetic
tattaccatgcaacttttgcaatagattcttatcttactttgagttgctgagttttgattataagtatttgcaac

SEQ ID NO: 29461 - DNA, 75 bp, Artificial Sequence
  Synthetic
tgatatggactgttgaagacttagtatatgctatatgtagtagttgtgcttttgcttcagcacagtttgaattta

SEQ ID NO: 29462 - DNA, 75 bp, Artificial Sequence
  Synthetic
tgaaatattttgaatactctgttgtaggaaaacagatagaaactgtagcaaaccagcctattggaaatattactg

SEQ ID NO: 29463 - DNA, 75 bp, Artificial Sequence
  Synthetic
ttaggtgtcaatattgtttgaaaaaattggatctggtagagaagctaggagtgtgctacaaacaacaatattttc

SEQ ID NO: 29464 - DNA, 75 bp, Artificial Sequence
  Synthetic
atagagttagggataattggaaaggattgtgcagacattgtgggtcgatagaatgattgggaaacaacccactat

SEQ ID NO: 29465 - DNA, 75 bp, Artificial Sequence
  Synthetic
gagcttgtccaacccactgacctgcattgctacgaagaattgacagaagagcctgcagaggaggagcagtgcctc

SEQ ID NO: 29466 - DNA, 75 bp, Artificial Sequence
  Synthetic
actccttacaaaattgtagttgcttgcaattgtggtacaagacttcgcttatacgtctttgctacggaacttgga

SEQ ID NO: 29467 - DNA, 75 bp, Artificial Sequence
  Synthetic
ataagagcccaacaagaactattactgggtgaagtacagcttgtgtgtccagagtgccgcgagagtcttcgccat

SEQ ID NO: 29468 - DNA, 75 bp, Artificial Sequence
  Synthetic
gagtgatgataaaggtactaaatatgatgctaaagaaggatgtagtgaatggttgtctttagaagcagaatgctc

SEQ ID NO: 29469 - DNA, 75 bp, Artificial Sequence
  Synthetic
tgattctagtttagatggtgatttggaaaaactgtttgacgaagggacagactctgataattcagactttataga

SEQ ID NO: 29470 - DNA, 75 bp, Artificial Sequence
  Synthetic
gaaaaactgtttgacgaagggacagactctgataattcagactttatagatgatggagatgctattcagggaaac

SEQ ID NO: 29471 - DNA, 75 bp, Artificial Sequence
  Synthetic
agtcctacagctgttttgcagcttagtcctcaattggagtctatctctttgtcaccacagcataaaactaagagg

SEQ ID NO: 29472 - DNA, 75 bp, Artificial Sequence
  Synthetic
gtcaccacagcataaaactaagaggagattatttgaacaagacagcggactagagagttcaataaatgaagctga

SEQ ID NO: 29473 - DNA, 75 bp, Artificial Sequence
  Synthetic
agatcattctcaaacacaggtggaagaggtaccagccattgttccaccaacaacagctcagggaactaagggttt

SEQ ID NO: 29474 - DNA, 75 bp, Artificial Sequence
  Synthetic
ggagattgtaaaagaattacttaaatctaataatgtgaaagctgtgttactggctaaatttaaagaggcatttgg

SEQ ID NO: 29475 - DNA, 75 bp, Artificial Sequence
  Synthetic
agttgggtttatggaacttacaagacaatataaaagtaataaaacatgttgtagagattgggtaattagtattta

SEQ ID NO: 29476 - DNA, 75 bp, Artificial Sequence
  Synthetic
tgcagctaatggcgatcttgtagaaggttctaagcaattgttgatacagcactgtggttatatttggttacaaca

SEQ ID NO: 29477 - DNA, 75 bp, Artificial Sequence
  Synthetic
aatgcctcctatgtgtttatatttactgtgttttaatgttggtaaaagtagagaaactgtactacgattattaag

SEQ ID NO: 29478 - DNA, 75 bp, Artificial Sequence
  Synthetic
cacaatattacaagtatcagaagtgcaggtattggcagatcctcctaaattgcgcagcgtgttggctgcactgtt

SEQ ID NO: 29479 - DNA, 75 bp, Artificial Sequence
  Synthetic
ttggtacaaaggaagtatgaatcctaatgtgtatgctcacggtacatacccagattggatattagcacaaacaat

SEQ ID NO: 29480 - DNA, 75 bp, Artificial Sequence
  Synthetic
gatcaatcatcaaaatgctgatgctactcaatttgatttatccaccatgatacaatttgcttatgataatcaata

SEQ ID NO: 29481 - DNA, 75 bp, Artificial Sequence
  Synthetic
tgtagaagaagcaataattgcctatcagtatgccaaactagcagatacagatgcaaatgctagagcatttctaca

SEQ ID NO: 29482 - DNA, 75 bp, Artificial Sequence
  Synthetic
aagtaatagccaagctagaattgtcagggaatgtgctactatggtaagacattatattcgaggggagatgcgaga

SEQ ID NO: 29483 - DNA, 75 bp, Artificial Sequence
  Synthetic
gatgagtatgtcaacttggattcacaaacaattattgtctgtggaaggggaagggcattggtcaaatattgtgaa

SEQ ID NO: 29484 - DNA, 75 bp, Artificial Sequence
  Synthetic
attcgttagatatcaaggaataaattttatagattttctttctgtatttactaagtttttacataataggcctaa

SEQ ID NO: 29485 - DNA, 75 bp, Artificial Sequence
  Synthetic
gcaaaactgcatattgcttcatggaccaccagatactggtaaatctatgtttaccatgtctctcattaatgttct

SEQ ID NO: 29486 - DNA, 75 bp, Artificial Sequence
  Synthetic
taaaggtaaagtgctctcttttgcaaattgtagaagtactttctggctgcaaccacttattgaagctaaaattgc

SEQ ID NO: 29487 - DNA, 75 bp, Artificial Sequence
  Synthetic
attaattgatgatgtgacagatgtatgttgggattatattgataattatttgcgtaatggattagatggcaatgt

SEQ ID NO: 29488 - DNA, 75 bp, Artificial Sequence
  Synthetic
tgtctgtttagacataaaacatagagcaccttgtcaagtaaaatttcccccactattattaacatcaaacataga

SEQ ID NO: 29489 - DNA, 75 bp, Artificial Sequence
  Synthetic
tatatccaaggagcagaagcataaatatttacatagcagaattaaatgctttgcttttactaacaagttcccctt

SEQ ID NO: 29490 - DNA, 75 bp, Artificial Sequence
  Synthetic
tgatgctgaccataaaccacagtttgaacttactgaccaaagctggaaatctttttttgaaaggctttggacaca

SEQ ID NO: 29491 - DNA, 75 bp, Artificial Sequence
  Synthetic
gttagagctctgatcaagaagacgagggagaggatggaaacactcagcgaacgtttcaatgcactgcaagagact

SEQ ID NO: 29492 - DNA, 75 bp, Artificial Sequence
  Synthetic
ttaatgggcctgtatgaatcaggtcgtgaggatctacaaagtcagattgaacattggcaagcattgagacaagag

SEQ ID NO: 29493 - DNA, 75 bp, Artificial Sequence
  Synthetic
caagttttattgtactttgctcgaaaaaatggagtcatgcgcatagggtatcgacccgtgcctcctttagccacc

SEQ ID NO: 29494 - DNA, 75 bp, Artificial Sequence
  Synthetic
agtgaaagtaaagctaaagacgcaattggcatggttattttgttgcaaagcctccaaaaatctaaatatggccag

SEQ ID NO: 29495 - DNA, 75 bp, Artificial Sequence
  Synthetic
gagccttggacacttgtacaaactagtcttgagactgtccgcagcccccctgcaaattgttttaaaaaagggcct

SEQ ID NO: 29496 - DNA, 75 bp, Artificial Sequence
  Synthetic
tacaatattgaagtaatctttgatggcgatccagagaatctaatgagctatacagtatggaaagatatatattat

SEQ ID NO: 29497 - DNA, 75 bp, Artificial Sequence
  Synthetic
caaactgtgactgactcttgggaaaaagtagaaggccaagtggattatttcggagccttttattttgaaggggct

SEQ ID NO: 29498 - DNA, 75 bp, Artificial Sequence
  Synthetic
ttgaaaacttattatattgactttgaaagtgatgcagccagatatagcacaactggcaaatgggaagtacatgtt

SEQ ID NO: 29499 - DNA, 75 bp, Artificial Sequence
  Synthetic
aacaagaatgttatgtttgcccctgtcactagtttttcgccacctcctggagacggggccagtggagaggcctcc

SEQ ID NO: 29500 - DNA, 75 bp, Artificial Sequence
  Synthetic
ggcaacacctcatccaggccgcaatcaccagcgcgggttccctccaccttgtcctcccaacggccactcaccaga

SEQ ID NO: 29501 - DNA, 75 bp, Artificial Sequence
  Synthetic
acatcccgacgatacagaagaaaagcctctagccccaccaccacgcggcaagaaagacaaagaaaaagacaaaaa

SEQ ID NO: 29502 - DNA, 75 bp, Artificial Sequence
  Synthetic
gccattacaaggaaatcaaggtccagatcaaggggtcgaacagaaacccaccggggagggcgaggtggaagggca

SEQ ID NO: 29503 - DNA, 75 bp, Artificial Sequence
  Synthetic
tcctccgcagactccgacagctccaccaacgggcagcggggaaggggaggaggaaaggggcccaccacaagatcc

SEQ ID NO: 29504 - DNA, 75 bp, Artificial Sequence
  Synthetic
caatcccgttcccgatcccggtcccggtcgcagtcccacacccgaagggctacttccagcactggcgtctcgcct

SEQ ID NO: 29505 - DNA, 75 bp, Artificial Sequence
  Synthetic
gctgatgtgggatcaggagttcgatcggttggtccagaacatcacggacgacttgcacggttattggcagaggct

SEQ ID NO: 29506 - DNA, 75 bp, Artificial Sequence
  Synthetic
aaagaccctccagtagtaatattgcgtggagatgctaatgtgctaaaatgctatcgcttcagagctcgcaaaaaa

SEQ ID NO: 29507 - DNA, 75 bp, Artificial Sequence
  Synthetic
catcaaggtttagttaaatattatagtacaacatggtcatgggtaggtggggactgctgtgatagagtaggcaga

SEQ ID NO: 29508 - DNA, 75 bp, Artificial Sequence
  Synthetic
tctagaatgcttttagcttttgatacatacaaacatcgagaacagtttatcactactatgaaattaccacctaag

SEQ ID NO: 29509 - DNA, 75 bp, Artificial Sequence
  Synthetic
gtagactggtcatttggacatttagatgatttataatttacttactaacttatgcattgctactaacacactaac

SEQ ID NO: 29510 - DNA, 75 bp, Artificial Sequence
  Synthetic
aaataatggctagggcaaaacgtgtaaaacgtgcctctgtcactgatatatacagaggttgcaaagcagctggta

SEQ ID NO: 29511 - DNA, 75 bp, Artificial Sequence
  Synthetic
cctgtcctccagatgtacttaataaagtggaacaaactactatagcagatcaaattttaaaatatggaagtgctg

SEQ ID NO: 29512 - DNA, 75 bp, Artificial Sequence
  Synthetic
gtgttttttttggtgggttgggaataagcacagggcgtggtaccggtggtaccacaggatatgtccctttgggtg

SEQ ID NO: 29513 - DNA, 75 bp, Artificial Sequence
  Synthetic
aaggcccaggagtacgcataggtggaactcccactgtggttcgccctggggtcattccagaggtaataggccctg

SEQ ID NO: 29514 - DNA, 75 bp, Artificial Sequence
  Synthetic
cagagttaatacctatagacacagtcagacccattgaccctacagctccaagtattgtcactggtgtcgacacca

SEQ ID NO: 29515 - DNA, 75 bp, Artificial Sequence
  Synthetic
cagttgaccttttacctggtgaaatagaatctattgctgagatacacccagtacctatagataatgtagaaatag

SEQ ID NO: 29516 - DNA, 75 bp, Artificial Sequence
  Synthetic
atacaccagttgttacaggaggacggggctcttcagccattttagaagtggctgatcccagtcctcctgtgcgaa

SEQ ID NO: 29517 - DNA, 75 bp, Artificial Sequence
  Synthetic
cccgtgttacacgaacacagtatcataacccttcctttcaaattatctctgaatcaacaccaacaagtggagaat

SEQ ID NO: 29518 - DNA, 75 bp, Artificial Sequence
  Synthetic
cgtctttagcagaccatgttattgtgtttgaaggctctggaggacagttggttggaggtgctcgagaaccctcca

SEQ ID NO: 29519 - DNA, 75 bp, Artificial Sequence
  Synthetic
tagttactgaaactatagaactgcaagaattaccttctagatacagttttgaaatcgatgaaggtaccccacctc

SEQ ID NO: 29520 - DNA, 75 bp, Artificial Sequence
  Synthetic
gtaccagtactcctgtgcaacgagcagtgcaatcacttagtactttaagaagagcactgtacaatagacgtttga

SEQ ID NO: 29521 - DNA, 75 bp, Artificial Sequence
  Synthetic
cagagcaggtagctgtaactgaccctttattcttaacaaaaccttcacgtcttgtacactttcagtttgataatc

SEQ ID NO: 29522 - DNA, 75 bp, Artificial Sequence
  Synthetic
ctgcatttgaagaagaagttacccaaatatttgaaagggatgtggatcaaattgaagaaccacctgatagacagt

SEQ ID NO: 29523 - DNA, 75 bp, Artificial Sequence
  Synthetic
ttttggatgtagcaaaattaagtaggcctttatatactgaaacacctcaaggatatgttagagttagtagactgg

SEQ ID NO: 29524 - DNA, 75 bp, Artificial Sequence
  Synthetic
gtcgcagagcctccatacgcacgcgtagtggagcacaggtgggagctcaagtacatttttacagggatttaagta

SEQ ID NO: 29525 - DNA, 75 bp, Artificial Sequence
  Synthetic
gcattaacactgaagcaccaatagaaatggaattattaggtgaacattctggagatagcactatttttcaaggac

SEQ ID NO: 29526 - DNA, 75 bp, Artificial Sequence
  Synthetic
cagtagagagttctttagtagatgttaatattgatgaacctgacgccttggttgtaggcagaccggaaacccctc

SEQ ID NO: 29527 - DNA, 75 bp, Artificial Sequence
  Synthetic
cattagaagatgaaatagattttaattcagaagatttgttattggaggaaggggtagaagattttagtggctcac

SEQ ID NO: 29528 - DNA, 75 bp, Artificial Sequence
  Synthetic
aacttgtagtaggtactaggcgaagcacaaatacattaacagttccccgctttgaaacacctcgtgacactagtt

SEQ ID NO: 29529 - DNA, 75 bp, Artificial Sequence
  Synthetic
tttatatacaggactttcagggctatacagtctcatacccagaatctagaaacactgaaaatattatttttcctc

SEQ ID NO: 29530 - DNA, 75 bp, Artificial Sequence
  Synthetic
atccagaagctcccacagttgtgattcacatatcagatacttctggtgattattatttacatcctagtttacaaa

SEQ ID NO: 29531 - DNA, 75 bp, Artificial Sequence
  Synthetic
aacgaaaacgtaagcgcaaacgaaaatatctataatttctttgcagatgtcattgtggctgcctgcaagcggtaa

SEQ ID NO: 29532 - DNA, 75 bp, Artificial Sequence
  Synthetic
ggtatatttgccaccatctacaccagtggctcgcgtacaaagcaccgatgaatatgtggaaagaaccaatatttt

SEQ ID NO: 29533 - DNA, 75 bp, Artificial Sequence
  Synthetic
ttaccatgcagttagtgatcgtctgctgacagtggggcatccatattttgatgttcgctccactgatgggcaacg

SEQ ID NO: 29534 - DNA, 75 bp, Artificial Sequence
  Synthetic
cattgaggttcctaaagtatcaggcaatcaatatagggcctttagaataacactaccagatcccaatcgttttgc

SEQ ID NO: 29535 - DNA, 75 bp, Artificial Sequence
  Synthetic
cttagctgatatgtctgtatataaccctgaaaaagaaaggttagtatgggcctgcagaggtcttgaaataggacg

SEQ ID NO: 29536 - DNA, 75 bp, Artificial Sequence
  Synthetic
tggtcaaccactaggtgtaggtacatcaggacatccattatttaataaggttcgtgacactgaaaattccagtaa

SEQ ID NO: 29537 - DNA, 75 bp, Artificial Sequence
  Synthetic
ttatcaagctgtgacacaagatgatagacaaaatacctcatttgatcctaagcaagtacaaatgtttataatagg

SEQ ID NO: 29538 - DNA, 75 bp, Artificial Sequence
  Synthetic
atgtgttccctgtatgggagaatactgggacaaagcaaaaccctgtgatgatgcaggaaaccagcaaggcttatg

SEQ ID NO: 29539 - DNA, 75 bp, Artificial Sequence
  Synthetic
cccgccaattgaattaaagaattctgtaatagaggatggagacatgtttgatataggatttggtaatatcaataa

SEQ ID NO: 29540 - DNA, 75 bp, Artificial Sequence
  Synthetic
taaggaattatcttttaataagtcagatgttagtttagatattgtcaatgaagtatgtaaataccctgacttcct

SEQ ID NO: 29541 - DNA, 75 bp, Artificial Sequence
  Synthetic
aactatggctaatgacgtctatggggacgcttgtttcttttttgccagaagggagcaatgttatgccagacatta

SEQ ID NO: 29542 - DNA, 75 bp, Artificial Sequence
  Synthetic
ctttgttagaggaggcaatgtaggagatgcaattccagatgcagcagtgcaacaaaatcacaattattatctgcc

SEQ ID NO: 29543 - DNA, 75 bp, Artificial Sequence
  Synthetic
agcacagggtaatcaacaacaaaacattttgggtaactccatttattatcctactgttagtggttctcttgttac

SEQ ID NO: 29544 - DNA, 75 bp, Artificial Sequence
  Synthetic
ttcagatgcgcagctatttaatagaccattttggttgcaacgtgcacaaggccacaacaatggtattttatgggg

SEQ ID NO: 29545 - DNA, 75 bp, Artificial Sequence
  Synthetic
aaatcaaatgtttataacagtagcagataataccagaaacactaattttactataagcgtatccacagaagctaa

SEQ ID NO: 29546 - DNA, 75 bp, Artificial Sequence
  Synthetic
tgcacagcaatataatgctagtaatattagagaatatttaagacatgtagaagaatatcaattgtctttgattct

SEQ ID NO: 29547 - DNA, 75 bp, Artificial Sequence
  Synthetic
tcaactatgtaaagtttctttagttccagaagttttatctcaaatcaatgcaatgaattcgaatattttggaaga

SEQ ID NO: 29548 - DNA, 75 bp, Artificial Sequence
  Synthetic
ttggcaattgggatttgtaccaacaccagataattctgtgcatgacacatatagatatattaattcaaaggctac

SEQ ID NO: 29549 - DNA, 75 bp, Artificial Sequence
  Synthetic
taaatgtccagatgctgtagaacctaaagagagagaagatccatttgctaaatatacattttggaatgtagattt

SEQ ID NO: 29550 - DNA, 75 bp, Artificial Sequence
  Synthetic
atcagacaaactgtccttagatttagatcaataccctctagggcgcaaatttttattccaggctggtttacaaac

SEQ ID NO: 29551 - DNA, 75 bp, Artificial Sequence
  Synthetic
acgaaaacggactttaaaaccttcgtctgtgaaatctactaaatctgcaaaacgcagacgcacctaaccgatttc

SEQ ID NO: 29552 - DNA, 75 bp, Artificial Sequence
  Synthetic
aacgcagacgcacctaaccgatttcggtttttcaataaaatgtaagtaatccatattggtatgtgaagcattttt

SEQ ID NO: 29553 - DNA, 75 bp, Artificial Sequence
  Synthetic
taaccatcttcgtgactaaaccgtacaagtcaacacagggcaaccgcgcccggttttatctgattataaaccgca

SEQ ID NO: 29554 - DNA, 75 bp, Artificial Sequence
  Synthetic
ccaggtgcagttttaaacaatgctatcgtggaatcaccggaggcgcccgccactttgactgccaagttttacttg

SEQ ID NO: 29555 - DNA, 75 bp, Artificial Sequence
  Synthetic
caccggaggcgcccgccactttgactgccaagttttacttggctgtacaccgatttggcttcaactgcgaccgat

SEQ ID NO: 29556 - DNA, 75 bp, Artificial Sequence
  Synthetic
ccacattcgttccagctacattttggcgccaactctttggcagcaacaccagaacgataacggtaagtttcaatc

SEQ ID NO: 29557 - DNA, 75 bp, Artificial Sequence
  Synthetic
gggcgcggtcacattatacttagtcatctcttgtggttgttaacaacaatcttgaaacagatatacatgtaaccg

SEQ ID NO: 29558 - DNA, 75 bp, Artificial Sequence
  Synthetic
cttgcgtgctgtactttctttattcttggaaagaatacagacaggacacatggctagacctgttaaggtatgtga

SEQ ID NO: 29559 - DNA, 75 bp, Artificial Sequence
  Synthetic
gctagcccaccacttaaatatacctatttgggaagttttgcttccttgtaatttttgcacggggtttctaacata

SEQ ID NO: 29560 - DNA, 75 bp, Artificial Sequence
  Synthetic
tcaggagttgttagaatttgactataaagactttaatttgctgtggaaagacggatttgtctttggttgttgtgc

SEQ ID NO: 29561 - DNA, 75 bp, Artificial Sequence
  Synthetic
agcttgtgcctatagatcagcatatcacgagtttactaattatcaccaagaaattgtcgtaggcatcgaaataga

SEQ ID NO: 29562 - DNA, 75 bp, Artificial Sequence
  Synthetic
aggacgagcagcggctaatattgctgagatagtagtcagatgtctcatttgccttaagaggctagatttgttgga

SEQ ID NO: 29563 - DNA, 75 bp, Artificial Sequence
  Synthetic
aaagcttgatatttgtgcacagcacagagagtttcacagagttagaaataggtggaaaggggtgtgtagacattg

SEQ ID NO: 29564 - DNA, 75 bp, Artificial Sequence
  Synthetic
cagagttatagaatgattgggaaagaagttacaataccagatataatactacaagaagagtttggccagcccatt

SEQ ID NO: 29565 - DNA, 75 bp, Artificial Sequence
  Synthetic
gacctgcaatgctacgagaatctaacagctgaagcgccagctgaacaagagttggaggcagaggaggagcttatc

SEQ ID NO: 29566 - DNA, 75 bp, Artificial Sequence
  Synthetic
caaggcatcccttacaaagttattgctacttgtggcggcggatgcggtgccagactgcgagtcttcgtgttagcc

SEQ ID NO: 29567 - DNA, 75 bp, Artificial Sequence
  Synthetic
actgacgctgctattagaagtttccaagaactgcttctggaggaactgcaattcttgtgtcctcagtgtcgtgaa

SEQ ID NO: 29568 - DNA, 75 bp, Artificial Sequence
  Synthetic
gaaattcggaatggcggacgataaaggtactgatcccaaagaagggtgtagcgagtggtttatagataatgaagc

SEQ ID NO: 29569 - DNA, 75 bp, Artificial Sequence
  Synthetic
agactgtagtgatttagaaaatgatttggaacaattatttgatgaaagcccaaagtccaatatttcaaatttgtt

SEQ ID NO: 29570 - DNA, 75 bp, Artificial Sequence
  Synthetic
aaatgatgaggaggatgtggagcagggaaattcgcgagatctgcttcgccagcaggaatttgaggagagcgcgga

SEQ ID NO: 29571 - DNA, 75 bp, Artificial Sequence
  Synthetic
gcaagtacaaaagttaaaacgaaagtatttcagtcctaaagcagttcaacaacttagcccacggttgcagtctat

SEQ ID NO: 29572 - DNA, 75 bp, Artificial Sequence
  Synthetic
gtcaatatctccgcgacaaaagtctaaacgaaggctatttgaggaggacagcgggctggaattatcggggctcga

SEQ ID NO: 29573 - DNA, 75 bp, Artificial Sequence
  Synthetic
acagtctttgactaatgaaattgaagatactcctgcggagctggaggtaccggcggcaacgccggcagagcaggg

SEQ ID NO: 29574 - DNA, 75 bp, Artificial Sequence
  Synthetic
tggtcagggagagggcaatttgcattataaagagttaatgcgatgcaataatagtcgtgcaaaattattaagtaa

SEQ ID NO: 29575 - DNA, 75 bp, Artificial Sequence
  Synthetic
agtcaaggaatattttggtgtgggtttttatgagttagctagacagtataaaagtgataaaacatgctgtaaaga

SEQ ID NO: 29576 - DNA, 75 bp, Artificial Sequence
  Synthetic
ttgggtaattgcagcctatggcgtgcgagaagagctggtagaaagtgcaaaacaattacttttaaatcattgttc

SEQ ID NO: 29577 - DNA, 75 bp, Artificial Sequence
  Synthetic
ctatgtgtggataaatataaatgggattatgactttatatttactgtgttttaatcatgcaaagagtagagaaac

SEQ ID NO: 29578 - DNA, 75 bp, Artificial Sequence
  Synthetic
tgttggtagattgcttatgtcaatactggatgtacaattattgcaattaatttgtgaaccaccaaaactaagaag

SEQ ID NO: 29579 - DNA, 75 bp, Artificial Sequence
  Synthetic
tgtggtgtcagcactatactggtacaaaggcagtatggactcatctgtgtatgctcatggagcctatcctgattg

SEQ ID NO: 29580 - DNA, 75 bp, Artificial Sequence
  Synthetic
gattgtaaatcagaccatgataagtcatcaggcagcagcagatgctatgcaatttgacctttctgaaatgataca

SEQ ID NO: 29581 - DNA, 75 bp, Artificial Sequence
  Synthetic
atgggcctatgatagcgatctcacagatgaagctgacattgcatatctttatgctaaaatggcaaatagtgactc

SEQ ID NO: 29582 - DNA, 75 bp, Artificial Sequence
  Synthetic
taatgcaagagcttggttagcacataataatcaggcaaggtacttaagagaatgtgctcaaatggttagacatta

SEQ ID NO: 29583 - DNA, 75 bp, Artificial Sequence
  Synthetic
cagacggggagaaatgagggatatgagtatgtctgagtggatacatcacagaatacaacaagtagaaggggaagg

SEQ ID NO: 29584 - DNA, 75 bp, Artificial Sequence
  Synthetic
ccattggtctgaaatagttaagtttataagatttcaagaaataaactttataatatttctggatgcatttaaaca

SEQ ID NO: 29585 - DNA, 75 bp, Artificial Sequence
  Synthetic
gtttatacatggcaaacctaaaaaaagctgtttattaatacatgggccgccggactgtggcaagtcaatgtttgc

SEQ ID NO: 29586 - DNA, 75 bp, Artificial Sequence
  Synthetic
tatgtcattattaaaagttttaaaaggcaaggtaatttcatttgtaaatgcaaaaagtcaattttggctgtctcc

SEQ ID NO: 29587 - DNA, 75 bp, Artificial Sequence
  Synthetic
actttcagaatgtaaaatagggctgttggatgatgctaccgatccttgttggcaatatatagatacatatttaag

SEQ ID NO: 29588 - DNA, 75 bp, Artificial Sequence
  Synthetic
aaatggtctcgatggaaatgttgtaagtgtggattgcaaacataaaacccctatgcaaattaggttcccaccatt

SEQ ID NO: 29589 - DNA, 75 bp, Artificial Sequence
  Synthetic
gttaataacttcaaattataatattaaagctaatgataaatataagtttttgtacagtagaattgcaatatttga

SEQ ID NO: 29590 - DNA, 75 bp, Artificial Sequence
  Synthetic
atttaaacataagttcccattcaaagaggatggtacccctgtatttcaacttactgaccaaagctggaaatcttt

SEQ ID NO: 29591 - DNA, 75 bp, Artificial Sequence
  Synthetic
ttttgaaaggctttggacacaattagagctcagtgacccagaagacgaggcagacaatggaggcactcaacgctc

SEQ ID NO: 29592 - DNA, 75 bp, Artificial Sequence
  Synthetic
gtttcaatgtactacaagagatgttaatggacatttatgaatcagggaaagaggatcttgaaacacaaatagaac

SEQ ID NO: 29593 - DNA, 75 bp, Artificial Sequence
  Synthetic
attggaaactgttaagacaggaacaagctttattattttttgcacgtaaacacagcataatgagactggggtatc

SEQ ID NO: 29594 - DNA, 75 bp, Artificial Sequence
  Synthetic
aacccgtacctccgatggcagtatctgaaaccaaagccaaacaagctattggcatgatgctaactttgcaaagct

SEQ ID NO: 29595 - DNA, 75 bp, Artificial Sequence
  Synthetic
tgcaaaagtctccttttggaaaagaaaagtggactttagtaaacacaagtcttgaaacatacaatgcaccaccag

SEQ ID NO: 29596 - DNA, 75 bp, Artificial Sequence
  Synthetic
cacagtgctttaaaaaaggtccttataatatagaagttatatttgatggagatcctgaaaatctaatggtatata

SEQ ID NO: 29597 - DNA, 75 bp, Artificial Sequence
  Synthetic
ctgcttggaaagagatttattttgtagactcagatgatatgtggcaaaaggtgcaaggtgaggtggattatgcag

SEQ ID NO: 29598 - DNA, 75 bp, Artificial Sequence
  Synthetic
gtgcatattataaggatggaactatcaaacagtattatgttaccttcgctgatgatgctgttagatatgggacat

SEQ ID NO: 29599 - DNA, 75 bp, Artificial Sequence
  Synthetic
ctggacaatatgaagtccgcattaacaacgaaactgtgtttgctcctgttactagctccaccccaccatccacgg

SEQ ID NO: 29600 - DNA, 75 bp, Artificial Sequence
  Synthetic
ggctacgagaatcctccaacgccagccccgttcacgacaccgtcgacgagacacccaccagcaccacagcaacca

SEQ ID NO: 29601 - DNA, 75 bp, Artificial Sequence
  Synthetic
ccaccaccttcagcaccaccacagccacagccacagccacaggagcacctgaactctcatccaaaaccggtacca

SEQ ID NO: 29602 - DNA, 75 bp, Artificial Sequence
  Synthetic
ggaaaggaaggtacgggcgaaaagactctagtcctacagcagcctccaactccaggaaagaggtctcgcgacgac

SEQ ID NO: 29603 - DNA, 75 bp, Artificial Sequence
  Synthetic
gatccaggtctagaaccaggacccgcagacgggaagcgagcacctcaaggtcccaaaaagccagccgttccagat

SEQ ID NO: 29604 - DNA, 75 bp, Artificial Sequence
  Synthetic
ccagatccagatccacttccagaggatccagagggtccggaggatctgtcacaacctccagagattccagcccca

SEQ ID NO: 29605 - DNA, 75 bp, Artificial Sequence
  Synthetic
agagaacccgcaggggcagagggaggggagggagaagtagaaggtcacccacccccacctccaccagtaaacggg

SEQ ID NO: 29606 - DNA, 75 bp, Artificial Sequence
  Synthetic
aaagaaggcgcagccggtcaagggggggagagcctgtttctggaggggttggcatctcgcctgacaaggtgggat

SEQ ID NO: 29607 - DNA, 75 bp, Artificial Sequence
  Synthetic
caagagtacaaacagttagtggacgacatcttggacgacttggaaggttactggaggaggctagcgatcctccag

SEQ ID NO: 29608 - DNA, 75 bp, Artificial Sequence
  Synthetic
taatacttttgcgaggagacccaaatattttaaaatgttacagatacagagataagaagcgtaaattaggtttag

SEQ ID NO: 29609 - DNA, 75 bp, Artificial Sequence
  Synthetic
taaaacattatagtaccacctggtcatgggttggtgtagatggcaatgaaagaataggtagatcacgtatgcttt

SEQ ID NO: 29610 - DNA, 75 bp, Artificial Sequence
  Synthetic
taagttttacttcaaacagcactagatcacagtatgttaaaattatgaagctccctaaaggtgtggaatggtctt

SEQ ID NO: 29611 - DNA, 75 bp, Artificial Sequence
  Synthetic
ttggtaattttgataagctttaacattttgctaacatactaacggtgcttgcactactaacacattaatctttta

SEQ ID NO: 29612 - DNA, 75 bp, Artificial Sequence
  Synthetic
acatttttatattgcttttttatttttatataatggtgcgtgctcgcagaacaaagcgagattctgtaacaaaca

SEQ ID NO: 29613 - DNA, 75 bp, Artificial Sequence
  Synthetic
tttacagaacctgcaaacaggcaggaaactgtcctccggatgttgttaataaagtggaacaaactacaattgctg

SEQ ID NO: 29614 - DNA, 75 bp, Artificial Sequence
  Synthetic
accaaatattaaaatttggcagcactggtgtgttttttggtggtttgggaataggtacaggccgtggtaccggtg

SEQ ID NO: 29615 - DNA, 75 bp, Artificial Sequence
  Synthetic
gcagtactggctatgtacctataggtgaaggcccagcaatacgtgttgggggcactccaagtgttgttcgtccag

SEQ ID NO: 29616 - DNA, 75 bp, Artificial Sequence
  Synthetic
gtatactccctgaggctattggtccggcggatatcattcctattgatactgtcaatccaattgatccaaatgcat

SEQ ID NO: 29617 - DNA, 75 bp, Artificial Sequence
  Synthetic
catctgtggtcccactcactgacacaggacctgatttgctacctgggacaattgagactattgcagaagtgaacc

SEQ ID NO: 29618 - DNA, 75 bp, Artificial Sequence
  Synthetic
ctgccccagatattcctagagttgacacatctgttgtcacaacaagcagaggctccagtgctgtattggaggttg

SEQ ID NO: 29619 - DNA, 75 bp, Artificial Sequence
  Synthetic
cctctgaacccacaccacccactcgcaccagaatttccagaacacagtaccataatccctcttttcaaatattaa

SEQ ID NO: 29620 - DNA, 75 bp, Artificial Sequence
  Synthetic
ctgaatctacaccctctttgggagaatctgcattaactgatcatgttgttgttactagtggttctggtggtcaac

SEQ ID NO: 29621 - DNA, 75 bp, Artificial Sequence
  Synthetic
caataggtggagttacaccagttgaaatagaattacaagaacttcctagcagatatacttttgaaatagaggaac

SEQ ID NO: 29622 - DNA, 75 bp, Artificial Sequence
  Synthetic
ctacaccaccaagacgctctagtaccccactacgcaacatcacacaagctgtaggaaatttaagaagatcactat

SEQ ID NO: 29623 - DNA, 75 bp, Artificial Sequence
  Synthetic
ataataggcgacttactcaacaagtaaatgtccaggatccattattcttacaacagccctcacgtttagttcgct

SEQ ID NO: 29624 - DNA, 75 bp, Artificial Sequence
  Synthetic
ttgcctttgataatcctgtgtttgaagaagaagttacacaaatatttgaaagggacgtagcagctgtagaagaac

SEQ ID NO: 29625 - DNA, 75 bp, Artificial Sequence
  Synthetic
ctccagacagagactttttagatatagcaaaattaagccgccctctttactctgaaacaccacagggatatgtca

SEQ ID NO: 29626 - DNA, 75 bp, Artificial Sequence
  Synthetic
gggtaagccgcttaggtaatagggcttctattagaacacgtagtggagctacagtaggggctcaagtgcattttt

SEQ ID NO: 29627 - DNA, 75 bp, Artificial Sequence
  Synthetic
atacagatcttagcacaatcgatgcagaggagtctatagagttatcactattaggggaacattctggtgatgcta

SEQ ID NO: 29628 - DNA, 75 bp, Artificial Sequence
  Synthetic
ctattgtccaaggcccagtagaaagctcatttgtagatttaaatgttcaggaactgcctcaagtaatagaagtag

SEQ ID NO: 29629 - DNA, 75 bp, Artificial Sequence
  Synthetic
acccagaacctactttccactctgatgatttgctactggatgagcaaaatgaagatttttctggctcccagttag

SEQ ID NO: 29630 - DNA, 75 bp, Artificial Sequence
  Synthetic
tttatggtagtggcaggcgttctaccacatttactgtaccccgcttctctactcccagatctgataccttttatg

SEQ ID NO: 29631 - DNA, 75 bp, Artificial Sequence
  Synthetic
tacaagatttggaaggttatgctgtgtcatatcctgaacgaaggaattatccagaaattatttatcctcaacccg

SEQ ID NO: 29632 - DNA, 75 bp, Artificial Sequence
  Synthetic
atttgccaactgtaataattcatactgcagatacctctggggacttctatttacatccaagccttcgcaggcgaa

SEQ ID NO: 29633 - DNA, 75 bp, Artificial Sequence
  Synthetic
aacgtaaacgcacttatttatgatatttctttcagatgacctcgctatggttacctgcaactggtaaggtatatc

SEQ ID NO: 29634 - DNA, 75 bp, Artificial Sequence
  Synthetic
taccaccttcaacacctgtggcaagggtacaaagcacggatgaatacattcagaggacagacatctactatcatg

SEQ ID NO: 29635 - DNA, 75 bp, Artificial Sequence
  Synthetic
ctaatagtgatcgattgttaactgtaggacatccatattttgatgtgagagatacagcagacaattctaaaattt

SEQ ID NO: 29636 - DNA, 75 bp, Artificial Sequence
  Synthetic
tagtaccaaaggtttcaggtaatcaatatcgagcctttagattactattaccagatcccaacagatttgcactag

SEQ ID NO: 29637 - DNA, 75 bp, Artificial Sequence
  Synthetic
tagatatgaatatatataacccagaaaaggaaagattagtatgggcctgtagaggcttagaaattggtcgtggcc

SEQ ID NO: 29638 - DNA, 75 bp, Artificial Sequence
  Synthetic
agcctttaggtgttggtacaacaggacatccattgtttaacaaagtcaaagatactgaaaatgctaataactata

SEQ ID NO: 29639 - DNA, 75 bp, Artificial Sequence
  Synthetic
tagtaacttctaaagatgatagacaggatacttcatttgaccctaaacaggtacaaatgtttatcataggttgta

SEQ ID NO: 29640 - DNA, 75 bp, Artificial Sequence
  Synthetic
ctccttgtatgggtgagtactgggacgctgctaaaccttgtgatgcagatgctggtcagggtaaatgccctccat

SEQ ID NO: 29641 - DNA, 75 bp, Artificial Sequence
  Synthetic
tagaattaatcaattcagttatacaagatggtgatatgattgatataggttttggtaatatcaataataagacat

SEQ ID NO: 29642 - DNA, 75 bp, Artificial Sequence
  Synthetic
tatctgttaacagatctgatgtcagtttggatatagtaaatgacatttgcaagtatcctgattttttaaagatgg

SEQ ID NO: 29643 - DNA, 75 bp, Artificial Sequence
  Synthetic
caaatgacatatatggggatgcttgtttcttctatgctagacgtgaacaatgttatgccaggcacttctttgtta

SEQ ID NO: 29644 - DNA, 75 bp, Artificial Sequence
  Synthetic
gaggtggtaatgtaggggatgcgatacccaatactgctgtaggtcaggataacaattacatattacctgcagcaa

SEQ ID NO: 29645 - DNA, 75 bp, Artificial Sequence
  Synthetic
gtcaacaggcccaaaatactcttggcagctccatctatttccctaccgtcagtggctctttggtatctactgatg

SEQ ID NO: 29646 - DNA, 75 bp, Artificial Sequence
  Synthetic
cgcagctattcaatagacctttttggttacaaagagcacagggtcacaacaatggaatttgctgggagaatcagc

SEQ ID NO: 29647 - DNA, 75 bp, Artificial Sequence
  Synthetic
tttttataacagtggctgataataccagaaataccaattttactattagtgtaagtacggatggccagacaccta

SEQ ID NO: 29648 - DNA, 75 bp, Artificial Sequence
  Synthetic
cagaatatgacagtaccaaggttagagaatttttaagacatgtagaggaatatgaaatttcaattatattacaat

SEQ ID NO: 29649 - DNA, 75 bp, Artificial Sequence
  Synthetic
tgtgtaaggtacctttagaaccggaagtcctggcacaaatcaatgctatgaattcttctatattggaaaattggc

SEQ ID NO: 29650 - DNA, 75 bp, Artificial Sequence
  Synthetic
aattgggatttgttcctacccctgataatcctatacatgacacatataggtatcttacatcacaggcaacacgat

SEQ ID NO: 29651 - DNA, 75 bp, Artificial Sequence
  Synthetic
gccctgacaaacaacctgctccagaaaggaaagatccatatgagcagtataacttttggactgtagatttaacag

SEQ ID NO: 29652 - DNA, 75 bp, Artificial Sequence
  Synthetic
aaaaactgtctttggatttggatcaatattctttaggaagaaagtttttatttcaagctgggctacaacgggctt

SEQ ID NO: 29653 - DNA, 75 bp, Artificial Sequence
  Synthetic
ctagagtgtctaaatcctctgctgctagagcttccacacggggtattaaacgaaaacggagatgaccgttttcgg

SEQ ID NO: 29654 - DNA, 75 bp, Artificial Sequence
  Synthetic
ttgctgggtcttataataaaatattttataaactgttttggtatgtgaggcatgttttaaccgagttcgtgacta

SEQ ID NO: 29655 - DNA, 75 bp, Artificial Sequence
  Synthetic
agattgattaacccacctgcaaccgcacccggttaatcagattataaaggtgcgccggtgttcacctctggctac

SEQ ID NO: 29656 - DNA, 75 bp, Artificial Sequence
  Synthetic
ttcacctctggctacttggcagttacaagttcacctctgccagaagtgtgtttttgccaagacatttgccaagta

SEQ ID NO: 29657 - DNA, 75 bp, Artificial Sequence
  Synthetic
gcgggtaagtcttggcgcgaagaagtgctgtcagcaatttggcacaatagttcaaccagtaacggtaaggacttg

SEQ ID NO: 29658 - DNA, 75 bp, Artificial Sequence
  Synthetic
taccgggtgcggttgggaagtattattcattgccatggtggttaacaacaatcagcataatccattacatgtaac

SEQ ID NO: 29659 - DNA, 75 bp, Artificial Sequence
  Synthetic
cgcttgtgtatatttgtataaaagaatatataaattggggattatagtacttgggtaatacacatggctaggcca

SEQ ID NO: 29660 - DNA, 75 bp, Artificial Sequence
  Synthetic
ggcagggttgtagagcttagtggctacttgcaaataccagtaggagatttattgttgccatgtaatttctgtggt

SEQ ID NO: 29661 - DNA, 75 bp, Artificial Sequence
  Synthetic
aaatttttaacatttgctgagttattagaatttgattataagaatttacgccttatttggaaaaatgcattagtg

SEQ ID NO: 29662 - DNA, 75 bp, Artificial Sequence
  Synthetic
tttgggtgctgcacagtgtgcgcttttgctacagccatttatgaattgcgaacctttcatcaagaaacagtaaca

SEQ ID NO: 29663 - DNA, 75 bp, Artificial Sequence
  Synthetic
ggttgtgagttagaaggacgagcacaggctccactagcaagtgttgttgtaaggtgtacattttgtttgaagcaa

SEQ ID NO: 29664 - DNA, 75 bp, Artificial Sequence
  Synthetic
ttagatttgttagagaagttagatatttgtgccagacatcaagagttccacagagtgagaaatcattggaaaggg

SEQ ID NO: 29665 - DNA, 75 bp, Artificial Sequence
  Synthetic
ctctgtaggcattgtagaacaatagaatgattgggaaagaagcaacaatacatgatatagtcttagaagacttaa

SEQ ID NO: 29666 - DNA, 75 bp, Artificial Sequence
  Synthetic
atgagcttgtccagcccattgacctgcattgcaacgaagagttacctgatgaacaagaagaagaggaggagctag

SEQ ID NO: 29667 - DNA, 75 bp, Artificial Sequence
  Synthetic
cacctgacagaacacctttcaaagtgattgtgtattgtggaggcagttgtggaaccaaacttcgcatctttcttc

SEQ ID NO: 29668 - DNA, 75 bp, Artificial Sequence
  Synthetic
tctctacaacgtatggtattcgattattggaagacctgctcttaaacgaacttgccctgctgtgtcctcagtgtc

SEQ ID NO: 29669 - DNA, 75 bp, Artificial Sequence
  Synthetic
gcgacaggattcgccatggcggaggatagaggtattgatcctattgaagggtgtagtggttggtttattgatgat

SEQ ID NO: 29670 - DNA, 75 bp, Artificial Sequence
  Synthetic
gaagctgagtgtagtgatttagagaatgagttggaaaaattgtttgatgaagaagcctcagagacagatttatct

SEQ ID NO: 29671 - DNA, 75 bp, Artificial Sequence
  Synthetic
gatttcttagatgatggggagacggaacagggaaactcccgagacttatttcatcaacaggagagtgctgagtgc

SEQ ID NO: 29672 - DNA, 75 bp, Artificial Sequence
  Synthetic
gaggaacaagtgcaattcctaaaacgaaagtatttcagtcctaaagctgtacaacagcttagtccgcggttgcag

SEQ ID NO: 29673 - DNA, 75 bp, Artificial Sequence
  Synthetic
gctatttcgttgtctccacaacaaaaatcaaaaaagcggctgtttgttgagcaggacagcggtgttgaactgtcg

SEQ ID NO: 29674 - DNA, 75 bp, Artificial Sequence
  Synthetic
ggccttgaacgatctgttaataatgaagctgaagatgtggctccggaggtggaggtaccggctgcagcgccggtt

SEQ ID NO: 29675 - DNA, 75 bp, Artificial Sequence
  Synthetic
gtccagggggaggaggggggacatgcacaaactgcaaacctgataaaggacctgttaaaatgtagtaattggcgt

SEQ ID NO: 29676 - DNA, 75 bp, Artificial Sequence
  Synthetic
gccaaactgttaagtaaagtgaaagaatattttggggtagggttttatgaattaaccaggcaatataaaagtaat

SEQ ID NO: 29677 - DNA, 75 bp, Artificial Sequence
  Synthetic
aagacatgctgtaaagattgggtcgtggctatttatggtgttagagaagagttattagaaggatgtaagcagttg

SEQ ID NO: 29678 - DNA, 75 bp, Artificial Sequence
  Synthetic
ctacagcaatactgttcatatatttggatttatataaatggtataatgtcattgttcctactatgtttcaatagt

SEQ ID NO: 29679 - DNA, 75 bp, Artificial Sequence
  Synthetic
gtaaaaagtagggatacagtgtgtaaattattgatgtctatattggatgtgcaaaaggagcaaatgttatcggaa

SEQ ID NO: 29680 - DNA, 75 bp, Artificial Sequence
  Synthetic
ccaccaaaattaagaagtcccgtgtcagcaatatattggtataagttaagcatggataaatctgtttatgcattt

SEQ ID NO: 29681 - DNA, 75 bp, Artificial Sequence
  Synthetic
gggacatatcctgattggatagtaaatcagaccatgataactcaccaattcggtgacgccgcacaatttgacctc

SEQ ID NO: 29682 - DNA, 75 bp, Artificial Sequence
  Synthetic
tcacaaatggtgcaatgggcattcgataataatcttatagacgatgcagatatagcgtatagatacgcaaaatta

SEQ ID NO: 29683 - DNA, 75 bp, Artificial Sequence
  Synthetic
gcagacagtgattcaaatgcaagggcttggttagcacacaatagtcaggcaagatttgtcaaagaatgtgcagcc

SEQ ID NO: 29684 - DNA, 75 bp, Artificial Sequence
  Synthetic
atggtaagacattataaacgtggtgaaatgagggatatgtccatgtctgagtggatcaatcatgtaatgcaaacg

SEQ ID NO: 29685 - DNA, 75 bp, Artificial Sequence
  Synthetic
gtggaaggggaaggccactggtctgagattgtaaaatttatacgatttcaaggtattaattttatactatttctg

SEQ ID NO: 29686 - DNA, 75 bp, Artificial Sequence
  Synthetic
gaggcctttaagcatttcatacagggtacacctaaaaagcaatgtttattaatctatggaccgccggattgtggg

SEQ ID NO: 29687 - DNA, 75 bp, Artificial Sequence
  Synthetic
aaaacaatgtttacaatgtcattactaaaatttatgaggggtcgagtaatttcatttgctaattccaaaagtcat

SEQ ID NO: 29688 - DNA, 75 bp, Artificial Sequence
  Synthetic
ttttggttacaacccttaggtgaatgtaaattaggtttattagatgatgcaacggaaccttgctggacatatata

SEQ ID NO: 29689 - DNA, 75 bp, Artificial Sequence
  Synthetic
gatttgtatttaaggaatggtattgatggtaatcttgttagtgtagattgcaaacacaaagcaccaatgcaaata

SEQ ID NO: 29690 - DNA, 75 bp, Artificial Sequence
  Synthetic
aagtttccacctttactaataacgtccaatatggatataaccaaggaggagaggtttcgatacttacacaccaga

SEQ ID NO: 29691 - DNA, 75 bp, Artificial Sequence
  Synthetic
atcaaaggttttgaatttaagcataaattcccatttaatgctgatggcaccccacagtttttacttactgaccaa

SEQ ID NO: 29692 - DNA, 75 bp, Artificial Sequence
  Synthetic
agctggaaatctttctttacaaggctttggaaacaattagatctcagtgatccagaagacgagggagaggaggac

SEQ ID NO: 29693 - DNA, 75 bp, Artificial Sequence
  Synthetic
aatggaggcactcaacgatcgtttcaatgcactacaagagacattgctggacatttatgaatcaggaaaagatga

SEQ ID NO: 29694 - DNA, 75 bp, Artificial Sequence
  Synthetic
cattgatacacaaatattacattggaactgcttaagaaaggaacaaattttattacattatgccaggaaacatgg

SEQ ID NO: 29695 - DNA, 75 bp, Artificial Sequence
  Synthetic
cataaggagagtgggctaccaacatgtcccacctttggcagtgacagaaactaaagcaaaagaagcaattggcat

SEQ ID NO: 29696 - DNA, 75 bp, Artificial Sequence
  Synthetic
ggtgttagtgttggaaagtttaaaaaagtctccatatggaagtgaatcatggactttagttaacacgagccttga

SEQ ID NO: 29697 - DNA, 75 bp, Artificial Sequence
  Synthetic
gacatatagaacacctccttccaattgctttaaaaaaggaccttctaatattgaagtgcgctatgataatgaccc

SEQ ID NO: 29698 - DNA, 75 bp, Artificial Sequence
  Synthetic
tgaaaacattatgcactacacggtgtgggattgtatatactttcagaatgctgatgaacagtgggaaaaggtcaa

SEQ ID NO: 29699 - DNA, 75 bp, Artificial Sequence
  Synthetic
agggcatgtggactatatgggggcctactatatggacggagagcagaagcagtattacatacactttgctgatga

SEQ ID NO: 29700 - DNA, 75 bp, Artificial Sequence
  Synthetic
tgctgctagatacagtaaaacaggaatatgggaagtaagatctaatgaagaaactttgtttgctcctgttactag

SEQ ID NO: 29701 - DNA, 75 bp, Artificial Sequence
  Synthetic
ttccacaccaccggggggtgagcaaggagtcggagtccccacctcatccaccgacgccagcgcctcaccggccac

SEQ ID NO: 29702 - DNA, 75 bp, Artificial Sequence
  Synthetic
caccaccagtgcagccaccaccacctacgggaccaccagagaggatagaggacagcaacaacagcaacaaaaagc

SEQ ID NO: 29703 - DNA, 75 bp, Artificial Sequence
  Synthetic
caagcgaggaaggtacggacggaaagcctctagccctacaggatccaccacatcgcccagaaaagcggcacaagg

SEQ ID NO: 29704 - DNA, 75 bp, Artificial Sequence
  Synthetic
gacaaggtcacgatccagaaacaggagacggaaaacgcaggggtctaagcacagatcagggagaaaacggtcttc

SEQ ID NO: 29705 - DNA, 75 bp, Artificial Sequence
  Synthetic
ccgcgacagctcccgatcctccaactccagatcctccagaaagcgggcgagatcccctaggggagggtcaggtag

SEQ ID NO: 29706 - DNA, 75 bp, Artificial Sequence
  Synthetic
aaggtcatcctcctccactgcctccaaacgggcacgatccagatcacaaaccccaaggagaggaaaatcagggtc

SEQ ID NO: 29707 - DNA, 75 bp, Artificial Sequence
  Synthetic
cagatccagatccagatcaaaatcaaaatcacggcattctgaagggggcggcgtatcaccttcagaggtgggaag

SEQ ID NO: 29708 - DNA, 75 bp, Artificial Sequence
  Synthetic
agacttacaaacagttagtggaagacatcttggacgacttgagcaattattggcagatgctagggatcccccaat

SEQ ID NO: 29709 - DNA, 75 bp, Artificial Sequence
  Synthetic
aatactttttaaaggtgcagctaacacattgaaatgctatcgctatagggaaaggcaaaggttaaaagggttcta

SEQ ID NO: 29710 - DNA, 75 bp, Artificial Sequence
  Synthetic
taagtggtttagcacaacatggtcctgggtagggtcagaagactgcactcgcattggcagggctcgcatgatagt

SEQ ID NO: 29711 - DNA, 75 bp, Artificial Sequence
  Synthetic
tagtttcacatcatattcacaaagacaagaattcacgaacagaatgaaaatacctaagggtgtggactggtgttt

SEQ ID NO: 29712 - DNA, 75 bp, Artificial Sequence
  Synthetic
tggtaattttgacaagttataactaaccttgtttgctattttactaaccttatactaacatggtacgggcacgtc

SEQ ID NO: 29713 - DNA, 75 bp, Artificial Sequence
  Synthetic
gtgtaaaacgtgactctgttactaacatatatagaggctgtaaagcggctggtacttgtccacccgatgtactca

SEQ ID NO: 29714 - DNA, 75 bp, Artificial Sequence
  Synthetic
ataaagtggaacagactactattgctgaccaaatcttaaaatatggcagcgctggtgtgttttttggcggcctgg

SEQ ID NO: 29715 - DNA, 75 bp, Artificial Sequence
  Synthetic
gcatcagcaccgggcgtggaaccggaggcagcacagggtatgtaccacttggcgaaggacccagcgttagagttg

SEQ ID NO: 29716 - DNA, 75 bp, Artificial Sequence
  Synthetic
ggggtacgccaagtataattcgccccagcgtcatacccgaaacaattggtccagccgatatcattccaattgaca

SEQ ID NO: 29717 - DNA, 75 bp, Artificial Sequence
  Synthetic
ctgtcaatccaattgacccgacagcatcatctgtggtcccactcacagaaagcacaggacctgatttgttgcctg

SEQ ID NO: 29718 - DNA, 75 bp, Artificial Sequence
  Synthetic
gggaaattgaaacaatagctgaaatacatcctgtacctgaagtaagacctgttgacacatctgtgacaaccaaca

SEQ ID NO: 29719 - DNA, 75 bp, Artificial Sequence
  Synthetic
ccagaggttctagtgcagttcttgaggtggcacctgaaccagtacctccaacgagaactagaattagtagaaccc

SEQ ID NO: 29720 - DNA, 75 bp, Artificial Sequence
  Synthetic
aatatcataacccttcttttcaaattattagtgaatctacaccttccacaggcgagtcttcattagctgatcaca

SEQ ID NO: 29721 - DNA, 75 bp, Artificial Sequence
  Synthetic
ttattgttaccagtggctctggtggacaacaaataggtggcccacgtattgaaatagaattagaagagataccaa

SEQ ID NO: 29722 - DNA, 75 bp, Artificial Sequence
  Synthetic
gtagatatagttttgaaattgaggaacccacaccaccacgacgctcaagtacgcctgtgtctgcagcacgccgag

SEQ ID NO: 29723 - DNA, 75 bp, Artificial Sequence
  Synthetic
cgttaggtgctatacgcagaggtatatataataggaggcttacacagcaaatcaatgttacagacccactattta

SEQ ID NO: 29724 - DNA, 75 bp, Artificial Sequence
  Synthetic
tacagcagccatctaggttggttagatttcaatttgataatccagcatttgaagaggaagttacacaaatatttg

SEQ ID NO: 29725 - DNA, 75 bp, Artificial Sequence
  Synthetic
atagagatattaatgaaattgaagagcctcctaatagggatttcctagatatagctaggttaagtaggcctttat

SEQ ID NO: 29726 - DNA, 75 bp, Artificial Sequence
  Synthetic
ttagtgaaacaccacagggttatgtgagggtaagtcgattaggtaatagggcaactataagaacacgtagtggag

SEQ ID NO: 29727 - DNA, 75 bp, Artificial Sequence
  Synthetic
caacaattgggtcacaggttcatttctatcaagatcttagcactattgataatgtggaatccatggaactctcat

SEQ ID NO: 29728 - DNA, 75 bp, Artificial Sequence
  Synthetic
tattaggagaacattctggggatgcaagtatagttcaagggccagtagaaagtacatttgtagaagccaatctag

SEQ ID NO: 29729 - DNA, 75 bp, Artificial Sequence
  Synthetic
atgaaattcctgaattgtctgaggaacctgactttaattctgaggatttgttattggatgaacatactgaccatt

SEQ ID NO: 29730 - DNA, 75 bp, Artificial Sequence
  Synthetic
ttagtgattcccagttagtctttggcacaggtcgcaggacggttagttacacaataccacgatttgaaacacctc

SEQ ID NO: 29731 - DNA, 75 bp, Artificial Sequence
  Synthetic
gcagtgacactatttttttggaaaatgttcaaggatatactgtagcctatcctgaacgcagagacaggcctgaaa

SEQ ID NO: 29732 - DNA, 75 bp, Artificial Sequence
  Synthetic
tcatatatcctatgccagacttaccagcagtggtaattcacatctatgatgattctggggacttttatttacatc

SEQ ID NO: 29733 - DNA, 75 bp, Artificial Sequence
  Synthetic
caagcctaaaaaagaggaaacgtaaacgagcctacttataatattctttttcagatgactctgtggttacctgca

SEQ ID NO: 29734 - DNA, 75 bp, Artificial Sequence
  Synthetic
accggtaaagtatatctaccaccatcgaccccagttgcaagggtacaaagcacggatgagtacatacaaaggact

SEQ ID NO: 29735 - DNA, 75 bp, Artificial Sequence
  Synthetic
gacatcttttaccacgctaatagtgatcggttacttacagtaggacatccatactttgaggttcgagccacaaca

SEQ ID NO: 29736 - DNA, 75 bp, Artificial Sequence
  Synthetic
gaaccatatcaggtgacagtacctaaagttagtggaaatcagtttagagctttcagacttaaattacctgatcct

SEQ ID NO: 29737 - DNA, 75 bp, Artificial Sequence
  Synthetic
aataggtttgcattggtagatactacagtgtataatcctgacaaggaaagattagtctgggcttgtagaggtatt

SEQ ID NO: 29738 - DNA, 75 bp, Artificial Sequence
  Synthetic
gaaattggaaggggccaacctttgggtgttggttctacaggtcatccattatttaataaggtaaaggatactgag

SEQ ID NO: 29739 - DNA, 75 bp, Artificial Sequence
  Synthetic
aatcctactgggtacattaccaattccaaggatgacagacaagatacatcctttgatcccaaacaggtacaaatg

SEQ ID NO: 29740 - DNA, 75 bp, Artificial Sequence
  Synthetic
tttataattggctgtaccccttgctggggagagcattgggatattgctccacgctgtgatgatgatcaacctatc

SEQ ID NO: 29741 - DNA, 75 bp, Artificial Sequence
  Synthetic
caaggggcctgtcctccattagaattaagaaatactattattgaggatggcgatatggtagacataggttttggt

SEQ ID NO: 29742 - DNA, 75 bp, Artificial Sequence
  Synthetic
aatataaataacaaaactctttcagtgaccaaatcagatgtcagtttagatatagtaaacagtacctgtaaatat

SEQ ID NO: 29743 - DNA, 75 bp, Artificial Sequence
  Synthetic
cctgactttctgaagatggcaaacgacatttatggagatgcctggtttttttatgcacgaagggaacaatgctat

SEQ ID NO: 29744 - DNA, 75 bp, Artificial Sequence
  Synthetic
gctagacacttttttgttcgtggtggtgctgtgggagatgctatcccagatgcagctgtacaacaagataataat

SEQ ID NO: 29745 - DNA, 75 bp, Artificial Sequence
  Synthetic
tactttttgccagctgcaggagaccaggctcaaaagacattaggtagttctatttatgtgcccactgtaagtggc

SEQ ID NO: 29746 - DNA, 75 bp, Artificial Sequence
  Synthetic
tctttagtgtcttctgatgcacagctatttaataggcctttttggttacaaagggcacaaggacacaacaatggc

SEQ ID NO: 29747 - DNA, 75 bp, Artificial Sequence
  Synthetic
atatgctgggaaaatcagctttttgtcactgttgtagataacacacgcaatactaactttacaattagtgtgtct

SEQ ID NO: 29748 - DNA, 75 bp, Artificial Sequence
  Synthetic
tccactgatcaagcacctacagagcataatgctagtaatactcctaattttagggaatatttaagacatgtagag

SEQ ID NO: 29749 - DNA, 75 bp, Artificial Sequence
  Synthetic
gaatatgagctctctgtcattttacaactttgtagggtgcctttacaaccagacatattggcacacataaatgca

SEQ ID NO: 29750 - DNA, 75 bp, Artificial Sequence
  Synthetic
atgaattctaatattttagaagagtggcagttggggtttgttcccacccctgaaaatcctatacaggatacctac

SEQ ID NO: 29751 - DNA, 75 bp, Artificial Sequence
  Synthetic
agatatattaactcagcagccacacgttgccctgataaaaacaccccaaaagaaaaggaagatcaatatgctaag

SEQ ID NO: 29752 - DNA, 75 bp, Artificial Sequence
  Synthetic
tttaacttttggactgttgacccaacagaaaaattgtccttagatttagatcaatactctttaggacgtaagttt

SEQ ID NO: 29753 - DNA, 75 bp, Artificial Sequence
  Synthetic
ttatatcaggcaggcttgaaacggtctgctacacctaaaaccacaacagctcgcaacactgtcactcgaggggtt

SEQ ID NO: 29754 - DNA, 75 bp, Artificial Sequence
  Synthetic
aaacgaaaacgtacatgaccgctttcggtatctgtataaaggttaataaattttttgaaacccctttggtatgtg

SEQ ID NO: 29755 - DNA, 75 bp, Artificial Sequence
  Synthetic
aagcatgttttaaccacgttcgtgactacaccggaatggatcatgccaaccgcgcccggttgatcagatataaat

SEQ ID NO: 29756 - DNA, 75 bp, Artificial Sequence
  Synthetic
gcgcccggttgatcagatataaatctccaggtgcaacttagaagttcagccagaagtgtctgccaaccgcttttg

SEQ ID NO: 29757 - DNA, 75 bp, Artificial Sequence
  Synthetic
cagatttgttccaacaacgattttggcgcgaacattttggcagcagaagagcgacggtaacggtaagtttcaacc

SEQ ID NO: 29758 - DNA, 75 bp, Artificial Sequence
  Synthetic
gggtgcggtcaaaacaacttactcatcataatggttgccaacaacaatcatcgaaacagatctttatgtaaccac

SEQ ID NO: 29759 - DNA, 75 bp, Artificial Sequence
  Synthetic
ataagttgttttcactcttttattcttggaaagaatagatacaggacacatggctagacctgctaaggtatgtga

SEQ ID NO: 29760 - DNA, 75 bp, Artificial Sequence
  Synthetic
gcttagccaactcttaaatatacccatttcttctatgctgataccctgtaacttttgcacagggtttctgaccta

SEQ ID NO: 29761 - DNA, 75 bp, Artificial Sequence
  Synthetic
ttgggaactcttagagtttgattataaggacttccatttagtgtggaaggacggattttgctttggttgctgtgc

SEQ ID NO: 29762 - DNA, 75 bp, Artificial Sequence
  Synthetic
taagtgtgcttttgcatctgcctaccacgagtttacacagtaccatcaggaaactgtggtaggcatagaaataga

SEQ ID NO: 29763 - DNA, 75 bp, Artificial Sequence
  Synthetic
aggcagagctgcagaaaatatagcgaacattataataaggtgtcaattttgtttgaaacgcctggatttatttga

SEQ ID NO: 29764 - DNA, 75 bp, Artificial Sequence
  Synthetic
aaaacttgatcattgtgcacagcaaagagagtttcacaaagttagaaataggtggaaaggggtgtgtagacattg

SEQ ID NO: 29765 - DNA, 75 bp, Artificial Sequence
  Synthetic
cagagtaatagaatgattgggaaagaggctacattacctgacattgtgctacaagaagagtttggccagcccatt

SEQ ID NO: 29766 - DNA, 75 bp, Artificial Sequence
  Synthetic
gacctgcaatgctacgagaacttaccagctgaagtgccagctgaacaagacacagaggaggagcttatccaaggc

SEQ ID NO: 29767 - DNA, 75 bp, Artificial Sequence
  Synthetic
atcccttacaaagtgattgcttgctgtggcggcggatgcggttctagacttcgtgtgtttgtgctggctactgat

SEQ ID NO: 29768 - DNA, 75 bp, Artificial Sequence
  Synthetic
cgggccattcgagaatttcaatctttactgctagaggagttgcaattcctgtgtccggagtgtcgtgaagagatt

SEQ ID NO: 29769 - DNA, 75 bp, Artificial Sequence
  Synthetic
tactgctagaggagttgcaattcctgtgtccggagtgtcgtgaagagattcgcaatggcggacgataaaggtact

SEQ ID NO: 29770 - DNA, 75 bp, Artificial Sequence
  Synthetic
gaccctaaagaagggtgtagtgaatggttcttagataatgaagcagactgtagtgatttagaaaatgaccttgag

SEQ ID NO: 29771 - DNA, 75 bp, Artificial Sequence
  Synthetic
cagttatttgatgaaagtccacagtccaatatatcagaattaatagatgatgatgcggacgtggagcagggaaat

SEQ ID NO: 29772 - DNA, 75 bp, Artificial Sequence
  Synthetic
tcgcgagatctgcttcgccagcaggaatttgaggaaagcgcggagcaagtgcaaaagttaaaacgaaagtatttc

SEQ ID NO: 29773 - DNA, 75 bp, Artificial Sequence
  Synthetic
gcaaaagttaaaacgaaagtatttcagtcctaaagcagtgcaacaacttagtccacggttgcagtctttgtctat

SEQ ID NO: 29774 - DNA, 75 bp, Artificial Sequence
  Synthetic
atctccgcaacaaaagtctaaacggaggctgtttgagcaggacagcgggctggaactgtcgggttgtgaacaaac

SEQ ID NO: 29775 - DNA, 75 bp, Artificial Sequence
  Synthetic
tttgtctaatgaagttgaagatattactacggagctggaggtaccagcggtgccgccggcagagcagggtggcca

SEQ ID NO: 29776 - DNA, 75 bp, Artificial Sequence
  Synthetic
gggatcgggaaatttgcattataaagaattaatgcgatgcagcaatagtcgtgcaagattattaagtaaagtcaa

SEQ ID NO: 29777 - DNA, 75 bp, Artificial Sequence
  Synthetic
agaatattttggtgtaggattttatgagttagctaggcaatataaaagtgataaaacatgttgcagagactgggt

SEQ ID NO: 29778 - DNA, 75 bp, Artificial Sequence
  Synthetic
agttggagcctatggagtgcgggaggaattgctagaaggtgcaaaacaattacttattaatcattgttcttatgt

SEQ ID NO: 29779 - DNA, 75 bp, Artificial Sequence
  Synthetic
gtggattaacataaatgggattatgtcattattcttgctgtgttttaacaatgctaaaagcagagaaactgtggg

SEQ ID NO: 29780 - DNA, 75 bp, Artificial Sequence
  Synthetic
atgctaaaagcagagaaactgtgggaagattgctgatgtcaatgcttgatgtacaattattgcaactaatatgtg

SEQ ID NO: 29781 - DNA, 75 bp, Artificial Sequence
  Synthetic
aacctcccaaacttagaagtgtggtgtcagcattatattggtataaaggtagtatggactcatctgtgtatgctc

SEQ ID NO: 29782 - DNA, 75 bp, Artificial Sequence
  Synthetic
acggaacctatcctgattggatagtaaatcagaccatgttaacacatcaggctgcagcagaagctgtgcaatttg

SEQ ID NO: 29783 - DNA, 75 bp, Artificial Sequence
  Synthetic
acttatctgaaatgatacaatgggcctatgatacagatctcacagatgaagctgacattgcatatggatatgcta

SEQ ID NO: 29784 - DNA, 75 bp, Artificial Sequence
  Synthetic
agatggctgagtctgactcaaatgccagagcttggctagcacataatagtcaagcaaaatttgtaagagaatgtg

SEQ ID NO: 29785 - DNA, 75 bp, Artificial Sequence
  Synthetic
cacaaatggtcagacattatagacggggagagatgagagatatgagtatatcagagtggattcattataggatag

SEQ ID NO: 29786 - DNA, 75 bp, Artificial Sequence
  Synthetic
aacaagtagagggtgaaggtcattggtctgaaattgtaaagtttattagatatcaaggaataaattttatattat

SEQ ID NO: 29787 - DNA, 75 bp, Artificial Sequence
  Synthetic
tccttgatgcatttaagcaatttttgcatgggaaacccaaaaaaagttgtttattaatttatggaccgcccgatt

SEQ ID NO: 29788 - DNA, 75 bp, Artificial Sequence
  Synthetic
gtggtaaatctatgtttgcaatgtcattaataagagtgttgagagggagggtaatatcatttgtaaatgcaaaaa

SEQ ID NO: 29789 - DNA, 75 bp, Artificial Sequence
  Synthetic
gtcaattttggttatcacctcttgcagaatgtaaaataggtttattagatgatgccactgatccatgttggcaat

SEQ ID NO: 29790 - DNA, 75 bp, Artificial Sequence
  Synthetic
atatagatacatacttaagaaatggcattgatggtaatattgtaagtgtggactgtaaacataaaactccattac

SEQ ID NO: 29791 - DNA, 75 bp, Artificial Sequence
  Synthetic
aaattagatttcctcctcttttaattacatcaaattataacatcaaggacaatgataaatacagatacctgtata

SEQ ID NO: 29792 - DNA, 75 bp, Artificial Sequence
  Synthetic
gcagaattgtgatatttgagtttaaacataagtttccatttaaagaggatggttcacctgaatttctccttactg

SEQ ID NO: 29793 - DNA, 75 bp, Artificial Sequence
  Synthetic
accaaagctggaaatctttttttaaaaggctttggaatcaattagatctcagtgaccctgaagacgaggcagaga

SEQ ID NO: 29794 - DNA, 75 bp, Artificial Sequence
  Synthetic
atggaggcactcaacgatcgtttcaatgcactacaagacaaattgatggacatttatgaatcagggaaagatgat

SEQ ID NO: 29795 - DNA, 75 bp, Artificial Sequence
  Synthetic
cttgaaacacaaatagaacattggaaattgttaagacaagaacaagtgttgtattattatgcacgcaaaaaaggc

SEQ ID NO: 29796 - DNA, 75 bp, Artificial Sequence
  Synthetic
gtgttaagacttgggtatcaacctattcccacacttgcaacctccgaaactaaggctaaagaagcaattggaatg

SEQ ID NO: 29797 - DNA, 75 bp, Artificial Sequence
  Synthetic
atgcttacactggagagtttgcaaaaatctccatttggaaaggaaccatggactttagtaaataccagtcttgaa

SEQ ID NO: 29798 - DNA, 75 bp, Artificial Sequence
  Synthetic
acatatcgcaccccacctataaactgttttaaaaaggggcctgtaaatatagaagtaagatttgatgaagatcct

SEQ ID NO: 29799 - DNA, 75 bp, Artificial Sequence
  Synthetic
gaaaatataatgttgtatacatcttggacatatatttactttctagatgcagaagatcaatggcaaaaagtaaaa

SEQ ID NO: 29800 - DNA, 75 bp, Artificial Sequence
  Synthetic
ggggaagtggactatttaggtgctttttataaggatgggccacataaacattattacataaacttcaatgatgat

SEQ ID NO: 29801 - DNA, 75 bp, Artificial Sequence
  Synthetic
gcccttagatatgggacatcaggccagtgggaagtaagaattaacaacgaaactgtgtttgctcctgtcactagc

SEQ ID NO: 29802 - DNA, 75 bp, Artificial Sequence
  Synthetic
tccacaccaccggccgcggagctacggggatcctccaacgccagccccgttcccgcccccgaccacaccaggtcc

SEQ ID NO: 29803 - DNA, 75 bp, Artificial Sequence
  Synthetic
cagacgcccaccagcaccacaggaaccaccacaacctacagcaccaccagcgttagcaccaagggagcaccagaa

SEQ ID NO: 29804 - DNA, 75 bp, Artificial Sequence
  Synthetic
ctcgcatccaaagccaacaccaggaaaagaaggtacggaagaaaagactctagccctacagccacctccaggaaa

SEQ ID NO: 29805 - DNA, 75 bp, Artificial Sequence
  Synthetic
gaggtctcgcggagacgctcccggtccagcaccaggacccgggcaacctccagagcaagggccatcagagtcaga

SEQ ID NO: 29806 - DNA, 75 bp, Artificial Sequence
  Synthetic
tcccaaagacccagccgatccagatcgcgatccagatcccgagaatccagaggatccagaggatccagagggtcc

SEQ ID NO: 29807 - DNA, 75 bp, Artificial Sequence
  Synthetic
agcagctccagaggatcctccagtcgcaggggccagcgggggcggggagggggaggtcgaagggcatccacacac

SEQ ID NO: 29808 - DNA, 75 bp, Artificial Sequence
  Synthetic
acacccacccccagtccccacaaacggtcacaacggagaagtaggtcccgagaacggggaaccggagccatttct

SEQ ID NO: 29809 - DNA, 75 bp, Artificial Sequence
  Synthetic
aacaggtctggcatctcgcctgacaaggtgggatctgcagtacaaacagttagtggacgacatcttggaagactt

SEQ ID NO: 29810 - DNA, 75 bp, Artificial Sequence
  Synthetic
ggaaggttactggcagaagctagcgatcctccagtaatacttttacgaggtgatccaaatgtgttgaaatgcttt

SEQ ID NO: 29811 - DNA, 75 bp, Artificial Sequence
  Synthetic
agatacagagataaaaaaaataagaagggattagtaaaatgttatagtaccacatggtcctgggtgcatgcagac

SEQ ID NO: 29812 - DNA, 75 bp, Artificial Sequence
  Synthetic
ggtaatgagagaataggtagagctagaatgcttttaggttttacttctcagcagcatagagcacagtatattagt

SEQ ID NO: 29813 - DNA, 75 bp, Artificial Sequence
  Synthetic
tccatgaaattgcctaaaggtgtagagtggtcctatggtaactttgataggttataacattaattaacctactaa

SEQ ID NO: 29814 - DNA, 75 bp, Artificial Sequence
  Synthetic
ccttgcttgcactactaatatattaacattttatatttttttactatggtccgtgctcgcagaacaaaaagagat

SEQ ID NO: 29815 - DNA, 75 bp, Artificial Sequence
  Synthetic
tctgtaacacacatttatcaaagctgcaaagcagctggaacctgtcctccggatgttttaaataaagtggaacaa

SEQ ID NO: 29816 - DNA, 75 bp, Artificial Sequence
  Synthetic
acaacaattgctgaccagattttaaaatatggcagcagtggtgttttctttggtggtttgggtataggcacaggt

SEQ ID NO: 29817 - DNA, 75 bp, Artificial Sequence
  Synthetic
cgtggaaccggaggcagtactggctatgtgccattaggtgagggccccgccattcgtgttgggggcactccaaat

SEQ ID NO: 29818 - DNA, 75 bp, Artificial Sequence
  Synthetic
gtcattcggcctagtgtgatacccgaggctattgggcctgttgatatcatacctattgacactgtcaatccaatt

SEQ ID NO: 29819 - DNA, 75 bp, Artificial Sequence
  Synthetic
gacccaactgcatcatctgtggtcccactcactgaaacaggacctgatttgctgcctggggaaattgagacaatt

SEQ ID NO: 29820 - DNA, 75 bp, Artificial Sequence
  Synthetic
gcagaagtgaaccctgccccagatattcctagagttgacacatctgttgtgacaacaagtcgtggcactagtgca

SEQ ID NO: 29821 - DNA, 75 bp, Artificial Sequence
  Synthetic
gtgcttgaagttgctcctgaaccagtacctcctacacggacacgtatatcacgaacacaatatcacaatccttct

SEQ ID NO: 29822 - DNA, 75 bp, Artificial Sequence
  Synthetic
tttcaagtacttactgaatccacaccaacactaggggaatccgcattgtcagaccaaattgtagttaccagtggc

SEQ ID NO: 29823 - DNA, 75 bp, Artificial Sequence
  Synthetic
tcaggtggccaggccattggtggttccagatatgtggaaatagagctggaggaaataccaagtagatatacattt

SEQ ID NO: 29824 - DNA, 75 bp, Artificial Sequence
  Synthetic
gaaatagaagaacccacccctccaagacgcacaagcacccctgttcaaagaattacacaaggtattagtaatatt

SEQ ID NO: 29825 - DNA, 75 bp, Artificial Sequence
  Synthetic
agaaggtctctatataatagaagactgacacagcaggttaatgttcaggatcctttatttttacaacaaccttca

SEQ ID NO: 29826 - DNA, 75 bp, Artificial Sequence
  Synthetic
cgtttggtacgttttacgtttgataatcccgcttttgaagatgaggttacacaaatatttgaaagagatgtagct

SEQ ID NO: 29827 - DNA, 75 bp, Artificial Sequence
  Synthetic
actgttgaggagccacctaatagagactttttggatatagctaaactaagtcgtccactatattcagacactcca

SEQ ID NO: 29828 - DNA, 75 bp, Artificial Sequence
  Synthetic
caaggttatgtacgtgttagtcgtcttggtaacagagcctctataaggactagaagtggtgctactgtaggggct

SEQ ID NO: 29829 - DNA, 75 bp, Artificial Sequence
  Synthetic
caggtacatttctataaagaccttagtactatagatgcagaagaatcaatagaattgtcactgcttggtgagcat

SEQ ID NO: 29830 - DNA, 75 bp, Artificial Sequence
  Synthetic
tcaggtgatgcctctatagtccaaggccctgtagaaagtacatttgttacatcagatctacaagaattgcctgtt

SEQ ID NO: 29831 - DNA, 75 bp, Artificial Sequence
  Synthetic
aatattgtagaggaaacagaacccgagtttcattctgatgatttattgcttgatgaacaaaatgaggattttagt

SEQ ID NO: 29832 - DNA, 75 bp, Artificial Sequence
  Synthetic
ggatctcagttagtgtatggtgcaggcagacggtccattacatacacagtgcctagatttacaacaccccgagca

SEQ ID NO: 29833 - DNA, 75 bp, Artificial Sequence
  Synthetic
gatacattttatgtgcaggacttagagggttatacagtgtcatatccagaaagaagggattatccagaaataatt

SEQ ID NO: 29834 - DNA, 75 bp, Artificial Sequence
  Synthetic
tatcctcaacctgaccttcctgctgttgttatacatacatctgatacatctggggatttctatttacatcctagc

SEQ ID NO: 29835 - DNA, 75 bp, Artificial Sequence
  Synthetic
ctacgtaggcgtaaacgtaaacgagcttatttataatatttttttcagatgacttcgctttggttaccagcaact

SEQ ID NO: 29836 - DNA, 75 bp, Artificial Sequence
  Synthetic
ggtaaggtttatcttccaccatcaacacctgtggccagggttcaaagcacggatgaatacattgaaagaacagac

SEQ ID NO: 29837 - DNA, 75 bp, Artificial Sequence
  Synthetic
atctactatcatgcaaatagcgatcgcctccttactgtaggccacccatattttgatgttagagacactggggat

SEQ ID NO: 29838 - DNA, 75 bp, Artificial Sequence
  Synthetic
tcaacaaaaatacaggttcctaaagtatcagggaatcagtttagagcatttagattactactaccagatcccaat

SEQ ID NO: 29839 - DNA, 75 bp, Artificial Sequence
  Synthetic
agattcgccttggtagacatgaatgtctataatcctgagaaggaaagactggtttgggcctgtagaggtttggaa

SEQ ID NO: 29840 - DNA, 75 bp, Artificial Sequence
  Synthetic
ataggtcgcggacaacccctaggagtagggtctacaggtcatcccctatttaataaagtgaaggatacggaaaat

SEQ ID NO: 29841 - DNA, 75 bp, Artificial Sequence
  Synthetic
gctaataattatatagtaacatctaaggatgataggcaggacacctcatttgatcctaaacaggttcaaatgttt

SEQ ID NO: 29842 - DNA, 75 bp, Artificial Sequence
  Synthetic
attattggctgcgcaccgtgcataggtgagcactgggatgcagccaagccctgtgatgctgacagaggggtaggc

SEQ ID NO: 29843 - DNA, 75 bp, Artificial Sequence
  Synthetic
aaatgtccacctttggaactggtaaatactgtaatagaagatggagatatggtggatataggttttggaaatata

SEQ ID NO: 29844 - DNA, 75 bp, Artificial Sequence
  Synthetic
aataataaaaccctgtcagcaaataagtcagatgtcagtttagatatagttaataatatttgtaagtatccagac

SEQ ID NO: 29845 - DNA, 75 bp, Artificial Sequence
  Synthetic
tttttaaaaatggccaatgacatatatggagactcctgttttttttatgctagacgggagcaatgttatgctaga

SEQ ID NO: 29846 - DNA, 75 bp, Artificial Sequence
  Synthetic
catttttttgttagaggaggtaatgtaggagatgctattcctgatgctgcagtgggtcaggacaataactttgtg

SEQ ID NO: 29847 - DNA, 75 bp, Artificial Sequence
  Synthetic
ttgcctgcagctgttggacaggcccaaaacactttgggtagctctatttacgtgcctaccgttagtggttctttg

SEQ ID NO: 29848 - DNA, 75 bp, Artificial Sequence
  Synthetic
gtatccacagatgcacaattatttaataggcccttttggctacaacgagcacagggtcataacaatggcatttgt

SEQ ID NO: 29849 - DNA, 75 bp, Artificial Sequence
  Synthetic
tgggaaaatcaattatttgttactgttgttgataatactaggaatactaattttaccataagtgttaccacagat

SEQ ID NO: 29850 - DNA, 75 bp, Artificial Sequence
  Synthetic
ggtcaaacaccaactgattatgatagtactaaaatcagagagtttttaagacatgtggaggaatatgaactatca

SEQ ID NO: 29851 - DNA, 75 bp, Artificial Sequence
  Synthetic
gttattttacaattgtgtaaagtacctttagtgccagaagtacttgcacaaatcaatgcaatgaattccaatata

SEQ ID NO: 29852 - DNA, 75 bp, Artificial Sequence
  Synthetic
ttagaaaattggcaattaggttttgtgcctacacctgacaatcccattcatgacacctatagatatttaacatcc

SEQ ID NO: 29853 - DNA, 75 bp, Artificial Sequence
  Synthetic
caggccactcgatgtccagataaacagcccgcccctgaaaaaaaggatccatatgagcaatacaatttttggcaa

SEQ ID NO: 29854 - DNA, 75 bp, Artificial Sequence
  Synthetic
gtggatctaactgagaaattgtcattagatttggatcaatattccttaggacgcaagtttctgtttcaagcaggc

SEQ ID NO: 29855 - DNA, 75 bp, Artificial Sequence
  Synthetic
ctgcgacgggcttccagagtatccaggacagccactgtccgcacagcatccaggggaaccaaacgcaaacgttca

SEQ ID NO: 29856 - DNA, 75 bp, Artificial Sequence
  Synthetic
tgaccgttttcggtcactgggtctcataataaaatattttataaactcttttggtatgtcaagcatgttttaacc

SEQ ID NO: 29857 - DNA, 75 bp, Artificial Sequence
  Synthetic
gagttcgtgactaagattgattaaggccatctgcaaccgcacccggttaatcagattataaaggagcgccagggt

SEQ ID NO: 29858 - DNA, 75 bp, Artificial Sequence
  Synthetic
tttacctcaagcaacttggcagttacaacttgtcttctgccagaaggtctgtctgccaacttcctttccaataac

SEQ ID NO: 29859 - DNA, 75 bp, Artificial Sequence
  Synthetic
aaccattttggcgcgaacattttggcagcagaagagcaacgataacggtaagtttcaaccgggcgcggtcaaaac

SEQ ID NO: 29860 - DNA, 75 bp, Artificial Sequence
  Synthetic
tacttactcatcattattgttgccaacaacaatcaccgaaacagatatttatgtaaccacttgtgttgttaccac

SEQ ID NO: 29861 - DNA, 75 bp, Artificial Sequence
  Synthetic
ttgtgttgttttcactcttttattcttggaaagaatacagacagaacacatggctagacctgctaaggtatgtga

SEQ ID NO: 29862 - DNA, 75 bp, Artificial Sequence
  Synthetic
gcttagccaactcttaaatatacctatttcacaaattttgttaccctgtaacttttgcacagggtttctgaccac

SEQ ID NO: 29863 - DNA, 75 bp, Artificial Sequence
  Synthetic
ttgggaactcctagagtttgattataaggacttccacttggtgtggaaggacggattttgctttggttgctgctc

SEQ ID NO: 29864 - DNA, 75 bp, Artificial Sequence
  Synthetic
aaagtgtgcctttgcatcggcctatcacgagtttacacagtatcatcaggagaccgtggtaggcatagaaataga

SEQ ID NO: 29865 - DNA, 75 bp, Artificial Sequence
  Synthetic
aggcagagcagcagaaagtatacataatcttattgtaaggtgccagttttgtctgaaacgtttggatatatttga

SEQ ID NO: 29866 - DNA, 75 bp, Artificial Sequence
  Synthetic
aaaacttgataattgtgcacagcacagagaattccacaaagttagaaataggtggaaaggggtgtgtagacattg

SEQ ID NO: 29867 - DNA, 75 bp, Artificial Sequence
  Synthetic
cagagtgatagaatgattgggaaacaggctacattacctgacattgtgctacaagaagagtttggccagcccatt

SEQ ID NO: 29868 - DNA, 75 bp, Artificial Sequence
  Synthetic
gacctgcaatgctacgaggatttagcagctgaagtgccagctgaacaacactcagaggaggagcttattcaaggc

SEQ ID NO: 29869 - DNA, 75 bp, Artificial Sequence
  Synthetic
atcccttacaaagtgattgcttgctgtggcggcggatgcggttctcgacttcgtgtgtttgtgcttgctactgat

SEQ ID NO: 29870 - DNA, 75 bp, Artificial Sequence
  Synthetic
cgggctattcgagaatttcaaactttgctgttggaggagctgcaattcctgtgtcctgagtgtcgtgaagaaatt

SEQ ID NO: 29871 - DNA, 75 bp, Artificial Sequence
  Synthetic
tgctgttggaggagctgcaattcctgtgtcctgagtgtcgtgaagaaattcgacatggcggacgataaaggtact

SEQ ID NO: 29872 - DNA, 75 bp, Artificial Sequence
  Synthetic
cagttatttgatgaaaatccacagtccaatatatcagaattaatagatgatgatgaggacgtggagcagggaaat

SEQ ID NO: 29873 - DNA, 75 bp, Artificial Sequence
  Synthetic
tcgcgagatctgtttcgcctgcaggaatttgaggaaagcgcggagcaagtgcaaatgttaaaacgaaagtatttc

SEQ ID NO: 29874 - DNA, 75 bp, Artificial Sequence
  Synthetic
gcaaatgttaaaacgaaagtatttcagtcctaaagctgttcaacaacttagtccacggttgcagtctttgtccat

SEQ ID NO: 29875 - DNA, 75 bp, Artificial Sequence
  Synthetic
gttgtctaatgaagttgaagatattactacggagctggaggtaccggcggtgcagccggcagagcagggtggcca

SEQ ID NO: 29876 - DNA, 75 bp, Artificial Sequence
  Synthetic
gggactgggaaatttgcactataaagagttaatgcgatgcagtaatagtcgtgccagattattaagtaaagttaa

SEQ ID NO: 29877 - DNA, 75 bp, Artificial Sequence
  Synthetic
agaatattttggtgtagggttttatgagttagctaggcaatataaaagtaataaaacgtgctgtagagactgggt

SEQ ID NO: 29878 - DNA, 75 bp, Artificial Sequence
  Synthetic
tattggagcgtatggtgtgcgggaggaattgctggaaggtgcaaaacaattacttctaaatcattgttcttatgt

SEQ ID NO: 29879 - DNA, 75 bp, Artificial Sequence
  Synthetic
gtggattaatatgaatgggattatgtcattattcttgttgtgttttaacaatgcaaaaagcagagaaactgtggg

SEQ ID NO: 29880 - DNA, 75 bp, Artificial Sequence
  Synthetic
atgcaaaaagcagagaaactgtgggaagattactaatgtctatgcttgatgtacaattattgcaattaatatgtg

SEQ ID NO: 29881 - DNA, 75 bp, Artificial Sequence
  Synthetic
acggaacgtatcctgattggattgtgaatcagaccatgttaacacatcaggctgcagcagaagctgtgcaatttg

SEQ ID NO: 29882 - DNA, 75 bp, Artificial Sequence
  Synthetic
atttgtctcaaatgatacaatgggcttatgatactgatctcacagatgaagctgacattgcatatggatatgcaa

SEQ ID NO: 29883 - DNA, 75 bp, Artificial Sequence
  Synthetic
agatggctgagtctgattcaaatgccagagcttggctagcacataatagtcaagcaaaatttgtaagagaatgtg

SEQ ID NO: 29884 - DNA, 75 bp, Artificial Sequence
  Synthetic
cacaaatggtcagacattatcgaagaggggaaatgagagatatgagtatctcagaatggattcattacagaatag

SEQ ID NO: 29885 - DNA, 75 bp, Artificial Sequence
  Synthetic
aacaggtggaaggcgaaggtcattggtctgaaatagttaagttcattagattccaagaaataaattttatattat

SEQ ID NO: 29886 - DNA, 75 bp, Artificial Sequence
  Synthetic
ttcttgatgcattcaaacaattcttgcatggtaaaccaaaaaaaagttgtttattaatatatggaccgcctgact

SEQ ID NO: 29887 - DNA, 75 bp, Artificial Sequence
  Synthetic
gtggaaaatctatgtttgcaatgtcattaataagagtgctaaaagggagagtaatatcatttgttaatgcaaaaa

SEQ ID NO: 29888 - DNA, 75 bp, Artificial Sequence
  Synthetic
gtcaattttggttatcgcctcttgcagaatgtaaaataggattattagatgatgccacagatccatgttggcaat

SEQ ID NO: 29889 - DNA, 75 bp, Artificial Sequence
  Synthetic
atatagatgcatatttaagaaatggaattgatggtaatattgtaagtgtggactgtaaacataaaacaccattac

SEQ ID NO: 29890 - DNA, 75 bp, Artificial Sequence
  Synthetic
aaattagatttcctcctcttttaattacatcaaattataatattaaggacaatgataaatatagatacttgtata

SEQ ID NO: 29891 - DNA, 75 bp, Artificial Sequence
  Synthetic
gcaggattgtgatatttgagtttaagcataagtttccatttaaagaggatggttcaccagaatttcttcttactg

SEQ ID NO: 29892 - DNA, 75 bp, Artificial Sequence
  Synthetic
accaaagctggaaatctttttttaaaaggctttggagtcaattagaactgagtgatcctgaagacgaggcagaca

SEQ ID NO: 29893 - DNA, 75 bp, Artificial Sequence
  Synthetic
cttgaaactcaaatagagcactggaaatgtttaagacaagaacaagtgttgtatttttatgcacgtaaaaaaggc

SEQ ID NO: 29894 - DNA, 75 bp, Artificial Sequence
  Synthetic
atactaagaattgggtatcaacctgtacccacacttgcagtatctgaaactaaggcaaaagaagcaattggaatg

SEQ ID NO: 29895 - DNA, 75 bp, Artificial Sequence
  Synthetic
atgcttacactggagagtttgcaaaaatctccatttggaaaagaatcatggaccttagtaaatacgagtcttgaa

SEQ ID NO: 29896 - DNA, 75 bp, Artificial Sequence
  Synthetic
acatttcgtaccccacctgcaaactgtttcaaaaaggggcctattaatatagaagtaagatttgatggagatcct

SEQ ID NO: 29897 - DNA, 75 bp, Artificial Sequence
  Synthetic
gaaaatataatgttgtatacagcatggacacatatttactttctagatgcagaagaacattggcaaaaagtaaaa

SEQ ID NO: 29898 - DNA, 75 bp, Artificial Sequence
  Synthetic
ggggaagtggactatctaggtgctttttataaggatgggccacataaacattactatatacacttcaatgatgat

SEQ ID NO: 29899 - DNA, 75 bp, Artificial Sequence
  Synthetic
gcccttagatatgggacttctggacaatgggaagtaagaattaacaacgaaactgtgtttactcctgttactagc

SEQ ID NO: 29900 - DNA, 75 bp, Artificial Sequence
  Synthetic
tccacaccaccgtccgcggagctacggggatccgccaacaccagccccgttcccgccgccgaccacaccaggtcc

SEQ ID NO: 29901 - DNA, 75 bp, Artificial Sequence
  Synthetic
cagacgcccaccagcaccacaggaaccaccaccacctacagcacctccaccgttagcaccaagagaccaccagaa

SEQ ID NO: 29902 - DNA, 75 bp, Artificial Sequence
  Synthetic
ctcacatccaaagccaacaccaggaaaggaaggtacggaagaaaagactctagccctacagccacctccaggaaa

SEQ ID NO: 29903 - DNA, 75 bp, Artificial Sequence
  Synthetic
gaggtctcgcggagacggtctcggtccagaaccaggacccggggacgggacgcgagcacaagggccatcagagtc

SEQ ID NO: 29904 - DNA, 75 bp, Artificial Sequence
  Synthetic
agatcccaaaaacccagccgatccagatcgcgatccagatccagagaatcccgaggatccagaggatccagcagc

SEQ ID NO: 29905 - DNA, 75 bp, Artificial Sequence
  Synthetic
tccagaggatcctcccgcaggggcgagcgggggcggggagggcgaggcggaggggcatccaccccccacaaacgg

SEQ ID NO: 29906 - DNA, 75 bp, Artificial Sequence
  Synthetic
gcacaaaggagaagtaggtcccgaggacgaggatcaggagccatttctaacgggtctggcatcgcgcctgacaaa

SEQ ID NO: 29907 - DNA, 75 bp, Artificial Sequence
  Synthetic
gtgggatcaacagtacaaacagttagtggaaaacatcttggacgacttggaaggttactggcagaagctagcgat

SEQ ID NO: 29908 - DNA, 75 bp, Artificial Sequence
  Synthetic
cctccagtaatacttttaagaggcgatccaaacatactaaaatgctttaggtacagagacaagaaaaacagaaag

SEQ ID NO: 29909 - DNA, 75 bp, Artificial Sequence
  Synthetic
ggattggttaaatgttatagtactacatggtcttgggtgcatgcagatggcaatgaaagaataggtagagctagg

SEQ ID NO: 29910 - DNA, 75 bp, Artificial Sequence
  Synthetic
atgcttttagggtttacttctgagcagaatagagcagaatatattaattctatgaaattgcctaaaggtgtggaa

SEQ ID NO: 29911 - DNA, 75 bp, Artificial Sequence
  Synthetic
tggtcctacggtaactttgataggctctaacatgttttaacatactaacttgcttgcactactaacatattaata

SEQ ID NO: 29912 - DNA, 75 bp, Artificial Sequence
  Synthetic
ttttatacttttttactatggttcgtgcccgcagaacaaaaagagattctgtaacccacatttaccaaagctgca

SEQ ID NO: 29913 - DNA, 75 bp, Artificial Sequence
  Synthetic
aagcagctggaacctgtcctccagatgtagttaataaagtggagcaaacaacaattgctgaccagattctgaaat

SEQ ID NO: 29914 - DNA, 75 bp, Artificial Sequence
  Synthetic
atggcagcagtggtgttttctttggtggtttgggtataagcacaggtcgtggaactggaggcagtactggctatg

SEQ ID NO: 29915 - DNA, 75 bp, Artificial Sequence
  Synthetic
tgccattgggtgagggccccggcattcgtgttgggggcactccaaatgttattcggcctagtgtaatacccgagg

SEQ ID NO: 29916 - DNA, 75 bp, Artificial Sequence
  Synthetic
ctattgggcctgtcgatatcattcctattgacactgtcaatccaattgacccaactgcatcatctgtggtcccac

SEQ ID NO: 29917 - DNA, 75 bp, Artificial Sequence
  Synthetic
tcactgaaacaggacctgatttgttgcctggggaaattgagacaattgcagaagtgaaccctgccccagatattc

SEQ ID NO: 29918 - DNA, 75 bp, Artificial Sequence
  Synthetic
ctagagttgacacatctgttgttacatctagcagtggcactagtgcagtgcttgaagttgctcctgaaccagtac

SEQ ID NO: 29919 - DNA, 75 bp, Artificial Sequence
  Synthetic
ctcctacacgaacacgtatttcaagaacacaatatcacaatccttcctttcaggtgctcactgaatccacaccaa

SEQ ID NO: 29920 - DNA, 75 bp, Artificial Sequence
  Synthetic
cattgggggagtctgcattatcagaccaaatcgtggtcaccaatggctctggtgggcaagccattggtggttccc

SEQ ID NO: 29921 - DNA, 75 bp, Artificial Sequence
  Synthetic
gcactgtggaaatagaattagaggaaataccaagcagatacacatttgaaatagaagaacccacccctccaagac

SEQ ID NO: 29922 - DNA, 75 bp, Artificial Sequence
  Synthetic
gcacaagcactcctgttcaaagaattacacagggaattagtaaccttagaaggtctttatataataggagactca

SEQ ID NO: 29923 - DNA, 75 bp, Artificial Sequence
  Synthetic
cacagcagattaatgtgcaagatcctttatttttacaacaaccatcacgtttagtacgtttcacatttgataatc

SEQ ID NO: 29924 - DNA, 75 bp, Artificial Sequence
  Synthetic
ctgcctttgaggatgaagttacacaaatatttgaaagagatgtggctactattgaggaacccccaaatagggatt

SEQ ID NO: 29925 - DNA, 75 bp, Artificial Sequence
  Synthetic
ttttagatatagcaaagctcagtcgtccagtctattcagatactccacagggttatgtacgtgttagtcgactag

SEQ ID NO: 29926 - DNA, 75 bp, Artificial Sequence
  Synthetic
gtaacagagcatctattagaaccaggagtggggctactgtaggagctcaggttcatttttatacagatttaagta

SEQ ID NO: 29927 - DNA, 75 bp, Artificial Sequence
  Synthetic
ctatagatacagaggaatcaatagaattatcactacttggagaacattctggtgatgcttctatagtacaaggcc

SEQ ID NO: 29928 - DNA, 75 bp, Artificial Sequence
  Synthetic
ctgtagaaagtacatttgtaacatcagatttacaagagttacctgtcaatattgtagaggaaactgaacctgaat

SEQ ID NO: 29929 - DNA, 75 bp, Artificial Sequence
  Synthetic
ttcattctgatgatttattgcttgatgaacaaaatgaggattttagtggatcgcaattggtatatggatctggca

SEQ ID NO: 29930 - DNA, 75 bp, Artificial Sequence
  Synthetic
gacggtccattacatatacagtgccgagattcagtacaccacgtgcagatacattttatgtgcaggatttggagg

SEQ ID NO: 29931 - DNA, 75 bp, Artificial Sequence
  Synthetic
gctacactgtttcatatccagaaagaagggattatccagaaataatttatcctcaaccagacctacctgctgttg

SEQ ID NO: 29932 - DNA, 75 bp, Artificial Sequence
  Synthetic
ttatacacacatctgatacttctggggatttctatttacatcctagtttacgaaggcgtaaacgtaaacgagctt

SEQ ID NO: 29933 - DNA, 75 bp, Artificial Sequence
  Synthetic
atttataatatttttttcagatgacttcgctttggttacctacaactggtaaggtttatcttccaccatcaacac

SEQ ID NO: 29934 - DNA, 75 bp, Artificial Sequence
  Synthetic
ctgtggccagggtgcaaagcacggatgaatacattcaaagaacagacatctactatcatgccaatagtgatcgcc

SEQ ID NO: 29935 - DNA, 75 bp, Artificial Sequence
  Synthetic
ttctcactgtaggtcatccatattttgatgttagagacactggagattcaacaaaaatattagtgcctaaagttt

SEQ ID NO: 29936 - DNA, 75 bp, Artificial Sequence
  Synthetic
caggaaatcagtttagagcatttagactgctattaccagatcccaatagatttgcattagtagatatgaatgtct

SEQ ID NO: 29937 - DNA, 75 bp, Artificial Sequence
  Synthetic
acaatccagaaaaagaaagattagtatgggcttgcagaggcttggaaataggtcgaggacagcctttaggggtag

SEQ ID NO: 29938 - DNA, 75 bp, Artificial Sequence
  Synthetic
gttctacaggccatcctttgttcaataaagtaaaggatactgaaaattcaaataattatataacaatgtctaaag

SEQ ID NO: 29939 - DNA, 75 bp, Artificial Sequence
  Synthetic
atgataggcaggacacctcgtttgaccctaagcaggttcaaatgtttattattggctgtgcaccttgtatagggg

SEQ ID NO: 29940 - DNA, 75 bp, Artificial Sequence
  Synthetic
agcactgggatgctgccaaaccctgtgacgctgacaaaggagacggtaaatgtccacctttagaattagtaaata

SEQ ID NO: 29941 - DNA, 75 bp, Artificial Sequence
  Synthetic
cagttattgaggatggggatatggtggatataggttttggtaacataaataataaaaccttgtcagcaaataaat

SEQ ID NO: 29942 - DNA, 75 bp, Artificial Sequence
  Synthetic
cagatgtcagtttggatatagttaataacatttgtaagtatccagacttccttaaaatggccaatgacatatatg

SEQ ID NO: 29943 - DNA, 75 bp, Artificial Sequence
  Synthetic
gggactcctgttttttttatgccagacgggaacaatgttatgctagacacttttttgttaggggaggcaatgtag

SEQ ID NO: 29944 - DNA, 75 bp, Artificial Sequence
  Synthetic
gcgatgcaattcctaatgctgcagtgggtcaggacaataattttatgttacctgcagccgctgggcaggctcaaa

SEQ ID NO: 29945 - DNA, 75 bp, Artificial Sequence
  Synthetic
acactttgggcaactctatttatgttcccacggtcagtggttctttggtgtccacagatgctcaattatttaaca

SEQ ID NO: 29946 - DNA, 75 bp, Artificial Sequence
  Synthetic
ggccattttggctgcaacgagcacagggtcataacaatggtatatgttgggaaaatcaattatttgttactgttg

SEQ ID NO: 29947 - DNA, 75 bp, Artificial Sequence
  Synthetic
ttgacaatactagaaataccaattttaccataagtgttaccacagatggacaaacacctactgattatgacagtg

SEQ ID NO: 29948 - DNA, 75 bp, Artificial Sequence
  Synthetic
gtaaaatacgagagtttttaagacatgttgaggaatatgaattatcagttattttacaattatgtagagtgcctt

SEQ ID NO: 29949 - DNA, 75 bp, Artificial Sequence
  Synthetic
tagagcctgaggtacttgcacaaattaatgcaatgaatccaaatatattggaaaattggcaattaggctttgtac

SEQ ID NO: 29950 - DNA, 75 bp, Artificial Sequence
  Synthetic
cttcgcctgacaatcccatccatgacacttatagatatttaacatcgcaggctactcgatgtccagataaacagc

SEQ ID NO: 29951 - DNA, 75 bp, Artificial Sequence
  Synthetic
ctgcccctgaaaagaaagatccttatgagcaatatactttctggcctgtggatctaactgaaaaattatcgttgg

SEQ ID NO: 29952 - DNA, 75 bp, Artificial Sequence
  Synthetic
atttggatcaatactcgttaggacgcaaattcctttttcaggcaggcttacgaagggcttccaaggtaaccagaa

SEQ ID NO: 29953 - DNA, 75 bp, Artificial Sequence
  Synthetic
cagccagtgtccgttcatcgtccaggggaaccaaacgaaaacgcacatgaccgttttcggtcactgggtcttata

SEQ ID NO: 29954 - DNA, 75 bp, Artificial Sequence
  Synthetic
ataaaatattttataaactcttgtggtatgtcaagcatgttttaaccgagttcgtgactaagattgattaaagcc

SEQ ID NO: 29955 - DNA, 75 bp, Artificial Sequence
  Synthetic
acctgcaaccgcacccggttaatcagattataaaggagcgccaaggtttacctcaagcagcttggcagttacaac

SEQ ID NO: 29956 - DNA, 75 bp, Artificial Sequence
  Synthetic
tggcagttacaacgtgtttcctgccagaagtgtgtgtctgccaacttccctgccaataaccgaatttgttccaac

SEQ ID NO: 29957 - DNA, 75 bp, Artificial Sequence
  Synthetic
tattgttgccaacaatcatcacgccatagaaaaacacgtaaccgcctgcgttataatacaaacagctagtatata

SEQ ID NO: 29958 - DNA, 75 bp, Artificial Sequence
  Synthetic
aatacaggcagtgaaagtgttcccatcacaatggcaaaacctccttcggtgcaggaacttagaagacagttagat

SEQ ID NO: 29959 - DNA, 75 bp, Artificial Sequence
  Synthetic
attccattggaggacattttattgcattgtaatttttgtgaggcttttttaacatttgaggagctactgcaattt

SEQ ID NO: 29960 - DNA, 75 bp, Artificial Sequence
  Synthetic
gatgcaaaaaatttaaatttaatttggaaggagaattatgcttatgcttgctgtggtgcttgtgctaaacaagta

SEQ ID NO: 29961 - DNA, 75 bp, Artificial Sequence
  Synthetic
gcagcaatagaaacaaaacatttttatgagtatagtgtacaaggaaaggatgctatagaaagggactcaggtagt

SEQ ID NO: 29962 - DNA, 75 bp, Artificial Sequence
  Synthetic
cttttgtgttgtttaactgttagatgtaagttttgtttaagacatttggattacttagagaaattggcagtttgt

SEQ ID NO: 29963 - DNA, 75 bp, Artificial Sequence
  Synthetic
gcatcaggcattccttttgatagagttagaggagcttggaaggcagtgtgtaggttttgtacagagatatgattg

SEQ ID NO: 29964 - DNA, 75 bp, Artificial Sequence
  Synthetic
ggaaacaggctactataccagatattgtgctggatctgcaagaccttgtccagcccattgacctgcattgtgacg

SEQ ID NO: 29965 - DNA, 75 bp, Artificial Sequence
  Synthetic
aagacttgtcagaaaatcaggaggaggagcctgcacctcaaagaatagactacaagatagtttcctcgtgtggtg

SEQ ID NO: 29966 - DNA, 75 bp, Artificial Sequence
  Synthetic
gctgcggaattaagcttcgaatttttgcatcgtgtacccaatttggaattagaactctgcaagacctacttcttg

SEQ ID NO: 29967 - DNA, 75 bp, Artificial Sequence
  Synthetic
aagaaatagcgttgctgtgtcctgactgcaaaaatggcagataaaggtatagatcctaaagaaggctgtagtact

SEQ ID NO: 29968 - DNA, 75 bp, Artificial Sequence
  Synthetic
tggtgtttaatagaagctgattgtagtgatgtagatggggattttgaaaagttatttgacaaagacacagactca

SEQ ID NO: 29969 - DNA, 75 bp, Artificial Sequence
  Synthetic
gatatttcagatttattagatgatggggaccttggggacgcagaattgggaaatccccaagagctgctgtgcctg

SEQ ID NO: 29970 - DNA, 75 bp, Artificial Sequence
  Synthetic
caggagagagaggagagcgatctacagctgcagcagttaaaacgaaagtattttagtcctaaagctgttttacag

SEQ ID NO: 29971 - DNA, 75 bp, Artificial Sequence
  Synthetic
cttagtccacaattggaatctattactatttcgcctcaacgcaaaagtaagaggcgactgttcgaggaacaggac

SEQ ID NO: 29972 - DNA, 75 bp, Artificial Sequence
  Synthetic
agcggacttgagctttctttaactcatgaagctgaagattctgttgcggaagtggaggtaccggggtcaaaagat

SEQ ID NO: 29973 - DNA, 75 bp, Artificial Sequence
  Synthetic
gacgtcccagaaactgtttctgctacagcagaaactaagggaagccaaaacaaagaacattacaaacagttacta

SEQ ID NO: 29974 - DNA, 75 bp, Artificial Sequence
  Synthetic
cagtgcagcaatgcgcgggctacattgcttagtaaatttaaagctgcttttggtgttagctttacagagttaacc

SEQ ID NO: 29975 - DNA, 75 bp, Artificial Sequence
  Synthetic
agaagatacaaaagtgataatacatgttgcagagactgggcaattattgtctatgggttgcaggatgaaattatt

SEQ ID NO: 29976 - DNA, 75 bp, Artificial Sequence
  Synthetic
gaaggctcaaagcatttatttcagcagcattgtgaatatatttggttgcatgttttatctccaatatctttgtat

SEQ ID NO: 29977 - DNA, 75 bp, Artificial Sequence
  Synthetic
ttactatgttttaaaactggaaaaagcagaaatactgtaaagaacttgttgatgtccattttaaatgttggggat

SEQ ID NO: 29978 - DNA, 75 bp, Artificial Sequence
  Synthetic
gcacagcttatagctgatccaccccagattcgcagcgtagtagcagctttgttttggtacaaagaatctatgaat

SEQ ID NO: 29979 - DNA, 75 bp, Artificial Sequence
  Synthetic
aaaaatgtatatacccatggagaatacccagagtggatagcaaatcaaacattgctttctcatcaggaatatgaa

SEQ ID NO: 29980 - DNA, 75 bp, Artificial Sequence
  Synthetic
acacagcaatttgatttaagtagaatgattcagtgggcatatgataatgaatatactgaggactcagatattgct

SEQ ID NO: 29981 - DNA, 75 bp, Artificial Sequence
  Synthetic
tatcattatgcaaaattagcagatgaagattcaaatgctcgcgcctttttagctcataacagtcaggcaaaattt

SEQ ID NO: 29982 - DNA, 75 bp, Artificial Sequence
  Synthetic
gttagagaatgtggacagatggtaaggcattataaaagaggagaaatgaaaaatatgagtatgtcagcctggatt

SEQ ID NO: 29983 - DNA, 75 bp, Artificial Sequence
  Synthetic
tatactagattgaaatcaattgaaggaccaggccattggtcagacattgttaaatttatacgatttcagcagatt

SEQ ID NO: 29984 - DNA, 75 bp, Artificial Sequence
  Synthetic
aattttataatgtttctagatgtattcaagcaatttcttgcctcagtacctaaaagaaattgtttattaatttat

SEQ ID NO: 29985 - DNA, 75 bp, Artificial Sequence
  Synthetic
ggtgcacctgattgtggcaaatcaatgttttgtatgtctttaataaaggccttaaagggaaaagttatatcgttt

SEQ ID NO: 29986 - DNA, 75 bp, Artificial Sequence
  Synthetic
gtaaatgctagaagtcaattttggttatctccattagtagaatctaaaattgcactactagatgatgccaccgag

SEQ ID NO: 29987 - DNA, 75 bp, Artificial Sequence
  Synthetic
tgctgttggaattatattgataattatttaagaaatggaatagatggtaacatggttagtgtggattgtaagcat

SEQ ID NO: 29988 - DNA, 75 bp, Artificial Sequence
  Synthetic
aaaaatccggtccaaattagatttccaccattattgattacatcaaataataatataatgtctgatccaaagtat

SEQ ID NO: 29989 - DNA, 75 bp, Artificial Sequence
  Synthetic
aaatatctgcatagtagaattaaagcatttgagtttgtaaataagtttccatttaaggacgatggcagtcccttg

SEQ ID NO: 29990 - DNA, 75 bp, Artificial Sequence
  Synthetic
tttgaacttactgaccaaagctggaaatctttttttcaaaggctttggaggcaattagatctaagtgaccaagaa

SEQ ID NO: 29991 - DNA, 75 bp, Artificial Sequence
  Synthetic
gacgagggtgaggatggaggctctcagcgaccgtttcaatgcactgcaagacaagttaatgacaatttatgaaag

SEQ ID NO: 29992 - DNA, 75 bp, Artificial Sequence
  Synthetic
agctagtgaatccttaaaagatcaaattgaacattggaacttgttaagacaggagcaggtgttatttcattatgc

SEQ ID NO: 29993 - DNA, 75 bp, Artificial Sequence
  Synthetic
cagacaaagaggagtattgcgccttggttatcagccagtacctgcattaactatttcagaggctaaagctaagga

SEQ ID NO: 29994 - DNA, 75 bp, Artificial Sequence
  Synthetic
agccattgctatggttttacatttagaagcattgcaaagatcaccttacaaaaatgaaaaatggacattagtaaa

SEQ ID NO: 29995 - DNA, 75 bp, Artificial Sequence
  Synthetic
tacaagtgtagaaacgtttcgcacacccccagaaaattgttttaaaaagggccctaagactattgaaatagtgta

SEQ ID NO: 29996 - DNA, 75 bp, Artificial Sequence
  Synthetic
tgatggcaatcctgaaaatacaatgttatacactatttggacacatatatattttgaagatgacgaaggcaactg

SEQ ID NO: 29997 - DNA, 75 bp, Artificial Sequence
  Synthetic
gcaaaagactgagggacatttggactatcatggtgcctattttatggatggattaaataaacaatactatatcag

SEQ ID NO: 29998 - DNA, 75 bp, Artificial Sequence
  Synthetic
atttgctcaagacgcacgcagatttagtgaaactggagaatgggaagttaagtttaacaacgaaattttgtttgc

SEQ ID NO: 29999 - DNA, 75 bp, Artificial Sequence
  Synthetic
tcctgttaccagctccaccaactccgaagaagaaagggaccgacccgcccctgccacagaccccggctccctttc

SEQ ID NO: 30000 - DNA, 75 bp, Artificial Sequence
  Synthetic
gcagacatccggaggacagtcccctgtacccactcaacggaagcaaccatctaaaggaaggtacgggcgaaaaga

SEQ ID NO: 30001 - DNA, 75 bp, Artificial Sequence
  Synthetic
ctctggtgctacaaccgcctccagggggatccaaagacgaccgaaagcgtcaccgaggagatcacgatcgcggtc

SEQ ID NO: 30002 - DNA, 75 bp, Artificial Sequence
  Synthetic
aggatcgagatcgggatcacaaggagacgcgcggaccctcctcacagtcagacgcggagaacgggaacggggaca

SEQ ID NO: 30003 - DNA, 75 bp, Artificial Sequence
  Synthetic
aggaaggggacaaggaagccggggtcggggaaggagcggggacagaagcaggagcgggagcagaagcaggagcgg

SEQ ID NO: 30004 - DNA, 75 bp, Artificial Sequence
  Synthetic
gagcaggagaaggagcaggagcaggggcaggagcaggaacggaagggaacgggggagagcagcctccagaggccg

SEQ ID NO: 30005 - DNA, 75 bp, Artificial Sequence
  Synthetic
tagagggtacagcaacaggaggtcaagatccaaatctgttggcacaagtggcataccacctgagcaagtgggaag

SEQ ID NO: 30006 - DNA, 75 bp, Artificial Sequence
  Synthetic
cagcctacaaggtgttggtagacaacatagtggacgacttgcgagattattggacgacgctagggatcccccagt

SEQ ID NO: 30007 - DNA, 75 bp, Artificial Sequence
  Synthetic
aattttgttgaaaggacaagccaatactcttaagtgttatcgctacagggctaaagaaaagtataaaggctatta

SEQ ID NO: 30008 - DNA, 75 bp, Artificial Sequence
  Synthetic
tgattgcttcagtactacatggtcatgggtcagtgcaggtagcaacgatagaataggacgctctagaatgattat

SEQ ID NO: 30009 - DNA, 75 bp, Artificial Sequence
  Synthetic
tagctttaccagtaaatctcaaagacaaatgtttttaagtattatgaaattaccaaagggcgttgattggtctct

SEQ ID NO: 30010 - DNA, 75 bp, Artificial Sequence
  Synthetic
tgggtgctttgactctatttaacacactaacctttctagtttttttactaacacatacgtttcaatagaattgtt

SEQ ID NO: 30011 - DNA, 75 bp, Artificial Sequence
  Synthetic
aatgcatggctcgcgcacgcagaacaaagcgtgattctgttactaatatttacaggacctgcaaagcagcaggca

SEQ ID NO: 30012 - DNA, 75 bp, Artificial Sequence
  Synthetic
cctgcccccctgatgttgttaataaagtggagcagactactgtagctgatcaaattttaaaatatggcagcactg

SEQ ID NO: 30013 - DNA, 75 bp, Artificial Sequence
  Synthetic
gtgtattttttggaggtttgggaattggtacaggaagaggcactggtggtagcactggatatgggccattaggtg

SEQ ID NO: 30014 - DNA, 75 bp, Artificial Sequence
  Synthetic
aagggacgagtgtaagagttggaaatacacccacagttattaggcctgctttggtgcctgaggctataggaccaa

SEQ ID NO: 30015 - DNA, 75 bp, Artificial Sequence
  Synthetic
gtgaactaatacctattgacagtgtcaatcctattgaccccagtgcttcttctatcatacctttaacagagtcaa

SEQ ID NO: 30016 - DNA, 75 bp, Artificial Sequence
  Synthetic
caggtcctgacctcttaccaggtgaaatagaaacaattgcagaggtgcatcctgcccctgacatacctacagtag

SEQ ID NO: 30017 - DNA, 75 bp, Artificial Sequence
  Synthetic
atacaccagtggtgactgggggcagaaactcgaatgctgttctggaggtggctgatccaagtccacccacacgaa

SEQ ID NO: 30018 - DNA, 75 bp, Artificial Sequence
  Synthetic
acagagttagtagaacacaatataacaatcctgcatttcaaatcatatctgaaactacaccaagtgcgggggaaa

SEQ ID NO: 30019 - DNA, 75 bp, Artificial Sequence
  Synthetic
cgtccctatcagaccaaattgttgttcagtcatttgatggtggacaatatataggtggtaacccacctccgcgat

SEQ ID NO: 30020 - DNA, 75 bp, Artificial Sequence
  Synthetic
cagtagttgaaatagaattacaagaaattccctcacaatattcttttgaaatcgaagagccaaccccacctaggc

SEQ ID NO: 30021 - DNA, 75 bp, Artificial Sequence
  Synthetic
aaacaagcactcctgtcagacaggcacaacaaatggcctcagcattacggagggctttatacaatagaaggttca

SEQ ID NO: 30022 - DNA, 75 bp, Artificial Sequence
  Synthetic
cacagcaggttcaagtggaagatccaatgttttatagtagaccttccaggttagttaggtttcaatttgataatc

SEQ ID NO: 30023 - DNA, 75 bp, Artificial Sequence
  Synthetic
ctgtatttgaagaagaagttactcaggtgtttgaaagagacctagaaactatagaagagcctcctgatagacaat

SEQ ID NO: 30024 - DNA, 75 bp, Artificial Sequence
  Synthetic
ttttagatgtacaaaaacttggtaggcctacctatgctgaaacacctgcaggctatataagggttagcagacttg

SEQ ID NO: 30025 - DNA, 75 bp, Artificial Sequence
  Synthetic
gcaaacgagctactataaggaccaggtctggaactacaataggcggtcaggtacatttttttagggatattagca

SEQ ID NO: 30026 - DNA, 75 bp, Artificial Sequence
  Synthetic
gtattgatactcaaccttctattgaactgcaagttcttggggaacattctggcgatgctacaatagtccagggtc

SEQ ID NO: 30027 - DNA, 75 bp, Artificial Sequence
  Synthetic
ctgtggaaagtacgttcgtaaatattgatttggaagagttacctaatttagaggaaaatgtacacctagaatctg

SEQ ID NO: 30028 - DNA, 75 bp, Artificial Sequence
  Synthetic
atgatatacttattgatgaagctatagaggattttagtggtgcccaattagtgtttggaaattctagaagatcaa

SEQ ID NO: 30029 - DNA, 75 bp, Artificial Sequence
  Synthetic
atactgttacattacctcgctttgaaactgtaagggaaacttctttatatactgtagatttagatggattccatg

SEQ ID NO: 30030 - DNA, 75 bp, Artificial Sequence
  Synthetic
tgtcttatcctgagagtagagcgtatccagaagttattcctacagaaccagataataccccaacagtaataattc

SEQ ID NO: 30031 - DNA, 75 bp, Artificial Sequence
  Synthetic
acacagaagattttagtggtgattattatctacatcctagcttaaaatggaagaaacgaaaacgggcctatttat

SEQ ID NO: 30032 - DNA, 75 bp, Artificial Sequence
  Synthetic
aattttttgcagatgtcctattggcttccagcaaatggtaaggtatacttacccccttcaacaccggttgcaagg

SEQ ID NO: 30033 - DNA, 75 bp, Artificial Sequence
  Synthetic
gtacaaagtacggatgaatttgttcaaaggaccaacatcttttatcatgcaaatagtgatcgcctgctgacagtt

SEQ ID NO: 30034 - DNA, 75 bp, Artificial Sequence
  Synthetic
ggacacccttattttgaagtgagaagctcagttgatccacatgatgtattagtgcctaaggtgtcagggaatcag

SEQ ID NO: 30035 - DNA, 75 bp, Artificial Sequence
  Synthetic
tttagagcttttcgactgaaattaccagatcctaatagatttgctttagctgacatgtctgtttataatccagac

SEQ ID NO: 30036 - DNA, 75 bp, Artificial Sequence
  Synthetic
aaggaaaggcttgtttggggctgcaggggattggaaatagggcgagggcagcctttaggtgttggcaccacaggt

SEQ ID NO: 30037 - DNA, 75 bp, Artificial Sequence
  Synthetic
catccattatttaataaggtattggacactgaaaatccaaataagtacaatactggaacaaaggatgacagagta

SEQ ID NO: 30038 - DNA, 75 bp, Artificial Sequence
  Synthetic
aacacatcttttgatccaaagcaaattcagttatttgttttaggatgtacaccatgcttaggtgaacattgggac

SEQ ID NO: 30039 - DNA, 75 bp, Artificial Sequence
  Synthetic
acagccttaccatgtgctgaaaagcaaccagatactgggggatgcccaccattagagttaaaaaacactgttatc

SEQ ID NO: 30040 - DNA, 75 bp, Artificial Sequence
  Synthetic
tctgatggagatatggttgacataggcttcggtaatatgaattttaaggccttatcagtaaccaaatctgacgta

SEQ ID NO: 30041 - DNA, 75 bp, Artificial Sequence
  Synthetic
agtttggatatagtagactccacatgtaaatatccagactttttaaagatgtcaaatgatgtatatggcaactca

SEQ ID NO: 30042 - DNA, 75 bp, Artificial Sequence
  Synthetic
tgttttttctatggacgacgagaacaatgttatgttaggcatatgtttgtgcgcggtggtgttgtgggtgatacc

SEQ ID NO: 30043 - DNA, 75 bp, Artificial Sequence
  Synthetic
atcccagatgcagttgtaaatgaagaccataactttatgttacctgcagcatccagtgaccagtctagaagtcaa

SEQ ID NO: 30044 - DNA, 75 bp, Artificial Sequence
  Synthetic
attgccagttctatctatttccctactgttagtgggtctttggtatccactgatgcacaattatttaatcggcca

SEQ ID NO: 30045 - DNA, 75 bp, Artificial Sequence
  Synthetic
tattggttacaaagagcacaaggccacaacaatggtatttgctggagtaatgaactgtttctgacagtttgtgat

SEQ ID NO: 30046 - DNA, 75 bp, Artificial Sequence
  Synthetic
aataccaggaatactaactttaatattagtgtccctaaggaaggtggtcaaataaccgactatgattcacaaaag

SEQ ID NO: 30047 - DNA, 75 bp, Artificial Sequence
  Synthetic
attagagaatacactagacatgttgaagaatatgaaatatcactaatattacaattatgtaaaattcctttggaa

SEQ ID NO: 30048 - DNA, 75 bp, Artificial Sequence
  Synthetic
gctgagatattagctcaaattaatgcaatgaatccaaatattttggaggactggcagttaggatttgttcctact

SEQ ID NO: 30049 - DNA, 75 bp, Artificial Sequence
  Synthetic
ccagataaccctattcaggatgcatacagatttattcattctaaagcaacaccttgtccagataaagcacaacct

SEQ ID NO: 30050 - DNA, 75 bp, Artificial Sequence
  Synthetic
aaagaaagagaagatccatgggccccatatacattttgggttgtagacttaactgaaaaattatctttagattta

SEQ ID NO: 30051 - DNA, 75 bp, Artificial Sequence
  Synthetic
gatcaatattcattgggtagaaaatttttatttcaagctggattaactaatacatctgttaatggtcttaaaaga

SEQ ID NO: 30052 - DNA, 75 bp, Artificial Sequence
  Synthetic
actagaagcagttctcaaagaggtactaaacgaaaaagaaaaagtaactaaaacggtcagtattctttattgaaa

SEQ ID NO: 30053 - DNA, 75 bp, Artificial Sequence
  Synthetic
ataaaatttttggaactcatgtgttatgagtaatgattattatctattctgactaactcaaacatgttaaccgcg

SEQ ID NO: 30054 - DNA, 75 bp, Artificial Sequence
  Synthetic
cccggtgtattcaatataaacgctgatggtacaagttgtcaaggaacttggcagtctgaactacagtggtgccaa

SEQ ID NO: 30055 - DNA, 75 bp, Artificial Sequence
  Synthetic
cacctggaaggcacacaagatttgcgcgccaaaactacttggcagaacatttcaccgataacggtaagattttat

SEQ ID NO: 30056 - DNA, 75 bp, Artificial Sequence
  Synthetic
acttggcagaacatttcaccgataacggtaagattttatctttaaccgggtgcggtcgttgggttactgtttagg

SEQ ID NO: 30057 - DNA, 75 bp, Artificial Sequence
  Synthetic
tcaaccttgtgagtaatttttaaccgctcctgactaatctaaacatgttaaccgcacccggtgcagagatataaa

SEQ ID NO: 30058 - DNA, 75 bp, Artificial Sequence
  Synthetic
acagaaccctccattgaattgcaactgttaggggaacattctggggatgctagtattgttcaaggcccagtagaa

SEQ ID NO: 30059 - DNA, 75 bp, Artificial Sequence
  Synthetic
gcgccgtcggtcatcagtatctgatctggcagtataacttggaacgcttatgttccaagaacgctgccaaaagga

SEQ ID NO: 30060 - DNA, 75 bp, Artificial Sequence
  Synthetic
agtacatttgttaatatggatgtacaagaaattcctactttggaggaagtgccagaattacattctgaagatgtg

SEQ ID NO: 30061 - DNA, 75 bp, Artificial Sequence
  Synthetic
aaagctgtgcgccaagaccttcccgccaaaactgctgccaagttccagaccgttatcggtaagtttcacccctcc

SEQ ID NO: 30062 - DNA, 75 bp, Artificial Sequence
  Synthetic
ctattagaggaggcattagaagactttagtggagcacaattagtttttggaaattctagaagatcaaatgtaata

SEQ ID NO: 30063 - DNA, 75 bp, Artificial Sequence
  Synthetic
cggttactaaaagttttttttcagatggttgttggcaataattatctgtcagtcataaacatgtaaccgcctgcg

SEQ ID NO: 30064 - DNA, 75 bp, Artificial Sequence
  Synthetic
actattcctagatttgagactccaagagagattaatatttatacaccagatttagatggatattacatatcatat

SEQ ID NO: 30065 - DNA, 75 bp, Artificial Sequence
  Synthetic
tttgtagggcatataatatacatacataaagggattatctcatttgggagatggatttaaagacagtacaggatc

SEQ ID NO: 30066 - DNA, 75 bp, Artificial Sequence
  Synthetic
ccagaaacaaggaatattccagaagttatatacactgagccagacacgactccaacaataataattcatacagag

SEQ ID NO: 30067 - DNA, 75 bp, Artificial Sequence
  Synthetic
ttagaagacatttaggtataccaacagaggatgtgctgctagcttgcaatttttgctctaactttttaagctttg

SEQ ID NO: 30068 - DNA, 75 bp, Artificial Sequence
  Synthetic
gatttcagtggtgattattatttacatccaagtttgagacgaagaaaaagaaaacgagcctatttgtaatttttt

SEQ ID NO: 30069 - DNA, 75 bp, Artificial Sequence
  Synthetic
tagaactattagaatttgataacaaaactttaaatttgatttggaaaaacggctatgcctatggttgctgctcac

SEQ ID NO: 30070 - DNA, 75 bp, Artificial Sequence
  Synthetic
tgcagatgtcatcattgtggttgtcaacaacgggtaaggtctatttaccaccatcaacaccagttgccagggtgc

SEQ ID NO: 30071 - DNA, 75 bp, Artificial Sequence
  Synthetic
gttgtgcagtagcaatagctaaattagaattagaacaattttatgaaaaatctgtaataggtagggaaatagagg

SEQ ID NO: 30072 - DNA, 75 bp, Artificial Sequence
  Synthetic
aaagcacggactcctacatacaaagaacaaacatctattatcatgctaatactgaccgcctgttaacagtaggac

SEQ ID NO: 30073 - DNA, 75 bp, Artificial Sequence
  Synthetic
tagacagtggaagtttgctttgttgtgtagcagtaaggtgttgttattgtttgagattcttagattacttggaga

SEQ ID NO: 30074 - DNA, 75 bp, Artificial Sequence
  Synthetic
atccttattttgatgtgaggaaaaataatggagatcatgaagtgttagttcccaaggtgtcaggtaatcagtaca

SEQ ID NO: 30075 - DNA, 75 bp, Artificial Sequence
  Synthetic
aattatatatctgctctcacaaccaacaattttataaagtgagaggcagttggaaaggtgtttgtagacattgca

SEQ ID NO: 30076 - DNA, 75 bp, Artificial Sequence
  Synthetic
gggcctttagggtacacttaccggatcctaacagatttgctctagctgacatgtcagtggtaaatcctgataggg

SEQ ID NO: 30077 - DNA, 75 bp, Artificial Sequence
  Synthetic
gacagaaatgattgggaaagaagttacaataccagacattgagcttgagctgcaagaccttgtccagcccattga

SEQ ID NO: 30078 - DNA, 75 bp, Artificial Sequence
  Synthetic
agcgtttggtatgggctgttagaggaatggaaattggtcgtggacagccattaggtgtaggtacatcaggacatc

SEQ ID NO: 30079 - DNA, 75 bp, Artificial Sequence
  Synthetic
cctgcattgtgacgaagtattatcacctgaagagtcagaaaacctgtcagaatcttcacaagcagaggtggagcc

SEQ ID NO: 30080 - DNA, 75 bp, Artificial Sequence
  Synthetic
cattatttaacaaggtgaaagacacggaaaatccaaatggctataatacaggtggaaaggatgatagggtgaata

SEQ ID NO: 30081 - DNA, 75 bp, Artificial Sequence
  Synthetic
tgaaagaattctcttcaagattgttgctccgtgtggaggctgtgaagctcgactgaaactgcatatcgcttcttc

SEQ ID NO: 30082 - DNA, 75 bp, Artificial Sequence
  Synthetic
catcctttgatcccaaacaaattcaaatgtttgttttgggttgtataccctgcttgggggaacattgggacaagg

SEQ ID NO: 30083 - DNA, 75 bp, Artificial Sequence
  Synthetic
tcgattgggaattcgttgtttggagaatctgttgctgtctgaaatttgcctactgtgtcctgcttgcagacatgg

SEQ ID NO: 30084 - DNA, 75 bp, Artificial Sequence
  Synthetic
ccttaccttgtgtagaaaatcctcctgatcagggagcgtgtccacctctagaattaaaaaatactattattgaag

SEQ ID NO: 30085 - DNA, 75 bp, Artificial Sequence
  Synthetic
cagacaatagaggtactgatcctaaagaagggtgtagtgaatggttttcactagaggcagaatgtagtgatttag

SEQ ID NO: 30086 - DNA, 75 bp, Artificial Sequence
  Synthetic
atggggacatgggagacatagggtttggaaatcttaattttaaaacattatcagtcactaagtctgatgttagtc

SEQ ID NO: 30087 - DNA, 75 bp, Artificial Sequence
  Synthetic
atgatgatttggaacagcttttggaggaaactaattcaaatatatctgaattaatagatgatggggatgttgttg

SEQ ID NO: 30088 - DNA, 75 bp, Artificial Sequence
  Synthetic
tggatattgttaatgaaatttgcaagtatccagatttcttaaaaatggctaatgatgtgtatggcaatgcttgct

SEQ ID NO: 30089 - DNA, 75 bp, Artificial Sequence
  Synthetic
ataatgctcatgtgcagggactttcccgagatctgtttcgccagcaggagaatgaggagaatgaacagcaaattc

SEQ ID NO: 30090 - DNA, 75 bp, Artificial Sequence
  Synthetic
tcttttatgccagaagagaacaatgttatgccagacatatgttttgtagaggtgggtcagtaggagacagtattc

SEQ ID NO: 30091 - DNA, 75 bp, Artificial Sequence
  Synthetic
aggacctaaaacgaaagtatattagccctttgcagcagcttagccctcgtttggaagcaatttctttgtcgccgc

SEQ ID NO: 30092 - DNA, 75 bp, Artificial Sequence
  Synthetic
cagatgatgcagttggagaagacaaccattattatttaaaggctgccagtgatcaaaacagagatacaatggcaa

SEQ ID NO: 30093 - DNA, 75 bp, Artificial Sequence
  Synthetic
aacacaaatgtaaaaagcggctatttttggaacaggacagcgggcttgagctatctttacccaatgagtctgaag

SEQ ID NO: 30094 - DNA, 75 bp, Artificial Sequence
  Synthetic
gttccatttacactcccacagtcagtggatctttagtttctacagatgcacagattttcaataggcctttttggc

SEQ ID NO: 30095 - DNA, 75 bp, Artificial Sequence
  Synthetic
atactactccagaggtggaggtacccccgaatgttgacgaaggagcagagactggagtgcaggcgagcaatgagc

SEQ ID NO: 30096 - DNA, 75 bp, Artificial Sequence
  Synthetic
tgcaaagggctcaaggccataataatggtatttgctggggtaatcaaatctttctcacagtaatagataatacca

SEQ ID NO: 30097 - DNA, 75 bp, Artificial Sequence
  Synthetic
attatagagaattgctaagatgcagtaatataagagccacgctgctcagcaagtttaaaactacttttggagtgg

SEQ ID NO: 30098 - DNA, 75 bp, Artificial Sequence
  Synthetic
ggaatactaatttctgtatcagtgtctcctcaaatgatcaggcattacaggaatacaatactgcaaactttagag

SEQ ID NO: 30099 - DNA, 75 bp, Artificial Sequence
  Synthetic
gatttatggaactttgtaggaaatataatagtgataaaacgtgctgtcgggactgggttgctacagtatatggtg

SEQ ID NO: 30100 - DNA, 75 bp, Artificial Sequence
  Synthetic
aatatttgagacatgtagaagagtatgaattatcctttatattacaattatgtaaagttccattagagccagaag

SEQ ID NO: 30101 - DNA, 75 bp, Artificial Sequence
  Synthetic
ttaaagaggaactgttagaagcttctaaacaattgttacagcagcactgtggttatatttggcttcatacattgt

SEQ ID NO: 30102 - DNA, 75 bp, Artificial Sequence
  Synthetic
tattagcacaaattaatgctatgaatgcagacattttagaagattggcaattaggttttgttccttctcctgaca

SEQ ID NO: 30103 - DNA, 75 bp, Artificial Sequence
  Synthetic
gtcctgtgtctttatatttgctatgttttcatactggtaaaagtagagaaactgtagtacgattgttaactaaca

SEQ ID NO: 30104 - DNA, 75 bp, Artificial Sequence
  Synthetic
atcccatcaatgatacatatagatacatacattcagcagccacacggtgtccagataaaactacacctaaagaaa

SEQ ID NO: 30105 - DNA, 75 bp, Artificial Sequence
  Synthetic
tgttaagtgtacataaagagcaaatacttactgaaccacctaagcttaaaagtgtcatggcggcactgtattggt

SEQ ID NO: 30106 - DNA, 75 bp, Artificial Sequence
  Synthetic
aagcagatccctttgcaggttatcacttttgggatgttgatttgtctgaaaagttatcattagatttagatcagt

SEQ ID NO: 30107 - DNA, 75 bp, Artificial Sequence
  Synthetic
ataaagaaagtatgaactctaacgtttatgcttttggagactatcctgagtggattgttaatcaaacaattataa

SEQ ID NO: 30108 - DNA, 75 bp, Artificial Sequence
  Synthetic
attctctgggacgtaaattcttatttcaagccaacctgcaaaacaaaagagttaacagaggggttactgtaaccg

SEQ ID NO: 30109 - DNA, 75 bp, Artificial Sequence
  Synthetic
ctcatcatgaaagtactactgtgcaatttgaattgtctcctatgatacagtgggcttacgacaatgatcatatag

SEQ ID NO: 30110 - DNA, 75 bp, Artificial Sequence
  Synthetic
ggagggctacaacctcaagaggtacaaaacgaaaacgacgctgaccgctatcggttcggggaccttcaataaaca

SEQ ID NO: 30111 - DNA, 75 bp, Artificial Sequence
  Synthetic
ctcaagaggtacaaaacgaaaacgacgctgaccgctatcggttcggggaccttcaataaacatatttggaacgtt

SEQ ID NO: 30112 - DNA, 75 bp, Artificial Sequence
  Synthetic
aagaatctgacattgcatttcattatgctaaattagctgaagaagatataaatgctcgtgcatttttagcacata

SEQ ID NO: 30113 - DNA, 75 bp, Artificial Sequence
  Synthetic
ataatcaggctaaaatagttagagattgtgcatggatggtaagacattataaacgaggggaaatgcggcaaatga

SEQ ID NO: 30114 - DNA, 75 bp, Artificial Sequence
  Synthetic
gtatgtccaaatggattcaccataaattgaaatatattgaaaatggaggacattggtcaaatatagttaaatatg

SEQ ID NO: 30115 - DNA, 75 bp, Artificial Sequence
  Synthetic
tgagattccaaggaataaattttataatgtttttagatgcatttaagaatttcttgttatctaaatctaaaaaaa

SEQ ID NO: 30116 - DNA, 75 bp, Artificial Sequence
  Synthetic
attgtattttaatatttggaccttcagattgtggtaaaacaatgttttgcatgtcattaattaaagctttgaaag

SEQ ID NO: 30117 - DNA, 75 bp, Artificial Sequence
  Synthetic
gtagagtgatttcatttgcaaatgctaaaagtcaattttggttacaaccactaactgaatgtaaaattgcaatgc

SEQ ID NO: 30118 - DNA, 75 bp, Artificial Sequence
  Synthetic
tggatgatgctacggaggcttgttggaattatttagatatgtatttaagaaatggcttagatggcaattgggtta

SEQ ID NO: 30119 - DNA, 75 bp, Artificial Sequence
  Synthetic
gtatagactgtaaacataaagcacctatgcaaattaaattccctcctttattaattacctctaactataatattt

SEQ ID NO: 30120 - DNA, 75 bp, Artificial Sequence
  Synthetic
tacaaaatgagaaatttagatttctagttagtagaattacagtatttgaatttaaaaataaatttcctattaatg

SEQ ID NO: 30121 - DNA, 75 bp, Artificial Sequence
  Synthetic
aggatgggtcccctatgtttgaaatcaatgaccaaagctggaaatctttttttcaaaggctttggaagcagttag

SEQ ID NO: 30122 - DNA, 75 bp, Artificial Sequence
  Synthetic
acctaagtgaccaagaagacgagggggaggatggaggctctcaatcaacgtttcactgtactacaagaccagctc

SEQ ID NO: 30123 - DNA, 75 bp, Artificial Sequence
  Synthetic
atggacatttatgaaagaggcagtgataccttagaagaacagataaagcattggactcttttaaaacaagagcaa

SEQ ID NO: 30124 - DNA, 75 bp, Artificial Sequence
  Synthetic
ataatattaaactatgccagaaggagaggcataatgcgattggggtatcatcccgtgccatcattggctatttct

SEQ ID NO: 30125 - DNA, 75 bp, Artificial Sequence
  Synthetic
gaatcaaaagcaaaggatgctattgcaatggcattacatttggaaaatttaaagcggtcaccttataaagatgaa

SEQ ID NO: 30126 - DNA, 75 bp, Artificial Sequence
  Synthetic
ccttggacattaataaatacaagtctagaaacctttagaactgcaccagctaattgttttaaaaaagggcctcaa

SEQ ID NO: 30127 - DNA, 75 bp, Artificial Sequence
  Synthetic
aatgtagaggtgatatttgatgctgatcctgaaaatattatgctttatactgcatggaagtttatttattatgaa

SEQ ID NO: 30128 - DNA, 75 bp, Artificial Sequence
  Synthetic
gatgcagatggacaatggcaaaaaacagagggacatattgattattctggtttatattttttagaaggaactatt

SEQ ID NO: 30129 - DNA, 75 bp, Artificial Sequence
  Synthetic
aaacactattatgtagaatttgctgtagatgctcgcaggtttggttcaggtagtgagtgggaagttcgttttaac

SEQ ID NO: 30130 - DNA, 75 bp, Artificial Sequence
  Synthetic
ggggaaactctgtttgctcctgtcaccagctcctcgccgtcctccctcgaggaaagccgagaacggcccgagtcc

SEQ ID NO: 30131 - DNA, 75 bp, Artificial Sequence
  Synthetic
cagtcccccgacgtccccgaaacaaccaccgacgccggcacccttctgcaacgggaaaccagacctaccgaacgg

SEQ ID NO: 30132 - DNA, 75 bp, Artificial Sequence
  Synthetic
gctgagccacgaaaagggcgaaggtacgagcgaaaagaatctagccctacttccacctccgtcaggggcaggcaa

SEQ ID NO: 30133 - DNA, 75 bp, Artificial Sequence
  Synthetic
agggtatcaggagctcctgcacggaaaaaagacatccgacggtcaagaagcaggtcctcggggcgattcgaaacc

SEQ ID NO: 30134 - DNA, 75 bp, Artificial Sequence
  Synthetic
gaccaagccactgcacggggacggggacaacgacaggccaggctcagaaccagaagcaggagcaggcgcaggagc

SEQ ID NO: 30135 - DNA, 75 bp, Artificial Sequence
  Synthetic
agtagcaggagcagaagcagggggagggacagaaaacaatccaagagagggaggggtggaagggggtacttcgct

SEQ ID NO: 30136 - DNA, 75 bp, Artificial Sequence
  Synthetic
cgatctagaagtagatctgctgaatccagatctgctgaccaatttggcatattaccgccacaagtgggaacagga

SEQ ID NO: 30137 - DNA, 75 bp, Artificial Sequence
  Synthetic
gtacaatctgttggtagaaaacattcttcaagagttgagaggttactggcagaagctgtcgaccccccagtaatt

SEQ ID NO: 30138 - DNA, 75 bp, Artificial Sequence
  Synthetic
ctttttagaggcccaccaaatactttgaaatgctatcgctatagggaaaaggaaagattaaaaggctcttatgac

SEQ ID NO: 30139 - DNA, 75 bp, Artificial Sequence
  Synthetic
agattcagcacaacctggtcatgggtaggatcagagggtaatgcacggttagggagagctcgcatgcttgttagc

SEQ ID NO: 30140 - DNA, 75 bp, Artificial Sequence
  Synthetic
tttttatcagaaaatcagagggatcaatttatagacaaaatgcgattgccaaaagacgttgactggtcatttggt

SEQ ID NO: 30141 - DNA, 75 bp, Artificial Sequence
  Synthetic
aactttgctagcatataacccactaatatagctttttatacttactaataactaacccactatttttgtatggcg

SEQ ID NO: 30142 - DNA, 75 bp, Artificial Sequence
  Synthetic
cgcgcacgcagaactaagcgtgattctgttactaacatttacaggggctgcaaggctgctggtacttgccctcct

SEQ ID NO: 30143 - DNA, 75 bp, Artificial Sequence
  Synthetic
gatgttctaaataaagttgaacaaacaacaattgctgaccagattttaaagtatggcagcactgctgttttcttt

SEQ ID NO: 30144 - DNA, 75 bp, Artificial Sequence
  Synthetic
ggtgggttgggtattagtacaggcaaaggcactggcggtactactggatatgtgccacttggtgaaggacctggg

SEQ ID NO: 30145 - DNA, 75 bp, Artificial Sequence
  Synthetic
gtacgagtaggcggcactctaacagtagttcgcccggggttaattcctgaagcaattggacctactgaactaata

SEQ ID NO: 30146 - DNA, 75 bp, Artificial Sequence
  Synthetic
cctttggacacagtcaaccctattgatccagcagcaccctcaattgtgcctcttacagagtcaggacctgatttg

SEQ ID NO: 30147 - DNA, 75 bp, Artificial Sequence
  Synthetic
ttacctggtgaaattgaaacaatagctgaggtacatcctgtgtcagaagctacacctgttgacacaccagtagtg

SEQ ID NO: 30148 - DNA, 75 bp, Artificial Sequence
  Synthetic
acaggtggcaaaggatctagtgctgtgttagaggttgctgacccaagccctcccacacgctcgcgtgttagtaga

SEQ ID NO: 30149 - DNA, 75 bp, Artificial Sequence
  Synthetic
acacagtatcacaacccatcttttcaaataatatcagagtctacacctactactggagagtcttctttagcagat

SEQ ID NO: 30150 - DNA, 75 bp, Artificial Sequence
  Synthetic
caagtggtagtggaaacaggtagcggagggcaaattattggtgggggaccacctgtagaaattgagttagaggag

SEQ ID NO: 30151 - DNA, 75 bp, Artificial Sequence
  Synthetic
tttcctagtaggtatacatttgaaatagaagaaccaacacctcccaggcgaactagcacacctatacgtagaata

SEQ ID NO: 30152 - DNA, 75 bp, Artificial Sequence
  Synthetic
caggatgctgcaaggtctttaagacgcacactttataatagaagattaacacagcaggttgcagtagaagatccc

SEQ ID NO: 30153 - DNA, 75 bp, Artificial Sequence
  Synthetic
ttattccttcaaaaaccatcacgacttgtgacatttcaatttgataatcctacatttgaggaggaggtgacacaa

SEQ ID NO: 30154 - DNA, 75 bp, Artificial Sequence
  Synthetic
atatttgaaagggatctaagtgctgttgaagaaccaccagacagacaatttttggatgttgttaaacttggtagg

SEQ ID NO: 30155 - DNA, 75 bp, Artificial Sequence
  Synthetic
cctacatatgctgaaacacccgaaggatatataagagttagtagattaggtaaacgtgcgactattcgaacccgg

SEQ ID NO: 30156 - DNA, 75 bp, Artificial Sequence
  Synthetic
tcaggagcacaggttggatcccaagtacattttttcagagatataagtactattgacacagagccttctattgaa

SEQ ID NO: 30157 - DNA, 75 bp, Artificial Sequence
  Synthetic
ttacaattattgggtgaacattcaggagatgcatctattgtacaaggggatgtagaaagcacatttgttaatatg

SEQ ID NO: 30158 - DNA, 75 bp, Artificial Sequence
  Synthetic
gatctacaggaaataccttctttggaagaggtacctgagttacattcagaagatatattactggatgaagccaca

SEQ ID NO: 30159 - DNA, 75 bp, Artificial Sequence
  Synthetic
gatgattttagtggtgctcaattaatatttggtaattccagaaggtcaaatgttataacaattcccagattttct

SEQ ID NO: 30160 - DNA, 75 bp, Artificial Sequence
  Synthetic
agtcctcgagaaatcagtatttatacccctgatttagatggcttccatatctcatatcctgagagtagagagatt

SEQ ID NO: 30161 - DNA, 75 bp, Artificial Sequence
  Synthetic
cctgaagtaatttatacagaaccagacacaacacctactgtaataattcatacagaagactatagtggagattat

SEQ ID NO: 30162 - DNA, 75 bp, Artificial Sequence
  Synthetic
tatttacatccaagtttgaaaagaagaaaaagaaaacgagcctatttgtaatttttttgcagatgtcatcattgt

SEQ ID NO: 30163 - DNA, 75 bp, Artificial Sequence
  Synthetic
ggttatcaacaaccggtaaagtatatttaccaccatcaacaccagttgccagggtgcaaagcacggacacctaca

SEQ ID NO: 30164 - DNA, 75 bp, Artificial Sequence
  Synthetic
taaaacgaacaaacatctattatcatgcaaatagcgatcggttactcactgtaggacatccatattttgatgtca

SEQ ID NO: 30165 - DNA, 75 bp, Artificial Sequence
  Synthetic
gaaaaagcagtggaaatcatgaagtgctggtaccaaaggtgtcaggaaatcaatttagagcctttagagttcatc

SEQ ID NO: 30166 - DNA, 75 bp, Artificial Sequence
  Synthetic
taccagaccctaatagatttgctttagcagataaatctgtagtgaatcctgacactgaaaggttggtatgggctg

SEQ ID NO: 30167 - DNA, 75 bp, Artificial Sequence
  Synthetic
ttagaggaatggaaatagggagaggacaaccattaggagtaggtacctcaggtcatccattattcaataaggtaa

SEQ ID NO: 30168 - DNA, 75 bp, Artificial Sequence
  Synthetic
aagacacagaaaatcctaataattataatttaggtggacaagatgacagggttaatgcatcctttgatcccaagc

SEQ ID NO: 30169 - DNA, 75 bp, Artificial Sequence
  Synthetic
aagtacaaatgttcatattgggatgtgtgccttgtttaggagaacattgggataaggccttaccttgtgctgaag

SEQ ID NO: 30170 - DNA, 75 bp, Artificial Sequence
  Synthetic
atgctccagatccaggttcatgtcctcctttagaattaaagaatacaatcattgaagatggagacatgatagata

SEQ ID NO: 30171 - DNA, 75 bp, Artificial Sequence
  Synthetic
taggttttggcaatttaaattttaaagctttatcagtaaccaagtcagatgtcagtttagatatagttaatgaaa

SEQ ID NO: 30172 - DNA, 75 bp, Artificial Sequence
  Synthetic
cgtgcaaatatccagactttttaaaaatggctaatgatgtttatggtaatgcttgctttttttatgcacgcagag

SEQ ID NO: 30173 - DNA, 75 bp, Artificial Sequence
  Synthetic
aacagtgttatgttaggcatatgttttgtaggggcggttcagtgggtgatactattccagatgatgctgtagggg

SEQ ID NO: 30174 - DNA, 75 bp, Artificial Sequence
  Synthetic
aagacagtaattattatttaaaggctgcaagtggacaaaataaggacacaatggctagctctatttactttccaa

SEQ ID NO: 30175 - DNA, 75 bp, Artificial Sequence
  Synthetic
ctgtaagtggctccttagtgtctaccgatgctcaagtatttaataggcctttttggttacaaagagcacagggtc

SEQ ID NO: 30176 - DNA, 75 bp, Artificial Sequence
  Synthetic
acaataatggtatttgttggggtaatcaaatctttttaacagtagcagacaacactagaaacactaatttctgta

SEQ ID NO: 30177 - DNA, 75 bp, Artificial Sequence
  Synthetic
ttagtgtttcttctaataatcaagcattaactgaatataatacttctaacttcagggaatatttgaggcacgtgg

SEQ ID NO: 30178 - DNA, 75 bp, Artificial Sequence
  Synthetic
aagaatatgaattatcatttatcttgcaactatgtattgtacctttggagcctgaagttttagctcaaattaatg

SEQ ID NO: 30179 - DNA, 75 bp, Artificial Sequence
  Synthetic
caatgaactcagatattttagaagagtggcagttagggtttgtaccctctccagataatccaattagcgacacat

SEQ ID NO: 30180 - DNA, 75 bp, Artificial Sequence
  Synthetic
atagatatatacattcagcagctaccagatgtccagacaaagtaacaccaaaggaaaaatcagatcccttttcac

SEQ ID NO: 30181 - DNA, 75 bp, Artificial Sequence
  Synthetic
agtaccacttttgggatgttgatttaacagagaaattatcattggacttagatcagtattctttagggcgcaagt

SEQ ID NO: 30182 - DNA, 75 bp, Artificial Sequence
  Synthetic
ttttatttcaggcaaatttacaaaacactagagtaaacagaggagtgaccgggagggcttcatcttcaagaggga

SEQ ID NO: 30183 - DNA, 75 bp, Artificial Sequence
  Synthetic
ctaaacgaaagcggcgctgaccggtttcggttacatggaacttcaataaaattatttgcaaccttttcaggtatg

SEQ ID NO: 30184 - DNA, 75 bp, Artificial Sequence
  Synthetic
cggcgctgaccggtttcggttacatggaacttcaataaaattatttgcaaccttttcaggtatgtgagttatttt

SEQ ID NO: 30185 - DNA, 75 bp, Artificial Sequence
  Synthetic
taaggtatgtgagtaatttttgaaccgcccctgactaatctaaacatgctaaccgcacccggtataagctataaa

SEQ ID NO: 30186 - DNA, 75 bp, Artificial Sequence
  Synthetic
atatcctgaggtgatgcagtatctgatcctggcagtcactcctggaacaacaccgatccagtggctttgccaaaa

SEQ ID NO: 30187 - DNA, 75 bp, Artificial Sequence
  Synthetic
gcagtttaaacctgccaagaaaagcccgccaaaacgtctgccaactttggaaccgttaacggtaagtttcgcaac

SEQ ID NO: 30188 - DNA, 75 bp, Artificial Sequence
  Synthetic
tctctcggttgccaaaagttttatcttgagaggttgttggcaattacaacctgccactcataaacaagtaaccgc

SEQ ID NO: 30189 - DNA, 75 bp, Artificial Sequence
  Synthetic
ctgcgtttctaggacattttatatacagacatacagatctctgttcattgttgagatggatttaaagacagtgca

SEQ ID NO: 30190 - DNA, 75 bp, Artificial Sequence
  Synthetic
gcaacttagaagtcatttgggcattcctactgaagacctgttgttagcctgtaacttctgtaagaaatttttaac

SEQ ID NO: 30191 - DNA, 75 bp, Artificial Sequence
  Synthetic
ctttgaggagctattaggatttgatagcaagactttaaatcttatttggaaggaaggttatgcatatgcgtgttg

SEQ ID NO: 30192 - DNA, 75 bp, Artificial Sequence
  Synthetic
tttcaattgtgctagaacagtagccaaagtagaatttgaacatttttatgaaaaaacagtcaagggacgagaaat

SEQ ID NO: 30193 - DNA, 75 bp, Artificial Sequence
  Synthetic
agaatctcgcagtggcagtttactttgttgtattgttgttagatgccagttttgtttgcgactgttagattattt

SEQ ID NO: 30194 - DNA, 75 bp, Artificial Sequence
  Synthetic
agaaaagttaaatatttgtgggtatcaagaaaacttttatttagtaagaggaggttggaaaggcatttgcagata

SEQ ID NO: 30195 - DNA, 75 bp, Artificial Sequence
  Synthetic
ttgtagagagatatgattgggaaagaagcaactataccagacataaagctggagctgcaagaccttgtcctgccc

SEQ ID NO: 30196 - DNA, 75 bp, Artificial Sequence
  Synthetic
attgacctgcattgtgacgaagagttgacagaagagcagtcagaaaacctgtcagaatctacagtagcagaggtg

SEQ ID NO: 30197 - DNA, 75 bp, Artificial Sequence
  Synthetic
gagcctcagagaactctgtacaagattgtagtaccgtgtggaggctgtgattcccggctgaaaatctacgtttct

SEQ ID NO: 30198 - DNA, 75 bp, Artificial Sequence
  Synthetic
gctacacagtttggaattcgttctttagaagacttgctgctagaagaaccttctttgctgtgtcctgcttgcaga

SEQ ID NO: 30199 - DNA, 75 bp, Artificial Sequence
  Synthetic
aatggcagataatagaggtattgatcctaaagaagggtgtagtaattggttttctcttgaagcagactgtagtga

SEQ ID NO: 30200 - DNA, 75 bp, Artificial Sequence
  Synthetic
tttagatgatgatttggaaaagctgtttgaagaagggacaaattcagatttatctgatttaattgatgatgggga

SEQ ID NO: 30201 - DNA, 75 bp, Artificial Sequence
  Synthetic
tgctgttgataatgcgaatgagcagggaatttcccgagatctctttcgccagcaggggagtgaggagtttgagca

SEQ ID NO: 30202 - DNA, 75 bp, Artificial Sequence
  Synthetic
gcaaatacaggacttaaaacgaaagtatttcagtccgaaagagttgcagcagcttagccctcgtttggaagcaat

SEQ ID NO: 30203 - DNA, 75 bp, Artificial Sequence
  Synthetic
acctttgtcgccgcaacacaaatgtaaaaagcggctatttatggaacaggacagcgggcttgagttatcattaac

SEQ ID NO: 30204 - DNA, 75 bp, Artificial Sequence
  Synthetic
tcatgagtgtgaagatactgctccggaggtggaggtacccccaaatactgacggcacagcacggacagaagttca

SEQ ID NO: 30205 - DNA, 75 bp, Artificial Sequence
  Synthetic
ggcgagcaatgagcattatagactattgttaaaatgcagtaatctcagagctacaatgctcagcaaatttaaaaa

SEQ ID NO: 30206 - DNA, 75 bp, Artificial Sequence
  Synthetic
cagctttggggtggggtttatggaactgtgtaggaaatttaatagcaataagacttgttgtcgggactgggtcgt

SEQ ID NO: 30207 - DNA, 75 bp, Artificial Sequence
  Synthetic
aactgcatatggagttaaagaggaattattagaaggatgtaagcaactgttacaagaacattgtggttatatatg

SEQ ID NO: 30208 - DNA, 75 bp, Artificial Sequence
  Synthetic
gcttcatacactatgtccaatgtcactctttctattgtgttttaaaactggtaaaagcagagatacagttgtaag

SEQ ID NO: 30209 - DNA, 75 bp, Artificial Sequence
  Synthetic
attgttacaaaggatgttaagtattcataaagagcaactcttaactgaaccaccaaagttacgaagtgttatggc

SEQ ID NO: 30210 - DNA, 75 bp, Artificial Sequence
  Synthetic
tgtactttactggtataagggcagtatgaatccaaatatctatgcatttggggagtatccagactggattgttca

SEQ ID NO: 30211 - DNA, 75 bp, Artificial Sequence
  Synthetic
gcaaacgatgattagtcaccatgagggcgataatttgcaatttgaattgtctcctatggtacaatgggcctatga

SEQ ID NO: 30212 - DNA, 75 bp, Artificial Sequence
  Synthetic
caatgactatatcgaagattctgacattgcatataactatgctaaattagctgacgaagacataaatgctcgcgc

SEQ ID NO: 30213 - DNA, 75 bp, Artificial Sequence
  Synthetic
gtttttagctcataataaccaagcaaaaattgttagagattgtgcttggatggtaagacattacaaacgaggtga

SEQ ID NO: 30214 - DNA, 75 bp, Artificial Sequence
  Synthetic
aatgagatatatgtctatttctaaatggatatggtataaattaaaaaaagtagaaaatggcggccactggtcaaa

SEQ ID NO: 30215 - DNA, 75 bp, Artificial Sequence
  Synthetic
catagtaaaatttgttagattccaaggtataaattttataatgtttttagatgccttcaaacacttccttttgtc

SEQ ID NO: 30216 - DNA, 75 bp, Artificial Sequence
  Synthetic
tagaacaaaaaaaaactgtattttattttatggtccttctgattgtggcaaaacgatgttttgcatgtcactaat

SEQ ID NO: 30217 - DNA, 75 bp, Artificial Sequence
  Synthetic
taaagctctcggtggtagggtgatttcatttgccaatgcaaaaagtcaattttggttacaacctttaacggaaag

SEQ ID NO: 30218 - DNA, 75 bp, Artificial Sequence
  Synthetic
caagattgctatgttagatgatgctacagaagcttgttggaattatttagatacctatttaagaaatggtttaga

SEQ ID NO: 30219 - DNA, 75 bp, Artificial Sequence
  Synthetic
tgggaattgggttagtgttgattgcaaacataaagctcccatacagattagatttcctccattattgattacctc

SEQ ID NO: 30220 - DNA, 75 bp, Artificial Sequence
  Synthetic
caattatgatattttaaaaaatgagaggtatagatttttggttagcagaattaaaatatttgaatttaagaataa

SEQ ID NO: 30221 - DNA, 75 bp, Artificial Sequence
  Synthetic
atttccttttaatgaagatggtacccctatgtttgaacttactgaccaaagctggaaatctttttttcaaaggct

SEQ ID NO: 30222 - DNA, 75 bp, Artificial Sequence
  Synthetic
ttggaagcagttagatctaagtgaccaagaagacgagggggaggatggaggctctgaaccagcgtttcaatgctc

SEQ ID NO: 30223 - DNA, 75 bp, Artificial Sequence
  Synthetic
tagaagaccagctcatggacatatatgaacaagggagtgataaattagaagatcaaataaaacattggaactttt

SEQ ID NO: 30224 - DNA, 75 bp, Artificial Sequence
  Synthetic
taagaaaagaacagattttattgcattatgccaggaggcgaggcattatgcgtttggggtacactcctgttccta

SEQ ID NO: 30225 - DNA, 75 bp, Artificial Sequence
  Synthetic
gtttagcagcttcagaaacaaaagctaaagatgttatttacatggttcttcaactagagaaattaagagactcac

SEQ ID NO: 30226 - DNA, 75 bp, Artificial Sequence
  Synthetic
cttacaaagatgaaccttggacattgattaacaccagtttagaaacatatagagctcctcctgttaactgcttta

SEQ ID NO: 30227 - DNA, 75 bp, Artificial Sequence
  Synthetic
aaaaaggtcctcaaaatgtagaggttatttttgatgcagatcctgaaaatattatgttatacacatcctggcagt

SEQ ID NO: 30228 - DNA, 75 bp, Artificial Sequence
  Synthetic
tcatttactttgaagacactgatggacattggcaaaaaactgaagggcgtattgattatgctggtttatattatt

SEQ ID NO: 30229 - DNA, 75 bp, Artificial Sequence
  Synthetic
tggaagggcaattaagacattattacgtggaatttaaagtagatgctcgcagatttggaactagtggagaatggg

SEQ ID NO: 30230 - DNA, 75 bp, Artificial Sequence
  Synthetic
aagtgcgttttaacggggaaactatctttgctcctgttaccagctcctcgccgtcctcatacgaagaggtcagag

SEQ ID NO: 30231 - DNA, 75 bp, Artificial Sequence
  Synthetic
aacgggctgagccccccgacgtccccgaggtcggaaccgcccctgactccggcaccctacagactgggagacctg

SEQ ID NO: 30232 - DNA, 75 bp, Artificial Sequence
  Synthetic
gaaccgaaaccgccaaagggcgaaggtacggacgaaaagaatctagtcctacagttgcctccctcagggtcaggc

SEQ ID NO: 30233 - DNA, 75 bp, Artificial Sequence
  Synthetic
aaaaagtatcacgatctactacacggaaagccgaagaacgacggtcccggagtccatcgtcagggacagagcaag

SEQ ID NO: 30234 - DNA, 75 bp, Artificial Sequence
  Synthetic
ccggtgcacggggacggggacaacggggaaccagggcccgttccagaaccagaagcaggagcaggcgccggagca

SEQ ID NO: 30235 - DNA, 75 bp, Artificial Sequence
  Synthetic
ggagcagcagcagagccagaagcaggagggcaagggaacactcagaatcgaggggagggagaggtagaggggcgt

SEQ ID NO: 30236 - DNA, 75 bp, Artificial Sequence
  Synthetic
acgccacaagatccagaagtagatctgcagagtgcagatctattgaccagtgtggcattccagcttcacaagtgg

SEQ ID NO: 30237 - DNA, 75 bp, Artificial Sequence
  Synthetic
gaaggtcagttcaatcagttggtagaaacaattcttcgagacttaagagattactggatgaagctctcgaccccc

SEQ ID NO: 30238 - DNA, 75 bp, Artificial Sequence
  Synthetic
cagtgatattgttaagaggggaaccaaatactttaaaatgttatcgctacagggtgaaagacaaacttagaggct

SEQ ID NO: 30239 - DNA, 75 bp, Artificial Sequence
  Synthetic
cttttgataaaattagtacaacatggtcatgggtggcttcacaaggtaatacacgcataggtagagctcgcatgc

SEQ ID NO: 30240 - DNA, 75 bp, Artificial Sequence
  Synthetic
tgcttagctttgtttcagaagatcagagggaaaaatttatcaatgttatgaaattacctaagggtgttgattggt

SEQ ID NO: 30241 - DNA, 75 bp, Artificial Sequence
  Synthetic
cctttggtagctttgatagtctttaactactaacatttcatttttttatactaataactaacccactttatatat

SEQ ID NO: 30242 - DNA, 75 bp, Artificial Sequence
  Synthetic
tgtatggcgcgcgcacgtagagtaaagcgtgattctgttacaaatatttacaggggctgtaaggcagctggcaca

SEQ ID NO: 30243 - DNA, 75 bp, Artificial Sequence
  Synthetic
tgcccccctgatgttattaataaagttgaacaaaaaactattgctgaccaaattttaaagtatggcagcaccgct

SEQ ID NO: 30244 - DNA, 75 bp, Artificial Sequence
  Synthetic
gcgttttttggtgggttgggtattagtacaggcaaaggaactggaggcagtactggttatgtccctttgcctgaa

SEQ ID NO: 30245 - DNA, 75 bp, Artificial Sequence
  Synthetic
ggacctgcacctggtgttcgcgtgggtggtacaccaactgtggtgcgccccggggtcattccagaagcgattggt

SEQ ID NO: 30246 - DNA, 75 bp, Artificial Sequence
  Synthetic
cctactgatataatacctttggatacagtcaaccctattgaccctgttgcaccttcagttgtccctcttacagac

SEQ ID NO: 30247 - DNA, 75 bp, Artificial Sequence
  Synthetic
acaggacctgatttgttgccaggagaaattgagaccattgctgaggtacatcctgtgtcagatgtaacacctgtt

SEQ ID NO: 30248 - DNA, 75 bp, Artificial Sequence
  Synthetic
gacacaccagtggtgacaggtggtagaggctcgagtgcagtattagaggttgctgacccaagtcctcccactcgt

SEQ ID NO: 30249 - DNA, 75 bp, Artificial Sequence
  Synthetic
gcacgtgtcagtagaacacaatatcataacccagcttttcaaataatatctgaaacaacaccaacaactggggaa

SEQ ID NO: 30250 - DNA, 75 bp, Artificial Sequence
  Synthetic
gcgtcgttatctgaccaaatcattgtacaatcaggttctggaggacaaaatattggtggtagtgggccttctgtg

SEQ ID NO: 30251 - DNA, 75 bp, Artificial Sequence
  Synthetic
gaaatagaattagaagagttccccacaagatattcatttgaaatagaagagccaacccctcctagaaaaactagt

SEQ ID NO: 30252 - DNA, 75 bp, Artificial Sequence
  Synthetic
acacctgtaagaatggctcagcaggcctcacgagctttacgtagagctttatacaatcgtagattaacacaacag

SEQ ID NO: 30253 - DNA, 75 bp, Artificial Sequence
  Synthetic
gtttctgtagaaaatcctctatttttacaacagccttctaaattagttacttttcaatttgataaccctgcatat

SEQ ID NO: 30254 - DNA, 75 bp, Artificial Sequence
  Synthetic
gaggaggaaataacacaaatatttgagagggatttaagctccattgaagaacctccagatagacaatttatggat

SEQ ID NO: 30255 - DNA, 75 bp, Artificial Sequence
  Synthetic
gttgttaaattaggtaggcctacatatgctgaaacaccagaaggttacattagagtcagtagacttgggaaacga

SEQ ID NO: 30256 - DNA, 75 bp, Artificial Sequence
  Synthetic
gcaaccatcagaacacgctctggagcacaggttggcactcaagttcacttttacagagatataagcactattgac

SEQ ID NO: 30257 - DNA, 75 bp, Artificial Sequence
  Synthetic
atggcgggcaggccgctatctgccaccgcactggcagaggagctaggaataggtataaaagatttgcaggtacca

SEQ ID NO: 30258 - DNA, 75 bp, Artificial Sequence
  Synthetic
tgtaacttctgccattctacactttcaggggcagatgttctggcgtttgactataaatgcctcaatttattatgg

SEQ ID NO: 30259 - DNA, 75 bp, Artificial Sequence
  Synthetic
aaggagggggtagcgtatgcagcatgtagcccatgttgtgcagctacagcggcctatgaggtacaggtgcattac

SEQ ID NO: 30260 - DNA, 75 bp, Artificial Sequence
  Synthetic
gaattctccgtttatgggagagaaattgagaggataactaatacccctctgtggaatatcatagtccgatgctgg

SEQ ID NO: 30261 - DNA, 75 bp, Artificial Sequence
  Synthetic
aattgtcttaagctattggatcttttagagaaaaacgacatttgtgctagacgtcagcaatttcatagagtcaga

SEQ ID NO: 30262 - DNA, 75 bp, Artificial Sequence
  Synthetic
ggtggttggaagggtaattgtaggcactgtagagaggtagaatgattgggaaagagcctactatacgagatattg

SEQ ID NO: 30263 - DNA, 75 bp, Artificial Sequence
  Synthetic
tgctggagctagaagacgctgtccagcccattgacctgcattgcaacgaagaggtgctagaagaacaggtagagg

SEQ ID NO: 30264 - DNA, 75 bp, Artificial Sequence
  Synthetic
aggagccagaaaagaatcctttcaaggtgctggtgtcctgtggaggaggctgtggatccaagttacgtttgtttg

SEQ ID NO: 30265 - DNA, 75 bp, Artificial Sequence
  Synthetic
tgaccgcgacagcatatggcatccggacctttcaacacgtcttactatctgagctgagcattttgtgtccggagt

SEQ ID NO: 30266 - DNA, 75 bp, Artificial Sequence
  Synthetic
gccgagaaaccactcgtgaggaaacaagacagagggacctgaaccgccttcgcaatgggagattctagaggtact

SEQ ID NO: 30267 - DNA, 75 bp, Artificial Sequence
  Synthetic
gatgatgttaaacctggctgtagtgattggtttgagttggaagctgaatgtagtgatattgagaatgatttggaa

SEQ ID NO: 30268 - DNA, 75 bp, Artificial Sequence
  Synthetic
aagctatttgaagatgacactgactctaatatttcaggactgatagatgatggggacgtgatacagggaaattcc

SEQ ID NO: 30269 - DNA, 75 bp, Artificial Sequence
  Synthetic
catgagctatttcacctgcaggagtgtgaggaaaatgagcagcagttgcaatttctaaaacgaaagtatttcagt

SEQ ID NO: 30270 - DNA, 75 bp, Artificial Sequence
  Synthetic
cctttagctgtgcagcagttaagccccaggttacagtcgatcactatctctccagagcacaaaagtaaaaggagg

SEQ ID NO: 30271 - DNA, 75 bp, Artificial Sequence
  Synthetic
ctatttgtggagcaagacagcggtgttgatttgacccaaaatgaagttgaagatattcctgaagaggaggtggag

SEQ ID NO: 30272 - DNA, 75 bp, Artificial Sequence
  Synthetic
gtaccgacggacagtgtagataatgttcctgcacctgctgttcaggaacctgctgttcagggagtcaggggacag

SEQ ID NO: 30273 - DNA, 75 bp, Artificial Sequence
  Synthetic
ggttctttgcattacaaggaactgctaaagacggctaatgtccgatctactatgcttggcaaattcaaaactgca

SEQ ID NO: 30274 - DNA, 75 bp, Artificial Sequence
  Synthetic
tttgactgtagctttacagaattaacgagacaatataaaagtaataagacgtgctgtcgcgactgggtgactatg

SEQ ID NO: 30275 - DNA, 75 bp, Artificial Sequence
  Synthetic
ctgtatggtgtaagggatgaattgctggaggcttcaaagcagctgttacaacagcattgttcttacatttggctc

SEQ ID NO: 30276 - DNA, 75 bp, Artificial Sequence
  Synthetic
tcgtctgtaggagccatgacgctatacttattaagctttaatagtgccaaaagccgagataccttacacagatta

SEQ ID NO: 30277 - DNA, 75 bp, Artificial Sequence
  Synthetic
ttaatgtctatacttgacgtgcatgagttgcagttaatatcagagcctccacgattgaggagtatggcagcggcc

SEQ ID NO: 30278 - DNA, 75 bp, Artificial Sequence
  Synthetic
ttgttctggtatagggggagcatgggtaatgctgtgtatgcattcggggcgtatccggactggattgtgcggcaa

SEQ ID NO: 30279 - DNA, 75 bp, Artificial Sequence
  Synthetic
acaatgctaaaccatcacacaggagaatgtccgcagtttgatctaagcactatggtgcagtgggcatatgacaat

SEQ ID NO: 30280 - DNA, 75 bp, Artificial Sequence
  Synthetic
gattacgtagaagaagcagatatagcttataactatgcaaagctagcagatgaagacgcaaatgcccgtgcatgg

SEQ ID NO: 30281 - DNA, 75 bp, Artificial Sequence
  Synthetic
ctaagtagcaatagccaggcaaagtttgtaagagaatgtgctcaaatggttaggcactataaacgtggagaaatg

SEQ ID NO: 30282 - DNA, 75 bp, Artificial Sequence
  Synthetic
cgtgatatgtcgatgtcctgctggatacataagtgtttaaaacgtattgagggagacgggtcgtgggccgacata

SEQ ID NO: 30283 - DNA, 75 bp, Artificial Sequence
  Synthetic
gtaaagtttataagattccagaatattaatttcattatatttctagatactttcaaacgttttctaaaaagtgtg

SEQ ID NO: 30284 - DNA, 75 bp, Artificial Sequence
  Synthetic
cccaaacaaaacacccttttaatatgggggcccccagatacagggaagtccacattctccatgtccctattgaaa

SEQ ID NO: 30285 - DNA, 75 bp, Artificial Sequence
  Synthetic
gccctaaagggcagagtgctttcatttgtgaattccagaagccagttttggttgcagcctgttgcagagtgcaaa

SEQ ID NO: 30286 - DNA, 75 bp, Artificial Sequence
  Synthetic
atagctttgcttgatgatgccacggaccctgcgtggacatatatagacacgtttctgaggaatggtctagatggt

SEQ ID NO: 30287 - DNA, 75 bp, Artificial Sequence
  Synthetic
aactgcgtgtcaatagactgtaagcacagggcccctacacaagtaagattccctcccctgttgataacgtccaac

SEQ ID NO: 30288 - DNA, 75 bp, Artificial Sequence
  Synthetic
tacaatataatggtagaggacagatacaggtatttgcatagtaggataagggcatttgagtttcccaacaaattt

SEQ ID NO: 30289 - DNA, 75 bp, Artificial Sequence
  Synthetic
ccctttaaagatgatggtactccgcagtttaacctcactgaccaaagctggaaatctttttttagaaggctgtgg

SEQ ID NO: 30290 - DNA, 75 bp, Artificial Sequence
  Synthetic
agtcagttagacctcagtgaccaagaagacgagggagacgatggagactctcagcgaacgttttcatgcactgca

SEQ ID NO: 30291 - DNA, 75 bp, Artificial Sequence
  Synthetic
agagaaactaatggaaatatatgaatcaggcaaaaacaccatagctgctcaaattgaacattggcaattattgag

SEQ ID NO: 30292 - DNA, 75 bp, Artificial Sequence
  Synthetic
gcaagaacaggtgttactgcactttgctagaaaacgtggtgtgacacgtttggggtaccagcctgtgcccaacct

SEQ ID NO: 30293 - DNA, 75 bp, Artificial Sequence
  Synthetic
ggcaataaccgaacaaaaagctaaagacgccataggtatgggcctgctgttgcagtccctggagaagtctcccta

SEQ ID NO: 30294 - DNA, 75 bp, Artificial Sequence
  Synthetic
tggtggggagtcatggtcattggttgacacaagcctagagacttttagaagccctccacagcagtgtttcaaaaa

SEQ ID NO: 30295 - DNA, 75 bp, Artificial Sequence
  Synthetic
gggcggacaggaagtggaggtcagatttgatggtgaccctgagaatattatgctgtatacttcgtggcagcacat

SEQ ID NO: 30296 - DNA, 75 bp, Artificial Sequence
  Synthetic
ctacttccaagattcccacgattcttggcaaaaagtacaagggcaagtggactatgatggactgttttactttga

SEQ ID NO: 30297 - DNA, 75 bp, Artificial Sequence
  Synthetic
cggccctgtaaaggtgtactatgttacatttgggactgatgcaaagagatatggtaaaactggactttgggaggt

SEQ ID NO: 30298 - DNA, 75 bp, Artificial Sequence
  Synthetic
tgtctataataaggacattatctttgctcctgtcaccagttcaacgccggagggacagggatcaccagcccccgc

SEQ ID NO: 30299 - DNA, 75 bp, Artificial Sequence
  Synthetic
cgactccaacaccgcagaaggatcccaacaccccactgaagtggtatcagtcgattcggccaccacctctgcccc

SEQ ID NO: 30300 - DNA, 75 bp, Artificial Sequence
  Synthetic
cgcagccacctctgccaccgctaaacagcgagccagaaggtacgggcgaaaagcctccagtccaggaggaggaga

SEQ ID NO: 30301 - DNA, 75 bp, Artificial Sequence
  Synthetic
acgaggatactcgcccctcaaagaaaaccaaagagaacggcgaccacacaagcggggacggggagaaagaggggg

SEQ ID NO: 30302 - DNA, 75 bp, Artificial Sequence
  Synthetic
gagatcccgatcccggtcccgtgccacatcccgatcccgatcccgatcccgatcccgaacccgaacccgagcccg

SEQ ID NO: 30303 - DNA, 75 bp, Artificial Sequence
  Synthetic
accccaatccgcaaccacaacccatccctgcacccgatccagatctagatccaggccaggttgcgtcctttctgg

SEQ ID NO: 30304 - DNA, 75 bp, Artificial Sequence
  Synthetic
agggggtggcgtcctaccttcacaggtgggaagtcggctatcaacagttggtcaaggacatcaaggaagacttgg

SEQ ID NO: 30305 - DNA, 75 bp, Artificial Sequence
  Synthetic
acaactattggctgaagctacagaccccccagtaattctcctgcggggtgatccaaacgctgttaaatgcttccg

SEQ ID NO: 30306 - DNA, 75 bp, Artificial Sequence
  Synthetic
ctttagagctaaagataaatataggggcttatatacccgtatgagcaccacatggtcctgggtgggggcagacaa

SEQ ID NO: 30307 - DNA, 75 bp, Artificial Sequence
  Synthetic
caatgataggataggtagagccagaatgctggtggcgtttagcagctatgaacagcgacatcttttccttaagca

SEQ ID NO: 30308 - DNA, 75 bp, Artificial Sequence
  Synthetic
tctaaaagtcccaaaagggatggattggtctcttggccagtttgacagcttgtgaggcgtctgaccgtgtcgcag

SEQ ID NO: 30309 - DNA, 75 bp, Artificial Sequence
  Synthetic
caccctcccccacaggtcctgcaacatttcacccattcactaaccttgtaacatttcagatatccttgtaccatt

SEQ ID NO: 30310 - DNA, 75 bp, Artificial Sequence
  Synthetic
tcagagattcactaaccctgtacatagtgtcttttttacttaccaccaatactaaccactaacagcactcctgcc

SEQ ID NO: 30311 - DNA, 75 bp, Artificial Sequence
  Synthetic
atttcaatgctgctctatgaccatggcccgcgcacgcagaacgaagcgtgcctctgtaaccgacatctacagggg

SEQ ID NO: 30312 - DNA, 75 bp, Artificial Sequence
  Synthetic
ctgcaaagctgctggcacctgcccacaagacgttctcaataaagttgagcagacaaccattgcagaccaaatcct

SEQ ID NO: 30313 - DNA, 75 bp, Artificial Sequence
  Synthetic
caaatatggcagtgctggtgtgtttttcggcggccttgggatctccacgggcagaggctcaggtggtgccaccgg

SEQ ID NO: 30314 - DNA, 75 bp, Artificial Sequence
  Synthetic
ctacaccccgctgggagggccgggggtgcgcgtcggggcccccaccgtcatacggccgggtgtggcccctgaggt

SEQ ID NO: 30315 - DNA, 75 bp, Artificial Sequence
  Synthetic
ggttggtccctccgatatcatcccgctggattctctggggaccatagacccttcagcgccatctgtggtgacact

SEQ ID NO: 30316 - DNA, 75 bp, Artificial Sequence
  Synthetic
tactgagggtggccccgaccttctccctggaggcgtggaatctattgcggaaattagccctgtgcccgatgttgc

SEQ ID NO: 30317 - DNA, 75 bp, Artificial Sequence
  Synthetic
gtccgtggacgcccccgttgttacgattgacacaggtgcaagtgctgtcctggaggttgcgccggagcctgcgcc

SEQ ID NO: 30318 - DNA, 75 bp, Artificial Sequence
  Synthetic
ccccacacgcacaagaatcagtcagcagcagtatcacaaccctgcgtttgaagttcttagtgaggtcacacccag

SEQ ID NO: 30319 - DNA, 75 bp, Artificial Sequence
  Synthetic
ccgtggtgagacgtcgcatggcgaccaagtgtttgtcaccagcggcattgggggtcaaactgttggaggggcggc

SEQ ID NO: 30320 - DNA, 75 bp, Artificial Sequence
  Synthetic
caccagggggcccaccattgagatcgagctagaaaatctccctacacagtacacatttgaaatcgcggagcccac

SEQ ID NO: 30321 - DNA, 75 bp, Artificial Sequence
  Synthetic
gccaccacgacaaaccagcactccggtgcagcgtggagtggccatcgcccgcagacttggcagggcctttactaa

SEQ ID NO: 30322 - DNA, 75 bp, Artificial Sequence
  Synthetic
tcgcaggctgactcaacaggttcctgtgagagaccccctctttttgacacagccacagaagcttgttaggttcca

SEQ ID NO: 30323 - DNA, 75 bp, Artificial Sequence
  Synthetic
gtttgagaaccctgcattcgaggatgaagttacacagatctttgagagggatctcagtgtccttgaggagccgcc

SEQ ID NO: 30324 - DNA, 75 bp, Artificial Sequence
  Synthetic
ggaccgagattttctggatgttgctcgcctgggccgcgcaaccttcagcgagacccccgcgggctacattaggct

SEQ ID NO: 30325 - DNA, 75 bp, Artificial Sequence
  Synthetic
cagtaggctagggaatagggccaccatccgcactcgcagcggagccgcaataggcagccaggtacatttctacag

SEQ ID NO: 30326 - DNA, 75 bp, Artificial Sequence
  Synthetic
agatctcagcagcatagacactgcagaatcactggagctaagcctattaggggaacattctggagacgctagtgt

SEQ ID NO: 30327 - DNA, 75 bp, Artificial Sequence
  Synthetic
ggtccagggctccgcggaaaccgcatttgtgaatgtggatctgcaggatgttcctggagtttcctcagacagccc

SEQ ID NO: 30328 - DNA, 75 bp, Artificial Sequence
  Synthetic
agaatattctgatgcatactccgatgcatttctgctggatgaagcagtggaggattttagtggctcacaattgat

SEQ ID NO: 30329 - DNA, 75 bp, Artificial Sequence
  Synthetic
atttggagatggaaggcaaaccagcacagttacagttcccagattcagcactacacgcaatgccagctattatac

SEQ ID NO: 30330 - DNA, 75 bp, Artificial Sequence
  Synthetic
ccaggatctcgagggctatgcggtgtcctatccagaacaaaggcagttccctgaaataatctatccccaaccgga

SEQ ID NO: 30331 - DNA, 75 bp, Artificial Sequence
  Synthetic
tcttccaacagtagtaattcgcacatctgatagtagtggtgacttttacttacaccctagtcttctacggctgaa

SEQ ID NO: 30332 - DNA, 75 bp, Artificial Sequence
  Synthetic
aaggaaacgaaaatatctataatttctttgcagatgtcatactggcttcctgctaccggtaaggtctacctgccc

SEQ ID NO: 30333 - DNA, 75 bp, Artificial Sequence
  Synthetic
ccatccacgccagtggccagggtccaaagcacagatgagtatatacaccgcactaacatattttatcatgccaat

SEQ ID NO: 30334 - DNA, 75 bp, Artificial Sequence
  Synthetic
agcgacagattgcttatcgtgggtcacccttacttcaatgtcctcaattccactggtgataaggttgaagtgccg

SEQ ID NO: 30335 - DNA, 75 bp, Artificial Sequence
  Synthetic
aaggtttcaggcaatcagttccgggccttccggctgctattgcctgaccctaaccgcttcgcattggcggacatg

SEQ ID NO: 30336 - DNA, 75 bp, Artificial Sequence
  Synthetic
tccatttatgatcctgacaaggaacgtctagtgtgggcctgcaggggtatagaaattggcagagggcagccccta

SEQ ID NO: 30337 - DNA, 75 bp, Artificial Sequence
  Synthetic
ggggtcggcacaacggggcaccctctattcaataggctgttggatacagagaatcccagacagtatcctccccaa

SEQ ID NO: 30338 - DNA, 75 bp, Artificial Sequence
  Synthetic
ggcactaaggacgacaggcaggatgtttcctttgatcccaagcaagtgcaaatgttcattataggctgtgagcca

SEQ ID NO: 30339 - DNA, 75 bp, Artificial Sequence
  Synthetic
tgtattggtgagcactgggatcgagcaaaggcctgtgcaggagttgaccaaacggggttgtgcccccctgtggaa

SEQ ID NO: 30340 - DNA, 75 bp, Artificial Sequence
  Synthetic
ctagtaaataccaccatacaggatggggacatggtggatttggggttcggggccattaataacataactttgtcg

SEQ ID NO: 30341 - DNA, 75 bp, Artificial Sequence
  Synthetic
ttcaataaatcagatgtcagcttagaccttgtgaatagcatagccaagtaccctgactttttgaaaatgaacaat

SEQ ID NO: 30342 - DNA, 75 bp, Artificial Sequence
  Synthetic
gacgtatatggcaattcctgctttttctatgctcggcgggaacagctatatgccaggcactattttgctaggggt

SEQ ID NO: 30343 - DNA, 75 bp, Artificial Sequence
  Synthetic
ggctttgtaggggatataattccggatggcacagtcaaccaggaccacaagtactacctgccaggcgacagtggg

SEQ ID NO: 30344 - DNA, 75 bp, Artificial Sequence
  Synthetic
gggccgcgttccacattggcgagttcaatttatttcccaacagttagtggctccctggtgtcttctgatgcccaa

SEQ ID NO: 30345 - DNA, 75 bp, Artificial Sequence
  Synthetic
ttatttaatcgtcccttctggttgcaaagggcacaaggacataacaatggcatatgctggcagaatcaattattt

SEQ ID NO: 30346 - DNA, 75 bp, Artificial Sequence
  Synthetic
gtcaccatggtcgacaacactcgtaacaccaatattactattagcgtatcgaccgaagcggctgggggggattcc

SEQ ID NO: 30347 - DNA, 75 bp, Artificial Sequence
  Synthetic
tacgacgctactaagattagggagtatctcagacatatggaagaatttgagatctctgtcatattgcagctatgt

SEQ ID NO: 30348 - DNA, 75 bp, Artificial Sequence
  Synthetic
aaggttcctctggatgccgaagtacttgctcagataaatgcaatgaactctagaatcctggaaaattggcaacta

SEQ ID NO: 30349 - DNA, 75 bp, Artificial Sequence
  Synthetic
ggctttgtgccttcccctgaaaaccccattttagatcagtacagatatctgaattccctagcgacacggtgcccc

SEQ ID NO: 30350 - DNA, 75 bp, Artificial Sequence
  Synthetic
gatcaggaaccccctaaggaaccagaggatccgtatgcacaatataatttctgggtagtagatctgacggaacga

SEQ ID NO: 30351 - DNA, 75 bp, Artificial Sequence
  Synthetic
ctatccttagatttggatcaatactccctgggaaggaaatttctttttcaggcgggtctgcaatccaacagcaca

SEQ ID NO: 30352 - DNA, 75 bp, Artificial Sequence
  Synthetic
agggtccggaatcctgcaagactcacaagcaacaggacttcagctaagaaaggaaccaaaagaaagagaacctga

SEQ ID NO: 30353 - DNA, 75 bp, Artificial Sequence
  Synthetic
ccgatttcggtcgcagacaactggcgccaataaacatgtttcgagttgctatggaatgtctgactatttctacct

SEQ ID NO: 30354 - DNA, 75 bp, Artificial Sequence
  Synthetic
ttctttaacctttccggtgactaacattcgcttcacgtttgttccaaccgcgcccggtgcatgtagccaatataa

SEQ ID NO: 30355 - DNA, 75 bp, Artificial Sequence
  Synthetic
aacgctggcggtgagaggcaaccgacttggcagcaggaccgggacaggttggagtttgcccgccaaaagttattt

SEQ ID NO: 30356 - DNA, 75 bp, Artificial Sequence
  Synthetic
gaaagtcttccaagaacctttcaggtacactgtgtaactacaacggtgagtatgtaccgggcgcggtcggaaaat

SEQ ID NO: 30357 - DNA, 75 bp, Artificial Sequence
  Synthetic
tatcgtcaaacaatggttgttggcaacaattaccgcttgcggttaacatgtaaccgcttgcgttattctttagta

SEQ ID NO: 30358 - DNA, 75 bp, Artificial Sequence
  Synthetic
ttgcgttattctttagtaagcagttatataatgtataaatacatggatttttgggatagaaacaaaagaattcca

SEQ ID NO: 30359 - DNA, 75 bp, Artificial Sequence
  Synthetic
acacagaggagccagcatggaaacaaggattcaggacacacgaatcaacttcccaaggagggaggaactaacagc

SEQ ID NO: 30360 - DNA, 75 bp, Artificial Sequence
  Synthetic
tgagggaattttgtatcatgcccaacttgatgacaccaccctccctgccttcactatcctggagacagaatcttc

SEQ ID NO: 30361 - DNA, 75 bp, Artificial Sequence
  Synthetic
actctctctcgagattgatgaggttcctgatagcatcagccaggtgggtagcagcatagctttgggtgcctcgag

SEQ ID NO: 30362 - DNA, 75 bp, Artificial Sequence
  Synthetic
aatagaagttggccaaatttctaccttagtacatgacttcacctttgcagttgtgtcggaagaaacagatgaacc

SEQ ID NO: 30363 - DNA, 75 bp, Artificial Sequence
  Synthetic
tctctcacggcacttccctgtaatgaatgatggggaagatcatctgactcctgacatgattatagatgtgacaca

SEQ ID NO: 30364 - DNA, 75 bp, Artificial Sequence
  Synthetic
aactgaaagaagggttgtggaatttgccacccataggggtgctgggcatagaggtgtcctaaattattttaatca

SEQ ID NO: 30365 - DNA, 75 bp, Artificial Sequence
  Synthetic
aaagatggagaagtacaaaaggcctctagctctcaggaaggacagaactgggtggcatatcactctgtcttgcat

SEQ ID NO: 30366 - DNA, 75 bp, Artificial Sequence
  Synthetic
ctctgttggtacagatcatgttgtgtcagacctcagacttcctcaaaatttggtggatgagttagtctacagatt

SEQ ID NO: 30367 - DNA, 75 bp, Artificial Sequence
  Synthetic
tcgatttgcatgtgctgtcatggctcagattcttgtggccttccctggccttgctcctcaattgtcagaggaggt

SEQ ID NO: 30368 - DNA, 75 bp, Artificial Sequence
  Synthetic
gactcaaaatgaaaggagagggattgagtgtgtagaattactaacccaaaatttagtaggagatggcccaggacc

SEQ ID NO: 30369 - DNA, 75 bp, Artificial Sequence
  Synthetic
aaaaacaggtgtcttccctctgggggagagggagatacttgacaacttcctcatgaagagtgaggatggagatta

SEQ ID NO: 30370 - DNA, 75 bp, Artificial Sequence
  Synthetic
cctcaagaccatctttgctaagagttttaacaatagtctaagagaaatcaggcaggaacatgttccagaaggcat

SEQ ID NO: 30371 - DNA, 75 bp, Artificial Sequence
  Synthetic
gcacaggaatggtgccctaagaaaaaatcaaggtgaagctttgtcccagatgacagctcttcaagaagaaatgct

SEQ ID NO: 30372 - DNA, 75 bp, Artificial Sequence
  Synthetic
gaatgattattcaagacaagcaagacccccccctgagaataagtataagtccacgatcaaggtgcccccatggtt

SEQ ID NO: 30373 - DNA, 75 bp, Artificial Sequence
  Synthetic
gatctatgcaaccaaaagggacattaatgtatgccctgatccagatgacttggatggactctctgatgagacagt

SEQ ID NO: 30374 - DNA, 75 bp, Artificial Sequence
  Synthetic
cacctcccgagtgtggaaaagcgctctaactgacactttcttttctggaaatccaggatggcaggagaacataga

SEQ ID NO: 30375 - DNA, 75 bp, Artificial Sequence
  Synthetic
cagggaggtttcattagctagtggcctgctcatcacagaggactccgacaaactgaagtcagatttccatcgaac

SEQ ID NO: 30376 - DNA, 75 bp, Artificial Sequence
  Synthetic
taagctcaatctaacttctcaagactgggtcgctttagcagccagaggaatagagggtaaagccttaaggcatga

SEQ ID NO: 30377 - DNA, 75 bp, Artificial Sequence
  Synthetic
ggaagtggttagggcagctgatgaggaatctcatcaaactttaagcccattatcagacaccacaggtattgagtc

SEQ ID NO: 30378 - DNA, 75 bp, Artificial Sequence
  Synthetic
atgcctagagggcaacaactggttccatcaaactcgaggacagaaagaacacttgttccaggatctagaccaatt

SEQ ID NO: 30379 - DNA, 75 bp, Artificial Sequence
  Synthetic
aattgagtcctctcttgaagtgtcttgtgactctcaaggacttcgagattccattttgaccacatttagaaatta

SEQ ID NO: 30380 - DNA, 75 bp, Artificial Sequence
  Synthetic
caggagcaccaatgctgttcattgggcttgcatggtcacacaattggctacagagttgtcaatttcagccaaaca

SEQ ID NO: 30381 - DNA, 75 bp, Artificial Sequence
  Synthetic
gagctgtaaaaagcaccagtttatccttaagaagctcccaaactttcctgtgttagttttgatcaagacaagcag

SEQ ID NO: 30382 - DNA, 75 bp, Artificial Sequence
  Synthetic
atcaggatctcatgtgttttacagtttagctgctagagcatgtgacatcacaggggaactggatggacaggtgtt

SEQ ID NO: 30383 - DNA, 75 bp, Artificial Sequence
  Synthetic
caagaattatgaaagatctggtgtctggtttatcactgaatttaattctgtaaaactttgcaagcttgaaaatat

SEQ ID NO: 30384 - DNA, 75 bp, Artificial Sequence
  Synthetic
gatcaagttgcccatgctaataatatccatgctggcatatttccaagagacagaagaaaagctagtaaccagata

SEQ ID NO: 30385 - DNA, 75 bp, Artificial Sequence
  Synthetic
tagtcgcccaactctcttttctaggaaaatgacaacacttgccattctgacatgcatggaggacaaatccctaac

SEQ ID NO: 30386 - DNA, 75 bp, Artificial Sequence
  Synthetic
agaagagctcatcaccatccaaaggtacatccagatggaaggttttgtgagtgagcctcttctgccaaaacctca

SEQ ID NO: 30387 - DNA, 75 bp, Artificial Sequence
  Synthetic
gaaaatgctagaaaaattatctgttccactgaggacccccctccaggtgttcctctttaaacagtgtatgaacag

SEQ ID NO: 30388 - DNA, 75 bp, Artificial Sequence
  Synthetic
cattaggattatctctggtagtccttttaagagattgtcaaagggtggtgagattgtctggaggggttgctttgc

SEQ ID NO: 30389 - DNA, 75 bp, Artificial Sequence
  Synthetic
agggtgtttaggcatcagctgtagtccagagcaaatggtcaactcttggtacctaggctacttaaaaaacaaaga

SEQ ID NO: 30390 - DNA, 75 bp, Artificial Sequence
  Synthetic
tgaggacacagaggtgaacatgctcagtgccatgtatgagaaaattgtgaaagttgaggaaaaaagaccagagag

SEQ ID NO: 30391 - DNA, 75 bp, Artificial Sequence
  Synthetic
tgatgaaaatctcataggaggggatcctgttgatcccaaaatgcatgagttttcaggttctttcattaaatttat

SEQ ID NO: 30392 - DNA, 75 bp, Artificial Sequence
  Synthetic
ggctagggctcttgacgaagaggtgagccaaaggagagggaggaattggaaacaggacctgacagttcaatttta

SEQ ID NO: 30393 - DNA, 75 bp, Artificial Sequence
  Synthetic
cagatccttgggctcgataacactagatcagatggctacccttaaggccagtagcaacttctcagaagagtggga

SEQ ID NO: 30394 - DNA, 75 bp, Artificial Sequence
  Synthetic
agagtttgaagaatctcgcatgagagaatatcacagagtgaaagtcatagaaaggatagcagatctggttaacca

SEQ ID NO: 30395 - DNA, 75 bp, Artificial Sequence
  Synthetic
aggacatacatactacacagactgcctgggaagatgttttaaggtggtcttggaagacgcttgcatgcggatctg

SEQ ID NO: 30396 - DNA, 75 bp, Artificial Sequence
  Synthetic
ccttttcaaaaaggcccaacatggggggttgagagagatttatgtactccgactggaagaacgtatgattcaatt

SEQ ID NO: 30397 - DNA, 75 bp, Artificial Sequence
  Synthetic
tggcatcgagctcttggctaggaagatcaatgaggctgtcggtcatgaaaccatcagtgtcccctctagaaaaga

SEQ ID NO: 30398 - DNA, 75 bp, Artificial Sequence
  Synthetic
agagatattagatacacatcaggttagagcagcaaaggcctgcggagaggggactatggtcacactctgtagctc

SEQ ID NO: 30399 - DNA, 75 bp, Artificial Sequence
  Synthetic
taatgatgctaggacctggaaccaaggccattacaccactaaatttgcattcctaatgtgtgagctcatgccaaa

SEQ ID NO: 30400 - DNA, 75 bp, Artificial Sequence
  Synthetic
agaactacatgggctaatctgggcttcatgtgcaatcttcaggaggaagaaaatgatgcttaatttagattattt

SEQ ID NO: 30401 - DNA, 75 bp, Artificial Sequence
  Synthetic
gaacagcattgcaaagcataaagaaggattaagaggttttaagaagagattacatgatggattttccgggaatga

SEQ ID NO: 30402 - DNA, 75 bp, Artificial Sequence
  Synthetic
cgatgtaccctggatcaagaagggtaaaacttacatcgtgaccgaaacagacatgatgcaaggcatactccacct

SEQ ID NO: 30403 - DNA, 75 bp, Artificial Sequence
  Synthetic
aacatctagcttgtaccatgctgcatatcaggcggcagtcaggaagctgatcaggacaaaattaaagactttagt

SEQ ID NO: 30404 - DNA, 75 bp, Artificial Sequence
  Synthetic
gggctgcaggattcttattgatgtcattgaaggttctgatgacagtgccatcattatttctggtgcagttaagag

SEQ ID NO: 30405 - DNA, 75 bp, Artificial Sequence
  Synthetic
cagtgaggaggaaattagattcaggttagcagcaactgcgtgcctgttgtgggtgaaacacttgggagtgtttgc

SEQ ID NO: 30406 - DNA, 75 bp, Artificial Sequence
  Synthetic
tggaatttacatgtctcccaagagcaccataggctgtctagatgtatgtgaatacaattcagaattcagatttgc

SEQ ID NO: 30407 - DNA, 75 bp, Artificial Sequence
  Synthetic
aagactgatgtgtaggcccacatttaagtgggtatgtgccagcttaaacatcccagaggttgaaaaaatctcgga

SEQ ID NO: 30408 - DNA, 75 bp, Artificial Sequence
  Synthetic
caggcaagaagcctttgcgaatcttctaacatcggttcttgaaggtggcgggacctcaagtctttgctccatcct

SEQ ID NO: 30409 - DNA, 75 bp, Artificial Sequence
  Synthetic
gcagatctgccaagcatggtgccattacatgctcctggggctctggtcttcttgtgttttcaagagtataatccc

SEQ ID NO: 30410 - DNA, 75 bp, Artificial Sequence
  Synthetic
acacttgatctcagggaaaaacccagatgttggatttttccttcttgacaaccctgtttgttctggtattttagg

SEQ ID NO: 30411 - DNA, 75 bp, Artificial Sequence
  Synthetic
attccgtcacaacctctggagatttgtccggaagactgagctttcaaacatctatgctaggacattagataatag

SEQ ID NO: 30412 - DNA, 75 bp, Artificial Sequence
  Synthetic
agcactagatggttttatgctcacatccgggggaagcctttctaaaagccatttaattaggtggggagatagaaa

SEQ ID NO: 30413 - DNA, 75 bp, Artificial Sequence
  Synthetic
aaaactagaacagatgaaggagaggtccaacctggtagagaactggcaagaacagactgatgatgaccctagtgt

SEQ ID NO: 30414 - DNA, 75 bp, Artificial Sequence
  Synthetic
gctgtacaaacctccaatgaccaacaaagaggtaaagctgcttttgtgcataaagattgactcaccaggtgttgc

SEQ ID NO: 30415 - DNA, 75 bp, Artificial Sequence
  Synthetic
tgagagcctctccaaaggcaatgtgttaggcagagtgctggcctcttctgtgtatatactccagagaagatgcat

SEQ ID NO: 30416 - DNA, 75 bp, Artificial Sequence
  Synthetic
cactgccaaaaaaagcaagagaaaatacactctaatggagcttgctatggaacaagatccaaattacagggcact

SEQ ID NO: 30417 - DNA, 75 bp, Artificial Sequence
  Synthetic
gacactagctgaagagtcagcaattttcggtgacatagtgtcactagagagaaatgaaaccatgtctcaggtcta

SEQ ID NO: 30418 - DNA, 75 bp, Artificial Sequence
  Synthetic
cagtcatgcaaatggggtgttgattgctaagtcaagagaaatgaggagagcaaaggttgaagtattgagtgctga

SEQ ID NO: 30419 - DNA, 75 bp, Artificial Sequence
  Synthetic
tgagagctttagggcccctcctgtcaaaataatgggtgatgtcttctttggaactacccgtagtcacatgggtgc

SEQ ID NO: 30420 - DNA, 75 bp, Artificial Sequence
  Synthetic
caacatgctaagcagagagctccattatctaaaggagagtttcccctggatttcaaatgacccttatgaatgctt

SEQ ID NO: 30421 - DNA, 75 bp, Artificial Sequence
  Synthetic
gaatcaatctccattctctagtcaggctgagatgaaaaccttttttgagaaattggagcagaaaacaaggaaagt

SEQ ID NO: 30422 - DNA, 75 bp, Artificial Sequence
  Synthetic
cagaatgataggtgcagctgttttcactagaatgggtcaaaccacactggagaacctcattagatttaacttcca

SEQ ID NO: 30423 - DNA, 75 bp, Artificial Sequence
  Synthetic
aaaaaactttgaactcacaaaaagtgatgtgtctgactctgattactctgatgaagatgagaaattctgtagaca

SEQ ID NO: 30424 - DNA, 75 bp, Artificial Sequence
  Synthetic
tgttgtaaccatgatactttcagggccgttcaccaatgagaggaaggaatgcatgataatcgacttccttagaaa

SEQ ID NO: 30425 - DNA, 75 bp, Artificial Sequence
  Synthetic
ctccagccttggaccacccaagcaacttttgaggaggagcaggactaatgtgttgcgagtagttcgctcctggct

SEQ ID NO: 30426 - DNA, 75 bp, Artificial Sequence
  Synthetic
tgatggccatgcacggatagaggaactggttgagaagagcatggatggtatatgcggggctttcaccataaggca

SEQ ID NO: 30427 - DNA, 75 bp, Artificial Sequence
  Synthetic
gaaagtctccaaagataagaagggcaatgtgagctacaaaggcttgggggtttggactggcagaattgagggtac

SEQ ID NO: 30428 - DNA, 75 bp, Artificial Sequence
  Synthetic
agactgcaaacttcacattgaaaatgggttttcttctgaccagatcctcaaacaagttgttattgcttctgacaa

SEQ ID NO: 30429 - DNA, 75 bp, Artificial Sequence
  Synthetic
gagcttgtctgacttcctgcctggtctggaaagactctgtaaagaacttaaagtcatcaaccctaggaagccctt

SEQ ID NO: 30430 - DNA, 75 bp, Artificial Sequence
  Synthetic
ccctataagagaagctgaacgtcaaaacttcatcggggctcttgttgactttaggctggagtctcgattttctag

SEQ ID NO: 30431 - DNA, 75 bp, Artificial Sequence
  Synthetic
agctggagctcctgtgttattagttcctcagcatgaaggctttctaaaagagatgatggacagatctgacataag

SEQ ID NO: 30432 - DNA, 75 bp, Artificial Sequence
  Synthetic
ccttatagtcaggtcagacgtcttgaatattagagctgatctgggagatggaaggctaataacaatgctgagcta

SEQ ID NO: 30433 - DNA, 75 bp, Artificial Sequence
  Synthetic
caagtcctcagggcaagatgctgactcagagcaaggcgctcaatttttctgtaggagggagatgctgtcaagaaa

SEQ ID NO: 30434 - DNA, 75 bp, Artificial Sequence
  Synthetic
gtttggctgggccatcagagaaccttatctgagctggattagtctgggaccaattcctgacactttggttcccag

SEQ ID NO: 30435 - DNA, 75 bp, Artificial Sequence
  Synthetic
gttaaaagaagaaatgacaggaaggaggaaaactgagggtatagatggagaacaacttagagaaatctttaaaag

SEQ ID NO: 30436 - DNA, 75 bp, Artificial Sequence
  Synthetic
gtgttgcaaagggtctttgaggcgaaaaggcctaactgttggtcaatattcaagtgtgagactcaggattgaaga

SEQ ID NO: 30437 - DNA, 75 bp, Artificial Sequence
  Synthetic
cacgtcagaggaggtagacattgatcttcttgagctgctggatgaggatgttgatttcggagacactcttcagtc

SEQ ID NO: 30438 - DNA, 75 bp, Artificial Sequence
  Synthetic
ccaaaacttacaggaccttgaagcgagcattgaagagatggaagtcctgtttggagaggatgatcttgaggtttt

SEQ ID NO: 30439 - DNA, 75 bp, Artificial Sequence
  Synthetic
tgacttcactgaggttatatcaagatctgatcccttagcttaccacgggttttgtgataggatcatagaagacta

SEQ ID NO: 30440 - DNA, 75 bp, Artificial Sequence
  Synthetic
catcaagaggctaggtcatgaggcaattaggaaggccattcaaaaaagagaatgcaccaggagtgactaccctct

SEQ ID NO: 30441 - DNA, 75 bp, Artificial Sequence
  Synthetic
tgttaagagtctctttgaaagcattggagagaaccctgatgagttatcagtgcttcctgacaaagatgacgtata

SEQ ID NO: 30442 - DNA, 75 bp, Artificial Sequence
  Synthetic
tgcctcttcaagccttgttacagaagacttgtggggttgacctctcagacctcttcttgatctccaaatttactg

SEQ ID NO: 30443 - DNA, 75 bp, Artificial Sequence
  Synthetic
gggttgacctctcagacctcttcttgatctccaaatttactgtatgtctctatatgccgctggcggtctttgtgt

SEQ ID NO: 30444 - DNA, 75 bp, Artificial Sequence
  Synthetic
acacaaagaagccgcaaacgaatcaaagatggttgcatacactgatatccttaaggagttcggtgaggacatcat

SEQ ID NO: 30445 - DNA, 75 bp, Artificial Sequence
  Synthetic
tgatgatgaggttgttggtggactggaggcattatttgcctatcaaggatttgatccaacaaggatgttgaagag

SEQ ID NO: 30446 - DNA, 75 bp, Artificial Sequence
  Synthetic
gatggctgacattgataaggatggctggaaagatgatgccaaagtcatcatcgtttttgccctaacaaggggcaa

SEQ ID NO: 30447 - DNA, 75 bp, Artificial Sequence
  Synthetic
caaaatgtccaaggccatggctaagatgtcagaagagggtcagactagactgaaggccctcaaggccaaataccg

SEQ ID NO: 30448 - DNA, 75 bp, Artificial Sequence
  Synthetic
gatgaaggagaatcctgagtctagggatgacatcaccccaacaagagtggcagctgcactgcctacttggactgt

SEQ ID NO: 30449 - DNA, 75 bp, Artificial Sequence
  Synthetic
ccgggcggcaaaggccctccagaactctcttcccatgggcccagacaacatcaaggccctgtgcagtgttgaggc

SEQ ID NO: 30450 - DNA, 75 bp, Artificial Sequence
  Synthetic
acctgcagaaatctgttgtgcagcttttgccagcctgatcccaactagtgagctgactgagaagcaaatagagca

SEQ ID NO: 30451 - DNA, 75 bp, Artificial Sequence
  Synthetic
gctcactcatgccttctatctctggcaattctacttcacccaactgatcaacccaaaggtgaggggcaagggcaa

SEQ ID NO: 30452 - DNA, 75 bp, Artificial Sequence
  Synthetic
agccattgtccttcagacctttgaaaatgctgtgaaagcagcaatgaactcgaccaactacccagataagtctcg

SEQ ID NO: 30453 - DNA, 75 bp, Artificial Sequence
  Synthetic
ggtggccttcctcaagaagataggcatcttcaacaagaagaatgaaattaacgggaacatccaggccatggctgc

SEQ ID NO: 30454 - DNA, 75 bp, Artificial Sequence
  Synthetic
agcctgggagaagcttgagtgaacaatctctcaagattcaatgatcaatctggcaaaattagacccaactttaat

SEQ ID NO: 30455 - DNA, 75 bp, Artificial Sequence
  Synthetic
caggctaaattagaccctctctctctctctgtgcaggtgcacagagagggggagggggtcggatagaggtgcaaa

SEQ ID NO: 30456 - DNA, 75 bp, Artificial Sequence
  Synthetic
gggtaccaggtctagggagttggccagtctgaagtgaatttggtgcaaaagtaatgaagtctgaatgtctcctgt

SEQ ID NO: 30457 - DNA, 75 bp, Artificial Sequence
  Synthetic
gtctcaaggaagtaattgatggattcttcgcaactcaatttgcttagatgcgtggcctcatcaaaaggagggccc

SEQ ID NO: 30458 - DNA, 75 bp, Artificial Sequence
  Synthetic
ttgttgaccttcttgcgatctcttgagtcaaaagtttccagcagcaatatcctagtattcgagccaaggctggcc

SEQ ID NO: 30459 - DNA, 75 bp, Artificial Sequence
  Synthetic
tcaatcctgatgtaatcatcaactgacttcctgatgggtctaggcagcttgactgggtaaaaccagcttaatgcc

SEQ ID NO: 30460 - DNA, 75 bp, Artificial Sequence
  Synthetic
tggaggacttgcacatccactagcccagaattggaaatcccgagaagttctaggtcttttgccgccatccttaag

SEQ ID NO: 30461 - DNA, 75 bp, Artificial Sequence
  Synthetic
taagacaatgcctgaagaaagcccactttcattagaatgggggttccactaagggcactaaaaacacctagtctc

SEQ ID NO: 30462 - DNA, 75 bp, Artificial Sequence
  Synthetic
tgagccctaatgttggccttttggtccagatcatagagtctatcagcaattgcgctctctctgcatgactcagga

SEQ ID NO: 30463 - DNA, 75 bp, Artificial Sequence
  Synthetic
gttgacctgatcaaaagtttcaccagagccttccaggagaaacatctctctagaggtgtgccattcccgtagacc

SEQ ID NO: 30464 - DNA, 75 bp, Artificial Sequence
  Synthetic
ttaagggccagagagatccaagagactgaagctacattttgaggccacctcaaagagcttctctcctgtttagtc

SEQ ID NO: 30465 - DNA, 75 bp, Artificial Sequence
  Synthetic
attggcctcccttttggcagaatctcttccattgtgcccaacaagtaaagtggtctgggcaaagatctcaccata

SEQ ID NO: 30466 - DNA, 75 bp, Artificial Sequence
  Synthetic
tggccaccatcgaggaagagagtctgtattgctgcagtcccttggaaaagatcagcaagctcacggggcactgga

SEQ ID NO: 30467 - DNA, 75 bp, Artificial Sequence
  Synthetic
ggatacaatgtgtggacgtcccgtattcggatgttagcaactgacatcctccagtatcctccaatgatcagggat

SEQ ID NO: 30468 - DNA, 75 bp, Artificial Sequence
  Synthetic
ggatccaggggaaacctcaccagacagtctgaactgtatagatctactgtcgtccatggtgcggcttctctgtgt

SEQ ID NO: 30469 - DNA, 75 bp, Artificial Sequence
  Synthetic
acacaaagacgccagctatcaagatgatgttctctcgtgttatgcaattggcactgatatgtgctgtgacttgtg

SEQ ID NO: 30470 - DNA, 75 bp, Artificial Sequence
  Synthetic
aagacaacccttgtctctgggagaggtttaccaattcaagagacattgagttcatgattcctgttgtcaatctat

SEQ ID NO: 30471 - DNA, 75 bp, Artificial Sequence
  Synthetic
ccacctctagaaggttgtctatgtctcaaagaatatgcatggttagtatgggcaaacactggtcccgcatcttta

SEQ ID NO: 30472 - DNA, 75 bp, Artificial Sequence
  Synthetic
gtgagggagaggaggatagagggatgaaagaccttgaccccctgctcatgtccagtctaaactggagaggtacag

SEQ ID NO: 30473 - DNA, 75 bp, Artificial Sequence
  Synthetic
caaaaaccagaagctcaaactcctttaattttgacatcctggatggcatctttcttggttttcttgacttggtga

SEQ ID NO: 30474 - DNA, 75 bp, Artificial Sequence
  Synthetic
agtggggtgaggaagccgacaggcacacacccatccatcccgaatgcataaaatcaaaagtttgtggattcatga

SEQ ID NO: 30475 - DNA, 75 bp, Artificial Sequence
  Synthetic
cagcatctggccctaggatcaagacatgcacaggaaagtttagaggagcagacagacatggccactgcactaaca

SEQ ID NO: 30476 - DNA, 75 bp, Artificial Sequence
  Synthetic
gggcaacaccccatgaggcaacaaatgtgatatcagtcggagtacagcatgctcaggaggccaaccaggtagatg

SEQ ID NO: 30477 - DNA, 75 bp, Artificial Sequence
  Synthetic
agcatgaggcacgctacatttctgaagccagaaaatcaattaatcctgagatctgcagcattgatggggtagaaa

SEQ ID NO: 30478 - DNA, 75 bp, Artificial Sequence
  Synthetic
tcaatcaatgtgatcttgcttctccagggaggtggcttatgctacactatgctagcttcaggctgcaagaaggca

SEQ ID NO: 30479 - DNA, 75 bp, Artificial Sequence
  Synthetic
gtttggtgtatctttctcctggactcaacataaaatggagccagataaacgtgcctgcgtctgatttttattgca

SEQ ID NO: 30480 - DNA, 75 bp, Artificial Sequence
  Synthetic
tcaatgtctctgaccacctgaacactcattataggccgtgtgaagtcaactgcactgacaactgtcagggggatg

SEQ ID NO: 30481 - DNA, 75 bp, Artificial Sequence
  Synthetic
agctttactgctcagttcaccagtgtgcccgatctgctgaatgcaagtgctctttcatagggagcaggggcatgg

SEQ ID NO: 30482 - DNA, 75 bp, Artificial Sequence
  Synthetic
ctgaagtccagattggtgatagatggttcaagccagctgtggtaggaagccagcagtttttcgtgaaggaggatg

SEQ ID NO: 30483 - DNA, 75 bp, Artificial Sequence
  Synthetic
tccctgtccttcaacaaccctctgccgactgcaccacatgctcaatgacctgcacagcggaggggattgccatta

SEQ ID NO: 30484 - DNA, 75 bp, Artificial Sequence
  Synthetic
gcagcataaaggatgaactcaaggatgtgacagtctgcgttgagggcttctgctctaccagagtgagcaaaggct

SEQ ID NO: 30485 - DNA, 75 bp, Artificial Sequence
  Synthetic
ccaaagtatggaagattgagttccacaaccaatatccttcttctggttcagtggctctggcaagagggacaactg

SEQ ID NO: 30486 - DNA, 75 bp, Artificial Sequence
  Synthetic
tgagtggagaaacctttgagctaactgctgagtgtgggagaagaacaggatgtgagcagatcaattgcctcttct

SEQ ID NO: 30487 - DNA, 75 bp, Artificial Sequence
  Synthetic
gcagggaaatgctgtctaaccctcaatgttacccttatggaaagtggtttttattgttcttgattttggctactc

SEQ ID NO: 30488 - DNA, 75 bp, Artificial Sequence
  Synthetic
tctacattattgttgctctccttaagacaatcatgagaatcttcatggcttgcctgtcagtcctttatggccctt

SEQ ID NO: 30489 - DNA, 75 bp, Artificial Sequence
  Synthetic
tcatcataataataaaaatctcaagatgcttgggtagactcgggaaaaggaaaggggagaggacatatgttaggc

SEQ ID NO: 30490 - DNA, 75 bp, Artificial Sequence
  Synthetic
ttatggaggccttagatgatgagagaaaacctgaggtggtgagagcaccagtttcattaggtaggacaaaacaac

SEQ ID NO: 30491 - DNA, 75 bp, Artificial Sequence
  Synthetic
ctcgcatagtcttattcattgtgttggcccttctggtccacatggccctctgctgtgatgagagcagactcgtag

SEQ ID NO: 30492 - DNA, 75 bp, Artificial Sequence
  Synthetic
aggaaacctctgtgacatgtaatcctggcccagacaacatcttctcctgctcaacaaaagaaatgatcactgtga

SEQ ID NO: 30493 - DNA, 75 bp, Artificial Sequence
  Synthetic
aagaactgagggcagggaaaacaatatgcgttagcctgaaaggacccggaggaagcctgtcaagcccaattaaga

SEQ ID NO: 30494 - DNA, 75 bp, Artificial Sequence
  Synthetic
tcaaaatgcttgacattgtaggaaggtctgaccttcttgacatttatttcactttcaatggacatgcaaactgca

SEQ ID NO: 30495 - DNA, 75 bp, Artificial Sequence
  Synthetic
aatcagtccgcaggtgccggtgggctgggtcctgtggtaattcaggatgcttgggtgtaggaaaggaagactatg

SEQ ID NO: 30496 - DNA, 75 bp, Artificial Sequence
  Synthetic
acagagaattaggagatcaggaatcctcactgcacccgaactggagagactgctatgacggttgcggaggggctg

SEQ ID NO: 30497 - DNA, 75 bp, Artificial Sequence
  Synthetic
cctgtggttgtttcaatgcggctcctagctgcattttcttgaagaggtatgttaccaatgcagattcaagggtat

SEQ ID NO: 30498 - DNA, 75 bp, Artificial Sequence
  Synthetic
tcaaggtgtttaagccctcagcttggtttttgtctacaaagatagttgtggagactacttctcacaaggaggatg

SEQ ID NO: 30499 - DNA, 75 bp, Artificial Sequence
  Synthetic
ttacattgaaaagtggtgaggccaaggtgattgacaaggtgtcattccattataggactgataaaaacttgtttg

SEQ ID NO: 30500 - DNA, 75 bp, Artificial Sequence
  Synthetic
ctgggatgtcaatccctcccatagtgacagaagtcaagagagaaggtaaacctcttagcttcttcctggaaaacc

SEQ ID NO: 30501 - DNA, 75 bp, Artificial Sequence
  Synthetic
aaggacaacacccaaaatgcaaagatgaaaactctgcaaggacatcatctgcatctaactgcatagttgaccaga

SEQ ID NO: 30502 - DNA, 75 bp, Artificial Sequence
  Synthetic
acacaatttcagctaatgtgagagtcgatgacgtgtcttgcagaagcaatctggttagcatatcaggaatgagca

SEQ ID NO: 30503 - DNA, 75 bp, Artificial Sequence
  Synthetic
cgttgaagcctctaccacaaagagtgggggatttcctaatccagttacataatgatgagcctgtacttctggcta

SEQ ID NO: 30504 - DNA, 75 bp, Artificial Sequence
  Synthetic
ctggggactctggtgttgttgagggagagctgcagatagacttgtcgcataagaagatctctatcaaggttgata

SEQ ID NO: 30505 - DNA, 75 bp, Artificial Sequence
  Synthetic
ccacagtctgcagaggaacagtgaaagaactgaaggggtgtgttggctgtaccaaaggggcctttgcctcactgg

SEQ ID NO: 30506 - DNA, 75 bp, Artificial Sequence
  Synthetic
aaattcactctacatcagcaggatcagcaagtcttcaatgcagcttgagtagctgttacatggaggttcagaagg

SEQ ID NO: 30507 - DNA, 75 bp, Artificial Sequence
  Synthetic
gagtcaacaatgtgaactgctctctcagattctcaaaagcagttgtggaggaaacatgtgtacttgcctgctcag

SEQ ID NO: 30508 - DNA, 75 bp, Artificial Sequence
  Synthetic
gctcaaaagagcagctgagcataaaaggaaacctcataattggaggagacttcaagaaattgaccgaggattctg

SEQ ID NO: 30509 - DNA, 75 bp, Artificial Sequence
  Synthetic
caacaagcttctctcacactgattcaaaagacacccgaatccatttgcagaccggattgatgaactggctggaca

SEQ ID NO: 30510 - DNA, 75 bp, Artificial Sequence
  Synthetic
cattgttcggcgccagccttcttgggaagatactagggataggattggccatcttatccccattcattctaattt

SEQ ID NO: 30511 - DNA, 75 bp, Artificial Sequence
  Synthetic
tgatcttaagatggattttgagggtcgtcctcaggagatccagaattagacgagagcctaagtatgaaatggcta

SEQ ID NO: 30512 - DNA, 75 bp, Artificial Sequence
  Synthetic
agtacagctaagtcttttcgcctgatggattgccatctctagtcttcgggctagagagttccaatgctggcggtc

SEQ ID NO: 30513 - DNA, 75 bp, Artificial Sequence
  Synthetic
ctaagtcttttcgcctgatggattgccatctctagtcttcgggctagagagttccaatgctggcggtctttgtgt

SEQ ID NO: 30514 - DNA, 75 bp, Artificial Sequence
  Synthetic
acacagagacgccagcatggaaactaggatacaggacacgcgtatcaacttccctaggagagaagagctaactgc

SEQ ID NO: 30515 - DNA, 75 bp, Artificial Sequence
  Synthetic
agagggcatactgtatcatgctcaacttgatgacaccacgctgcctgctttcaccatacaagagactgagtcttc

SEQ ID NO: 30516 - DNA, 75 bp, Artificial Sequence
  Synthetic
aatctctctcgagattgatgaagtcccagatagtgttagtcaaataggcagcagcattgccttgggggcaacaag

SEQ ID NO: 30517 - DNA, 75 bp, Artificial Sequence
  Synthetic
aattgaagtcggtcaaatttctacattggttcatgatttcacattcgcagttgtgtccgaagacacggatgagcc

SEQ ID NO: 30518 - DNA, 75 bp, Artificial Sequence
  Synthetic
tctctcacgccatttccctgtaatgaatgacggggaggaccatttaactccagacatgataattgatgtgaccca

SEQ ID NO: 30519 - DNA, 75 bp, Artificial Sequence
  Synthetic
aactgaaaggcgggttgtggagtttgcaacccatagaggtgctgggcacagaggggtcttgaattacttcaatca

SEQ ID NO: 30520 - DNA, 75 bp, Artificial Sequence
  Synthetic
aaaaatggaaaaatataaacgacccttagcactaagaagagagaggactggatggcacatcacattgtcatgcat

SEQ ID NO: 30521 - DNA, 75 bp, Artificial Sequence
  Synthetic
ctctgtgggcacagaccatgtggtttcagacttgagactgccccaaaacttaattgatgaactagtctacaggtt

SEQ ID NO: 30522 - DNA, 75 bp, Artificial Sequence
  Synthetic
ccgatttgcttgtgctgtaatggcacagatattggtggccttccctggtcttgctccccagttgtcagaagaagt

SEQ ID NO: 30523 - DNA, 75 bp, Artificial Sequence
  Synthetic
cacccaaaatgagagaagaggcattgagtgcgtggagctcctgacacagaacctagtgggggaagggccaggccc

SEQ ID NO: 30524 - DNA, 75 bp, Artificial Sequence
  Synthetic
aaaaaccggcgtctttcctctgggtgaaaaggaaattcttgatgagttcctaatgagaagtgaggatggagagta

SEQ ID NO: 30525 - DNA, 75 bp, Artificial Sequence
  Synthetic
cctcaagtcagtcttcacaaagaccttcaatgagagcttgagggaaattagacaggaacatgtgccagagggtat

SEQ ID NO: 30526 - DNA, 75 bp, Artificial Sequence
  Synthetic
gcacagaaatggagctctcaggaagaatcaaggtgaagccttgacgcagatgaccacacttcaagaagaattact

SEQ ID NO: 30527 - DNA, 75 bp, Artificial Sequence
  Synthetic
agctaatcattccaagcaactgagagcacctcctgagaacaagtacaagtccacagtgaagatacccccttggtt

SEQ ID NO: 30528 - DNA, 75 bp, Artificial Sequence
  Synthetic
gatcccagcaaccaagagagacatcaatgtttgcccagacccagaagatttggatggcctctctgatgaaacagt

SEQ ID NO: 30529 - DNA, 75 bp, Artificial Sequence
  Synthetic
aacctcccgagtctggaaaagtgccttgacagacacattcttctcaggtaatcctggttggcaagagaacattga

SEQ ID NO: 30530 - DNA, 75 bp, Artificial Sequence
  Synthetic
cagggaggtctctatcgccagtgggatcctcatgaccgaggatgcagaaaacttgaagacagaatatcatcgaac

SEQ ID NO: 30531 - DNA, 75 bp, Artificial Sequence
  Synthetic
aaaactcaatttaacctctcaagactgggttgctttggccgcaagaggcattgaaggtaaggcttacaggcatga

SEQ ID NO: 30532 - DNA, 75 bp, Artificial Sequence
  Synthetic
ggatttagttaagacggcagatgaggaatctcaccaaactctaagccctttatcggacacttccggcattgaatc

SEQ ID NO: 30533 - DNA, 75 bp, Artificial Sequence
  Synthetic
atgtttggagagcaataactggttttatcaggctcgaagtcaaaaggagtacttgtttcaggacctggatcagct

SEQ ID NO: 30534 - DNA, 75 bp, Artificial Sequence
  Synthetic
aattgaatcctcactagaagtttcctgtgaatctcaagggctcagagattctgtcttgacgacattcaagaacta

SEQ ID NO: 30535 - DNA, 75 bp, Artificial Sequence
  Synthetic
caggaacacaaatgttgtgcattgggcatgcatggtgacgcagctggcaacagagctgtccatatcagcacagca

SEQ ID NO: 30536 - DNA, 75 bp, Artificial Sequence
  Synthetic
gggttgcaagaaacatcaattcattctcaagaagctccctaattttcctgtattagtcttgatcaagacaaccag

SEQ ID NO: 30537 - DNA, 75 bp, Artificial Sequence
  Synthetic
atctggatctcatgtgttctacagtctagctgccaaggcttctgacataacaggagagttagacgggcaagtatt

SEQ ID NO: 30538 - DNA, 75 bp, Artificial Sequence
  Synthetic
caagaattatgaaagaacaggtgcctggttcatcactgagtttaattctgtgaagctctgtaagctagagaacat

SEQ ID NO: 30539 - DNA, 75 bp, Artificial Sequence
  Synthetic
gatcaaattgcctatgctaatcatatccatgctagcgtacttccaagagacagaagagaagttggtcacaaaata

SEQ ID NO: 30540 - DNA, 75 bp, Artificial Sequence
  Synthetic
tagtcgccctacccttttcacaaggaagatgaccacacttgctatcctgacctgcatggaggataagtctttgac

SEQ ID NO: 30541 - DNA, 75 bp, Artificial Sequence
  Synthetic
ggaagagctcatcacaatccagaggtatatccagatggagggttttgtgagcgagcctctcttgccaaaacctca

SEQ ID NO: 30542 - DNA, 75 bp, Artificial Sequence
  Synthetic
aaaaatgctagaaaaactgtctgtgcctttgagaactactcttcaagtgtttctcttcaaacagtgcatgagcag

SEQ ID NO: 30543 - DNA, 75 bp, Artificial Sequence
  Synthetic
cataagaatcatttctggtagccctttcaaaaggttgtccagaggaggagaagttgtgtggaggggatgtttcgc

SEQ ID NO: 30544 - DNA, 75 bp, Artificial Sequence
  Synthetic
cggctgccttggcattagctgcagtcctgaacaaatggtcaattcatggtacctgggctatctgaagaacaaaga

SEQ ID NO: 30545 - DNA, 75 bp, Artificial Sequence
  Synthetic
cgaggatactgaggtgaacatgctcagtgcaatgtatgaaaagatagttaaggtagaagaaaaaaggccggaaag

SEQ ID NO: 30546 - DNA, 75 bp, Artificial Sequence
  Synthetic
tgatgaaaatttggtagggggggatccagccaacccaaaaatgcatgaattctccggatctctgattaaattcat

SEQ ID NO: 30547 - DNA, 75 bp, Artificial Sequence
  Synthetic
ggccagggccctagatgaggagattagtcagagaagaggtagaaactggaagcaagatttgactgttcaatttta

SEQ ID NO: 30548 - DNA, 75 bp, Artificial Sequence
  Synthetic
cagatctctgggctccataactctagaccaaatggccacgttaaaggctagtagcaatttctcagaagaatggga

SEQ ID NO: 30549 - DNA, 75 bp, Artificial Sequence
  Synthetic
ggaatttgaggagtctcgaatgaaggagtaccacagagtgaaagtcattgagagaatcgcagacttagtcaatca

SEQ ID NO: 30550 - DNA, 75 bp, Artificial Sequence
  Synthetic
agggttcacctactacactgattgtcttggcagatgcttcaaggttgtgttagaggatgggtgcatgaggatctg

SEQ ID NO: 30551 - DNA, 75 bp, Artificial Sequence
  Synthetic
tctctttaagaaagctcagcatggaggactcagagagatttatgtgctcaggctagaagaacgaatgatccagtt

SEQ ID NO: 30552 - DNA, 75 bp, Artificial Sequence
  Synthetic
tgggattgagctcttagctaggaaaatcaatgaggctgttgggcacgagaccattagtgttccttctagaaagga

SEQ ID NO: 30553 - DNA, 75 bp, Artificial Sequence
  Synthetic
agagattttagacactcaccaggttagggctgcgaaagcatgtggagaagggaccatgatcacactctgcagctc

SEQ ID NO: 30554 - DNA, 75 bp, Artificial Sequence
  Synthetic
aaatgatgctagaacctggaatcaaggacattacaccactaagtttgcatttctgatgtgcgaactcatgcctaa

SEQ ID NO: 30555 - DNA, 75 bp, Artificial Sequence
  Synthetic
agaacttcatggattgatttgggcatcatgtgccattttcagaaggaagaagatgatgctcaatctagactactt

SEQ ID NO: 30556 - DNA, 75 bp, Artificial Sequence
  Synthetic
gaatagcattgcaaagcacaaagatgggttgaaagggtttaaaaagagattgcatgatggcttttcaggaaatga

SEQ ID NO: 30557 - DNA, 75 bp, Artificial Sequence
  Synthetic
tgaggtcccttggatcaagaaaggcaagacttacatcctgactgaaacaggtatgatgcagggtatactacacct

SEQ ID NO: 30558 - DNA, 75 bp, Artificial Sequence
  Synthetic
tacctctagtctttatcacgctgcgtaccaagctgcagtcagaaagctaatcaagactaagctaaagaccttggt

SEQ ID NO: 30559 - DNA, 75 bp, Artificial Sequence
  Synthetic
ggggtgcagaatcctcatagatgtgattgaaggctctgacgatagtgccatcatcatctcaggtgctgtcaaaag

SEQ ID NO: 30560 - DNA, 75 bp, Artificial Sequence
  Synthetic
tggagaagaagagatcaggtttaggttggcagcctctgcatgtctgctctgggtcaaacatttgggagtttatgc

SEQ ID NO: 30561 - DNA, 75 bp, Artificial Sequence
  Synthetic
aggcatttacatgtctcctaaaagcacaataggctgcctagatgtttgtgaatacaattcagaatttagattcgc

SEQ ID NO: 30562 - DNA, 75 bp, Artificial Sequence
  Synthetic
gagactgatgtgtagacccaccttcaagtgggtatgtgcaagtctgaacatcccagaagtggagaagatctcaga

SEQ ID NO: 30563 - DNA, 75 bp, Artificial Sequence
  Synthetic
cagacaagaggcatttgccaacttactaacatcagtcttggaaggaggtggcacctcaagtttgtgctcagtact

SEQ ID NO: 30564 - DNA, 75 bp, Artificial Sequence
  Synthetic
acagatgtgtcaggcctggtgccactacatactccttggattgtggtcttcatgtgtttttaaaagcatcatccc

SEQ ID NO: 30565 - DNA, 75 bp, Artificial Sequence
  Synthetic
gcacttaatgtctggcaaaaatccagacgtaggcttcttcctactggacaaccctgtctgctcgggcatattggg

SEQ ID NO: 30566 - DNA, 75 bp, Artificial Sequence
  Synthetic
tttccgtcacaacctatggagatttgttagaaagacggaactttcgaacatttatgccaggaccctagacaatcg

SEQ ID NO: 30567 - DNA, 75 bp, Artificial Sequence
  Synthetic
tgctctagacggatttgtattgacgtcaggggggagtctttccaaaagtcatcttatccgctggggagacaggaa

SEQ ID NO: 30568 - DNA, 75 bp, Artificial Sequence
  Synthetic
aaaactagaacagatgaaggataggtctggcctggtggagaactggcaggagcagactgatgatgaccccagtgt

SEQ ID NO: 30569 - DNA, 75 bp, Artificial Sequence
  Synthetic
tctgtacaaagccccatcaaccaataaggaagtgaaactcctgctttgtatcaaaattgattccccaggcgtggc

SEQ ID NO: 30570 - DNA, 75 bp, Artificial Sequence
  Synthetic
tgagagcctctctaagggcaatgtcttaggcagggtcttggcttcttcagtgtacattttgcagagaagatgtat

SEQ ID NO: 30571 - DNA, 75 bp, Artificial Sequence
  Synthetic
cactgccaagaagagcaggaggaaatacaccctgatggagttggccatcgagcaggatcctaattacagagcact

SEQ ID NO: 30572 - DNA, 75 bp, Artificial Sequence
  Synthetic
aaccttagctgaagaatcagccatttttggagatgtgatttccttggagaggaatgaaacaatgtcacaggtgta

SEQ ID NO: 30573 - DNA, 75 bp, Artificial Sequence
  Synthetic
cagccatgccactggcgttctgatagcaaagtcaagagaaatgaggagagcaaaggtggaggtgttgagtgctga

SEQ ID NO: 30574 - DNA, 75 bp, Artificial Sequence
  Synthetic
tgagagttttcgggcaccaccagtcaaaattatgggggacgtcttctttgggacaactcgcagccacatgggagc

SEQ ID NO: 30575 - DNA, 75 bp, Artificial Sequence
  Synthetic
aaatatgttgagcagagaactccattacctcaaggagagcttcccctggatctcaaatgaccctcatgagtgcct

SEQ ID NO: 30576 - DNA, 75 bp, Artificial Sequence
  Synthetic
gaatcaatcaccctttacaagccaagcggaaatgaagaccttttttgagaaattggaacaaaaaacaaggaaggt

SEQ ID NO: 30577 - DNA, 75 bp, Artificial Sequence
  Synthetic
caggatgataggggcggctgtgttcactagaatgggccaaaccaccttggagaatctaataagatttaatttcca

SEQ ID NO: 30578 - DNA, 75 bp, Artificial Sequence
  Synthetic
gaagaactttgaactcagcaagagtgaagtttcagatacagactactctgatgaggatgagaaattttgtagaca

SEQ ID NO: 30579 - DNA, 75 bp, Artificial Sequence
  Synthetic
tgtcgtaactatgattctttcggggcctttcaccaatgagagaaaagaatgcatgcttatagactttctcaagaa

SEQ ID NO: 30580 - DNA, 75 bp, Artificial Sequence
  Synthetic
ttcaaacttggggcctccaaagcaactcctaagaaggagcagaaccaatgtgctacgcgtagttcgctcatggct

SEQ ID NO: 30581 - DNA, 75 bp, Artificial Sequence
  Synthetic
tgaaggtcatgcgcggatagaagaactagtagaaaagagcatggatggcatttgtggtgcattcaccatacgaca

SEQ ID NO: 30582 - DNA, 75 bp, Artificial Sequence
  Synthetic
gaaagtcttcaaggataggaaaggcaatgtgagctacaaagggctgggtgtgtggaccggcagaattgaagggac

SEQ ID NO: 30583 - DNA, 75 bp, Artificial Sequence
  Synthetic
agactgcaaacttcaaattgagagcggatattcatctgagcaagttctgaagcaagttgtcattgcttcagacaa

SEQ ID NO: 30584 - DNA, 75 bp, Artificial Sequence
  Synthetic
gaacctttctgattttctgcctggattggagagattatgcaaagaactaaaagttatcaatcccaggagaccatt

SEQ ID NO: 30585 - DNA, 75 bp, Artificial Sequence
  Synthetic
cccgatcagagaggctgaacgtctgaacttcattggagctctggttgacttcaagctggagtcaagattttctag

SEQ ID NO: 30586 - DNA, 75 bp, Artificial Sequence
  Synthetic
agcaggagccccagtcctactggtgccacaacatgaagggtttctcaaggagatgatggacaggtctgacataag

SEQ ID NO: 30587 - DNA, 75 bp, Artificial Sequence
  Synthetic
cctcattgttaggtcagatgtgcttaatatcagagctgatctaggagatggcaggctgataacaatgttgagtta

SEQ ID NO: 30588 - DNA, 75 bp, Artificial Sequence
  Synthetic
caagtcttctggacaagatgctgattctgagcagggcaatctgtttttctccaggagggactcactttcagagaa

SEQ ID NO: 30589 - DNA, 75 bp, Artificial Sequence
  Synthetic
gtttggatgggcaattagagaaccttacctcagctggatcagtctaggcccaatcccagatgctctagttccaag

SEQ ID NO: 30590 - DNA, 75 bp, Artificial Sequence
  Synthetic
attgaaggaagagatgactggaaggagaaggacagagggcattgatggtgatcagctgagggacatctttaaaag

SEQ ID NO: 30591 - DNA, 75 bp, Artificial Sequence
  Synthetic
atgttgtaagggatccctgagacggaagggcctaactgtcggtcagtattcaaatgttaggctgaggattgagga

SEQ ID NO: 30592 - DNA, 75 bp, Artificial Sequence
  Synthetic
cacatcagaagaagtagatattgatctccttgagctgttggatgaggatgtggacttcgaggacaccttgcaggc

SEQ ID NO: 30593 - DNA, 75 bp, Artificial Sequence
  Synthetic
acaaaacattcaagatcttgaggcaagtgtagaagatatggaggtcctttttggtgaggatgatctagaagtgtt

SEQ ID NO: 30594 - DNA, 75 bp, Artificial Sequence
  Synthetic
tgatttcacggaggttatttccagatctgacccattggcgtaccatgggttctgtgatagaattatagaagacta

SEQ ID NO: 30595 - DNA, 75 bp, Artificial Sequence
  Synthetic
catcaagagactaggccatgaagccatcagaaaggccatccaaaaaagagaatgcactcggagtgactaccccct

SEQ ID NO: 30596 - DNA, 75 bp, Artificial Sequence
  Synthetic
ggtcaagaatctctttgagaacattggtgaaaaccctgacgagctgtgcatactgcctgacaaagatgatgcata

SEQ ID NO: 30597 - DNA, 75 bp, Artificial Sequence
  Synthetic
tgcctcttctggacacattacagaagacatttggggttgacctccttttctctttctagaactccaaattatctg

SEQ ID NO: 30598 - DNA, 75 bp, Artificial Sequence
  Synthetic
gggttgacctccttttctctttctagaactccaaattatctgcttttctccatatgctgctggcggtctttgtgt

SEQ ID NO: 30599 - DNA, 75 bp, Artificial Sequence
  Synthetic
acacaaagaagccgctaacgaatcaaagatggttgcatacactgatatccttaaggagttcggtgaggacatcat

SEQ ID NO: 30600 - DNA, 75 bp, Artificial Sequence
  Synthetic
aagatggttgcatacactgatatccttaaggagttcggtgaggacatcatcgatgatgaagttgttggcggcttg

SEQ ID NO: 30601 - DNA, 75 bp, Artificial Sequence
  Synthetic
gaggcgctatttgcctatcagggttttgacccaactagaatgctgaaaaagatggctgacatcgacaaggagggc

SEQ ID NO: 30602 - DNA, 75 bp, Artificial Sequence
  Synthetic
tggaaagatgacgctaaagtcatcattgtctttgctctcacgagaggtaacaagatgtccaaagccatggccaaa

SEQ ID NO: 30603 - DNA, 75 bp, Artificial Sequence
  Synthetic
atgtcggaagaaggacaagcaaagctgaaggctttaaagaacaaatacaggatgaaggagaatcctgagtcaagg

SEQ ID NO: 30604 - DNA, 75 bp, Artificial Sequence
  Synthetic
gacgacatcactcccacaagagtggcggctgccctgcctacttggactgtgagggctgccaaagctctccaaaac

SEQ ID NO: 30605 - DNA, 75 bp, Artificial Sequence
  Synthetic
tcccttcctatgggccctgacaacatcaaggccctgtgtggagctgatgcaccagcagagatctgctgtgctgcc

SEQ ID NO: 30606 - DNA, 75 bp, Artificial Sequence
  Synthetic
tttgcaagcctgatcccgactagtgagctgacagaaaaacaaatcgaacagctcacacatgccttttacctctgg

SEQ ID NO: 30607 - DNA, 75 bp, Artificial Sequence
  Synthetic
caattctacttcacccaactgattaacccaaaggtgagaggaaagggcaaggccactgtcctccagacctttgag

SEQ ID NO: 30608 - DNA, 75 bp, Artificial Sequence
  Synthetic
aatgctgtgaaggcagcaatgaactccaccagctacccggataaatcccgagtggcctttctgaagaagattggc

SEQ ID NO: 30609 - DNA, 75 bp, Artificial Sequence
  Synthetic
ccaccagctacccggataaatcccgagtggcctttctgaagaagattggcatctttaacaagaaaaatgagatca

SEQ ID NO: 30610 - DNA, 75 bp, Artificial Sequence
  Synthetic
agtggcctttctgaagaagattggcatctttaacaagaaaaatgagatcaatggaaatgtccaggatatggcagc

SEQ ID NO: 30611 - DNA, 75 bp, Artificial Sequence
  Synthetic
tgcctgggaaaaactggagtaaatcagtgctcaatatttcatcaccaatctggctaaattttgattctggttaat

SEQ ID NO: 30612 - DNA, 75 bp, Artificial Sequence
  Synthetic
taggctaaattagaccccttctctctctctgtgcttatgcacagagagggggagggggtcgggtaggctgaggac

SEQ ID NO: 30613 - DNA, 75 bp, Artificial Sequence
  Synthetic
agttctggaatcaaggggttggccaatcggatgagaagtcagtgcagaaataatgagccctaaatgattcctgag

SEQ ID NO: 30614 - DNA, 75 bp, Artificial Sequence
  Synthetic
tttcaaggaagtattcaatgctctcactgcaactcaggccacttaggaaatctgcctcattgaagggaggacctc

SEQ ID NO: 30615 - DNA, 75 bp, Artificial Sequence
  Synthetic
tgttgatcttcctccgatctcctgactcaaaggtctccagtaaaaggatccgagtattggaaccctggctagcct

SEQ ID NO: 30616 - DNA, 75 bp, Artificial Sequence
  Synthetic
caattctgatatattcatcaacttgctttctaattggtcgtggcaatttaacagggtaataccagcccaaagctt

SEQ ID NO: 30617 - DNA, 75 bp, Artificial Sequence
  Synthetic
ggagtacttggacatctacaagccctgaagtggtgatccccagtagctctagatctttagcagctgctcgcagat

SEQ ID NO: 30618 - DNA, 75 bp, Artificial Sequence
  Synthetic
aggacagtgcttgcagcaaacccactttcatcaaaatgggagatccaccaagagcactcatcagacccattctct

SEQ ID NO: 30619 - DNA, 75 bp, Artificial Sequence
  Synthetic
gggcccttttgttggccttctggttcagatcataaagcctatctgctactgagctttctgggtctgattcaggag

SEQ ID NO: 30620 - DNA, 75 bp, Artificial Sequence
  Synthetic
ttgacctaatcaacagtctgaccaatgccttccaggagaagcatctctccaaaggagtgccattcccatacacct

SEQ ID NO: 30621 - DNA, 75 bp, Artificial Sequence
  Synthetic
tgagtgcaagagaaatccaggaaattgatgcaactccttgaggccaccttaaagagctcctctcttggcttgtca

SEQ ID NO: 30622 - DNA, 75 bp, Artificial Sequence
  Synthetic
tgggccttccttttggcaggatgtcttccattgtctcaaaaaggaaaatgggtctaggtagtgacctaaccatgt

SEQ ID NO: 30623 - DNA, 75 bp, Artificial Sequence
  Synthetic
ggccaccatcaagaaaaagagtttggatggctgcagacccttgaaatagatccactaactcccttggcactggag

SEQ ID NO: 30624 - DNA, 75 bp, Artificial Sequence
  Synthetic
gatacaaggtgtggatgtcccgaatacggacatttgccactgacatcctccagtatcctcccacaatcagtgagc

SEQ ID NO: 30625 - DNA, 75 bp, Artificial Sequence
  Synthetic
tgagccaggtgaaacctcgccagagagcctgaactgtatagatctactatcgtccattctgcggcttctctgtgt

SEQ ID NO: 30626 - DNA, 75 bp, Artificial Sequence
  Synthetic
acacaaagaagccgcgaacgaatcaaagatggttgcatacactgatatccttaaggagttcggtgaggacatcat

SEQ ID NO: 30627 - DNA, 75 bp, Artificial Sequence
  Synthetic
aagatggttgcatacactgatatccttaaggagttcggtgaggacatcatcgatgatgaggttgttggcggtttg

SEQ ID NO: 30628 - DNA, 75 bp, Artificial Sequence
  Synthetic
agtggcctttctgaagaagattggcatctttaacaagaaaaatgagatcaatggagatgtccaggctatggcagc

SEQ ID NO: 30629 - DNA, 75 bp, Artificial Sequence
  Synthetic
acacaaagacgccagctatcaagatgatgttcacacattcactgttgctggcactgatttgtgctgctgcctgtg

SEQ ID NO: 30630 - DNA, 75 bp, Artificial Sequence
  Synthetic
atgacaatccatgcctgtgggatcggcttgccaatttcagagacatgggattcatgacacctgctgtcaacttga

SEQ ID NO: 30631 - DNA, 75 bp, Artificial Sequence
  Synthetic
gcacctcaaagggcctgtcaatatcccagaggatatgcatggtcagtatgggcaagcactgggctcgaatactta

SEQ ID NO: 30632 - DNA, 75 bp, Artificial Sequence
  Synthetic
gtgaagcagaggagaagcagatgaaagacctggatccgctagtgatgtcaagcctaaattggaaaggcacagcca

SEQ ID NO: 30633 - DNA, 75 bp, Artificial Sequence
  Synthetic
agaccagaagctcttcatcattcaattttgacatcctggacgggatcttcctaggcttcttgaatatgaccaaat

SEQ ID NO: 30634 - DNA, 75 bp, Artificial Sequence
  Synthetic
gggatgaagagaacagtaggaacaggcctttgcatcctgagtgcatcaaatcaaaagtatgtggcttcatgacag

SEQ ID NO: 30635 - DNA, 75 bp, Artificial Sequence
  Synthetic
cttcaggaccaagagtcaagacatgctcaggtaaattcagaggtgcggatagacatgggcactgcaccaacagag

SEQ ID NO: 30636 - DNA, 75 bp, Artificial Sequence
  Synthetic
ccgcccctcatgaggcaacaaatgtgatctctgtcggagtccagcacgctcaagaggcaagccagcttgatgagc

SEQ ID NO: 30637 - DNA, 75 bp, Artificial Sequence
  Synthetic
atgaggcaaacttcatatcagaggccagaaagtcaaataacccagatttctgcagtgttgacggagttgagatca

SEQ ID NO: 30638 - DNA, 75 bp, Artificial Sequence
  Synthetic
atcaatgcgacttgacttccccagggaggtggcttcttttgcattacgctagtttcagattgcaagaaggtagtc

SEQ ID NO: 30639 - DNA, 75 bp, Artificial Sequence
  Synthetic
tggtgtatttctctcctggcctcaacattaaatggagtcaaatcaatgcacccatatcagacttcttctgcatta

SEQ ID NO: 30640 - DNA, 75 bp, Artificial Sequence
  Synthetic
atgtttctgaacacctggattctcattacagaccttgcaatacaaactgctccacagagtgtcaaggagatgaac

SEQ ID NO: 30641 - DNA, 75 bp, Artificial Sequence
  Synthetic
tttattgttcaatccaccaatgtgccagatcagctgagtgcaaatgctcattcattggcagcaggggggtggctg

SEQ ID NO: 30642 - DNA, 75 bp, Artificial Sequence
  Synthetic
aggtgcaaataggtgatcgatggttcactccagctgttgttggcagtcagcaattctttgtgaaggaggaggtgc

SEQ ID NO: 30643 - DNA, 75 bp, Artificial Sequence
  Synthetic
ctgtgttgcagcagccgtcaggcgattgcagcacctgtgcgatgacatgcacaacagaggggatatccataagca

SEQ ID NO: 30644 - DNA, 75 bp, Artificial Sequence
  Synthetic
gtataaaagatgaactaaaggacgtcactgtatgcatagaaggcttttgctcaactagggtgagcaaaggttcaa

SEQ ID NO: 30645 - DNA, 75 bp, Artificial Sequence
  Synthetic
aagtgtggaaaatagagttcaataaccagtacccatcctctggttccattgctcaggccaggggaacaactgttg

SEQ ID NO: 30646 - DNA, 75 bp, Artificial Sequence
  Synthetic
gaggggaaagttttgagctcactgcagaatgtggaaggaggtcaggatgtgaacagatcaactgcctcttctgca

SEQ ID NO: 30647 - DNA, 75 bp, Artificial Sequence
  Synthetic
gggagatgctctcaaatcctcagtgctatccctacgggaaatggcttttgttgttcctcatgcttgctgtgtttt

SEQ ID NO: 30648 - DNA, 75 bp, Artificial Sequence
  Synthetic
acatcttcattgccttactcaagacaatcatgagaatcatcatgacatgtctctccattctttatggacccttca

SEQ ID NO: 30649 - DNA, 75 bp, Artificial Sequence
  Synthetic
tgattgtcattaagatatcaaggtgtttaggcagactagggaagaggaagggagagaggacttatgtgagactaa

SEQ ID NO: 30650 - DNA, 75 bp, Artificial Sequence
  Synthetic
tggaagcaatagatgatgagaaggagcctgaagctccaaagcctatggcaacagcgaacaaagctaaacaaccgc

SEQ ID NO: 30651 - DNA, 75 bp, Artificial Sequence
  Synthetic
gcattgtcttgttcattatcttaggcatttttgtgcatgttgcatttggctgtgatgagagcaggctggtggaag

SEQ ID NO: 30652 - DNA, 75 bp, Artificial Sequence
  Synthetic
agacagctgttacatgcagtcctggctctgacaacattttctcttgcaccactaaggaggtgatcaccatcaagg

SEQ ID NO: 30653 - DNA, 75 bp, Artificial Sequence
  Synthetic
agctgagagcagggaaaacaatctgtgtgagcctgaaaggccccggagggagtctttcaaagccaatcaaagtca

SEQ ID NO: 30654 - DNA, 75 bp, Artificial Sequence
  Synthetic
aaatgcttgatattgtgggtcggtcagacctgctggacatatacttcacctataatggccatgcaaattgtaagt

SEQ ID NO: 30655 - DNA, 75 bp, Artificial Sequence
  Synthetic
ctgttcgaagatgcagatgggcaggttcctgtggcaattcaggatgtgtaggggttgggaaggaggattatgaca

SEQ ID NO: 30656 - DNA, 75 bp, Artificial Sequence
  Synthetic
gagaactgggagaacaagaatcttcaacacatccgaactggagggactgttatgacgggtgtggtggggcagcat

SEQ ID NO: 30657 - DNA, 75 bp, Artificial Sequence
  Synthetic
gtgggtgctttaatgcagctcctagttgcatcttcctgaagaggtatgtcacaaatgctgactccagggttttca

SEQ ID NO: 30658 - DNA, 75 bp, Artificial Sequence
  Synthetic
aagtctttaagcccttagcttggtttttgtctaccaaaattgtggttgacactgctacacacaaggaagatacaa

SEQ ID NO: 30659 - DNA, 75 bp, Artificial Sequence
  Synthetic
ccttgaaaagtggagaggcaaaagtgattgataaggtgtcttttcactacaggacagacaaaaatctctttgccg

SEQ ID NO: 30660 - DNA, 75 bp, Artificial Sequence
  Synthetic
ggataaccattcctcccatagtgacagaggtgaaaagagaaggaaagcccctcagtttttttatggagagccagg

SEQ ID NO: 30661 - DNA, 75 bp, Artificial Sequence
  Synthetic
gtcaacacccgaagtgcaaggatgaaaactcagcaagaatttcatctgcttcaaactgcatagttgatcagaact

SEQ ID NO: 30662 - DNA, 75 bp, Artificial Sequence
  Synthetic
caatttcagcaaatgcaagggtagatgatgtcacttgcagaagtaacttggtaagcatttctgggatgagcactt

SEQ ID NO: 30663 - DNA, 75 bp, Artificial Sequence
  Synthetic
taaagcctcttccgcaaagggtaggagattttcttatagaactgcaaaatgatgagcctgtgcttttggctactg

SEQ ID NO: 30664 - DNA, 75 bp, Artificial Sequence
  Synthetic
gggattcaggtgtagtagaaggagagctccaaatagacctatcacacaagaaaatctctatcaaagttgacacga

SEQ ID NO: 30665 - DNA, 75 bp, Artificial Sequence
  Synthetic
cagtctgtaggggttcaatgaaagaactcaaaggatgtgtggggtgcacaaagggggcttttgtgtcactggagg

SEQ ID NO: 30666 - DNA, 75 bp, Artificial Sequence
  Synthetic
ttcattctacgtctgcaggatcagccagcctacagtgcagcctgagcagttgttatatggaagttcagaagggca

SEQ ID NO: 30667 - DNA, 75 bp, Artificial Sequence
  Synthetic
tcaacaatgtgaattgttcactcaggtttgctaaagcagttgtagaggaatcatgtgttctagcctgctcaggat

SEQ ID NO: 30668 - DNA, 75 bp, Artificial Sequence
  Synthetic
ccaaggagcaattacttataaagggaaacctcataattggtggagactttaaaaagttaactgaggattctgcaa

SEQ ID NO: 30669 - DNA, 75 bp, Artificial Sequence
  Synthetic
caagcttctctcatggtgactcaaaagacacacgaattcacatacaaactggcttcttaaattggctagacacac

SEQ ID NO: 30670 - DNA, 75 bp, Artificial Sequence
  Synthetic
tatttgggactggccttctagggaaaattctaggaataggccttgccatcctatccccatttattctagtcctgc

SEQ ID NO: 30671 - DNA, 75 bp, Artificial Sequence
  Synthetic
tcataaaatggattatcagagccataattaaacgatctagaattagaaaaggtcccaaacatggcatggtcaaag

SEQ ID NO: 30672 - DNA, 75 bp, Artificial Sequence
  Synthetic
acagctaagtcatttggcctgatggattaccatctctagtcttcgggctagagagttccagtgctggcggtcttt

SEQ ID NO: 30673 - DNA, 75 bp, Artificial Sequence
  Synthetic
ctaagtcatttggcctgatggattaccatctctagtcttcgggctagagagttccagtgctggcggtctttgtgt

SEQ ID NO: 30674 - DNA, 75 bp, Artificial Sequence
  Synthetic
acacagaggcgccagcatggaaacaaggatacaggatactcgtataaacttcccaaggagagaggagttaactgc

SEQ ID NO: 30675 - DNA, 75 bp, Artificial Sequence
  Synthetic
tgaaggcatcctgtatcatgcccagctcgatgacaccactcttcctgccttcagcatccaagaaacagagtcctc

SEQ ID NO: 30676 - DNA, 75 bp, Artificial Sequence
  Synthetic
actctcccttgagattgatgaggttcctgatagtgtcagtcagattggcagcagtatagccctgggagcaacaaa

SEQ ID NO: 30677 - DNA, 75 bp, Artificial Sequence
  Synthetic
aattgaagttggccaaatatctactctggtgcatgacttcacttttgctgttgtgtccgaagatacagatgagcc

SEQ ID NO: 30678 - DNA, 75 bp, Artificial Sequence
  Synthetic
tctctcacggcattttccagtgatgaatgatggagaagaccacctaactcctgatatgatcattgatgtgactca

SEQ ID NO: 30679 - DNA, 75 bp, Artificial Sequence
  Synthetic
aacggaaaggcgggttgtagagtttgccacacacaggggtgctggccacagaggagttttaaactacttcaacca

SEQ ID NO: 30680 - DNA, 75 bp, Artificial Sequence
  Synthetic
aaaaatggagaagtacaaaaggcctttagccctcaggaaggagagaactggttggcacatcacattatcgtgtat

SEQ ID NO: 30681 - DNA, 75 bp, Artificial Sequence
  Synthetic
ttctgtgggcacagaccatgtagtttcagatttgagacttccccagaatctagttgatgagcttgtctacagatt

SEQ ID NO: 30682 - DNA, 75 bp, Artificial Sequence
  Synthetic
tcgatttgcgtgtgccgtcatggcacaaattctagtagccttcccaggacttgctcctcaactgtcagaagaagt

SEQ ID NO: 30683 - DNA, 75 bp, Artificial Sequence
  Synthetic
cacccaaaacgaaaggagggggattgagtgtgttgagctcttgactcaaaatctagtaggggatggtccggggcc

SEQ ID NO: 30684 - DNA, 75 bp, Artificial Sequence
  Synthetic
aaaaacaggggttttccctcttggagaaaaggaaatccttgacaactttctcatggggagtgaggatggagaata

SEQ ID NO: 30685 - DNA, 75 bp, Artificial Sequence
  Synthetic
ccttaagacagtattcaccaggaccttcaacgatagcctaaaagaaattaggcatgagcatgtgccagagggcat

SEQ ID NO: 30686 - DNA, 75 bp, Artificial Sequence
  Synthetic
gcacaggaatggagcactcagaaaaaaccagggcgaggctctaagtcagatgacagatctccaggaagaaatgct

SEQ ID NO: 30687 - DNA, 75 bp, Artificial Sequence
  Synthetic
ggcagattactcaaaacagtcgagagctccccctgaaaacaaatacaaatccaccatcaagatacctccatggct

SEQ ID NO: 30688 - DNA, 75 bp, Artificial Sequence
  Synthetic
aatcccagcaagcaaaagagatatcaatgtgtgtcctgacccagatgatctggatggtctttctgacgagactgt

SEQ ID NO: 30689 - DNA, 75 bp, Artificial Sequence
  Synthetic
gacctctcgagtctggaaaagtgcactaacagacacattcttttcaggtaacccgggatggcaagaaaacattga

SEQ ID NO: 30690 - DNA, 75 bp, Artificial Sequence
  Synthetic
cagagaagtttcattggccagcggcatactcattacagaggatgctgaaaacctgaaaacggagtaccatagaac

SEQ ID NO: 30691 - DNA, 75 bp, Artificial Sequence
  Synthetic
aaagctcaacttgacttctcaagactgggttgctttggcagctagaggcattgaaggtaaagccctcagacatga

SEQ ID NO: 30692 - DNA, 75 bp, Artificial Sequence
  Synthetic
ggacactgttaagactgcagatgaagagtcccatcaaactcttagccccttatcagatacctcaggcattgagtc

SEQ ID NO: 30693 - DNA, 75 bp, Artificial Sequence
  Synthetic
ctgtttggagagcaacaactggtttcatcaggctcgaagtcaaaaagagcacttgtttcaagatctggaccagct

SEQ ID NO: 30694 - DNA, 75 bp, Artificial Sequence
  Synthetic
gattgaggcttcccttgaggtgtcttgtgaatctcaaggacttagggattctgtgttaaccaccttcaagaacta

SEQ ID NO: 30695 - DNA, 75 bp, Artificial Sequence
  Synthetic
cagaaacaccaatgctgtgcactgggcttgcatggtgacgcaacttgctactgagctgtcaatctcagctaaaca

SEQ ID NO: 30696 - DNA, 75 bp, Artificial Sequence
  Synthetic
gagctgcaaaaaacaccagttcattcttaagaagctccccaacttccctgtactggttctaattaaaacaagcag

SEQ ID NO: 30697 - DNA, 75 bp, Artificial Sequence
  Synthetic
gtcaggatctcacgttttttacagcttggctgctaaggcaagtgacatcacgggagaattggatgggcaggtgtt

SEQ ID NO: 30698 - DNA, 75 bp, Artificial Sequence
  Synthetic
caaaaattatgaaagatcaggtggttggttcatcactgaatttaactctgtgaaactctgcaagctagagaacat

SEQ ID NO: 30699 - DNA, 75 bp, Artificial Sequence
  Synthetic
gattaagttgcccatgctgatcatctctatgctagcatactttcaagaaactgaggagaagctggtgacaaaata

SEQ ID NO: 30700 - DNA, 75 bp, Artificial Sequence
  Synthetic
tagccgtccaactctatttacaaggaagatgactactctagcaatcctgacatgtttggaggacaagtcactgac

SEQ ID NO: 30701 - DNA, 75 bp, Artificial Sequence
  Synthetic
agaagagctcatcaccatccagagatatattcagatggagggatttgtaagtgagccactgctaccaaaacctca

SEQ ID NO: 30702 - DNA, 75 bp, Artificial Sequence
  Synthetic
aaaaatgctagagaaactgtctgtgccattaagaaccaccctccaggtctatctttttaagcagtgcatgagtag

SEQ ID NO: 30703 - DNA, 75 bp, Artificial Sequence
  Synthetic
cattaggatcatctcaggcagtccttttaagaggctatccaggggaggagaagttgtttggagaggctgctttgc

SEQ ID NO: 30704 - DNA, 75 bp, Artificial Sequence
  Synthetic
tggatgcttgggcattagctgttctcctgaacaaatggttaactcttggtacctaggctacctgaagaataagga

SEQ ID NO: 30705 - DNA, 75 bp, Artificial Sequence
  Synthetic
cgaagacacagaagtgaacatgctcagtgccatgtatgaaaaaattgtgaaagtggaggagaaaagaccagaaaa

SEQ ID NO: 30706 - DNA, 75 bp, Artificial Sequence
  Synthetic
ggatgacaacctagtgggaggagaccccattaaccctaaaatgcatgagttttcaggttctttcatcaagttcat

SEQ ID NO: 30707 - DNA, 75 bp, Artificial Sequence
  Synthetic
ggctagagcccttgatgaagagatcagccaaaggagaggaaggaactggaggcaggatctgacagcacaattcta

SEQ ID NO: 30708 - DNA, 75 bp, Artificial Sequence
  Synthetic
cagatccctagggtcaataactctagatcagatggccaccttgaaagctagtagcaacttctcagaagagtggga

SEQ ID NO: 30709 - DNA, 75 bp, Artificial Sequence
  Synthetic
agaatttgaagaatcccgcatgaaagaataccatagggtaaaagttatagagaggattgctgacttagtcaacca

SEQ ID NO: 30710 - DNA, 75 bp, Artificial Sequence
  Synthetic
aggacatacttactacactgactgtcttggtagatgcttcaaagttgtgctagaggatggctgcatgaggatctg

SEQ ID NO: 30711 - DNA, 75 bp, Artificial Sequence
  Synthetic
tctttttaagaaagcgcaacatgggggtcttagagagatttatgttctccgactagaagaacgcatgatccaatt

SEQ ID NO: 30712 - DNA, 75 bp, Artificial Sequence
  Synthetic
tggaatcgaacttctcgcaaggaaaattaacgaggttgttggtcatgaaaccatcagtgttccttccagaaaaga

SEQ ID NO: 30713 - DNA, 75 bp, Artificial Sequence
  Synthetic
agagatattggacacacaccaagttagggctgcaaaggcctgtggagaaggaaccatgatcacactctgcagttc

SEQ ID NO: 30714 - DNA, 75 bp, Artificial Sequence
  Synthetic
aaatgatgctagaacctggaaccaagggcattacaccaccaaatttgcattcctaatgtgtgaactcatgcctaa

SEQ ID NO: 30715 - DNA, 75 bp, Artificial Sequence
  Synthetic
ggaactgcatggcttaatttgggcctcatgcgccattttccgaaggaaaaagatgatgctcaatctagactactt

SEQ ID NO: 30716 - DNA, 75 bp, Artificial Sequence
  Synthetic
gaacagcattgcaaagcacaaagagggcctaaagggattcaagaaaaggttgcatgacggattttccgggaatga

SEQ ID NO: 30717 - DNA, 75 bp, Artificial Sequence
  Synthetic
tgaagttccctggatcaagaaaggcaagacttacatcctgaccgagacaggcatgatgcaaggcattctgcacct

SEQ ID NO: 30718 - DNA, 75 bp, Artificial Sequence
  Synthetic
gacttccagcctctatcatgctgcataccaggctgctgttaggaagctgattcgaacaaaattaaagactctagt

SEQ ID NO: 30719 - DNA, 75 bp, Artificial Sequence
  Synthetic
gggctgtaggatccttattgatgtcattgagggttctgatgacagtgccattatcatttcaggtgcagtcaagag

SEQ ID NO: 30720 - DNA, 75 bp, Artificial Sequence
  Synthetic
tggagaggaagagattagatttagactggcagcctcagcttgtttgctgtgggttaagcacttaggggtatatgc

SEQ ID NO: 30721 - DNA, 75 bp, Artificial Sequence
  Synthetic
aggaatttacatgtccccaaaaagcaccataggttgtcttgatgtttgtgagtacaactcagagttcaggtttgc

SEQ ID NO: 30722 - DNA, 75 bp, Artificial Sequence
  Synthetic
gagattaatgtgcagacccacattcaaatgggtatgtgccagcctaaacatcccggaagtggaaaaaatctcaga

SEQ ID NO: 30723 - DNA, 75 bp, Artificial Sequence
  Synthetic
cagacaggaagcctttgccaacctgctaacctcagttttggagggaggaggaacctctagcctatgctccatttt

SEQ ID NO: 30724 - DNA, 75 bp, Artificial Sequence
  Synthetic
gcagatgtgtcaggcttggtgccattacatcctcttgggactgtggtcttcgtgcgttttcaggagcataatccc

SEQ ID NO: 30725 - DNA, 75 bp, Artificial Sequence
  Synthetic
gcatctaatttctggaaagaatccagatgtgggctttttcctccttgacaacccagtctgttctggcattctagg

SEQ ID NO: 30726 - DNA, 75 bp, Artificial Sequence
  Synthetic
ctttcgccacaacctctggaggtttgtcagaaagactgaactctcaaacatttatgccagaacactagacaatcg

SEQ ID NO: 30727 - DNA, 75 bp, Artificial Sequence
  Synthetic
ggcactggacggatttgttttaacatcaggaggaagcctttccaaaagccacttgatccgatggggagacaggaa

SEQ ID NO: 30728 - DNA, 75 bp, Artificial Sequence
  Synthetic
gaagttagagcagatgaaggaaagatctggcctggtggagaactggcaggagcagactgatgatgaccctagtgt

SEQ ID NO: 30729 - DNA, 75 bp, Artificial Sequence
  Synthetic
attgtataagaacccatcaaccaacaaggaggtcaaactactgctctgcataaaaattgactctccaggtgttgc

SEQ ID NO: 30730 - DNA, 75 bp, Artificial Sequence
  Synthetic
tgaaagtctttctaaaggcaatgtgctaggcagggttttggcctcctcggtgtatgtgctacagaggagatgtat

SEQ ID NO: 30731 - DNA, 75 bp, Artificial Sequence
  Synthetic
tactgcaaagagaagtaaaagaaaatacaccctgatggagctggccctagagcaggatccaaattacagagcgtt

SEQ ID NO: 30732 - DNA, 75 bp, Artificial Sequence
  Synthetic
gactctggctgaggagtctgccatttttggtgatatagtgtctttggaaaggaatgagactatgtcacagattta

SEQ ID NO: 30733 - DNA, 75 bp, Artificial Sequence
  Synthetic
cagtcatgccaatggagtgctgattgctaaatcaagagaaatgaggagagctaaagttgaggtgttaagtgcaga

SEQ ID NO: 30734 - DNA, 75 bp, Artificial Sequence
  Synthetic
tgagagcttcagggctcctcctgtcaagataatgggagatgtcttctttggaacgacccgcagtcacatgggagc

SEQ ID NO: 30735 - DNA, 75 bp, Artificial Sequence
  Synthetic
aaatatgcttaacagggaactccattacctcaaagaaagcttcccatggatatctaatgaccctcatgactgtct

SEQ ID NO: 30736 - DNA, 75 bp, Artificial Sequence
  Synthetic
gtttcaatcacccttctcaagtcaggctgagatgaagaccttctttgagaagctagaacaaaagaccagaaaagt

SEQ ID NO: 30737 - DNA, 75 bp, Artificial Sequence
  Synthetic
taggatgataggagcagctgtgttcaccagaatgggccagacatccttggagaacctcataaggttcaacttcca

SEQ ID NO: 30738 - DNA, 75 bp, Artificial Sequence
  Synthetic
gaagaactttgaactcaccaagagtgatgtgtctgactctgattattcagatgaagatgagaaattctgcaggca

SEQ ID NO: 30739 - DNA, 75 bp, Artificial Sequence
  Synthetic
tgttgtgaccatgattctctctgggcccttcactaatgaaaggaaagagtgcatgctcatcgattttcttaagaa

SEQ ID NO: 30740 - DNA, 75 bp, Artificial Sequence
  Synthetic
ttctagtctaggaccaccaaaacaactcttgaggagaagcaggacaaacgtactgcgggtggttcgctcctggct

SEQ ID NO: 30741 - DNA, 75 bp, Artificial Sequence
  Synthetic
tgaaggtcatgcacggatagaagaactggtggaaaagagcatggacggcatatgtggagccttcaccataaggca

SEQ ID NO: 30742 - DNA, 75 bp, Artificial Sequence
  Synthetic
aaaggtgttcaaagacaaaaaaggcaatgtgagttacaaagggttgggtgtgtggacaggcagaatcgaaggaac

SEQ ID NO: 30743 - DNA, 75 bp, Artificial Sequence
  Synthetic
agattgcaaacttcagatagaaagtgggtttgcatctgaccaaatcttaaagcaagttgtcattgcctctgacag

SEQ ID NO: 30744 - DNA, 75 bp, Artificial Sequence
  Synthetic
aagtctttctgacttcctgcctggcttagaaagactttgcaaagaactgaaggtcagtaatcccagaaagccttt

SEQ ID NO: 30745 - DNA, 75 bp, Artificial Sequence
  Synthetic
tccagtaaaagaggctgaacgtcagaactttattggcgccctagttgacttcaggctggagtcaaggttttcaag

SEQ ID NO: 30746 - DNA, 75 bp, Artificial Sequence
  Synthetic
agctggagctccagttttattggtgcctcagcatgaagggttcctcaaagagatgatggataggtctgacataag

SEQ ID NO: 30747 - DNA, 75 bp, Artificial Sequence
  Synthetic
cctcatggttagatcagatgtactgaacatcagagcagatttgggagatgggagattaataacaatgttgagtta

SEQ ID NO: 30748 - DNA, 75 bp, Artificial Sequence
  Synthetic
caagtcctcagggcaggatgctgactcagaacaaggcaaccaatttttcagtaggagagaatcactctcaaaaag

SEQ ID NO: 30749 - DNA, 75 bp, Artificial Sequence
  Synthetic
gtttggttgggctattagggagccttacctcagctggattagcctagggccaatccctgatgttctagttccaag

SEQ ID NO: 30750 - DNA, 75 bp, Artificial Sequence
  Synthetic
attgaaggaagaaatgacaggaagaaggaggacagaagggattgatggagaacagctcagagatatcttcaaaag

SEQ ID NO: 30751 - DNA, 75 bp, Artificial Sequence
  Synthetic
atgctgtaaggggtcattaaggcggaaaggcttgactgttggccagtattccaacgtaagattgagaatagaaga

SEQ ID NO: 30752 - DNA, 75 bp, Artificial Sequence
  Synthetic
tacatcagaggaagtggacattgaccttctcgaattgctagatgaagatgttgactttggagatactttacagtc

SEQ ID NO: 30753 - DNA, 75 bp, Artificial Sequence
  Synthetic
acagaacattcaggatctcgaggctagcatagaagagatggaagttttgtttggggaggatgaccttgaagtttt

SEQ ID NO: 30754 - DNA, 75 bp, Artificial Sequence
  Synthetic
tgatttcactgaggtaatttcaagatctgacccgctagcctaccacggattttgtgacagaataattgaggacta

SEQ ID NO: 30755 - DNA, 75 bp, Artificial Sequence
  Synthetic
catcaaaaggctaggtcatgaggctatcaggaaagccatccaaaagagagaatgtgcccaaagtgattaccctct

SEQ ID NO: 30756 - DNA, 75 bp, Artificial Sequence
  Synthetic
tgtcaagaatctctttgaaagcattggcgagaaccctgacgagctgtcagtactgcctgacaaagatgatgcata

SEQ ID NO: 30757 - DNA, 75 bp, Artificial Sequence
  Synthetic
tgcctcttctggcctcattacagaagacttgtggggttgatctctttgcccttctcttaaaatcttaactttctg

SEQ ID NO: 30758 - DNA, 75 bp, Artificial Sequence
  Synthetic
gggttgatctctttgcccttctcttaaaatcttaactttctgtatttctctactaaccgctggcggtctttgtgt

SEQ ID NO: 30759 - DNA, 75 bp, Artificial Sequence
  Synthetic
cgatgatgaggttgttggcgggttggaggcgctgtttgcctatcaaggctttgatccaaccagaatgctgaaaaa

SEQ ID NO: 30760 - DNA, 75 bp, Artificial Sequence
  Synthetic
gatggctgacattgacaaggatggctggaaagatgatgccaaggtcatcatcgtgtttgccttgacaagaggcaa

SEQ ID NO: 30761 - DNA, 75 bp, Artificial Sequence
  Synthetic
caagatgtcaaaagccatggccaagatgtcagaggagggccaaacaaagttgaaggcccttaaaagcaagtacag

SEQ ID NO: 30762 - DNA, 75 bp, Artificial Sequence
  Synthetic
gatgaaggaaaatcctgaggcaagggatgacatcacccccacgagagtagcagctgccctgcccacatggactgt

SEQ ID NO: 30763 - DNA, 75 bp, Artificial Sequence
  Synthetic
gcgagctgcaaaggcccttcagaactctcttccaatgggccctgacaacatcaaagctctgtgtgctgtagatgc

SEQ ID NO: 30764 - DNA, 75 bp, Artificial Sequence
  Synthetic
accagcagagatttgctgtgcagccttcgccagcctgattccgaccagtgagctgactgaaaagcagattgagca

SEQ ID NO: 30765 - DNA, 75 bp, Artificial Sequence
  Synthetic
gctcacccatgctttctatctctggcagttttatttcactcagctgatcaacccaaaagtgaggggcaagggcaa

SEQ ID NO: 30766 - DNA, 75 bp, Artificial Sequence
  Synthetic
aacaactgtcctacagacttttgagaacgctgtgaaagctgctatgaactcaaccagctaccctgacaagtcaag

SEQ ID NO: 30767 - DNA, 75 bp, Artificial Sequence
  Synthetic
agtggccttcctgaagaagattggcatcttcaacaagaagaacgaaatcaacggaaatatccaggccatggcagc

SEQ ID NO: 30768 - DNA, 75 bp, Artificial Sequence
  Synthetic
agcctgggaaaaactggaatgagctgcctccaaaacgacaccaatcaggcaaaattctgttcagacttaattagg

SEQ ID NO: 30769 - DNA, 75 bp, Artificial Sequence
  Synthetic
ctaaattagaccccttctctctctctgtgcatatgcacagagagggggaaggggtcaaataggtaaagagcctgt

SEQ ID NO: 30770 - DNA, 75 bp, Artificial Sequence
  Synthetic
tatgggttcaaggggtaggccaatcagaagtgaattgagtacagaaatagtgaagcctgaatgtttcttgagtct

SEQ ID NO: 30771 - DNA, 75 bp, Artificial Sequence
  Synthetic
caaggaaataggtgatggactcgtcacagctcagcttggccaggtgagaagcctcatcaaaaggcggtcctctgt

SEQ ID NO: 30772 - DNA, 75 bp, Artificial Sequence
  Synthetic
taaccttcctacgatctcccgagttgaaggtttccagcagtaaaatccgagtgttggagccctgactggcctcaa

SEQ ID NO: 30773 - DNA, 75 bp, Artificial Sequence
  Synthetic
tcctgatgtattcatcaacctcttttctaattggccgtggcaattttactgggtaaaaccagcccaaagcctgga

SEQ ID NO: 30774 - DNA, 75 bp, Artificial Sequence
  Synthetic
gcacctgcacatccacaagcccagaggtcgaaattccaagcaactctaggtcctttgctgctgctctaaggtagg

SEQ ID NO: 30775 - DNA, 75 bp, Artificial Sequence
  Synthetic
atagaacctggagtaagcccactttcatcaaaattgggcacccactgagaacgcccaagacacccaacctttgtg

SEQ ID NO: 30776 - DNA, 75 bp, Artificial Sequence
  Synthetic
ctcttacattggcttttctatttaagtcaaaaagcctgtctgcaatggtactctcatggtttgactcaggtgttg

SEQ ID NO: 30777 - DNA, 75 bp, Artificial Sequence
  Synthetic
acttgatgagcagtttaactagagccttccaagagtagcatctctctagaggagttccatgcccgtacaccttta

SEQ ID NO: 30778 - DNA, 75 bp, Artificial Sequence
  Synthetic
atgcaagagaaatccaagagactgaggtgactccctgaggccacctcaaagagctcctttcctgactagtcatgg

SEQ ID NO: 30779 - DNA, 75 bp, Artificial Sequence
  Synthetic
gccttccttttggcaggatgtcttccatagtctccaagaggaagattggcctaggcaaggacctcaccatatggc

SEQ ID NO: 30780 - DNA, 75 bp, Artificial Sequence
  Synthetic
ctccatcaaggaagagagtttgaattgcagcagtgccttgaaacagatccaccagttctcttggcactggaggat

SEQ ID NO: 30781 - DNA, 75 bp, Artificial Sequence
  Synthetic
acaatgtgtggacatcccgtatacggatgtttgccactgacatcctccagtatcctcctatgatcaaggatccag

SEQ ID NO: 30782 - DNA, 75 bp, Artificial Sequence
  Synthetic
ggatccaggtgaaacctcaccagacagcctaaactgtatagatctactgtcgtccattctgcggcttctctgtgt

SEQ ID NO: 30783 - DNA, 75 bp, Artificial Sequence
  Synthetic
acacaaagacgccagctatcaagatgatgttctcacgtacactgatgctggcattgatttgtgctgcagcttgcg

SEQ ID NO: 30784 - DNA, 75 bp, Artificial Sequence
  Synthetic
atgataacccatgtctctgggagtggtttgccaactccaaggacatggaattcatgactccagttgtcaatctga

SEQ ID NO: 30785 - DNA, 75 bp, Artificial Sequence
  Synthetic
gcacctccaagggattatcaatgtcccaaaggatatgcatggtcagcatgggagagcactggtctaggatcttga

SEQ ID NO: 30786 - DNA, 75 bp, Artificial Sequence
  Synthetic
gtgaggcagaggaaaaggagatgaagaatctggatccattggtgatgtcaagtttaaactggagaggtacagcta

SEQ ID NO: 30787 - DNA, 75 bp, Artificial Sequence
  Synthetic
aaactaggagttcaacatccttcaactttgacatcctggacgccattttccttggcctcctaaacatgaccaaat

SEQ ID NO: 30788 - DNA, 75 bp, Artificial Sequence
  Synthetic
gggatgaggataacggtaagcagaggcccattcaccctgagtgcattaaatccaagatttgcggttttatgacag

SEQ ID NO: 30789 - DNA, 75 bp, Artificial Sequence
  Synthetic
cttcagggcccagagtcaaaacatgctctggcaagtttagaggagctgacagacatggtcactgcaccagcagag

SEQ ID NO: 30790 - DNA, 75 bp, Artificial Sequence
  Synthetic
ccataccctatgaagcaactaatgtgatctctgttggtgtacaacatgctcaagaggctgatcagttggatgaac

SEQ ID NO: 30791 - DNA, 75 bp, Artificial Sequence
  Synthetic
atgaagagagctttatatctgaagctagaaaatcaaacaaccctgacttttgcagtgttgatggggtcgagatca

SEQ ID NO: 30792 - DNA, 75 bp, Artificial Sequence
  Synthetic
atcagtgtgacatgacctctcctgggagatggctccttctgcactatgccagcttcagactgcaggaaggaagtc

SEQ ID NO: 30793 - DNA, 75 bp, Artificial Sequence
  Synthetic
tagtgtacttttctcctggtctcaacatcaaatggagtcagatcagtgcacccatctctgacttcttctgcatta

SEQ ID NO: 30794 - DNA, 75 bp, Artificial Sequence
  Synthetic
atgtctccaaacacctggattctcactatagaccctgcaacataaactgcaccaatgactgtcaaggagacgagc

SEQ ID NO: 30795 - DNA, 75 bp, Artificial Sequence
  Synthetic
tctactgctcaatccatgagtgcgccagatcagctgaatgcaaatgctcatttatagggagtagaggtgttgctc

SEQ ID NO: 30796 - DNA, 75 bp, Artificial Sequence
  Synthetic
aggttcagattggagatcggtggtttacacctgcagttgtgggaagccagcaattttttgtgaaagaggagatcc

SEQ ID NO: 30797 - DNA, 75 bp, Artificial Sequence
  Synthetic
ctatccttcagcagccatctgcagactgtaccacgtgctccatgacatgctcaactgaaggaatttcaatcagta

SEQ ID NO: 30798 - DNA, 75 bp, Artificial Sequence
  Synthetic
gcattaaggatgaactcaaggatgtaacagtatgtgttgaaggattctgctcatcaagaatgagcaaagggtcta

SEQ ID NO: 30799 - DNA, 75 bp, Artificial Sequence
  Synthetic
aggtttggaagattgaatttcataaccagtatccatcttctgggtcagttgcacaggccagaggaacaactgtgg

SEQ ID NO: 30800 - DNA, 75 bp, Artificial Sequence
  Synthetic
gaggagagagatttgaactcactgccgaatgtggaagaagatcaggatgtgaacaaatcaattgcctcttctgca

SEQ ID NO: 30801 - DNA, 75 bp, Artificial Sequence
  Synthetic
gggaaatgttatctaatcctcaatgctacccttatggcaaatggcttctcctcttcctgatacttgccgtcttct

SEQ ID NO: 30802 - DNA, 75 bp, Artificial Sequence
  Synthetic
acatctttattgccctccttaggacaatcatgagaattgttatgacatgcctttcaatcctgtatggacctttca

SEQ ID NO: 30803 - DNA, 75 bp, Artificial Sequence
  Synthetic
tgattgtcattaagatctcaaaatgcctgggcaggatagggaagaagaagggtgaaagaacatatgtgaggctga

SEQ ID NO: 30804 - DNA, 75 bp, Artificial Sequence
  Synthetic
tggaagctatagatgaagagaaaaaacttgaagtgcagagacccgtaacacctgtagggagagctaaacagcctc

SEQ ID NO: 30805 - DNA, 75 bp, Artificial Sequence
  Synthetic
gcattgtcctgttcattgttttaactatcatgatgcatgtggctctctgctgcgatgagagcagactgatcgagg

SEQ ID NO: 30806 - DNA, 75 bp, Artificial Sequence
  Synthetic
aaacatctgtgacttgcactcctggatctgacaatatcttctcttgttctactaaagagattgttactatcaagg

SEQ ID NO: 30807 - DNA, 75 bp, Artificial Sequence
  Synthetic
aattgagggcagggaaaacaatttgtgttagcctgaaagggcccggtgggagcctctcaagccctatcaaagtca

SEQ ID NO: 30808 - DNA, 75 bp, Artificial Sequence
  Synthetic
agatgcttgacatagtggggaggtcagaccttctagatgtctattttactttcaatggccacgcaaattgcaaat

SEQ ID NO: 30809 - DNA, 75 bp, Artificial Sequence
  Synthetic
ctgtccgcaggtgcaggtgggcagggtcttgtggcaattcagggtgcatgggtgtggagaaagatgactatgaca

SEQ ID NO: 30810 - DNA, 75 bp, Artificial Sequence
  Synthetic
gagagttgggagaacaagattcttcaacacacccgaactggagggactgttatgatggttgtggtggagcagctt

SEQ ID NO: 30811 - DNA, 75 bp, Artificial Sequence
  Synthetic
gtgggtgcttcaatgctgcacccagctgcattttccttaagaggtatgtcaccaatgctgattcaagagtattca

SEQ ID NO: 30812 - DNA, 75 bp, Artificial Sequence
  Synthetic
aggtgttcaagccttctgcatggtttttatctacaaaaatagtggttgacactgcgtcacacaaggaggatacaa

SEQ ID NO: 30813 - DNA, 75 bp, Artificial Sequence
  Synthetic
cactaaagagtggggaggccaaggttattgacaaggtgtcttttcattacaggactgataagaacctgtttgctg

SEQ ID NO: 30814 - DNA, 75 bp, Artificial Sequence
  Synthetic
ggattacaatcccccccatagtaacagaagtaaagagggaagggaaacctcttagcttctttctggagagccaag

SEQ ID NO: 30815 - DNA, 75 bp, Artificial Sequence
  Synthetic
ggcaacatcctaaatgcaaagatgaaaactcagcaaggatctcatcagcatcaaactgcatcattgaccaaaact

SEQ ID NO: 30816 - DNA, 75 bp, Artificial Sequence
  Synthetic
caatctcagccaatgcaagagtagatgatgtttcatgtagaagcaatctagtcagtgtctccggaatgagtgctc

SEQ ID NO: 30817 - DNA, 75 bp, Artificial Sequence
  Synthetic
taaagcctttaccacagagggtgggagacttcctcatagaattgcagaatgatgagcctgttcttctggcaacag

SEQ ID NO: 30818 - DNA, 75 bp, Artificial Sequence
  Synthetic
gggattcaggggttgttgaaggagaactccaaatagatctgtcacataagaaaatatcaatcaaggtggacacaa

SEQ ID NO: 30819 - DNA, 75 bp, Artificial Sequence
  Synthetic
cagtgtgcagaggctctatgaaggaactcaaaggatgtgtgggctgcaccaaaggggcctttgtctctttggaag

SEQ ID NO: 30820 - DNA, 75 bp, Artificial Sequence
  Synthetic
tccattcaacttcagcaggatcagccagccttcaatgcagtttgagtagctgctatatggatgttcagaaaggca

SEQ ID NO: 30821 - DNA, 75 bp, Artificial Sequence
  Synthetic
taaataatgttaattgttccctcagatttgccaaggcagttgttgaagaagcttgtgtactagcttgttcaggat

SEQ ID NO: 30822 - DNA, 75 bp, Artificial Sequence
  Synthetic
ccaaagaacagttggtcattaaggggaatctcattattggaggagatttcaagaaattgacagaggactcagcaa

SEQ ID NO: 30823 - DNA, 75 bp, Artificial Sequence
  Synthetic
caagtttttctcatagtgattcaaaagatgccagaatccacctgcagaccggtttcttaaactggctagatacat

SEQ ID NO: 30824 - DNA, 75 bp, Artificial Sequence
  Synthetic
tgtttggaaccagccttattgggaaaatattagggataggctttgcagttctatctccattcatcctggtcctaa

SEQ ID NO: 30825 - DNA, 75 bp, Artificial Sequence
  Synthetic
ttttaaaatggattataaaagccataatcagaagatccagagttaggcagggctctagacatgatgtgatcaaag

SEQ ID NO: 30826 - DNA, 75 bp, Artificial Sequence
  Synthetic
acaactaagtcatctgacctgatggatttccatctctagtcttcgggctagagagttccaatgctggcggtcttt

SEQ ID NO: 30827 - DNA, 75 bp, Artificial Sequence
  Synthetic
ctaagtcatctgacctgatggatttccatctctagtcttcgggctagagagttccaatgctggcggtctttgtgt

SEQ ID NO: 30828 - DNA, 75 bp, Artificial Sequence
  Synthetic
gcctcggcctcttatatattataaaaaaaaaggccacagggaggagctgctaacccatggaatgtagccaaacca

SEQ ID NO: 30829 - DNA, 75 bp, Artificial Sequence
  Synthetic
atgaagggtatctactctttttttagctaaaactgtatctactgcttgctgacaaataacttttttgtttttact

SEQ ID NO: 30830 - DNA, 75 bp, Artificial Sequence
  Synthetic
aggaactccaccaggactcccactcttctgttccataggttggcacctaaaaaaaaaataattacttagggcctt

SEQ ID NO: 30831 - DNA, 75 bp, Artificial Sequence
  Synthetic
tggccttgtccccagttaaactggacaaaggccatggttctgcgccagctgtcacgacaagcttctgtgaaagtt

SEQ ID NO: 30832 - DNA, 75 bp, Artificial Sequence
  Synthetic
ctgggcagccagccagtggcagttaatagtgaaaccccgcccctaaaattctcaaataaacacaagaggaagtgg

SEQ ID NO: 30833 - DNA, 75 bp, Artificial Sequence
  Synthetic
tgacctcaggaaggaaagtgcatgactgggcagccagccagtggcagttaatagtgaaaccccgcccctaaaatt

SEQ ID NO: 30834 - DNA, 75 bp, Artificial Sequence
  Synthetic
ctcaaataaacacaagaggaagtggaaactggccaaaggagtggaaagcagccagacagacatgttttgcgagcc

SEQ ID NO: 30835 - DNA, 75 bp, Artificial Sequence
  Synthetic
aagaatcttggccttgtccccagttaatactggacaaaggccatggttctgcgccagctgtcacgacaagcttca

SEQ ID NO: 30836 - DNA, 75 bp, Artificial Sequence
  Synthetic
agtaaaacctggactggaacaaaaaaaagagctcagaggatttttatttttattttagagcttttgctggaattt

SEQ ID NO: 30837 - DNA, 75 bp, Artificial Sequence
  Synthetic
agcatttgcaaagtgcttttcatgatacttaaagtgataaggctggtcttttttctgacactttttacactcctc

SEQ ID NO: 30838 - DNA, 75 bp, Artificial Sequence
  Synthetic
tctaaatataagttagttaccttaaagctttagatctctgaagggagtttctccaattatttggacccaccattg

SEQ ID NO: 30839 - DNA, 75 bp, Artificial Sequence
  Synthetic
ccttgttacagtacagcaagaattccactgcccaatctaaatgaggacctaacctgtggaaatctactaatgtgg

SEQ ID NO: 30840 - DNA, 75 bp, Artificial Sequence
  Synthetic
gggctatagtcagcacctaagtgctgaaaatgcctttgagagtgatagcccagacagaaaaatgcttccttgtta

SEQ ID NO: 30841 - DNA, 75 bp, Artificial Sequence
  Synthetic
ttttatttttattttagagcttttgctggaattttgtagaggtgaagacagtgtagacgggaaaaacaaaagtac

SEQ ID NO: 30842 - DNA, 75 bp, Artificial Sequence
  Synthetic
gggaaaatgttcccccagtacttcatgtgaccaacacagctaccacagtgttgctggatgaacagggtgtggggc

SEQ ID NO: 30843 - DNA, 75 bp, Artificial Sequence
  Synthetic
agcagtagcaacaaggtcattccactttgtaatattcttttttcaagtaaaaattctgagttttgcagggatttt

SEQ ID NO: 30844 - DNA, 75 bp, Artificial Sequence
  Synthetic
gaacaaaaaaaagggctcagaggatttttatttttattttagagcttttgctggaattttgtagaggtgaagaca

SEQ ID NO: 30845 - DNA, 75 bp, Artificial Sequence
  Synthetic
attcaaggcagtaatttccacttctttgctgtaggtggagaacccttggaaatgcagggagtgctaatgaattac

SEQ ID NO: 30846 - DNA, 75 bp, Artificial Sequence
  Synthetic
ttgatgggtgctgctctagcacttttgggggacctagttgccagtgtatctgaggctgctgctgccacaggattt

SEQ ID NO: 30847 - DNA, 75 bp, Artificial Sequence
  Synthetic
tgggggacctagttgccagtgtatctgaggctgctgctgccacaggattttcagtggctgaaattgctgctgggg

SEQ ID NO: 30848 - DNA, 75 bp, Artificial Sequence
  Synthetic
cttccatctaaataatcccttaaactgtctaaattgtttattccatgtcctgaaggcaaatcctttgattcagct

SEQ ID NO: 30849 - DNA, 75 bp, Artificial Sequence
  Synthetic
tgaaggcaaatcctttgattcagctcctgttcccttcacatcttcaaaaacaaccatatactgatctatagccac

SEQ ID NO: 30850 - DNA, 75 bp, Artificial Sequence
  Synthetic
gtatctgggcaaagaggaaaatcagcacaaacctctgagctactccaggttccaaaatcaggctgatgagctacc

SEQ ID NO: 30851 - DNA, 75 bp, Artificial Sequence
  Synthetic
ttgctactatttcccaggctttgtggcatgttattagggatgatatacctgctataacctcacaagaattgcaaa

SEQ ID NO: 30852 - DNA, 75 bp, Artificial Sequence
  Synthetic
ttataattatattcaggattattattctaatttgtcccctattaggccttcaatggttaggcaagtagctgaaag

SEQ ID NO: 30853 - DNA, 75 bp, Artificial Sequence
  Synthetic
ctaacactgtatccactgcttgctgacaaatacttttttgatttttactttctgcaaaaatggtagcatttgcaa

SEQ ID NO: 30854 - DNA, 75 bp, Artificial Sequence
  Synthetic
ctgttacagcacagcaagaattccactacctaatttaaatgaggatctaacctgtggaaatctactaatgtggga

SEQ ID NO: 30855 - DNA, 75 bp, Artificial Sequence
  Synthetic
ttactaacagctctggaacacaacagtggagaggccttgcaagatattttaagattcgcctgagaaaaagatctg

SEQ ID NO: 30856 - DNA, 75 bp, Artificial Sequence
  Synthetic
gttgtttttccactatcaattggacctttaaataaccagtatcttcttttaggtacattaaaaacaatacagtgc

SEQ ID NO: 30857 - DNA, 75 bp, Artificial Sequence
  Synthetic
gtagggttggtcttttttttgacactttttacactcctctacattgtactgaaattctaaatacatacccaatag

SEQ ID NO: 30858 - DNA, 75 bp, Artificial Sequence
  Synthetic
gaagaacagaaagattttttagagactccttggctagatttttggaggaaactacctggacaattgtaaatgccc

SEQ ID NO: 30859 - DNA, 75 bp, Artificial Sequence
  Synthetic
gcagccagacagacatgttttgcgagcctaggaatcttggccttgtccccagttaatactggacaaaggccatgg

SEQ ID NO: 30860 - DNA, 75 bp, Artificial Sequence
  Synthetic
agttaccttaaagctttagatctctgaagggagtttctccaattatttggacccaccattgcagagtttcttcag

SEQ ID NO: 30861 - DNA, 75 bp, Artificial Sequence
  Synthetic
acattttggccatacttatagtatagatgatgctgacagtatagaagaagttacacaaagaatggacttaagaaa

SEQ ID NO: 30862 - DNA, 75 bp, Artificial Sequence
  Synthetic
tctactgcatattcagttattaatttccaggacacctgctttgtttcttcaggttcctctgggttaaaatcatgc

SEQ ID NO: 30863 - DNA, 75 bp, Artificial Sequence
  Synthetic
aagaatagggatttcccccaaatagttttgctaggcctcagaaaaagcctccacacccttactacttgagagaaa

SEQ ID NO: 30864 - DNA, 75 bp, Artificial Sequence
  Synthetic
tttatagaaaaaactattgccccaggaggtgctaatcaaagaactgctcctcaatggatgttgcctttacttcta

SEQ ID NO: 30865 - DNA, 75 bp, Artificial Sequence
  Synthetic
gaagcagtcaatgcagtagcaatctatccaaaccaagggctcttttcttaaaaattttctatttaaatgccttaa

SEQ ID NO: 30866 - DNA, 75 bp, Artificial Sequence
  Synthetic
ccaggtaatgaatactgaccataaggcctacttggacaaaaacaatgcttatccagttgaatgctggattcctga

SEQ ID NO: 30867 - DNA, 75 bp, Artificial Sequence
  Synthetic
gaggtgctaatcaaagaactgctcctcaatggatgttgcctttacttctaggcctgtacgggactgtaacacctg

SEQ ID NO: 30868 - DNA, 75 bp, Artificial Sequence
  Synthetic
ctcttgaagcatatgaagatggccccaaccaaaagaaaaggagagtgtccaggggcagctcccaaaaagccaaag

SEQ ID NO: 30869 - DNA, 75 bp, Artificial Sequence
  Synthetic
ccaaaccatgacctcaggaaggaaagtgcatgactcacagggaggagctgcttacccatggaatgcagccaaacc

SEQ ID NO: 30870 - DNA, 75 bp, Artificial Sequence
  Synthetic
atatgataagatatattgataaacaaggacaattgcaaaccaaaatgctttaaacaggtgcttttattgtacata

SEQ ID NO: 30871 - DNA, 75 bp, Artificial Sequence
  Synthetic
actggggtagatgctataacagaggtagaatgctttctaaacccagaaatgggggatccagatgataaccttagg

SEQ ID NO: 30872 - DNA, 75 bp, Artificial Sequence
  Synthetic
taataaaaggaggagtagaagttctagaagttaaaactggggtagatgctataacagaggtagaatgcttcctaa

SEQ ID NO: 30873 - DNA, 75 bp, Artificial Sequence
  Synthetic
aatcagctacaggcctaaaccaaattagtagtagcaaaagggtcattccactttgtaatattcttttttcaagta

SEQ ID NO: 30874 - DNA, 75 bp, Artificial Sequence
  Synthetic
tggcagttaatagtgaaaccatgccaaaccatgacctcaggaaggaaagtgcatgactgggcagccagccagtgg

SEQ ID NO: 30875 - DNA, 75 bp, Artificial Sequence
  Synthetic
agttaaggcactgtatagtaagtattccttattaacacccttacaaattaaaaaactaaaagtacacagcttttg

SEQ ID NO: 30876 - DNA, 75 bp, Artificial Sequence
  Synthetic
aggggcagctcccaaaaagccaaaggaacccgtgcaagtgccaaaactactaataaaaggaggagtagaagttct

SEQ ID NO: 30877 - DNA, 75 bp, Artificial Sequence
  Synthetic
ttaacccagatgagtactatgatattttgtttcctggtgtaaatacctttgttaataatattcaatatctagatc

SEQ ID NO: 30878 - DNA, 75 bp, Artificial Sequence
  Synthetic
aaccttaggggctatagtctaaagctaactgctgaaaatgcctttgacagtgatagcccagacaaaaaaatgctt

SEQ ID NO: 30879 - DNA, 75 bp, Artificial Sequence
  Synthetic
agaagttaaaactggggtagatgctataacagaggtagaatgcttcctaaacccagaaatgggggatccagatga

SEQ ID NO: 30880 - DNA, 75 bp, Artificial Sequence
  Synthetic
cccctccccaatttaaatgaggacctaacctgtggaaatctactgatgtgggaggctgtaactgtacaaacagag

SEQ ID NO: 30881 - DNA, 75 bp, Artificial Sequence
  Synthetic
aataaatcttcatcccatttttcattaaaggaactccaccaggactcccactcttctgttccataggttggcacc

SEQ ID NO: 30882 - DNA, 75 bp, Artificial Sequence
  Synthetic
agggatttccccaaatagttttgctaggcctcagaaaaagcctccacacccttactacttgagagaaagggtgga

SEQ ID NO: 30883 - DNA, 75 bp, Artificial Sequence
  Synthetic
ggaggctgtaactgtacaaacagaggtcattggaataactagcatgcttaaccttcatgcagggtcacaaaaagt

SEQ ID NO: 30884 - DNA, 75 bp, Artificial Sequence
  Synthetic
attcaaggcagtaatttccacttctttgctgttggtggagaccccttggaaatgcagggagtgctaatgaattac

SEQ ID NO: 30885 - DNA, 75 bp, Artificial Sequence
  Synthetic
gaggccttgcaagatattttaagattcgcctgagaaaaagatctgtaaagaatccttacccaatttcctttttgc

SEQ ID NO: 30886 - DNA, 75 bp, Artificial Sequence
  Synthetic
gagactccttggctagatttttggaagaaactacctggacaattgtaaatgcccctataaacttttataattata

SEQ ID NO: 30887 - DNA, 75 bp, Artificial Sequence
  Synthetic
agaaatgaaaatactaggtattttggaacttacacaggaggggaaaatgttcccccagtacttcatgttaccaac

SEQ ID NO: 30888 - DNA, 75 bp, Artificial Sequence
  Synthetic
acagctaccacagtgttgctggatgaacagggtgtggggcctctgtgtaaagctgatagcctgtatgtttcagct

SEQ ID NO: 30889 - DNA, 75 bp, Artificial Sequence
  Synthetic
tctggaacacaacagtggaggggccttccaagatattttaagattcgcctgagaaaaagatctgtaaagaaccct

SEQ ID NO: 30890 - DNA, 75 bp, Artificial Sequence
  Synthetic
ctcttttcttaaaaattttctatttaaatgtcttaatcttagctgacacagcatgcaagggcagtgcactgaagg

SEQ ID NO: 30891 - DNA, 75 bp, Artificial Sequence
  Synthetic
tatatatgcttaataaatgctgcttttgtataacacagtttaagcttctgttattttgggggtggtgttttaggc

SEQ ID NO: 30892 - DNA, 75 bp, Artificial Sequence
  Synthetic
gcctcggcctcttatatattataaaaaaaaaggccacagggaggagctgcttacccatggaatgcagccaaacgg

SEQ ID NO: 30893 - DNA, 75 bp, Artificial Sequence
  Synthetic
aaggaaagtgtacattcaggagagtttatagaaaaaactattgccccaggaggtgctaatcaaagaactgctcct

SEQ ID NO: 30894 - DNA, 75 bp, Artificial Sequence
  Synthetic
ttgctagatgaacagggtgtggggcctctttgtaaagctgatagcctgtatgtttcagctgctgatatttgtggc

SEQ ID NO: 30895 - DNA, 75 bp, Artificial Sequence
  Synthetic
gacaaatacttttttgatttttactttctgcaaaaataatagcatttgcaaaatgcttttcatgatacttaaagt

SEQ ID NO: 30896 - DNA, 75 bp, Artificial Sequence
  Synthetic
ctgaagtatctgagacttgggaagagcattgtgattgggattcagtgcttgatccatgtccagagtcttcagttt

SEQ ID NO: 30897 - DNA, 75 bp, Artificial Sequence
  Synthetic
ccatctaaataatctctcagactgtctaaattgtttattccatgtcctgaaggcaaatcctttgattcagcccct

SEQ ID NO: 30898 - DNA, 75 bp, Artificial Sequence
  Synthetic
cagcttccaggggacccagatatgataagatatattgacagacaaggacaattgcaaacaaaaatggtttaaaca

SEQ ID NO: 30899 - DNA, 75 bp, Artificial Sequence
  Synthetic
ctttttacactcctctacattgtattgaaattctaaatacatacccaataataaaaacacatcctcacactttgt

SEQ ID NO: 30900 - DNA, 75 bp, Artificial Sequence
  Synthetic
tttgcgagcctgggaatgttggccttgtccccagttaaactggacaaaggccatggttctgcgccagctgtcacg

SEQ ID NO: 30901 - DNA, 75 bp, Artificial Sequence
  Synthetic
taactgctgaaaatgcctttgacagtgatagcccagacaaaaaaatgcttccttgttacagcacagcaagaattc

SEQ ID NO: 30902 - DNA, 75 bp, Artificial Sequence
  Synthetic
tgacctcaggaaggaaagtgcatgactggcagccagccagtggcagttaatagtgaaaccccgcccctagaattc

SEQ ID NO: 30903 - DNA, 75 bp, Artificial Sequence
  Synthetic
tatctactctttttttagctaaaactgtatctactgcttgctgacaaatacttttttgatttttactttctgcaa

SEQ ID NO: 30904 - DNA, 75 bp, Artificial Sequence
  Synthetic
gcctcggcctcttatatattataaaaaaaaaggccacagggaggagctgcttacccatggaatgcagccaaacca

SEQ ID NO: 30905 - DNA, 75 bp, Artificial Sequence
  Synthetic
tcaaataaacacaagaggaagtggaaagtagccaaaggagtggaaagcagccagacagacatgttttgcgagccg

SEQ ID NO: 30906 - DNA, 75 bp, Artificial Sequence
  Synthetic
gtgtacattcaggagagtttatagaaaaaactattgccccaggaggtgctaatcaaagaactgctcctcaatgga

SEQ ID NO: 30907 - DNA, 75 bp, Artificial Sequence
  Synthetic
ttattggaataactagcatgcttaaccttcatgcagggtcccaaaaagttcatgagaatggtggaggtaaacctg

SEQ ID NO: 30908 - DNA, 75 bp, Artificial Sequence
  Synthetic
caggagaacccagagagtggatgggcagcctatgtatggtatggaatcccaggtagaagaggttagggtgtttga

SEQ ID NO: 30909 - DNA, 75 bp, Artificial Sequence
  Synthetic
tccaaggcagtaatttccacttctttgctgtgggtggagaccccttggaaatgcagggagtgctaatgaattaca

SEQ ID NO: 30910 - DNA, 75 bp, Artificial Sequence
  Synthetic
atgcagggagtgctaatgaattacagaacaaagtacccacaaggtactataacccctaaaaaccctacagctcag

SEQ ID NO: 30911 - DNA, 75 bp, Artificial Sequence
  Synthetic
aggggctgaagtatctgagacttgggaagagcattgtgattgggattcagtgcttgatccatgtccagagtcttc

SEQ ID NO: 30912 - DNA, 75 bp, Artificial Sequence
  Synthetic
aaagctaagtgctgaaaatgactttagcagtgatagcccagagagaaaaatgcttccctgttacagcacagcaag

SEQ ID NO: 30913 - DNA, 75 bp, Artificial Sequence
  Synthetic
atatcaagaatacatttccccatgcatatattatatttcatccttgaaaaagtatacatacttatctcagaatcc

SEQ ID NO: 30914 - DNA, 75 bp, Artificial Sequence
  Synthetic
gcgccagctgtcacgacaagcttcagtgaaagttggtaaaacctggactggaacaaaaaaaagagctcagaggat

SEQ ID NO: 30915 - DNA, 75 bp, Artificial Sequence
  Synthetic
gactttcttaaatatattttgggtctaaaatctatctgtcttacaaatctagcctgcagagttttagggacagga

SEQ ID NO: 30916 - DNA, 75 bp, Artificial Sequence
  Synthetic
ctctgagttttgtaaggattttcttaaatatattttgggtctaaaatctatctgtcttacaaatctagcctgcag

SEQ ID NO: 30917 - DNA, 75 bp, Artificial Sequence
  Synthetic
agctttttctttagtagtatacacagcaaagcaggcaagggttctattactaaatacagcttgactaagaaactg

SEQ ID NO: 30918 - DNA, 75 bp, Artificial Sequence
  Synthetic
acagtggagaggccttgcaagatattttaagattcgcctgagaaaaagatctgtgaagaatccttacccaatttc

SEQ ID NO: 30919 - DNA, 75 bp, Artificial Sequence
  Synthetic
ggttttaggaacaggatactcattcattgtaaccaggcctggtggaaatatttgggttcttttgtttaaatgttt

SEQ ID NO: 30920 - DNA, 75 bp, Artificial Sequence
  Synthetic
ttaaagctttgcctccacataaatctaataaccctgcagctagtgttgtttttccactatcaattggacctttga

SEQ ID NO: 30921 - DNA, 75 bp, Artificial Sequence
  Synthetic
tacagcatttccatgagctccaaatattaaatccattttatctaatatatgattaaatctttctgttagcatttc

SEQ ID NO: 30922 - DNA, 75 bp, Artificial Sequence
  Synthetic
ctttttgctaagtgaccttataaacaggagaacccaaaaagtggatgggcagcctatgtatggtatggaatctca

SEQ ID NO: 30923 - DNA, 75 bp, Artificial Sequence
  Synthetic
tacgccagctgtcacgacaagcttctgtgagagttagtaaaacctggactggaactaaaagaagagctcagagga

SEQ ID NO: 30924 - DNA, 75 bp, Artificial Sequence
  Synthetic
attaaaaacaatacagtgcaggaaatcaaatataacagaatccattttaggtagcaaacagtgcagccaggcaac

SEQ ID NO: 30925 - DNA, 75 bp, Artificial Sequence
  Synthetic
aggtactataaccccaaaaaacccaacagcccagtcccaggtaatgaatactgaccataaggcctatttggacaa

SEQ ID NO: 30926 - DNA, 75 bp, Artificial Sequence
  Synthetic
aggagaacccaaaaagtggatgggcagcctatgtatggtatggaatctcaggttgaggaggtaagggtgtttgat

SEQ ID NO: 30927 - DNA, 75 bp, Artificial Sequence
  Synthetic
agcatgcaagggcagtgcacagaaggctttttggaacaaataggccattccttgcagtacagggtatctgggcaa

SEQ ID NO: 30928 - DNA, 75 bp, Artificial Sequence
  Synthetic
ttattttgggggtggtgttttaggccttttaaaacactgaaagcctttacacaaatgtaactcttggctgtgagg

SEQ ID NO: 30929 - DNA, 75 bp, Artificial Sequence
  Synthetic
aaccttcatgcagggtcacagaaagtacatcaaaatggtggaggcaaacctgttcaaggcagcaattttcacttt

SEQ ID NO: 30930 - DNA, 75 bp, Artificial Sequence
  Synthetic
tagatattttggaacatacacaggaggggaaaatgttcccccagtacttcatgtaaccaacacagctaccacagt

SEQ ID NO: 30931 - DNA, 75 bp, Artificial Sequence
  Synthetic
agctagtgttgtttttccactatcaatgggacctttaaataaccagtatcttcttttaggtacattaaaaacaat

SEQ ID NO: 30932 - DNA, 75 bp, Artificial Sequence
  Synthetic
gatatgataagatatattgacaaacaaggacaattgcaaaccaaaatgctttaaacaggtgcttttattgtacat

SEQ ID NO: 30933 - DNA, 75 bp, Artificial Sequence
  Synthetic
ttgcaaaatgcttttcatgatacttaaagtggtaaggttggtcttttttttgacactttttacactcctctacat

SEQ ID NO: 30934 - DNA, 75 bp, Artificial Sequence
  Synthetic
aaatcatgctcctttaggcccccttgaatactttcctctattatataatatggatctctagttaaggcactgtat

SEQ ID NO: 30935 - DNA, 75 bp, Artificial Sequence
  Synthetic
aatacttttttgatttttactttctgcaaaaatagtagcatttgcaaaatgcttttcatgatacttaaagtgata

SEQ ID NO: 30936 - DNA, 75 bp, Artificial Sequence
  Synthetic
aaaagttacagaatatttttccataagttttttatacagaatttgagctttttctttagtagtatacacagcaaa

SEQ ID NO: 30937 - DNA, 75 bp, Artificial Sequence
  Synthetic
gtcccaggtaatgaatactgaccataaggcctatttggacaaaaacaatgcttatccagttgagtgctggattcc

SEQ ID NO: 30938 - DNA, 75 bp, Artificial Sequence
  Synthetic
actgcatactcagtaattaatttccaagacacctgctttgtttcttcaggctcttctgggttaaaatcatgctcc

SEQ ID NO: 30939 - DNA, 75 bp, Artificial Sequence
  Synthetic
ctggtggaaatatttgtgttcttttgtttaaatgtttcttttctaaattaaccttaacacttccatctagataat

SEQ ID NO: 30940 - DNA, 75 bp, Artificial Sequence
  Synthetic
ggtcttctacctttcttttttttttgggtggtgttgagtgttgagaatctgctgttgcttcttcatcactggcaa

SEQ ID NO: 30941 - DNA, 75 bp, Artificial Sequence
  Synthetic
tttagtagtatacacagcaaagcaggcaagagttctattactaaatacagcttgactaagaaactggtgtagatc

SEQ ID NO: 30942 - DNA, 75 bp, Artificial Sequence
  Synthetic
aatgaggacctaacctgtggaaatctcctgatgtgggaggctgtaactgtacaaacagaggttattggaataact

SEQ ID NO: 30943 - DNA, 75 bp, Artificial Sequence
  Synthetic
taaggcactatatagtaagtattccttattaacacccttacaaattaaaaaactaaaggtacacagcttttgaca

SEQ ID NO: 30944 - DNA, 75 bp, Artificial Sequence
  Synthetic
ttgagtgttgggaatctgctgttgcctcctcatcactggcaaacatatcttcatggcagaataaatcttcatccc

SEQ ID NO: 30945 - DNA, 75 bp, Artificial Sequence
  Synthetic
ggaaatctactaatgtgggaggctgtaactgtaaaaacagaggttattggaataactagtatgcttaaccttcat

SEQ ID NO: 30946 - DNA, 75 bp, Artificial Sequence
  Synthetic
aggaagtggaaactggccaaaggagtggaaagcagccagacagacatgttttgcgggcctaggaatcttggcctt

SEQ ID NO: 30947 - DNA, 75 bp, Artificial Sequence
  Synthetic
agcctttccatgggtaaatttacatttaaagctttacctccacataagtctaataaccctgcagctaaggttgtt

SEQ ID NO: 30948 - DNA, 75 bp, Artificial Sequence
  Synthetic
gggcaatgcactgaaggctttttggaacaaataggccattccttgcagtacaaagtatctgggcaaagaggaaaa

SEQ ID NO: 30949 - DNA, 75 bp, Artificial Sequence
  Synthetic
gacactttttacactcttctacattgtattgaaattctaaatacatacccaataataaaaacacatcctcacact

SEQ ID NO: 30950 - DNA, 75 bp, Artificial Sequence
  Synthetic
ttaaagctttacctccacataagtctaataaccctgcagctaaggttgttttgccactatcaattggacctttaa

SEQ ID NO: 30951 - DNA, 75 bp, Artificial Sequence
  Synthetic
ctgtttactaacagctctggaacacaacagtggaggggccttgcaagatattttaagattcgcctgagaaaaaga

SEQ ID NO: 30952 - DNA, 75 bp, Artificial Sequence
  Synthetic
ataaccagtatcttcttttaggtacattaaaaacaacacagtgaagaaaatcaaaaataacagaatccattttag

SEQ ID NO: 30953 - DNA, 75 bp, Artificial Sequence
  Synthetic
tagattgtatatctgttgcaaaatcagctacaggcctaaaccaaattagcagtagcaataaggtcattccacttt

SEQ ID NO: 30954 - DNA, 75 bp, Artificial Sequence
  Synthetic
attttattatttatctaaatataagttagttaccttaaagctttagatctctgaagggagtttctccaattattt

SEQ ID NO: 30955 - DNA, 75 bp, Artificial Sequence
  Synthetic
tcaaaaataacagaatccattttaggtagcagacaatgtagccaagcaacccctgccatatattgttctagtaca

SEQ ID NO: 30956 - DNA, 75 bp, Artificial Sequence
  Synthetic
taggcctcagaaaaagcctccacacccttactacttgagagaaagggtggaggccgaggcggcctcggcctctta

SEQ ID NO: 30957 - DNA, 75 bp, Artificial Sequence
  Synthetic
gacagggacaattgcaaacaaaaatggtttaaacaaggtgcttttattgtacatatacatgcttaataaatgctg

SEQ ID NO: 30958 - DNA, 75 bp, Artificial Sequence
  Synthetic
tctgtcttacaaatctagcctgcagggttttagggacaggatactcattcattgtaaccaagcctggaggaaata

SEQ ID NO: 30959 - DNA, 75 bp, Artificial Sequence
  Synthetic
agtttctccaattatttggacccaccattgcagggtttcttcagtgaggtctaagccaaaccactgtctgaagca

SEQ ID NO: 30960 - DNA, 75 bp, Artificial Sequence
  Synthetic
tttgggttcttttgtttaaatgtttcttttctaaattaaccttaacacttccatctaaataatctctgagactgt

SEQ ID NO: 30961 - DNA, 75 bp, Artificial Sequence
  Synthetic
gtgttattttgggggtggtgttttaggccttttaaaacactgaaagcctttacacaaatgtaactcttcactatg

SEQ ID NO: 30962 - DNA, 75 bp, Artificial Sequence
  Synthetic
ataagttagttaccttaaagctttagatctctgaagggagtttctccaattatttggacccaccattgcagagtt

SEQ ID NO: 30963 - DNA, 75 bp, Artificial Sequence
  Synthetic
cttttatattacacattttaatcttgtgttattttgggggtggtgttttaggccttttaaaacactgaaagcctt

SEQ ID NO: 30964 - DNA, 75 bp, Artificial Sequence
  Synthetic
cctgtttagcactttatccatttttgcaaaaaattgcaaaagagtagggatttccccaaatagttttgctaggcc

SEQ ID NO: 30965 - DNA, 75 bp, Artificial Sequence
  Synthetic
aggagctccaccaggactcccactcttctgttccataggttggcacctataaaaaaaataattacttagggcctt

SEQ ID NO: 30966 - DNA, 75 bp, Artificial Sequence
  Synthetic
cactttgtttctactgcatattcagtaattaatttccaagacacctgctttgtttcttcaggctcctctgggtta

SEQ ID NO: 30967 - DNA, 75 bp, Artificial Sequence
  Synthetic
tgtttcttcaggctcctctgggttaaagtcatgctcctttaagcccccttgaatgctttcctctattatatggta

SEQ ID NO: 30968 - DNA, 75 bp, Artificial Sequence
  Synthetic
gccttaatctaagctgacatagcatgcaagggcagtgcacagaaggctttttggaacaaataggccaatccttgc

SEQ ID NO: 30969 - DNA, 75 bp, Artificial Sequence
  Synthetic
aaaaacccaacagcccagtcccaggtaatgaatactgaccataaggcctatttggacaaaaacaatgcttatcca

SEQ ID NO: 30970 - DNA, 75 bp, Artificial Sequence
  Synthetic
agtacagggtatctgggcaaagaggaaaatcagcacaaacctctgagctactccaggttccaaaatcaggctgat

SEQ ID NO: 30971 - DNA, 75 bp, Artificial Sequence
  Synthetic
gagctacctttacatcctgctccatttttttatataaagtattcattctcttcattttatcctcgtcgccccctt

SEQ ID NO: 30972 - DNA, 75 bp, Artificial Sequence
  Synthetic
gcttttcatgatacttaaagtgataaggttggtcttttttctgacactttttacactcctctacattgtattgaa

SEQ ID NO: 30973 - DNA, 75 bp, Artificial Sequence
  Synthetic
tgggactttgacaggaggggaaaatgttcccccagtacttcatgtgaccaacacagctaccacagtgttgctaga

SEQ ID NO: 30974 - DNA, 75 bp, Artificial Sequence
  Synthetic
attctaaatacatacctaataataaaaacacatcctcacactttgtctctactgcatactcagtaattaatttcc

SEQ ID NO: 30975 - DNA, 75 bp, Artificial Sequence
  Synthetic
aggctatctactctttttttagctaaaacagtatctactgcttgttgacaaatacttttttgatttttactttct

SEQ ID NO: 30976 - DNA, 75 bp, Artificial Sequence
  Synthetic
ttctattactaaatacagcttgactaagaaactggtgtagatcagaaggaaagtctttagggtcttctacctttc

SEQ ID NO: 30977 - DNA, 75 bp, Artificial Sequence
  Synthetic
ccaaatatttttgctaggcctcagaaaaagcctccacacccttactacttgagagaaagggtggaggcagaggcg

SEQ ID NO: 30978 - DNA, 75 bp, Artificial Sequence
  Synthetic
ttttgcaaaaattgcaaaagaatagggatttccccaaatatttttgctaggcctcagaaaaagcctccacaccct

SEQ ID NO: 30979 - DNA, 75 bp, Artificial Sequence
  Synthetic
atttttcattaaaggagctccaccaggactcccactcttctgttccataggttggcacctataaaaaaaaaataa

SEQ ID NO: 30980 - DNA, 75 bp, Artificial Sequence
  Synthetic
aacaaggacaattgcaaaccaaaatgctttaaacaggtgcttttattgttcatatacatttaataaatgctgctt

SEQ ID NO: 30981 - DNA, 75 bp, Artificial Sequence
  Synthetic
cagaggcggcctcggcctcttatatattataaaaaaaaaggccacagggaggagctgctaacccatggaatgtag

SEQ ID NO: 30982 - DNA, 75 bp, Artificial Sequence
  Synthetic
aggagtagaagttctagaagttaaaactggggtagatgctataacagaggtagaatgctttctaaatccagaaat

SEQ ID NO: 30983 - DNA, 75 bp, Artificial Sequence
  Synthetic
ggagctgctaacccatggaatgtagccaaaccatgacctcaggaaggaaagtgcatgactgggcagccagccagt

SEQ ID NO: 30984 - DNA, 75 bp, Artificial Sequence
  Synthetic
aaaatcagcacaaacctctgagctactccaggttccaaaatcaggctgatgggctacctttacatcctgctccat

SEQ ID NO: 30985 - DNA, 75 bp, Artificial Sequence
  Synthetic
gcaatcaatgcagtagcaatctatccaaaccaatggctcttttcttaaaaattttctatttaaatgccttaatct

SEQ ID NO: 30986 - DNA, 75 bp, Artificial Sequence
  Synthetic
cctggactggaactaaaaaaagagctcagaggatttttatttttattttagagcttttgctggaattttgtagag

SEQ ID NO: 30987 - DNA, 75 bp, Artificial Sequence
  Synthetic
aaaaatgcttccctgttacagcacagcaagaattcccctccccaatttaaatgaggacctaacctgtggaaatct

SEQ ID NO: 30988 - DNA, 75 bp, Artificial Sequence
  Synthetic
tgcgagcctaggaatcttggccttgtccccagttaaactggacaaaggccatggttctgcgccagctgtcacgac

SEQ ID NO: 30989 - DNA, 75 bp, Artificial Sequence
  Synthetic
ctataacctcacaggaattgcaaagaagaacagaaagattttttagagactccttggctagatttttggaggaaa

SEQ ID NO: 30990 - DNA, 75 bp, Artificial Sequence
  Synthetic
gtaaaagactctgtaaaagactcctaggtaagtaatgctttttttttgtattttcaggttgatgggtgctgctct

SEQ ID NO: 30991 - DNA, 75 bp, Artificial Sequence
  Synthetic
aaaagtaccactgctttacctgctgtaaaagactctgtaaaagactcctaggtaagtaatccctttttttttgta

SEQ ID NO: 30992 - DNA, 75 bp, Artificial Sequence
  Synthetic
gaagttcaaattgcatcccttgctactgtagagggcataacaagtacctcagaggctatagctgctataggccta

SEQ ID NO: 30993 - DNA, 75 bp, Artificial Sequence
  Synthetic
acaaatacttttttgatttttactttctgcaaaaatggtagcatttgcaaaatgcttttcatgatatttaaagtg

SEQ ID NO: 30994 - DNA, 75 bp, Artificial Sequence
  Synthetic
ggatcacaaagtttccactgtaggcctttatcagcaatcaggcatggctttggaattgtttaacccagatgagta

SEQ ID NO: 30995 - DNA, 75 bp, Artificial Sequence
  Synthetic
aggattattattctaatttgtcccctattaggccttcaatggttaggcaagttgctgaaagggaaggaacccagg

SEQ ID NO: 30996 - DNA, 75 bp, Artificial Sequence
  Synthetic
ggaaactggccaaaggagtggaaagcagccagacagacatgttttgcgagcctaggaatcttggccttgtcccca

SEQ ID NO: 30997 - DNA, 75 bp, Artificial Sequence
  Synthetic
tacatgaaaatggtggaggcaaacctattcaaggcagcaattttcacttttttgctgtgggtggggaccccttgg

SEQ ID NO: 30998 - DNA, 75 bp, Artificial Sequence
  Synthetic
attgcaaaggagaacagagagattttttagggactctttggctagatttttggaagaaaccacctggacaattgt

SEQ ID NO: 30999 - DNA, 75 bp, Artificial Sequence
  Synthetic
tgctgtaattgctggtgctcctggggctattgctgggtttgctgctttaattcaaactgttactggtgttagttc

SEQ ID NO: 31000 - DNA, 75 bp, Artificial Sequence
  Synthetic
aaaggacctccaccaggactcccactcttctgttccataggttggcacctataaaaaaaaaataattacttaggg

SEQ ID NO: 31001 - DNA, 75 bp, Artificial Sequence
  Synthetic
gatgatgctgacagtatagaagaagttacacaaagaatggacttaagaaatcaacaaactgtacattcaggagag

SEQ ID NO: 31002 - DNA, 75 bp, Artificial Sequence
  Synthetic
taagcttgtgttattttgggggtggtgttttaggccttttaaaacactgaaagcctttacacaaatgcaactctt

SEQ ID NO: 31003 - DNA, 75 bp, Artificial Sequence
  Synthetic
atggcacagaacagcttccaggggacccagatatgataagatatattgacagacagggacaattgcaaacaaaaa

SEQ ID NO: 31004 - DNA, 75 bp, Artificial Sequence
  Synthetic
tttttacactcctctacattgtactgaaattctaaatacatacccaatagtaaaaacacatcttcacactttgtt

SEQ ID NO: 31005 - DNA, 75 bp, Artificial Sequence
  Synthetic
ggctcaagtagggtataggttttttagtgattgggatcacaaagtttccactgtaggcctctatcagcaatcagg

SEQ ID NO: 31006 - DNA, 75 bp, Artificial Sequence
  Synthetic
tatattcaagaatattattctgatctttcccctattaggccctcaatggttagacaagtggctgaaagggaaggt

SEQ ID NO: 31007 - DNA, 75 bp, Artificial Sequence
  Synthetic
gagtgttgagaatctgctgttgcttcttcatcactggcaaacatatcttcatggcaaaataaatcttcatcccat

SEQ ID NO: 31008 - DNA, 75 bp, Artificial Sequence
  Synthetic
gaagttctagaagttaaaactggggtagatgctataacagaggtagaatgcttcctaaacccagaagaccaagtc

SEQ ID NO: 31009 - DNA, 75 bp, Artificial Sequence
  Synthetic
aaattctgagttttgcagggattttcttaaataaattttaggtctaaaatctatctgtcttacaaatctagcctg

SEQ ID NO: 31010 - DNA, 75 bp, Artificial Sequence
  Synthetic
ttctctaaatataagttagttaccttaaagctttagatctctgaagggagtttctccaattatttggacccacca

SEQ ID NO: 31011 - DNA, 75 bp, Artificial Sequence
  Synthetic
attgtatatctgttgcaaaatcagctacaggcctaaaccaaattagcagtagcaacaaggtcattccactttgta

SEQ ID NO: 31012 - DNA, 75 bp, Artificial Sequence
  Synthetic
tttataattatattcaagaatattattctgatctttcccctattaggccctcaatggttagacaagtagctgaaa

SEQ ID NO: 31013 - DNA, 75 bp, Artificial Sequence
  Synthetic
caaggttttggggacaggatactcattcattgtaactaaacctggtggaaatatttgggttcttttgtttaagtg

SEQ ID NO: 31014 - DNA, 75 bp, Artificial Sequence
  Synthetic
ggaagtggaaactggccaaaggagtggaaagtagccagacagacatgttttgcgagcctgggaatgttggccttg

SEQ ID NO: 31015 - DNA, 75 bp, Artificial Sequence
  Synthetic
atatacatttaataaatgctgcttttgtataagccacttttaagcttgtgttattttgggggtggtgttttaggc

SEQ ID NO: 31016 - DNA, 75 bp, Artificial Sequence
  Synthetic
ctgtaaaagactctgtaaaagactcctaggtaagtaatccctttttttttgtatttccaggttgatgggtgctgc

SEQ ID NO: 31017 - DNA, 75 bp, Artificial Sequence
  Synthetic
atataatattatgaccagcacacatgtgtctactaataaaagttacagaatatttttccataagttttttataca

SEQ ID NO: 31018 - DNA, 75 bp, Artificial Sequence
  Synthetic
tggattcctgatcctagtagaaatgaaaatactaggtattttggaacttacacaggaggggaaaatgttcctcca

SEQ ID NO: 31019 - DNA, 75 bp, Artificial Sequence
  Synthetic
caaaccatgacctcaggaaggaaagtgcatgactgggcagccagccagtggcagttaatagtgaaaccccgccca

SEQ ID NO: 31020 - DNA, 75 bp, Artificial Sequence
  Synthetic
ccacttctttgctgttggtggagaccccttggaaatgcagggagtgctaatgaattacaggaccaagtacccaga

SEQ ID NO: 31021 - DNA, 75 bp, Artificial Sequence
  Synthetic
tggtactataaccccaaaaaacccaacagcccagtcccaggtaatgaatactgaccataaggcctatttggacaa

SEQ ID NO: 31022 - DNA, 75 bp, Artificial Sequence
  Synthetic
ctgaccataaggcctatttggacaaaaacaatgcttatccagttgagtgctgggttcctgatcccagtagaaatg

SEQ ID NO: 31023 - DNA, 75 bp, Artificial Sequence
  Synthetic
cttttgtttaagtgtttcttttctaaattaactttgacacttccatctaaataatcccttaaactgtctaaattg

SEQ ID NO: 31024 - DNA, 75 bp, Artificial Sequence
  Synthetic
aaacccagaaatgggggatccagatgaaaaccttaggggctttagtctaaagctaagtgctgaaaatgactttag

SEQ ID NO: 31025 - DNA, 75 bp, Artificial Sequence
  Synthetic
cacatcttcaaaaacaaccatatactgatctatagccacacccagttcaaaagtaagcctttccatgggtaaatt

SEQ ID NO: 31026 - DNA, 75 bp, Artificial Sequence
  Synthetic
tgacactttttacactcctctacattgtattgaaattctaaatacatacctaataataaaaacacatcctcacac

SEQ ID NO: 31027 - DNA, 75 bp, Artificial Sequence
  Synthetic
aagtaagcctttccatgggtaaattcacatttaaagctttgcctccacataaatctaacaaccctgcagctagtg

SEQ ID NO: 31028 - DNA, 75 bp, Artificial Sequence
  Synthetic
ggaattgtttaacccagatgagtactatgatattttgtttcctggtgtaaatacttttgtaaataatattcaata

SEQ ID NO: 31029 - DNA, 75 bp, Artificial Sequence
  Synthetic
cctaggcattggggtccttctttgtttgctactatttctcaggctttgtggcatgttattagggatgatatacct

SEQ ID NO: 31030 - DNA, 75 bp, Artificial Sequence
  Synthetic
gcaactcctgccatatattgttctagtacagcatttccatgagctccaaatattaaatccattttatctaatata

SEQ ID NO: 31031 - DNA, 75 bp, Artificial Sequence
  Synthetic
gcctcggcctcttatatattataaaaaaaaaaggccacagggaggagctgcttacccatggaatgcagccaaacc

SEQ ID NO: 31032 - DNA, 75 bp, Artificial Sequence
  Synthetic
tacaaacagaggtcattggaataactagcatgcttaaccttcatgcagggtcacaaaaagtgcatgagcatggtg

SEQ ID NO: 31033 - DNA, 75 bp, Artificial Sequence
  Synthetic
tccaggttccaaaatcaggctgatgagctacctttacatcctgctccatttttttatataaagtattcattctct

SEQ ID NO: 31034 - DNA, 75 bp, Artificial Sequence
  Synthetic
aaactactaataaaaggaggagtagaagttctagaagttaaaactggggtagatgctataacagaggtagaatgc

SEQ ID NO: 31035 - DNA, 75 bp, Artificial Sequence
  Synthetic
aaagaatagggatttccccaaatagttttgctaggcctcagaaaaagcctccacacccttactacttcagagaaa

SEQ ID NO: 31036 - DNA, 75 bp, Artificial Sequence
  Synthetic
ccagatatgataagatatattgacaaacaaggacaattgcaaactaaaatggtttaaacaggtgcttttattgtt

SEQ ID NO: 31037 - DNA, 75 bp, Artificial Sequence
  Synthetic
agtgaccttataaacaggagaacccagagagtggatgggcagcctatgtatggtatggaatcccaggtagaagag

SEQ ID NO: 31038 - DNA, 75 bp, Artificial Sequence
  Synthetic
ttggacccaccattgcagagtttcttcagttaggtctaagccaaaccactgtgtgaagcagtcaatgcagtagca

SEQ ID NO: 31039 - DNA, 75 bp, Artificial Sequence
  Synthetic
ggaaggtacccatgtaaattttggccatacctacagcatagatgatgctgacagtatagaagaagttacccaaag

SEQ ID NO: 31040 - DNA, 75 bp, Artificial Sequence
  Synthetic
aaatgctgcttttgtataagccagttttaagcttgtgttattttgggggtggtgttttaggccttttaaaacact

SEQ ID NO: 31041 - DNA, 75 bp, Artificial Sequence
  Synthetic
gaaagcctttacacaaatgcaactcttgactatgggggtctgacctttgggaatcttcagcaggggctgaagtat

SEQ ID NO: 31042 - DNA, 75 bp, Artificial Sequence
  Synthetic
atcccatttttcattaaaggagctccaccaggactcccactcttctgttccataggttggcacctataaaaaaaa

SEQ ID NO: 31043 - DNA, 75 bp, Artificial Sequence
  Synthetic
aaaaatcccacagctcagtcccaggtaatgaatactgaccataaggcctacttggacaaaaacaatgcttatcca

SEQ ID NO: 31044 - DNA, 75 bp, Artificial Sequence
  Synthetic
atccttgaaaaagtatacatacttatctcagaatccagcctttccttccattcaacaattctagattgtatatct

SEQ ID NO: 31045 - DNA, 75 bp, Artificial Sequence
  Synthetic
ataattacttagggccttcctataatttactattatctaaagataaattagttaccttaaagctttagatctctg

SEQ ID NO: 31046 - DNA, 75 bp, Artificial Sequence
  Synthetic
aaaacaatacagtgcaaaaaatcaaatataacagaatccattttaggtagcaaacagtgcagccaagcaacacct

SEQ ID NO: 31047 - DNA, 75 bp, Artificial Sequence
  Synthetic
accaggactcccactcttctgttccataggttggcacctataaaacaaataattacttagggcctttaaatattt

SEQ ID NO: 31048 - DNA, 75 bp, Artificial Sequence
  Synthetic
ccatgtactgatctatagctacacctagttcaaaggtcagcctttccatgggtaggtttacatttaaagctttac

SEQ ID NO: 31049 - DNA, 75 bp, Artificial Sequence
  Synthetic
acagtgcaaaaaatcaaatataacagaatccattttaggtaacaaacagtgcagccaagcaacacctgccatata

SEQ ID NO: 31050 - DNA, 75 bp, Artificial Sequence
  Synthetic
taaaggaactccaccaggactcccactcttctgttccataggttggcacctagaaaaaaaataattacttagggc

SEQ ID NO: 31051 - DNA, 75 bp, Artificial Sequence
  Synthetic
gtgtaaatacttttgtaaataatattcaataccttgatcctaggcattggggtccttctttgtttgctactattt

SEQ ID NO: 31052 - DNA, 75 bp, Artificial Sequence
  Synthetic
cttagtgaccttataaacaggagaacccagagagtggatgggcagcctatgtatggtatggagtctcaggtggag

SEQ ID NO: 31053 - DNA, 75 bp, Artificial Sequence
  Synthetic
gtaaaaactctgagttttgtaaggattttcttaaatatattttgggcctaaaatctatctgtcttacaaatctag

SEQ ID NO: 31054 - DNA, 75 bp, Artificial Sequence
  Synthetic
ctgataaaagttacagaatatttttccataagttttttatacagaatttgagctttttctttagtggtatacaca

SEQ ID NO: 31055 - DNA, 75 bp, Artificial Sequence
  Synthetic
ggatactcattcattgtaactaaccctggtggaaatatttgtgttcttttgtttaaatgtttcttttctaaatta

SEQ ID NO: 31056 - DNA, 75 bp, Artificial Sequence
  Synthetic
caattgcaaacaaaaatggtttaaacaaggtgcttttattgtacatatacatgcttaataaatgctgcttttata

SEQ ID NO: 31057 - DNA, 75 bp, Artificial Sequence
  Synthetic
cctccacacaaatctaataaccctgcagctagtgttgtttttccactatcaatgggacctttaaataaccagtat

SEQ ID NO: 31058 - DNA, 75 bp, Artificial Sequence
  Synthetic
ggaaggtttccccaggcagctctttcaaggcccaaaaggtccatgagctccatggattcttccctgttaagcact

SEQ ID NO: 31059 - DNA, 75 bp, Artificial Sequence
  Synthetic
tttaatttactacttttctaaatataaattagttaccttaaagctttagatctctgaagggagtttctccaatta

SEQ ID NO: 31060 - DNA, 75 bp, Artificial Sequence
  Synthetic
taaactggacaaaggccatggttctgcgccagctgtcacgacaagcttctgtgaaagttggtaaaacctggactg

SEQ ID NO: 31061 - DNA, 75 bp, Artificial Sequence
  Synthetic
cctggggctattgctgggtttgctgctttaattcaaactgttagtggtattagttccttggctcaagtagggtat

SEQ ID NO: 31062 - DNA, 75 bp, Artificial Sequence
  Synthetic
catacttatctcagaatccagcctttccttccattcaacaattctagactgtatatcttgtgcaaaatcagcaac

SEQ ID NO: 31063 - DNA, 75 bp, Artificial Sequence
  Synthetic
tgcttttcatgatacttaaagtgataaggttggtcttttttctgacactttttacactcttctacattgtattga

SEQ ID NO: 31064 - DNA, 75 bp, Artificial Sequence
  Synthetic
attaattgcagaaactctatgtctatgtggagttaaaaagaatataatattatgcccagcacacatgtgtctact

SEQ ID NO: 31065 - DNA, 75 bp, Artificial Sequence
  Synthetic
acacttccatctaaataatctctcaaactgtctaaattgtttattccatgtcctgaaggcaaatcctttgattca

SEQ ID NO: 31066 - DNA, 75 bp, Artificial Sequence
  Synthetic
tggaatgcagccaaaccatgacctcaggaaggaaagtgcatgactgggcagccagccagtggcagttaatagtga

SEQ ID NO: 31067 - DNA, 75 bp, Artificial Sequence
  Synthetic
aggaaggaaagtgcatgactgggcagccagccagtggcagttaatagtgaaaccccgcccatgaaattctcaaat

SEQ ID NO: 31068 - DNA, 75 bp, Artificial Sequence
  Synthetic
tccccaggcagctctttcaaggcctaaaaggtccatgagctccatggattcttccctgtttaagactttatccat

SEQ ID NO: 31069 - DNA, 75 bp, Artificial Sequence
  Synthetic
atagtaagtattccttattaacacccttacaaattaaaaaactaaaggtacacagcttttgacagaaattattaa

SEQ ID NO: 31070 - DNA, 75 bp, Artificial Sequence
  Synthetic
tataaaaaaaacataattacttagggccttcctataatttactattatctacataggttggcacctataaaaaaa

SEQ ID NO: 31071 - DNA, 75 bp, Artificial Sequence
  Synthetic
aaaagttagcctttccatgggtaaattaacatttaaagctttgcctccacataaatctaataaccctgcagctag

SEQ ID NO: 31072 - DNA, 75 bp, Artificial Sequence
  Synthetic
aaggctttttggaacaaataggccattccttgcagtacagggtatctgggcaaagaggaaaatcagcacaaacct

SEQ ID NO: 31073 - DNA, 75 bp, Artificial Sequence
  Synthetic
gttgctggatgaacagggtgtggggcctctatgtaaagctgatagcctgtatgtttcagctgctgatatttgtgg

SEQ ID NO: 31074 - DNA, 75 bp, Artificial Sequence
  Synthetic
tcattctcttcattttatcctcgtcgccccctttgtcagggtgaaattccttacacttccttaaataggcttttc

SEQ ID NO: 31075 - DNA, 75 bp, Artificial Sequence
  Synthetic
tcattaagggaaggtttccccaggcagctctttcaaggcctaaaaggtccatgagctccatggattcttccctgt

SEQ ID NO: 31076 - DNA, 75 bp, Artificial Sequence
  Synthetic
aatattaaatccattttatctaatatatgattaaatctgtctgttagcatttcttctctggtcatatggagggta

SEQ ID NO: 31077 - DNA, 75 bp, Artificial Sequence
  Synthetic
tccccaggcagctctttcaaggcctaaaaggtccatgagctccatggattcttccctgttaagcactttatccat

SEQ ID NO: 31078 - DNA, 75 bp, Artificial Sequence
  Synthetic
aaaaaaggccacagggaggagctgctttcccatggaatgcagccaaaccatgacctcaggaaggaaagtgcatga

SEQ ID NO: 31079 - DNA, 75 bp, Artificial Sequence
  Synthetic
tttcccatggaatgcagccaaaccatgacctcaggaaggaaagtgcatgactgggcagccagccagtggcagtta

SEQ ID NO: 31080 - DNA, 75 bp, Artificial Sequence
  Synthetic
gcctcggcctcttatatattataaaaaaaaaggccacagggaggagctgctaacccatggaatgcatggaatgta

SEQ ID NO: 31081 - DNA, 75 bp, Artificial Sequence
  Synthetic
tgcaaaagagtagggatttccccaaatagttttgctaggcccttactacttgagagaaagggtggaggcagaggc

SEQ ID NO: 31082 - DNA, 75 bp, Artificial Sequence
  Synthetic
gcctcggcctcttatatattataaaaaaaaaggccacagggaggagctgctttcccatggaatgcagccaaacca

SEQ ID NO: 31083 - DNA, 75 bp, Artificial Sequence
  Synthetic
aacagaggttattggaataactagcatgcttaaccttcatgcagggtcacaaaaagtgcatgagcatggtggagg

SEQ ID NO: 31084 - DNA, 75 bp, Artificial Sequence
  Synthetic
agtgcatgactgggcagccagccagtggcagttaatagtgaaaccccgcccctaaaattctcaaataaacacaag

SEQ ID NO: 31085 - DNA, 75 bp, Artificial Sequence
  Synthetic
taatactggacaaaggccatggttctacgccagctgtcacgacaagcttctgtgaaagttagtaaaacctggact

SEQ ID NO: 31086 - DNA, 75 bp, Artificial Sequence
  Synthetic
ccaaaccatgacctcaggaaggaaagtgcatgactgggcagccagccagtggcagttaataagcagccagacaga

SEQ ID NO: 31087 - DNA, 75 bp, Artificial Sequence
  Synthetic
aataactagtatgcttaaccttcatgcagggtcacagaaagtacatgagaatggtggaggcaaacctattcaagg

SEQ ID NO: 31088 - DNA, 75 bp, Artificial Sequence
  Synthetic
attagggatgatatacctgctataacctcacaagaattacaaagaagaacagaaagattttttagagactccttg

SEQ ID NO: 31089 - DNA, 75 bp, Artificial Sequence
  Synthetic
acacccttacaaattaaaaaactaaaagtacacagcttttgacagaaattattaattgcagaaactctatgtcta

SEQ ID NO: 31090 - DNA, 75 bp, Artificial Sequence
  Synthetic
gtgtttgatggcacagaaagacttccaggggacccagatatgataagatatattgacaaacaaggacaattgcaa

SEQ ID NO: 31091 - DNA, 75 bp, Artificial Sequence
  Synthetic
aaaaattgcaaaagaatagggatttccccaaatagttttgctaggcctcagaaaaagcctccacacccttactac

SEQ ID NO: 31092 - DNA, 75 bp, Artificial Sequence
  Synthetic
ccaatttcctttttgctaagtgaccttataaacaggagaacccagagagtggatgggcagcctatgtatggtatg

SEQ ID NO: 31093 - DNA, 75 bp, Artificial Sequence
  Synthetic
agtaagaactctgagttttgtaaggattttcttaaatatattttgggcctaaaatctatctgtcttacaaatcta

SEQ ID NO: 31094 - DNA, 75 bp, Artificial Sequence
  Synthetic
tttgggaatcttcagcaggggctgaagtatctgagacttgggaagagcattgtgattgtgattcagtgcttgatc

SEQ ID NO: 31095 - DNA, 75 bp, Artificial Sequence
  Synthetic
tactttactattatctaaagataaattagttaccttaaagctttagatctctgaagggagtctctccaattattt

SEQ ID NO: 31096 - DNA, 75 bp, Artificial Sequence
  Synthetic
tcctaggcattggggtccttctttgtttgctactatttcccaggctttgtggcatgttattagggatgatatacc

SEQ ID NO: 31097 - DNA, 75 bp, Artificial Sequence
  Synthetic
taaatctaacaaccctgcagctagtgttgtttttccactatcaattggacctttgaacaaccagtatcttctttt

SEQ ID NO: 31098 - DNA, 75 bp, Artificial Sequence
  Synthetic
taaattttggccatacctacagaatagatgatgctgacagtatacaagaagttacccaaagaatggagttaagaa

SEQ ID NO: 31099 - DNA, 75 bp, Artificial Sequence
  Synthetic
ttactaaatacagcttgactaagaaactggtgtagatcagagggaaagtctttagggtcttctacctttcttttt

SEQ ID NO: 31100 - DNA, 75 bp, Artificial Sequence
  Synthetic
aacagtggagaggccttgcaagatattttaagattcgcctgagaaaaagatctgtaaaaaatccttacccaattt

SEQ ID NO: 31101 - DNA, 75 bp, Artificial Sequence
  Synthetic
gtaatgaatactgaccataaggcctatttggacaaaaacaatgcttatccagttgagtgctggattcctgatccc

SEQ ID NO: 31102 - DNA, 75 bp, Artificial Sequence
  Synthetic
aggaactccaccaggactcccactcttctgttccataggttggcacctataaaaaaaataattacttagggcctt

SEQ ID NO: 31103 - DNA, 75 bp, Artificial Sequence
  Synthetic
acagacatgttttgcgagcctaggaatcttggccttgtccccagttaaactggacaaaggccatggttctgcgcc

SEQ ID NO: 31104 - DNA, 75 bp, Artificial Sequence
  Synthetic
ctgggcagccagccagtggcagttaatagtgaaactccgcccctaaaattctcaaataaacacaagaggaagtgg

SEQ ID NO: 31105 - DNA, 75 bp, Artificial Sequence
  Synthetic
ggacaaaaacaatgcttatccagttgagtgctgggttcctgatcccagtagaaatgaaaatactaggtattttgg

SEQ ID NO: 31106 - DNA, 75 bp, Artificial Sequence
  Synthetic
taaagctgatagcctgtatgtttcagctgctgatatttgtggcctgtttactaacagctctggaacacaacagtg

SEQ ID NO: 31107 - DNA, 75 bp, Artificial Sequence
  Synthetic
gcagccagccagtggcagttaatagtgaaaccccgcccctaaaattctcaaataaacacaagaggaagtggaaac

SEQ ID NO: 31108 - DNA, 75 bp, Artificial Sequence
  Synthetic
gtcctgaaggcaaatcctttgattcagctcctgtcccttttacatcttcaaaaacaaccatgtactgatctatag

SEQ ID NO: 31109 - DNA, 75 bp, Artificial Sequence
  Synthetic
ttgtgttattttgggggtggtgttttaggccttttaaaacactgaaagcctttacacaaatgcaactcttgacta

SEQ ID NO: 31110 - DNA, 75 bp, Artificial Sequence
  Synthetic
atgaccttaggggctatagtctaagactaactgctgaaactgcctttgacagtgatagcccagacagaaaaatgc

SEQ ID NO: 31111 - DNA, 75 bp, Artificial Sequence
  Synthetic
tgtttcagctgctgatatttgtggcctgtttactaacagctctgggacacaacagtggagaggccttgcaagata

SEQ ID NO: 31112 - DNA, 75 bp, Artificial Sequence
  Synthetic
tcacaagaattgcaaagaagaacagagagattctttagagactccttggctagatttttggaagaaactacctgg

SEQ ID NO: 31113 - DNA, 75 bp, Artificial Sequence
  Synthetic
agagagtggatgggcagcctatgtatggtatggaatcccaggtagaagaggttagggtgtttgatggcacagaaa

SEQ ID NO: 31114 - DNA, 75 bp, Artificial Sequence
  Synthetic
tccactacctaatttgaatgaggatctaacctgtggaaatctactaatgtgggaggctgtgactgtaaaaacaga

SEQ ID NO: 31115 - DNA, 75 bp, Artificial Sequence
  Synthetic
tttgctgtgggtggggaccccttggaaatgcagggagtacttatgaactacagaacaaagtacccagaaggtact

SEQ ID NO: 31116 - DNA, 75 bp, Artificial Sequence
  Synthetic
cttccatctaaataatccctcaaactgtctaaattgtttattccatgtcctgaaggcaaatcctttgattcagct

SEQ ID NO: 31117 - DNA, 75 bp, Artificial Sequence
  Synthetic
aggtattttgggactttcacaggaggggaaaatgttcctccagttcttcatataacaaacactgctaccacagtg

SEQ ID NO: 31118 - DNA, 75 bp, Artificial Sequence
  Synthetic
taaggcctacttggacaaaaacaatgcttatccagttgaatgctggattcctgaccctagtagaaatgaaaatac

SEQ ID NO: 31119 - DNA, 75 bp, Artificial Sequence
  Synthetic
tattattctgatctttcccctattaggccctcaatggtcagacaagtggctgaaagggaaggtacccgtgtacat

SEQ ID NO: 31120 - DNA, 75 bp, Artificial Sequence
  Synthetic
tatgctgtaattgctggtgctcctggggctattgctgggtttgctgctttaattcaaactgttactggtattagt

SEQ ID NO: 31121 - DNA, 75 bp, Artificial Sequence
  Synthetic
gttgctggatgaacagggtgtggggcctctgtgtaaagctgatagcctgtatgtttcagctgctgatatttgtgg

SEQ ID NO: 31122 - DNA, 75 bp, Artificial Sequence
  Synthetic
caggatactcattcattgtaaccaagcctggtggaaatatttgggttcttttgtttaaatgtttcttttctaaat

SEQ ID NO: 31123 - DNA, 75 bp, Artificial Sequence
  Synthetic
cttcaggctcttctgggttaaaatcatgctcctttaagcccccttgaatgctttcttctatagtatggtatggat

SEQ ID NO: 31124 - DNA, 75 bp, Artificial Sequence
  Synthetic
gtattccttattaacacccttacaaattaaaaaactaaaggtacacagcttttgacagaaattattaattgcaga

SEQ ID NO: 31125 - DNA, 75 bp, Artificial Sequence
  Synthetic
aacttttataattatattcaacaatattattctgatttgtcccctattaggccctcaatggttagacaagtagct

SEQ ID NO: 31126 - DNA, 75 bp, Artificial Sequence
  Synthetic
tttttatataaagtattcattctcttcattttatcctcgtcgccccctttgtcagggtgaaattccttacacttc

SEQ ID NO: 31127 - DNA, 75 bp, Artificial Sequence
  Synthetic
ttacctctacacaaatctaacaaccctgcagctagtgttgtttttccactatcaatgggacctttaaataaccag

SEQ ID NO: 31128 - DNA, 75 bp, Artificial Sequence
  Synthetic
gtgcatgactcacagggaggagctgcttacccatggaatgcagccaaaccatgacctcaggaaggaaagtgcatg

SEQ ID NO: 31129 - DNA, 75 bp, Artificial Sequence
  Synthetic
ttacatcttcaaaaacaaccatgtactgatctatagctacacctagttcaaaggttagcctttccatgggtaggt

SEQ ID NO: 31130 - DNA, 75 bp, Artificial Sequence
  Synthetic
acgcttaacgacaaaatcagaaaaggagtagacacactcatctacagagcaaaaaggtaacacccctacaatgga

SEQ ID NO: 31131 - DNA, 75 bp, Artificial Sequence
  Synthetic
ctctgacaagattgtcttcaaagtccataatcagttggtgtctgtaaagccagaggtgattgttgatcaatatga

SEQ ID NO: 31132 - DNA, 75 bp, Artificial Sequence
  Synthetic
gtacaaatatcctgctatcagagatcagaagaaacctagcataactctggggaaagctcctgatttaaacaaggc

SEQ ID NO: 31133 - DNA, 75 bp, Artificial Sequence
  Synthetic
ttacaaatctattttgtcaggaataaatgcggctagattggatcccgatgatgtatgttcctacctagcagcagc

SEQ ID NO: 31134 - DNA, 75 bp, Artificial Sequence
  Synthetic
tatggaactgtttgaaggaatttgccctgaagactggctaagctatgggattctcatagcaagaaagggggagaa

SEQ ID NO: 31135 - DNA, 75 bp, Artificial Sequence
  Synthetic
gattacccctgccaccttggtgaacattcagagaacgaacattgaaggcaactgggccttgaccggaggatacga

SEQ ID NO: 31136 - DNA, 75 bp, Artificial Sequence
  Synthetic
ccttacaagggatccaactgtggccgaacatgcatctctagtgggccttctgctctgcttgtatagactaagcaa

SEQ ID NO: 31137 - DNA, 75 bp, Artificial Sequence
  Synthetic
ggtctccgggcagaacacagggaattataagactaacatagccgatcgaatggagcaaatctttgagaccgctcc

SEQ ID NO: 31138 - DNA, 75 bp, Artificial Sequence
  Synthetic
ttttgtcaaaatcgtggagcatcataccttaatgaccactcacaaaatgtgtgccaattggagtacaatcccaaa

SEQ ID NO: 31139 - DNA, 75 bp, Artificial Sequence
  Synthetic
ttttaggtttcttgcaggcacatatgatatgttcttttctaggatagagcatttattttctgcaatccgggtcgg

SEQ ID NO: 31140 - DNA, 75 bp, Artificial Sequence
  Synthetic
aactgtagtgacggcatatgaagattgttctggactggtctctttcacaggattcatcaaacaaataaatttgac

SEQ ID NO: 31141 - DNA, 75 bp, Artificial Sequence
  Synthetic
ggctagggaggctatattgtatttcttccacaagaattttgaagaggaaatcaagaggatgtttgaaccagggca

SEQ ID NO: 31142 - DNA, 75 bp, Artificial Sequence
  Synthetic
agagactgcagttccacactcttattttatacatttcaggtccttagggttgagtgggaagtctccttattcctc

SEQ ID NO: 31143 - DNA, 75 bp, Artificial Sequence
  Synthetic
aaatgcagtaggtcatgtgtttaatctgatccatttcgttggctgttacatgggtcaaatcagatctctaaatgc

SEQ ID NO: 31144 - DNA, 75 bp, Artificial Sequence
  Synthetic
tactgttatctctagttgtgcaccacatgaaatgtctgtgttagggggttatctgggggaggaattctttggcaa

SEQ ID NO: 31145 - DNA, 75 bp, Artificial Sequence
  Synthetic
gggaacattcgagaggaggttcttcagagacgaaaaggagctccgagattatgaagccgcagagtctgtcaaaaa

SEQ ID NO: 31146 - DNA, 75 bp, Artificial Sequence
  Synthetic
cgacgtcgcactggcagatgatggaaccgtcaactcagatgatgaggactttttttctggggaaacgagaagtcc

SEQ ID NO: 31147 - DNA, 75 bp, Artificial Sequence
  Synthetic
ggaggccgtgtatgcgaagatcatgatgaacgggggaaaattgaaaaagtctcacatccggcgatatgtatcagt

SEQ ID NO: 31148 - DNA, 75 bp, Artificial Sequence
  Synthetic
cagctcaaaccaccaggccagaccgaactcctttgcagaatttttgaacaaaacttacctaggtgatcagagata

SEQ ID NO: 31149 - DNA, 75 bp, Artificial Sequence
  Synthetic
atcgaaccagtgcctcccctcaatccgtcccgctgcttctccagacgaaacaagaaaaaaactaacacccctccc

SEQ ID NO: 31150 - DNA, 75 bp, Artificial Sequence
  Synthetic
tcaaattcattcccgtcatgagcaaaatctttgtaaatcctagtgcaattcgtgcaggactggcagaccttgaga

SEQ ID NO: 31151 - DNA, 75 bp, Artificial Sequence
  Synthetic
tggctgaagagacagttgatttgatcaacaggaatcttgaggacaaccaggctcatcttcaaggagagcccatcg

SEQ ID NO: 31152 - DNA, 75 bp, Artificial Sequence
  Synthetic
aagtggatgctcttccagaggatatgagaaggctccagataagtgaacatgcaccttgtcacccgtcagagggtg

SEQ ID NO: 31153 - DNA, 75 bp, Artificial Sequence
  Synthetic
cctgcaagaaagaagaagggagcgacgatgacttctacatggcggagagtgaggacccatatgtacctcttcagt

SEQ ID NO: 31154 - DNA, 75 bp, Artificial Sequence
  Synthetic
cctatctagacagtgtgggaattcagatcgtgaggcagatgaagactggggagagattcttcaaaatctggtccc

SEQ ID NO: 31155 - DNA, 75 bp, Artificial Sequence
  Synthetic
agaccgtagaagagatcatatcatatgtgactgtcaactttcctctgccatctggaagaccaactgaggacaaat

SEQ ID NO: 31156 - DNA, 75 bp, Artificial Sequence
  Synthetic
ctacccagactgtaggggagaagcctaggtcaaatgtccagcagggatctgccaagaaagaggatcacctgtcta

SEQ ID NO: 31157 - DNA, 75 bp, Artificial Sequence
  Synthetic
aggccaaaatgacctcccaagaagcatctgggcctccggcgctcgagtggtccactaccaacgatgaagatgatg

SEQ ID NO: 31158 - DNA, 75 bp, Artificial Sequence
  Synthetic
catcaatagaagcagagatagcccatcagattgcagaaagtttctcgaagaaatataaattcccttctagatctt

SEQ ID NO: 31159 - DNA, 75 bp, Artificial Sequence
  Synthetic
ctgggatatttctatataactttgagcaactgaagatgaatctggatgacatcgtgggagaggccaaaaagatcc

SEQ ID NO: 31160 - DNA, 75 bp, Artificial Sequence
  Synthetic
caggtgtgaccagactggctcaagatggtcttaagctcccactcaggtgtatattaggaggggtggcctcaaccc

SEQ ID NO: 31161 - DNA, 75 bp, Artificial Sequence
  Synthetic
attcaaagaagttccaactcctggttggttccgataagctgggcaaaatcatgcaggacgatctcaacagatatc

SEQ ID NO: 31162 - DNA, 75 bp, Artificial Sequence
  Synthetic
tggcttattaacttatcccccaaggattccttcaccccacaagatcatccagagcctcatctgactcatggaaaa

SEQ ID NO: 31163 - DNA, 75 bp, Artificial Sequence
  Synthetic
aacaggcaacaccactgacgcaatgaattttttccgaaagatagtgaaaagttgcaaagatgaggaggatcaaaa

SEQ ID NO: 31164 - DNA, 75 bp, Artificial Sequence
  Synthetic
gccagctctgatgtcggctccaccagatgatgacgatctgtggcttcccccgccggagtatgtacctttgaccga

SEQ ID NO: 31165 - DNA, 75 bp, Artificial Sequence
  Synthetic
gatcacagctaaaaagaatatgaggaacttttgtgtcaatggcgagattaagatttgcagccccaacgggtattc

SEQ ID NO: 31166 - DNA, 75 bp, Artificial Sequence
  Synthetic
ctttaggatcctgagacatattctgaggtcttttgatggagtctattctggaaatcggagaatgataggacttgt

SEQ ID NO: 31167 - DNA, 75 bp, Artificial Sequence
  Synthetic
caaggttgtgatcggtctagccctctcaggtgctccggtcccggaggggatgaactgggtctacaagataagacg

SEQ ID NO: 31168 - DNA, 75 bp, Artificial Sequence
  Synthetic
cacccttgttttccaatgggcagagtctcacggcccactagatggagaagagctagaatactcacaggagataac

SEQ ID NO: 31169 - DNA, 75 bp, Artificial Sequence
  Synthetic
ctgggatgatgattcagagttcataggtttgcaaataaggataagtgcaaggcaatgtcatatccaaggacggat

SEQ ID NO: 31170 - DNA, 75 bp, Artificial Sequence
  Synthetic
ctggtgcatcaacatgaactccagggcatgtcagttatggtcagatatgtctctcaagacccagcaggctgacga

SEQ ID NO: 31171 - DNA, 75 bp, Artificial Sequence
  Synthetic
ggacaggaacacctctttgttgctagaatgacctcccctttacatagcaccttactcagttacctctacacaagg

SEQ ID NO: 31172 - DNA, 75 bp, Artificial Sequence
  Synthetic
atgtacatgattttatcctccaccttttatgagcaatagaacaaaaatatgtaatggtgccactctaccgctgca

SEQ ID NO: 31173 - DNA, 75 bp, Artificial Sequence
  Synthetic
ttttattgagacaccctattgaacatcttcacatgtgaaacctctgcaatgtgaaaaaaacatttaacatccctc

SEQ ID NO: 31174 - DNA, 75 bp, Artificial Sequence
  Synthetic
aaggatccaaggcaccatgccaactcaagccgtcctctctgcatttctcgcaacaatcacaatttgtgtagggaa

SEQ ID NO: 31175 - DNA, 75 bp, Artificial Sequence
  Synthetic
attccccatctacacaatccccgataaactgggtccctggagccccattgacatcaatcacctcagctgcccaaa

SEQ ID NO: 31176 - DNA, 75 bp, Artificial Sequence
  Synthetic
caatcttgtcgtggaagatgaggggtgtacgaacctgtccgggttcacatatatggagctaaaggtcggatacat

SEQ ID NO: 31177 - DNA, 75 bp, Artificial Sequence
  Synthetic
aacaacaataaaggtgagcggatttacatgtacaggagtggtcacggaagccgagacttacaccaactttgtagg

SEQ ID NO: 31178 - DNA, 75 bp, Artificial Sequence
  Synthetic
ttatgtcacaaccactttcaagagaaagcacttccgtccacgtcctgatgcatgtagggaagcttatgattggaa

SEQ ID NO: 31179 - DNA, 75 bp, Artificial Sequence
  Synthetic
gaccgcaggagaccctagatacgaggagtcattgcataacccatatcctgattcccattggctgagaacagtcac

SEQ ID NO: 31180 - DNA, 75 bp, Artificial Sequence
  Synthetic
caccacgaaagagtcactcctgataatagggccaagtgtggcggacatggacgcctatgacaagtctctttattc

SEQ ID NO: 31181 - DNA, 75 bp, Artificial Sequence
  Synthetic
caagatattcccagatgggaaatgttctggaatctctgctgtctctcccttctgcccgacgaaccatgaatatac

SEQ ID NO: 31182 - DNA, 75 bp, Artificial Sequence
  Synthetic
aatatggatgtccgagaatcaaaagcccggtatgtcctgtgacatattcaccactagcaaggggaagaaggccac

SEQ ID NO: 31183 - DNA, 75 bp, Artificial Sequence
  Synthetic
gaaaaatggcaaaatgtgtgggtttgttgacgagagaggattatacaaatccctcaaaggagcctgcaaactgaa

SEQ ID NO: 31184 - DNA, 75 bp, Artificial Sequence
  Synthetic
actgtgcggtgtctccggcctgagactaatggacggatcttgggtctctgttcagaacccggaggatgcaaaatg

SEQ ID NO: 31185 - DNA, 75 bp, Artificial Sequence
  Synthetic
gtgctctcccgaccagctggtgaacattcatgacttccactcagatgaagttgaacatcttattgtggaggagct

SEQ ID NO: 31186 - DNA, 75 bp, Artificial Sequence
  Synthetic
tgttaaaaagagagaagagtgtctggatgctctggaatcaatcatgaccaccaaatcagtaagcttccggcgatt

SEQ ID NO: 31187 - DNA, 75 bp, Artificial Sequence
  Synthetic
gagtcacttgagaaagcttgttcctggatttgggaaggcttacaccattatcaataaaaccttgatggaggcaga

SEQ ID NO: 31188 - DNA, 75 bp, Artificial Sequence
  Synthetic
tgcccactacaagtcaattaggcaatggactgagataatcccttcaaaggggtgtttaatggcaggagggagatg

SEQ ID NO: 31189 - DNA, 75 bp, Artificial Sequence
  Synthetic
ctatcctcaccataatggggtcttcttcaacgggataatcctcagcccggatggccacgtgttgattccagagat

SEQ ID NO: 31190 - DNA, 75 bp, Artificial Sequence
  Synthetic
gcaatctgctttgcttcagcagcatatagagctgctggagtcatctgttatacccctcatgcatcccctggctga

SEQ ID NO: 31191 - DNA, 75 bp, Artificial Sequence
  Synthetic
tccctcaactgcccttaaagggggagacggagcagaggactttgtagagatccatctccccgatgtgcaaaaaca

SEQ ID NO: 31192 - DNA, 75 bp, Artificial Sequence
  Synthetic
aatctcggggattgacttgggtctccctgagtggaagaggtatttcttaatgggggtatctgctttggccctgct

SEQ ID NO: 31193 - DNA, 75 bp, Artificial Sequence
  Synthetic
tgccttaacaataattctcgccacgtgttgtaaacggataaggaggaaaaagaagatgaagtcaagtcctgtgga

SEQ ID NO: 31194 - DNA, 75 bp, Artificial Sequence
  Synthetic
gttgattcgaaaggtgtctgtgacctctcaaagcgggaaggtagttccatcgtgggaatcttataaggttgatgc

SEQ ID NO: 31195 - DNA, 75 bp, Artificial Sequence
  Synthetic
aggaggtcaagcttaggttctgatcacatggttgacgatcagaatatataacaatctatgcctatttaaatcaag

SEQ ID NO: 31196 - DNA, 75 bp, Artificial Sequence
  Synthetic
gggtgttaagccatgagatcctcctgatgtcatcctcagttctggaaaggaggaagtcccatatccaagccaggg

SEQ ID NO: 31197 - DNA, 75 bp, Artificial Sequence
  Synthetic
atgaggagtgagatcattcttagtatctcggtatacagggtatattgatgatgacatcaattactggtgcttcag

SEQ ID NO: 31198 - DNA, 75 bp, Artificial Sequence
  Synthetic
ttgattcgggatgcatttattcagtccttctcgcgataaaaggtggtgatcatattatcctgtatttgatgcaga

SEQ ID NO: 31199 - DNA, 75 bp, Artificial Sequence
  Synthetic
catctcaatacactttgagacaaggtacattctagagaacagggatgtagaattctcaccatcggggaatctctt

SEQ ID NO: 31200 - DNA, 75 bp, Artificial Sequence
  Synthetic
gatcagatgacgctcagctattttactaactaagtgtatatattgacaatgagtgctatcatctagattacatta

SEQ ID NO: 31201 - DNA, 75 bp, Artificial Sequence
  Synthetic
tcatgaaaaaaacatgacactggggaagaatcaacacctctcttctgagaaactgtctcaatatgctggaccctc

SEQ ID NO: 31202 - DNA, 75 bp, Artificial Sequence
  Synthetic
aagaggtctatgatgatcctgtggacccggtggaacctgagacagatctcaagaacaactctgtggtaccaaaca

SEQ ID NO: 31203 - DNA, 75 bp, Artificial Sequence
  Synthetic
tactcagaaactcagactataatctgaattcccccttgatagaagacccatcaaggcttatgttggactggctaa

SEQ ID NO: 31204 - DNA, 75 bp, Artificial Sequence
  Synthetic
caacaggaaatagaccaaatcgattaaacatgactgacaatgcgtttagatcatacaaagtgcttaaaagttact

SEQ ID NO: 31205 - DNA, 75 bp, Artificial Sequence
  Synthetic
tcaaaagattagatgttgggtctttgaaggttggtggcgttggagcccaagccatgatgtcattgtggttgcacg

SEQ ID NO: 31206 - DNA, 75 bp, Artificial Sequence
  Synthetic
gagctcactctgagtctaccagaagcagaaagtgtctgtctgacctgacccatttttaccagagatcatccccaa

SEQ ID NO: 31207 - DNA, 75 bp, Artificial Sequence
  Synthetic
ttgagaagctcctgaactataccttggaaaatagaggacttcagaccccaccggagggagttctctccagtttga

SEQ ID NO: 31208 - DNA, 75 bp, Artificial Sequence
  Synthetic
agaaggttgactatgaccaggcattcggtcgatacatgggcaatgtttactcctcttacttgttctttcatgtca

SEQ ID NO: 31209 - DNA, 75 bp, Artificial Sequence
  Synthetic
taatcttatatatgaatgcattggattgggaggaagaaaagacaattctagcattgtggaaagacctaagctcag

SEQ ID NO: 31210 - DNA, 75 bp, Artificial Sequence
  Synthetic
tggacattaaaaaggatcaagtcaagtttagagatcagatatgggggtccctggtagtgaccaaggactttatct

SEQ ID NO: 31211 - DNA, 75 bp, Artificial Sequence
  Synthetic
attctcaaagtgccaactgcctattcgataggaactacaccttgatgttgaaggatctgtttctgtctaggttca

SEQ ID NO: 31212 - DNA, 75 bp, Artificial Sequence
  Synthetic
actcccttcttatcttactgtcacctccagagcccaggtactcagacgacttgatttctcagctgtgtcaactct

SEQ ID NO: 31213 - DNA, 75 bp, Artificial Sequence
  Synthetic
acattgcaggagatcacgttttggcgatgtgcggcaactccgggtatgatgtaatcaaaatgttggagccgtatg

SEQ ID NO: 31214 - DNA, 75 bp, Artificial Sequence
  Synthetic
tcgtaaatagcctagtacagagggccgagggattcagacctttaatccactccttgggagattttccccttttta

SEQ ID NO: 31215 - DNA, 75 bp, Artificial Sequence
  Synthetic
taaaagacaaggttacacaacttgagggtatctttgggccgagtgcaaggaacttttttcatatcctggatcaac

SEQ ID NO: 31216 - DNA, 75 bp, Artificial Sequence
  Synthetic
tcgacaatatacatgatttggtttttgtttatggctgttataggcactgggggcacccttacatagactatcgga

SEQ ID NO: 31217 - DNA, 75 bp, Artificial Sequence
  Synthetic
aggggctgtccaagctgtatgatcaagttcatctcaaaaaggttatcgacaaggattatcaggaatgtttggcta

SEQ ID NO: 31218 - DNA, 75 bp, Artificial Sequence
  Synthetic
gtgacttggctaaaagaatccttagatggggatttgacaagtactcgaagtggtatctagactctaaactacttg

SEQ ID NO: 31219 - DNA, 75 bp, Artificial Sequence
  Synthetic
cacatgaccaccctttgaccccctatgtcaagacccaaacctggccgcccaaacatatagtagatatagtgggaa

SEQ ID NO: 31220 - DNA, 75 bp, Artificial Sequence
  Synthetic
acacatggcacaagctccccatcactcaaatctttgagatccctgagtccatggacccctctgagatcctagatg

SEQ ID NO: 31221 - DNA, 75 bp, Artificial Sequence
  Synthetic
acaagtcacactcttttaccagaaccaagctggcgtcctggctttctgataatcgagggggtcccgtcccgagtg

SEQ ID NO: 31222 - DNA, 75 bp, Artificial Sequence
  Synthetic
agaaggtgataatcacggccctctccagaccccctgtcaaccctcgtgagttcttaaagtcgatagatttaggag

SEQ ID NO: 31223 - DNA, 75 bp, Artificial Sequence
  Synthetic
gcttgccagatgatgatctcataatagggttgaagcccaaggagagagaattaaagattgagggtaggttttttg

SEQ ID NO: 31224 - DNA, 75 bp, Artificial Sequence
  Synthetic
ctctaatgtcatggaatttaagactctattttgtgatcacagagaagctcctagcaaactatattctacctctat

SEQ ID NO: 31225 - DNA, 75 bp, Artificial Sequence
  Synthetic
ttgatgccttgaccatgacagacaacttgaataaagtgttcaaaaagctcatcgacagagttacaggacaggggt

SEQ ID NO: 31226 - DNA, 75 bp, Artificial Sequence
  Synthetic
tgcaggattattccagggtgacatatgctttccacttagactatgaaaagtggaacaaccaccagaggttggagt

SEQ ID NO: 31227 - DNA, 75 bp, Artificial Sequence
  Synthetic
ctacaaaagatgtgttctccgtactggatcatgtgttcggattgaagagggttttctccagaactcatgagttct

SEQ ID NO: 31228 - DNA, 75 bp, Artificial Sequence
  Synthetic
ttcagaagtcttgggtttattattctgacaggtcagaccttataggtctatgggaaggccagatatattgtctgg

SEQ ID NO: 31229 - DNA, 75 bp, Artificial Sequence
  Synthetic
atatgtcagatggccccacttgttggaacggtcaagatgggggcttagaagggttgagacagaagggttggagtt

SEQ ID NO: 31230 - DNA, 75 bp, Artificial Sequence
  Synthetic
tagtgagtcttttgatgatagatcgagagtcccagacaaggaacacgaggacaaagatcttggcacagggggaca

SEQ ID NO: 31231 - DNA, 75 bp, Artificial Sequence
  Synthetic
atcaagtcctatgccccacatacatgttgtcctctgggctgactgaagaggggcttctttacgagttggaaagca

SEQ ID NO: 31232 - DNA, 75 bp, Artificial Sequence
  Synthetic
tatcgagaaatgccctctccatatatcgagccattgaggatggagcatctaaattgggactgataatcaaaaagg

SEQ ID NO: 31233 - DNA, 75 bp, Artificial Sequence
  Synthetic
aggagacaatgtgcagttatgacttccttatatatggaaaaactcctttgtttaggggcaacatcttggttcctg

SEQ ID NO: 31234 - DNA, 75 bp, Artificial Sequence
  Synthetic
agtccaagagatgggccagggtctcatgtatctccaatgaccaaattgtcaatctagccaacattatgtccacag

SEQ ID NO: 31235 - DNA, 75 bp, Artificial Sequence
  Synthetic
tgtctactaatgctctgacagtggctcaacactcacaatccctgataaaacctatgagagactttttgctcatgt

SEQ ID NO: 31236 - DNA, 75 bp, Artificial Sequence
  Synthetic
cagtacaagctgtctttcattacttgctgttcagccctatattgaaagacagggtttataagatcttaagtgcag

SEQ ID NO: 31237 - DNA, 75 bp, Artificial Sequence
  Synthetic
acggagacgacttcctccttgccttgtcaaggattgtttatttggacccatcgctgggaggtgtgtcgggtatgt

SEQ ID NO: 31238 - DNA, 75 bp, Artificial Sequence
  Synthetic
ctttgggccgttttcacatacgacagttctctgaccctgtatctgagggattggcgttttggaaagaaatttggt

SEQ ID NO: 31239 - DNA, 75 bp, Artificial Sequence
  Synthetic
caagctcttcagaggcttggatccactctttgtgtcaagaggcaggcaacccagacctaggtgacaggagtctag

SEQ ID NO: 31240 - DNA, 75 bp, Artificial Sequence
  Synthetic
aaagtttcacccgtcttcttgaggaccccactactctgaacataaggggaggagccagcccaaccatcttattga

SEQ ID NO: 31241 - DNA, 75 bp, Artificial Sequence
  Synthetic
aggatgccatcaggaaggccctttatgatgaggtcgacaaggtggaaaactcagaattcagagaggcaatattat

SEQ ID NO: 31242 - DNA, 75 bp, Artificial Sequence
  Synthetic
tatccaaaacccatcgagataattttatcctatttctgagatcagtggagccccttttccccagatttctcagcg

SEQ ID NO: 31243 - DNA, 75 bp, Artificial Sequence
  Synthetic
agttattcagttcatcttttctcgggataccggagtctattatcggactcatccagaactctcgaacgattcggc

SEQ ID NO: 31244 - DNA, 75 bp, Artificial Sequence
  Synthetic
ggcaattcaggaggagtctctccaggaccttggaagaatccttcttcaactcagaggtccacggaatcaacagaa

SEQ ID NO: 31245 - DNA, 75 bp, Artificial Sequence
  Synthetic
tgactcaggtaccacaaagaatagggaaggtgtgggcgtgctcagcagaaagggcagatctcctgagagagattt

SEQ ID NO: 31246 - DNA, 75 bp, Artificial Sequence
  Synthetic
cctggggtagaaaagtggtaggcaccaccgtgcctcatccagcagagatgctggttctagtgccgaggtcttcca

SEQ ID NO: 31247 - DNA, 75 bp, Artificial Sequence
  Synthetic
tctcgtgtgtgtgtacccaaactggagaagatagccccagaatctccgtgtctgtattaccctcgttcgatcgat

SEQ ID NO: 31248 - DNA, 75 bp, Artificial Sequence
  Synthetic
ctttcttctctagaggtcctctaaaagggtatctaggctcttcgacatctatgtcaacccagttgttccatgctt

SEQ ID NO: 31249 - DNA, 75 bp, Artificial Sequence
  Synthetic
gggagaaggtgacaaatgtccatgtggtaaagagggcgttgtccctgaaagagtccataaactggtttatagaca

SEQ ID NO: 31250 - DNA, 75 bp, Artificial Sequence
  Synthetic
gaaagtccaatttagctcagacactgatcaaaaacatcatctcgctgacaggtcctctattccctcttgaagaga

SEQ ID NO: 31251 - DNA, 75 bp, Artificial Sequence
  Synthetic
cccctgtgttcaagaggacaggatctgcacttcaccggtttaagtcagcaagatacagtgaagggggttactctt

SEQ ID NO: 31252 - DNA, 75 bp, Artificial Sequence
  Synthetic
ctatctgccccaatttgttgtcacacatctccgtcagcacagatacaatgtccgacttgacacaggatggaagga

SEQ ID NO: 31253 - DNA, 75 bp, Artificial Sequence
  Synthetic
actttgactttatgtttcaacccctcatgctctacgctcaaacatggacctctgagcttgtgcagaaagacatca

SEQ ID NO: 31254 - DNA, 75 bp, Artificial Sequence
  Synthetic
gattgagggattcgacatttcattggcatcttcgctgtcttaaatgtatcagaccaattgatgagataactctcg

SEQ ID NO: 31255 - DNA, 75 bp, Artificial Sequence
  Synthetic
aagctcctcaaatcttcaccttcccagatgtgtctaagaggatctcaaggatggtgtcaggtgcagtacctcaat

SEQ ID NO: 31256 - DNA, 75 bp, Artificial Sequence
  Synthetic
ttcagagacttccagaagttgttttgaagcctgggaagtttgaatccttgaatggcaaagaaaaatctaggcata

SEQ ID NO: 31257 - DNA, 75 bp, Artificial Sequence
  Synthetic
taggcactgcccaagggttgctgtattccatactagtcgctacccatgatgcaggatacaacgacggtactatat

SEQ ID NO: 31258 - DNA, 75 bp, Artificial Sequence
  Synthetic
ttcctgtcaatatatatagtaaggtttctccaagggattatcttagggggctggctaggggtgtgttgatagggt

SEQ ID NO: 31259 - DNA, 75 bp, Artificial Sequence
  Synthetic
cgtcgatctgtttcctgaccagaatgaccaacatcaacattaatagacctctagaactcatatctggtgttatat

SEQ ID NO: 31260 - DNA, 75 bp, Artificial Sequence
  Synthetic
cctatatattgctaagacttgacaatcatccatcattgtatgtgatgctcaaagagtcctcactcagatcagaga

SEQ ID NO: 31261 - DNA, 75 bp, Artificial Sequence
  Synthetic
tattctcaatcccccagaaaattcccgcagcttatccaaccacaatgaaagaaggcaatagatctgttttgtgct

SEQ ID NO: 31262 - DNA, 75 bp, Artificial Sequence
  Synthetic
atctccagcatgtacttcgttatgagagagacatgatcacatcctcccctgataatgactggctttggatattct

SEQ ID NO: 31263 - DNA, 75 bp, Artificial Sequence
  Synthetic
ctgacttcaggagtgctaagatgacatacttgactctagtaacttatcagtcacatatcttacttctgaagattg

SEQ ID NO: 31264 - DNA, 75 bp, Artificial Sequence
  Synthetic
agaagagcctctccaagcagatgagaattaggcttagacagttaagttcattgatgagacaggtcttaggaggtc

SEQ ID NO: 31265 - DNA, 75 bp, Artificial Sequence
  Synthetic
atggggaggactccctggagtctgatgaggacattcaggggttgttaagggatgccttgcaaagaactcgatggg

SEQ ID NO: 31266 - DNA, 75 bp, Artificial Sequence
  Synthetic
tggatcaagaagttcgtcatgcagcaaagactatgacgggagatcacagccctagtaggaagatacctcggaagg

SEQ ID NO: 31267 - DNA, 75 bp, Artificial Sequence
  Synthetic
gaggctgttcagaatgggtttgttctgcccaacaggttgcaatttcaacctcttctaatcctgccccaatgtctg

SEQ ID NO: 31268 - DNA, 75 bp, Artificial Sequence
  Synthetic
aactagacgttagagccttatctagaagacttcagaacccactaatatcaggtttgagagtggtgcaatgggcta

SEQ ID NO: 31269 - DNA, 75 bp, Artificial Sequence
  Synthetic
caggtgctcactataaactaaagccaatacttgatgatcttgatgcctatccatctctctgtctggttgtaggag

SEQ ID NO: 31270 - DNA, 75 bp, Artificial Sequence
  Synthetic
atggatccggcggaatctcaaggactgtgcttagcatgttccccgatgccagattggtttttaacagcttgttag

SEQ ID NO: 31271 - DNA, 75 bp, Artificial Sequence
  Synthetic
aggtgagcgatctaatggcctctgggacgcatccgttacctccctcagcaatcatgagtgggggcagtgatatag

SEQ ID NO: 31272 - DNA, 75 bp, Artificial Sequence
  Synthetic
tgtctagggtcatagatttcgggtcaatctgggagaagccatcagacctaaggaacctttctacctggaggtact

SEQ ID NO: 31273 - DNA, 75 bp, Artificial Sequence
  Synthetic
ttcagtcaatccaaggtcgccttaacatgtcttatgatttgatcatatgtgacgcagaagtgacagacatcccat

SEQ ID NO: 31274 - DNA, 75 bp, Artificial Sequence
  Synthetic
cagtcaacaagatcactctgttgatgtctgatttttcgctctcaattaatggtcccctcaacctaatctttaaaa

SEQ ID NO: 31275 - DNA, 75 bp, Artificial Sequence
  Synthetic
cttacgggactatgctggtgaactcagattataaggctatccagcatctctcaagggctttcccgtccgttgcag

SEQ ID NO: 31276 - DNA, 75 bp, Artificial Sequence
  Synthetic
gatatattactcagatgacatcatccttctcgtctgaaatctacctgaggttttcaaagaggggtaagttcttta

SEQ ID NO: 31277 - DNA, 75 bp, Artificial Sequence
  Synthetic
gagattctgagtatctgacctcctccaccctgcgggagatgagtcttgttctgttcaattgtagcagtcctaaga

SEQ ID NO: 31278 - DNA, 75 bp, Artificial Sequence
  Synthetic
gcgagatgcaaagggcccgttctttgaactatcaggatctggtgcgaggatttcctgaggagattatttcaaacc

SEQ ID NO: 31279 - DNA, 75 bp, Artificial Sequence
  Synthetic
cttacaatgagatgataataacccttatagacagtgaagtagagtccttccttgttcacaagatggtggatgatt

SEQ ID NO: 31280 - DNA, 75 bp, Artificial Sequence
  Synthetic
tggagctccagagaggaactctgtcaaagatgtccatcattgtcgccatagtcgtagtcttttctaatagggtgt

SEQ ID NO: 31281 - DNA, 75 bp, Artificial Sequence
  Synthetic
tcaatgtgtcaaagccattgagcggttcagtattctacccgccttcagacccgaagattctaagacacttcaaca

SEQ ID NO: 31282 - DNA, 75 bp, Artificial Sequence
  Synthetic
tctgttgcagcaccctgatgtatctgtcgactgccttgggtgatgtgctgaattttgctcgacttcatgagctct

SEQ ID NO: 31283 - DNA, 75 bp, Artificial Sequence
  Synthetic
ataacaacccggtcacctactattttaagaagcaggtcgtcaaagggagcatatatctgtcatggagctggtcgg

SEQ ID NO: 31284 - DNA, 75 bp, Artificial Sequence
  Synthetic
atagcacatccatcttcaagagggtggcatgtaactccaacctgagtctatcctctcactggatacgactgattt

SEQ ID NO: 31285 - DNA, 75 bp, Artificial Sequence
  Synthetic
acaagatagtccggaccactcggtttgtggggaacaccaatgaactctctaaagaggttgagaagcacttaagag

SEQ ID NO: 31286 - DNA, 75 bp, Artificial Sequence
  Synthetic
ggtacaacagatggataaatctcaacgatattcgatctcggtcctctttattagattacagtggcttatgactct

SEQ ID NO: 31287 - DNA, 75 bp, Artificial Sequence
  Synthetic
gctgggtatctcatatatgcccttccatcttattgtacactgaatcttgaaaaaaacacacctagaatccatagc

SEQ ID NO: 31288 - DNA, 75 bp, Artificial Sequence
  Synthetic
aaaaaacacacctagaatccatagccggtacctatctgggggtttctcttctttattgttttttttgttaagcgt

SEQ ID NO: 31289 - DNA, 75 bp, Artificial Sequence
  Synthetic
tacttaaatgatgagagcagacttcagaccagcacgccagaggcaaggccaggcctcaagcgagttctctggttt

SEQ ID NO: 31290 - DNA, 75 bp, Artificial Sequence
  Synthetic
tgttgcgttaacaacaaaccaatcattatccttctaacaaaatgaatacacgcaatgccacccaagagacgcctg

SEQ ID NO: 31291 - DNA, 75 bp, Artificial Sequence
  Synthetic
ggcagatatttccttgggacagtcggatcaggagtcaaacctagaagaattaggtataatagaacatcacatgat

SEQ ID NO: 31292 - DNA, 75 bp, Artificial Sequence
  Synthetic
gttgatgacgccgatgccatggaggaccaagatttatatgaacccccagcgagcctccccaagctccccggaaaa

SEQ ID NO: 31293 - DNA, 75 bp, Artificial Sequence
  Synthetic
tttcacctacaagactttgatgcaagtcttaacttaacaccttcaatcaatctagcaacagggcacgaaacagac

SEQ ID NO: 31294 - DNA, 75 bp, Artificial Sequence
  Synthetic
ttcctacaatacaccgttggggggtctgacccgcatccgggtatagggcatgagaaggatatcaggcagaacgca

SEQ ID NO: 31295 - DNA, 75 bp, Artificial Sequence
  Synthetic
tgagaaggatatcaggcagaacgcagtggcattgttagaccagtcacggcgcgatatgtttcatacagtaacgcc

SEQ ID NO: 31296 - DNA, 75 bp, Artificial Sequence
  Synthetic
ccaataaatcacgcgtttggcacacaagccaacctactgccctataccaggtccaacaacatcacatcaaccgat

SEQ ID NO: 31297 - DNA, 75 bp, Artificial Sequence
  Synthetic
cagccttgtgtttctatgtttgctaatcccaggactgcacgctgcgtttgttcacggaggggtgcctcgtgaatc

SEQ ID NO: 31298 - DNA, 75 bp, Artificial Sequence
  Synthetic
actgggtctgggtgggtacatattgggttgccatcattcgcttttctcaacccccttggatggctcagagatatc

SEQ ID NO: 31299 - DNA, 75 bp, Artificial Sequence
  Synthetic
ttacctgtcgacgcctgttacgcgtggggaacagactgtcgttaagactgcaaagttttacggggaaaagacaac

SEQ ID NO: 31300 - DNA, 75 bp, Artificial Sequence
  Synthetic
ttttcttgggcagcatggattggagggatactatacttaatcacattatgtatttctctcccagcctccttcgcg

SEQ ID NO: 31301 - DNA, 75 bp, Artificial Sequence
  Synthetic
acagcgtgatctcaccgagctggagatctcctctatattcagccattgttgctcattactaattggggttgtgat

SEQ ID NO: 31302 - DNA, 75 bp, Artificial Sequence
  Synthetic
aggaggagacgcctcggccggtggtagggataaaccgaacagatcaatcactaaagaaccctctacttggaactg

SEQ ID NO: 31303 - DNA, 75 bp, Artificial Sequence
  Synthetic
atctcctctatattcagccattgttgctcattactaattggggttgtgataggatcgtcatctaagattaaagca

SEQ ID NO: 31304 - DNA, 75 bp, Artificial Sequence
  Synthetic
ggagccgagcagatcaagaaaaggtttaaaactatgatggcagccttaaaccggccatcccatggtgagactgct

SEQ ID NO: 31305 - DNA, 75 bp, Artificial Sequence
  Synthetic
ttaaaactatgatggcagccttaaaccggccatcccatggtgagactgctacactacttcagatgtttaatccac

SEQ ID NO: 31306 - DNA, 75 bp, Artificial Sequence
  Synthetic
aagttgcattttgtcttaactcaagtttaatccctcaccatatacgagcccgcagctatgttaaacccaagaatt

SEQ ID NO: 31307 - DNA, 75 bp, Artificial Sequence
  Synthetic
tgccatctaaggattattaccgcctcttccgccaagtcgttcttccatcagaaatctacccacttggagttctga

SEQ ID NO: 31308 - DNA, 75 bp, Artificial Sequence
  Synthetic
tacgtgctgcggaagctatacttcaagttatcatatcaacttggaagcttaatcatatgtcaaaactcatttctg

SEQ ID NO: 31309 - DNA, 75 bp, Artificial Sequence
  Synthetic
agtccccaggtaaagaattcatggatcagattaaacttgtcgcaagttatgcgcagatgactacgtacactacta

SEQ ID NO: 31310 - DNA, 75 bp, Artificial Sequence
  Synthetic
ctgctgtacgctatgctttaactaatccgaaaatcaggagtcaacttgagttacatattgcttatcaacgaatca

SEQ ID NO: 31311 - DNA, 75 bp, Artificial Sequence
  Synthetic
taaaggagtacctcgcagaatgtatggatgctacccttacaatccctgtagttgcatatgagattcgtgactttt

SEQ ID NO: 31312 - DNA, 75 bp, Artificial Sequence
  Synthetic
ttaaccaggtttcctacagtagagaggctgatgtaggaccaaaaaggcttggaaatatgactcttatgtttgttc

SEQ ID NO: 31313 - DNA, 75 bp, Artificial Sequence
  Synthetic
tagaagtttcagcaaagcttaaagaggaacatgctgacctgtttccgttcctgggggctattcggcaccccgacg

SEQ ID NO: 31314 - DNA, 75 bp, Artificial Sequence
  Synthetic
aatcactagttgttgcaatgattgatgacactagttgtttaatgacatacaatcactttctagctgctgctgaca

SEQ ID NO: 31315 - DNA, 75 bp, Artificial Sequence
  Synthetic
ctatcaagcttgcgccacggagctttcccaatctggcttctgcagcgttttactggagtaagaaggagaatccca

SEQ ID NO: 31316 - DNA, 75 bp, Artificial Sequence
  Synthetic
ccgccaaaagtagatgtcacttgtttatcgcttctgttatccaaggggctctttgggaacaaggatcatttcttg

SEQ ID NO: 31317 - DNA, 75 bp, Artificial Sequence
  Synthetic
caatggcgggctaccgggcctccaccatccagccgggcgcgagtgtcaaggagacccagcttgcccggtataggc

SEQ ID NO: 31318 - DNA, 75 bp, Artificial Sequence
  Synthetic
atcatatccttgatttaacacatataatagactctataatattacctcatgatgattattttcagattatcaagt

SEQ ID NO: 31319 - DNA, 75 bp, Artificial Sequence
  Synthetic
gccgcgagatatctcgcggggaagacggggcagagctctcaggtgagatctctgccataatgagaatgataggtg

SEQ ID NO: 31320 - DNA, 75 bp, Artificial Sequence
  Synthetic
ctatttccccatactcccaaggtttagtaatggatcagcataatgtcactgtctcaacaaattttaaatcaatct

SEQ ID NO: 31321 - DNA, 75 bp, Artificial Sequence
  Synthetic
tgactggtctaaactagaaaacaatgaacaaaccaataaaaaaccaaatgcggcaaaccccccgcgacctgtgat

SEQ ID NO: 31322 - DNA, 75 bp, Artificial Sequence
  Synthetic
ttccgatccaagaactctgtccaccacttgacaacttacttaaaaaactattatcaattgacccagtgcttcttt

SEQ ID NO: 31323 - DNA, 75 bp, Artificial Sequence
  Synthetic
gcaacgcgaccatcgagtctggtcgactccctggaggacgaagaagatccccagacactacgacgggaacgatcg

SEQ ID NO: 31324 - DNA, 75 bp, Artificial Sequence
  Synthetic
tggtaataacctcagttcaaaaatcatggtactttccagaaataaacatgtgtgacggttctcgcgaacaactaa

SEQ ID NO: 31325 - DNA, 75 bp, Artificial Sequence
  Synthetic
ccagacactacgacgggaacgatcggggtcaccaagaccacggaagatcccaaggaatgcattgacccaaccggt

SEQ ID NO: 31326 - DNA, 75 bp, Artificial Sequence
  Synthetic
tgaagatgcgctttgactcagaatcgcctaaggccctgctatcgtatggacagacactcctcgcaatgttccggg

SEQ ID NO: 31327 - DNA, 75 bp, Artificial Sequence
  Synthetic
agaccagctcctgaaggacctcaggaagaacccctccatgatctcagacccagaccagcgaaccggaagggagca

SEQ ID NO: 31328 - DNA, 75 bp, Artificial Sequence
  Synthetic
ctgagttcatcaagggctatatctccaagcatggtaaatggccacctgttcatttattacctacttgtaacaggt

SEQ ID NO: 31329 - DNA, 75 bp, Artificial Sequence
  Synthetic
gctatcgaatgatgagcttatcaagaagctagtgacggagctggccgagaatagcatgatcgaggctgaggaggt

SEQ ID NO: 31330 - DNA, 75 bp, Artificial Sequence
  Synthetic
caataagaaatgcacgtgaattgggaaggtggagtccatcacttgatcggaattggcaatggttctcagaagtat

SEQ ID NO: 31331 - DNA, 75 bp, Artificial Sequence
  Synthetic
gcggggcactcttggggacatctcggctcgcatcgaggcagggtttgagtccctgtccgccctccaagtggaaac

SEQ ID NO: 31332 - DNA, 75 bp, Artificial Sequence
  Synthetic
tgattcttaaattaacagatcttgacatggatcctgattttaatgatattgtaagtgataaagcaattattaatt

SEQ ID NO: 31333 - DNA, 75 bp, Artificial Sequence
  Synthetic
ccctgtccgccctccaagtggaaaccatccagacagctcagcggtgcgaccactccgatagcatcagaatccttg

SEQ ID NO: 31334 - DNA, 75 bp, Artificial Sequence
  Synthetic
cacgggtagattggtcatttgagtataatgcagcagcataccgccaaaagtatggagagaagctggaacgaccct

SEQ ID NO: 31335 - DNA, 75 bp, Artificial Sequence
  Synthetic
gcgagaacatcaagatactggatcgctccatgaagacaatgatggagacaatgaagctcatgatggagaaggtgg

SEQ ID NO: 31336 - DNA, 75 bp, Artificial Sequence
  Synthetic
ctgtgaaatctggaccatcgagactggtcaatgccctgatagacggccggttggacgatatcccacacctacttg

SEQ ID NO: 31337 - DNA, 75 bp, Artificial Sequence
  Synthetic
acctcctctacgcatcaaccgccgttgggacctctgcacccatgttgccctcccatcctgcacctccgcgcattt

SEQ ID NO: 31338 - DNA, 75 bp, Artificial Sequence
  Synthetic
ggcccttttataaggggtcagtagagtttgaggacagactcaccgtccttgttcccaaagagaaagagttgaaag

SEQ ID NO: 31339 - DNA, 75 bp, Artificial Sequence
  Synthetic
tcccatcctgcacctccgcgcatttatccccagctcccaagtgccccgacagcggatgagtgggacatcatacca

SEQ ID NO: 31340 - DNA, 75 bp, Artificial Sequence
  Synthetic
taaaaaaatcgaatcaccatgaattcaaagcattcctatgtggagctcaaggacaaggtaatcgtccctggatgg

SEQ ID NO: 31341 - DNA, 75 bp, Artificial Sequence
  Synthetic
ttaaaggtcgattcttttccaagcaaacacttgctattagagtatatcaagttattgcagaggcagctcttaaaa

SEQ ID NO: 31342 - DNA, 75 bp, Artificial Sequence
  Synthetic
cccacactgatgcttgagatagactttgtaggagggacttcacggaaccagttccttaacatcccatttctttca

SEQ ID NO: 31343 - DNA, 75 bp, Artificial Sequence
  Synthetic
atgaaatcatgccatatctcaagacacactcaatgaccatgagttcgactgctttaacacacctcttaaacaagc

SEQ ID NO: 31344 - DNA, 75 bp, Artificial Sequence
  Synthetic
tatcgtatcaggtagttaaaggagaatcatttgtaattaatttagattacagttcatggtgcaatgcttttaggc

SEQ ID NO: 31345 - DNA, 75 bp, Artificial Sequence
  Synthetic
gtgaaagagcctctgcagcttccacgcgagaagaagttgaccgactacttcaccattgacgtagagccagcaggt

SEQ ID NO: 31346 - DNA, 75 bp, Artificial Sequence
  Synthetic
ctgaacttcagatgccgatttgtagacaacttgacttaatgtttgatagtggttactttttcaggactggatgca

SEQ ID NO: 31347 - DNA, 75 bp, Artificial Sequence
  Synthetic
cattccctggtcaacatatacttccagattgacgacttcttgctcctaacactcaactcactgtccgtatacaag

SEQ ID NO: 31348 - DNA, 75 bp, Artificial Sequence
  Synthetic
gacccgattaggaaatacatgttcctacgcctcaacaaggaacagagcaagcacgcaattaatgcagctttcaat

SEQ ID NO: 31349 - DNA, 75 bp, Artificial Sequence
  Synthetic
cattaccgtgctttacaacattcattatacaagaccggttcaatccaccttactctattaaaggggatcctcacg

SEQ ID NO: 31350 - DNA, 75 bp, Artificial Sequence
  Synthetic
aggatgggatcacgtgtgcaattggaacaaagacgatgggtgaggggatgcgtcaaaagttatggactatcttaa

SEQ ID NO: 31351 - DNA, 75 bp, Artificial Sequence
  Synthetic
gtcttctcttatcggcttcggaacattggtgttggccctctcggcccagacattcgatcttcagggccttagttg

SEQ ID NO: 31352 - DNA, 75 bp, Artificial Sequence
  Synthetic
cattcgatcttcagggccttagttgcaatactgactccactcctggattaatcgatctggagataaggcgacttt

SEQ ID NO: 31353 - DNA, 75 bp, Artificial Sequence
  Synthetic
ccagctgttgggaaattattgcccttcgagaagcaaatgttacgtttaatatcttaggccaaggcgacaaccaga

SEQ ID NO: 31354 - DNA, 75 bp, Artificial Sequence
  Synthetic
gccacaccccaacggaaaatgtcatttcatgcgaggttagttatcttaaccacacgactattagcctcccggcag

SEQ ID NO: 31355 - DNA, 75 bp, Artificial Sequence
  Synthetic
ccatcattatccataagtcgcccagtcaatccaaccaagcactagcagatacagcgttaagttgtttacacaaac

SEQ ID NO: 31356 - DNA, 75 bp, Artificial Sequence
  Synthetic
ctgcaaaacctattggggattctttggtagctacagcgctgaccgaatcatcaatcggtacactggtactgttaa

SEQ ID NO: 31357 - DNA, 75 bp, Artificial Sequence
  Synthetic
atgcgagacttgctggacataacttgaaaacagaggagtgttgggtttctgattgcctgtatgaatatgggaaga

SEQ ID NO: 31358 - DNA, 75 bp, Artificial Sequence
  Synthetic
ggtagctacagcgctgaccgaatcatcaatcggtacactggtactgttaagggttgtttaaacaactcagcgcca

SEQ ID NO: 31359 - DNA, 75 bp, Artificial Sequence
  Synthetic
gaatgtttttccgtggtgtacccgtaccgggcagtttgaagcagctatctcgtgtcaccgactcaacaggggagc

SEQ ID NO: 31360 - DNA, 75 bp, Artificial Sequence
  Synthetic
tttttcctaatttatactcgaaattagcttgtctgacctcatcatgtcttagtgcttccatggctgacacatctc

SEQ ID NO: 31361 - DNA, 75 bp, Artificial Sequence
  Synthetic
aatgtcacggtggctgtacagacattcccaccgttcatgtactgcagtttcgcggactgtagtactgtgagtcag

SEQ ID NO: 31362 - DNA, 75 bp, Artificial Sequence
  Synthetic
catgggtctccttgacaactggagtatgtctctatcttattgagctctatgtagaatttccaggaacaataatgc

SEQ ID NO: 31363 - DNA, 75 bp, Artificial Sequence
  Synthetic
caggagctagagagtggcaaggcaatgctgagcgatggcagtaccttaacttataccccgtatatcttacaatca

SEQ ID NO: 31364 - DNA, 75 bp, Artificial Sequence
  Synthetic
aaaacgaagcacttctaattacactttgtttggttggcccgtcaatcgggggattgcctacaccagcaacattgc

SEQ ID NO: 31365 - DNA, 75 bp, Artificial Sequence
  Synthetic
ttataccccgtatatcttacaatcagaagtcgtgaacaaaacccttaatgggactatactctgcaactcatcctc

SEQ ID NO: 31366 - DNA, 75 bp, Artificial Sequence
  Synthetic
caagtgtgttctttcgaggcatgtcagaccctctaccccttcagttagcattacttaaaacccttataactgtga

SEQ ID NO: 31367 - DNA, 75 bp, Artificial Sequence
  Synthetic
ctaaattcccttatgagttcattaaccgagtggttaaactcaaacttgccccctatcccgactggttgaccctgg

SEQ ID NO: 31368 - DNA, 75 bp, Artificial Sequence
  Synthetic
tgtgacgtgtgtaaactacacgtcgtcctgccggtccaagttgagaaggcggcgtagggatactcaacagattga

SEQ ID NO: 31369 - DNA, 75 bp, Artificial Sequence
  Synthetic
tgacagacccaacatctttaaatattgcacaggtttacaggcctgagaggcaaattaggaggtggatagaagaag

SEQ ID NO: 31370 - DNA, 75 bp, Artificial Sequence
  Synthetic
gtacctagttcacaagcttaggcctacactgaaagatgcgtgggaggactgtgagatcctccagtctctgctcct

SEQ ID NO: 31371 - DNA, 75 bp, Artificial Sequence
  Synthetic
caataacgtcaggttcccactcatcaaggatagcaaccttctttcaaaattccctaactgaattagcacaacttc

SEQ ID NO: 31372 - DNA, 75 bp, Artificial Sequence
  Synthetic
agggatgtttggtactgggattgcaagtgcttcgcaattcttgaggggctggctcaaccaccctgatatcatcgg

SEQ ID NO: 31373 - DNA, 75 bp, Artificial Sequence
  Synthetic
agtgcttcgcaattcttgaggggctggctcaaccaccctgatatcatcgggtatatagttaatggagttggggta

SEQ ID NO: 31374 - DNA, 75 bp, Artificial Sequence
  Synthetic
tggccagagacttatcaactatgatgcctcttcgtccacgtgatatgtccgcgttgttttcactctcgaatgttg

SEQ ID NO: 31375 - DNA, 75 bp, Artificial Sequence
  Synthetic
gtctggcaatgccatcgtgttaatgtcacgttcatggcgtggaatgagtccacatattaccctccagtagattac

SEQ ID NO: 31376 - DNA, 75 bp, Artificial Sequence
  Synthetic
catatgggctaagcatcatagatttgttccaaaagtcttcaacagttgtggcagcaagtcaagctattcacatag

SEQ ID NO: 31377 - DNA, 75 bp, Artificial Sequence
  Synthetic
cacatattaccctccagtagattacaatggacggaagtactttctgaatgatgaggggaggctacaaacaaacac

SEQ ID NO: 31378 - DNA, 75 bp, Artificial Sequence
  Synthetic
ccccgaggcaaggccagggcttaagcgggtcatgtggttcggcaggtacttcctagggacagtagggtctggggt

SEQ ID NO: 31379 - DNA, 75 bp, Artificial Sequence
  Synthetic
aggacgtaatcttagaaagccagcgctataagacatcgattattaacaatttgctggatcaatctgagggccatg

SEQ ID NO: 31380 - DNA, 75 bp, Artificial Sequence
  Synthetic
atatgagtgtttaccttaaagggtgtacacacctggctgctaaacaacttcgcaaattcacttggggaagagaac

SEQ ID NO: 31381 - DNA, 75 bp, Artificial Sequence
  Synthetic
gaaaccgaggaggattcggtacaataagacctcacatgattaccatctagaggagtttgaggcaagtctcaacat

SEQ ID NO: 31382 - DNA, 75 bp, Artificial Sequence
  Synthetic
aagacctcacatgattaccatctagaggagtttgaggcaagtctcaacatgaccccccagaccagtatcgcctcg

SEQ ID NO: 31383 - DNA, 75 bp, Artificial Sequence
  Synthetic
ttgtaggggttacaatgccatttgtagccgagcagttttgtccccatgactctgtgaatgtggatgaggggcact

SEQ ID NO: 31384 - DNA, 75 bp, Artificial Sequence
  Synthetic
acacaaatgcaatcatatattgtcctcaggagactcttcgaacagcacacctgataactcgtgggagccagcccc

SEQ ID NO: 31385 - DNA, 75 bp, Artificial Sequence
  Synthetic
ataacgtctacagatacaggctcaggctgggtgcacatcggcctaccctcatttgctttcctcaatcctctcggg

SEQ ID NO: 31386 - DNA, 75 bp, Artificial Sequence
  Synthetic
gctgggtgcacatcggcctaccctcatttgctttcctcaatcctctcgggtggcttagggacctacttgcgtggg

SEQ ID NO: 31387 - DNA, 75 bp, Artificial Sequence
  Synthetic
tatatcttggatctaatacgtcaatcaaggtccaaaagggggatataacaggtcttaataagtcaagggcagcta

SEQ ID NO: 31388 - DNA, 75 bp, Artificial Sequence
  Synthetic
cggcctggttgggtggggttctatacttaataagtctttgtgtttccttaccagcctccttcgcgaggaggagac

SEQ ID NO: 31389 - DNA, 75 bp, Artificial Sequence
  Synthetic
atcttgttcgtgatacactcatcttgcaccagtggtacaagatcaggaatatcactgacccaaatctgtctatat

SEQ ID NO: 31390 - DNA, 75 bp, Artificial Sequence
  Synthetic
gcctcggccggtggcaggaataaaccgtaccgaccaatctcttaaaaaccctcttctcgggacagaggtctcttt

SEQ ID NO: 31391 - DNA, 75 bp, Artificial Sequence
  Synthetic
tgttatcaagatttctttctgaaaaggggtacacatccgaggtccgaccacacatccatggaggaacattaacac

SEQ ID NO: 31392 - DNA, 75 bp, Artificial Sequence
  Synthetic
ctcttctcgggacagaggtctctttctgccttaaatcgagttcactcccccatcacgtacgagcattgggccaga

SEQ ID NO: 31393 - DNA, 75 bp, Artificial Sequence
  Synthetic
atagattaccatcacggcaagacacaagacaagggttaactggttacattaacttaattagtacttggttaaagt

SEQ ID NO: 31394 - DNA, 75 bp, Artificial Sequence
  Synthetic
tttccagtgactatctccaatcctactcaaagtcatcagatgattataccattcacttccaacatgtattcacat

SEQ ID NO: 31395 - DNA, 75 bp, Artificial Sequence
  Synthetic
gttgtattgccccctgaagtatatcccattggtgtcttaataagagctgcggaggccatactaacagttatagta

SEQ ID NO: 31396 - DNA, 75 bp, Artificial Sequence
  Synthetic
atggatgtctgtatgctgactcaatcattagagcagggggtataatcaataagccttacctcttaagtgctcatt

SEQ ID NO: 31397 - DNA, 75 bp, Artificial Sequence
  Synthetic
gttcaacatgttttgagaaaattgagtcggaggagtttgtacttgcatgccagccaatgtatacaggagcagagt

SEQ ID NO: 31398 - DNA, 75 bp, Artificial Sequence
  Synthetic
cgggcccaacttgagctccacattgcctaccagcgcatagtgggtcaggtctcgtatagccgggaagcagatata

SEQ ID NO: 31399 - DNA, 75 bp, Artificial Sequence
  Synthetic
ggcttatatccaaacccgtgactataccagagaagatactagatattgaggttgagttcgatccttgcatcagtg

SEQ ID NO: 31400 - DNA, 75 bp, Artificial Sequence
  Synthetic
gggccaaaaaggcttgggaatatgtcattgcaattcatccaatccctcgttattgccaccatagacacaacgagc

SEQ ID NO: 31401 - DNA, 75 bp, Artificial Sequence
  Synthetic
tgcctaatgacctacaaccactttcttgctgcagcagacacagccaagagcagatgccacctcctaatcgcctca

SEQ ID NO: 31402 - DNA, 75 bp, Artificial Sequence
  Synthetic
ccagtgtctgccttggagtattaattgggaaatcactgctcattgacattcgggcaaatcaacttgacattatgg

SEQ ID NO: 31403 - DNA, 75 bp, Artificial Sequence
  Synthetic
agcaaagaacttggggaaacttggagcgtttctcaatctccgatcttaggagactcccttggagtatagttatac

SEQ ID NO: 31404 - DNA, 75 bp, Artificial Sequence
  Synthetic
gtggtccaaggagccctttgggagcaagggtcatttcttgatcatataatcaacatgatcgacacaattgactca

SEQ ID NO: 31405 - DNA, 75 bp, Artificial Sequence
  Synthetic
atcaacctcccccatgatgattacttcacaattattaagtctatctctccctactcccaagggcttgttatgggg

SEQ ID NO: 31406 - DNA, 75 bp, Artificial Sequence
  Synthetic
ggtcaatatggagatgtctaatggaatccaatttactccaatttgaaagagccgggttgattaaactgctccatt

SEQ ID NO: 31407 - DNA, 75 bp, Artificial Sequence
  Synthetic
ctggggcaggtccaacttttgcatttttataccgcactttacaagattcttcaatattaatggagtgcacacctg

SEQ ID NO: 31408 - DNA, 75 bp, Artificial Sequence
  Synthetic
aggcacaatgtgtcagtctcctctgattttgcgtccgtatttactattcctgaatcatgcccacaactagacagc

SEQ ID NO: 31409 - DNA, 75 bp, Artificial Sequence
  Synthetic
ttactaaaaaaactgcttcaacttgaccctgttctcctcctcatggtctcttcggtgcagaagtcatggtacttc

SEQ ID NO: 31410 - DNA, 75 bp, Artificial Sequence
  Synthetic
ttgacagacttttaagacacattaactttcataataaaagggatttgatctcaaaggttattctaatgccactta

SEQ ID NO: 31411 - DNA, 75 bp, Artificial Sequence
  Synthetic
ttcggtgcagaagtcatggtacttccctgagatccgaatggttgacgggtcacgggagcagctccacaagatgcg

SEQ ID NO: 31412 - DNA, 75 bp, Artificial Sequence
  Synthetic
taaattatagtcttatacattcagagattgacagaattgatatcaagtaccgccaaatttctgaagcaaacgttg

SEQ ID NO: 31413 - DNA, 75 bp, Artificial Sequence
  Synthetic
tgtcgagctggagacgccccaagccctgctgtcatacggccatacccccctgtcaatatttcgagcagagtttat

SEQ ID NO: 31414 - DNA, 75 bp, Artificial Sequence
  Synthetic
atctttacatggcagctgccaagtctgccggtattgcaccaggatgcgttgtagaggaaacaaatgattttgtgg

SEQ ID NO: 31415 - DNA, 75 bp, Artificial Sequence
  Synthetic
caaaggctatgtctcaaagaatgcgaagtggccgcctgtacacctgctcccaggctgtgacaaatccataaagaa

SEQ ID NO: 31416 - DNA, 75 bp, Artificial Sequence
  Synthetic
tacgaggacaacatcacgggtattattcactctcggacattggtactcaagtccagtcacaagtttttaaaatgg

SEQ ID NO: 31417 - DNA, 75 bp, Artificial Sequence
  Synthetic
tgcgagagagctgggccgctggagcccggtgtttgaccgacgatggcagctcttcgcgaaggttgtcattctaag

SEQ ID NO: 31418 - DNA, 75 bp, Artificial Sequence
  Synthetic
taattcgtaagttaaatttaacagaggtatatatatatccatcgttggatcctgaggttgcattagatatctgtc

SEQ ID NO: 31419 - DNA, 75 bp, Artificial Sequence
  Synthetic
atcttcctggtctaagaattattctagtgctggcaggtgatccaacctattatgaacaacttctcgagatggact

SEQ ID NO: 31420 - DNA, 75 bp, Artificial Sequence
  Synthetic
ctgggtatttgagtacaatgcagcagccttttggaagaaatacggtgagcggttggagaggccccctgccagatc

SEQ ID NO: 31421 - DNA, 75 bp, Artificial Sequence
  Synthetic
tatgcggggctgtttcaactagagttgatgttcctaaatcattagcaaccaggacccacagtggctatgctattg

SEQ ID NO: 31422 - DNA, 75 bp, Artificial Sequence
  Synthetic
gggaccatcacggcttgtgaatgctctgatcgatggacacttagataatatcccagccctgctagagccatttta

SEQ ID NO: 31423 - DNA, 75 bp, Artificial Sequence
  Synthetic
gccctacaatagggaataacgttatacgacttcaagagctgcaacatgtatcctatgctcacccatgtatagagg

SEQ ID NO: 31424 - DNA, 75 bp, Artificial Sequence
  Synthetic
caggggagcggttgagtttgaggatcggctgactgtgctcgtgcctaaggagaaggagttgaaggtaaagggaag

SEQ ID NO: 31425 - DNA, 75 bp, Artificial Sequence
  Synthetic
agttgccctataatgcatatgttgatcaaactttaatagatatttctgatatgtgctgtttaccactagtcgttc

SEQ ID NO: 31426 - DNA, 75 bp, Artificial Sequence
  Synthetic
gttcttctcgaagcaaacattggcaatcaggatatatcaggttgttgctgaagctgcacttaagaacgaggttat

SEQ ID NO: 31427 - DNA, 75 bp, Artificial Sequence
  Synthetic
cgtgtagatccctctttaaaccaatttactcaaacattaaggcctttagagtggccttattagaaaattattatt

SEQ ID NO: 31428 - DNA, 75 bp, Artificial Sequence
  Synthetic
gccatacttaaaaacacattcaatgaccatgagctcaacggccctaacccatcttcttaaccggctatcacatac

SEQ ID NO: 31429 - DNA, 75 bp, Artificial Sequence
  Synthetic
tcttcttagatcttattaggataaaaggatttgatgtacggcctcatcttgaagagttcgatgagcttgtgcttg

SEQ ID NO: 31430 - DNA, 75 bp, Artificial Sequence
  Synthetic
tatcactaagggtgactcctttgttattaacttagattatagctcctggtgcaacggtttccgaccagaactaca

SEQ ID NO: 31431 - DNA, 75 bp, Artificial Sequence
  Synthetic
ttgcacagtttattgccaggctcccgacattgtcggaagttgtatattatattggtgtgaaggctgggcaaccga

SEQ ID NO: 31432 - DNA, 75 bp, Artificial Sequence
  Synthetic
attaacttagattatagctcctggtgcaacggtttccgaccagaactacaagccccactctgtcgtcagttggat

SEQ ID NO: 31433 - DNA, 75 bp, Artificial Sequence
  Synthetic
tccttacaaggattcagcaaggtcaggatcttaagcgaattactattagtaatagactcccaaatcctgcagcta

SEQ ID NO: 31434 - DNA, 75 bp, Artificial Sequence
  Synthetic
ttcaacttagggcaaatggtgatacactggagttgatggatgaccttccggacagtctccgagatatacttttgg

SEQ ID NO: 31435 - DNA, 75 bp, Artificial Sequence
  Synthetic
agattcaacccgccctattccttccgtggtgagcccgttgaagacggtgtcacatgcgcggttgggactaagaca

SEQ ID NO: 31436 - DNA, 75 bp, Artificial Sequence
  Synthetic
acactggagttgatggatgaccttccggacagtctccgagatatacttttggcagatttgtttcgacgcccctag

SEQ ID NO: 31437 - DNA, 75 bp, Artificial Sequence
  Synthetic
atgggagagggtatgaggcagaaactatggacaattcttacgagctgctgggagataattgctcttcgggaaatt

SEQ ID NO: 31438 - DNA, 75 bp, Artificial Sequence
  Synthetic
tgttgcgctaacaacaaaccaatcaccatccttctaacaaaatgaacacacgcaatgccacccaagagacgcctg

SEQ ID NO: 31439 - DNA, 75 bp, Artificial Sequence
  Synthetic
aacgtgacgtttaatatactaggccagggtgataatcagacaatcattgtacataaatctgcaagccaaaataat

SEQ ID NO: 31440 - DNA, 75 bp, Artificial Sequence
  Synthetic
cagctattagcggagcgagcattgggagctttgtacaagcatgctagattagctggccataaccttaaggtagaa

SEQ ID NO: 31441 - DNA, 75 bp, Artificial Sequence
  Synthetic
gaatgttgggtgtcagattgtctgtatgagtatggaaagaagctcttcttccgtggtgtacctgtcccaggctgt

SEQ ID NO: 31442 - DNA, 75 bp, Artificial Sequence
  Synthetic
ttgaagcagctctcgcgggtgacggactccactggggagttattcccaaacctatactcaaagttagcctgctta

SEQ ID NO: 31443 - DNA, 75 bp, Artificial Sequence
  Synthetic
acatcatcatgcttaagcgcagcgatggcagacacatccccatgggtggcactcgcgacaggtgtctgtctgtat

SEQ ID NO: 31444 - DNA, 75 bp, Artificial Sequence
  Synthetic
cttatcgagttgtatgttgagctgcctccggcaatcatgcaggacgagtcgctgttaacgaccctctgtctcgta

SEQ ID NO: 31445 - DNA, 75 bp, Artificial Sequence
  Synthetic
ggtccatccattggtgggcttccaactcctgcaaccctgcccagtgtctttttcagaggaatgtccgacccattg

SEQ ID NO: 31446 - DNA, 75 bp, Artificial Sequence
  Synthetic
ccctttcagctagcactcttgcagaccctcattaaaacgacaggggtgacttgtagcttggtgaatcgtgtggtt

SEQ ID NO: 31447 - DNA, 75 bp, Artificial Sequence
  Synthetic
ctactaccctattcttaaaaaaccatatgtcagtggtgtagtgcttgggcttggttgttgctttgttggagcgcg

SEQ ID NO: 31448 - DNA, 75 bp, Artificial Sequence
  Synthetic
aagttacggatagcaccctatccagactggctctccctagtgactgacccgacttcactcaacattgctcaggtg

SEQ ID NO: 31449 - DNA, 75 bp, Artificial Sequence
  Synthetic
taccggccagaacgtcaaatcaggaggtggattgaggaggcaatagcaacaagctcacactcgtcacgcatagca

SEQ ID NO: 31450 - DNA, 75 bp, Artificial Sequence
  Synthetic
acttttttccagcagcccctcacggagatggcccagctgcttgcgagggacctctcaacaatgatgcctcttcgg

SEQ ID NO: 31451 - DNA, 75 bp, Artificial Sequence
  Synthetic
ttaaaactatgatggcagccttaaaccggccatcccatggtgagactgctacactactccaaatgttcaatccac

SEQ ID NO: 31452 - DNA, 75 bp, Artificial Sequence
  Synthetic
ccccgggatatgtcggccttattcgcattatcaaatgtcgcatatggtctaagcattatagatctatttcaaaag

SEQ ID NO: 31453 - DNA, 75 bp, Artificial Sequence
  Synthetic
tcctctaccgttgtctctgcaagtcaagctgtccataccgaagatgttgccctagagagtgtaaggtataaggaa

SEQ ID NO: 31454 - DNA, 75 bp, Artificial Sequence
  Synthetic
tctatcattcagggtctgttagacactactgaggggtacaacatgcaaccttatttggaaggttgcacttacctt

SEQ ID NO: 31455 - DNA, 75 bp, Artificial Sequence
  Synthetic
gcagccaagcagctacggaggttgacgtggggtcgagacctagttggagttacaatgccgtttgttgccgagcaa

SEQ ID NO: 31456 - DNA, 75 bp, Artificial Sequence
  Synthetic
ttccatccccatagttctgtcggtgcaaaagcagaactctacctcgatgctatcatatactgcccacaagagacg

SEQ ID NO: 31457 - DNA, 75 bp, Artificial Sequence
  Synthetic
cctactaccccattcttaaaaaaccatatgtcagtggtgtagtgcttgggcttggttgttgctttgttggagcgc

SEQ ID NO: 31458 - DNA, 75 bp, Artificial Sequence
  Synthetic
ttgcggtcacaccatctgactaccaggggggaccagccgctttaccttggatctaatacggctgtcaaggttcag

SEQ ID NO: 31459 - DNA, 75 bp, Artificial Sequence
  Synthetic
cgaggtgagatcacaggcctaacaaagtcaagggctgcaaatctagtcaaggacactctcgttctccaccagtgg

SEQ ID NO: 31460 - DNA, 75 bp, Artificial Sequence
  Synthetic
tacaaggtccgtaaggttaccgatccacacttgaacactctcatggcgcgcttcttgcttgagaagggatacaca

SEQ ID NO: 31461 - DNA, 75 bp, Artificial Sequence
  Synthetic
tctgacgctcggcctagcattcagggtgggaccctcacacatcgtctcccatcccgtggagactcacgccaaggg

SEQ ID NO: 31462 - DNA, 75 bp, Artificial Sequence
  Synthetic
ctcactgggtatgtgaatatactcagcacgtggctccggttctcaagtgattatcttcactctttctcgaaatca

SEQ ID NO: 31463 - DNA, 75 bp, Artificial Sequence
  Synthetic
gcacgtggctccggttctcaagtgattatcttcactctttctcgaaatcatcagatgactacacaatccacttcc

SEQ ID NO: 31464 - DNA, 75 bp, Artificial Sequence
  Synthetic
agcatgtattcacatacggttgcctctatgctgattcggtgattagatcgggcggtgttatttccactccttacc

SEQ ID NO: 31465 - DNA, 75 bp, Artificial Sequence
  Synthetic
ttttgagtgcaagttgtaaaacatgctttgagaagatagactcagaggagttcgtcctggcatgcgaacctcaat

SEQ ID NO: 31466 - DNA, 75 bp, Artificial Sequence
  Synthetic
ataggggtgctgagtggctgatatcaaagccagttactgtccctgagcagataattgacgctgaagtcgagtttg

SEQ ID NO: 31467 - DNA, 75 bp, Artificial Sequence
  Synthetic
ggcatgatattatggagcagcggacatgggctaacttggagaggttttctgtgtcggacatgcagaaacttccat

SEQ ID NO: 31468 - DNA, 75 bp, Artificial Sequence
  Synthetic
ggagtattgtaattcggtctctctggagattccttattggcgcacgactcctccagtttgagaaggctggcctta

SEQ ID NO: 31469 - DNA, 75 bp, Artificial Sequence
  Synthetic
ttaggatgctgtatgctgcaacaggtccaacctttagcttcctaatgaaagtctttcaagactcagccctactta

SEQ ID NO: 31470 - DNA, 75 bp, Artificial Sequence
  Synthetic
tggactgcgcacctcttgatcggctgtcccctaggatcaactttcatagtcggggagacctcgtcgccaagctcg

SEQ ID NO: 31471 - DNA, 75 bp, Artificial Sequence
  Synthetic
ttttattacccttcatcaacccgggtatagtggagattgaagtgtctagaattaatagcaagtatcatgcagtat

SEQ ID NO: 31472 - DNA, 75 bp, Artificial Sequence
  Synthetic
attaatagcaagtatcatgcagtatcggaggctaatatggatctgtacatcgctgctgcaaaatctgtgggcgta

SEQ ID NO: 31473 - DNA, 75 bp, Artificial Sequence
  Synthetic
aagcccacacagtttgttgaggaaacaaacgactttacggcccgcggccaccaccatggttgttattccctttct

SEQ ID NO: 31474 - DNA, 75 bp, Artificial Sequence
  Synthetic
tggtctaagtcacgcaatcaatcacaggtcctaaagatggtagtgcggaagctgaagctatgtgtcctgtatata

SEQ ID NO: 31475 - DNA, 75 bp, Artificial Sequence
  Synthetic
taccccacagtcgatcccgccgttgctctcgacctgtgccacctgccagcactaactataatcctagtgctcggc

SEQ ID NO: 31476 - DNA, 75 bp, Artificial Sequence
  Synthetic
ggtgacccagcgtactacgagcgattacttgagatggacctatgcggggctgtgtcaagtcgcgttgatatcccc

SEQ ID NO: 31477 - DNA, 75 bp, Artificial Sequence
  Synthetic
cattccctagctgccagaacgcacagggggttcacaataggcccagacgctggtccaggtgtgattagacttgac

SEQ ID NO: 31478 - DNA, 75 bp, Artificial Sequence
  Synthetic
aagttagagtcggtttgttacgcccacccctgtttggaggagctagagtttaatgcgtacctagactctgagtta

SEQ ID NO: 31479 - DNA, 75 bp, Artificial Sequence
  Synthetic
gttgatattagtgatatgtgctgcctccccctagcgacaccctgtaaggccctattcaggccagtgtatcggagc

SEQ ID NO: 31480 - DNA, 75 bp, Artificial Sequence
  Synthetic
ttacagtcgttcaggttagccttaatggacaactatagttttgtaatggacctcattacgatccgggggctggac

SEQ ID NO: 31481 - DNA, 75 bp, Artificial Sequence
  Synthetic
atcaggcctcaccttgaggagtttgatgaactgcttgtggtggggcagcatatcctcggtcagcccgtcctagtg

SEQ ID NO: 31482 - DNA, 75 bp, Artificial Sequence
  Synthetic
gaggttgtttactacgttggagttgttgggaagcgtcctgtgttagcgaggcatccctggtcagcagatcttaag

SEQ ID NO: 31483 - DNA, 75 bp, Artificial Sequence
  Synthetic
cgaatcactgtaggggggcgagcgccctgcccttctgctgctggactgcgtgatgaggattgtcgggggtctctg

SEQ ID NO: 31484 - DNA, 75 bp, Artificial Sequence
  Synthetic
ctggttgggcttcccgctggattgacgcagttgttggtggttgattgaggttgagccatctactgccctattctt

SEQ ID NO: 31485 - DNA, 75 bp, Artificial Sequence
  Synthetic
ctactgccctattcttaaaaaaccatacgtcagtggtgcagtgcttgggtttggttgttgctttgttgtagcgca

SEQ ID NO: 31486 - DNA, 75 bp, Artificial Sequence
  Synthetic
tgttgcgttaacaacaaatcaatcaccactcttctaacaaaatgaacatacgcaatgccacccaagagacgccta

SEQ ID NO: 31487 - DNA, 75 bp, Artificial Sequence
  Synthetic
gttgatgatgccgatatggaggatcaagatatatatgaacccccagcaagccttcccaagctttccgggaagttt

SEQ ID NO: 31488 - DNA, 75 bp, Artificial Sequence
  Synthetic
ctacaatacacagttgggggctccgacccgcacccgggtattgggcacgaaaaagagattaggcagaacgcagtg

SEQ ID NO: 31489 - DNA, 75 bp, Artificial Sequence
  Synthetic
gcattgttagaccagtcacgacgtgacatgttccacacagttacacctagccttgtattcctatgcttattaatc

SEQ ID NO: 31490 - DNA, 75 bp, Artificial Sequence
  Synthetic
ccagggctgcatgctgcattcctccacgggggggtacctcgcgagtcttacctctcaacacccgttacacgcggg

SEQ ID NO: 31491 - DNA, 75 bp, Artificial Sequence
  Synthetic
gagcagactgttgttaagacagccaagttttatggagagaagactacacaacgagagctcaccgagttagagata

SEQ ID NO: 31492 - DNA, 75 bp, Artificial Sequence
  Synthetic
tcctctatcttcagccactgttgctccttactgataggggttgttataggttcatcatccaagattaaggctgga

SEQ ID NO: 31493 - DNA, 75 bp, Artificial Sequence
  Synthetic
gctgaacaaattaagaagagattcaagacaatgatggcagccctcaatcggccatctcatggtgagactgctaca

SEQ ID NO: 31494 - DNA, 75 bp, Artificial Sequence
  Synthetic
ctgctgcagatgtttaacccccacgaggctatagactggattaacggccaaccctgggtaggatcatttgtttta

SEQ ID NO: 31495 - DNA, 75 bp, Artificial Sequence
  Synthetic
tccctacttaccacagactttgagtccccagggaaagagttcatggaccagattaagctcgtcgcaagctacgcg

SEQ ID NO: 31496 - DNA, 75 bp, Artificial Sequence
  Synthetic
cagatgaccacgtacaccactattaaggagtacctcgcggagtgtatggatgctactctaacaatccctgtagtt

SEQ ID NO: 31497 - DNA, 75 bp, Artificial Sequence
  Synthetic
gcatatgagattcgtgactttttagaggtctcggcaaagctgaaggaggaacatgctgacttatttccgttttta

SEQ ID NO: 31498 - DNA, 75 bp, Artificial Sequence
  Synthetic
ggggccatcaggcacccagatgctataaagcttgctccccgtagctttcctaacttagcatctgcggcattttac

SEQ ID NO: 31499 - DNA, 75 bp, Artificial Sequence
  Synthetic
tggagcaaaaaagagaaccctacaatggctgggtatcgggcttcgaccatacaaccgggctctagtgtaaaggag

SEQ ID NO: 31500 - DNA, 75 bp, Artificial Sequence
  Synthetic
acccagcttgcccgatataggcgccgcgagatatctcgcggagaggatggggcagagctctcaggtgagatctct

SEQ ID NO: 31501 - DNA, 75 bp, Artificial Sequence
  Synthetic
gcaataatgaagatgataggtgtgactggtctaaattgaaaacaatgaacaaaccaataaaaaaccaaatgcggc

SEQ ID NO: 31502 - DNA, 75 bp, Artificial Sequence
  Synthetic
agcaaacctcccacgctctgtaatgagttcagacctccgactgacactgctcgaattggttaggaggctcaatgg

SEQ ID NO: 31503 - DNA, 75 bp, Artificial Sequence
  Synthetic
caacacgaccgtcgagtctggtagactctctggaggacgaagaagatccccagacactacgacgggcgcggtcgg

SEQ ID NO: 31504 - DNA, 75 bp, Artificial Sequence
  Synthetic
gatcaccaagaccaaggaagattccaaagaatgcactgacccagccagtggaccagctcctgagggatctccgga

SEQ ID NO: 31505 - DNA, 75 bp, Artificial Sequence
  Synthetic
agaacccctccatgatctcagatccagatcagcgaaccggaagggagcagctatcgaatgatgagctcatcaaga

SEQ ID NO: 31506 - DNA, 75 bp, Artificial Sequence
  Synthetic
agctagtgacagagctggctgagaacagcatgatagaagcagaagaagtccgtggcacccttggagatatctcag

SEQ ID NO: 31507 - DNA, 75 bp, Artificial Sequence
  Synthetic
ctcgccttgaggccggttttgagtccctgtcagcactccaggttgaaaccattcaaacagctcagcgctgcgacc

SEQ ID NO: 31508 - DNA, 75 bp, Artificial Sequence
  Synthetic
attctgacagcatcagggtcctgggagagaacatcaagatattggatcggtccatgaaaacaatgatggagacaa

SEQ ID NO: 31509 - DNA, 75 bp, Artificial Sequence
  Synthetic
tgaagctcatgatggagaaagtcgatcttctctatgcatctaccgccgtcggaacctccgcacccatgctaccct

SEQ ID NO: 31510 - DNA, 75 bp, Artificial Sequence
  Synthetic
cacaccccgcaccaccacgcatatacccccagctcccaagcgctcccacagctgatgagtgggacatcataccat

SEQ ID NO: 31511 - DNA, 75 bp, Artificial Sequence
  Synthetic
aaaaaaaccgaatcatcatgaattccaaacattcctatgtagaactcaaggacaaggtaatcgtccctggatggc

SEQ ID NO: 31512 - DNA, 75 bp, Artificial Sequence
  Synthetic
ccacactgatgcttgagatagactttgttgggggaacctcacggaaccaattcctaaacatcccgtttctttcag

SEQ ID NO: 31513 - DNA, 75 bp, Artificial Sequence
  Synthetic
taaaggagccactccaactgccccgcgagaagcggttgaccgattacttcacaattgacgttgagcccgcaggcc

SEQ ID NO: 31514 - DNA, 75 bp, Artificial Sequence
  Synthetic
actctctagtaaacatatacttccagattgacgacttcctactcctgacactcaactcactgtcggtgtataagg

SEQ ID NO: 31515 - DNA, 75 bp, Artificial Sequence
  Synthetic
accccgtcaggaagtacatgttcctgcgtctcaacaaagagcagagcaagcacgcgatcaatgcagccttcaatg

SEQ ID NO: 31516 - DNA, 75 bp, Artificial Sequence
  Synthetic
tcttttcttaccggcttcggaacattggtgttggccctctcggcccagacattcgatcttcagggccttagctgc

SEQ ID NO: 31517 - DNA, 75 bp, Artificial Sequence
  Synthetic
aacactgattcgactccgggactgattgaccttgagattcgacgactctgccacaccccgacggagaatgtcgtt

SEQ ID NO: 31518 - DNA, 75 bp, Artificial Sequence
  Synthetic
tcatgtgaggttagttacctgaatcacacgacaatcagccttcctgcagtccacacgtcatgcctcaagtaccac

SEQ ID NO: 31519 - DNA, 75 bp, Artificial Sequence
  Synthetic
tgcaaaacttactggggattcttcggcagttacagtgccgaccgactcatcaatcggtacactggcactgtacgg

SEQ ID NO: 31520 - DNA, 75 bp, Artificial Sequence
  Synthetic
ggttgtctcaacaactcagcacccgaggatccctttgagtgcaactggttttattgctgctcggctattacaacc

SEQ ID NO: 31521 - DNA, 75 bp, Artificial Sequence
  Synthetic
gagatttgtcggtgttccattaagaatgttacagtcgctgtgcagacattcccgccctttatgtactgtagcttt

SEQ ID NO: 31522 - DNA, 75 bp, Artificial Sequence
  Synthetic
gctgactgtagcaccgtgagccagcaagagctagagagtgggtccgcggtgcttagtgatggtagtacgctgacc

SEQ ID NO: 31523 - DNA, 75 bp, Artificial Sequence
  Synthetic
tatgccccgtacagcccacggtcggagactgtgaacacaaccctcaatgggacaatactttgtaactcatcctcc

SEQ ID NO: 31524 - DNA, 75 bp, Artificial Sequence
  Synthetic
aagattatctcgtttgatgaatttagacggtcatactcactagcaaacggcagctatcaaagcccgtccatcaac

SEQ ID NO: 31525 - DNA, 75 bp, Artificial Sequence
  Synthetic
ataacgtgcttcaactatacatcatcctgtcgaccccggctagttagaaggcgtagggacacgcagcagatagag

SEQ ID NO: 31526 - DNA, 75 bp, Artificial Sequence
  Synthetic
tacctaattcacaagcttaggcctacactcaaggatgcctgggaggactgcgagatcctccagtccttgctctta

SEQ ID NO: 31527 - DNA, 75 bp, Artificial Sequence
  Synthetic
ggggtctttgggactgggattgcaagcgcgtcccagtttctaagaggctggctcaaccaccccaatatcattggt

SEQ ID NO: 31528 - DNA, 75 bp, Artificial Sequence
  Synthetic
tacatagttaatggggtaggggtggtttggcagtgtcatcgggtcaatatcacatttatggtatggaacgagtca

SEQ ID NO: 31529 - DNA, 75 bp, Artificial Sequence
  Synthetic
acatactatccccctgttgattacaatgggcggaagtattatctgaatgatgagggtaggctgcagaccaacacc

SEQ ID NO: 31530 - DNA, 75 bp, Artificial Sequence
  Synthetic
cctgaggcccggccagggctcaaacgtgtcatgtggtttggtaggtatttcctaggaaccgtagggtcgggggtc

SEQ ID NO: 31531 - DNA, 75 bp, Artificial Sequence
  Synthetic
aagccgaagaggatcagatataataagacgtcacacgactatcacctggaggagtttgaggctagtctcaacatg

SEQ ID NO: 31532 - DNA, 75 bp, Artificial Sequence
  Synthetic
accccacagcttgacattgcctcaggtcatgagacagaccccattaaccatgcttacggaactcaggctgatctc

SEQ ID NO: 31533 - DNA, 75 bp, Artificial Sequence
  Synthetic
ttaccgtacacaaggtctagtaacatgacatcaacagatacaggttccgggtgggtacacattgggttaccctca

SEQ ID NO: 31534 - DNA, 75 bp, Artificial Sequence
  Synthetic
tttgccttccttaatccccttgggtggttgagggacttactggcatgggccgcctggctcggaggggtcctctat

SEQ ID NO: 31535 - DNA, 75 bp, Artificial Sequence
  Synthetic
ctaataaatctctgtgtttccttgccagcctccttcgcgaggaggagacgcctcggccggtggcaggaataaacc

SEQ ID NO: 31536 - DNA, 75 bp, Artificial Sequence
  Synthetic
gaaccgaccaatcccttaaaaatcctctacttgggactgaggtatccttttgcctcaaatcaagctcacttccac

SEQ ID NO: 31537 - DNA, 75 bp, Artificial Sequence
  Synthetic
accatatccgtgccctgggtcaaatcaaaccgaggaatttagcatcctgtgattattacctcttattccgccaag

SEQ ID NO: 31538 - DNA, 75 bp, Artificial Sequence
  Synthetic
tggttctacctcccgaggtgtatccaattggtgttctaatccgagctgcagagactatactaactgtgattgtct

SEQ ID NO: 31539 - DNA, 75 bp, Artificial Sequence
  Synthetic
cagcctggaagttggagcatatgacgaagaccttatactcctctgttaggtacgcactaaccaatccccgggtga

SEQ ID NO: 31540 - DNA, 75 bp, Artificial Sequence
  Synthetic
gagctcaacttgaactccatattgcataccagcgagttgtggggcaggtctcgtacagccgagaagctgacatag

SEQ ID NO: 31541 - DNA, 75 bp, Artificial Sequence
  Synthetic
gacccaagaggcttggaaacatgtcactttacttcatacaatcacttgtcattgcaaccatagacaccactagct

SEQ ID NO: 31542 - DNA, 75 bp, Artificial Sequence
  Synthetic
gcctaatgacctacaatcactttcttgcggcagcagacacagccaagagcaggtgtcatctcctgatcgcgtcgg

SEQ ID NO: 31543 - DNA, 75 bp, Artificial Sequence
  Synthetic
tggtccaaggtgctctttgggaacaagggtcgtttcttgatcacgtaatcaacttaatcgatataattgactcaa

SEQ ID NO: 31544 - DNA, 75 bp, Artificial Sequence
  Synthetic
tcaacctcccccacgatgagtactttacaatcattaaatccatctccccctactcacaggggcttgtcatgggga

SEQ ID NO: 31545 - DNA, 75 bp, Artificial Sequence
  Synthetic
gatacaatgtctctgtctcgtctaattttgcatctgtgtttactatccccgagacctgcccacaattggacagct

SEQ ID NO: 31546 - DNA, 75 bp, Artificial Sequence
  Synthetic
tactaaaaaaactactcaacttggatcctgtgctgctcctaatgatatcttcagtacaaaagtcatggtatttcc

SEQ ID NO: 31547 - DNA, 75 bp, Artificial Sequence
  Synthetic
ctgagattaggatggttgacgggtcacgagagcaactccacaagatgcgcgttgactcggaaaagccccaggccc

SEQ ID NO: 31548 - DNA, 75 bp, Artificial Sequence
  Synthetic
tcctgtcgtatggccacacccttttgtcaatgttccgagctgagttcattaagggttacgtgtcaaagaatgcaa

SEQ ID NO: 31549 - DNA, 75 bp, Artificial Sequence
  Synthetic
aatggcctccagtccacttactccccggctgtgacaagtcgatcaaaaatgcccgggagctgggccgatggagcc

SEQ ID NO: 31550 - DNA, 75 bp, Artificial Sequence
  Synthetic
ctgcgtttgaccggaggtggcaactttttgcaaaggtggttatcctcaaaatcgctgatttggacatggacccgg

SEQ ID NO: 31551 - DNA, 75 bp, Artificial Sequence
  Synthetic
acttcaacgacattgttagtgataaagcgataattagctcaagaagggactgggtatttgagtacaacgcggcgg

SEQ ID NO: 31552 - DNA, 75 bp, Artificial Sequence
  Synthetic
cgttctggaagaaatacggtgagcggctggagagaccggttagcaggtcgggaccctcaaggcttgtcaacgccc

SEQ ID NO: 31553 - DNA, 75 bp, Artificial Sequence
  Synthetic
tgattgatggccgtctcgacaatataccggctctgctagagccattctacaggggggctgtggactttgaggatc

SEQ ID NO: 31554 - DNA, 75 bp, Artificial Sequence
  Synthetic
gattaacagtcctcgtgcctaaggagaaggaattgaaagttaaggggaggtttttctcgaaacagacattggcca

SEQ ID NO: 31555 - DNA, 75 bp, Artificial Sequence
  Synthetic
ttcgaatctaccaagtcgtcgctgaggctgctcttaagaacgaggtcatgccataccttaagacacactcaatga

SEQ ID NO: 31556 - DNA, 75 bp, Artificial Sequence
  Synthetic
ccatgagctctacagctttaactcacttattaaatcggttgtcccacacgataactaagggagattcctttgtta

SEQ ID NO: 31557 - DNA, 75 bp, Artificial Sequence
  Synthetic
ttaacctagattacagctcctggtgcaatggtttcaggccggagctccaggcccccttgtgtcgccagttggacc

SEQ ID NO: 31558 - DNA, 75 bp, Artificial Sequence
  Synthetic
agatgtttaactgcgggtacttcttcagaaccggctgtacattgccctgcttcactacgttcataattcaagaca

SEQ ID NO: 31559 - DNA, 75 bp, Artificial Sequence
  Synthetic
ggttcaacccaccttattcagaccgtggtgagcctgttgaggacggtgtgacttgtgctatagggacaaagacaa

SEQ ID NO: 31560 - DNA, 75 bp, Artificial Sequence
  Synthetic
tgggggagggcatgcggcaaaagttgtggactatccttacgagctgttgggaaattgttgctcttcgggaagtaa

SEQ ID NO: 31561 - DNA, 75 bp, Artificial Sequence
  Synthetic
atgtgacgttcaacatcctcggccagggtgataaccaaacaatcatcatccataggtctgtgagtcagaacaatc

SEQ ID NO: 31562 - DNA, 75 bp, Artificial Sequence
  Synthetic
agcagctagccgaacgagcattaggagcattatataagcacgctaggcttgctggtcataacctcaaggtggagg

SEQ ID NO: 31563 - DNA, 75 bp, Artificial Sequence
  Synthetic
agtgctgggtttcagactgtttgtatgagtatgggaagaagctcttcttccgtggggtgcctgtcccagggtgcc

SEQ ID NO: 31564 - DNA, 75 bp, Artificial Sequence
  Synthetic
ttaagcaactatcgcgggtaactgactcaacgggggagctcttcccaaatctgtactcgaagctagcttgcttga

SEQ ID NO: 31565 - DNA, 75 bp, Artificial Sequence
  Synthetic
cgtcatcatgcttaagcgcggccatggcagacacgtccccctgggtagcactagcgacaggggtttgcttgtacc

SEQ ID NO: 31566 - DNA, 75 bp, Artificial Sequence
  Synthetic
ttattgagctatatgtcgagttacctccggccgtcatgcaagacgagtcactgttaacgacactatgcctagtgg

SEQ ID NO: 31567 - DNA, 75 bp, Artificial Sequence
  Synthetic
gaccgtcaatcggtggacttccgacaccggctaccctgccgagtgtattcttccgggggatgtcggatccactac

SEQ ID NO: 31568 - DNA, 75 bp, Artificial Sequence
  Synthetic
ctttccaattagcactgctgcagaccttgattaagacaacaggagtcacgtgtagcctggtcaaccgcgtagtca

SEQ ID NO: 31569 - DNA, 75 bp, Artificial Sequence
  Synthetic
aattaagaatagcaccctatccggattggttgtcccttgtcacagaccctacatccctcaatatagctcaagtat

SEQ ID NO: 31570 - DNA, 75 bp, Artificial Sequence
  Synthetic
atcggccagaacggcagatcaggaaatggattgaggaagccattgcgacaagtacgcactcgtcccgagtcgcaa

SEQ ID NO: 31571 - DNA, 75 bp, Artificial Sequence
  Synthetic
ctttcttccagcagcccctcacagagatggcccagttgttagcacgggacctctcaacaatgatgcccttgctac

SEQ ID NO: 31572 - DNA, 75 bp, Artificial Sequence
  Synthetic
cgagggacatgtccgcactgttcgcactgtcgaatgttgcatatggtctgagcataatagatcttttccaaaagt

SEQ ID NO: 31573 - DNA, 75 bp, Artificial Sequence
  Synthetic
cctcaactgtcgtgtccgcaagtcaggcagtccacattgaggacgtggccttagagagtgtccgttacaaggagt

SEQ ID NO: 31574 - DNA, 75 bp, Artificial Sequence
  Synthetic
caattatccagcggctccttgacactaccgaggggtataatatgcagccctacctggagggctgtacgtaccttg

SEQ ID NO: 31575 - DNA, 75 bp, Artificial Sequence
  Synthetic
cagcgaagcagctacgaaggctgacgtggggtagggatttggttggggtgacaatgccattcgtagcagaacagt

SEQ ID NO: 31576 - DNA, 75 bp, Artificial Sequence
  Synthetic
tccacccccacagttccgtgggagcaaatgcagagctttacttggacgcaattatatactgcccccaggaaccct

SEQ ID NO: 31577 - DNA, 75 bp, Artificial Sequence
  Synthetic
tacgttcccaccaccttacaacccgaggagaccagcccctgtaccttgggtccaacacagctgtcaaggtgcagc

SEQ ID NO: 31578 - DNA, 75 bp, Artificial Sequence
  Synthetic
gaggtgagattaccggattgacaaagtctagagctgccaacctagttagggacactctcgttctccaccagtggt

SEQ ID NO: 31579 - DNA, 75 bp, Artificial Sequence
  Synthetic
ataaagtccgcagggtcacggacccacacttaaacacccttatgtgtcgctttctccttgaaaaggggtacacat

SEQ ID NO: 31580 - DNA, 75 bp, Artificial Sequence
  Synthetic
ccgaggcaaggccgagtatacaagggggaacccttacacaccgcttgccgtcgcgtggtgactcacggcaggggc

SEQ ID NO: 31581 - DNA, 75 bp, Artificial Sequence
  Synthetic
ttacaggatatgtcaatattttaagtacgtggcttaggttctctagtgattatctccattctttctccaagtcat

SEQ ID NO: 31582 - DNA, 75 bp, Artificial Sequence
  Synthetic
ccgacgattacacaattcactttcagcatgtattcacatatggatgcctctatgctgactctgtaatccgatctg

SEQ ID NO: 31583 - DNA, 75 bp, Artificial Sequence
  Synthetic
gtggggttatttccaccccctatctcctaagtgcaagttgtaagacatgttttgagaaaattgattctgaagagt

SEQ ID NO: 31584 - DNA, 75 bp, Artificial Sequence
  Synthetic
ttgtcttagcctgcgaacctcagtacaagggggccgagtggcttatttcgaagcctgtcactatccccgagcaga

SEQ ID NO: 31585 - DNA, 75 bp, Artificial Sequence
  Synthetic
tcatagatgctgaggttgaatttgatccgtgtgtaagtgcaagttattgtcttggaatccttattggcaagtcgt

SEQ ID NO: 31586 - DNA, 75 bp, Artificial Sequence
  Synthetic
tcttggtagacatcagggcaagtgggcatgatatcatggagcagcgtacgtgggcaaaccttgagcggttctcac

SEQ ID NO: 31587 - DNA, 75 bp, Artificial Sequence
  Synthetic
tatcagacatgcaaaagcttccgtggagcatagttatacgatcactttggcgattcctggttggtgcccggttgc

SEQ ID NO: 31588 - DNA, 75 bp, Artificial Sequence
  Synthetic
ttcaatttgagagagccggcttgatcaggctgctctatgctgctgcaggcccgacctttagcttcctgatgaggg

SEQ ID NO: 31589 - DNA, 75 bp, Artificial Sequence
  Synthetic
tgttccaggactctgctctcctaatggactgtgccccacttgacagactgtccccaaggattaattttcagaacc

SEQ ID NO: 31590 - DNA, 75 bp, Artificial Sequence
  Synthetic
ggggtgatcttgtggcgaagctgatcctgttgccttttatcaatcctggcatagttgacattgaggtggctggga

SEQ ID NO: 31591 - DNA, 75 bp, Artificial Sequence
  Synthetic
taaatagtaagtatctcgcagtttcagagactaacatggatttgtacattgctgcagcgaaatcagttggtgtga

SEQ ID NO: 31592 - DNA, 75 bp, Artificial Sequence
  Synthetic
agcctatacagtttgtagaggagacaaatgatttcgttgcccgtggccagcaccacggccgctattccctctcct

SEQ ID NO: 31593 - DNA, 75 bp, Artificial Sequence
  Synthetic
ggtccgggctccacagacgcgcccaggcactgaagatggttgtccggaagcttaagctgtgcgtcctgtatatat

SEQ ID NO: 31594 - DNA, 75 bp, Artificial Sequence
  Synthetic
acccaacagtcgaccctgcgattgccctggacctgtgtcatctcccagccctaacgataattttagtactcggag

SEQ ID NO: 31595 - DNA, 75 bp, Artificial Sequence
  Synthetic
gtgacccagcatactacgagcggttacttgagttggatctatgcggagcagtctctagtcgtgtcgatgtcccgc

SEQ ID NO: 31596 - DNA, 75 bp, Artificial Sequence
  Synthetic
actccctcgcggccaagacacacagggggttcacaataggcccagagaccggccccggcgttattcggctggaaa

SEQ ID NO: 31597 - DNA, 75 bp, Artificial Sequence
  Synthetic
agctggaatcagcctcgtacgctcatccgtgccttgaggagttagagtttaatgcgtatctaggctctgagcaag

SEQ ID NO: 31598 - DNA, 75 bp, Artificial Sequence
  Synthetic
ttgacattagtgatatgtgctgtttgcccttagctacaccctgtaaagccttatttaagcccgtttacaggagta

SEQ ID NO: 31599 - DNA, 75 bp, Artificial Sequence
  Synthetic
tgcagtcatttaggttggccttgatggataactatggcttcttgatggacttggtcatgattcgagggctcgata

SEQ ID NO: 31600 - DNA, 75 bp, Artificial Sequence
  Synthetic
tcagacctcatcttgaagagtttgacgagttgttggtggtagggcagtacatcttgggccaattgattcaggagg

SEQ ID NO: 31601 - DNA, 75 bp, Artificial Sequence
  Synthetic
aggccgtttactatgtcggagttgtggggagaggtcctgtggtgtcgaggtcgagccggtgggtgggcctcaaga

SEQ ID NO: 31602 - DNA, 75 bp, Artificial Sequence
  Synthetic
gaattactattggaggacggtcgccatgtccttgtgctgcaaggttgcgtgatgaggatcgtcagggctccctgt

SEQ ID NO: 31603 - DNA, 75 bp, Artificial Sequence
  Synthetic
tggctgggctgcccgcggagttagtccagctattgttggttgagtgatgtttgattacccattgctctattctta

SEQ ID NO: 31604 - DNA, 75 bp, Artificial Sequence
  Synthetic
ccattgctctattcttaaaaaaccatatgcctgtgatgtggtgtttgggttgagttgtggctttgttgtagcgca

SEQ ID NO: 31605 - DNA, 75 bp, Artificial Sequence
  Synthetic
tgttgcgttaacaacaaaccaatcaccattcttctaacaaaatgaacacacgcaatgccacccaagagacgcctg

SEQ ID NO: 31606 - DNA, 75 bp, Artificial Sequence
  Synthetic
ccattcttctaacaaaatgaacacacgcaatgccacccaagagacgcctggttgatgacgccgatgccatggagg

SEQ ID NO: 31607 - DNA, 75 bp, Artificial Sequence
  Synthetic
atcaagatctatatgaacccccagcgagcctccctaagctccctgggaaattcctacaatacaccgttggggggt

SEQ ID NO: 31608 - DNA, 75 bp, Artificial Sequence
  Synthetic
ctgacccgcatccgggtatagggcatgagaaagacatcaggcagaacgcagtggcattgttagaccagtcacggc

SEQ ID NO: 31609 - DNA, 75 bp, Artificial Sequence
  Synthetic
tgagaaagacatcaggcagaacgcagtggcattgttagaccagtcacggcgcgatatgtttcacacagtaacgcc

SEQ ID NO: 31610 - DNA, 75 bp, Artificial Sequence
  Synthetic
ctacctgtcgacgcctgttacgcgtggagagcagactgttgttaagactgcgaagttctacggggaaaagacgac

SEQ ID NO: 31611 - DNA, 75 bp, Artificial Sequence
  Synthetic
gcagcgtgatctcaccgagctggagatctcttctatcttcagccattgttgctcattgctaataggggttgtgat

SEQ ID NO: 31612 - DNA, 75 bp, Artificial Sequence
  Synthetic
gctcattgctaataggggttgtgataggatcgtcgtctaagatcaaagcaggagccgagcagatcaagaaaaggt

SEQ ID NO: 31613 - DNA, 75 bp, Artificial Sequence
  Synthetic
agtccccaggtaaagaatttatggaccagattaagcttgtcgcaagttatgcgcagatgactacgtacactacta

SEQ ID NO: 31614 - DNA, 75 bp, Artificial Sequence
  Synthetic
taaaggagtacctcgcagaatgcatggatgctacccttacaatccccgtagttgcatatgagatccgtgactttt

SEQ ID NO: 31615 - DNA, 75 bp, Artificial Sequence
  Synthetic
tagaggtttcagcaaagcttaaggaggatcatgctgacctgttcccgtttctgggagccattaggcaccccgacg

SEQ ID NO: 31616 - DNA, 75 bp, Artificial Sequence
  Synthetic
ctatcaagctggcgccacgaagctttcccaatctggcctccgcagcgttttactggagtaagaaggaaaacccca

SEQ ID NO: 31617 - DNA, 75 bp, Artificial Sequence
  Synthetic
caatggcaggctaccgggcctccaccatccagccgggcgcaagtgtcaaggaaacccagcttgcccggtataggc

SEQ ID NO: 31618 - DNA, 75 bp, Artificial Sequence
  Synthetic
gccgcgagatatctcgcggggaggatggggcagagctctcaggtgagatctctgccataatgaaaatgataggtg

SEQ ID NO: 31619 - DNA, 75 bp, Artificial Sequence
  Synthetic
tctgccataatgaaaatgataggtgtgactggtctaaactaaaaaacaatgaacaaaccaataaaaaaccaaatg

SEQ ID NO: 31620 - DNA, 75 bp, Artificial Sequence
  Synthetic
cggcaaaccctccgcaacctgtgatgagttccgacctccggctgacattgcttgaactagtcaggaggctcaatg

SEQ ID NO: 31621 - DNA, 75 bp, Artificial Sequence
  Synthetic
gagttccgacctccggctgacattgcttgaactagtcaggaggctcaatggcaacgcgaccatcgagtctggtcg

SEQ ID NO: 31622 - DNA, 75 bp, Artificial Sequence
  Synthetic
gctgtcgaatgatgagctaatcaagaagttagtgacggagctggccgagaatagcatgatcgaggctgaggaggt

SEQ ID NO: 31623 - DNA, 75 bp, Artificial Sequence
  Synthetic
gcggggcactcttggagacatctcggctcgtatcgaggcagggtttgaatccctgtccgccctccaagtggaaac

SEQ ID NO: 31624 - DNA, 75 bp, Artificial Sequence
  Synthetic
ccctgtccgccctccaagtggaaaccatccagacagctcagcggtgcgaccactccgacagcatcaggattctcg

SEQ ID NO: 31625 - DNA, 75 bp, Artificial Sequence
  Synthetic
tcccatcctgcacctccgcgcatttatccccagctcccaagtgccccgacaacggatgaatgggacatcataccg

SEQ ID NO: 31626 - DNA, 75 bp, Artificial Sequence
  Synthetic
gtgaaagagcctctgcagcttccacgcgagaagaagttgaccgactacttcactatcgacgtagaaccagcaggc

SEQ ID NO: 31627 - DNA, 75 bp, Artificial Sequence
  Synthetic
cattccctggtcaatatatacttccagattgacgactttttgctcctaacactcaactcactatccgtgtacaag

SEQ ID NO: 31628 - DNA, 75 bp, Artificial Sequence
  Synthetic
gtcttttcttatcggcttcggaacattggtgttggccctctcggcccggacattcgatcttcagggccttagctg

SEQ ID NO: 31629 - DNA, 75 bp, Artificial Sequence
  Synthetic
caatactgactccactcctggactgatcgacctggagataaggcgactttgccacaccccaacggaaaatgtcat

SEQ ID NO: 31630 - DNA, 75 bp, Artificial Sequence
  Synthetic
atcgacctggagataaggcgactttgccacaccccaacggaaaatgtcattccatgcgaggttagttatctcaac

SEQ ID NO: 31631 - DNA, 75 bp, Artificial Sequence
  Synthetic
ggtagctacagcgctgaccgagtcatcaatcggtacactggtactgttaaaggttgtttaaacaactcagcacca

SEQ ID NO: 31632 - DNA, 75 bp, Artificial Sequence
  Synthetic
aatgtcacggtggctgtgcaaacattcccaccgttcatgtactgcagttttgcagactgcagtaccgtgagccag

SEQ ID NO: 31633 - DNA, 75 bp, Artificial Sequence
  Synthetic
caggagctagagagtggaaaggcaatgctgagcgatggcagtacattaacttataccccgtatgtcctacagtca

SEQ ID NO: 31634 - DNA, 75 bp, Artificial Sequence
  Synthetic
ttataccccgtatgtcctacagtcagaagtcgtgaacaaaaccctcaatgggaccatactctgcaactcatcctc

SEQ ID NO: 31635 - DNA, 75 bp, Artificial Sequence
  Synthetic
taagatagtttccttcgatgaatttaggcgttcatactccctagcgaatggtagttaccagagctcatcaatcaa

SEQ ID NO: 31636 - DNA, 75 bp, Artificial Sequence
  Synthetic
tgtgacgtgtgtaaactacacgtcgtcctgccggcccaggttgaaaaggcggcgtagggacacccagcagattga

SEQ ID NO: 31637 - DNA, 75 bp, Artificial Sequence
  Synthetic
gtatctagttcacaagcttaggcccacactgaaagatgcatgggaggactgtgagatcctccagtctctgctcct

SEQ ID NO: 31638 - DNA, 75 bp, Artificial Sequence
  Synthetic
aggggtgtttggtactgggatcgcaagtgcctctcaatttttgaggggctggctcaaccaccctgacatcatcgg

SEQ ID NO: 31639 - DNA, 75 bp, Artificial Sequence
  Synthetic
ggctcaaccaccctgacatcatcgggtatatggttaatggagttggggttgtctggcaatgccatcgtgttaatg

SEQ ID NO: 31640 - DNA, 75 bp, Artificial Sequence
  Synthetic
aatgggcggaagtactttctgaatgatgagggaaggttacaaacaaacacccccgaggcaaggccagggcttaag

SEQ ID NO: 31641 - DNA, 75 bp, Artificial Sequence
  Synthetic
ccccgaggcaaggccagggcttaagcgggtcatgtggttcggcaggtactttctagggacagtggggtctggggt

SEQ ID NO: 31642 - DNA, 75 bp, Artificial Sequence
  Synthetic
gaaaccgaggaggattcggtacaataagacctcacatgactaccacctggaggagtttgaggcaattctcaacat

SEQ ID NO: 31643 - DNA, 75 bp, Artificial Sequence
  Synthetic
aagacctcacatgactaccacctggaggagtttgaggcaattctcaacatgacccctcagaccagtatcgcctcg

SEQ ID NO: 31644 - DNA, 75 bp, Artificial Sequence
  Synthetic
ataacatctacggatacaggctcaggctgggtgcacatcggcctaccctcatttgctttcctcaatcccctcggg

SEQ ID NO: 31645 - DNA, 75 bp, Artificial Sequence
  Synthetic
gctgggtgcacatcggcctaccctcatttgctttcctcaatcccctcgggtggctcagggacctacttgcatggg

SEQ ID NO: 31646 - DNA, 75 bp, Artificial Sequence
  Synthetic
gcctcggccggtggcaggaataaaccgtaccgaccagtctcttaaaaaccctctccttggaacagaggtctcttt

SEQ ID NO: 31647 - DNA, 75 bp, Artificial Sequence
  Synthetic
ctctccttggaacagaggtctctttctgccttaaatcgagctcactcccccatcatgtacgagcactaggccaga

SEQ ID NO: 31648 - DNA, 75 bp, Artificial Sequence
  Synthetic
gttgtattgccccctgaagtatatcccattggtgttctaataagagctgcagaggctatactaacagttatagta

SEQ ID NO: 31649 - DNA, 75 bp, Artificial Sequence
  Synthetic
tcagcttggaagctggatcacatgacgaagaccctatactcctctgtgagatatgcactcaccaatccccgggtc

SEQ ID NO: 31650 - DNA, 75 bp, Artificial Sequence
  Synthetic
cgagcccaacttgagcttcacattgcctaccagcgcatagtgggccaggtctcgtacagccgggaggcagacata

SEQ ID NO: 31651 - DNA, 75 bp, Artificial Sequence
  Synthetic
gggccaaaaaggcttgggaatatgtcattgcaatttgtccaatctctcgttattgccaccatagacacaacaagc

SEQ ID NO: 31652 - DNA, 75 bp, Artificial Sequence
  Synthetic
gtggtccagggggccctttgggaacaagggtcatttcttgatcatataattaacatgatcgacataattgactca

SEQ ID NO: 31653 - DNA, 75 bp, Artificial Sequence
  Synthetic
aggcataatgtatcagtctcctctgatttcgcgtccgtatttaccattcctgaattatgcccgcaactagacagc

SEQ ID NO: 31654 - DNA, 75 bp, Artificial Sequence
  Synthetic
accctgttctcctcctcatggtctcttcggtgcagaagtcatggtacttccctgagatccggatggtcgacggct

SEQ ID NO: 31655 - DNA, 75 bp, Artificial Sequence
  Synthetic
cacgggagcagctccacaaaatgcgtgtcgagctggaaacgccccaagccctgctgtcgtacggccataccctcc

SEQ ID NO: 31656 - DNA, 75 bp, Artificial Sequence
  Synthetic
tgtcaatatttcgggcagagtttatcaaaggctatgtatcaaagaatgcgaagtggccgcccgtacacctgctcc

SEQ ID NO: 31657 - DNA, 75 bp, Artificial Sequence
  Synthetic
caggctgtgacaagtccataaaaaatgcgagagagctgggccgctggagcccggcatttgaccgacgatggcagc

SEQ ID NO: 31658 - DNA, 75 bp, Artificial Sequence
  Synthetic
tgcgagagagctgggccgctggagcccggcatttgaccgacgatggcagctcttcgagaaggttgtcattctaag

SEQ ID NO: 31659 - DNA, 75 bp, Artificial Sequence
  Synthetic
ctgggtattcgagtacaatgcagcggccttttggaagaaatacggtgaacggttggagaggcctcctgccaggtc

SEQ ID NO: 31660 - DNA, 75 bp, Artificial Sequence
  Synthetic
gccttttggaagaaatacggtgaacggttggagaggcctcctgccaggtcgggaccatcacggcttgtgaatgct

SEQ ID NO: 31661 - DNA, 75 bp, Artificial Sequence
  Synthetic
ctaatcgatggacgcttagacaatatcccagccctgctagagccattttacaggggagcggttgagttcgaggat

SEQ ID NO: 31662 - DNA, 75 bp, Artificial Sequence
  Synthetic
caggggagcggttgagttcgaggatcggttgactgtgctcgtgcctaaggagaaagagttaaaggtaaagggaag

SEQ ID NO: 31663 - DNA, 75 bp, Artificial Sequence
  Synthetic
gccatacctaaagacacactcaatgaccatgagctcaacggctctaactcaccttcttaaccggctatcacatac

SEQ ID NO: 31664 - DNA, 75 bp, Artificial Sequence
  Synthetic
tatcactaagggtgactcctttgttattaaccttgactatagttcctggtgcaacggtttccgaccagaactgca

SEQ ID NO: 31665 - DNA, 75 bp, Artificial Sequence
  Synthetic
attaaccttgactatagttcctggtgcaacggtttccgaccagaactgcaggccccaatctgtcgtcagttggat

SEQ ID NO: 31666 - DNA, 75 bp, Artificial Sequence
  Synthetic
aggttcaacccgccctattccctcagcggtgagcccgttgaagacggagtcacatgcgcggttgggactaaaaca

SEQ ID NO: 31667 - DNA, 75 bp, Artificial Sequence
  Synthetic
atgggggagggtatgaggcagaaactatggacaattcttacgagctgctgggagataattgctcttcgagagatt

SEQ ID NO: 31668 - DNA, 75 bp, Artificial Sequence
  Synthetic
tatggacaattcttacgagctgctgggagataattgctcttcgagagattaacgtgacgttcaacatactaggcc

SEQ ID NO: 31669 - DNA, 75 bp, Artificial Sequence
  Synthetic
aaggtgataatcagacaatcatcatacataaatctgcaagccaaaataatcagctattagcggagcgagcactag

SEQ ID NO: 31670 - DNA, 75 bp, Artificial Sequence
  Synthetic
gggccctgtacaagcatgctagattagctggccataacctcaaggtagaggaatgctgggtgtcagattgcctgt

SEQ ID NO: 31671 - DNA, 75 bp, Artificial Sequence
  Synthetic
atgagtatgggaagaagcttttcttccgtggtgtacctgtcccgggctgtttgaagcagctctcgcgggtgacgg

SEQ ID NO: 31672 - DNA, 75 bp, Artificial Sequence
  Synthetic
attctactggagagttattcccaaacctatactcaaagttagcctgcttaacatcatcgtgtttaagcgcagcga

SEQ ID NO: 31673 - DNA, 75 bp, Artificial Sequence
  Synthetic
tggcagacacatctccatgggtggcactcgcgacaggtgtctgtctgtatcttatcgagttatatgttgagctgc

SEQ ID NO: 31674 - DNA, 75 bp, Artificial Sequence
  Synthetic
gctattgacgaccctctgcctcgtaggcccatccattggtgggcttccgacccctgcaaccctacccagtgtctt

SEQ ID NO: 31675 - DNA, 75 bp, Artificial Sequence
  Synthetic
cccctgcaaccctacccagtgtctttttcagaggaatgtccgacccactgccctttcagctagcactcttgcaaa

SEQ ID NO: 31676 - DNA, 75 bp, Artificial Sequence
  Synthetic
ccctcatcaagacgacaggggtgacctgtagcttggtgaatcgtgtggtcaagttacggatagcaccctatccag

SEQ ID NO: 31677 - DNA, 75 bp, Artificial Sequence
  Synthetic
actggctctctctagtgactgacccgacctcactcaacattgcccaagtgtatcggccggaacgtcagatcagga

SEQ ID NO: 31678 - DNA, 75 bp, Artificial Sequence
  Synthetic
ggtggattgaggaagcgatagcgacaagctcacactcgtcacgcatagcaacttttttccagcagcccctcacgg

SEQ ID NO: 31679 - DNA, 75 bp, Artificial Sequence
  Synthetic
agatggctcagttgcttgcgagggacctttcaacaatgatgcctcttcgaccccgggatatgtcggccttgttcg

SEQ ID NO: 31680 - DNA, 75 bp, Artificial Sequence
  Synthetic
cattatcaaatgtcgcatacggtttaagtattatagatctatttcaaaaatcctctaccgttgtttctgcaagtc

SEQ ID NO: 31681 - DNA, 75 bp, Artificial Sequence
  Synthetic
aagctgtccatatcgaggatgttgccctagagagtgtaaggtataaggaatctatcatccagggtctgttagaca

SEQ ID NO: 31682 - DNA, 75 bp, Artificial Sequence
  Synthetic
ccactgaggggtataacatgcaaccttatttggaaggttgcacttaccttgcagccaaacagctacgtaggttga

SEQ ID NO: 31683 - DNA, 75 bp, Artificial Sequence
  Synthetic
catggggccgagacctagttggagttacaatgccgtttgttgccgagcaattccatcctcacagttctgcgggtg

SEQ ID NO: 31684 - DNA, 75 bp, Artificial Sequence
  Synthetic
tacaatgccgtttgttgccgagcaattccatcctcacagttctgcgggtgcaaaggcggaactctatctcgacgc

SEQ ID NO: 31685 - DNA, 75 bp, Artificial Sequence
  Synthetic
tattatatactgcccacaagagacattgcggtcacaccatctgactaccaggggggaccagccgctttacctcgg

SEQ ID NO: 31686 - DNA, 75 bp, Artificial Sequence
  Synthetic
ggggggaccagccgctttacctcggatccaatacggctgtcaaggttcagcgaggtgagatcacgggcctaacaa

SEQ ID NO: 31687 - DNA, 75 bp, Artificial Sequence
  Synthetic
ggacactctcgtcctccatcagtggtataaagtccgtaaagttaccgatccacacttgaacactctcatggcacg

SEQ ID NO: 31688 - DNA, 75 bp, Artificial Sequence
  Synthetic
cttcttgcttgagaaggggtacacatctgacgctcgacctagcatccagggtgggaccctcacgcatcgtctccc

SEQ ID NO: 31689 - DNA, 75 bp, Artificial Sequence
  Synthetic
atcccgcggggactcacggcaggggcttactgggtatgtaaatatactaagtacgtggcttcgattctccagtga

SEQ ID NO: 31690 - DNA, 75 bp, Artificial Sequence
  Synthetic
ttatctccactctttctcgaaatcatcagacgactatacaatccactttcagcatgtattcacatacggttgcct

SEQ ID NO: 31691 - DNA, 75 bp, Artificial Sequence
  Synthetic
tcttgagtgcaagttgtaaaacatgctttgagaagatagactcagaggagttcgtcctggcatgtgaaccccaat

SEQ ID NO: 31692 - DNA, 75 bp, Artificial Sequence
  Synthetic
accggggtgctgagtggctggtatcaaagccagtctctgtccctgagcagataactgatgctgaagtcgagtttg

SEQ ID NO: 31693 - DNA, 75 bp, Artificial Sequence
  Synthetic
aaagccagtctctgtccctgagcagataactgatgctgaagtcgagtttgatccctgtgtgagtgcgagttattg

SEQ ID NO: 31694 - DNA, 75 bp, Artificial Sequence
  Synthetic
tctcgggattctcattggcaagtcattcttagttgacataagggcaagtgggcatgatatcatggagcagcggac

SEQ ID NO: 31695 - DNA, 75 bp, Artificial Sequence
  Synthetic
atgggctaacctggagaggttttctgtatcggacatgcagaaacttccgtggagtattgtaattcggtctctctg

SEQ ID NO: 31696 - DNA, 75 bp, Artificial Sequence
  Synthetic
gagattccttattggcgcacggctccttcagtttgagaaggctggcctcattagaatgctatatgctgcgacagg

SEQ ID NO: 31697 - DNA, 75 bp, Artificial Sequence
  Synthetic
cttcagtttgagaaggctggcctcattagaatgctatatgctgcgacaggtccaacctttagcttcctaatgaaa

SEQ ID NO: 31698 - DNA, 75 bp, Artificial Sequence
  Synthetic
gttttccaagactcagccctcctcatggactgcgcacccctcgatcggctgtcccctaggatcaactttcatagt

SEQ ID NO: 31699 - DNA, 75 bp, Artificial Sequence
  Synthetic
gtcccctaggatcaactttcatagtcggggagacctcgttgctaagcttgttttgttacccttcatcaacccggg

SEQ ID NO: 31700 - DNA, 75 bp, Artificial Sequence
  Synthetic
tatagtggagattgaagtgtctggaattaatagcaagtaccatgcagtgtcggaggccaatatggatctgtacat

SEQ ID NO: 31701 - DNA, 75 bp, Artificial Sequence
  Synthetic
attaatagcaagtaccatgcagtgtcggaggccaatatggatctgtacatcgctgctgccaagtctgtgggcgtg

SEQ ID NO: 31702 - DNA, 75 bp, Artificial Sequence
  Synthetic
tggtccaagtcacgcaatcaatcacaggtcctaaagatggtagtacggaagctgaagctctgtgtcctgtatata

SEQ ID NO: 31703 - DNA, 75 bp, Artificial Sequence
  Synthetic
taccccacagtcgatcccgccgttgctctcgacctgtgccatctaccagcattaactataatcctagtgctcggc

SEQ ID NO: 31704 - DNA, 75 bp, Artificial Sequence
  Synthetic
attaactataatcctagtgctcggcggtgacccggcgtactatgagcgattacttgagatggacctgtgcggggc

SEQ ID NO: 31705 - DNA, 75 bp, Artificial Sequence
  Synthetic
tgtgtcaagtcgcgtcgatatcccccattctttagctgccagaacgcacagggggtttacaataggcccagacgc

SEQ ID NO: 31706 - DNA, 75 bp, Artificial Sequence
  Synthetic
gggggtttacaataggcccagacgctggtccaggtgtgattagactcgacaggttggagtcagtttgttatgctc

SEQ ID NO: 31707 - DNA, 75 bp, Artificial Sequence
  Synthetic
acccctgtttagaggaactagagtttaatgcgtatctagactctgagttggttgacattagtgatatgtgctgcc

SEQ ID NO: 31708 - DNA, 75 bp, Artificial Sequence
  Synthetic
tccccttagcgacaccctgtaaggcccttttcaggccaatatatcggagcttacagtcgttcaggttagccttaa

SEQ ID NO: 31709 - DNA, 75 bp, Artificial Sequence
  Synthetic
tggacaattatagttttgtcatggacctcattatgatccgaggactggacattaggccttaccttgaggaatttg

SEQ ID NO: 31710 - DNA, 75 bp, Artificial Sequence
  Synthetic
atgagctgcttgtggtaggacagcacatcctcggccagcccgtcctagtggaggttgtctactacgttggggttg

SEQ ID NO: 31711 - DNA, 75 bp, Artificial Sequence
  Synthetic
ttaggaagcgccccgtgttagcgaggcatccgtggtcagcagatcttaagcgaatcactgtgggggggcgagttc

SEQ ID NO: 31712 - DNA, 75 bp, Artificial Sequence
  Synthetic
gcatccgtggtcagcagatcttaagcgaatcactgtgggggggcgagttccctgcccctctgctgccagactgcg

SEQ ID NO: 31713 - DNA, 75 bp, Artificial Sequence
  Synthetic
tgatgaggattgtcaggggtctctgttggttgggcttcctgccgggttgacgcagttattgataattgattaaga

SEQ ID NO: 31714 - DNA, 75 bp, Artificial Sequence
  Synthetic
ctacctgtcgacgcctgtcacgcgtggagaacagactgttgttaagactgcgaagttttacggggaaaagacgac

SEQ ID NO: 31715 - DNA, 75 bp, Artificial Sequence
  Synthetic
cgaagttttacggggaaaagacgacgcagcgtgatctcaccgagctggagatctcctctatcttcagccattgtt

SEQ ID NO: 31716 - DNA, 75 bp, Artificial Sequence
  Synthetic
atgaggctatagattggattaacggccaaccctgggtaggctcctttgtgttgtctctactaactacagactttg

SEQ ID NO: 31717 - DNA, 75 bp, Artificial Sequence
  Synthetic
tagaagtttcagcaaagcttaaggaggatcatgctgacctgttcccgtttctgggggccattagacaccccgacg

SEQ ID NO: 31718 - DNA, 75 bp, Artificial Sequence
  Synthetic
gaaacccagcttgcccggtataggcgccgcgagatatctcgtggagaggacggggcagagctctcaggtgagatc

SEQ ID NO: 31719 - DNA, 75 bp, Artificial Sequence
  Synthetic
tgactggtctaaactaaaaaacaatgaacaaaccaataaaaaaccaaatgcggcaaaccctccgcgacctgcgat

SEQ ID NO: 31720 - DNA, 75 bp, Artificial Sequence
  Synthetic
ccagacactacgacgggaacgaccggggtcaccaagaccacggaaggtcccaaggaatgcattgacccaaccagt

SEQ ID NO: 31721 - DNA, 75 bp, Artificial Sequence
  Synthetic
ccctgtccgccctccaagtggaaaccatccagacagctcagcggtgcgatcactccgacagcatcaggatcctcg

SEQ ID NO: 31722 - DNA, 75 bp, Artificial Sequence
  Synthetic
gtgaaagagcctctgcagcttccacgcgagaagaagttgaccgactactttactattgacgtagaaccagcaggt

SEQ ID NO: 31723 - DNA, 75 bp, Artificial Sequence
  Synthetic
cattccctggtcaatatatacttccagattgacgacttcttgctcctaacactcaactcactatctgtgtacaag

SEQ ID NO: 31724 - DNA, 75 bp, Artificial Sequence
  Synthetic
gacccgattagaaaatacatgttcctacgcctcaacaaggaccagagcaagcacgcaatcaatgcagccttcaat

SEQ ID NO: 31725 - DNA, 75 bp, Artificial Sequence
  Synthetic
cacacgactattagcctcccggcagtccacacatcatgcctcaagtaccactgcaaaacctattggggattcttt

SEQ ID NO: 31726 - DNA, 75 bp, Artificial Sequence
  Synthetic
ggtagctacagcgctgaccgaatcataaatcggtacactggtactgttaagggttgtctaaacaactcagcacca

SEQ ID NO: 31727 - DNA, 75 bp, Artificial Sequence
  Synthetic
gaggaccccttcgagtgcaactggttctactgctgctcggcgattacaacagagatctgccgatgctctattaca

SEQ ID NO: 31728 - DNA, 75 bp, Artificial Sequence
  Synthetic
gtgagatcctccagtctctgctcctaggggtgtttggtactgggatcgcaagtgcttctcaatttttgaggagct

SEQ ID NO: 31729 - DNA, 75 bp, Artificial Sequence
  Synthetic
ggtcatgagacagaccccataaatcatgcctacggaacgcaggctgatctccttccatacaccaggtctagtaat

SEQ ID NO: 31730 - DNA, 75 bp, Artificial Sequence
  Synthetic
ctctcctcggaacagaggtctctttctgccttaagtcgagctcactcccccatcatgtacgagcactaggccaga

SEQ ID NO: 31731 - DNA, 75 bp, Artificial Sequence
  Synthetic
ttaaagcaaggaacctggcatcctgtgactattacttgctattccgccaagttgtattgccccctgaagtatatc

SEQ ID NO: 31732 - DNA, 75 bp, Artificial Sequence
  Synthetic
gggccaaaaaggcttgggaatatgtcattgcaattcatccaatctctcgttattgccaccatagacacgacaagc

SEQ ID NO: 31733 - DNA, 75 bp, Artificial Sequence
  Synthetic
tgaattatgcccgcaactagacagcttactaaaaaaactgctccaacttgaccccgttctcctcctcatggtctc

SEQ ID NO: 31734 - DNA, 75 bp, Artificial Sequence
  Synthetic
aattgctgacctagatatggatcccgacttcaacgatattgttagcgataaggcgataatcagctcaagaaggga

SEQ ID NO: 31735 - DNA, 75 bp, Artificial Sequence
  Synthetic
gccttttggaagaaatacggtgaacggttggagaggcctcctgccaggtcgggaccgtcacgacttgtgaatgct

SEQ ID NO: 31736 - DNA, 75 bp, Artificial Sequence
  Synthetic
cagatgttcaattgcgggtacttcttcaggactgggtgcacactgccatgctttaccacgtttattattcaagac

SEQ ID NO: 31737 - DNA, 75 bp, Artificial Sequence
  Synthetic
aggttcaacccgccctattccctcagtggtgagcccgttgaagacggagttacatgcgcggttgggactaaaaca

SEQ ID NO: 31738 - DNA, 75 bp, Artificial Sequence
  Synthetic
atgggggagggcatgaggcagaaactatggacaatccttacgagctgctgggagataattgctcttcgggaaatt

SEQ ID NO: 31739 - DNA, 75 bp, Artificial Sequence
  Synthetic
tatggacaatccttacgagctgctgggagataattgctcttcgggaaattaacgtgacgtttaacatactaggcc

SEQ ID NO: 31740 - DNA, 75 bp, Artificial Sequence
  Synthetic
atgagtatggaaagaagcttttcttccgtggtgtacctgtcccgggctgtttgaagcagctctcacgggtgacgg

SEQ ID NO: 31741 - DNA, 75 bp, Artificial Sequence
  Synthetic
actggctctctctagtgactgacccgacctcactcaacattgcccaagtgtaccggccagaacgtcagatcagga

SEQ ID NO: 31742 - DNA, 75 bp, Artificial Sequence
  Synthetic
catggggtcgagacctagttggagtcacaatgccgtttgttgccgagcaattccatcctcacagttctgtgggtg

SEQ ID NO: 31743 - DNA, 75 bp, Artificial Sequence
  Synthetic
cacaatgccgtttgttgccgagcaattccatcctcacagttctgtgggtgcaaaggcggaactctacctcgacgc

SEQ ID NO: 31744 - DNA, 75 bp, Artificial Sequence
  Synthetic
ggggggaccagccgctttacctcggatccaatacggctgtcaaggtccagcgaggtgagatcacgggcctagcaa

SEQ ID NO: 31745 - DNA, 75 bp, Artificial Sequence
  Synthetic
agtcaagggctgcaaatctagtcaaggacactctcgttctccatcagtggtataaagtccgtaaagttaccgatc

SEQ ID NO: 31746 - DNA, 75 bp, Artificial Sequence
  Synthetic
ggacactctcgttctccatcagtggtataaagtccgtaaagttaccgatccacacttgaacaccctcatggcacg

SEQ ID NO: 31747 - DNA, 75 bp, Artificial Sequence
  Synthetic
atcccgcggagactcacggcaggggcttactgggtatgtaaatatactaagtacgtggcttcgattctcaagtga

SEQ ID NO: 31748 - DNA, 75 bp, Artificial Sequence
  Synthetic
acaggggtgctgagtggctgatatcaaagccagtcactgtccctgagcagataactgatgctgaagtcgagtttg

SEQ ID NO: 31749 - DNA, 75 bp, Artificial Sequence
  Synthetic
acccctgtgtgagtgcgagttattgtctcgggattctcattggcaagtcattcttagttgacataagggcaagtg

SEQ ID NO: 31750 - DNA, 75 bp, Artificial Sequence
  Synthetic
gtcccctaggatcaactttcatagtcggggagacctcgttgctaagcttgttttattgcccttcatcaacccggg

SEQ ID NO: 31751 - DNA, 75 bp, Artificial Sequence
  Synthetic
tgtgtcaagtcgagtcgatatcccccattctctggctgccagaacgcacagggggttcgcagtgggcccagacgc

SEQ ID NO: 31752 - DNA, 75 bp, Artificial Sequence
  Synthetic
gggggttcgcagtgggcccagacgctggtccaggtgtaattagactcgacaggttagagtcagtttgttatgctc

SEQ ID NO: 31753 - DNA, 75 bp, Artificial Sequence
  Synthetic
tggacaactatagttttgtcatggacctcattatgatccgaggactggacattaggcctcaccttgaggaatttg

SEQ ID NO: 31754 - DNA, 75 bp, Artificial Sequence
  Synthetic
acgagctgcttgtggtaggacagcacatcctcggccagcccgtcctagtagaggttgtttactacgttggagttg

SEQ ID NO: 31755 - DNA, 75 bp, Artificial Sequence
  Synthetic
ttaggaagcgccctgtgttagcgaggcatccgtggtcagcagatcttaagcgaattactgtgggggggcgggctc

SEQ ID NO: 31756 - DNA, 75 bp, Artificial Sequence
  Synthetic
gcatccgtggtcagcagatcttaagcgaattactgtgggggggcgggctccctgcccctctgctgccagattgcg

SEQ ID NO: 31757 - DNA, 75 bp, Artificial Sequence
  Synthetic
ttggttgggcttcctgctgggttgacgcagttattgataattgattaagatcaagccacctactaccctattctt

SEQ ID NO: 31758 - DNA, 75 bp, Artificial Sequence
  Synthetic
ctactaccctattcttaaaaaaccatatgtcagtggtgcagtgcttgggcttggttgttgctttgttgtagcgca

SEQ ID NO: 31759 - DNA, 75 bp, Artificial Sequence
  Synthetic
gttgcgctaacaacaaaccaatcaccatccttctaacaaaatgaacacacgcaatgccacccaagagacgcctgg

SEQ ID NO: 31760 - DNA, 75 bp, Artificial Sequence
  Synthetic
ttgcatatgagatccgtgactttttagaggtttcagcaaagcttaaggaggatcatgctgacctgttcccgtttc

SEQ ID NO: 31761 - DNA, 75 bp, Artificial Sequence
  Synthetic
ctgccataatgaaaatgataggtgtgactggtctaaactaaaagacaatgaccaaaccaataaaaaaccaaatgc

SEQ ID NO: 31762 - DNA, 75 bp, Artificial Sequence
  Synthetic
ttgaactagtcaggaggctcaatggcaacgggaccatcgagcctggtcgactccctggaggacgaagaagatccc

SEQ ID NO: 31763 - DNA, 75 bp, Artificial Sequence
  Synthetic
ttccttaacatcccatttctttcagtgaaagagcctctgcagcttccacgcgagaagaagttgaccgactacttc

SEQ ID NO: 31764 - DNA, 75 bp, Artificial Sequence
  Synthetic
cagcctccttcgcgaggaggagacgcctcggggggtggcaggaataaaccgtaccgaccagtctcttaaaaaccc

SEQ ID NO: 31765 - DNA, 75 bp, Artificial Sequence
  Synthetic
gccccaatctgtcgtcagttggatcagatgttcaattgcgggtacttcttcaggactgggtgcacactgccatgc

SEQ ID NO: 31766 - DNA, 75 bp, Artificial Sequence
  Synthetic
ggccctgtacaagcatgctagattagctggccataacctcaaggtagaggaatgctgggtgtcagattgcctgta

SEQ ID NO: 31767 - DNA, 75 bp, Artificial Sequence
  Synthetic
tgagtatggatataagcttttcttccgtggtgtacctgtcccgggctgtttgaagcagctctcgcgggtgacgga

SEQ ID NO: 31768 - DNA, 75 bp, Artificial Sequence
  Synthetic
agttacggatagcaccctatccagactggctctctctagtgactgacccgacctcactcaacattgcccaagtgt

SEQ ID NO: 31769 - DNA, 75 bp, Artificial Sequence
  Synthetic
tgggaccctcacgcatcgtctcccatcccgcggggactcacggcaggggcttactgggtatgtaaatatactaag

SEQ ID NO: 31770 - DNA, 75 bp, Artificial Sequence
  Synthetic
tacagtcgttcaggttagccttaatggacaattatagttttgtcatggacctcattatgatccgaggactggaca

SEQ ID NO: 31771 - DNA, 75 bp, Artificial Sequence
  Synthetic
gatgaggattgtcaggggtctctgttggttgggcttcctgccgggttgacgcagttattgataattgattaagat

SEQ ID NO: 31772 - DNA, 75 bp, Artificial Sequence
  Synthetic
ctagccacctactaccctattcttaaaaaaccatatgtcagtggtgtagtgcttgggcttggttgttgctttgtt

SEQ ID NO: 31773 - DNA, 75 bp, Artificial Sequence
  Synthetic
acctactaccctattcttaaaaaaccatatgtcagtggtgtagtgcttgggcttggttgttgctttgttggcagc

SEQ ID NO: 31774 - DNA, 75 bp, Artificial Sequence
  Synthetic
gttgcgttaacaacaaaccactcatcattcttctaacaaaatgaacacacgcaatgccacccaagagacgcctgg

SEQ ID NO: 31775 - DNA, 75 bp, Artificial Sequence
  Synthetic
ctcgcgacaggtgtctgtctgtatcttatcgagttatatgttgagctgcctccagcaatcatgcaggatgagtcg

SEQ ID NO: 31776 - DNA, 75 bp, Artificial Sequence
  Synthetic
ttcagtttgagaaggctggcctcattagaatgctgtatgctgcgacaggtccaacccctagcttcctaatgaaag

SEQ ID NO: 31777 - DNA, 75 bp, Artificial Sequence
  Synthetic
actaccctattcttaaaaaaccatatgtcagtggtgcagtgcttgggcttggttgttgctttgttgtagcgcgtt

SEQ ID NO: 31778 - DNA, 75 bp, Artificial Sequence
  Synthetic
atgaacattacaatgccacccaaaagacgtctcctagaggaccccgacgtgatggatgatcaagagcccgaacca

SEQ ID NO: 31779 - DNA, 75 bp, Artificial Sequence
  Synthetic
acctctcccccgatgcccaaactcccgggcaagttcctccaatacacagttggaggatctgacccgcaccctgga

SEQ ID NO: 31780 - DNA, 75 bp, Artificial Sequence
  Synthetic
ataggagaggaaaaagatataaaacacaatgctgttgccctccttgattcttccagaagagatatgttccatcca

SEQ ID NO: 31781 - DNA, 75 bp, Artificial Sequence
  Synthetic
gttactccaagtcttgtatttttgtgtttattaatccctggattacacgctgcgtttcttcatggtggtgtccca

SEQ ID NO: 31782 - DNA, 75 bp, Artificial Sequence
  Synthetic
aaggaatcttatctgtccacacctatatcaaggggagaacaaacgtttgtaaaggttagccgattctatggtgaa

SEQ ID NO: 31783 - DNA, 75 bp, Artificial Sequence
  Synthetic
cgaacagcttcacgggagctaactgagctggaaatatcatccatctttaaccattgctgctccttgctcatagga

SEQ ID NO: 31784 - DNA, 75 bp, Artificial Sequence
  Synthetic
gttgttattgggtcgtcggctaaaatcagggccggcgcagaacaaataaagaagcgcttcaaaaccttgatggcc

SEQ ID NO: 31785 - DNA, 75 bp, Artificial Sequence
  Synthetic
tctctcaacaggccatcacacggggaaactgcaactctgctgcagatgttcaacccacatgaggcaatcgattgg

SEQ ID NO: 31786 - DNA, 75 bp, Artificial Sequence
  Synthetic
attaatggacagccctgggttggatcattagttctgtcactcctaacaactgattttgaatctccagggaaagag

SEQ ID NO: 31787 - DNA, 75 bp, Artificial Sequence
  Synthetic
tttatggatcaaattaagcttgttgccagttatgcccagatgacaacatataccactataaaagaatacctggct

SEQ ID NO: 31788 - DNA, 75 bp, Artificial Sequence
  Synthetic
gaatgtatggatgcaacattaactatccctgccgtggctcacgagatacgtgagtttcttgagatctcagcgaaa

SEQ ID NO: 31789 - DNA, 75 bp, Artificial Sequence
  Synthetic
cttaagaatgagcatgctgaactattcccatttctcggagcaataaggcaccctgatgccatcaagctagcccca

SEQ ID NO: 31790 - DNA, 75 bp, Artificial Sequence
  Synthetic
cgtagttttccaaacctagcatcggctgcattttattggagtaagaaggaaaatcccacgatggctggctaccgg

SEQ ID NO: 31791 - DNA, 75 bp, Artificial Sequence
  Synthetic
gcatccacgatccagccaggggcaacagttaaagagactcaactggcgcgctatcgccgacgtgaggtatctaga

SEQ ID NO: 31792 - DNA, 75 bp, Artificial Sequence
  Synthetic
ggggaagacggagcggagctttcaggtgagatctctgatattatgaagatgattggagtgacagggcttgtttaa

SEQ ID NO: 31793 - DNA, 75 bp, Artificial Sequence
  Synthetic
caataatcgaacataacaataaaaaatcataaccacaccgcaaatctccgcatgtggcatgaactcggatcttca

SEQ ID NO: 31794 - DNA, 75 bp, Artificial Sequence
  Synthetic
gctcacactgcttgaactcatcagacggctcaatggcatcgcgcccctcgagtctagtcgagtcattggaggacg

SEQ ID NO: 31795 - DNA, 75 bp, Artificial Sequence
  Synthetic
aagagagtctccagacaccacgacgagtcaggtctcgatcaccccggccaaagaggattccacaagatgcactaa

SEQ ID NO: 31796 - DNA, 75 bp, Artificial Sequence
  Synthetic
cacaacctgtggaccgccttctcaagaacataaagaagaacccctccatgatctccgacccagaacaaaggaccg

SEQ ID NO: 31797 - DNA, 75 bp, Artificial Sequence
  Synthetic
gaagggaacagctgtcgaatgatgaactcatcaagcaacttgtcaccgagctagcagaaaatagcatgatagagg

SEQ ID NO: 31798 - DNA, 75 bp, Artificial Sequence
  Synthetic
cagaaggacttcgaggagcgctagatgatatctcatcaaaggttgactctggattagagtcaatctcatcactcc

SEQ ID NO: 31799 - DNA, 75 bp, Artificial Sequence
  Synthetic
aggtcgagacactccaaaccgtacagaagactgactacgctgacagcattaagaccctaggagaaaacatcaaag

SEQ ID NO: 31800 - DNA, 75 bp, Artificial Sequence
  Synthetic
tcctagatcgatcaatgaagacaatgatggagaccatgcgattgatgatggagaagattgatctattgtatgcat

SEQ ID NO: 31801 - DNA, 75 bp, Artificial Sequence
  Synthetic
caactgcaattggccagagcaacaccccaatgcttccttcacatcctgcacagccaaggctttaccccactcttc

SEQ ID NO: 31802 - DNA, 75 bp, Artificial Sequence
  Synthetic
ccagtgcacccacagccgatgagtgggatatactaccataaaaaaatcgaatcaaaatgaattctaagcacacat

SEQ ID NO: 31803 - DNA, 75 bp, Artificial Sequence
  Synthetic
acgttgagctaaaggacaaggtaattgttcccggttggccaactctcatgttagaaattgatttcgttggagggt

SEQ ID NO: 31804 - DNA, 75 bp, Artificial Sequence
  Synthetic
catccagaaaccagtttctcaatataccatttctttcagttaaagaaccactgcaacttccccgagagaagcgat

SEQ ID NO: 31805 - DNA, 75 bp, Artificial Sequence
  Synthetic
tgacggactacctgaccatagatgttgagcctgccgggcactctcttgtgaacatttacttgcagatcgacgact

SEQ ID NO: 31806 - DNA, 75 bp, Artificial Sequence
  Synthetic
tccttgccttgaccctgaactcaatttcagtctacaaggagccagtcaagaagttcatgtacatccggctaaacg

SEQ ID NO: 31807 - DNA, 75 bp, Artificial Sequence
  Synthetic
aggaacagagcaagcatgcaatcaacgcagcattcaatgtcttttcctatcgtctgcgtaatattgggatcggtc

SEQ ID NO: 31808 - DNA, 75 bp, Artificial Sequence
  Synthetic
ctcttggtccagacattcgagcttcggggccttagatgcaacaccgactcaacacccgcgctggttgatcttgag

SEQ ID NO: 31809 - DNA, 75 bp, Artificial Sequence
  Synthetic
attcgccgattgtgccataccccgtcagaaaatgtcatttcatgcgaggttagctattataaccattcacagcaa

SEQ ID NO: 31810 - DNA, 75 bp, Artificial Sequence
  Synthetic
agcctagaagctcgacatacatcatgctataaatatcattgtaaaacttactggggcttttttggaagttatagt

SEQ ID NO: 31811 - DNA, 75 bp, Artificial Sequence
  Synthetic
gccgacaggttagtcagtcgttacactggggcatttaatgtatgtaacaatggatcgtttccggatgacccatat

SEQ ID NO: 31812 - DNA, 75 bp, Artificial Sequence
  Synthetic
gagtgtaactggtactactgttgttcagccttaaccacagagatttgccggtgctcaattaataatgtcacagtg

SEQ ID NO: 31813 - DNA, 75 bp, Artificial Sequence
  Synthetic
gctgtaagaacgtttcccccatttatgtattgcagctttgctgactgcagcactgtaagtcaattagaactaaca

SEQ ID NO: 31814 - DNA, 75 bp, Artificial Sequence
  Synthetic
acagggttcgcaagtttaagtgatgggagcgtactggaatttgagccatggaatatatcaaaggaactgattaat

SEQ ID NO: 31815 - DNA, 75 bp, Artificial Sequence
  Synthetic
ggtaccttcaacggcaccatcttatgcaattcttcatcaaaaataatatcattcgatgagtttaggcgctcttat

SEQ ID NO: 31816 - DNA, 75 bp, Artificial Sequence
  Synthetic
tcattagttaatggaacctatatgagtagctccataaacattacttgttcatcgtataatggtacttgtagggcg

SEQ ID NO: 31817 - DNA, 75 bp, Artificial Sequence
  Synthetic
aagcctagaaaaaaacgtgacctatcacaaatagagtatttagtccacaaattgaggcccacattgcgagatgca

SEQ ID NO: 31818 - DNA, 75 bp, Artificial Sequence
  Synthetic
tgggaagattgtgagattcttcaatcgcttctcttaggggtttttggaactggaatggcaagtgcctctcaattc

SEQ ID NO: 31819 - DNA, 75 bp, Artificial Sequence
  Synthetic
ttaagggaatggttaaatcagaccaacattgtaggttatgttgtgaacggagtcggggttgtttggcagtgtgat

SEQ ID NO: 31820 - DNA, 75 bp, Artificial Sequence
  Synthetic
tgggtcaatgtttcatttttgccgtggaacgaatccacttactacccccctgttaacttctcaaacagtagattg

SEQ ID NO: 31821 - DNA, 75 bp, Artificial Sequence
  Synthetic
agcaaaaacaagcagttgttaaccatgaatctcttctcaccaagaacatgtctgagcccaacagagacacaagaa

SEQ ID NO: 31822 - DNA, 75 bp, Artificial Sequence
  Synthetic
ttgctctacgcctatacagggcctgcaccagtcgcatacggaaccaggacgagagccgttctagagaatgtcctc

SEQ ID NO: 31823 - DNA, 75 bp, Artificial Sequence
  Synthetic
agaccatataaatatttctatccagaagaggacgttcagagagccctaatgatcaagaccgggatgaagagtcct

SEQ ID NO: 31824 - DNA, 75 bp, Artificial Sequence
  Synthetic
gataatatttcaaccaggacaccaagcagtggattccacagagactctgtaatacttctctcggaacaactaatg

SEQ ID NO: 31825 - DNA, 75 bp, Artificial Sequence
  Synthetic
cacaagtacccggagggttttgagaggcttaagacatggttggagtgtgacctcctggaaatgaactactctgag

SEQ ID NO: 31826 - DNA, 75 bp, Artificial Sequence
  Synthetic
ttaagcaaaggaagacaaacattaagttttctgagagacaggaatcagccagcacctatagcactagaagaaaca

SEQ ID NO: 31827 - DNA, 75 bp, Artificial Sequence
  Synthetic
attgagtatctacaacaaaatctcaaccggccaatagggcaatcgatgatgtgctatctgaatgcaattatggag

SEQ ID NO: 31828 - DNA, 75 bp, Artificial Sequence
  Synthetic
gtgctttcactaccaaaaaccaccttcacttatgaagttgctacccaactggcacattttgactatgatgaattt

SEQ ID NO: 31829 - DNA, 75 bp, Artificial Sequence
  Synthetic
gatgatggagaaaccggcccactcagaatgcactttgaaagagcaaaaaagaaggttacaatcactctcactagg

SEQ ID NO: 31830 - DNA, 75 bp, Artificial Sequence
  Synthetic
caagagctgtggagcaaaatgtgcaccttaggcaccatgtggaaacatctcgaacgaggacgattaaaccgaagg

SEQ ID NO: 31831 - DNA, 75 bp, Artificial Sequence
  Synthetic
accattgctactccgtccatgttagtaaggggctttgtgaaagtggtggaagatgcagcaagggtcttattggaa

SEQ ID NO: 31832 - DNA, 75 bp, Artificial Sequence
  Synthetic
tgtctaccaagttctggagtccctgtaggaggtgaagaaaagcttgcaaagctgtccagcaagctcgaaacagtg

SEQ ID NO: 31833 - DNA, 75 bp, Artificial Sequence
  Synthetic
gcagaggttacaggtgaactgagtggagaccaagagaagttcaatgaatgtttagacccagatgctatgaggatt

SEQ ID NO: 31834 - DNA, 75 bp, Artificial Sequence
  Synthetic
atgtggactgtgtttctcagagaccagccagactggatgaaaaagcttttcaacattcccttcttggtctttaaa

SEQ ID NO: 31835 - DNA, 75 bp, Artificial Sequence
  Synthetic
agtaaaatagcagacataggagaagggttgacctatgaaaagagcaaaataatcaggaacttccctttggggaca

SEQ ID NO: 31836 - DNA, 75 bp, Artificial Sequence
  Synthetic
taccagtctgagtttgatgatttgttgcccaaccttgtgagaaacaaagaaggagaacctgttggagtaaaatgt

SEQ ID NO: 31837 - DNA, 75 bp, Artificial Sequence
  Synthetic
actcttggtatgttcatggggatgttcaacctcagctctacacttctagcactgatagcagcggaccgcgaagag

SEQ ID NO: 31838 - DNA, 75 bp, Artificial Sequence
  Synthetic
atcactggagaccatgtggaaagcagcgacgactttattcatttcttcaaaacaaagacccacgacgaaatgttt

SEQ ID NO: 31839 - DNA, 75 bp, Artificial Sequence
  Synthetic
aaacaggcagagttgctgagatggtctctcaagcttgtcgggattaacatgtctcccagcaaatgcatcctgata

SEQ ID NO: 31840 - DNA, 75 bp, Artificial Sequence
  Synthetic
agccccgctgggattggagagttcaattccaaatatcaccatagagactttgttgggaacgttgctacagatctg

SEQ ID NO: 31841 - DNA, 75 bp, Artificial Sequence
  Synthetic
ccttccttggttccaggtgggaaaaacccttccagtgacttggcaatgggactgaatgtgatcaggcactctgtg

SEQ ID NO: 31842 - DNA, 75 bp, Artificial Sequence
  Synthetic
aacacaaaccagatgaattttatcagtggagatttggcactccggatttttacaaaagcatacaggtactcatac

SEQ ID NO: 31843 - DNA, 75 bp, Artificial Sequence
  Synthetic
atggctgaaggagttaccaggcgaactaagttcttggaagcaataagtcaagaaccaaagctcctgaaccaggga

SEQ ID NO: 31844 - DNA, 75 bp, Artificial Sequence
  Synthetic
gccaagactgtacactgcagcggaacgatacacctggatgagatatgtcttagatacaagatgggcctgatatca

SEQ ID NO: 31845 - DNA, 75 bp, Artificial Sequence
  Synthetic
gaacaggagctctgcagactaatgaacccctcaaacccaatttccaaaatgggagatgaagttgtcgctttccgg

SEQ ID NO: 31846 - DNA, 75 bp, Artificial Sequence
  Synthetic
cctgagggcaaattgccgctggtactagaggacacaagtgttggtagttgcttcaaatacaactttacaaggaac

SEQ ID NO: 31847 - DNA, 75 bp, Artificial Sequence
  Synthetic
agaaccgtggtggataagccacatcgtgtgctgcttgaaaaagagatcaagtatcaacagatgacctcttttgtg

SEQ ID NO: 31848 - DNA, 75 bp, Artificial Sequence
  Synthetic
gaggagtgcttccctgaacttatgataaagcaaaatgcaatgccaggcacagtgaagaatgcctgcaagcggaga

SEQ ID NO: 31849 - DNA, 75 bp, Artificial Sequence
  Synthetic
attgagtacatcattgaccaaagtgatctaccccaagacgtgaagagaagcctggttgaggagttgggttagttt

SEQ ID NO: 31850 - DNA, 75 bp, Artificial Sequence
  Synthetic
atctaccccaagacgtgaagagaagcctggttgaggagttgggttagtttaggaaaaaactgctttgatttctct

SEQ ID NO: 31851 - DNA, 75 bp, Artificial Sequence
  Synthetic
agcaaaaacaagcagattgtccaaagatgaatgcccttctagtcatactggtagcgattgccgcaaaatcagcag

SEQ ID NO: 31852 - DNA, 75 bp, Artificial Sequence
  Synthetic
accaagctgaactgtgcaataagcagcaacagcaaggcccgttcacgttcgcaaattaccaagagtcaccattaa

SEQ ID NO: 31853 - DNA, 75 bp, Artificial Sequence
  Synthetic
acgtgtccagactgcaaatcaaagtcaccaaaacaacagtccaagacagaggaaagaattttatcattggctatc

SEQ ID NO: 31854 - DNA, 75 bp, Artificial Sequence
  Synthetic
gcgcatactggaggagctactgctacaacggcggatcactggacggtaacactggatgctacaactctctcaatc

SEQ ID NO: 31855 - DNA, 75 bp, Artificial Sequence
  Synthetic
caaagccgcctacaaaagacgagttgaaaacatggggacaagaagaagtgtgctacaccggaccagaagtgcaag

SEQ ID NO: 31856 - DNA, 75 bp, Artificial Sequence
  Synthetic
atgcttggtctggggactctagcatatgctttgtggattggaagatggacaacaaacacagagccaaagagttgg

SEQ ID NO: 31857 - DNA, 75 bp, Artificial Sequence
  Synthetic
agaagcggagcaacaacaaccattttgcgcaccacacatgcaatctctcctggaggtgtggggtaacaaacaccc

SEQ ID NO: 31858 - DNA, 75 bp, Artificial Sequence
  Synthetic
atttagaagtgagactggttgcatccggcactcaaccccaagcagtaatagtgatgcccaacgggactacgagag

SEQ ID NO: 31859 - DNA, 75 bp, Artificial Sequence
  Synthetic
ctgtgtctatggtggcagaaacgttctggactgacggagaattttcctacctttacagccctaaggtctttggaa

SEQ ID NO: 31860 - DNA, 75 bp, Artificial Sequence
  Synthetic
caagagcagagaccaaattcatcccatgctttaaagaacatgtgaagacccgtcttgaccaaggagggagtgact

SEQ ID NO: 31861 - DNA, 75 bp, Artificial Sequence
  Synthetic
acctaatccacgaccttaccacagagaagtttcattgcaaagatggagacaacttcttcgaatttccctcatcag

SEQ ID NO: 31862 - DNA, 75 bp, Artificial Sequence
  Synthetic
ggttcatctgcttaccagatgcttgctacaaaaatgaaaagcagaaaaacaatctattgcaccccggaatgtgga

SEQ ID NO: 31863 - DNA, 75 bp, Artificial Sequence
  Synthetic
atatttctgagaaactacatgcagcaagtgtctatgatgtaaacaatgtaatacattctttagtgtatgaaactg

SEQ ID NO: 31864 - DNA, 75 bp, Artificial Sequence
  Synthetic
aaagcctacggctctcactagcccaattagaccatagattttctgtgctaaccaaactcatgaataagatggtct

SEQ ID NO: 31865 - DNA, 75 bp, Artificial Sequence
  Synthetic
ccagcttggctaagatcgatgatagattgattggagcactgctggagaaacctatggcaagtaaattcatctctc

SEQ ID NO: 31866 - DNA, 75 bp, Artificial Sequence
  Synthetic
ctaccaaattcatggtgtcgccctgtgtcgctgtgttagaagaagaatcgaattgccataaggacagcatatata

SEQ ID NO: 31867 - DNA, 75 bp, Artificial Sequence
  Synthetic
gagacggccggtgggtgtacaataacgacccaacaaaatgcttcatcctcaactcgtcccaaactattgatttgt

SEQ ID NO: 31868 - DNA, 75 bp, Artificial Sequence
  Synthetic
ttaactttaaaactctgtggttgccccagttagtggctgcaaaggtcgagggagtggtttccgacgaggatggtt

SEQ ID NO: 31869 - DNA, 75 bp, Artificial Sequence
  Synthetic
ggacatttgtagcaaacagcaaacaggcattgcttgacaccatgacatacaccaagaatggaggcagagggacta

SEQ ID NO: 31870 - DNA, 75 bp, Artificial Sequence
  Synthetic
gcatggaggatgttttgaactaccccagcggatggctgtctggcaagttaaacggcttgctgctcaatggagctg

SEQ ID NO: 31871 - DNA, 75 bp, Artificial Sequence
  Synthetic
tgtcttggctggggatttgtgctgtggtcgtcttgggggtttgtttgtgcaggcgggtctattaagaaaaaactg

SEQ ID NO: 31872 - DNA, 75 bp, Artificial Sequence
  Synthetic
gatttgtgctgtggtcgtcttgggggtttgtttgtgcaggcgggtctattaagaaaaaactgctttgatttctct

SEQ ID NO: 31873 - DNA, 75 bp, Artificial Sequence
  Synthetic
agcaaaaacaagcagttattcgacataagagaacatacgcacagatggagggcaacgagacagccaaaggaatca

SEQ ID NO: 31874 - DNA, 75 bp, Artificial Sequence
  Synthetic
aagcgcttataaagaagtacaaagaactgtcaaatgaacctctctttcaagagaaaagaatttgggagtatgaca

SEQ ID NO: 31875 - DNA, 75 bp, Artificial Sequence
  Synthetic
cgttcaaaaggtatacgaccagcaaaaaagaccatgctccacacactcgactggtgtacaatgtgaggaggagtt

SEQ ID NO: 31876 - DNA, 75 bp, Artificial Sequence
  Synthetic
atccactgcaagtactgccaacgctcccagaagtgtacaaaggccacagactgtgcaagagggaggtagatattg

SEQ ID NO: 31877 - DNA, 75 bp, Artificial Sequence
  Synthetic
gagaatctaaaagaatcctcggcacaatctactgtcctgattactggatgtcccaaggtgaacctacgagcaagg

SEQ ID NO: 31878 - DNA, 75 bp, Artificial Sequence
  Synthetic
aaattgcagaatccttgatcgggccagaaatggataaggtagataggttcttccaagccagttggggcgacctgc

SEQ ID NO: 31879 - DNA, 75 bp, Artificial Sequence
  Synthetic
agtatggacatttactgccttaccggaaaccagtatctattgtaccagtgattcaagaagtcacacctggatcca

SEQ ID NO: 31880 - DNA, 75 bp, Artificial Sequence
  Synthetic
ttgcaccaacccttgagcaagtcttttgtccacagttcagcaccatagatgctgccggtaggtccaacagagagg

SEQ ID NO: 31881 - DNA, 75 bp, Artificial Sequence
  Synthetic
ctgtagagaagatcaccaagaagatccggcctctcctatcattgaagagcactcctgcactcatacacctagccc

SEQ ID NO: 31882 - DNA, 75 bp, Artificial Sequence
  Synthetic
gaggactcatcactcaaagaaagaaatgggtccctgtcactatcgatactaaccccagcacagcagagctgtctc

SEQ ID NO: 31883 - DNA, 75 bp, Artificial Sequence
  Synthetic
acttcctgtacagcagttaccaccatcttccagtttcaaaggtgcacacaatagaaactgcgtcgatagaaagac

SEQ ID NO: 31884 - DNA, 75 bp, Artificial Sequence
  Synthetic
tgtgcggagaaatcgttcagtgggcactgaagacgtgggaaccaaagaagaagctactggaattgctggaaaaga

SEQ ID NO: 31885 - DNA, 75 bp, Artificial Sequence
  Synthetic
taactgtaaaagggaccagcttgtcctcaatactggaatcactggactccgacaagcaatacacaagcatctgca

SEQ ID NO: 31886 - DNA, 75 bp, Artificial Sequence
  Synthetic
aagttgccctaggaattcctattcacctggtgaatcagatcagagaaactaggtttgtaataatgaaccgagagg

SEQ ID NO: 31887 - DNA, 75 bp, Artificial Sequence
  Synthetic
cagagaggataaatgttgagtgcataaagaagttcgggaatatccagtacctgcataaataccaaaggtttgaag

SEQ ID NO: 31888 - DNA, 75 bp, Artificial Sequence
  Synthetic
ggccttacaaggtattttttcattggaggcatgtcaaggggataatcattggatccgatatgaaaataagcaaga

SEQ ID NO: 31889 - DNA, 75 bp, Artificial Sequence
  Synthetic
tcctgttacatgcagaacaaggtgacttcctgctaccacttgtgttggacattctgtactacacagcatcccttg

SEQ ID NO: 31890 - DNA, 75 bp, Artificial Sequence
  Synthetic
agccaggatttgaaaggtcctatgaccaatttgtggaaaagaagaatctgttctcccacttcttcgcacaccaca

SEQ ID NO: 31891 - DNA, 75 bp, Artificial Sequence
  Synthetic
cttcaaacccactggaggtgtacagagtgcttggggttggacccactggtgctctagccaacagtttccattgga

SEQ ID NO: 31892 - DNA, 75 bp, Artificial Sequence
  Synthetic
aaatagtatcagaagggttcttgagcaagattggagaaatggaaacaagtgtacagccatatagtgcgtatgcag

SEQ ID NO: 31893 - DNA, 75 bp, Artificial Sequence
  Synthetic
caactcaccaactatctgatcagctggaagtgttccgcatcagtaaacattccaaacacaagctgatagacccaa

SEQ ID NO: 31894 - DNA, 75 bp, Artificial Sequence
  Synthetic
acgagttgctggtaccaaaaacaccactcccactcggactggatgctacatcaactgaattagtggatgtgataa

SEQ ID NO: 31895 - DNA, 75 bp, Artificial Sequence
  Synthetic
caaacccgcttgtcaaagccaagactatgtggaccaaactgataacagaccccatgaggtgtaagacttttgtgt

SEQ ID NO: 31896 - DNA, 75 bp, Artificial Sequence
  Synthetic
caaatgcaataacagggaatcctgacccctttatgaagactgtccaacagatcatgcctccacgaagtagggttg

SEQ ID NO: 31897 - DNA, 75 bp, Artificial Sequence
  Synthetic
ccaacaaaagaaggcttgaagaactggtcgaagacgatcccaattggacaagatccccagagaaaaggttcaagg

SEQ ID NO: 31898 - DNA, 75 bp, Artificial Sequence
  Synthetic
cggcgtttgatgctgcagtcctgttagcaggcaagccgaagaaacgccctgctgagggcccacccctgaataaag

SEQ ID NO: 31899 - DNA, 75 bp, Artificial Sequence
  Synthetic
tagcgatgagctgcttgggcgagacacttgactacagcatgtctggaggacttgttgtcagtacagggcacaaaa

SEQ ID NO: 31900 - DNA, 75 bp, Artificial Sequence
  Synthetic
tacgtgtgatgagtcagatagtagtggacaactccatcactcctgttgaaggatttgtctacactggtgtgtaca

SEQ ID NO: 31901 - DNA, 75 bp, Artificial Sequence
  Synthetic
cagagaagccgaaggacatggaagtgaccactcttgaggatgcgatgaagatgaggctaaaacgaatttgcctga

SEQ ID NO: 31902 - DNA, 75 bp, Artificial Sequence
  Synthetic
tgcaacacaaccgatactacgtgctggaagagaaaacatctctgtggagtgcaattgaaaatataaggacaacaa

SEQ ID NO: 31903 - DNA, 75 bp, Artificial Sequence
  Synthetic
tagaccaccaacaaagcatgataaaggccagccaggtcgacgaggcactgctatcgttgggtgcacccggacctt

SEQ ID NO: 31904 - DNA, 75 bp, Artificial Sequence
  Synthetic
ttgggtgcacccggaccttcctggaagtagggtgtggggatttgcttggtttgaaaaaactgctttgatttctct

SEQ ID NO: 31905 - DNA, 75 bp, Artificial Sequence
  Synthetic
agcaaaaacaagcagttaacgcttcacaagagaaatggctcaccaggttgcagcaggtaactccttggacacact

SEQ ID NO: 31906 - DNA, 75 bp, Artificial Sequence
  Synthetic
atgcatcggtagaatctctccccatgtgagggaaatggagtactgccactcagataaaacatgcaaccgtatttg

SEQ ID NO: 31907 - DNA, 75 bp, Artificial Sequence
  Synthetic
gaagacagtgagggatgagccaacatatagcactgaagaactgcttcaagtggcgctggtatataaatatgtcac

SEQ ID NO: 31908 - DNA, 75 bp, Artificial Sequence
  Synthetic
aaagagggctccagaagcatttattttgatatcccagagattaaaaggtggaaagtacgacccgcaaaacgtgaa

SEQ ID NO: 31909 - DNA, 75 bp, Artificial Sequence
  Synthetic
gaaatgtttcaaacagaaagacggtctgagagaaatctcagagtacatctgttcattggacaaagaagggaagat

SEQ ID NO: 31910 - DNA, 75 bp, Artificial Sequence
  Synthetic
ggtcctatcaagcatgctggttcttagcagccaagtgctaaacaaaactgtgcttgtagagctgattgctgggct

SEQ ID NO: 31911 - DNA, 75 bp, Artificial Sequence
  Synthetic
cagtggaaaaaacaaatgtgatgtgctgagtgtgcaagctaatgacatccaattgtatgaatctgattcagagga

SEQ ID NO: 31912 - DNA, 75 bp, Artificial Sequence
  Synthetic
cgagcagagggacctttggttggaggaggtgaccagacagctcaacacattgacccctgtgatacgaggcaagtt

SEQ ID NO: 31913 - DNA, 75 bp, Artificial Sequence
  Synthetic
cgacactgttgaagagaaagaggtctgcgggctggtgaagcagcggatcgaggcttttatggagctagaaaagat

SEQ ID NO: 31914 - DNA, 75 bp, Artificial Sequence
  Synthetic
ggctaagagttccgggtgtaaatatgacaaaaggatgtacatgaaaggattgttaaaagaactgtgtggaatact

SEQ ID NO: 31915 - DNA, 75 bp, Artificial Sequence
  Synthetic
gcagggacagcaggtgctgaaggtcaaagggctcacctaccagatcctcgtgggcgtcggagaacaattgtacca

SEQ ID NO: 31916 - DNA, 75 bp, Artificial Sequence
  Synthetic
actcctgaagagtgtcgaataatccagctggaatcagaatgcatcatcagagacaacctctaacaaccttcttag

SEQ ID NO: 31917 - DNA, 75 bp, Artificial Sequence
  Synthetic
taacaaccttcttagagaggcatggctctgtgcaaggaggcagggttaataggaaaaaactgctttgatttctct

SEQ ID NO: 31918 - DNA, 75 bp, Artificial Sequence
  Synthetic
agcaacaacaagcagttgttcaacatgcagtcctctcgcaaagcaccaaaccctcgatctagcaatgacgaggaa

SEQ ID NO: 31919 - DNA, 75 bp, Artificial Sequence
  Synthetic
atggagatagacaccaaaaggtccaaaatcgaagtcgaccctctcgcaaacaagcgaaagtatgaggaatttaag

SEQ ID NO: 31920 - DNA, 75 bp, Artificial Sequence
  Synthetic
gcacaaatggtgtcgctggctaacaaagcgaaagtggatatgactgtccattacaatgccagcgtcataggaact

SEQ ID NO: 31921 - DNA, 75 bp, Artificial Sequence
  Synthetic
ttgtgtttgagtgcgtgtactgatgggaccttaagggatggaagcaaatactcatttttctttaagacccaggac

SEQ ID NO: 31922 - DNA, 75 bp, Artificial Sequence
  Synthetic
aacgaatgggaaatgaaagaggttgtgattgattgcagctcggtgcaggaatgggctaagacaaccatcaatgat

SEQ ID NO: 31923 - DNA, 75 bp, Artificial Sequence
  Synthetic
gctacaagaaaggactggtatccgttcctctcatccttgcaactctgtgtaaagagtgaagacgccatcctgtgg

SEQ ID NO: 31924 - DNA, 75 bp, Artificial Sequence
  Synthetic
caaagaaatgtagtgaccaaaaacttgggcgtgtctcctgtgtgtgagccttacgccgttggatacaacataaaa

SEQ ID NO: 31925 - DNA, 75 bp, Artificial Sequence
  Synthetic
gacaaacttaaaaagagccgtcccttgtcaattggaccactcaaccatctagaccactggctagggctatacact

SEQ ID NO: 31926 - DNA, 75 bp, Artificial Sequence
  Synthetic
gagcgctctgtcgggaaagggaaaaaactttctcagagagcagcagctgggatccgtgagcgtcttgaaaagaat

SEQ ID NO: 31927 - DNA, 75 bp, Artificial Sequence
  Synthetic
ctcatgcgccagacaataggccagtcccaaaaagctatgctaagacaaatcttcgatgggaaaacctcctacatc

SEQ ID NO: 31928 - DNA, 75 bp, Artificial Sequence
  Synthetic
agaacattggcacacagctactgctcaataaagccgcacatcgagaatcagtttgtactgccttactctgtgatc

SEQ ID NO: 31929 - DNA, 75 bp, Artificial Sequence
  Synthetic
gctgtcactgacaactttgacggggcaaatatgtctgacgagtgggtattcaagaagatctcagaggcaagcgag

SEQ ID NO: 31930 - DNA, 75 bp, Artificial Sequence
  Synthetic
aagatactcctcactgggcccagccaagaatggaagccatttatggcacaaatactcatccattgcaccttccgc

SEQ ID NO: 31931 - DNA, 75 bp, Artificial Sequence
  Synthetic
agtatgcatgaagacttgggagtcctctctgcaatgtttggtatggagttccagccgagaaaagcctttgggaaa

SEQ ID NO: 31932 - DNA, 75 bp, Artificial Sequence
  Synthetic
ttctgctcatcctcagacctcaaagtccttggctcacagaagatccaataccacttctggtctaaaccacaaaga

SEQ ID NO: 31933 - DNA, 75 bp, Artificial Sequence
  Synthetic
ggtgcaccaaggaatctagggggtgcaagaagaggccagatttctacaagacccagcttccgtggtgtgaggaca

SEQ ID NO: 31934 - DNA, 75 bp, Artificial Sequence
  Synthetic
acctacaatcagtattcaagcctggagcagctggaaaaggcatgtggcactggtaccagtgagagcttggtggat

SEQ ID NO: 31935 - DNA, 75 bp, Artificial Sequence
  Synthetic
gctctgaatgctgaattcgaggagtactctcgtctgacgcaggaaggcacagggcacttcttcgagaagggtggt

SEQ ID NO: 31936 - DNA, 75 bp, Artificial Sequence
  Synthetic
gaaaatgaattcaagggctctgtggttgccagcggacgactgcttttcgaggcataggcctggctctgctttgtt

SEQ ID NO: 31937 - DNA, 75 bp, Artificial Sequence
  Synthetic
aggcctggctctgctttgtttggcttgatctcttttcgcgctttttgtgtttgaaaaaactgctttgatttctct

SEQ ID NO: 31938 - DNA, 75 bp, Artificial Sequence
  Synthetic
agcaaaaacaagcagtaattgtcaatcatggagcgattcagacccaaaacaatcagcaccgagatatggcagatg

SEQ ID NO: 31939 - DNA, 75 bp, Artificial Sequence
  Synthetic
tcggaacattcgactgagtggatatctgccagcagtccccacgagatgcgaattttagagtgtgtgaaatataca

SEQ ID NO: 31940 - DNA, 75 bp, Artificial Sequence
  Synthetic
gtatgttgccacatcagtgatatgcatctgcataatgggcttccaaggtacatcctgctcacatggtgcccgaaa

SEQ ID NO: 31941 - DNA, 75 bp, Artificial Sequence
  Synthetic
gaagttgtagattcagtaatgagacaaaaccagatggtgtttgcaaggccaaacattcctgacatgctggacctg

SEQ ID NO: 31942 - DNA, 75 bp, Artificial Sequence
  Synthetic
aagactaaactgggtctctatgtaaagatctacaccaatgaagatcaacccaaagactatgattccgcaccgaac

SEQ ID NO: 31943 - DNA, 75 bp, Artificial Sequence
  Synthetic
gaaatgatcctcaggatgaccaccacaggacggtttagccctgctactctcgaatacttggatccatctcaatct

SEQ ID NO: 31944 - DNA, 75 bp, Artificial Sequence
  Synthetic
caagatgtgagaaactttttggtgacattctacaatgaatgcctagaatcaaacctttacgaaaggattgcaaga

SEQ ID NO: 31945 - DNA, 75 bp, Artificial Sequence
  Synthetic
gttcagaatgaagagcctgttccatttgctgtccctttgacagtggagacgttgctcctacaggacacggatctt

SEQ ID NO: 31946 - DNA, 75 bp, Artificial Sequence
  Synthetic
gatctgataccaaatttagaggttagcggtacaataccaccagtaaagggagacagatggagccaaatgaagact

SEQ ID NO: 31947 - DNA, 75 bp, Artificial Sequence
  Synthetic
ctgccaaaactcaagaccccaatagggagaccagcaaaatggggtgcttggctggcaggcaaagaggcaagattc

SEQ ID NO: 31948 - DNA, 75 bp, Artificial Sequence
  Synthetic
aaagtctttgatgagagcacagaccaagtggtggctgcaagatttctagcggactataccgacactgtctgtgta

SEQ ID NO: 31949 - DNA, 75 bp, Artificial Sequence
  Synthetic
agagaatctcatgccactccaaagaccatcattgagaccgttctagcatcattgagagcattctcagaggggagg

SEQ ID NO: 31950 - DNA, 75 bp, Artificial Sequence
  Synthetic
cccaaaaggacaaagatccaagaagaccttcaagcatttgggatcggtatcaagaagaggaaaaaacaggacgaa

SEQ ID NO: 31951 - DNA, 75 bp, Artificial Sequence
  Synthetic
gaggtcagactgaaatcttcggtagatgattggaaacgagcatcttttccgatggaagaagcctcagagccagag

SEQ ID NO: 31952 - DNA, 75 bp, Artificial Sequence
  Synthetic
tgggtagtagaagaactcgaagaactagaaaggcccacagacatggaatggctcactttagatgataactacatc

SEQ ID NO: 31953 - DNA, 75 bp, Artificial Sequence
  Synthetic
catactattgtggatgaacatgcaacagaagcagtcaactcatacaaggacatagttaccaaactttgggtgagc

SEQ ID NO: 31954 - DNA, 75 bp, Artificial Sequence
  Synthetic
gcactcattgaaaggatgcaggttgccgcaacgagagcatttaatgaactgcacacagacagagccaaagttacc

SEQ ID NO: 31955 - DNA, 75 bp, Artificial Sequence
  Synthetic
acagtccctataataactaggaagtcgtggaagacacattcactttcacaactatgggggtttgtcattgttggc

SEQ ID NO: 31956 - DNA, 75 bp, Artificial Sequence
  Synthetic
ccgcatcacatcaaacaagaaacagatagaatccccatcgtcactgtggagttggtttcagaagacaaccctgaa

SEQ ID NO: 31957 - DNA, 75 bp, Artificial Sequence
  Synthetic
aaataccccaaccactcacactttaaattcctgtaccacaagggaaatgattctgtggggcatgaggacgttctg

SEQ ID NO: 31958 - DNA, 75 bp, Artificial Sequence
  Synthetic
gtgagagtcacttcaattgccaaatacaagctgttcaccttctcaactatcagaagagtatatatacaaccttgt

SEQ ID NO: 31959 - DNA, 75 bp, Artificial Sequence
  Synthetic
agcgtgttcagcaagctgattctcaagcaatctgcagagaagagagagaaggactttagcctggaaaatcgcata

SEQ ID NO: 31960 - DNA, 75 bp, Artificial Sequence
  Synthetic
gagatcatgatcaacgggaggccagtgcttgtcacctggaggagttggataattagggtactctgcattgagtat

SEQ ID NO: 31961 - DNA, 75 bp, Artificial Sequence
  Synthetic
ctgatggccatacataacaacccacaaatggaagggtttctcgcaaacatcaggcgtctgcatatggcacggcac

SEQ ID NO: 31962 - DNA, 75 bp, Artificial Sequence
  Synthetic
gctatgatggagaagtcctgtgtgttcctgccatttggctctgcacctgaggacaaatgtaatgagtgcatcata

SEQ ID NO: 31963 - DNA, 75 bp, Artificial Sequence
  Synthetic
aacaacccagtggttgcgtttctggctaggacctggaatgagttgccaaatgtttacatgtaggaaaaaactgct

SEQ ID NO: 31964 - DNA, 75 bp, Artificial Sequence
  Synthetic
ggttgcgtttctggctaggacctggaatgagttgccaaatgtttacatgtaggaaaaaactgctttgatttctct

SEQ ID NO: 31965 - DNA, 75 bp, Artificial Sequence
  Synthetic
ccatcaacactccaggctcacggattaagttaggttccgccgaagcgggctaaccaggcccctagtaggaggcgc

SEQ ID NO: 31966 - DNA, 75 bp, Artificial Sequence
  Synthetic
taagttaggttccgccgaagcgggctaaccaggcccctagtaggaggcgcctatcccgtgagcccttaccccaca

SEQ ID NO: 31967 - DNA, 75 bp, Artificial Sequence
  Synthetic
gattgagtggagctggagctgggaaggaccgagtacggtccaatcgagaagaaccctgatgaacattccaggcct

SEQ ID NO: 31968 - DNA, 75 bp, Artificial Sequence
  Synthetic
cttcggtagatttggatatatccaccagtgaaggcggggtcgtgggcacaggccccctagtccacacagcctgat

SEQ ID NO: 31969 - DNA, 75 bp, Artificial Sequence
  Synthetic
ggccccctagtccacacagcctgatagggtcctgccgcaggatctgtgggtgcggctgtacatgtaccatggaag

SEQ ID NO: 31970 - DNA, 75 bp, Artificial Sequence
  Synthetic
tttctgtctcaagttctacccaaaccagaagcagatcacgatcccgcagacgccgagcttctcgctcgcgttcgc

SEQ ID NO: 31971 - DNA, 75 bp, Artificial Sequence
  Synthetic
gacgccgttccggggtcaccgtcgtcgttccaacttcgactgatggtggccgtaggcggcggcgtaatcggcaac

SEQ ID NO: 31972 - DNA, 75 bp, Artificial Sequence
  Synthetic
gtgattatgcttggccttatattgatactggcttgtcatacgccgttggggctctcactccggttggatcgccgt

SEQ ID NO: 31973 - DNA, 75 bp, Artificial Sequence
  Synthetic
ctcacgacccgtaccgccggagtcagaatctcggcaggcttattgacggccctctctcatgggctgctgattgtt

SEQ ID NO: 31974 - DNA, 75 bp, Artificial Sequence
  Synthetic
tccggaagattcctcttttgggacctcccgcaggttggtgtgttcgggttgttggtagagccgttcgcgtatgcg

SEQ ID NO: 31975 - DNA, 75 bp, Artificial Sequence
  Synthetic
aggactttgtcaatggcctaacgcgctccacagtcggcatgtcaatctttctcctgtgtcttttcagtgttgcgg

SEQ ID NO: 31976 - DNA, 75 bp, Artificial Sequence
  Synthetic
ctcctgtgtcttttcagtgttgcggttgacgggtaccgacacgtgaaaattggtaaccactatcagattaccaac

SEQ ID NO: 31977 - DNA, 75 bp, Artificial Sequence
  Synthetic
tgctgccaggatggtgatgtgctttactccaccaaggagtttgcttaccatcttcctggttgcgtcatctgtact

SEQ ID NO: 31978 - DNA, 75 bp, Artificial Sequence
  Synthetic
gaggaccagtgttgggatccagtaactgttttcttgagtgtgaagcctaacggctccacttacgatcatcacttg

SEQ ID NO: 31979 - DNA, 75 bp, Artificial Sequence
  Synthetic
aggaaccatgtgctgggtcttggtattggtgccgcagtatgtgacatgttggacatcaatgatcactgtggtatg

SEQ ID NO: 31980 - DNA, 75 bp, Artificial Sequence
  Synthetic
ggacatcaatgatcactgtggtatgctcgctgtgtcactgatatctttgtttgatattcttcccactcatatcac

SEQ ID NO: 31981 - DNA, 75 bp, Artificial Sequence
  Synthetic
ctcgctgtgtcactgatatctttgtttgatattcttcccactcatatcactctcaacactactgccttttgctat

SEQ ID NO: 31982 - DNA, 75 bp, Artificial Sequence
  Synthetic
cttgaggttgattactccccttttggcactatcgttgggtgggtgaattgggccgttaatgaggcaggggtggtt

SEQ ID NO: 31983 - DNA, 75 bp, Artificial Sequence
  Synthetic
acatgggctttgtcgattgtcacccgcataccttatgcggtgtttcacttgatggagcttagttccacccctttc

SEQ ID NO: 31984 - DNA, 75 bp, Artificial Sequence
  Synthetic
cttattgctgttgtgtggttcgccatccaggggcagtgggccagattactcttgctcgctgtcctggttgtcgag

SEQ ID NO: 31985 - DNA, 75 bp, Artificial Sequence
  Synthetic
tccaggggcagtgggccagattactcttgctcgctgtcctggttgtcgaggccactacgacgggttgtgcacggc

SEQ ID NO: 31986 - DNA, 75 bp, Artificial Sequence
  Synthetic
gccactacgacgggttgtgcacggcacgatgacgcctcgcgcgatgctacttccaaatggggccatatgactagt

SEQ ID NO: 31987 - DNA, 75 bp, Artificial Sequence
  Synthetic
ttccaaatggggccatatgactagttgttcattgcaaatgatcccttgcaagtgccgcaatgttacccactctgt

SEQ ID NO: 31988 - DNA, 75 bp, Artificial Sequence
  Synthetic
cgaggacatgtggtgctttggtgatgccgtggtgaatgtacccatttaccgcgaccgctcccagggtaagaacgt

SEQ ID NO: 31989 - DNA, 75 bp, Artificial Sequence
  Synthetic
gtccttggcaaagctgccttacctaccagggttgcgtgggtgcgagtacaaggtgaacggaacatggagctgttg

SEQ ID NO: 31990 - DNA, 75 bp, Artificial Sequence
  Synthetic
cagcctcatggatcgggatcctgtgtgcaagcgacatcactgccccacggattgcacttggaaggacccggccct

SEQ ID NO: 31991 - DNA, 75 bp, Artificial Sequence
  Synthetic
cacgtgggaaagatgtggtgtggtttcctgcatcacgtcctaccacgcggggaatggttccgccctttgtgctgc

SEQ ID NO: 31992 - DNA, 75 bp, Artificial Sequence
  Synthetic
ctggattgttagggcggctatgtgggatacatttgcggtttcctttgatgataaaaattggattaatgtaagata

SEQ ID NO: 31993 - DNA, 75 bp, Artificial Sequence
  Synthetic
caacaaatcaatgtcaaacaatattaccactgctgctagattgccaggcgctcgccggctttatagcggcatgtg

SEQ ID NO: 31994 - DNA, 75 bp, Artificial Sequence
  Synthetic
ggttttctctcctaatggaacttactttcctttgggtgatctggctacagggttaatttctaaggctaggcgtga

SEQ ID NO: 31995 - DNA, 75 bp, Artificial Sequence
  Synthetic
tcctaacatgcagattatctactctggtggtgggtccttagctgtgccgcatttagaaactactcttttcttagc

SEQ ID NO: 31996 - DNA, 75 bp, Artificial Sequence
  Synthetic
atttagaaactactcttttcttagctttagttgctggcgttttcaagtctcgctcagccttgctctggatactct

SEQ ID NO: 31997 - DNA, 75 bp, Artificial Sequence
  Synthetic
tcatttccttgtggaaatccgcgacagctgctctactagctccgtgggtcacagctgttgcgattgcttccacct

SEQ ID NO: 31998 - DNA, 75 bp, Artificial Sequence
  Synthetic
gggatgattggtacatcagacttatcatctatctctttctttgcaaaagtcgtagaccttacagatttatgctat

SEQ ID NO: 31999 - DNA, 75 bp, Artificial Sequence
  Synthetic
gcaataaatttcctttgactattctcctcctgctgctgaatgtcttgggagttactgctttagatgttgattatt

SEQ ID NO: 32000 - DNA, 75 bp, Artificial Sequence
  Synthetic
ctactcatgctcctcttgcgtatgtgactttgatcgctctcgttggttctggcttgttcgctactacagcaccat

SEQ ID NO: 32001 - DNA, 75 bp, Artificial Sequence
  Synthetic
cagttagctttacttgtcattacttgcttgagtggttgagttgcattagctatagtcttgagtctaatcactata

SEQ ID NO: 32002 - DNA, 75 bp, Artificial Sequence
  Synthetic
tatagtcttgagtctaatcactatatcttcatgcttggtctggttttctctccttctttggtgttagatgttagt

SEQ ID NO: 32003 - DNA, 75 bp, Artificial Sequence
  Synthetic
atgggcttgctagctatacattgtagtgtctggataatagctgtcactgtcccaaatttcatgctccctaaacat

SEQ ID NO: 32004 - DNA, 75 bp, Artificial Sequence
  Synthetic
cggggaacttatgaggtgctgctcaaatttgcgaaggtcctacctgcaggcaggtgggtccaacgcgctattctt

SEQ ID NO: 32005 - DNA, 75 bp, Artificial Sequence
  Synthetic
tatgtagcaggtgaagctggtgtgttgtggtatcagcatttggggcaacaactcgacctgttgcccggggttgat

SEQ ID NO: 32006 - DNA, 75 bp, Artificial Sequence
  Synthetic
cagcttaacggtgatccctatggtgccattcgcagccgtttggaatactttgaggatgccggacataggtacgca

SEQ ID NO: 32007 - DNA, 75 bp, Artificial Sequence
  Synthetic
tgaggatgccggacataggtacgcatgtggtgatctcgtgcgggggagacccgtccttggccgccagggttccct

SEQ ID NO: 32008 - DNA, 75 bp, Artificial Sequence
  Synthetic
ggtggccttcggctggtcaacccttccgtccgggtttgctccgtgttcacctattggtgttcgacaagtttccag

SEQ ID NO: 32009 - DNA, 75 bp, Artificial Sequence
  Synthetic
ccgtccgggtttgctccgtgttcacctattggtgttcgacaagtttccaggcgtggagagctcaagacgtgggct

SEQ ID NO: 32010 - DNA, 75 bp, Artificial Sequence
  Synthetic
gtctcgctcacgggaattgacactgcactttgggagggcaatattttcaccatgggtaccatgtctcgccgttat

SEQ ID NO: 32011 - DNA, 75 bp, Artificial Sequence
  Synthetic
atggggttcacatgtggcgggttgctccacacggtttgtcatggagctggacaccgctccttggcatctacgtct

SEQ ID NO: 32012 - DNA, 75 bp, Artificial Sequence
  Synthetic
ggacccctgccgcctgtggtctttgatgatggcgcagactatgccatgcacatggcacctcggggtgccaaggat

SEQ ID NO: 32013 - DNA, 75 bp, Artificial Sequence
  Synthetic
atgatggcgcagactatgccatgcacatggcacctcggggtgccaaggatctggacgtctgcacctgtgcagcca

SEQ ID NO: 32014 - DNA, 75 bp, Artificial Sequence
  Synthetic
cttccggattcatggttacccgagttggtacagtgattcctctcaaattgtcggctcaaaacctgtgggcggttc

SEQ ID NO: 32015 - DNA, 75 bp, Artificial Sequence
  Synthetic
tggtacagtgattcctctcaaattgtcggctcaaaacctgtgggcggttcaggctcctcttgcgctctcaatctg

SEQ ID NO: 32016 - DNA, 75 bp, Artificial Sequence
  Synthetic
caagggcagttctggagcaccagtgttgtgttcagcgggccatgtcatcgctatggtgcaacgctgcagagccgt

SEQ ID NO: 32017 - DNA, 75 bp, Artificial Sequence
  Synthetic
ttccggctctgtcgcgtatgtctgcaccactcccgtcagacacaccgctgtgggtaaatccactcccactaggac

SEQ ID NO: 32018 - DNA, 75 bp, Artificial Sequence
  Synthetic
tgatatgtcggcccctccagctgtaggaactagttgggaggtccagactgtctatgccccaacagggtcagggaa

SEQ ID NO: 32019 - DNA, 75 bp, Artificial Sequence
  Synthetic
aaccactttgctgccgatgcattatgtccgcaagggctataatgtcctcgtgctcaacccctctgttgcaaccac

SEQ ID NO: 32020 - DNA, 75 bp, Artificial Sequence
  Synthetic
aatgtccatgcctgcttacatgaaggatgcatttggcgtaaacccaaatttgaaagctgctgagatgactctcaa

SEQ ID NO: 32021 - DNA, 75 bp, Artificial Sequence
  Synthetic
cacaggtgctcggctcacttattctacttatggcaggtttctggcagatgggaaaaataacataaattttgatgt

SEQ ID NO: 32022 - DNA, 75 bp, Artificial Sequence
  Synthetic
ggaaaaataacataaattttgatgtggttatttgtgatgagtgccatgctaccgattcaactaccattctgggca

SEQ ID NO: 32023 - DNA, 75 bp, Artificial Sequence
  Synthetic
accgattcaactaccattctgggcatcggcgctgtcctttctatcactcccaatacgaaatgtaaattagtcctt

SEQ ID NO: 32024 - DNA, 75 bp, Artificial Sequence
  Synthetic
cttgccactgctacgccacctggccagcctgttttaccacaccctaacatacaggagcttgaattagatgatgtt

SEQ ID NO: 32025 - DNA, 75 bp, Artificial Sequence
  Synthetic
ggtgatatcaatttccatgggaaaaaacttaaattggcttcctataaaactggtagacatttaattttccaaaac

SEQ ID NO: 32026 - DNA, 75 bp, Artificial Sequence
  Synthetic
agtaagaagcactgtgaagcgctcgctgctgacctccgttctaggggcattcatgcggtggcttactatcgcgga

SEQ ID NO: 32027 - DNA, 75 bp, Artificial Sequence
  Synthetic
ctgctgacctccgttctaggggcattcatgcggtggcttactatcgcggactccccatcagtaccattcctgttg

SEQ ID NO: 32028 - DNA, 75 bp, Artificial Sequence
  Synthetic
tcatgcggtggcttactatcgcggactccccatcagtaccattcctgttgcgggagattgcgtggtgatcgccac

SEQ ID NO: 32029 - DNA, 75 bp, Artificial Sequence
  Synthetic
tgatgctctgatgactggttacaccgggaacttcgacagtgttactgactgcaatttggccacaattgaagatgt

SEQ ID NO: 32030 - DNA, 75 bp, Artificial Sequence
  Synthetic
tgagattgattttgacccaacaataacagtcactctcaaaacagttccagctaactccgttacgcgggcacagag

SEQ ID NO: 32031 - DNA, 75 bp, Artificial Sequence
  Synthetic
acagtcactctcaaaacagttccagctaactccgttacgcgggcacagagacgtggtcgcactgggcgtggtagt

SEQ ID NO: 32032 - DNA, 75 bp, Artificial Sequence
  Synthetic
cccggcgtctactattatgtaacccaggatacacccctttccggcactgtttctgaggcttccgtgtttggtgca

SEQ ID NO: 32033 - DNA, 75 bp, Artificial Sequence
  Synthetic
ttcgacagtggtatggcgtggtttggaatgtcacctgccgaagtgcttgaacacctcgaccactaccgggtgact

SEQ ID NO: 32034 - DNA, 75 bp, Artificial Sequence
  Synthetic
cctggcctgcctatcctgaagggtgtgctttcggagatatctgccttttatgggtgccttgggtgggtgacacct

SEQ ID NO: 32035 - DNA, 75 bp, Artificial Sequence
  Synthetic
gctttcctatccaaggctcgcatacattccacctcttttacgtggctcaatgccgcgcagaggcagatctgctat

SEQ ID NO: 32036 - DNA, 75 bp, Artificial Sequence
  Synthetic
gagaatggctgtaatccacctgatccccagtctccaatatggaagggtgttcgtgtcacaggcgaaccatgtaga

SEQ ID NO: 32037 - DNA, 75 bp, Artificial Sequence
  Synthetic
atactttgccatcttgaggggcaccaacccctccaaggtcctgttcctgaagttgtgaatcaactgcagcttgca

SEQ ID NO: 32038 - DNA, 75 bp, Artificial Sequence
  Synthetic
tttaccgaattggatgtttggggtgccggggttgctgcttcggcggcttcaatgtttgctctcggtctcgccttg

SEQ ID NO: 32039 - DNA, 75 bp, Artificial Sequence
  Synthetic
gactacttcggatctgtagtgataacatctgctatggtccttgatagtggcgagcctcaaaatgccccagagcct

SEQ ID NO: 32040 - DNA, 75 bp, Artificial Sequence
  Synthetic
aatgctggggtctcccagaattttccgagccaatagtcaccagatgcagaatctgggttgaaagggtgcaactct

SEQ ID NO: 32041 - DNA, 75 bp, Artificial Sequence
  Synthetic
gggccgccggaatggcaaagtccggtgccgtcaatgacattaacaattggtttgcttcaaatttgattacaatag

SEQ ID NO: 32042 - DNA, 75 bp, Artificial Sequence
  Synthetic
cctcagctttacaattgggcgctggcatattaatatctccagacaatccactccttgctggcttgctcagttttt

SEQ ID NO: 32043 - DNA, 75 bp, Artificial Sequence
  Synthetic
ctggcgccgttacactcccacttagcaggtcgcttcaggcgatagtgatcactattggcgccattttgactgctc

SEQ ID NO: 32044 - DNA, 75 bp, Artificial Sequence
  Synthetic
actattggcgccattttgactgctcgcttgactacagcagagggcgcggtgtttatcgcaggggctaccctcgct

SEQ ID NO: 32045 - DNA, 75 bp, Artificial Sequence
  Synthetic
gggttccaattgtctgggacccctctgctgtcttttctgttctccattcttggcacttacgcttcctttgtacct

SEQ ID NO: 32046 - DNA, 75 bp, Artificial Sequence
  Synthetic
tggcacttacgcttcctttgtacctgcctttggagtagttttcaaacttcttgatggtcagctcccttccaccgt

SEQ ID NO: 32047 - DNA, 75 bp, Artificial Sequence
  Synthetic
cgagcttgctagtttgattaactgtgcctttgccccgggtgctgctgtggcggccatcgctgtcgcggtgggtgc

SEQ ID NO: 32048 - DNA, 75 bp, Artificial Sequence
  Synthetic
gcctttgccccgggtgctgctgtggcggccatcgctgtcgcggtgggtgctatagcattaactcagggcacaggg

SEQ ID NO: 32049 - DNA, 75 bp, Artificial Sequence
  Synthetic
cggccatcgctgtcgcggtgggtgctatagcattaactcagggcacaggggtagtctggatgaaccgtcttctgt

SEQ ID NO: 32050 - DNA, 75 bp, Artificial Sequence
  Synthetic
ccatggtcgcaaaatctaatgtcatctctccagattactttgttgaagcacgcgacatcaggttaaccattaaga

SEQ ID NO: 32051 - DNA, 75 bp, Artificial Sequence
  Synthetic
ctttgtttgagaagatccatccttggaacgtcgttaaaacagccatcaaattcctcacaactccaactgatgtgc

SEQ ID NO: 32052 - DNA, 75 bp, Artificial Sequence
  Synthetic
ttcctcacaactccaactgatgtgcagtgcgggtttaacatctttgactgcttctacagtgtttggcatgtgctc

SEQ ID NO: 32053 - DNA, 75 bp, Artificial Sequence
  Synthetic
tgtaagtgggcaaaagccctttatgaggcactaatcggtggtgtgaaacgtgccatttccctcccgggtgtccct

SEQ ID NO: 32054 - DNA, 75 bp, Artificial Sequence
  Synthetic
gttgccggctgtcaagctggctacacgggtccctggaagggcgagggcatgatcaccactcggtgtgggtgcggt

SEQ ID NO: 32055 - DNA, 75 bp, Artificial Sequence
  Synthetic
agagagctggtttattcggtagagtttggcaccgctaaagttatcagcggatccaagctttgccggaattactgg

SEQ ID NO: 32056 - DNA, 75 bp, Artificial Sequence
  Synthetic
ttggcaccgctaaagttatcagcggatccaagctttgccggaattactggacctctgccgtcccaatcaacaaca

SEQ ID NO: 32057 - DNA, 75 bp, Artificial Sequence
  Synthetic
ccacttctggtgtagccaaacctgctccgtcttcttggaagacgatgactgtacaagttggctttggcttcgtgg

SEQ ID NO: 32058 - DNA, 75 bp, Artificial Sequence
  Synthetic
gtacaagttggctttggcttcgtggaataccgtatggacggtgatgtgatctctgtcgttgccacctcttctccg

SEQ ID NO: 32059 - DNA, 75 bp, Artificial Sequence
  Synthetic
gacgtaaccgtgccaagggttattcccagggtgttcagtgcggccgccatcaatggccgtcgcactgatccttac

SEQ ID NO: 32060 - DNA, 75 bp, Artificial Sequence
  Synthetic
ccagggtgttcagtgcggccgccatcaatggccgtcgcactgatccttactctggagaaccagccaccccttggc

SEQ ID NO: 32061 - DNA, 75 bp, Artificial Sequence
  Synthetic
gtggtgaagtttggagggatactggcagtggcagggagcgcattaaacttccctacgctcttcacgattaccaga

SEQ ID NO: 32062 - DNA, 75 bp, Artificial Sequence
  Synthetic
ccgactctacggtcgctcgctctttcgagatgggcggtctaagcccaaaggaagatcctttcaccactgatgttg

SEQ ID NO: 32063 - DNA, 75 bp, Artificial Sequence
  Synthetic
cgagatgggcggtctaagcccaaaggaagatcctttcaccactgatgttggggttgtccatatccagcaggctgt

SEQ ID NO: 32064 - DNA, 75 bp, Artificial Sequence
  Synthetic
ttctaacgagcgcgctgaggacatcctcgagggcccgtctgacactccacttgaccctcccgatgttgccgctga

SEQ ID NO: 32065 - DNA, 75 bp, Artificial Sequence
  Synthetic
acgaagcagattggatcgagaggctgctcaacgctcagatcccggcactgacgggttttgggcgggcctgcagcc

SEQ ID NO: 32066 - DNA, 75 bp, Artificial Sequence
  Synthetic
ttttggacaattacaggtttttgagactccacccccaccttacactaagccacattctgttagctttgtgtccct

SEQ ID NO: 32067 - DNA, 75 bp, Artificial Sequence
  Synthetic
cagctcgccaggagctcccgtgtcaacgtcacaaccaaccgacgatggtagcactaaggttgttttgtctggccg

SEQ ID NO: 32068 - DNA, 75 bp, Artificial Sequence
  Synthetic
acgtcacaaccaaccgacgatggtagcactaaggttgttttgtctggccggctcacgcccccagacagaccaccc

SEQ ID NO: 32069 - DNA, 75 bp, Artificial Sequence
  Synthetic
gcactaaggttgttttgtctggccggctcacgcccccagacagaccaccctctgtggtgtcttactccagcatgc

SEQ ID NO: 32070 - DNA, 75 bp, Artificial Sequence
  Synthetic
catcacttgaacctagtgctacaggcacggaatactcctgttcgggctggcgagatgcatctttgcctgctcctt

SEQ ID NO: 32071 - DNA, 75 bp, Artificial Sequence
  Synthetic
ctgaagactctctttccgccttgggagcggctgctcccaaggagtgcagctacagctacatttgggatggactcc

SEQ ID NO: 32072 - DNA, 75 bp, Artificial Sequence
  Synthetic
tacagctacatttgggatggactcccttatgttgctcatcttgcaaagcgatccttctctgcggttgccgccata

SEQ ID NO: 32073 - DNA, 75 bp, Artificial Sequence
  Synthetic
atccttctctgcggttgccgccataacacacggtctcgtgtcccgcaaccttgtctatgtcaccaagcctgagaa

SEQ ID NO: 32074 - DNA, 75 bp, Artificial Sequence
  Synthetic
tgttttggaacggatgaagaaagtgactcgattccgaccacctcctactccgaacccccacttggaagctctgac

SEQ ID NO: 32075 - DNA, 75 bp, Artificial Sequence
  Synthetic
actcgattccgaccacctcctactccgaacccccacttggaagctctgacgaaacaagccgtgcggctggtttct

SEQ ID NO: 32076 - DNA, 75 bp, Artificial Sequence
  Synthetic
cgaacccccacttggaagctctgacgaaacaagccgtgcggctggtttctacattggacttggggcccatgacct

SEQ ID NO: 32077 - DNA, 75 bp, Artificial Sequence
  Synthetic
attgggaggcttctgctatcacatcggcgcgaactgcccgttctgccgtcactggccatactggcggtgatgtta

SEQ ID NO: 32078 - DNA, 75 bp, Artificial Sequence
  Synthetic
agagcggtgcggctcgcaaggatgttgaacagctctacaagactctggagacagagtctctgcagaggccttaca

SEQ ID NO: 32079 - DNA, 75 bp, Artificial Sequence
  Synthetic
atgaggtcgtggtgatgccaaaagctgaagtctttatgcggaataaggctacagagaagccgccgcgcatcatag

SEQ ID NO: 32080 - DNA, 75 bp, Artificial Sequence
  Synthetic
cttaccctcatcttgagactagagttgctgaaaaaatggtactgggcaatataggaccgggcactgttaaaaagg

SEQ ID NO: 32081 - DNA, 75 bp, Artificial Sequence
  Synthetic
tgctcggaaaagcctacggctttgtacctcccaaagatagaatcaacagactcctcacaatgtggcgccggccaa

SEQ ID NO: 32082 - DNA, 75 bp, Artificial Sequence
  Synthetic
atcccatggcttttgcgtgtgacgtgatcaccttcgactccaccataacaccggaggacgtcgatcgtgaagctc

SEQ ID NO: 32083 - DNA, 75 bp, Artificial Sequence
  Synthetic
ggttatatgcatcagctactaaggacgcggctactcgcgccagaatttggaatttgcacaaattctatgcttcag

SEQ ID NO: 32084 - DNA, 75 bp, Artificial Sequence
  Synthetic
aatttgcacaaattctatgcttcaggtcctatggttgatcagcgtggtaattacctcggaacacgcaattgccgt

SEQ ID NO: 32085 - DNA, 75 bp, Artificial Sequence
  Synthetic
gtcctatggttgatcagcgtggtaattacctcggaacacgcaattgccgtgcgtccggggtctttaccacatcca

SEQ ID NO: 32086 - DNA, 75 bp, Artificial Sequence
  Synthetic
gttctaacaccatgactgcttttctgaaggtgaaggctgcggctatgactgcaggttttgttagaccagaattcc

SEQ ID NO: 32087 - DNA, 75 bp, Artificial Sequence
  Synthetic
gcaggttttgttagaccagaattccttgtggctggcgacgacgtcgtcgtagtcactcaggctgaacctgttcct

SEQ ID NO: 32088 - DNA, 75 bp, Artificial Sequence
  Synthetic
ttgtggctggcgacgacgtcgtcgtagtcactcaggctgaacctgttcctgatagggataaaagaaagctcgcaa

SEQ ID NO: 32089 - DNA, 75 bp, Artificial Sequence
  Synthetic
tctttgcgaatgccatgaaggatatgggtgctccggtggaattgcctgctccaaagtactcattggaggacgtca

SEQ ID NO: 32090 - DNA, 75 bp, Artificial Sequence
  Synthetic
ccagctgctccagtaacgtgacaacggggtttactcgagatggccgtcaggtgtttttcctgacgcgcgacccga

SEQ ID NO: 32091 - DNA, 75 bp, Artificial Sequence
  Synthetic
ggggtttactcgagatggccgtcaggtgtttttcctgacgcgcgacccgagcatcccgttcgcacgctgctctgc

SEQ ID NO: 32092 - DNA, 75 bp, Artificial Sequence
  Synthetic
ggaaggtgaagggttcaacccgatgggcgcctggataggcaacctgctgtggcatttcccatgtctttgggtgcg

SEQ ID NO: 32093 - DNA, 75 bp, Artificial Sequence
  Synthetic
tatcatcagtacccacatgcttgagacgtacctcgagtccgactttcccgatgaaattacaactgattggtatgg

SEQ ID NO: 32094 - DNA, 75 bp, Artificial Sequence
  Synthetic
cgtccgctttactccctatgagatgaacagagttgctgccacactcaaagcttgccacatgaagcctttgcgttg

SEQ ID NO: 32095 - DNA, 75 bp, Artificial Sequence
  Synthetic
gtggcggaagcgcgcccggaccatcagggctgcgtgtttccgcaagggaggattgcacaagtttcttgcttacca

SEQ ID NO: 32096 - DNA, 75 bp, Artificial Sequence
  Synthetic
gattgcacaagtttcttgcttaccatctactatcctttgcatctaatgctgtcaggcaacctctcaacccaaaag

SEQ ID NO: 32097 - DNA, 75 bp, Artificial Sequence
  Synthetic
tctactatcctttgcatctaatgctgtcaggcaacctctcaacccaaaagttgtgtcccgattctcggtcgagct

SEQ ID NO: 32098 - DNA, 75 bp, Artificial Sequence
  Synthetic
cggagcggacattgaggaacccattgtaatcgggaaacctccgggcccgccctggtttggggccatagctctctc

SEQ ID NO: 32099 - DNA, 75 bp, Artificial Sequence
  Synthetic
tgtgttggctttgctgttcttcttcctcaaacactgaccactgaccactaaccaattgaccactggctactgatt

SEQ ID NO: 32100 - DNA, 75 bp, Artificial Sequence
  Synthetic
atggattgtgattgaggtgagattttcggcctgcaggaagcgtctcgcagcaggctgtggataccgtctcggcca

SEQ ID NO: 32101 - DNA, 75 bp, Artificial Sequence
  Synthetic
catttagatagggttgatcctcctgggattggtgacgcgcccgggagagtatgtccgccgtagccggcgtaataa

SEQ ID NO: 32102 - DNA, 75 bp, Artificial Sequence
  Synthetic
gccggcgtaataaggggctacccgctttgggttgggttttgggattgcgcaagcacctaattcccatcctaaagt

SEQ ID NO: 32103 - DNA, 75 bp, Artificial Sequence
  Synthetic
atggaagtttcagtctcaagttctacccaaaccagaagtagatcacgatcccgcaagcgacgagcctctcgctct

SEQ ID NO: 32104 - DNA, 75 bp, Artificial Sequence
  Synthetic
cgctcgcgacgccgtcctggggtcaccgttgtggttcctacctccactgatggtggccgcaggcgtcggcgtaat

SEQ ID NO: 32105 - DNA, 75 bp, Artificial Sequence
  Synthetic
tggtggccgcaggcgtcggcgtaatcggcaacgtgactatgcctggccatatatagatactgggttgtcgtattt

SEQ ID NO: 32106 - DNA, 75 bp, Artificial Sequence
  Synthetic
cgtcggtgctgtgactccggttggttcaccatctcatgatccttaccgccggagccagaacatcggccgacttat

SEQ ID NO: 32107 - DNA, 75 bp, Artificial Sequence
  Synthetic
tcaccatctcatgatccttaccgccggagccagaacatcggccgacttattgatggccccctttcttgggctgct

SEQ ID NO: 32108 - DNA, 75 bp, Artificial Sequence
  Synthetic
tgatggccccctttcttgggctgctgactgcctcaggaagattcccgttttggggcctcctgttggctggtgcgc

SEQ ID NO: 32109 - DNA, 75 bp, Artificial Sequence
  Synthetic
tcgagtcgttggcagagccgttcgcgtctgcgaggactttgtcaatggtttgacacgttcgactgtcggcatgtc

SEQ ID NO: 32110 - DNA, 75 bp, Artificial Sequence
  Synthetic
catcttcatcttatgcctatttagtgtttgtgtttctggatatcgtatggttaaggtgggctcgtattatcaact

SEQ ID NO: 32111 - DNA, 75 bp, Artificial Sequence
  Synthetic
taccaactgctgccaggagggtgacgtgctttactccaccaaggagtttgcttaccaccttcccggttgtgtgat

SEQ ID NO: 32112 - DNA, 75 bp, Artificial Sequence
  Synthetic
ctgcactgacgaccaatgctgggatcctgtcactgtttttctcagcgttaaacccaatggttccacttatgatca

SEQ ID NO: 32113 - DNA, 75 bp, Artificial Sequence
  Synthetic
tcacttgcggaaccatgttctcggactgggtgtcggtgcggctgtatgtgatatgcttgacatcaatgaccaatg

SEQ ID NO: 32114 - DNA, 75 bp, Artificial Sequence
  Synthetic
cggtatgctagctgtgtccttgatttctctctttgacattttgcctacacatattcaactcaataccactgctac

SEQ ID NO: 32115 - DNA, 75 bp, Artificial Sequence
  Synthetic
ctgctatttggaggtggattactcaccctttggcaccattgttgggtgggttaattgggctgtgaatgaggcggg

SEQ ID NO: 32116 - DNA, 75 bp, Artificial Sequence
  Synthetic
ggtcgtgacttgggctctgtcaatagttacccgcataccttatgcggtgttccacttgatggagctcagttcgac

SEQ ID NO: 32117 - DNA, 75 bp, Artificial Sequence
  Synthetic
cccgtttctaattgccgttgtgtggttcgcaatacagggacagtgggctagactcctcttgctcgctgttttggt

SEQ ID NO: 32118 - DNA, 75 bp, Artificial Sequence
  Synthetic
tgtcgaggccaccacgacggaatgctcacgccatgatgacatctcaagaaatgccaccaccaaatggggtcacat

SEQ ID NO: 32119 - DNA, 75 bp, Artificial Sequence
  Synthetic
gactagttgttctctgcaaatgattccttgcaagtgtcgcaacgtaacttactctgttgaggacatgtggtgctt

SEQ ID NO: 32120 - DNA, 75 bp, Artificial Sequence
  Synthetic
cggtgacgctgtcgtgaacgtgccaatctatcgtgacaggtcagaaggcaagaacgtgtccttagctaggctgcc

SEQ ID NO: 32121 - DNA, 75 bp, Artificial Sequence
  Synthetic
ttatctaccaggtctccgtgggtgtgaatacaaggtgaacggtacatggagctgttgtagcctcatggaccgtga

SEQ ID NO: 32122 - DNA, 75 bp, Artificial Sequence
  Synthetic
tcctatctgcaaacaacatcactgccctacggactgcacgtggaaggacccttcgctaacgtgggaacgttgtgg

SEQ ID NO: 32123 - DNA, 75 bp, Artificial Sequence
  Synthetic
tgtggtttcctgcattacatcctaccactctgggaacggttcagccgcgtgcgcggcctggatagttagagctgc

SEQ ID NO: 32124 - DNA, 75 bp, Artificial Sequence
  Synthetic
catgtgggatacttttgcgatatcctttgatgataagaattggattaatgtgagatacaacaaatctatggctaa

SEQ ID NO: 32125 - DNA, 75 bp, Artificial Sequence
  Synthetic
caacatcacaaccgccgcgcgccttccgggcgcccgacggctgtacagtggtatgtgggtcttttctcctaatgg

SEQ ID NO: 32126 - DNA, 75 bp, Artificial Sequence
  Synthetic
gacttactttcctttgggtgatctggctactgggcttatctctaaggccagacatgatccgaacatgcagatcat

SEQ ID NO: 32127 - DNA, 75 bp, Artificial Sequence
  Synthetic
ttactctggtgggggttccttagctgtacctcacttggaaactactctgttcttagctttagtagcaggcgtttt

SEQ ID NO: 32128 - DNA, 75 bp, Artificial Sequence
  Synthetic
ccgatcgcggtctacgctgctatggattctctttatctctctctggaaatctgcgacggcggctttactggcccc

SEQ ID NO: 32129 - DNA, 75 bp, Artificial Sequence
  Synthetic
atgggtcactgctgtcgccatcgcttcaacttgggatgaatggtatcttaggctcctcatataccttttcttgtg

SEQ ID NO: 32130 - DNA, 75 bp, Artificial Sequence
  Synthetic
taagagtcgtaggccctaccgtttcatgctttgtaataagtttcccctcactatgctccttttgttgcttaatgt

SEQ ID NO: 32131 - DNA, 75 bp, Artificial Sequence
  Synthetic
gttaggggttactgctttggatgttgattatactactcatattcccttagcttatgtcacctttatcgctcttat

SEQ ID NO: 32132 - DNA, 75 bp, Artificial Sequence
  Synthetic
tggttctggcttgttcgctacgactgcaccgtccgttagcttcacatgtcactaccttttggagtggttgagctg

SEQ ID NO: 32133 - DNA, 75 bp, Artificial Sequence
  Synthetic
cattagctatagtcttgagtctaatcactttctcttcatgctcggtcttgtcctatctccctctcttatgctaga

SEQ ID NO: 32134 - DNA, 75 bp, Artificial Sequence
  Synthetic
tgttactatgggcttgcttgctgtacattgctctgtctggattattgctgtgactgtgccaaatttcatgctccc

SEQ ID NO: 32135 - DNA, 75 bp, Artificial Sequence
  Synthetic
aaaacatcggggtacttatgagattctactcaaatttgcgaagggtttgcctgccggcaggtggatccaacgcat

SEQ ID NO: 32136 - DNA, 75 bp, Artificial Sequence
  Synthetic
catcctttatgtagcgggtgaagccggtgtggtgtggtatcagcatcttgggcagcaattagatctgttgcccgg

SEQ ID NO: 32137 - DNA, 75 bp, Artificial Sequence
  Synthetic
cgttgaccaactcaacggtgacccgtatggtgccataagatcgcggctggagtactttgaggatgcaggtcatag

SEQ ID NO: 32138 - DNA, 75 bp, Artificial Sequence
  Synthetic
gtacgcttgtggcgacttggtgagggggaggcccatcctgggccgccagggatctctggttgcttttgggtggtc

SEQ ID NO: 32139 - DNA, 75 bp, Artificial Sequence
  Synthetic
taccctccctgctgggtttgccccttgtgctcctatcggcgttcgacaggtctccaggcgtggtgagcttaagac

SEQ ID NO: 32140 - DNA, 75 bp, Artificial Sequence
  Synthetic
ctgggcagtctcgctcacgggaattgacacggctttgtgggaaggtaacatctttaccatgggtaccatgtcgcg

SEQ ID NO: 32141 - DNA, 75 bp, Artificial Sequence
  Synthetic
ccgttacatgggcttcacctgtggggggttgctccatacggtctgccatggggcgggccaccgctctttggcgag

SEQ ID NO: 32142 - DNA, 75 bp, Artificial Sequence
  Synthetic
tacctctggagccctcccaccggtggtgtttgatgacggtgctgactatgccatgcatatggcaccccgcggggc

SEQ ID NO: 32143 - DNA, 75 bp, Artificial Sequence
  Synthetic
caaggatctcgacgtttgcacttgtgctgctacgtcgggattcatggttacccgtgttggtacggtaatcccgct

SEQ ID NO: 32144 - DNA, 75 bp, Artificial Sequence
  Synthetic
taagctgtctgctcaaaacctgtgggcggttcaagccccgcttgctctttccatctgtaaaggcagttctggtgc

SEQ ID NO: 32145 - DNA, 75 bp, Artificial Sequence
  Synthetic
tcccgtgttgtgttctgccggccatgttattgccatggtccagcgctgtagggctgtttccggctctgtggctta

SEQ ID NO: 32146 - DNA, 75 bp, Artificial Sequence
  Synthetic
tgtctgtactactcctgttagacatactgctgtgggcaaaccaacacctactcgcaccgacatgtcggctccgcc

SEQ ID NO: 32147 - DNA, 75 bp, Artificial Sequence
  Synthetic
ggcagttggtaccagttgggaagtccaaactgtctatgcacctacgggttctgggaaaacaacattgttaccgat

SEQ ID NO: 32148 - DNA, 75 bp, Artificial Sequence
  Synthetic
gcattacgtccgcaagggctataatgtgttggtcttaaacccgtctgttgccaccaccatgtccatgcctgctta

SEQ ID NO: 32149 - DNA, 75 bp, Artificial Sequence
  Synthetic
catgaaagatgcatttggcattaatccaaatttgaaagctgctgaaatgacattgaatactggtgctaggttgac

SEQ ID NO: 32150 - DNA, 75 bp, Artificial Sequence
  Synthetic
ctactccacctatgggaggtttcttgcagatggtaagaataatgttaactttgatgtggttatttgtgatgagtg

SEQ ID NO: 32151 - DNA, 75 bp, Artificial Sequence
  Synthetic
ccacgccactgactccactaccattcttggaatcggtgccgtgttgtcgatcacacccaatactaagtgtaaatt

SEQ ID NO: 32152 - DNA, 75 bp, Artificial Sequence
  Synthetic
agtcctccttgccactgcaacccctccgggccagcctgtgctaccgcatcctaacatacaggaattggagctcga

SEQ ID NO: 32153 - DNA, 75 bp, Artificial Sequence
  Synthetic
tgacgtcggggacatcaatttccatggtagaaagcttaaattggcatcctacaaaacaggtagacatctgatttt

SEQ ID NO: 32154 - DNA, 75 bp, Artificial Sequence
  Synthetic
ccaaaacagtaaaaaacactgtgaggctctcgctgctgaccttcgttctaggggcatccgagctgtggcttacta

SEQ ID NO: 32155 - DNA, 75 bp, Artificial Sequence
  Synthetic
gctctcgctgctgaccttcgttctaggggcatccgagctgtggcttactatcgcggtctccccattagtaccatt

SEQ ID NO: 32156 - DNA, 75 bp, Artificial Sequence
  Synthetic
cctactgaaggggactgcgtggttgtcgctacggatgctcttatgactggttacaccgggaacttcgacagtgtt

SEQ ID NO: 32157 - DNA, 75 bp, Artificial Sequence
  Synthetic
acagattgtaatttggctactgttgaggacatcgaaattgattttgacccaactgtttcagtcactctcaaaact

SEQ ID NO: 32158 - DNA, 75 bp, Artificial Sequence
  Synthetic
gttccagctaactcagtcacacgtgcgcagaggcggggccggactggtcgcggcagtcctggcgtctactactac

SEQ ID NO: 32159 - DNA, 75 bp, Artificial Sequence
  Synthetic
gttacacaggacacgccgctgtctggtactgtctctgaggcatcagtgtttggcgcattcgacagtggtatggcg

SEQ ID NO: 32160 - DNA, 75 bp, Artificial Sequence
  Synthetic
gtactgtctctgaggcatcagtgtttggcgcattcgacagtggtatggcgtggtttggcatgtctcctgctgagg

SEQ ID NO: 32161 - DNA, 75 bp, Artificial Sequence
  Synthetic
tccttgaacacctggaccactacagggtcacgcctggcctccctatcctgaagggtgtgctgtctgagatatctg

SEQ ID NO: 32162 - DNA, 75 bp, Artificial Sequence
  Synthetic
ctttctatggatgccttggctgggtcacaccagctttccttgccaaggcgcgcatacactccacttcctttacgt

SEQ ID NO: 32163 - DNA, 75 bp, Artificial Sequence
  Synthetic
ggctcaacgctgcgcagaggcagatttgttatgagaatggctgtaatccacctgacccccaatctcccatatgga

SEQ ID NO: 32164 - DNA, 75 bp, Artificial Sequence
  Synthetic
agggtgtgcgtgtcacgggtgagccgtgcaggattctttgtcatcttgaagggcatcagcccatgcagggtccgt

SEQ ID NO: 32165 - DNA, 75 bp, Artificial Sequence
  Synthetic
gccctgaggttgtcacacaactacagctagccttcacagaattggatgtgtggggcgcgggcgtcgctgcgtctg

SEQ ID NO: 32166 - DNA, 75 bp, Artificial Sequence
  Synthetic
ctgcttcagtgtttgcacttggtctggctcttgactacttcggttccgtggccataacatcagctatggttatcg

SEQ ID NO: 32167 - DNA, 75 bp, Artificial Sequence
  Synthetic
acagcggtgagccacccaacgccccagagcccgcggatgatgacgacggctttgaggaatgttggggactccccg

SEQ ID NO: 32168 - DNA, 75 bp, Artificial Sequence
  Synthetic
agttctcggagccgatagttactcgctgtaggatctgggtagagagggtgcaactctgggcagcgggcatggcga

SEQ ID NO: 32169 - DNA, 75 bp, Artificial Sequence
  Synthetic
agtctggcgccgtcaatgatatcaacaattggtttgcaaccaacttgatcacaattgcatcagcattacaattag

SEQ ID NO: 32170 - DNA, 75 bp, Artificial Sequence
  Synthetic
gagctggtatcctgatttctccagacaaccctttactcgctggcttgctcagcttttctggtgccgtcactttgc

SEQ ID NO: 32171 - DNA, 75 bp, Artificial Sequence
  Synthetic
ccttgagccggtctctccaggcaatcgtgattactcttggtgccattctaactgcccgccttactacggccgagg

SEQ ID NO: 32172 - DNA, 75 bp, Artificial Sequence
  Synthetic
gggccgtttttattgcgggcgctaccctagcaggtttccaactatctgggactcccttgctatctctactgtttt

SEQ ID NO: 32173 - DNA, 75 bp, Artificial Sequence
  Synthetic
ccattcttggtacttatgcttccttcgtaccagcctttggagttgttttcaagctactcgatgggcagctccctt

SEQ ID NO: 32174 - DNA, 75 bp, Artificial Sequence
  Synthetic
ctacggttgagctcgctagcttgataaactgcgcctttgctccgggggctgctgtggcggcgatagctgtcgctg

SEQ ID NO: 32175 - DNA, 75 bp, Artificial Sequence
  Synthetic
tcggtgccattgctctaacccagggtacgggcgtagtgtggatgaacaggctcctgtctatggtcgctaagtcta

SEQ ID NO: 32176 - DNA, 75 bp, Artificial Sequence
  Synthetic
atgttatctctcctgactacttcgtggaagctcgtgacatcaggctaactattaaaaccttgtttgagaaaatac

SEQ ID NO: 32177 - DNA, 75 bp, Artificial Sequence
  Synthetic
atccctggaacgtcgtgaagacagctatcaagttcctaacgactccaactgatgtaccatgcgggttcaacatct

SEQ ID NO: 32178 - DNA, 75 bp, Artificial Sequence
  Synthetic
ttgattgcttttacagtgtttggcacgtcctctgtaagtgggccaaggccctttacgaggccctcattggtggtg

SEQ ID NO: 32179 - DNA, 75 bp, Artificial Sequence
  Synthetic
ttaagcgtgccttgtctcttccgggtgtccctgttgctggctgtcaggctggctacacgggcccctggaaggggg

SEQ ID NO: 32180 - DNA, 75 bp, Artificial Sequence
  Synthetic
agggcatgatcaccacgcggtgtgggtgcggtagggaactagtttattcggtggagttcgggactgctaaagtca

SEQ ID NO: 32181 - DNA, 75 bp, Artificial Sequence
  Synthetic
tcagcggttcgaagctctgccggaattactggacctctgccgtgcccatcaacaacactacatcaggtgttgcca

SEQ ID NO: 32182 - DNA, 75 bp, Artificial Sequence
  Synthetic
aacctgctccctcgtcttggaagacgatgactgtgcaagtcggttttggtttcgtggagtaccgcatggacggtg

SEQ ID NO: 32183 - DNA, 75 bp, Artificial Sequence
  Synthetic
atgtgatctcagtcgttgccacgtcctctccggacgtaaccgtgcccagggttattcccagggtgttcagtgcgg

SEQ ID NO: 32184 - DNA, 75 bp, Artificial Sequence
  Synthetic
ccgccatcaatggccgccgcactgatccatactctggggagccgaataccccttggcgcggtgaagtttggagag

SEQ ID NO: 32185 - DNA, 75 bp, Artificial Sequence
  Synthetic
acaccggctccggcagggagcgcatcaaacttccgtacgctctccgtgactaccaaactgactcaacggtcgctc

SEQ ID NO: 32186 - DNA, 75 bp, Artificial Sequence
  Synthetic
gttcctttgagatggggggggaaagccctaaagaggaccccttcactactgatattggagttgtccacatccaac

SEQ ID NO: 32187 - DNA, 75 bp, Artificial Sequence
  Synthetic
ccctaaagaggaccccttcactactgatattggagttgtccacatccaacaagctgtttccaacgaacgagccga

SEQ ID NO: 32188 - DNA, 75 bp, Artificial Sequence
  Synthetic
ggacattctcgaagggcctagcgacactccgcttgaccctcctgatgttgctgctgagcgaagtagactggatcg

SEQ ID NO: 32189 - DNA, 75 bp, Artificial Sequence
  Synthetic
agaggctgcccaacgcgcagacgtcggcactgacggcttctgggcagggctgcaacccttcggccaattacaggt

SEQ ID NO: 32190 - DNA, 75 bp, Artificial Sequence
  Synthetic
gtttgaaactccaccacccccttacacaaaaccacactccgttagttttgtgtccctcagctcaccaggggctcc

SEQ ID NO: 32191 - DNA, 75 bp, Artificial Sequence
  Synthetic
tgtgtccactagtcaacctactgatgaagatggtagcactagggtggtgctgtccggcaggctgacacctccgga

SEQ ID NO: 32192 - DNA, 75 bp, Artificial Sequence
  Synthetic
ccgccctccttcacagatctcgtactccagtatgccatcactggaacctagtgctacgggcactgaacactcctg

SEQ ID NO: 32193 - DNA, 75 bp, Artificial Sequence
  Synthetic
ctcgggctggcgagatgctagcttacctgcaccttctgaggattctctgtccgccttgggtgctgccgcacccaa

SEQ ID NO: 32194 - DNA, 75 bp, Artificial Sequence
  Synthetic
ggagtgcagctatagctacatatgggacgggctcccatatgtggcccaccttgcaaagcgatctttctctgctgt

SEQ ID NO: 32195 - DNA, 75 bp, Artificial Sequence
  Synthetic
cgccgccattacccacggcttagtgtcacgtaaccttgtttatgtcaccaaacctgagaatgtcttggaacggat

SEQ ID NO: 32196 - DNA, 75 bp, Artificial Sequence
  Synthetic
gaagaaagtaactcggtttcgcccaccagcgacgccgaatccacacttggaggctcttaccaaacaagctgtgcg

SEQ ID NO: 32197 - DNA, 75 bp, Artificial Sequence
  Synthetic
gctggtttccacattggacatgcagcccatgacctattgggaggctgctgctattacgtccgcgcgcacggcccg

SEQ ID NO: 32198 - DNA, 75 bp, Artificial Sequence
  Synthetic
atctgctgttaccggccacacaggcggtgatgtgaagactggcgccgcgcgcaaggatgtggagcagctctacag

SEQ ID NO: 32199 - DNA, 75 bp, Artificial Sequence
  Synthetic
gactctcgaaagcgagtccctgcagaggccttacaatgaggttgtggtcatgccaaaatcagaagtcttcatgag

SEQ ID NO: 32200 - DNA, 75 bp, Artificial Sequence
  Synthetic
aaacaaggcaactgagaaaccacctcgtatcatagcttatcctcaccttgagaccagggtcgctgagaagatggt

SEQ ID NO: 32201 - DNA, 75 bp, Artificial Sequence
  Synthetic
gcttggcaatataggacccggcacggttaaaaaagtgctgggaaaagcctacggctttgtaccacctaaagacag

SEQ ID NO: 32202 - DNA, 75 bp, Artificial Sequence
  Synthetic
aattaataggctcctgactatgtggcgtcggcctaatcctatggcttttgcttgtgacgtcatcacttttgactc

SEQ ID NO: 32203 - DNA, 75 bp, Artificial Sequence
  Synthetic
cacaatcacacctgaggatgtcgatcgtgaagcacgtttatacgcatccgctactaaggattcggccacccgcgc

SEQ ID NO: 32204 - DNA, 75 bp, Artificial Sequence
  Synthetic
aagaatctggaacttacacaaattttatgcttcaggacctatggttgaccaaagaggaaattatttgggcactcg

SEQ ID NO: 32205 - DNA, 75 bp, Artificial Sequence
  Synthetic
aaattgtagagcttctggtgtcttcactacttccagttccaacacaatgacggccttcctgaaggttaaggcagc

SEQ ID NO: 32206 - DNA, 75 bp, Artificial Sequence
  Synthetic
cgccttgactgccgggtttgttaggcctgagttcatcgtcgcgggcgacgatgtcgttgttgtcacccaagcaga

SEQ ID NO: 32207 - DNA, 75 bp, Artificial Sequence
  Synthetic
acccgttcctgatagggacaagaaaaaactagctgtctttgccaatgcaatgaaggacatgggtgctccaataga

SEQ ID NO: 32208 - DNA, 75 bp, Artificial Sequence
  Synthetic
gctgcctagcccaaagtactcattggaggacgtcaccagctgctcgagcaacgtaacgacgggattcacaaggga

SEQ ID NO: 32209 - DNA, 75 bp, Artificial Sequence
  Synthetic
cgggcgccaggtatacttcctgacgcgtgaccccagtgttccgtttgcacgctgttctgcagaaggtgaagggtt

SEQ ID NO: 32210 - DNA, 75 bp, Artificial Sequence
  Synthetic
caacccaatgggtgcctgggttggcaatctgttgtggcacttcccatgtttatgggtgcggatcatcagcactca

SEQ ID NO: 32211 - DNA, 75 bp, Artificial Sequence
  Synthetic
catgctagagacgtacctcgagtcagacttcccagatgaaatcacatgcgactggtatgggaggcaggtctcatt

SEQ ID NO: 32212 - DNA, 75 bp, Artificial Sequence
  Synthetic
gaaaatccaggatctgccttacattctcaccgccatgcatgggaacgatggcttcgacgtcgtccgtttcactcc

SEQ ID NO: 32213 - DNA, 75 bp, Artificial Sequence
  Synthetic
ctatgagatgaaccgggttgctgctactctcaaggcttgtcacatgaagccgttgagatggtggcgcaagcgtgc

SEQ ID NO: 32214 - DNA, 75 bp, Artificial Sequence
  Synthetic
tcgtaccatcagagccgcttgcttccgcaagggaggattgcataaattccttgcctatcacttgctttcctttgc

SEQ ID NO: 32215 - DNA, 75 bp, Artificial Sequence
  Synthetic
ttctaactctgttaggcaacctctcaacccgaaagctgtgtcccgattctcggtcgagctcggagcggatgtgga

SEQ ID NO: 32216 - DNA, 75 bp, Artificial Sequence
  Synthetic
cctccgggtccgccgtggatcggggctatagctctctctgtgctggctttactgttcttcttcctcaaacactga

SEQ ID NO: 32217 - DNA, 75 bp, Artificial Sequence
  Synthetic
atggaagtttctgtctcaagttctacccaaaccagaagcagatcacgatcccgcagacgccgagcttctcgctcg

SEQ ID NO: 32218 - DNA, 75 bp, Artificial Sequence
  Synthetic
ggagtcagaatctcggcaggcttattgacggccctctgtcatgggctgctgattgtttccggaagattcctctct

SEQ ID NO: 32219 - DNA, 75 bp, Artificial Sequence
  Synthetic
tgggacctcccgcaggttggtgcgttcgggttgttggtagagccgttcgcgtatgcgaagactttatcaatggcc

SEQ ID NO: 32220 - DNA, 75 bp, Artificial Sequence
  Synthetic
taacgcgctccacagtcggcatgtcgatctttctcctgtgtctcttcagtgttgcggttgacgggtaccgacacg

SEQ ID NO: 32221 - DNA, 75 bp, Artificial Sequence
  Synthetic
gttgcggttgacgggtaccgacacgtggaaattggtggctactatcagattaccaactgctgccaggatggtgat

SEQ ID NO: 32222 - DNA, 75 bp, Artificial Sequence
  Synthetic
tctttgtttgatattcttcccactcatatcactctcaacactactgccacttgctatcttgaggttgattactcc

SEQ ID NO: 32223 - DNA, 75 bp, Artificial Sequence
  Synthetic
gcacggcacgacgacatctcgcgcaatgctacttccaaatggggccatatgactagttgttcattgcaaatgatc

SEQ ID NO: 32224 - DNA, 75 bp, Artificial Sequence
  Synthetic
gactagttgttcattgcaaatgatcccttgcaagtgccgcaatgttacttactctgtcgaggacatgtggtgctt

SEQ ID NO: 32225 - DNA, 75 bp, Artificial Sequence
  Synthetic
tcttagctttagttgctggtgttttcaggtctcgttcaaccttgctttggatactcttcatttccttgtggaaat

SEQ ID NO: 32226 - DNA, 75 bp, Artificial Sequence
  Synthetic
cactatatctttatgcttggtctggttttgtctccttctttaatgttagatgttagtatgggcttgctagctata

SEQ ID NO: 32227 - DNA, 75 bp, Artificial Sequence
  Synthetic
gtctttgatgatggcgcagactatgccatgcacatggcacctcggggtgccaaggatctggacgtctgcacttgt

SEQ ID NO: 32228 - DNA, 75 bp, Artificial Sequence
  Synthetic
ccatgcacatggcacctcggggtgccaaggatctggacgtctgcacttgtgcggctacttccggattcatggtta

SEQ ID NO: 32229 - DNA, 75 bp, Artificial Sequence
  Synthetic
gagccgtttccggctccgtcgcgtatgtctgcaccacccccgtcagacacaccgctgtgggtaaacccactccca

SEQ ID NO: 32230 - DNA, 75 bp, Artificial Sequence
  Synthetic
tgtctgcaccacccccgtcagacacaccgctgtgggtaaacccactcccactaggactgatatgtcggcccctcc

SEQ ID NO: 32231 - DNA, 75 bp, Artificial Sequence
  Synthetic
ctgggcattggcgctgtcctttctatcactcccaatacaaaatgtaaattagtccttctcgccactgctacgcca

SEQ ID NO: 32232 - DNA, 75 bp, Artificial Sequence
  Synthetic
tcgcggactccccatcagtaccattcctgttgagggagactgcgtggtggtcgccactgatgctctgatgactgg

SEQ ID NO: 32233 - DNA, 75 bp, Artificial Sequence
  Synthetic
agagcctgttgaagatgacgacgggttcgaggaatgctggggtctcccagaattttccgagccaatagtcaccag

SEQ ID NO: 32234 - DNA, 75 bp, Artificial Sequence
  Synthetic
actgctcgtttgactacagcagagggtgcggtatttatcgcaggggctaccctcgctgggttccaattgtctggg

SEQ ID NO: 32235 - DNA, 75 bp, Artificial Sequence
  Synthetic
ccattcttggcacttacgcttcctttgtacctgcctttggagtagttttcaaacttcttgatggtcagctccctt

SEQ ID NO: 32236 - DNA, 75 bp, Artificial Sequence
  Synthetic
tgtacctgcctttggagtagttttcaaacttcttgatggtcagctcccttctacggtcgagcttgctagtttgat

SEQ ID NO: 32237 - DNA, 75 bp, Artificial Sequence
  Synthetic
tgggtgctatagcattgactcagggcacaggggtggtttggatgaaccgtcttctgtccatggtcgcaaaatcta

SEQ ID NO: 32238 - DNA, 75 bp, Artificial Sequence
  Synthetic
gacgtgcagtgtgggtttaacatctttgactgcttttacagtgtttggcatgtgctctgtaagtgggcgaaagcc

SEQ ID NO: 32239 - DNA, 75 bp, Artificial Sequence
  Synthetic
ggctacacgggtccctggaagggcgagggcatgattaccactcggtgtgggtgcggtagagagctagtttattcg

SEQ ID NO: 32240 - DNA, 75 bp, Artificial Sequence
  Synthetic
gtagagtttggtaccgctaaagttatcagcggatccaagctttgccgaaattactggacctccgccgtcccaatc

SEQ ID NO: 32241 - DNA, 75 bp, Artificial Sequence
  Synthetic
tcagcggatccaagctttgccgaaattactggacctccgccgtcccaatcaacaacaccacttctggtgtagcca

SEQ ID NO: 32242 - DNA, 75 bp, Artificial Sequence
  Synthetic
ttcgtggagtaccgtatggacggtgatgtgatctctgtcgttgccacctcttctccggacgtaactgtgccaagg

SEQ ID NO: 32243 - DNA, 75 bp, Artificial Sequence
  Synthetic
gttattcccagggtattcagtgcggccgccattaatggccgtcgcactgatccttactctggggagccagccacc

SEQ ID NO: 32244 - DNA, 75 bp, Artificial Sequence
  Synthetic
ccgccattaatggccgtcgcactgatccttactctggggagccagccaccccttggcgtggtgaagtttggaggg

SEQ ID NO: 32245 - DNA, 75 bp, Artificial Sequence
  Synthetic
gctctttcgagatgggcggtctaagcccaaaggaagatcctttcaccactgatgttggggttgtccatatccaac

SEQ ID NO: 32246 - DNA, 75 bp, Artificial Sequence
  Synthetic
cccaaaggaagatcctttcaccactgatgttggggttgtccatatccaacaagctgtttctaacgagcgcgccga

SEQ ID NO: 32247 - DNA, 75 bp, Artificial Sequence
  Synthetic
ccggccggctcacgcccccagacagaccaccctctgtggtgtcatactccagtatgccatcacttgaacctagtg

SEQ ID NO: 32248 - DNA, 75 bp, Artificial Sequence
  Synthetic
ctctgacgaaacaagccgtgcggctggtttctacattggacatgcagcccatgacctattgggaggcttctgcta

SEQ ID NO: 32249 - DNA, 75 bp, Artificial Sequence
  Synthetic
gtggtaattacctcggaacacgcaattgccgtgcatccggggtcttcaccacatccagttctaacaccatgactg

SEQ ID NO: 32250 - DNA, 75 bp, Artificial Sequence
  Synthetic
tcgtcgtagtcactcaggctgaacctgtacctgatagggataaaaagaagctcgcaatctttgcgaatgccatga

SEQ ID NO: 32251 - DNA, 75 bp, Artificial Sequence
  Synthetic
ggtatggtaggcaggtttcattgaagatccaagacttgccttacattctaactgcaatgcacgggaacgacggtt

SEQ ID NO: 32252 - DNA, 75 bp, Artificial Sequence
  Synthetic
ttgacgtcgtccgctttactccctatgagatgaacagagttgctgccacactcaaagcttgccacatgaagcctt

SEQ ID NO: 32253 - DNA, 75 bp, Artificial Sequence
  Synthetic
taatgctgtcaggcaacctctcaacccaaaagctgtgtcccgattttcggtcgagctcggagcggatattgagga

SEQ ID NO: 32254 - DNA, 75 bp, Artificial Sequence
  Synthetic
cctccgggcccgccctggtttggggccatagctctctctatgttggctttgctgttcttcttcctcaaacactga

SEQ ID NO: 32255 - DNA, 75 bp, Artificial Sequence
  Synthetic
taagttaggttccgccgaagcgggctaaccaggcccctagtaggaggcgcctatcccgtgagccctttccccacg

SEQ ID NO: 32256 - DNA, 75 bp, Artificial Sequence
  Synthetic
tttcagtctcaagttctacccaaaccagaagtagatcacgatcccgcaggcgacgagcttctcgctctcgctcgc

SEQ ID NO: 32257 - DNA, 75 bp, Artificial Sequence
  Synthetic
gacgccgtcccggggttaccgtcgtggttcctacctccactgacggtggccgcaggcgtcggcgtaatcggcagc

SEQ ID NO: 32258 - DNA, 75 bp, Artificial Sequence
  Synthetic
cgcaggcgtcggcgtaatcggcagcgtgactatgcctggccttatatagatactgggctgtcgtatttcgtcggt

SEQ ID NO: 32259 - DNA, 75 bp, Artificial Sequence
  Synthetic
cccctttcttgggctgctgattgcctcaggaagattcccgttctggggcctcctgttggctggtgtgctcgggtc

SEQ ID NO: 32260 - DNA, 75 bp, Artificial Sequence
  Synthetic
gttggtagagccgttcgcgtttgcgaggactttgtcaatggcctgacgcgctcaacagtcggcatgtccatcttt

SEQ ID NO: 32261 - DNA, 75 bp, Artificial Sequence
  Synthetic
attctctgcctatttagtgtttgtgtttctgggtatcgcttggtcaaggtgggctcgcactatcaacttaccaac

SEQ ID NO: 32262 - DNA, 75 bp, Artificial Sequence
  Synthetic
tgctgccaggagggtgacgtgctttactctaccaaggagtttgcttaccacctccccggttgcgttatctgcact

SEQ ID NO: 32263 - DNA, 75 bp, Artificial Sequence
  Synthetic
gacgatcaatgctgggatcctgtcaccgttttcctcagcgttaagcccaatggttctacttatgaccatcatctg

SEQ ID NO: 32264 - DNA, 75 bp, Artificial Sequence
  Synthetic
cggaaccatgtacttgggctgggcgtcggtgcggctgtatgtgatatgcttgacatcaatgaccaatgcggtatg

SEQ ID NO: 32265 - DNA, 75 bp, Artificial Sequence
  Synthetic
ctagctgtgtctctgatctctctctttgacattctgcctactcatatccaactcaatactactgctgcttgctat

SEQ ID NO: 32266 - DNA, 75 bp, Artificial Sequence
  Synthetic
ttggaagtggattactcaccctttggtaccatcgttgggtgggtcaattgggctgtgaatgaggcgggggtagtg

SEQ ID NO: 32267 - DNA, 75 bp, Artificial Sequence
  Synthetic
acctgggctttgtcaatagtcacccgcataccatatgcggtgttccatttgatggagctcagctcgaccccgttt

SEQ ID NO: 32268 - DNA, 75 bp, Artificial Sequence
  Synthetic
ctgattgccgttgtgtggttcgcgatacaggggcagtgggctagacttctcttgcttgctgttctagttgttgag

SEQ ID NO: 32269 - DNA, 75 bp, Artificial Sequence
  Synthetic
gccaccacgacggaatgctcacgccatgatgaaatctcaagaaatgccactaccaaatggggtcacatgaccagt

SEQ ID NO: 32270 - DNA, 75 bp, Artificial Sequence
  Synthetic
tgttccttacaaatgattccctgcaagtgtcgcaatgtgacctactctgttgaggacatgtggtgcttcggtgac

SEQ ID NO: 32271 - DNA, 75 bp, Artificial Sequence
  Synthetic
gccgtcgtgaacgtaccaatctatcgcgaccggtcgggaggcaagaacgtgtccttagctaggctgccttatcta

SEQ ID NO: 32272 - DNA, 75 bp, Artificial Sequence
  Synthetic
ccaggcctccgtgggtgcgaatacaaggtaaacggtacgtggagctgttgcagcctcatggaccgtgaccctgtt

SEQ ID NO: 32273 - DNA, 75 bp, Artificial Sequence
  Synthetic
tgtaaacaacatcattgccctacggactgcacgtggaaggacccttcactgacgtgggaaaggtgtggtgtagtc

SEQ ID NO: 32274 - DNA, 75 bp, Artificial Sequence
  Synthetic
tcctgcatcacatcctaccactccgggaacggttcagcggcgtgcgccgcctggatagttagagctgccatgtgg

SEQ ID NO: 32275 - DNA, 75 bp, Artificial Sequence
  Synthetic
gatacttttgcgatatcctttgatgacaagaattggatcaatgtgagatacaacaagtccatgtccaacaacatc

SEQ ID NO: 32276 - DNA, 75 bp, Artificial Sequence
  Synthetic
acaaccgccgcacgccttccgggcgcccggcggctgtacagtggtatgtgggtcttttctcctaaggggacctac

SEQ ID NO: 32277 - DNA, 75 bp, Artificial Sequence
  Synthetic
tttcctttgggtgatctggctactgggcttatttctaaggctagacatgatccgaacatgcaaatcatttactct

SEQ ID NO: 32278 - DNA, 75 bp, Artificial Sequence
  Synthetic
ggtgggggttccttagctgtacctcacttggaaaccactctgtttctggctttagtagctggcgttttccgatcg

SEQ ID NO: 32279 - DNA, 75 bp, Artificial Sequence
  Synthetic
cggtctacgcttttgtggattctctttgtctctctctggaaatctgcgactgcagctttgctggccccatgggtc

SEQ ID NO: 32280 - DNA, 75 bp, Artificial Sequence
  Synthetic
accgctgttgccatcgcttcaacttgggatgaatggtatctcaggctcctcatatatctctttttgtgtaagagt

SEQ ID NO: 32281 - DNA, 75 bp, Artificial Sequence
  Synthetic
cgcaggccttaccgttttatgctttgcaataagttccctcttactatgctccttttgttgcttaatgtactaggg

SEQ ID NO: 32282 - DNA, 75 bp, Artificial Sequence
  Synthetic
gttactgctttagatgttgattatactactcatattcccttggcttatgtcacctttgtcgctcttatcggttct

SEQ ID NO: 32283 - DNA, 75 bp, Artificial Sequence
  Synthetic
ggcttgtttgctacaactgcaccatctgttagcttcacatgccattaccttttggagtggctgagttgcatcagc

SEQ ID NO: 32284 - DNA, 75 bp, Artificial Sequence
  Synthetic
tatagtcttgagtctaatcattccatctttatgcttggtcttgtcctgtctccgtctcttatgctggatattact

SEQ ID NO: 32285 - DNA, 75 bp, Artificial Sequence
  Synthetic
atgggtttgcttgctatacactgctctgtctggattattgctgttactgtgccaaatttcatgctcccaaaacat

SEQ ID NO: 32286 - DNA, 75 bp, Artificial Sequence
  Synthetic
cggggtacttatgaaattttgcttaaatttgcgaagggtctgcctgccggtaggtggatccaacgcatcatcctt

SEQ ID NO: 32287 - DNA, 75 bp, Artificial Sequence
  Synthetic
tatgtggcgggtgaagctggtgtattgtggtatcaacaccttgggcagcaactagatttgttgcctggggtcgac

SEQ ID NO: 32288 - DNA, 75 bp, Artificial Sequence
  Synthetic
cagcttaacggcgacccgtacggtgccataaggtcgcgcctggaatactttgaggatgcaggtcataggtacgct

SEQ ID NO: 32289 - DNA, 75 bp, Artificial Sequence
  Synthetic
tgtggcgacttagtgagagggagacctgtcctaggccgccagggatccctggttgcttttgggtggtccactctc

SEQ ID NO: 32290 - DNA, 75 bp, Artificial Sequence
  Synthetic
ggttgcttttgggtggtccactctcccaactgggtttgccccttgcgctcctatcggcgtccgacaggtctctag

SEQ ID NO: 32291 - DNA, 75 bp, Artificial Sequence
  Synthetic
gcgtggtgagcttaagacctgggcagtttcgctcacgggaattgacacggctttgtgggaaggtaacatctttac

SEQ ID NO: 32292 - DNA, 75 bp, Artificial Sequence
  Synthetic
catgggcactatgtcgcgccgttatatgggcttcacttgtggggggcttctccatacggtctgccatggggcagg

SEQ ID NO: 32293 - DNA, 75 bp, Artificial Sequence
  Synthetic
tcatcgctctttggcaagcacttctggagccctcccgccggtggtgtttgatgacggtgctgactacgccatgca

SEQ ID NO: 32294 - DNA, 75 bp, Artificial Sequence
  Synthetic
tatggcgccccgcggagccaaggatctggacgtctgcacttgtgcagctacgtcggggttcatggttacccgcgt

SEQ ID NO: 32295 - DNA, 75 bp, Artificial Sequence
  Synthetic
tggtacagtgatcccactcaagctgtctgctcaaaacctgtgggcggttcaagccccacttgctctctccatctg

SEQ ID NO: 32296 - DNA, 75 bp, Artificial Sequence
  Synthetic
taagggcagttctggtgctcccgtgttgtgttctgccggccatgttatcgctatggttcagcgttgcagagctgt

SEQ ID NO: 32297 - DNA, 75 bp, Artificial Sequence
  Synthetic
ctccggctctgtggcttatgtctgtactactcctgtcagacacactgctgtcggcaaaccaacacctactcgcac

SEQ ID NO: 32298 - DNA, 75 bp, Artificial Sequence
  Synthetic
tgacatgtcggctccgccggcagttggtaccagttgggaagtccaaactgtctatgcacctacggggtctgggaa

SEQ ID NO: 32299 - DNA, 75 bp, Artificial Sequence
  Synthetic
aacaacactgctgccgatgcattatgtccgcaagggctataatgtgctggttttgaacccgtctgttgccactac

SEQ ID NO: 32300 - DNA, 75 bp, Artificial Sequence
  Synthetic
catgtccatgcctgcttatatgaaggacgcatttggcatcaatccaaatttaaaggctgctgagatgacactgaa

SEQ ID NO: 32301 - DNA, 75 bp, Artificial Sequence
  Synthetic
tactggtgccagattgacctattccacttacgggagattccttgcagatggcaaaaataatatcaattttgatgt

SEQ ID NO: 32302 - DNA, 75 bp, Artificial Sequence
  Synthetic
ggttatttgtgatgagtgtcacgccactgactccactaccattcttggaatcggtgccgtcttgtcaatcacacc

SEQ ID NO: 32303 - DNA, 75 bp, Artificial Sequence
  Synthetic
caatactaagtgcaaattggtccttcttgccactgcaactcctcctggccagcctgtgctaccacaccccaatat

SEQ ID NO: 32304 - DNA, 75 bp, Artificial Sequence
  Synthetic
acaggaattggagctagatgatgttggggacatcaatttccacggcagaaaactcaaattggcatcctataaaac

SEQ ID NO: 32305 - DNA, 75 bp, Artificial Sequence
  Synthetic
aggtagacatttgattttccaaaacagtaagaagcactgtgaggctctcgctgctgaccttcgttctaggggcat

SEQ ID NO: 32306 - DNA, 75 bp, Artificial Sequence
  Synthetic
ctgctgaccttcgttctaggggcattcgggctgtggcttactatcgcggcctccctatcagtactattcccactg

SEQ ID NO: 32307 - DNA, 75 bp, Artificial Sequence
  Synthetic
agggggactgcgtggttgtcgctacggatgcccttatgactggttacaccgggaacttcgacagtgttacagact

SEQ ID NO: 32308 - DNA, 75 bp, Artificial Sequence
  Synthetic
gcaatttggccactgttgaagacatcgaaattgattttgacccaactgtttcaatcactctcaaaactgttccag

SEQ ID NO: 32309 - DNA, 75 bp, Artificial Sequence
  Synthetic
ctaactcagtcacacgagcacagagacggggccggactggccgcggcagtcccggtgtctactattatgttacac

SEQ ID NO: 32310 - DNA, 75 bp, Artificial Sequence
  Synthetic
aggacacaccgctgtccggtactgtctctgaggcatcagtgtttggcgcattcgacagtggtatggcatggttcg

SEQ ID NO: 32311 - DNA, 75 bp, Artificial Sequence
  Synthetic
gcatgtctcctgctgaggtccttgaacatctggaccactacagggtcacgcctggcctccctatcctgaagggtg

SEQ ID NO: 32312 - DNA, 75 bp, Artificial Sequence
  Synthetic
tgctatctgagatatctgccttctacgggtgccttggctgggttacaccagctttccttgccaaggcacgcatac

SEQ ID NO: 32313 - DNA, 75 bp, Artificial Sequence
  Synthetic
actctacctcctttacgtggcttaacgctgcgcagaggcagatttgttatgagaatggttgtaacccacctgatc

SEQ ID NO: 32314 - DNA, 75 bp, Artificial Sequence
  Synthetic
cccaatctcccatatggaagggtgtgcgtgtcacgggtgagccatgcagaattctttgtcatcttgaagggcacc

SEQ ID NO: 32315 - DNA, 75 bp, Artificial Sequence
  Synthetic
agcccatgcagggcccatgccctgacgttgtcacgcaactgcagttagccttcacagaattggacgtatggggcg

SEQ ID NO: 32316 - DNA, 75 bp, Artificial Sequence
  Synthetic
ctggcgtcgctgcgtccgccgcttcagtgtttgcacttggtttggctctcgactacttcggctccgtggctataa

SEQ ID NO: 32317 - DNA, 75 bp, Artificial Sequence
  Synthetic
catcagctatggtcatcgatagtggtgagccacctaatgccccagagcctgcggatgatgacgatggtttcgaag

SEQ ID NO: 32318 - DNA, 75 bp, Artificial Sequence
  Synthetic
agtgttgggggttacccgagttctcggagccgatagtcactcgctgcaggatctgggtagaaagggtgcagctct

SEQ ID NO: 32319 - DNA, 75 bp, Artificial Sequence
  Synthetic
gggcggcgggcatggcgaagtccggtgccgtcaatgatattaacaattggtttgcatccaacttgatcacaattg

SEQ ID NO: 32320 - DNA, 75 bp, Artificial Sequence
  Synthetic
catcagcattacaattaggagctggtatcctaatttctccagacaatcccttacttgctggcttgcttagctttt

SEQ ID NO: 32321 - DNA, 75 bp, Artificial Sequence
  Synthetic
ctggcgccgtcaccttgccattgagccggtctcttcaggcaatcgtgattactctcggtgccatcttgaccgccc

SEQ ID NO: 32322 - DNA, 75 bp, Artificial Sequence
  Synthetic
gccttaccacggccgagggggccgttttcatcgcgggcgctaccctagcaggcttccagttatccgggactcctt

SEQ ID NO: 32323 - DNA, 75 bp, Artificial Sequence
  Synthetic
tactatctctaatattttccattcttggcacttatgcttcctttgtaccagcttttggagttgttttcaagctac

SEQ ID NO: 32324 - DNA, 75 bp, Artificial Sequence
  Synthetic
tggcacttatgcttcctttgtaccagcttttggagttgttttcaagctactcgatggacagctcccttccacggt

SEQ ID NO: 32325 - DNA, 75 bp, Artificial Sequence
  Synthetic
tgagctcgctagcttgataaactgcgcctttgctccgggggctgctgtggcggcgatagctgtcgctgttggcgc

SEQ ID NO: 32326 - DNA, 75 bp, Artificial Sequence
  Synthetic
cattgctttaacccagggcacgggcgtggtgtggatgaacaggctcctgtctatggtcgctaagtctaatgttat

SEQ ID NO: 32327 - DNA, 75 bp, Artificial Sequence
  Synthetic
ctctcctgactatttcgtggaagcccgcgacatcaggatgacaatcaagaccttgtttgagaaaatacatccctg

SEQ ID NO: 32328 - DNA, 75 bp, Artificial Sequence
  Synthetic
ctctcctgactatttcgtggaagcccgcgacatcaggttgacaatcaagaccttgtttgagaaaatacatccctg

SEQ ID NO: 32329 - DNA, 75 bp, Artificial Sequence
  Synthetic
ctctcctgactatttcgtggaagcccgcgacatcaggctgacaatcaagaccttgtttgagaaaatacatccctg

SEQ ID NO: 32330 - DNA, 75 bp, Artificial Sequence
  Synthetic
ctctcctgactatttcgtggaagcccgcgacatcagggtgacaatcaagaccttgtttgagaaaatacatccctg

SEQ ID NO: 32331 - DNA, 75 bp, Artificial Sequence
  Synthetic
gaacgtcgtgaagacagccattaagttcctgacgactccaactgacgtgccatgtgggtttaacatctttgattg

SEQ ID NO: 32332 - DNA, 75 bp, Artificial Sequence
  Synthetic
cttttacagtgtttggcatgtcctctgtaagtgggccaaagccctttacgaggctctcatcggtggtgttaagcg

SEQ ID NO: 32333 - DNA, 75 bp, Artificial Sequence
  Synthetic
tgccatttctctcccgggggtccctgtcgccggctgtcaggctggctacacgggtccctggaagggggagggcat

SEQ ID NO: 32334 - DNA, 75 bp, Artificial Sequence
  Synthetic
gatcaccacacggtgtgggtgtggcagggaactggtttattcggtggagttcggaaccgctaaagtcatcagcgg

SEQ ID NO: 32335 - DNA, 75 bp, Artificial Sequence
  Synthetic
ctcaaagctctgccggaattactggacctctgctgtgccgattaacaacactacatcaggtgttgccaaacctgc

SEQ ID NO: 32336 - DNA, 75 bp, Artificial Sequence
  Synthetic
tccctcctcttggaagacgatgactgtacaagtcggatttggttttgtggagtaccgcatggatggtgatgtgat

SEQ ID NO: 32337 - DNA, 75 bp, Artificial Sequence
  Synthetic
ctcggtcgttgccacgtcctctccagatgtgaccgtgcctagggttattcccagggtattcagtgcggctgctat

SEQ ID NO: 32338 - DNA, 75 bp, Artificial Sequence
  Synthetic
taacggtcgtcgcaccgatccatactctggggagcccaacaccccttggcgcggtgaagtttggagggacactgg

SEQ ID NO: 32339 - DNA, 75 bp, Artificial Sequence
  Synthetic
ctccggccgagagcgcattaagcttccgtacgctctccgtgattaccagaccgattcgacagttgctcgctcctt

SEQ ID NO: 32340 - DNA, 75 bp, Artificial Sequence
  Synthetic
tgagatggggggagagagtccaaaagaagacccctttaccactgatattggagttgtccacatccaacaagctgt

SEQ ID NO: 32341 - DNA, 75 bp, Artificial Sequence
  Synthetic
gaagacccctttaccactgatattggagttgtccacatccaacaagctgtttctaacgaacgggccgaggacatt

SEQ ID NO: 32342 - DNA, 75 bp, Artificial Sequence
  Synthetic
ctcgaggggcctagcgacactccgcttgaccctcctgatgttgctgctgagcgaagtagactggatcgagaggcc

SEQ ID NO: 32343 - DNA, 75 bp, Artificial Sequence
  Synthetic
gctcaacgcgcagacgtcggcactgacggcttctgggcggggctgcaaccttttggccaactacaggtgtttgaa

SEQ ID NO: 32344 - DNA, 75 bp, Artificial Sequence
  Synthetic
actccaccacccccttacacgaaaccacactccgttagttttgtgtccctcagctcgccaggggctcctgtgtcc

SEQ ID NO: 32345 - DNA, 75 bp, Artificial Sequence
  Synthetic
acctctcaacccactgatgaagatggtagcactagggtggtcctttccggcaggctcacccctccggatcggcct

SEQ ID NO: 32346 - DNA, 75 bp, Artificial Sequence
  Synthetic
ccttcacagatctcatactccagcatgccatcgctggaacctagtgctacgggcactgagcactcctgctcgggc

SEQ ID NO: 32347 - DNA, 75 bp, Artificial Sequence
  Synthetic
tggcgagacgctactttacctgcaccttctgaagattctttgtccgccttaggtgctgctgcgcctaaggagtgc

SEQ ID NO: 32348 - DNA, 75 bp, Artificial Sequence
  Synthetic
agctacagctacatatgggacgggctcccatatgtagctcatcttgcaaagcgttccttctctgctgttgctgcc

SEQ ID NO: 32349 - DNA, 75 bp, Artificial Sequence
  Synthetic
atcactcacggcttggtgtcgcgtaatcttgtgtatgtcactaaacctgagaatgtcttggagcgaatgaagaaa

SEQ ID NO: 32350 - DNA, 75 bp, Artificial Sequence
  Synthetic
gtgactcggtttcgcccacctgcgacgccgaacccacacttagaggctcttaccaaacaggctgtgcggctggtt

SEQ ID NO: 32351 - DNA, 75 bp, Artificial Sequence
  Synthetic
tccacattggacatgcagcctatgacctattgggaggccgctgctatcacgtctgcacgcacggcccgatctgct

SEQ ID NO: 32352 - DNA, 75 bp, Artificial Sequence
  Synthetic
gtcaccggccataccggcggtgatgtgaagagcggtgccgcgcgcaaggatgtggagcagttgtacaggactctc

SEQ ID NO: 32353 - DNA, 75 bp, Artificial Sequence
  Synthetic
gaaagcgagtctttgcagaggccttacaatgaggttgtggtcatgccaaaatcagaagtcttcatgagaaataaa

SEQ ID NO: 32354 - DNA, 75 bp, Artificial Sequence
  Synthetic
gcaactgagaaaccaccccgcatcatagcttatcctcatcttgagaccagggtcgctgagaagatggtacttggt

SEQ ID NO: 32355 - DNA, 75 bp, Artificial Sequence
  Synthetic
aatataggacccggcacagttaaaaaggtgctgggaaaagcctacggctttgtgccacctaaagatagaatcaat

SEQ ID NO: 32356 - DNA, 75 bp, Artificial Sequence
  Synthetic
aggctcctgaccatgtggcgccggcccaaccccatggcttttgcttgcgacgtcatcactttcgactccacaatc

SEQ ID NO: 32357 - DNA, 75 bp, Artificial Sequence
  Synthetic
acacccgaggatgttgatcgtgaagcacgtctgtatgcatctgctactaaggattcggccacgcgcgcaagaatc

SEQ ID NO: 32358 - DNA, 75 bp, Artificial Sequence
  Synthetic
tggaacctacacaaattttatgcatcaggacccatggtggaccagagaggaaactatttgggcactcgtaattgc

SEQ ID NO: 32359 - DNA, 75 bp, Artificial Sequence
  Synthetic
agggcctctggtgtgttcactacttccagttccaacacaatgacggccttcctgaaagtcaaagcagctgctatg

SEQ ID NO: 32360 - DNA, 75 bp, Artificial Sequence
  Synthetic
actgccgggtttgttaggcctgagttcatcgtcgcaggcgacgatgtcgttgttgttacccaagcagaacccgtt

SEQ ID NO: 32361 - DNA, 75 bp, Artificial Sequence
  Synthetic
cctgatagggacaagaagaaactagctgtctttgctaatgcaatgaaagacatgggtgccccaatagagctgccc

SEQ ID NO: 32362 - DNA, 75 bp, Artificial Sequence
  Synthetic
agcccaaagtactcattggaggacgtcaccagctgctcaagcaacgtgacgacgggattcacgagggacgggcgt

SEQ ID NO: 32363 - DNA, 75 bp, Artificial Sequence
  Synthetic
caggtgtatttcttgacgcgtgaccccagtgtcccgtttgcgcgctgctctgcagaaggtgaagggttcaacccg

SEQ ID NO: 32364 - DNA, 75 bp, Artificial Sequence
  Synthetic
atgggcgcctgggttggcaacctgctgtggcatttcccatgtttatgggtgcggatcatcagcactcacatgcta

SEQ ID NO: 32365 - DNA, 75 bp, Artificial Sequence
  Synthetic
gagacgtacctcgagtcagaatttccagatgagatcacatgcgactggtatgggaggcaggtctcactgaaaatc

SEQ ID NO: 32366 - DNA, 75 bp, Artificial Sequence
  Synthetic
caggatctgccttacatcctcaccgcaatgcacgggaacgatggcttcgatgtcgtccgctttactccttatgag

SEQ ID NO: 32367 - DNA, 75 bp, Artificial Sequence
  Synthetic
atgaaccgggttgctgctactctcaaggcttgccacatgaagccactgagatggtggcgcaagcgtgctcgtacc

SEQ ID NO: 32368 - DNA, 75 bp, Artificial Sequence
  Synthetic
atcagagctgcttgcttccgtaaaggaggattgcacaaatttcttgcttaccacttgctttcctttgcttctaac

SEQ ID NO: 32369 - DNA, 75 bp, Artificial Sequence
  Synthetic
ccacttgctttcctttgcttctaactctgttaggcaacccctcaacccaaaagctgtgtctcgattctcggttga

SEQ ID NO: 32370 - DNA, 75 bp, Artificial Sequence
  Synthetic
gctcggagcggatgtggaggaacccattgtaatcgggaaacctccgggtccgccgtggatcggggccatagctct

SEQ ID NO: 32371 - DNA, 75 bp, Artificial Sequence
  Synthetic
ctctgtgttggctctactgttcttctttctcaaacactgaactgaccactggaatctgaccactggatactgatt

SEQ ID NO: 32372 - DNA, 75 bp, Artificial Sequence
  Synthetic
tggatgatgagattcggcccgcaggaagcgtctcgcagcgggctgtggataccgtctcggccacatttagatagg

SEQ ID NO: 32373 - DNA, 75 bp, Artificial Sequence
  Synthetic
gttgaccctcccaggattggtgacgcgcctgggagtgaatgtccgccgtagccggcgtaataaggggctacccgc

SEQ ID NO: 32374 - DNA, 75 bp, Artificial Sequence
  Synthetic
gccggcgtaataaggggctacccgctttgaggtgggttacagggttgcgcaagctcctgtttcccatcttaaagt

SEQ ID NO: 32375 - DNA, 75 bp, Artificial Sequence
  Synthetic
atggaagtttcagtttcaagttctacccaaaccagaagtaggtcacgatcccgcaggcgacgagcttctcgctct

SEQ ID NO: 32376 - DNA, 75 bp, Artificial Sequence
  Synthetic
cgctcgcgacgccgtcctggggtcaccgtcgtggttcctacatccactgatggcggccgcagacgtcggcgtaat

SEQ ID NO: 32377 - DNA, 75 bp, Artificial Sequence
  Synthetic
cggcaacgtgactatgcctggccttatatagatactgggttgtcatatttcgtcggtgctgtgactccggttggt

SEQ ID NO: 32378 - DNA, 75 bp, Artificial Sequence
  Synthetic
tcgccatctcacgatccttaccgccggagccagaacatcggtcgtcttattgacggccctctttcttgggctgct

SEQ ID NO: 32379 - DNA, 75 bp, Artificial Sequence
  Synthetic
gattgcctcaggaagattccagtcttgggacctcctgttggctggtgtgctcgagtcgttggcagggctgttcgc

SEQ ID NO: 32380 - DNA, 75 bp, Artificial Sequence
  Synthetic
gtctgcgaagactttgtcaatggtttgacacgctctactgtcggcatgtccattttcattctttgcctatttagt

SEQ ID NO: 32381 - DNA, 75 bp, Artificial Sequence
  Synthetic
gtttgtgtttctgggtatcgcttggtcaaagtgggcgactactatcaactcaccaactgctgtcaggagggtgat

SEQ ID NO: 32382 - DNA, 75 bp, Artificial Sequence
  Synthetic
gtgctttactccaccaaggaatttgcttaccacctccctggctgcgtgatctgcactaatgaccaatgctgggat

SEQ ID NO: 32383 - DNA, 75 bp, Artificial Sequence
  Synthetic
cctgtcaccgtttttctcagcgtcaagcccaacggttctacgtatgaccaccatctgcggaaccatgtgcttggc

SEQ ID NO: 32384 - DNA, 75 bp, Artificial Sequence
  Synthetic
ttgggcgtcggtgctgctgtgtgtgatatgcttgacatcaatgaccaatgcggtatgctagctgtgtctctgatt

SEQ ID NO: 32385 - DNA, 75 bp, Artificial Sequence
  Synthetic
tctctctttgacatcttacccactcacatccaactcaatgccactgctgtttgctacttggaggtggattactca

SEQ ID NO: 32386 - DNA, 75 bp, Artificial Sequence
  Synthetic
ccctttggtaccatcgttgggtgggtgaactgggctgtgaatgaggcgggggtagtgacttgggctctgtcgata

SEQ ID NO: 32387 - DNA, 75 bp, Artificial Sequence
  Synthetic
gtcactcgcataccttatgcggtgttccatttgatggagctcagttctactccgtttctaatcgctgttgtgtgg

SEQ ID NO: 32388 - DNA, 75 bp, Artificial Sequence
  Synthetic
tttgcgatacagggacagtgggcgagacttctcttgcttgctgttcttgttgttgaggccactacgacagagtgt

SEQ ID NO: 32389 - DNA, 75 bp, Artificial Sequence
  Synthetic
tcacgccatgatgacatttcaagaaatgccaccaccaagtggggtcatatgactagttgctctctgcaaatgatt

SEQ ID NO: 32390 - DNA, 75 bp, Artificial Sequence
  Synthetic
ccgtgcaagtgtcgcaatgtgacctactccgttgaggacatgtggtgctttggtgacgctgttgtgaatgtaccc

SEQ ID NO: 32391 - DNA, 75 bp, Artificial Sequence
  Synthetic
atctatcgtgacaggtcagcaggcaagaacgtatccttggctcggctgccttatctaccaggcctccgcgggtgt

SEQ ID NO: 32392 - DNA, 75 bp, Artificial Sequence
  Synthetic
gagtataaggtgaacggtacgtggagctgttgcagcctcatggaccgtgaccctgtctgcaaacaacatcactgc

SEQ ID NO: 32393 - DNA, 75 bp, Artificial Sequence
  Synthetic
cctacggattgtacgtggaaggacccttcgctgacgtgggaacgctgtggtgtagtttcctgcatcacatcctac

SEQ ID NO: 32394 - DNA, 75 bp, Artificial Sequence
  Synthetic
cactctgggaacggttcggctgcgtgtgctgcttggatagttagagctgccatgtgggacacttttgcgatatcc

SEQ ID NO: 32395 - DNA, 75 bp, Artificial Sequence
  Synthetic
tttgatgataagaattggattaacgtgagatacaacaagtctatgtccaacaacatcacaaccgccgcgcgtctt

SEQ ID NO: 32396 - DNA, 75 bp, Artificial Sequence
  Synthetic
cccggcgcccggcgactgtatagtggtatgtgggttttttcccctaatggcacttacttcccattaggtgatctg

SEQ ID NO: 32397 - DNA, 75 bp, Artificial Sequence
  Synthetic
gctactgggcttatctctaaggccagacgtgatccgaacatgcagatcatctactctggtgggggttccttagct

SEQ ID NO: 32398 - DNA, 75 bp, Artificial Sequence
  Synthetic
gtgcctcacttagaaactactctattcttggctttagtagctggcgttttccgatcacggtccacgctattatgg

SEQ ID NO: 32399 - DNA, 75 bp, Artificial Sequence
  Synthetic
attctctttatttctctctggaaatctgcaacggcagcgttattggccccatgggtcaccgctgttgccatcgcc

SEQ ID NO: 32400 - DNA, 75 bp, Artificial Sequence
  Synthetic
tcaacttgggatgagtggtacctcaggcttctcatataccttttcttgtgcaagagtcgcaggccttaccgcttc

SEQ ID NO: 32401 - DNA, 75 bp, Artificial Sequence
  Synthetic
atgctctgcaataaattcccccttactatgcttcttttgttgcttaatgtattaggagttactgctttagacatt

SEQ ID NO: 32402 - DNA, 75 bp, Artificial Sequence
  Synthetic
gattatactactcatgttcctttggcttatgtcacctttatcgctcttattggttctggcttgtttgctacgact

SEQ ID NO: 32403 - DNA, 75 bp, Artificial Sequence
  Synthetic
gcaccatccgttagctttacatgccactacctcttggagtggttgagttgcatcagctatagtcttgagtctaat

SEQ ID NO: 32404 - DNA, 75 bp, Artificial Sequence
  Synthetic
catttccttttcatgctcggtcttgtcctgtctccagctcttatgctagatattactatgggtttgcttgctgta

SEQ ID NO: 32405 - DNA, 75 bp, Artificial Sequence
  Synthetic
cattgctctgtctggatcattgctgtgactgtgccaaacttcatgctcccgaaacatcggggtacttacgaaatt

SEQ ID NO: 32406 - DNA, 75 bp, Artificial Sequence
  Synthetic
atgcttaaatttgcgaaggtcctacctgccggcaggtggatccaacgcatcatcctttatatcgccggcgaggct

SEQ ID NO: 32407 - DNA, 75 bp, Artificial Sequence
  Synthetic
ggcgtgttgtggtatcagcaccttgggcagcgactggacttgttgcctggtgttgaccaactcaacggtgacccg

SEQ ID NO: 32408 - DNA, 75 bp, Artificial Sequence
  Synthetic
tatggtgctataaggtcccgcctggaatactttgaggatgcaggccataggtatgcttgtggcgacttggtgagg

SEQ ID NO: 32409 - DNA, 75 bp, Artificial Sequence
  Synthetic
gggaggcctgtcctgggccgccaggggtccctggttgccttcgggtggtctacccttccctccgggtttgctcct

SEQ ID NO: 32410 - DNA, 75 bp, Artificial Sequence
  Synthetic
tgcgctcctattggcgtccgacaagtctctaggcgtggtgagcttaagacctgggcggtttcactcacgggaatt

SEQ ID NO: 32411 - DNA, 75 bp, Artificial Sequence
  Synthetic
gacacagctttgtgggaaggtaacatctttaccatgggcaccatgtcgcgccgttatatgggcttcacttgcggg

SEQ ID NO: 32412 - DNA, 75 bp, Artificial Sequence
  Synthetic
gggttgctccatacggtctgccatggggcgggtcaccgctccttggctagcacgtctggggccctcccaccggtg

SEQ ID NO: 32413 - DNA, 75 bp, Artificial Sequence
  Synthetic
gtgttcgatgatggcgctgactatgctatgcacatggcgcctcgcggggctaaggacctggatgtctgcacctgt

SEQ ID NO: 32414 - DNA, 75 bp, Artificial Sequence
  Synthetic
gcagctacgtccgggttcatggttacccgcgttggtactgtgatcccacttaagttgtctgctcaaaacctgtgg

SEQ ID NO: 32415 - DNA, 75 bp, Artificial Sequence
  Synthetic
gcggttcaagccccacttgctctttccatctgtaagggcagttctggcgcccccgtgttgtgttctgccggccat

SEQ ID NO: 32416 - DNA, 75 bp, Artificial Sequence
  Synthetic
gtcatcgccatggtccagcgctgcagggccgtctctggctctgtggcttatgtctgtactactcctgtcagacat

SEQ ID NO: 32417 - DNA, 75 bp, Artificial Sequence
  Synthetic
actgctgtcggtaaaccaacacctactcgtaccgatatgtcggccccaccggcagttggtaccagttgggaggtt

SEQ ID NO: 32418 - DNA, 75 bp, Artificial Sequence
  Synthetic
caaactgtctatgcacctacgggttctgggaaaacaacattgttgccgatgcattatgtccgtaagggctataat

SEQ ID NO: 32419 - DNA, 75 bp, Artificial Sequence
  Synthetic
gtgttggttctcaatccatctgtagccacaaccatgtccatgcctgcttacatgaaggatgcttttggcattaac

SEQ ID NO: 32420 - DNA, 75 bp, Artificial Sequence
  Synthetic
ccaaacttgaaggctgctgagatgacattgaatactggagctagattaacctattccacctacgggaggtttctt

SEQ ID NO: 32421 - DNA, 75 bp, Artificial Sequence
  Synthetic
gcggatggtaagaataatgtaaattttgatgtggtcatctgtgatgagtgtcacgccactgactccactaccatt

SEQ ID NO: 32422 - DNA, 75 bp, Artificial Sequence
  Synthetic
cttggaatcggtgccgtgctatcaatcacgccaaacaccaaatgcaaattagtgcttcttgccactgcaacccct

SEQ ID NO: 32423 - DNA, 75 bp, Artificial Sequence
  Synthetic
cccggccaacctgtactaccacaccccaatatacaggaattggagcttgacgatgttggggatattaatttccat

SEQ ID NO: 32424 - DNA, 75 bp, Artificial Sequence
  Synthetic
ggcaggaaactcaaattggcgtcctacaaaacaggtagacatttgattttccaaaacagtaagaagcattgtgaa

SEQ ID NO: 32425 - DNA, 75 bp, Artificial Sequence
  Synthetic
gctctcgctgctgaccttcgttctaggggcattcgtgctgtggcttactatcgcggtctccctatcagtactatc

SEQ ID NO: 32426 - DNA, 75 bp, Artificial Sequence
  Synthetic
tcgctacggatgctcttatgactggttacaccgggaacttcgacagtgttacagactgtaatttggccactgttg

SEQ ID NO: 32427 - DNA, 75 bp, Artificial Sequence
  Synthetic
aagacatagaaattgattttgacccaaccgtttcagtcactctcaaaacagttccagctaactcagtcacacgtg

SEQ ID NO: 32428 - DNA, 75 bp, Artificial Sequence
  Synthetic
cacagaggcggggccggactggccgcggcagtcctggtgtttactactacgtaacacaggacacgccgctgtctg

SEQ ID NO: 32429 - DNA, 75 bp, Artificial Sequence
  Synthetic
gcaccgtctctgaagcatccgtgtttggcgcattcgacagtggtatggcgtggttcggtatgtcccctgcggagg

SEQ ID NO: 32430 - DNA, 75 bp, Artificial Sequence
  Synthetic
tccttgagcacctagaccactacagggtcacacctggcctgcctatcctgaagggtgtgctatctgagatatctg

SEQ ID NO: 32431 - DNA, 75 bp, Artificial Sequence
  Synthetic
ctttttatgggtgccttggctgggttactccagctttccttgccaaggcgcgcatacattccacctcttttacgt

SEQ ID NO: 32432 - DNA, 75 bp, Artificial Sequence
  Synthetic
ggcttaatgccgcgcagaggcagatttgttatgagaacggctgcaacccacctgatccccaatctcccatatgga

SEQ ID NO: 32433 - DNA, 75 bp, Artificial Sequence
  Synthetic
agggtgtgcgtgttacgggtgaaccatgtagaattctttgccatcttgaggggcatcagcccatgcaaggcccat

SEQ ID NO: 32434 - DNA, 75 bp, Artificial Sequence
  Synthetic
gccctgacgttgtcacccaactacagctagcctttacagaattggatgtatggggcgctggcgtcgctgcgtccg

SEQ ID NO: 32435 - DNA, 75 bp, Artificial Sequence
  Synthetic
ctgcctcagtgttcgcactcggcttggctctcgactactttggctccgtggccataacatcagccatggtcattg

SEQ ID NO: 32436 - DNA, 75 bp, Artificial Sequence
  Synthetic
atagtggtgagccacccaacgccccagagcctgtggacgatgatgacggctttgaagaatgttgggggttacctg

SEQ ID NO: 32437 - DNA, 75 bp, Artificial Sequence
  Synthetic
agttctcggagccgatagtcactcgctgcaggatctgggtcgaaagagtgcagctctgggcggcgggcatggcga

SEQ ID NO: 32438 - DNA, 75 bp, Artificial Sequence
  Synthetic
agtccggcgccgtcaatgatatcaacaattggtttgcaactaacttgattaccattgcatcagcactgcaattag

SEQ ID NO: 32439 - DNA, 75 bp, Artificial Sequence
  Synthetic
gagctggcatcctaatttctccagacaatcccttacttgctggcttgcttagcttttctggtgccgtcaccttgc

SEQ ID NO: 32440 - DNA, 75 bp, Artificial Sequence
  Synthetic
ctctgagccggtctcttcaggcaatcgtgattactcttggtgccatcttgactgctcgccttactacggctgaag

SEQ ID NO: 32441 - DNA, 75 bp, Artificial Sequence
  Synthetic
gggccgtatttattgcgggcgccaccctagcaggtttccagctatctgggactcctctactatccttactatttt

SEQ ID NO: 32442 - DNA, 75 bp, Artificial Sequence
  Synthetic
ccattcttggcacttatgcctcctttgtaccagcgtttggagttgttttcaaactactcgatgggcagctcccct

SEQ ID NO: 32443 - DNA, 75 bp, Artificial Sequence
  Synthetic
ccacggttgagctagctagcttgataaactgcgcctttgctccgggggcggctgtggcggcgacagccgttgctg

SEQ ID NO: 32444 - DNA, 75 bp, Artificial Sequence
  Synthetic
ttggtgccattgccttaacccagggcacgggtgtagtctggatgaacagactcctgtctatggtcgctaagtcta

SEQ ID NO: 32445 - DNA, 75 bp, Artificial Sequence
  Synthetic
atgttatctctcctgattatttcgtggaagctcgcgacatcagattgacaattaagaccttgtttgagaaaatac

SEQ ID NO: 32446 - DNA, 75 bp, Artificial Sequence
  Synthetic
atccttggaacgtcgtgaagacagccatcaaattcctgacaaccccaaccgatgtgccatgtgggtttaacatct

SEQ ID NO: 32447 - DNA, 75 bp, Artificial Sequence
  Synthetic
ttgattgcttttacagtgtttggcatgtcctctgtaaatgggcgaaagccctttacgaggctctcatcggtggcg

SEQ ID NO: 32448 - DNA, 75 bp, Artificial Sequence
  Synthetic
tcaaacgtgccatttccctcccgggtgtccctgttgctggctgccaggctggctacacgggcccctggaaggggg

SEQ ID NO: 32449 - DNA, 75 bp, Artificial Sequence
  Synthetic
agggcatgatcaccacacggtgtgggtgcggcagggaactggtttattcggtggagtttgggactgctaaagtca

SEQ ID NO: 32450 - DNA, 75 bp, Artificial Sequence
  Synthetic
tcagcggctcgaagctttgccggaattactggacctctgctgtgccaattaacaacactacatcaggtgttgcca

SEQ ID NO: 32451 - DNA, 75 bp, Artificial Sequence
  Synthetic
aacctgctccctcgtcttggaagacgatgactgttcaagttggttttggcttcgtggagtaccgtatggatggcg

SEQ ID NO: 32452 - DNA, 75 bp, Artificial Sequence
  Synthetic
atgtgatttcagtcgttgccacgtcgtctccggatgtcaccgtgcctagggttattcccagggtgttcagcgcgg

SEQ ID NO: 32453 - DNA, 75 bp, Artificial Sequence
  Synthetic
ctgccatcaacggccgtcgcactgacccatactctggggagcccaacaccccttggcgcggtgaggtttggagag

SEQ ID NO: 32454 - DNA, 75 bp, Artificial Sequence
  Synthetic
atactggctccggcagagagcgcatcaagcttccttatgctctccgtgattaccagactgactcaacggttgctc

SEQ ID NO: 32455 - DNA, 75 bp, Artificial Sequence
  Synthetic
gttctttcgagatgggaggggaaagtccaaaagaagatcccttcaccactgacattggggtcgttcatatccagc

SEQ ID NO: 32456 - DNA, 75 bp, Artificial Sequence
  Synthetic
aggctgtttccaacgaacgggccgaggacattctcgagggtcctagcgacactccgcttgatcctcctgatgttg

SEQ ID NO: 32457 - DNA, 75 bp, Artificial Sequence
  Synthetic
cggctgaacgaagtaggctggatcgagaggctgctcaacgcgcagacgtcggtactgacggcttctgggcggggt

SEQ ID NO: 32458 - DNA, 75 bp, Artificial Sequence
  Synthetic
tgcagcccttcggccaattacaggtgtttgaaactccaccacccccttacacaaagccacactctgttagttttg

SEQ ID NO: 32459 - DNA, 75 bp, Artificial Sequence
  Synthetic
tgtccctcagctcaccaggggctcctgtgtccaccagtcaacctactgatgatgaaggtagcactaaggtggtcc

SEQ ID NO: 32460 - DNA, 75 bp, Artificial Sequence
  Synthetic
tgtcaggtagactcacgcctccagaccgccccccttcacagatttcatactccagcatgccatccttggagccta

SEQ ID NO: 32461 - DNA, 75 bp, Artificial Sequence
  Synthetic
gtgctaccggcactgaacactcctgttcgggctggcgagatgcctccttgcctgcaccttctgaagactctttat

SEQ ID NO: 32462 - DNA, 75 bp, Artificial Sequence
  Synthetic
ctgccttgggtgctgccgcgcctaaggagtgcagctacagttacatatgggacgggctcccatatgtggctcacc

SEQ ID NO: 32463 - DNA, 75 bp, Artificial Sequence
  Synthetic
ttgcaaaacgatccttctctgctgttgccgccataactcacggtttggtgtcacgcaacctcgtttatgtcacca

SEQ ID NO: 32464 - DNA, 75 bp, Artificial Sequence
  Synthetic
agcctgaaaatgttttggagcggatgaagaaagtgactcggttccgtccacctgcaacaccgaatccacacttag

SEQ ID NO: 32465 - DNA, 75 bp, Artificial Sequence
  Synthetic
agactcttaccaaacaagctgtgcggctggtttccacattggatatgcagcccatgacatattgggaggccgctg

SEQ ID NO: 32466 - DNA, 75 bp, Artificial Sequence
  Synthetic
ccatcacgtcctcgcgcactgctcgatctgctgtcaccggccacacgggcggtgatgtgaagagcggtgctgcgc

SEQ ID NO: 32467 - DNA, 75 bp, Artificial Sequence
  Synthetic
gcagggacgtggagcaactctacaggactcttgagagcgagtccttgcagaggccttacaatgaagtcgtggtca

SEQ ID NO: 32468 - DNA, 75 bp, Artificial Sequence
  Synthetic
tgccaaaatcagaagtctttatgcgaaataaagcaactgagaaaccaccccgcataattgcttatccccaccttg

SEQ ID NO: 32469 - DNA, 75 bp, Artificial Sequence
  Synthetic
agaccagggtcgctgaaaagatggtacttggcaatataggacctggcacggtaaagaaagtgctgggaaaagcct

SEQ ID NO: 32470 - DNA, 75 bp, Artificial Sequence
  Synthetic
acggctttgtaccacccaaagacagaatcaatagactcctgactatgtggcgccggcctaatcccatggcttttg

SEQ ID NO: 32471 - DNA, 75 bp, Artificial Sequence
  Synthetic
cttgcgatgtgatcactttcgactccacaattacacccgaggatgttgatcgtgaagcacgtttgtatgcatctg

SEQ ID NO: 32472 - DNA, 75 bp, Artificial Sequence
  Synthetic
ccactaaggattcgtcgacgcgcgcaagaatctggaacctacataaattctatgcatcaggacctatggtggacc

SEQ ID NO: 32473 - DNA, 75 bp, Artificial Sequence
  Synthetic
agaggggaaattatttgggcactcgcaattgcagagcctctggtgtatttactacttccagctctaacacaatga

SEQ ID NO: 32474 - DNA, 75 bp, Artificial Sequence
  Synthetic
cggccttcctgaaagtcaaggcggctgccatgactgccgggtttgttaggcctgaattcatcgtcgcaggcgacg

SEQ ID NO: 32475 - DNA, 75 bp, Artificial Sequence
  Synthetic
atgtcgttgttgtcacccaagcagagcccgttcctgatagggataagaagaaactagctatctttgctaatgcaa

SEQ ID NO: 32476 - DNA, 75 bp, Artificial Sequence
  Synthetic
tgaaagacatgggcgcaccaatagaattgcccagccccaagtactcattggaagacgtcaccagctgctcgagca

SEQ ID NO: 32477 - DNA, 75 bp, Artificial Sequence
  Synthetic
acgtcacgacgggattcacgagggacgggcgccaggtgtatttcctgacgcgcgaccccagtgttccgtttgcac

SEQ ID NO: 32478 - DNA, 75 bp, Artificial Sequence
  Synthetic
gctgttccgcggagggtgaaggattcaatccgatgggtgcctgggtgggcaatctgttgtggcatttcccgtgtt

SEQ ID NO: 32479 - DNA, 75 bp, Artificial Sequence
  Synthetic
tgtgggtccggatcatcagcacccacatgctagagacgtacctcgagtcagagttcccagatgaaatcacatgcg

SEQ ID NO: 32480 - DNA, 75 bp, Artificial Sequence
  Synthetic
attggtatgggaggcaggtctcactcaaaatccaggacctgccatacatactcaccgccatgcacgggaacgatg

SEQ ID NO: 32481 - DNA, 75 bp, Artificial Sequence
  Synthetic
caaaatccaggacctgccatacatactcaccgccatgcacgggaacgatggcttcgacgtcgtccgcttcactcc

SEQ ID NO: 32482 - DNA, 75 bp, Artificial Sequence
  Synthetic
tcgtaccatcagagctgcttgcttccgcaaaggaggattgcacaagtttcttgcctatcacctgctctcttttgc

SEQ ID NO: 32483 - DNA, 75 bp, Artificial Sequence
  Synthetic
ttctaattctgttaggcaacctctcaacccaaaagctgtgtctcggttctcggttgaactcggagcggatgtgga

SEQ ID NO: 32484 - DNA, 75 bp, Artificial Sequence
  Synthetic
ggaacccattgtaatcgggaaacctccgggtccaccgtggatcggggctatagctctctctgtgttggctctact

SEQ ID NO: 32485 - DNA, 75 bp, Artificial Sequence
  Synthetic
cctccgggtccaccgtggatcggggctatagctctctctgtgttggctctactgttcttctttctcaaacactga

SEQ ID NO: 32486 - DNA, 75 bp, Artificial Sequence
  Synthetic
accaaacaagagaagagacctgtttggaaatatgaatttaaatagaaattaacttaggattaaagaactttaccg

SEQ ID NO: 32487 - DNA, 75 bp, Artificial Sequence
  Synthetic
ggaaatatgaatttaaatagaaattaacttaggattaaagaactttaccgaaaggtaagggagaagaaatccttg

SEQ ID NO: 32488 - DNA, 75 bp, Artificial Sequence
  Synthetic
aattgtcatcatgttgagtctgtttgatacattcagtgcacgcaggcaggaaaacataaccaaatcagctggtgg

SEQ ID NO: 32489 - DNA, 75 bp, Artificial Sequence
  Synthetic
agctgttattcctgggcaaaagaacacagtctctatatttgcccttggtccctcaataacagatgacaatgataa

SEQ ID NO: 32490 - DNA, 75 bp, Artificial Sequence
  Synthetic
acagtctctatatttgcccttggtccctcaataacagatgacaatgataaaatgacattagctctcctgttctta

SEQ ID NO: 32491 - DNA, 75 bp, Artificial Sequence
  Synthetic
tctcactcactagataatgagaagcagcatgcacaaagagctggatttttagtctccttgctatccatggcttat

SEQ ID NO: 32492 - DNA, 75 bp, Artificial Sequence
  Synthetic
agtctccttgctatccatggcttatgctaacccagaattatacttaacatcaaatggtaataatgcagatgtcaa

SEQ ID NO: 32493 - DNA, 75 bp, Artificial Sequence
  Synthetic
caaatggtaataatgcagatgtcaaatatgttatctatatgatagaaaaagactcagggagacaaaaatacggtg

SEQ ID NO: 32494 - DNA, 75 bp, Artificial Sequence
  Synthetic
gcttagttgttaagactagggaaatggtttatgagaagacaactgattggatgtttggaagtgatcttgagtatg

SEQ ID NO: 32495 - DNA, 75 bp, Artificial Sequence
  Synthetic
atgtttggaagtgatcttgagtatgatcaagataatatgttacagaatggtaggagcacctccacgattgaagat

SEQ ID NO: 32496 - DNA, 75 bp, Artificial Sequence
  Synthetic
tccagtctggtattaagtggagatgcagtagagcagatcggatcgatcatgaggtctcagcaaagtttggttacg

SEQ ID NO: 32497 - DNA, 75 bp, Artificial Sequence
  Synthetic
cttatggtcgagacactgataacaatgaacacaggaaggaatgatctaacaacgatagagaagaacatacaaatt

SEQ ID NO: 32498 - DNA, 75 bp, Artificial Sequence
  Synthetic
tgaacacaggaaggaatgatctaacaacgatagagaagaacatacaaattgtaggaaactacataagagatgcag

SEQ ID NO: 32499 - DNA, 75 bp, Artificial Sequence
  Synthetic
gacttgcttcattctttaatacaatcagatatggcattgaaaccagaatggcagctctaacattgtctactctta

SEQ ID NO: 32500 - DNA, 75 bp, Artificial Sequence
  Synthetic
gtcttgcttcattctttaatacaatcagatatggcattgaaaccagaatggcagctctaacattgtctactctta

SEQ ID NO: 32501 - DNA, 75 bp, Artificial Sequence
  Synthetic
gccttgcttcattctttaatacaatcagatatggcattgaaaccagaatggcagctctaacattgtctactctta

SEQ ID NO: 32502 - DNA, 75 bp, Artificial Sequence
  Synthetic
ggcttgcttcattctttaatacaatcagatatggcattgaaaccagaatggcagctctaacattgtctactctta

SEQ ID NO: 32503 - DNA, 75 bp, Artificial Sequence
  Synthetic
gaccagacatcaacagactcaaagcattaatagagttatacctatcaaaggggccacgtgccccttttatatgta

SEQ ID NO: 32504 - DNA, 75 bp, Artificial Sequence
  Synthetic
ctctggagttatgcaatgggtgtagcagttgtccagaacaaagctatgcaacagtatgtaacaggacggtcctat

SEQ ID NO: 32505 - DNA, 75 bp, Artificial Sequence
  Synthetic
ctagatattgagatgttccaactaggtcaagcagtggcacgtgacgccgagtcacaaatgaattcaatattggat

SEQ ID NO: 32506 - DNA, 75 bp, Artificial Sequence
  Synthetic
gtcaagcagtggcacgtgacgccgagtcacaaatgaattcaatattggatgaagaattggggattacacaagagg

SEQ ID NO: 32507 - DNA, 75 bp, Artificial Sequence
  Synthetic
ccaagcagagtttgaagaaacacatgaagaaaatcagtagttcggacacaactttctacaaacctacagggggaa

SEQ ID NO: 32508 - DNA, 75 bp, Artificial Sequence
  Synthetic
cagccatagaaatggcaatagacgaagaaatagaacaaccagaatccagaggagaccaggatcaaactgacgatc

SEQ ID NO: 32509 - DNA, 75 bp, Artificial Sequence
  Synthetic
ttcagtcatctataatcccctatgcatgggcagacgaggcaagcgacaaaaaccaagcagggtcaaccacagacg

SEQ ID NO: 32510 - DNA, 75 bp, Artificial Sequence
  Synthetic
aaacatcagagatagattgaacaaaaggctcaacgaaaagagaagacagaatgaatcaaaatcagctgacataac

SEQ ID NO: 32511 - DNA, 75 bp, Artificial Sequence
  Synthetic
ttaccatttgcaacaaataagaaaaacttaggattaacggagattatccaatcctgacacagcagaccaagacca

SEQ ID NO: 32512 - DNA, 75 bp, Artificial Sequence
  Synthetic
gagaattcatggaagacaatgttcaaaacaatcaaatcatggattcttgggaagagagatcaggagacaagtcat

SEQ ID NO: 32513 - DNA, 75 bp, Artificial Sequence
  Synthetic
ccgacatctcatcagccctcgacatcattgaattcatactcagcaccgatccccaagaaagcgcggtcagcgaca

SEQ ID NO: 32514 - DNA, 75 bp, Artificial Sequence
  Synthetic
gctcagcacaacaatccaccggcccgacccaaaatcaacaaagacaggcgaggaaaatagtggatcaactaacga

SEQ ID NO: 32515 - DNA, 75 bp, Artificial Sequence
  Synthetic
aggaaaatagtggatcaactaacgaagatcgacagcttgggacatcatacaaatataccgcagaaacaaaagata

SEQ ID NO: 32516 - DNA, 75 bp, Artificial Sequence
  Synthetic
gagttgttaatcaggaagctatacagggaagaaataggagaggaagcagctcagatagtagaactgagactatgg

SEQ ID NO: 32517 - DNA, 75 bp, Artificial Sequence
  Synthetic
tcattagaagaatcaccggaggcagctcagatcctgacaatggaaccgaaatccaggaaaatcttgattacaatg

SEQ ID NO: 32518 - DNA, 75 bp, Artificial Sequence
  Synthetic
aaactagagaggtggataagaaccctactaaggggaaagtgcgacaacttgaaaatgttccagtcaaggtaccaa

SEQ ID NO: 32519 - DNA, 75 bp, Artificial Sequence
  Synthetic
gaaaatgttccagtcaaggtaccaagaagtgatgccatacctccagcaaaatcagatggaaacagtgatgatgga

SEQ ID NO: 32520 - DNA, 75 bp, Artificial Sequence
  Synthetic
atcagatggaaacagtgatgatggaggaagcctggaatctatcagtacacctaatccaagacatactagcctagt

SEQ ID NO: 32521 - DNA, 75 bp, Artificial Sequence
  Synthetic
ggaagcctggaatctatcagtacacctaatccaagacatactagcctagtgaccacagcaacaccagatgatgaa

SEQ ID NO: 32522 - DNA, 75 bp, Artificial Sequence
  Synthetic
gaccacagcaacaccagatgatgaagaagagcttttctcgaaaaacaaaaggtcaaaaaggcaccagctaacaac

SEQ ID NO: 32523 - DNA, 75 bp, Artificial Sequence
  Synthetic
ccagagagacaacaaagaaattaaaaaagggggagaggaggagatttggaagcaagcagatatcgaccatcagtc

SEQ ID NO: 32524 - DNA, 75 bp, Artificial Sequence
  Synthetic
agaaatccccaacgatcagtacacggacagaaacaaacaatggtatcaaacaaatcagctcccgaacaacaagtc

SEQ ID NO: 32525 - DNA, 75 bp, Artificial Sequence
  Synthetic
tcaatttacagaaagggcgattacattattacagagtcttggtgtaatccaatctgcagcaaaattagacctgta

SEQ ID NO: 32526 - DNA, 75 bp, Artificial Sequence
  Synthetic
ccaagacaagagagttgtatgtgtggcgaatgtcctgaacaatgcagatactgcatcgaagatcgattttttagc

SEQ ID NO: 32527 - DNA, 75 bp, Artificial Sequence
  Synthetic
tcacacagaaggttgattgagaatcaaaaagaacaactatcattaatcacatcattaatttcgaatcttaagatt

SEQ ID NO: 32528 - DNA, 75 bp, Artificial Sequence
  Synthetic
atcattaatttcgaatcttaagattatgacagagagaggaggaaagaaagaccaggctgagacaagtggaagaac

SEQ ID NO: 32529 - DNA, 75 bp, Artificial Sequence
  Synthetic
accaatgataaaaacaaaaatgaaagaagagaagataaggaaagttaagttcgatcctctcatggaaacacaagg

SEQ ID NO: 32530 - DNA, 75 bp, Artificial Sequence
  Synthetic
gaagagaagataaggaaagttaagttcgatcctctcatggaaacacaaggcatcgaaaagaatgttcctgattta

SEQ ID NO: 32531 - DNA, 75 bp, Artificial Sequence
  Synthetic
tcgatcctctcatggaaacacaaggcatcgaaaagaatgttcctgatttatacaggtcgatagagaaggcaccag

SEQ ID NO: 32532 - DNA, 75 bp, Artificial Sequence
  Synthetic
tacaggtcgatagagaaggcaccagaaagtgacgtgcagattaaatcagaaattagtaggttaagtgatgaatcg

SEQ ID NO: 32533 - DNA, 75 bp, Artificial Sequence
  Synthetic
aaagtgacgtgcagattaaatcagaaattagtaggttaagtgatgaatcgaatgcaactagactaataccaaaga

SEQ ID NO: 32534 - DNA, 75 bp, Artificial Sequence
  Synthetic
gaataagcagcacaatgaggtcattaatcataatcatcaataacagcagcctgtcatcaaaggcaaaacagtcat

SEQ ID NO: 32535 - DNA, 75 bp, Artificial Sequence
  Synthetic
acataaatgaactcaagctctgcaagagtgatgaagaagtatctgaattgatggatatgtttaatgaagacatta

SEQ ID NO: 32536 - DNA, 75 bp, Artificial Sequence
  Synthetic
gagtgatgaagaagtatctgaattgatggatatgtttaatgaagacattagctcctaatagacagctaaatgaca

SEQ ID NO: 32537 - DNA, 75 bp, Artificial Sequence
  Synthetic
atcaccaccacagaacacaccgacacacatcagcaaaccaaagattatccccaattaccaagtcaatcaacacac

SEQ ID NO: 32538 - DNA, 75 bp, Artificial Sequence
  Synthetic
cacatcagcaaaccaaagattatccccaattaccaagtcaatcaacacactacagtagttcccagacacaagcca

SEQ ID NO: 32539 - DNA, 75 bp, Artificial Sequence
  Synthetic
atcaagaaaaacttaggacaaaagagccaatcagtccctcgacaaaatgagcatcacaaactccgcaatatatac

SEQ ID NO: 32540 - DNA, 75 bp, Artificial Sequence
  Synthetic
atttccagaatcttcattttctgaaagtggcaatatagagccactaccactaaaggtcaacgaacaaaggaaggc

SEQ ID NO: 32541 - DNA, 75 bp, Artificial Sequence
  Synthetic
aattcctcacatcagagttgttaaaataggtgacccacccaaacatggttcaagatatcttgatgtatttctact

SEQ ID NO: 32542 - DNA, 75 bp, Artificial Sequence
  Synthetic
gggtttttttgagatggagcggtcaaaggacagatatgggagtgtcagtgatctggatgatgatccaagttataa

SEQ ID NO: 32543 - DNA, 75 bp, Artificial Sequence
  Synthetic
agtttgtggttctggatctctaccacttgggctagcaagatacactgggaatgatcaggaactcctacaagccgc

SEQ ID NO: 32544 - DNA, 75 bp, Artificial Sequence
  Synthetic
atgatcaggaactcctacaagccgcaactaagttagacatagaagtgagaagaaccgtcaaagccacggagatga

SEQ ID NO: 32545 - DNA, 75 bp, Artificial Sequence
  Synthetic
tagtctacaccgtacagaacattaaacctgaactgtacccatggtcaagcagattaagaaaagggatgttatttg

SEQ ID NO: 32546 - DNA, 75 bp, Artificial Sequence
  Synthetic
ataaaattcagagtaatatttgtgaattgtacagcaattggatcaataacactctttaaaattcccaaatctatg

SEQ ID NO: 32547 - DNA, 75 bp, Artificial Sequence
  Synthetic
gctttgctatcattgccaaacactatatcaataaacttacaggtacacataaaaacaggaattcaaactgactct

SEQ ID NO: 32548 - DNA, 75 bp, Artificial Sequence
  Synthetic
tatggtccatcttggattaatcaaacggaaggtaggtcgaatgtattcagtagagtattgcaaacaaaagattga

SEQ ID NO: 32549 - DNA, 75 bp, Artificial Sequence
  Synthetic
tagagtattgcaaacaaaagattgagaagatgagactactattttcattgggattagttggaggaattagctttc

SEQ ID NO: 32550 - DNA, 75 bp, Artificial Sequence
  Synthetic
ttcaaaagggaaatctgttatcctctcatggatttaaatccacacctaaatctggttatatgggcatcatcaatt

SEQ ID NO: 32551 - DNA, 75 bp, Artificial Sequence
  Synthetic
gaaattacaagagtggatgcaatccttcaaccttcattgcccggtgagttcagatattacccaaacataatagca

SEQ ID NO: 32552 - DNA, 75 bp, Artificial Sequence
  Synthetic
cagatattacccaaacataatagcaaaaggagtcgggaaaatcaagcagtaacaccgacagcctggacaagcaac

SEQ ID NO: 32553 - DNA, 75 bp, Artificial Sequence
  Synthetic
aaaggagtcgggaaaatcaagcagtaacaccgacagcctggacaagcaacactataaatcagatcatccaaaaaa

SEQ ID NO: 32554 - DNA, 75 bp, Artificial Sequence
  Synthetic
acggacagagcagaagaggcaccaggggaagaaccaacaaacgggaaaggggaaagaacaacagaaaacaggggc

SEQ ID NO: 32555 - DNA, 75 bp, Artificial Sequence
  Synthetic
caacagaacacaagaaaaaagaatagaaaacgaagagtatcaaagatgatcactatagttgcaacgacagttata

SEQ ID NO: 32556 - DNA, 75 bp, Artificial Sequence
  Synthetic
ttattattacctttatcactatgtcagatagatataacaaagttgcaacgagtaggggtgctagtcaacaatcca

SEQ ID NO: 32557 - DNA, 75 bp, Artificial Sequence
  Synthetic
aaaggcatgaagatttcacaaaattttgaaacaagatacttaatattaagtttaataccaaagatagagaactca

SEQ ID NO: 32558 - DNA, 75 bp, Artificial Sequence
  Synthetic
ttgaaacaagatacttaatattaagtttaataccaaagatagagaactcacaaccatgcggagaccaacaaataa

SEQ ID NO: 32559 - DNA, 75 bp, Artificial Sequence
  Synthetic
atcaatataagaaattattagatagattaattattcctttatatgatgggttaaaattacagaaagatgtaatcg

SEQ ID NO: 32560 - DNA, 75 bp, Artificial Sequence
  Synthetic
tactagttccaggaagaagcggttcttcggagaaataattgggacaattgcgatagggatagccacatcagctca

SEQ ID NO: 32561 - DNA, 75 bp, Artificial Sequence
  Synthetic
aataactgcagcagttgcccttgttgaagccaaacaagcaagagcagatatagacaagctcaaggaagccatcag

SEQ ID NO: 32562 - DNA, 75 bp, Artificial Sequence
  Synthetic
agatacaaacaaggcagtacagtcaattcaaagctcagtaggaaatctaattgttgcggttaagtcagttcaaga

SEQ ID NO: 32563 - DNA, 75 bp, Artificial Sequence
  Synthetic
ttgttgcggttaagtcagttcaagattacgtcaataatgagattgtaccatcaatagcaagactaggctgtgaag

SEQ ID NO: 32564 - DNA, 75 bp, Artificial Sequence
  Synthetic
gaacactgaaggagaagggaataaaattacaagggatagcatcattatatcgcacaaacataacagagatattca

SEQ ID NO: 32565 - DNA, 75 bp, Artificial Sequence
  Synthetic
ctacttcaacagttgatcaatatgacatttatgatctattgttcactgagtcaatcaaaatgagagttatagatg

SEQ ID NO: 32566 - DNA, 75 bp, Artificial Sequence
  Synthetic
tagacttaaatgactattcaattacactacaagttagactacctttattaacaaaattatcaaacactcagattt

SEQ ID NO: 32567 - DNA, 75 bp, Artificial Sequence
  Synthetic
atagagtggattctatatcatataatatccaaggtaaggaatggtacattcctcttcccaatcacatcatgacaa

SEQ ID NO: 32568 - DNA, 75 bp, Artificial Sequence
  Synthetic
cctcttcccaatcacatcatgacaaagggggcatttttgggtggtgccgatataaaagagtgtatagaggcattc

SEQ ID NO: 32569 - DNA, 75 bp, Artificial Sequence
  Synthetic
agcagttacatatgtccctctgacccaggttttatattaaatcgtgagatagaaaactgtctatcagggaatatc

SEQ ID NO: 32570 - DNA, 75 bp, Artificial Sequence
  Synthetic
caggttttatattaaatcgtgagatagaaaactgtctatcagggaatatcacacagtgtccgaaaaccgtcgtta

SEQ ID NO: 32571 - DNA, 75 bp, Artificial Sequence
  Synthetic
catcagacatagtaccaagatatgcatttgttaatggcggagtaattgccaattgtataccaaccacttgtacat

SEQ ID NO: 32572 - DNA, 75 bp, Artificial Sequence
  Synthetic
gtaataacacataaagaatgtcaagtgataggtataaacgggatgttattcagacctaacaaagaagggactttg

SEQ ID NO: 32573 - DNA, 75 bp, Artificial Sequence
  Synthetic
gcaacttatacatatgatgacattgttttaaacaattctgtcgcgcttgacccaattgacatatcaatggaactc

SEQ ID NO: 32574 - DNA, 75 bp, Artificial Sequence
  Synthetic
aacaaagctaaattggaattagaagaatcaaaagaatggataaagaagtcaaatcaaaaattggactctgttgga

SEQ ID NO: 32575 - DNA, 75 bp, Artificial Sequence
  Synthetic
ggttggtatcagtcaaatataacaattactataataatagtgatgataataattctgtttataatcaacatgata

SEQ ID NO: 32576 - DNA, 75 bp, Artificial Sequence
  Synthetic
atcattataataatctttaaacaattcaagattcgcaatagacacccaatcgacaagagcaatgaaccctatgtc

SEQ ID NO: 32577 - DNA, 75 bp, Artificial Sequence
  Synthetic
tcaagattcgcaatagacacccaatcgacaagagcaatgaaccctatgtcctgaccaggaaacagtagggaaatg

SEQ ID NO: 32578 - DNA, 75 bp, Artificial Sequence
  Synthetic
tggcaccaaacatcaagggtataaaaaacttaggaacaaagcagttcaactcagagacaaagaacagacgacaaa

SEQ ID NO: 32579 - DNA, 75 bp, Artificial Sequence
  Synthetic
aaacttaggaacaaagcagttcaactcagagacaaagaacagacgacaaagaatcccggcctcaaaaatggaata

SEQ ID NO: 32580 - DNA, 75 bp, Artificial Sequence
  Synthetic
ttggaggcacacaaacaacgccaaaaacaccaacactgaattccaaacagagacaactaggcgtaataataaagt

SEQ ID NO: 32581 - DNA, 75 bp, Artificial Sequence
  Synthetic
agacaactaggcgtaataataaagttacaaatatcatgatgtccatcttcggggcaatactctcaactatattgt

SEQ ID NO: 32582 - DNA, 75 bp, Artificial Sequence
  Synthetic
ggggcaatactctcaactatattgttgacagtgttcataatgatactggtaggtttgattcaagaaagcaaccac

SEQ ID NO: 32583 - DNA, 75 bp, Artificial Sequence
  Synthetic
aaaaatccagcaagctgcagatgaaattggtacatcaatacaatcgggaataaacacaagactcctaactatcca

SEQ ID NO: 32584 - DNA, 75 bp, Artificial Sequence
  Synthetic
gagtcatgtccaaaattatattccattatctttgacacaacaaatgtcggatcttagaaaatttatcaatgaatt

SEQ ID NO: 32585 - DNA, 75 bp, Artificial Sequence
  Synthetic
acagcgggattgaacctctaaacccagacaaattctggagatgtacctctggcaatccatccctgacaagtaacc

SEQ ID NO: 32586 - DNA, 75 bp, Artificial Sequence
  Synthetic
caaagataagactaataccaggtcctagtctgttagcagcatctaccactgtaaatggttgtataaggatcccgt

SEQ ID NO: 32587 - DNA, 75 bp, Artificial Sequence
  Synthetic
ccttcgtaatcaacaatctaatatatgcttacacttccaaccttattgttcaaggttgccaggatatagggaagt

SEQ ID NO: 32588 - DNA, 75 bp, Artificial Sequence
  Synthetic
catcactataaattcagacctggtacctgacttaaaccctagagttacacatacttttaatattgatgataatag

SEQ ID NO: 32589 - DNA, 75 bp, Artificial Sequence
  Synthetic
aaagtcctgttctttagcactactaaatacagatgtatatcagttgtgctcaactccgaaagttgacgaaagatc

SEQ ID NO: 32590 - DNA, 75 bp, Artificial Sequence
  Synthetic
caactccgaaagttgacgaaagatcagactatgcatcaacagggattgaagacattgtacttgatattattacta

SEQ ID NO: 32591 - DNA, 75 bp, Artificial Sequence
  Synthetic
acaatggattaatcatcacaacaagatttaccaatgataatataacatttgacaaaccatatgcagcactgtacc

SEQ ID NO: 32592 - DNA, 75 bp, Artificial Sequence
  Synthetic
catcagtaggaccggggatttattataaaggtaaggttatttttctcggatatggtggattagaacatgcagaga

SEQ ID NO: 32593 - DNA, 75 bp, Artificial Sequence
  Synthetic
atggtgatgtaatatgcaatttaactggttgtccaggcaaaacacagagagactgtaatcaggcttcctacagcc

SEQ ID NO: 32594 - DNA, 75 bp, Artificial Sequence
  Synthetic
catggttttcagataggagaatggtgaactctattattgttgttaataagggtgtggacacaactttcaatttaa

SEQ ID NO: 32595 - DNA, 75 bp, Artificial Sequence
  Synthetic
ggtgtggacacaactttcaatttaagagtatggactatcccaatgaggcaaaactattggggatcagaagggaga

SEQ ID NO: 32596 - DNA, 75 bp, Artificial Sequence
  Synthetic
ttacttttattaggcaataagatatacatatatactagatctacaagttggcatagtaaactccaattagggaca

SEQ ID NO: 32597 - DNA, 75 bp, Artificial Sequence
  Synthetic
acatatatactagatctacaagttggcatagtaaactccaattagggacaattgacatcaccaattacagtgata

SEQ ID NO: 32598 - DNA, 75 bp, Artificial Sequence
  Synthetic
tcaggatcaattggacttggcatgatgcattatcgagaccaggaaatgatgattgtccgtggggtcactcatgcc

SEQ ID NO: 32599 - DNA, 75 bp, Artificial Sequence
  Synthetic
tgcattatcgagaccaggaaatgatgattgtccgtggggtcactcatgcccggatgggtgtataacaggggttta

SEQ ID NO: 32600 - DNA, 75 bp, Artificial Sequence
  Synthetic
tactgatgcatacccgctaaacccatcaggaagtgttgtgtcatcagttattcttgattctcgaaaatccaggga

SEQ ID NO: 32601 - DNA, 75 bp, Artificial Sequence
  Synthetic
aaatccgatcatcacttacgcaacagacacacgtagagtaaatgaactggctatatataacagaacacttccagc

SEQ ID NO: 32602 - DNA, 75 bp, Artificial Sequence
  Synthetic
tgcatacacaacaacaaattgcattatgcattatgataagggatactgcttccacattgtcgagataaatcatag

SEQ ID NO: 32603 - DNA, 75 bp, Artificial Sequence
  Synthetic
gagcctaaatacattccaacctatgttattcaaaacagaaattccaaagaactgtagttgagttgactctcccat

SEQ ID NO: 32604 - DNA, 75 bp, Artificial Sequence
  Synthetic
gttaattatcaaacacaaaagacaagcatcaacaggtaggggattaaaaaaatgagatgacaaataggggaagaa

SEQ ID NO: 32605 - DNA, 75 bp, Artificial Sequence
  Synthetic
taaaaaacttaggagaaaagtttgtcgggaaaatggacaccgaattcagcggtggcacaacatctgatattttat

SEQ ID NO: 32606 - DNA, 75 bp, Artificial Sequence
  Synthetic
atccagaatgtcatctcaattctcctatagttaaagggaaaatagcacaattacacactataatgagtttgcctc

SEQ ID NO: 32607 - DNA, 75 bp, Artificial Sequence
  Synthetic
aaccttatgatatggatgatgactcaatactagttataactaggcagaagattaggctaaataaattagataaaa

SEQ ID NO: 32608 - DNA, 75 bp, Artificial Sequence
  Synthetic
gacaacgatcaatcaggaaattgaaatctgtcctaatggaaagagtaattgacttaggtaaatataactttatta

SEQ ID NO: 32609 - DNA, 75 bp, Artificial Sequence
  Synthetic
ggtatccagaaatgtctaatgaaatgttccaattgtgtatacctggaattaatagcagaataaatgaattattaa

SEQ ID NO: 32610 - DNA, 75 bp, Artificial Sequence
  Synthetic
aatgactgatggattaaggaatttatgggttactatactatcaaaattggcatcaaaaaatgatggaagtaatta

SEQ ID NO: 32611 - DNA, 75 bp, Artificial Sequence
  Synthetic
taatattaacgaagatatcagtaacatatctagtgttcacacaacctatcaatcagatagatggtataatccatt

SEQ ID NO: 32612 - DNA, 75 bp, Artificial Sequence
  Synthetic
caaggattacaatttattagaagatcaaaggaatgtattactgatacatacggagcttgtcctcatactagacaa

SEQ ID NO: 32613 - DNA, 75 bp, Artificial Sequence
  Synthetic
acaaaattataaaggatatataataacccctgaattggtattaatgtattgtgacgtagttgaaggaagatggaa

SEQ ID NO: 32614 - DNA, 75 bp, Artificial Sequence
  Synthetic
cattagctcgtgtgcaaaactagaccctaaattacattcaatgtattacaaaggtaacaacttgtgggaaacaat

SEQ ID NO: 32615 - DNA, 75 bp, Artificial Sequence
  Synthetic
agatgggttgttcccaaaattaggagagaaaacttttgatataatatcattgttagaaccactagctttgtcact

SEQ ID NO: 32616 - DNA, 75 bp, Artificial Sequence
  Synthetic
atgtattatctgaaatggagtcaatattagacaccaggtataagaccgaagaaacacctgaattggactacatag

SEQ ID NO: 32617 - DNA, 75 bp, Artificial Sequence
  Synthetic
gaaacacctgaattggactacatagacaaaattctagatgtattcaaagaatcaacaatagatgaaatagcagag

SEQ ID NO: 32618 - DNA, 75 bp, Artificial Sequence
  Synthetic
attttctcttttttccgaacttttggacatcctccattagaagctagtatagcagcagaaaaagtcaggaaatat

SEQ ID NO: 32619 - DNA, 75 bp, Artificial Sequence
  Synthetic
atgtatactgagaaaagcctaaattttgatactattaataaatgtcatgctattttttgtacaatcattataaat

SEQ ID NO: 32620 - DNA, 75 bp, Artificial Sequence
  Synthetic
ttgatactattaataaatgtcatgctattttttgtacaatcattataaatgggtatagagaaagacacggaggac

SEQ ID NO: 32621 - DNA, 75 bp, Artificial Sequence
  Synthetic
tattttttgtacaatcattataaatgggtatagagaaagacacggaggacaatggcctccaattatattgcctgc

SEQ ID NO: 32622 - DNA, 75 bp, Artificial Sequence
  Synthetic
catacgaaaatgctgttgattactataggagctttataggaattaagttcaacaaatttatagaacctcaattag

SEQ ID NO: 32623 - DNA, 75 bp, Artificial Sequence
  Synthetic
atgaagacttaactatttatatgaaagataaagcattatctccaaaaaaatcaaactgggacaccgtatatccat

SEQ ID NO: 32624 - DNA, 75 bp, Artificial Sequence
  Synthetic
cctcaaacttactgtatcgtactagtacaacccatgattcaagaaggttagttgaggtttttatagcagatagta

SEQ ID NO: 32625 - DNA, 75 bp, Artificial Sequence
  Synthetic
cctcaaacttactgtatcgtactagtacatcccatgattcaagaaggttagttgaggtttttatagcagatagta

SEQ ID NO: 32626 - DNA, 75 bp, Artificial Sequence
  Synthetic
cctcaaacttactgtatcgtactagtacaccccatgattcaagaaggttagttgaggtttttatagcagatagta

SEQ ID NO: 32627 - DNA, 75 bp, Artificial Sequence
  Synthetic
cctcaaacttactgtatcgtactagtacagcccatgattcaagaaggttagttgaggtttttatagcagatagta

SEQ ID NO: 32628 - DNA, 75 bp, Artificial Sequence
  Synthetic
aatgatcctgagttcaatatctcatatagtctaaaagagaaggagataaagcaagaaggtaggctttttgcaaag

SEQ ID NO: 32629 - DNA, 75 bp, Artificial Sequence
  Synthetic
gcaagaaggtaggctttttgcaaagatgacatataaaatgagagctgcgcaagttttgtcagaaacgttattagc

SEQ ID NO: 32630 - DNA, 75 bp, Artificial Sequence
  Synthetic
atgacatataaaatgagagctgcgcaagttttgtcagaaacgttattagcaaacaatatagggaaattctttcag

SEQ ID NO: 32631 - DNA, 75 bp, Artificial Sequence
  Synthetic
gagaatggaatggtcaaaggagagattgagctacttaaaagattgacaacaatatctatgtctggagtcccacga

SEQ ID NO: 32632 - DNA, 75 bp, Artificial Sequence
  Synthetic
ttgagctacttaaaagattgacaacaatatctatgtctggagtcccacgatacaatgaagtatacaataatccca

SEQ ID NO: 32633 - DNA, 75 bp, Artificial Sequence
  Synthetic
aaagtcatacagatgagatcaaagcttacaacgcaattagtaattctaatttatcttctaaccaaaaatcaagaa

SEQ ID NO: 32634 - DNA, 75 bp, Artificial Sequence
  Synthetic
atacaatgacggatatgaaactgtaagttgttttttaacaacagatctaaagaaatattgtttgaattggagata

SEQ ID NO: 32635 - DNA, 75 bp, Artificial Sequence
  Synthetic
tgaatcaacagctctatttggtgatacttgcaatcagattttcgggttaaaagagttattcaattggttgcatcc

SEQ ID NO: 32636 - DNA, 75 bp, Artificial Sequence
  Synthetic
tcgccttgaaaagagtacaatatatgttggagatccctattgcccgcccttagatatagaacacttacaacttga

SEQ ID NO: 32637 - DNA, 75 bp, Artificial Sequence
  Synthetic
acttatatctattagcgcaatacacctagcggctgtcaaaataggtgttagagtgactgcaatggtgcaaggaga

SEQ ID NO: 32638 - DNA, 75 bp, Artificial Sequence
  Synthetic
caatcaagccattgctgtgactacaagggtgccaaataactatgattacaggatcaagaaggaaattgtttacaa

SEQ ID NO: 32639 - DNA, 75 bp, Artificial Sequence
  Synthetic
ggatgtggttaagttttttgattctttaagagaggttatggatgatctgggtcatgaacttaaattaaatgaaac

SEQ ID NO: 32640 - DNA, 75 bp, Artificial Sequence
  Synthetic
aataataagcagcaaaatgtttatatacagcaaaagaatatattatgatggaagaattctccctcaagctttaaa

SEQ ID NO: 32641 - DNA, 75 bp, Artificial Sequence
  Synthetic
tacagcaaaagaatatattatgatggaagaattctccctcaagctttaaaagcgttatctagatgtgtcttttgg

SEQ ID NO: 32642 - DNA, 75 bp, Artificial Sequence
  Synthetic
tctgaaaccattatagacgaaacaagatcggcatcttctaatttagcaacatcatttgcaaaagctattgagaat

SEQ ID NO: 32643 - DNA, 75 bp, Artificial Sequence
  Synthetic
ggttattcacctgtgttgggatatgtgtgttcaatattcaaaaatatccaacaattatatatagcactcggaatg

SEQ ID NO: 32644 - DNA, 75 bp, Artificial Sequence
  Synthetic
aatattaatcctactataactcagaatatcagagatcaatattttaggaacacccattggatgcaatatgcttct

SEQ ID NO: 32645 - DNA, 75 bp, Artificial Sequence
  Synthetic
ttaatacctgcaagtgttggagggtttaattatatggccatgtctaggtgttttgtaagaaacattggggacccc

SEQ ID NO: 32646 - DNA, 75 bp, Artificial Sequence
  Synthetic
aaagatttataaaagcaaatctgttggatcgtggtgttctttatcgaattatgaatcaagaaccaggtgaatctt

SEQ ID NO: 32647 - DNA, 75 bp, Artificial Sequence
  Synthetic
cgtttctagactgggcttctgatccgtactcatgtaacttaccacaatcccaaaatataacaactatgattaaaa

SEQ ID NO: 32648 - DNA, 75 bp, Artificial Sequence
  Synthetic
atataactgcaagaaatgtactacaagattcaccaaatccattattatcaggattatttacaagcacgatgatag

SEQ ID NO: 32649 - DNA, 75 bp, Artificial Sequence
  Synthetic
aagaggatgaagaactcgctgagtttttgatggataggagaataattcttccaagagttgcacatgatattttag

SEQ ID NO: 32650 - DNA, 75 bp, Artificial Sequence
  Synthetic
tttgatggataggagaataattcttccaagagttgcacatgatattttagataattctcttactggaatcagaaa

SEQ ID NO: 32651 - DNA, 75 bp, Artificial Sequence
  Synthetic
tgctatagcaggaatgctggacacaacaaaatcgttaattcgagtagggataaatcgcggagggttaacttatag

SEQ ID NO: 32652 - DNA, 75 bp, Artificial Sequence
  Synthetic
tttgttaagaaagataagtaactatgatcttgtacaatatgagacacttagtagaaccttaagattaattgttag

SEQ ID NO: 32653 - DNA, 75 bp, Artificial Sequence
  Synthetic
tgataagataaagtatgaagacatgtgctcggtagatctagctatctcgttaagacaaaaaatgtggatgcattt

SEQ ID NO: 32654 - DNA, 75 bp, Artificial Sequence
  Synthetic
atcaggaggaagaatgataaatgggcttgaaacacctgatccattagaactattgtctggggtaataataacagg

SEQ ID NO: 32655 - DNA, 75 bp, Artificial Sequence
  Synthetic
gtctgagcactgcaggatatgttattcaactgaaggagaaagcccatacacttggatgtatttacctggtaatct

SEQ ID NO: 32656 - DNA, 75 bp, Artificial Sequence
  Synthetic
attgcatcattaagagtcccttactttgggtcggtaactgatgagagatctgaagcacaactagggtacattaag

SEQ ID NO: 32657 - DNA, 75 bp, Artificial Sequence
  Synthetic
aatttaagcaaaccagcaagagctgctataagaatagcaatgatctatacttgggcatttggcaatgatgagata

SEQ ID NO: 32658 - DNA, 75 bp, Artificial Sequence
  Synthetic
tcctggatggaggcatcacagattgcacagacacgcgcaaatttcacgttagatagcttaaagattctgacacca

SEQ ID NO: 32659 - DNA, 75 bp, Artificial Sequence
  Synthetic
gtgactacatcaacaaatttatcacacagattaaaggataccgctacccagatgaaattttctagtacatcactt

SEQ ID NO: 32660 - DNA, 75 bp, Artificial Sequence
  Synthetic
atcagagtaagcagatttatcacaatatcaaatgataatatgtctatcaaggaagctaacgagacaaaagataca

SEQ ID NO: 32661 - DNA, 75 bp, Artificial Sequence
  Synthetic
aatcttatttatcaacaggtaatgttaacagggttaagtatgtttgaatatttatttagattagaagaaaataca

SEQ ID NO: 32662 - DNA, 75 bp, Artificial Sequence
  Synthetic
gggcacaatcctatggttatgcatctacatatagaagacgggtgttgtattaaagaaagttacaatgatgatcat

SEQ ID NO: 32663 - DNA, 75 bp, Artificial Sequence
  Synthetic
atcaatccagagtccacattggagttgattaggtatcctgaaagtaatgagtttatatatgacaatgaccctctc

SEQ ID NO: 32664 - DNA, 75 bp, Artificial Sequence
  Synthetic
agagatgtagatctgacaaaactaatgattataagagatcactcctatactattgatatgaattattgggatgac

SEQ ID NO: 32665 - DNA, 75 bp, Artificial Sequence
  Synthetic
acagatattatacacgcagtatcaatatgtacagcaatcacaatagcagacaccatgtcacagcttgaccgggac

SEQ ID NO: 32666 - DNA, 75 bp, Artificial Sequence
  Synthetic
aatcttaaggagctaatagttattgcaaatgatgatgatataaatagtcttataactgaattcctaacccttgac

SEQ ID NO: 32667 - DNA, 75 bp, Artificial Sequence
  Synthetic
atattagtatttcttaaaacattcggaggattacttgttaatcaattcgcatatactctatatgggttgaaaata

SEQ ID NO: 32668 - DNA, 75 bp, Artificial Sequence
  Synthetic
gaaggaagggatcctatctgggactatataatgaggacactaaaagacacctcacactcaatattaaaagttttg

SEQ ID NO: 32669 - DNA, 75 bp, Artificial Sequence
  Synthetic
atataatgaggacactaaaagacacctcacactcaatattaaaagttttgtcaaatgcattatcccatccaaagg

SEQ ID NO: 32670 - DNA, 75 bp, Artificial Sequence
  Synthetic
tttttaaaaggttctgggattatggagttttaaatcctatctatgggcctaacactgctagtcaagaccaaatca

SEQ ID NO: 32671 - DNA, 75 bp, Artificial Sequence
  Synthetic
agcttgctctttctgtttgtgagtattctcttgatttatttatgagagaatggctgaatggtgcatcgcttgaaa

SEQ ID NO: 32672 - DNA, 75 bp, Artificial Sequence
  Synthetic
aatagcaaatgacaggagacaagcatttgtttcgagacatctcgcgtttgtgtgttgtttagcagaaatagcatc

SEQ ID NO: 32673 - DNA, 75 bp, Artificial Sequence
  Synthetic
atttggaccgaatttattaaacttgacgtatttggaaaggttagaagaattaaagcggtatttagatttaaacat

SEQ ID NO: 32674 - DNA, 75 bp, Artificial Sequence
  Synthetic
taaagaagatccaactcttaaatacgtacaagtatcaggactattaatcaaatcattcccttcaactgttacata

SEQ ID NO: 32675 - DNA, 75 bp, Artificial Sequence
  Synthetic
tgtaaggaagacagcaattaaatatctaagaattcgtggaattgacccacctaacatacttgaggattgggatcc

SEQ ID NO: 32676 - DNA, 75 bp, Artificial Sequence
  Synthetic
ctaacatacttgaggattgggatcccgtagaagatgagaatatattagataatattgttaggactgtgaatgata

SEQ ID NO: 32677 - DNA, 75 bp, Artificial Sequence
  Synthetic
aatattgttaggactgtgaatgataattgtaacgacaatccaaggaaatgtaagagtaattatttttggggttta

SEQ ID NO: 32678 - DNA, 75 bp, Artificial Sequence
  Synthetic
taagagtaattatttttggggtttagctcttaaaaattatcaagttgtgaggataagatctataaccagtgatcc

SEQ ID NO: 32679 - DNA, 75 bp, Artificial Sequence
  Synthetic
gctcttaaaaattatcaagttgtgaggataagatctataaccagtgatcctgaagtttatgagacctcagatgat

SEQ ID NO: 32680 - DNA, 75 bp, Artificial Sequence
  Synthetic
ggataagatctataaccagtgatcctgaagtttatgagacctcagatgatatggatcatggattgacacttcctg

SEQ ID NO: 32681 - DNA, 75 bp, Artificial Sequence
  Synthetic
agggaggaaattatttatcacaccagctgcgattatttggagtgaatagtacaagttgtatcaaagcccttgagc

SEQ ID NO: 32682 - DNA, 75 bp, Artificial Sequence
  Synthetic
tatcgcagattctaatgaaagaagttaaaagagataaggatagacttttcctaggagagggagcaggtgctatgc

SEQ ID NO: 32683 - DNA, 75 bp, Artificial Sequence
  Synthetic
taaaagagataaggatagacttttcctaggagagggagcaggtgctatgctagcatgttatgatgccacactcgg

SEQ ID NO: 32684 - DNA, 75 bp, Artificial Sequence
  Synthetic
tcaatcgtgtgaaaatattatttaacgggaatcctaactcaacatggataggaaatatggaatgcgaaagtttaa

SEQ ID NO: 32685 - DNA, 75 bp, Artificial Sequence
  Synthetic
cgggaatcctaactcaacatggataggaaatatggaatgcgaaagtttaatatggagtgaattacatgacaaatc

SEQ ID NO: 32686 - DNA, 75 bp, Artificial Sequence
  Synthetic
ccaaaatcataccaaccatcactccaaattggtctaaaatacttcatttatataaactgtattggaaggatgtga

SEQ ID NO: 32687 - DNA, 75 bp, Artificial Sequence
  Synthetic
gaataatatcccttaagacatccaaccccgcctcgacagagctgtatctaatttctaaggaagcatattgtactg

SEQ ID NO: 32688 - DNA, 75 bp, Artificial Sequence
  Synthetic
ccccgcctcgacagagctgtatctaatttctaaggaagcatattgtactgtgatggagcccagtaatcttgtgtt

SEQ ID NO: 32689 - DNA, 75 bp, Artificial Sequence
  Synthetic
tgatggagcccagtaatcttgtgttatcaaaactcagaagaatatcatcaatagaagagaataatctattgaagt

SEQ ID NO: 32690 - DNA, 75 bp, Artificial Sequence
  Synthetic
ggataatcttatctaaaaagaagaataatgaatggttgcagcatgaaattaaagaaggagaaagagactatggag

SEQ ID NO: 32691 - DNA, 75 bp, Artificial Sequence
  Synthetic
taatgagaccctatcacacagcactgcaaatattcggattccagattaatctaaaccatctagcaaaagagtttc

SEQ ID NO: 32692 - DNA, 75 bp, Artificial Sequence
  Synthetic
ctaaaccatctagcaaaagagtttctatcaactcctgatttaaccaatattaacattgtgatacaaagtttcata

SEQ ID NO: 32693 - DNA, 75 bp, Artificial Sequence
  Synthetic
tatcaactcctgatttaaccaatattaacattgtgatacaaagtttcataagaacaatcaaagatgtgatattcg

SEQ ID NO: 32694 - DNA, 75 bp, Artificial Sequence
  Synthetic
aatgggttaacataactcatgacaacaaaagacataaattaggagggaaatataatttgtttccgctcaaaaata

SEQ ID NO: 32695 - DNA, 75 bp, Artificial Sequence
  Synthetic
gaggaaagttaaaattactttcacggagattagtgttgagctggatatcattatctctatcgaccagattactga

SEQ ID NO: 32696 - DNA, 75 bp, Artificial Sequence
  Synthetic
cgggtcgtttcccggatgagaagtttgagggtagagcacagaccgggtttgtgtcattagctgacactgatctcg

SEQ ID NO: 32697 - DNA, 75 bp, Artificial Sequence
  Synthetic
ttatgaatatgataatgaatttgatattgattaatgtataaatccagtaaatagtgtacttaatccctatctgta

SEQ ID NO: 32698 - DNA, 75 bp, Artificial Sequence
  Synthetic
atatattaagaaaaacaaataataagaaaaacatatgatatatatatatcaaacagagttcttctcttgtttggt

SEQ ID NO: 32699 - DNA, 75 bp, Artificial Sequence
  Synthetic
accaaacaagagaagagacttgtttgggaatattaattcaaataaaaattaacttaggattaaagaactttgccg

SEQ ID NO: 32700 - DNA, 75 bp, Artificial Sequence
  Synthetic
aacttaggattaaagaactttgccgagaggtgaggggaaagaaatcctaagattgcaatcatgctgagtctattt

SEQ ID NO: 32701 - DNA, 75 bp, Artificial Sequence
  Synthetic
gacacattcagtgcgcgtaggcaagagaatataacaaaatcagctggtggggccgttatccccgggcaaaaaaat

SEQ ID NO: 32702 - DNA, 75 bp, Artificial Sequence
  Synthetic
tctcattctttagacaacgagaaacagcatgcacaaagagccggatttctagtttctctgttatcaatggcctat

SEQ ID NO: 32703 - DNA, 75 bp, Artificial Sequence
  Synthetic
gccaacccagaattgtatttaacatcaaacggtagtaatgcagatgttaaatatgtcatttatatgatagaaaag

SEQ ID NO: 32704 - DNA, 75 bp, Artificial Sequence
  Synthetic
atatgtcatttatatgatagaaaaggacccaggaagacaaaagtatggtgggctcgtagttaagaccagagagat

SEQ ID NO: 32705 - DNA, 75 bp, Artificial Sequence
  Synthetic
ggtttatgaaaagacaactgactggatgttcgggagtgatcttgagtatgatcaagacaatatgttgcaaaatgg

SEQ ID NO: 32706 - DNA, 75 bp, Artificial Sequence
  Synthetic
atcaagacaatatgttgcaaaatggcagaagcacttctacaatcgaggatctcgttcatacttttggatatccat

SEQ ID NO: 32707 - DNA, 75 bp, Artificial Sequence
  Synthetic
catgtcttggagcccttataatccaagtttggattatacttgtcaaggctataactagtatatcaggattgagga

SEQ ID NO: 32708 - DNA, 75 bp, Artificial Sequence
  Synthetic
agggattctttactcgattagaagcatttagacaagatgggacagttaaatccagcttggtgttaagtggtgatg

SEQ ID NO: 32709 - DNA, 75 bp, Artificial Sequence
  Synthetic
cagtagaacaaattggatcaattatgaggtctcaacagagcttagtaacactcatggttgaaacactgataacaa

SEQ ID NO: 32710 - DNA, 75 bp, Artificial Sequence
  Synthetic
tgaacacaggtaggaacgacttgacaacgatagagaagaatatacagattgtaggaaactatataagggatgcag

SEQ ID NO: 32711 - DNA, 75 bp, Artificial Sequence
  Synthetic
gtcttgcctcattcttcaacacaatcagatacggcattgagactagaatggcagctctaactctatccaccctca

SEQ ID NO: 32712 - DNA, 75 bp, Artificial Sequence
  Synthetic
gaccggacatcaataggctcaaggcactgatagagctatatctatcaaaagggccacgtgctccttttatatgca

SEQ ID NO: 32713 - DNA, 75 bp, Artificial Sequence
  Synthetic
gggccacgtgctccttttatatgcattttaagagatcctgtgcatggtgagttcgcaccaggcaactatcccgct

SEQ ID NO: 32714 - DNA, 75 bp, Artificial Sequence
  Synthetic
cagttgtacaaaacaaggctatgcaacagtatgtaacaggaaggtcttatctagatattgagatgttccaactag

SEQ ID NO: 32715 - DNA, 75 bp, Artificial Sequence
  Synthetic
gtcaagcagtggcacgtgatgctgaatcgcagatgagctcaatactagaggatgaactaggggtcacacaggaag

SEQ ID NO: 32716 - DNA, 75 bp, Artificial Sequence
  Synthetic
gatgaactaggggtcacacaggaagccaagcaaagcttaaagaaacacatgaagaacatcagcagctcagataca

SEQ ID NO: 32717 - DNA, 75 bp, Artificial Sequence
  Synthetic
accttccacaaacccacaggggggtcagctatagaaatggcaatagatgaggaagcagagcagcctgaatctagg

SEQ ID NO: 32718 - DNA, 75 bp, Artificial Sequence
  Synthetic
ggagaccaggatcaaggaaatgagcctcagtcatccatagttccttatgcatgggcagacgaaaccaggagtgat

SEQ ID NO: 32719 - DNA, 75 bp, Artificial Sequence
  Synthetic
acccagactgaatctgtcacagaaatcgacagcatcaaaaccgaacaaagaaacatcagagacaggctgaacaaa

SEQ ID NO: 32720 - DNA, 75 bp, Artificial Sequence
  Synthetic
agactcaacgaaaagaggaaacagagcgacccaaaatcaaccaacatcgcaaacgacacaaatcaaactgaaata

SEQ ID NO: 32721 - DNA, 75 bp, Artificial Sequence
  Synthetic
gatgatctgttcagtgcatttggaaacaactaattatacagagatgatcaccatcatcagcaacaagtaagaaaa

SEQ ID NO: 32722 - DNA, 75 bp, Artificial Sequence
  Synthetic
acttaggattaacgggaattatccaatccggagacggagggacaaatccaggatccacccaaaaccaaccaaacc

SEQ ID NO: 32723 - DNA, 75 bp, Artificial Sequence
  Synthetic
aaagattcatggaaaacaatgctaaagacaatcaaatcatggattcttgggaagagggaccaggagacaagtcat

SEQ ID NO: 32724 - DNA, 75 bp, Artificial Sequence
  Synthetic
ctgacatctcatcggccctcgacatcattgaattcatactcagcaccgactcccaagagaacacggcagacagca

SEQ ID NO: 32725 - DNA, 75 bp, Artificial Sequence
  Synthetic
atgaagtcaacacaggaaacaagagactcagcacgacaatctaccaacttgaatccaaaacaacagaaacaagca

SEQ ID NO: 32726 - DNA, 75 bp, Artificial Sequence
  Synthetic
aagaaaatagtggatcagttaacgaaaatcgacagcttggggcatcacacgaacgtgccacagagacaaagaata

SEQ ID NO: 32727 - DNA, 75 bp, Artificial Sequence
  Synthetic
gaacgtgccacagagacaaagaatagaaatgttaatcaggagactatacagggaggaaataggggaggaagcagc

SEQ ID NO: 32728 - DNA, 75 bp, Artificial Sequence
  Synthetic
tcagatagtagagctgagactatggtcactcgaggaatctccagaagcagcccagatcctaacaatggaacccaa

SEQ ID NO: 32729 - DNA, 75 bp, Artificial Sequence
  Synthetic
atccaggaaagtattgattacaatgaagttggagagatggataaggactctgctaagagggaaatgcgacagtct

SEQ ID NO: 32730 - DNA, 75 bp, Artificial Sequence
  Synthetic
agaagcatggaatctatcagtacatttgattcaggatataccagcatagtgactgctgcaacattggatgatgaa

SEQ ID NO: 32731 - DNA, 75 bp, Artificial Sequence
  Synthetic
gaagaactccttatgaagaacaccaggccaagaagatatcagtcaacaccccaggaagatgacaagggaattaaa

SEQ ID NO: 32732 - DNA, 75 bp, Artificial Sequence
  Synthetic
aaaggggttggaaagccagaagatacaaacaaacaatcaccaacactggactacgaactcaactccaaaggatcg

SEQ ID NO: 32733 - DNA, 75 bp, Artificial Sequence
  Synthetic
caaacaaacaatcaccaacactggactacgaactcaactccaaaggatcgaagaagaaccagaagacctccaaaa

SEQ ID NO: 32734 - DNA, 75 bp, Artificial Sequence
  Synthetic
tcagcacgaccacaggggaaccaacaagaccacagagtggatcccaagggaagagaatcacatcctggaacatcc

SEQ ID NO: 32735 - DNA, 75 bp, Artificial Sequence
  Synthetic
tcaacagcgagagcatcagtcgaacagaatcaacaagccaaaatcctcagacaccaacatctgggaagagcaata

SEQ ID NO: 32736 - DNA, 75 bp, Artificial Sequence
  Synthetic
cagtgggaccaggcagaacaaccctcgaatcaaggatcaagacacaaaagacggatggaaaggaaagagaggaca

SEQ ID NO: 32737 - DNA, 75 bp, Artificial Sequence
  Synthetic
cgaatcaaggatcaagacacaaaagacggatggaaaggaaagagaggacacagaagagagcactcgatttacaga

SEQ ID NO: 32738 - DNA, 75 bp, Artificial Sequence
  Synthetic
cagaagagagcactcgatttacagaaagggcgattacattattacagaatcttggtgtaatccaatctgcagcaa

SEQ ID NO: 32739 - DNA, 75 bp, Artificial Sequence
  Synthetic
aattagacctataccaagacaagagagttgtgtgtgtggcgaatgtcctaaacaatgcggatactgcatcgaaga

SEQ ID NO: 32740 - DNA, 75 bp, Artificial Sequence
  Synthetic
tagactttctagcaggtctaatgattggagtatcaatggatcatgataccaaattaaaccagattcagaatgaga

SEQ ID NO: 32741 - DNA, 75 bp, Artificial Sequence
  Synthetic
tattaagtttaaaaactgatcttaagaagatggatgaatcacatagaagattaattgaaaatcaaaaagaacaat

SEQ ID NO: 32742 - DNA, 75 bp, Artificial Sequence
  Synthetic
tatcactgattacatcattgatctcaaatcttaaaattatgacagagagaggagggaagaaggaccaatccgaac

SEQ ID NO: 32743 - DNA, 75 bp, Artificial Sequence
  Synthetic
aaatcttaaaattatgacagagagaggagggaagaaggaccaatccgaacacagcggaaggacacctatgatcaa

SEQ ID NO: 32744 - DNA, 75 bp, Artificial Sequence
  Synthetic
gacaaaagcaaaagaagagaaaataaagaaagtcaggtttgatcctcttatggaaacacagggtatcgagaaaaa

SEQ ID NO: 32745 - DNA, 75 bp, Artificial Sequence
  Synthetic
tatccctgacctctatagatcaatagagaaaacaccagaaaacgacatacagatcaaatcagatataaacagatc

SEQ ID NO: 32746 - DNA, 75 bp, Artificial Sequence
  Synthetic
gagaaaacaccagaaaacgacatacagatcaaatcagatataaacagatcaaatgatgagtccaatgcaaccaga

SEQ ID NO: 32747 - DNA, 75 bp, Artificial Sequence
  Synthetic
ctagtacccaagagaacaagcaatacaatgagatcactaatcataatcatcaacaacagcaatttgtcatcaaga

SEQ ID NO: 32748 - DNA, 75 bp, Artificial Sequence
  Synthetic
gcaaagcagtcatatatcaacgaactcaagctctgcaagagtgacgaagaagtgtccgagttgatggacatgttc

SEQ ID NO: 32749 - DNA, 75 bp, Artificial Sequence
  Synthetic
aatgaggatgtcaactctcagtaaacaaccaaccaaggatccacctcacagaaatcaacagcacaagacaaccaa

SEQ ID NO: 32750 - DNA, 75 bp, Artificial Sequence
  Synthetic
caaccaaccaaggatccacctcacagaaatcaacagcacaagacaaccaatcagagatcaacccaaaacaccaga

SEQ ID NO: 32751 - DNA, 75 bp, Artificial Sequence
  Synthetic
ctaaacaacacacagcaaacaccctccaatcacagctgattaagaaaaacttaggataaaagtatcaatccatcc

SEQ ID NO: 32752 - DNA, 75 bp, Artificial Sequence
  Synthetic
tccgaaacaatgagcatcaccaactctgcaatctacacattcccagaatcttccttttctgacaatggcaacatc

SEQ ID NO: 32753 - DNA, 75 bp, Artificial Sequence
  Synthetic
ctgcaatctacacattcccagaatcttccttttctgacaatggcaacatcgagccgttgccgctcaaagtcaatg

SEQ ID NO: 32754 - DNA, 75 bp, Artificial Sequence
  Synthetic
aacagagaaaagcaatacctcacattagggttgtcagaataggggatccacccaaacatggatctagatatttgg

SEQ ID NO: 32755 - DNA, 75 bp, Artificial Sequence
  Synthetic
atgtctttctattgggcttcttcgagatggaaagatcaaaagacagatatgggagtgtaagtgatctagatgatg

SEQ ID NO: 32756 - DNA, 75 bp, Artificial Sequence
  Synthetic
gatggaaagatcaaaagacagatatgggagtgtaagtgatctagatgatgatccaagctacaaggtttgtggctc

SEQ ID NO: 32757 - DNA, 75 bp, Artificial Sequence
  Synthetic
tggatcgttaccacttgggttagctagatacactggaaatgatcaggaacttctacaggctgcaaccaagttaga

SEQ ID NO: 32758 - DNA, 75 bp, Artificial Sequence
  Synthetic
catagaagtaagaagaactgtaaaagctacagagatgatagtctacaccgtacagaacatcaaacctgaactata

SEQ ID NO: 32759 - DNA, 75 bp, Artificial Sequence
  Synthetic
tacagaacatcaaacctgaactatatccatggtccagtagattaagaaaggggatgttgttcgatgctaataaag

SEQ ID NO: 32760 - DNA, 75 bp, Artificial Sequence
  Synthetic
ttgcacttgctcctcaatgtcttccactagatagagggataaaattcagggtgatattcgtgaattgcacagcaa

SEQ ID NO: 32761 - DNA, 75 bp, Artificial Sequence
  Synthetic
actagatagagggataaaattcagggtgatattcgtgaattgcacagcaattggatcaataactctattcaaaat

SEQ ID NO: 32762 - DNA, 75 bp, Artificial Sequence
  Synthetic
ccccaaatccatggcattgttatcattgcccaatacagtatcaataaatctacaagtacatatcaaaacaggaat

SEQ ID NO: 32763 - DNA, 75 bp, Artificial Sequence
  Synthetic
tacaagtacatatcaaaacaggaattcagacagattccaaaggagtagttcagattctagatgaaaaaggtgaaa

SEQ ID NO: 32764 - DNA, 75 bp, Artificial Sequence
  Synthetic
tgggctgatcaagaggaagatgggtagaatgtattcagttgaatattgtaagcagaaaattgagaagatgagatt

SEQ ID NO: 32765 - DNA, 75 bp, Artificial Sequence
  Synthetic
actattctcactgggattggttggtgggatcagcctccatgttaacgcaactggctctatatcaaaaacattagc

SEQ ID NO: 32766 - DNA, 75 bp, Artificial Sequence
  Synthetic
aagccaactagcattcaaaagagaaatctgctatcccctaatggatctgaatccacacttaaatctggttatatg

SEQ ID NO: 32767 - DNA, 75 bp, Artificial Sequence
  Synthetic
ggcatcatcagttgaaatcacaagagtagacgcaattttccagccttcattacctggtgaatttagatactaccc

SEQ ID NO: 32768 - DNA, 75 bp, Artificial Sequence
  Synthetic
aaatatcatagcaaaaggagtcgggaaaatcagacagtaaaaccgacaatcctgacacccgacaccgcagaccag

SEQ ID NO: 32769 - DNA, 75 bp, Artificial Sequence
  Synthetic
gctacccacaggagaaaaatcaaaaacttaggatcaaagggatcaccacaaactctgagcaacagtcaaaccaac

SEQ ID NO: 32770 - DNA, 75 bp, Artificial Sequence
  Synthetic
caacacacagatcacaggaaaaaagagaaagaaaaagaaaaagaaaaagaaaaaaacaccgcaaagaccaagatc

SEQ ID NO: 32771 - DNA, 75 bp, Artificial Sequence
  Synthetic
aagcagagcacacacaaccaagcagaagaaaatcaaggcccaccacccacaaacacaccaacaatcctgctgaca

SEQ ID NO: 32772 - DNA, 75 bp, Artificial Sequence
  Synthetic
agcaccggactgaagaccaaaagaaaaagagcatcagacatgatcatcacaaacacaatcataatcatactaata

SEQ ID NO: 32773 - DNA, 75 bp, Artificial Sequence
  Synthetic
atatccccatcattttgtcaaatagacataacaaaacttcaacgtgtaggtgtattagtcaataaccccaaaggt

SEQ ID NO: 32774 - DNA, 75 bp, Artificial Sequence
  Synthetic
atgaagatttcacaaaatttcgaaacgagatacttaatattaagtttgatacccaaaatagagaactcacactca

SEQ ID NO: 32775 - DNA, 75 bp, Artificial Sequence
  Synthetic
tgtggggaccaacagataaaccaatacaagaaactattggacagattgatcattcctctatatgatggactaaaa

SEQ ID NO: 32776 - DNA, 75 bp, Artificial Sequence
  Synthetic
cattcctctatatgatggactaaaattacaaaaagatgtgatagtagtaagtcatgagactcacaataacaccaa

SEQ ID NO: 32777 - DNA, 75 bp, Artificial Sequence
  Synthetic
ttctaggacaaaacgatttttcggagaaataattgggacaattgcgatagggatagccacctcagcacagattac

SEQ ID NO: 32778 - DNA, 75 bp, Artificial Sequence
  Synthetic
cgcagcagtcgctcttgtcgaggccaaacaggcaaagtcagacatagagaaactcaaagaagctataagagatac

SEQ ID NO: 32779 - DNA, 75 bp, Artificial Sequence
  Synthetic
aaataaggcagtacaatcaattcaaagttctgtaggtaatctaattgttgcagttaaatcagttcaagattatgt

SEQ ID NO: 32780 - DNA, 75 bp, Artificial Sequence
  Synthetic
caacaatgaaattgtaccttcaatcacaagattaggttgtgaagcagctggtctacaactaggaattgcattaac

SEQ ID NO: 32781 - DNA, 75 bp, Artificial Sequence
  Synthetic
ccaacattactcagaattaacaaatatatttggtgataatatagggacactgaaagaaaaggggataaaattaca

SEQ ID NO: 32782 - DNA, 75 bp, Artificial Sequence
  Synthetic
ggggatagcatcgctataccacacaaacataacagaaatatttactacttcaacagttgaccaatatgacattta

SEQ ID NO: 32783 - DNA, 75 bp, Artificial Sequence
  Synthetic
tgatctattattcactgaatcaatcaaaatgagagtaatagatgttgatttgagtgattactcaatcactcttca

SEQ ID NO: 32784 - DNA, 75 bp, Artificial Sequence
  Synthetic
ctatcaaacactcaaatttataaagtagattctatatcatacaacatacagggcaaagagtggtatattccgctt

SEQ ID NO: 32785 - DNA, 75 bp, Artificial Sequence
  Synthetic
cccaatcatataatgacaaaaggagctttcctaggtggtgctgatattaaagaatgcatagaagcattcagcagt

SEQ ID NO: 32786 - DNA, 75 bp, Artificial Sequence
  Synthetic
tatatatgtccttctgacccaggctttacactaaatcacgagatagagaattgtttatcagggaatataacacag

SEQ ID NO: 32787 - DNA, 75 bp, Artificial Sequence
  Synthetic
tgtcctaagactattgttacatcagatgtagtaccacgatatgcatttgtgaatggtggattaattgcaaactgt

SEQ ID NO: 32788 - DNA, 75 bp, Artificial Sequence
  Synthetic
ataacaactacatgtacatgtaatggagttgacaatagaataaatcaatcacccgatcaaggaataaaaatcata

SEQ ID NO: 32789 - DNA, 75 bp, Artificial Sequence
  Synthetic
acacataaagaatgtcaagtaataggtataaacggaatgttattcagtaccaatagagaggggacattagcagct

SEQ ID NO: 32790 - DNA, 75 bp, Artificial Sequence
  Synthetic
tatacatttgatgacatcatattaaataactctgttgcccttaatccgattgatatatctatggaactcaacaag

SEQ ID NO: 32791 - DNA, 75 bp, Artificial Sequence
  Synthetic
gcaaaattggaactggaagaatcgaaagaatggataaagaaatcaaatcaaaagttggattctgttggaaattgg

SEQ ID NO: 32792 - DNA, 75 bp, Artificial Sequence
  Synthetic
tatcaatctagtgcaacaattaccataatcatagtgatggtagtcgtcctattcataatcaatataacaattatt

SEQ ID NO: 32793 - DNA, 75 bp, Artificial Sequence
  Synthetic
gtagtcataatcagacaccatagaattcaggggaaaaaccaaaacgacaaaaatagtgaaccgtatgtactaaca

SEQ ID NO: 32794 - DNA, 75 bp, Artificial Sequence
  Synthetic
agtagacaatgagattataagtgattaaatatagaaagtacaaaaaacttaggaacaaagttgctcaacacagca

SEQ ID NO: 32795 - DNA, 75 bp, Artificial Sequence
  Synthetic
acaccagacagaccaaaggccagtgcagagacgacaccaaacccaaaaatggaatactggaaacacacaaacagc

SEQ ID NO: 32796 - DNA, 75 bp, Artificial Sequence
  Synthetic
ggaatactggaaacacacaaacagcacaaaggacactaacaatgaacttggaacaaccagagatagacacagcag

SEQ ID NO: 32797 - DNA, 75 bp, Artificial Sequence
  Synthetic
caaagccacaaatatcataatgtacatcttctggacaacaacatcaacaatattatcagtaatttttataatgat

SEQ ID NO: 32798 - DNA, 75 bp, Artificial Sequence
  Synthetic
attgataaatttaattcaagagaacaatcacaacaaattaatgttgcaggaaataaggaaagaattcgcagtaat

SEQ ID NO: 32799 - DNA, 75 bp, Artificial Sequence
  Synthetic
agataccaaaattcaaaagacctcagatgacattggtacttcaatacaatcaggaataaacacaagacttcttac

SEQ ID NO: 32800 - DNA, 75 bp, Artificial Sequence
  Synthetic
aattcagagtcatgttcaaaactatattccattatcattaacacaacaaatgtcagatctcagaaaatttatcaa

SEQ ID NO: 32801 - DNA, 75 bp, Artificial Sequence
  Synthetic
cgatctcacgactaaaagagaacatcaagaggtgccaatacagagaatgactcatgatagtggtatagaacctct

SEQ ID NO: 32802 - DNA, 75 bp, Artificial Sequence
  Synthetic
aaatccggacaaattctggagatgtacatctggtaatccatctttaacaagtagtcccaagataagactaatacc

SEQ ID NO: 32803 - DNA, 75 bp, Artificial Sequence
  Synthetic
agggccaggtttattagcaacatccactactgtaaatggctgcattagaattccatctttagcaatcaataatct

SEQ ID NO: 32804 - DNA, 75 bp, Artificial Sequence
  Synthetic
aatctacgcttacacctctaatcttattacccagggctgtcaagatatagggaaatcttaccaagtactacaaat

SEQ ID NO: 32805 - DNA, 75 bp, Artificial Sequence
  Synthetic
ggaaatcttaccaagtactacaaatagggataattactataaattcagacttggtacctgacttgaacccaagag

SEQ ID NO: 32806 - DNA, 75 bp, Artificial Sequence
  Synthetic
tcacacatacatttaatattgatgacaataggaaatcctgttcccttgcactattgaacacagatgtttatcaac

SEQ ID NO: 32807 - DNA, 75 bp, Artificial Sequence
  Synthetic
tatgctcaaccccaaaagttgatgagagatcagattacgcatcaacaggtattgaggacattgtacttgacattg

SEQ ID NO: 32808 - DNA, 75 bp, Artificial Sequence
  Synthetic
tcactagtaatggattaatcataacaacaagattcacgaataataatataacttttgataaaccttatgcagcat

SEQ ID NO: 32809 - DNA, 75 bp, Artificial Sequence
  Synthetic
tatatccatcagtaggaccaggaatatattataaagacaaagttatcttcctcggatatggaggcctagagcatg

SEQ ID NO: 32810 - DNA, 75 bp, Artificial Sequence
  Synthetic
atattataaagacaaagttatcttcctcggatatggaggcctagagcatgaggaaaacggagacgtaatatgtaa

SEQ ID NO: 32811 - DNA, 75 bp, Artificial Sequence
  Synthetic
cacaactggttgtcctggcaaaacacagagagactgcaatcaggcctcctacagcccatggttctcaaataggag

SEQ ID NO: 32812 - DNA, 75 bp, Artificial Sequence
  Synthetic
aatggtaaattccattatcgttgttgataaaggtatagatacaacctttagcttaagagtgtggactattccaat

SEQ ID NO: 32813 - DNA, 75 bp, Artificial Sequence
  Synthetic
gagacaaaactattgggggtcagaaggaagattgcttttattaggtgacagaatatacatatatactagatctac

SEQ ID NO: 32814 - DNA, 75 bp, Artificial Sequence
  Synthetic
gaatatacatatatactagatctacgagttggcacagtaaattacagttaggggtaattgacatttctgattata

SEQ ID NO: 32815 - DNA, 75 bp, Artificial Sequence
  Synthetic
ataatataagaataaattggacttggcataatgtactatcacggccagggaatgatgaatgtccatggggtcatt

SEQ ID NO: 32816 - DNA, 75 bp, Artificial Sequence
  Synthetic
catgcccagacggatgcataacaggagtttacactgatgcatatccactaaacccatcagggagtgttgtatcct

SEQ ID NO: 32817 - DNA, 75 bp, Artificial Sequence
  Synthetic
cagtcattcttgattcacaaaaatccagagaaaaccccatcattacctactcaacagctacaaatagggtaaatg

SEQ ID NO: 32818 - DNA, 75 bp, Artificial Sequence
  Synthetic
cagagaaaaccccatcattacctactcaacagctacaaatagggtaaatgagttggctatatataacagaacact

SEQ ID NO: 32819 - DNA, 75 bp, Artificial Sequence
  Synthetic
tccagctgcatacacaacaacaaactgtatcacacactatgataaagggtattgttttcatatagtagaaataaa

SEQ ID NO: 32820 - DNA, 75 bp, Artificial Sequence
  Synthetic
tcacagaagtttgaacacgtttcaacctatgttatttaaaacagaagttccgaaaaactgcagctaaactgatcc

SEQ ID NO: 32821 - DNA, 75 bp, Artificial Sequence
  Synthetic
ccgcacactgaacattagatgacacacatagaaaccaccaaacagacaacacaggagatgatgcaagacacaaag

SEQ ID NO: 32822 - DNA, 75 bp, Artificial Sequence
  Synthetic
aaattacaaaaaacttaggaggaaagtgtgtacgagagatggacaccgaatcccacagcggtacaacatctgaca

SEQ ID NO: 32823 - DNA, 75 bp, Artificial Sequence
  Synthetic
ttctgtatcctgaatgtcacctcaattcccctatagttaaaggcaagatagcacaactgcataccataatgagtt

SEQ ID NO: 32824 - DNA, 75 bp, Artificial Sequence
  Synthetic
tgcctcaaccttacgatatggatgatgattcaatactgattatcactagacaaaagattaaactcaataaattag

SEQ ID NO: 32825 - DNA, 75 bp, Artificial Sequence
  Synthetic
acaaaagacaacggtcaattagaaaattaaaatcagtcttaatggaaagagtaaatgatctaggtaagtacacct

SEQ ID NO: 32826 - DNA, 75 bp, Artificial Sequence
  Synthetic
ttatcagatatccagaaatgtctaacgaaatgttccaattatgtatacctggaattaataataaaataaatgaat

SEQ ID NO: 32827 - DNA, 75 bp, Artificial Sequence
  Synthetic
ggaattaataataaaataaatgaattgctaagtaaagcaagtaaaacatataatcaaatgactgatggattaaga

SEQ ID NO: 32828 - DNA, 75 bp, Artificial Sequence
  Synthetic
tgctaagtaaagcaagtaaaacatataatcaaatgactgatggattaagagatctatgggttactatactatcga

SEQ ID NO: 32829 - DNA, 75 bp, Artificial Sequence
  Synthetic
aattagcatcaaaaaatgatggaagtaattatgatatcaatgaagatattagcaatatatcgaatgttcacacta

SEQ ID NO: 32830 - DNA, 75 bp, Artificial Sequence
  Synthetic
cttaccaatcagacaaatggtataacccatttaagacatggtttactattaaatatgatatgaggagattacaaa

SEQ ID NO: 32831 - DNA, 75 bp, Artificial Sequence
  Synthetic
aggccaaaaatgagattacattcaacagacataaagattataatctattagaagatcaaaagaatatattgctga

SEQ ID NO: 32832 - DNA, 75 bp, Artificial Sequence
  Synthetic
tacatccagaacttgtcttaatattggataaacaaaattacaaaggatatataatgactcctgagttagtactca

SEQ ID NO: 32833 - DNA, 75 bp, Artificial Sequence
  Synthetic
tgtactgtgatgtagttgaaggaaggtggaatataagttcatgtgcaaaattagatcctaagttacaatcaatgt

SEQ ID NO: 32834 - DNA, 75 bp, Artificial Sequence
  Synthetic
aataatagatggtctattcccgactttaggagaaagaacatttgacataatatcattattagagccacttgcatt

SEQ ID NO: 32835 - DNA, 75 bp, Artificial Sequence
  Synthetic
tatcattattagagccacttgcattatcactcattcaaactcatgatccggttaaacagctcagaggagcttttt

SEQ ID NO: 32836 - DNA, 75 bp, Artificial Sequence
  Synthetic
atatagataagattttagatgtatttaaagaatcaacaatagatgaaatagcagaaattttctctttcttccgca

SEQ ID NO: 32837 - DNA, 75 bp, Artificial Sequence
  Synthetic
ctttcggacaccctccattagaagcaagtatagcagcagaaaaagtcagaaagtatatgtacactgaaaaatgct

SEQ ID NO: 32838 - DNA, 75 bp, Artificial Sequence
  Synthetic
aagtatagcagcagaaaaagtcagaaagtatatgtacactgaaaaatgcttgaaatttgacactattaataaatg

SEQ ID NO: 32839 - DNA, 75 bp, Artificial Sequence
  Synthetic
tcatgctattttttgcacaataattataaatggatatagagaaagacatggtggtcaatggcctccagttacatt

SEQ ID NO: 32840 - DNA, 75 bp, Artificial Sequence
  Synthetic
ataaatggatatagagaaagacatggtggtcaatggcctccagttacattgcctgctcatgcacacgagttcatc

SEQ ID NO: 32841 - DNA, 75 bp, Artificial Sequence
  Synthetic
ataaatgcatacggatcgaattctgccatatcatatgaaaatgctgtggattattataagagcttcataggaata

SEQ ID NO: 32842 - DNA, 75 bp, Artificial Sequence
  Synthetic
aaatttgacaagtttatagagccacaattggatgaggacttaactatttatatgaaagacaaagcattatcccca

SEQ ID NO: 32843 - DNA, 75 bp, Artificial Sequence
  Synthetic
aagaaatcaaactgggacacagtttacccagcttcaaacctgttgtatcgcactaatgtatctcatgattcacga

SEQ ID NO: 32844 - DNA, 75 bp, Artificial Sequence
  Synthetic
cggttagttgaagtatttatagcagacagtaaatttgatccccatcaagtattagattatgtagaatcaggatat

SEQ ID NO: 32845 - DNA, 75 bp, Artificial Sequence
  Synthetic
attagattatgtagaatcaggatattggttagacgatcctgaatttaatatttcatatagtttaaaggagaaaga

SEQ ID NO: 32846 - DNA, 75 bp, Artificial Sequence
  Synthetic
aataaaacaagaaggtagactttttgcaaaaatgacatacaagatgagggctacacaagtattatcagaaacatt

SEQ ID NO: 32847 - DNA, 75 bp, Artificial Sequence
  Synthetic
gcaaaaatgacatacaagatgagggctacacaagtattatcagaaacattattggcaaataacatagggaaattc

SEQ ID NO: 32848 - DNA, 75 bp, Artificial Sequence
  Synthetic
ttccaagagaatgggatggttaaaggagaaattgaattacttaagagactgacaacaatatctatgtctggggtt

SEQ ID NO: 32849 - DNA, 75 bp, Artificial Sequence
  Synthetic
ccacggtataatgaggtatacaataattcaaaaagtcatacagaagaacttaaagcttataatgcaattagcagt

SEQ ID NO: 32850 - DNA, 75 bp, Artificial Sequence
  Synthetic
tctaacctgtcttccaatcagaagtcaaaaaagtttgaattcaagtcaacagatatatacaatgatggatacgag

SEQ ID NO: 32851 - DNA, 75 bp, Artificial Sequence
  Synthetic
accgtaagctgcttcttaacgacagatcttaagaaatattgtttaaattggaggtatgaatcaacagctttattc

SEQ ID NO: 32852 - DNA, 75 bp, Artificial Sequence
  Synthetic
atcttaagaaatattgtttaaattggaggtatgaatcaacagctttattcggtgatacttgtaatcagatatttg

SEQ ID NO: 32853 - DNA, 75 bp, Artificial Sequence
  Synthetic
ggtgatacttgtaatcagatatttgggttaaaagaattatttaattggttgcaccctcgccttgaaaagagtaca

SEQ ID NO: 32854 - DNA, 75 bp, Artificial Sequence
  Synthetic
atatatgttggagatccttattgtccaccatcagatattgaacatttaccactcgatgaccatcctgattcagga

SEQ ID NO: 32855 - DNA, 75 bp, Artificial Sequence
  Synthetic
ttttatgttcataatcctaaaggaggaatagaggggttttgccaaaagttatggacacttatatctatcagtgca

SEQ ID NO: 32856 - DNA, 75 bp, Artificial Sequence
  Synthetic
atggacacttatatctatcagtgcaatacacttagcagctgtcaaaatcggtgtaagagttactgcaatggttca

SEQ ID NO: 32857 - DNA, 75 bp, Artificial Sequence
  Synthetic
aggagataatcaagccatagctgttactacaagagtacctaataattatgattataaggttaagaaagaaattgt

SEQ ID NO: 32858 - DNA, 75 bp, Artificial Sequence
  Synthetic
attataaggttaagaaagaaattgtttataaagatgtgataaggttttttgattctttaagagaagttatggatg

SEQ ID NO: 32859 - DNA, 75 bp, Artificial Sequence
  Synthetic
atcttggtcatgagctcaaactaaatgaaactataataagtagtaaaatgtttatatatagcaaaaggatatact

SEQ ID NO: 32860 - DNA, 75 bp, Artificial Sequence
  Synthetic
atgacggaagaattcttcctcaggcgctaaaggcgttgtctagatgtgttttttggtctgaaacaatcatagatg

SEQ ID NO: 32861 - DNA, 75 bp, Artificial Sequence
  Synthetic
aaacaagatcagcatcctcaaatctggcaacatcgtttgcaaaggccatcgagaatggctactcacctgtattgg

SEQ ID NO: 32862 - DNA, 75 bp, Artificial Sequence
  Synthetic
ggtatgtatgttcactttttaagaatatccaacaattgtatatagcacttggaatgaatattaatccaactataa

SEQ ID NO: 32863 - DNA, 75 bp, Artificial Sequence
  Synthetic
tatccaacaattgtatatagcacttggaatgaatattaatccaactataactcaaaacattaaagatcaatattt

SEQ ID NO: 32864 - DNA, 75 bp, Artificial Sequence
  Synthetic
caggaatatgcattggatgcaatatgcttctctaatccctgctagtgtcggaggatttaactatatggctatgtc

SEQ ID NO: 32865 - DNA, 75 bp, Artificial Sequence
  Synthetic
aaggtgctttgtgagaaatattggagaccctacagttgctgctttagctgatattaaaagatttataaaagcaaa

SEQ ID NO: 32866 - DNA, 75 bp, Artificial Sequence
  Synthetic
tttgttggatagaggtgtcctttacagaattatgaatcaagaaccaggtgagtcttcttttttagactgggcttc

SEQ ID NO: 32867 - DNA, 75 bp, Artificial Sequence
  Synthetic
agtcttcttttttagactgggcttcagacccttattcatgtaacttgccacaatctcaaaacataaccactatga

SEQ ID NO: 32868 - DNA, 75 bp, Artificial Sequence
  Synthetic
taaagaatataactgcaagaaatgtactacaggactcaccaaacccattactatctggattgtttacaagtacaa

SEQ ID NO: 32869 - DNA, 75 bp, Artificial Sequence
  Synthetic
ctatctggattgtttacaagtacaatgatagaagaggatgaagaactagctgaattcttaatggacaggagaata

SEQ ID NO: 32870 - DNA, 75 bp, Artificial Sequence
  Synthetic
atcctcccaagagttgcacatgatattttagataattcccttactggaattaggaatgctatagctgggatgtta

SEQ ID NO: 32871 - DNA, 75 bp, Artificial Sequence
  Synthetic
taggaatgctatagctgggatgttagatacaacaaaatcactaattcgagtagggattaacagagggggattaac

SEQ ID NO: 32872 - DNA, 75 bp, Artificial Sequence
  Synthetic
ctataacttattaagaaagataagcaactatgatcttgtacaatatgagacacttagtaaaactttaagactaat

SEQ ID NO: 32873 - DNA, 75 bp, Artificial Sequence
  Synthetic
agttagtgacaagattaagtatgaggatatgtgctcagtagatctagccatatcattgagacaaaaaatgtggat

SEQ ID NO: 32874 - DNA, 75 bp, Artificial Sequence
  Synthetic
gcatttgtcaggaggaagactgataaatggacttgaaactccagatcctttagaattactgtctggagtaataat

SEQ ID NO: 32875 - DNA, 75 bp, Artificial Sequence
  Synthetic
aatggacttgaaactccagatcctttagaattactgtctggagtaataataacgggatctgaacattgtaggata

SEQ ID NO: 32876 - DNA, 75 bp, Artificial Sequence
  Synthetic
acaggagtagcatcattgagggtcccttactttggatcggttacagatgagagatctgaagcacaattgggatat

SEQ ID NO: 32877 - DNA, 75 bp, Artificial Sequence
  Synthetic
atcaaaaatctaagtaaaccagccaaggctgctataagaatagcaatgatatatacttgggcatttgggaatgac

SEQ ID NO: 32878 - DNA, 75 bp, Artificial Sequence
  Synthetic
gaagtatcctggatggaagcatcacagattgcacagacacgtgcgaatttcacattggatagcttaaagattcta

SEQ ID NO: 32879 - DNA, 75 bp, Artificial Sequence
  Synthetic
cacattggatagcttaaagattctaacaccagtgacaacatcaacaaatctctcacataggttgaaagatactgc

SEQ ID NO: 32880 - DNA, 75 bp, Artificial Sequence
  Synthetic
tactcaaatgaaattttctagtacatcacttattagagtaagcaggttcatcacaatatctaatgataatatgtc

SEQ ID NO: 32881 - DNA, 75 bp, Artificial Sequence
  Synthetic
tatcaaggaggcaaatgaaactaaagacacaaatcttatttatcaacaagtgatgttaacaggattaagcgtatt

SEQ ID NO: 32882 - DNA, 75 bp, Artificial Sequence
  Synthetic
tgatgttaacaggattaagcgtatttgaatatctatttagattagaagagaatacgggacataaccctgtggtga

SEQ ID NO: 32883 - DNA, 75 bp, Artificial Sequence
  Synthetic
tagaattaattaaatatcctgaaagtaatgaattcatatatgataaggaccctttaaaggatatagacctatcaa

SEQ ID NO: 32884 - DNA, 75 bp, Artificial Sequence
  Synthetic
cctttaaaggatatagacctatcaaaattaatggttataagagatcattcttatactattgacatgaactactgg

SEQ ID NO: 32885 - DNA, 75 bp, Artificial Sequence
  Synthetic
gatgacacagatattgtacatgcaatatcaatatgtactgcagttacaatagcggatactatgtcgcagctagat

SEQ ID NO: 32886 - DNA, 75 bp, Artificial Sequence
  Synthetic
tatcaatatgtactgcagttacaatagcggatactatgtcgcagctagatcgggataatcttaaagagttggtag

SEQ ID NO: 32887 - DNA, 75 bp, Artificial Sequence
  Synthetic
ctcgatatactagtgtttctcaaaacatttggagggttactcgtgaatcaatttgcatataccctttatggattg

SEQ ID NO: 32888 - DNA, 75 bp, Artificial Sequence
  Synthetic
aaaatagaagggagggatcctatttgggactatataatgagaacattaaaagacacatcacattcagtactaaag

SEQ ID NO: 32889 - DNA, 75 bp, Artificial Sequence
  Synthetic
gtattatccaatgcactatctcatcccaaggtgtttaagagattttgggattgcggagttttaaatcctatttat

SEQ ID NO: 32890 - DNA, 75 bp, Artificial Sequence
  Synthetic
ggtcccaatactgctagtcaggatcaagttaagcttgctctttcaatctgcgagtactccttggatctatttatg

SEQ ID NO: 32891 - DNA, 75 bp, Artificial Sequence
  Synthetic
agagaatggttgaatggagcatcacttgagatctacatctgtgatagtgacatggaaatagcaaatgatagaaga

SEQ ID NO: 32892 - DNA, 75 bp, Artificial Sequence
  Synthetic
aatctaacatatttagagagacttaatgagttaaaacaatacttagatttgaacatcaaagaagatcctaccctt

SEQ ID NO: 32893 - DNA, 75 bp, Artificial Sequence
  Synthetic
aaatatgtgcaagtatcagggctgttaattaaatcattcccttcaactgttacatatgtgaggaaaactgcgatt

SEQ ID NO: 32894 - DNA, 75 bp, Artificial Sequence
  Synthetic
aagtatctgaggattcgtggaatcaatccacctgaaacaattgaagattgggaccctgtagaagatgagaatatt

SEQ ID NO: 32895 - DNA, 75 bp, Artificial Sequence
  Synthetic
ttagataatattgttaaaactgtaaatgataattgcaatgaaaatcaaaagagaaataagagtagttatttctgg

SEQ ID NO: 32896 - DNA, 75 bp, Artificial Sequence
  Synthetic
atgataattgcaatgaaaatcaaaagagaaataagagtagttatttctggggattggctctaaagaattaccaag

SEQ ID NO: 32897 - DNA, 75 bp, Artificial Sequence
  Synthetic
ttgtaagaataagatctataacaagtgactctgaaggtaacgaagcttcaaatgttaatacacatggaatgacac

SEQ ID NO: 32898 - DNA, 75 bp, Artificial Sequence
  Synthetic
tgactctgaaggtaacgaagcttcaaatgttaatacacatggaatgacacttcctcagggaggaaattatctatc

SEQ ID NO: 32899 - DNA, 75 bp, Artificial Sequence
  Synthetic
acatcagctgaggttatttggagtgaatagtactagttgtctaaaagctcttgaattatcacaaattttaatgag

SEQ ID NO: 32900 - DNA, 75 bp, Artificial Sequence
  Synthetic
ttgaattatcacaaattttaatgagagaagtaagaagagataaagatagactattcttaggagaaggagcaggag

SEQ ID NO: 32901 - DNA, 75 bp, Artificial Sequence
  Synthetic
cttcccatcagaagtatcattggtaggtaaaaaactaggaaatgtaacacagattcttaatcgggtgaaggtatt

SEQ ID NO: 32902 - DNA, 75 bp, Artificial Sequence
  Synthetic
attcaatgggaatcccaattcaacatggataggaaatatggaatgtgagagtttaatatggagtgaattaaatga

SEQ ID NO: 32903 - DNA, 75 bp, Artificial Sequence
  Synthetic
cagaagatactgttttacacgaacattatagtattattaggattacatatttaattggagatgatgacgttgttc

SEQ ID NO: 32904 - DNA, 75 bp, Artificial Sequence
  Synthetic
tagtatcaaaaattataccgactatcactccaaattggtctaagatactctatctatataaattgtattggaaag

SEQ ID NO: 32905 - DNA, 75 bp, Artificial Sequence
  Synthetic
atgtaagcgtagtgtctcttaagacatccaatcccgcttcaacagagctgtatttaatttcaaaggatgcatact

SEQ ID NO: 32906 - DNA, 75 bp, Artificial Sequence
  Synthetic
gtactgtaatggaacctagtaatcttgtgttatcaaaacttaaaagaatatcatccatagaagaaaataatctat

SEQ ID NO: 32907 - DNA, 75 bp, Artificial Sequence
  Synthetic
taaaatggataatcttatcaaaaaggaagaataacgaatggttacagcatgaaatcaaagaaggagaaagggatt

SEQ ID NO: 32908 - DNA, 75 bp, Artificial Sequence
  Synthetic
gaagaataacgaatggttacagcatgaaatcaaagaaggagaaagggattatgggataatgaggccatatcatac

SEQ ID NO: 32909 - DNA, 75 bp, Artificial Sequence
  Synthetic
gaaatcaaagaaggagaaagggattatgggataatgaggccatatcatacagcactacaaatttttggattccaa

SEQ ID NO: 32910 - DNA, 75 bp, Artificial Sequence
  Synthetic
agcactacaaatttttggattccaaattaacttaaatcacttagccaaagaatttttatcaactcctgatctaac

SEQ ID NO: 32911 - DNA, 75 bp, Artificial Sequence
  Synthetic
caacattaacaatataattcaaagttttacaaggacaattaaagatgttatgttcgagtgggtcaatataactca

SEQ ID NO: 32912 - DNA, 75 bp, Artificial Sequence
  Synthetic
atcacgaagattaatactaagctggatatcattatccttatcaactagattattgacgggtcgtttcccagatga

SEQ ID NO: 32913 - DNA, 75 bp, Artificial Sequence
  Synthetic
atatcattatccttatcaactagattattgacgggtcgtttcccagatgaaaaatttgaaaatagagcacagact

SEQ ID NO: 32914 - DNA, 75 bp, Artificial Sequence
  Synthetic
ggatatgtatcattggctgatactgatttagaatccttaaagttattatcaagaaatattattaaaagttacaaa

SEQ ID NO: 32915 - DNA, 75 bp, Artificial Sequence
  Synthetic
gaacacataggattaatatcatattggtttttgaccaaagaagtcaaaatactgatgaaacttatcggaggagtc

SEQ ID NO: 32916 - DNA, 75 bp, Artificial Sequence
  Synthetic
aaattattaggaattcctaaacagtacaaggaattagaggaacaaccatttcagagttatgaatatgataacgga

SEQ ID NO: 32917 - DNA, 75 bp, Artificial Sequence
  Synthetic
tttgatattgattaatatacaaataaaaaagacaaaacgcttgatcctcaactattcaccctcagcagagtaaaa

SEQ ID NO: 32918 - DNA, 75 bp, Artificial Sequence
  Synthetic
tcaccctcagcagagtaaaaagtaagaaaaacatataatatatatataccaaacagagtttttctcttgtttggt

SEQ ID NO: 32919 - DNA, 75 bp, Artificial Sequence
  Synthetic
accaaacaagagaagagacttgtatgggaatattaattcagataaaaattaacttaggattaaagaactttgccg

SEQ ID NO: 32920 - DNA, 75 bp, Artificial Sequence
  Synthetic
accaaacaagagaagagacttgtttgggaatattaattcagataaaaattaacttaggattaaagaactttgccg

SEQ ID NO: 32921 - DNA, 75 bp, Artificial Sequence
  Synthetic
accaaacaagagaagagacttgtctgggaatattaattcagataaaaattaacttaggattaaagaactttgccg

SEQ ID NO: 32922 - DNA, 75 bp, Artificial Sequence
  Synthetic
accaaacaagagaagagacttgtgtgggaatattaattcagataaaaattaacttaggattaaagaactttgccg

SEQ ID NO: 32923 - DNA, 75 bp, Artificial Sequence
  Synthetic
actgtatctatatttgctcttggtccatcaataacagatgacaacgacaaaatgacattggctcttctctttttg

SEQ ID NO: 32924 - DNA, 75 bp, Artificial Sequence
  Synthetic
atcaagacaatatgttgcaaaatggcagaagtacttctacaatcgaggatcttgttcatacttttggatatccat

SEQ ID NO: 32925 - DNA, 75 bp, Artificial Sequence
  Synthetic
gtcttgcctcatttttcaacacaatcagatacggcattgagactagaatggcagctctaactctgtctaccctca

SEQ ID NO: 32926 - DNA, 75 bp, Artificial Sequence
  Synthetic
cagttgtacaaaacaaggctatgcaacagtatgtaacaggaaggtcttatctagatattgaaatgttccaactgg

SEQ ID NO: 32927 - DNA, 75 bp, Artificial Sequence
  Synthetic
gatgaactaggggtcacacaggaagccaagcaaagcttaaagaaacatatgaagaacatcagcagttcagataca

SEQ ID NO: 32928 - DNA, 75 bp, Artificial Sequence
  Synthetic
acttaggattaacgggaattatccaatccggagacggagggacaaatccagaatccacccacgaccaaccaaacc

SEQ ID NO: 32929 - DNA, 75 bp, Artificial Sequence
  Synthetic
aaagatgttccagtcaaggtatcaagaagtgatgccattcctccaacaaaacaagatggaaacggtgatgatgga

SEQ ID NO: 32930 - DNA, 75 bp, Artificial Sequence
  Synthetic
aaaggggttggaaagccagaagatacaaacaaacaatcaccaatattggactacgaactcaactccaaaggatcg

SEQ ID NO: 32931 - DNA, 75 bp, Artificial Sequence
  Synthetic
caaacaaacaatcaccaatattggactacgaactcaactccaaaggatcgaagaggaaccagaagaccctcaaaa

SEQ ID NO: 32932 - DNA, 75 bp, Artificial Sequence
  Synthetic
tcaacagcgagagcggcagtcgaacagaatcaacaagccaaaactctcagataccaacatctgggaagagcaata

SEQ ID NO: 32933 - DNA, 75 bp, Artificial Sequence
  Synthetic
tatcactgatcacatcattgatctcaaatcttaaaattatgacagagagaggagggaagaaggaccaacccgaaa

SEQ ID NO: 32934 - DNA, 75 bp, Artificial Sequence
  Synthetic
aaatcttaaaattatgacagagagaggagggaagaaggaccaacccgaaaacagcggaaggacacccatgatcaa

SEQ ID NO: 32935 - DNA, 75 bp, Artificial Sequence
  Synthetic
catccccgacctctatagatcaatagagaaaacaccagaaaacgacatacagatcaaatcagacataaacagatc

SEQ ID NO: 32936 - DNA, 75 bp, Artificial Sequence
  Synthetic
gagaaaacaccagaaaacgacatacagatcaaatcagacataaacagatcgaatgatgagtccaatgcaaccaga

SEQ ID NO: 32937 - DNA, 75 bp, Artificial Sequence
  Synthetic
aacgaggatgtcagctctcagtaaacagccaaccaaggatccacctcacagaaatcaacagcacaagacaaccaa

SEQ ID NO: 32938 - DNA, 75 bp, Artificial Sequence
  Synthetic
cagccaaccaaggatccacctcacagaaatcaacagcacaagacaaccaaccagagatcaccccaaaacaccaga

SEQ ID NO: 32939 - DNA, 75 bp, Artificial Sequence
  Synthetic
tccgaaacaatgagcattaccaactctgcaatctacacattcccagaatcctccttttccgataatggcaacata

SEQ ID NO: 32940 - DNA, 75 bp, Artificial Sequence
  Synthetic
ctgcaatctacacattcccagaatcctccttttccgataatggcaacatagagccgctgccgctcaaagtcaatg

SEQ ID NO: 32941 - DNA, 75 bp, Artificial Sequence
  Synthetic
tacagaacatcaaacctgaactatatccatggtccagtagattaagaaaggggatgttgtttgacgctaataaag

SEQ ID NO: 32942 - DNA, 75 bp, Artificial Sequence
  Synthetic
tcagacagattctaaaggagtagttcagattctagatgaaaaaggtgaaaaatcactaaatttcatggttcatct

SEQ ID NO: 32943 - DNA, 75 bp, Artificial Sequence
  Synthetic
aagtcaactagcattcaaaagagaaatctgctatcccctaatggatctgaatccgcacttaaatctagttatatg

SEQ ID NO: 32944 - DNA, 75 bp, Artificial Sequence
  Synthetic
ggcatcatcagttgaaattacaagagtggacgcaattttccagccttcattacctggtgaatttagatactaccc

SEQ ID NO: 32945 - DNA, 75 bp, Artificial Sequence
  Synthetic
gctacccacaggagaaaaatcaaaaacttaggatcaaagggatcaccacaaactccgagcaacagttaaaccaac

SEQ ID NO: 32946 - DNA, 75 bp, Artificial Sequence
  Synthetic
caatacatagatcacaggagaaaagaaaaggaaaaagaaaaagaaaaagaaaaaaacaccgcaaagaccgagatc

SEQ ID NO: 32947 - DNA, 75 bp, Artificial Sequence
  Synthetic
aatcagagcacccacaaccaagcagaagaaagccaaggcccgccacccacaaacacaccaacaaccctgcagaca

SEQ ID NO: 32948 - DNA, 75 bp, Artificial Sequence
  Synthetic
cgcagcagtcgctcttgtcgaggcaaaacaggcaaagtcagacatagagaaactcaaagaagctataagagacac

SEQ ID NO: 32949 - DNA, 75 bp, Artificial Sequence
  Synthetic
caacaatgaaattgtaccttcaatcacaagattaggttgtgaagcagctgggctaaaactaggaattgcattaac

SEQ ID NO: 32950 - DNA, 75 bp, Artificial Sequence
  Synthetic
agttagacttcctttgttaactaaactatcaaatactcaaatttataaagtagattctatatcatacaacataca

SEQ ID NO: 32951 - DNA, 75 bp, Artificial Sequence
  Synthetic
ctatcaaatactcaaatttataaagtagattctatatcatacaacatacaaggcaaagagtggtatattccgctt

SEQ ID NO: 32952 - DNA, 75 bp, Artificial Sequence
  Synthetic
acacataaagaatgtcaagtaataggtataaacggaatgttattcagtaccaatagagaagggacattagcaact

SEQ ID NO: 32953 - DNA, 75 bp, Artificial Sequence
  Synthetic
gcaaaattggaactggaagaatcgaaagaatggataaagaaatcaaatcaaaagttagattctgttggaagttgg

SEQ ID NO: 32954 - DNA, 75 bp, Artificial Sequence
  Synthetic
acaccagacagaccaaaagtcagtgcagagacgacaccaaattcaaaaatggaatattggaaacacacaaacagc

SEQ ID NO: 32955 - DNA, 75 bp, Artificial Sequence
  Synthetic
ggaatattggaaacacacaaacagcacaaaggacactaacaatgaacttgggacaaccagagacagacacagcag

SEQ ID NO: 32956 - DNA, 75 bp, Artificial Sequence
  Synthetic
agggccaggtttattagcaacatccactactgtaaatggctgcattagaatcccatctttagcaatcaataatct

SEQ ID NO: 32957 - DNA, 75 bp, Artificial Sequence
  Synthetic
agggccaggtttattagcaacatccactactgtaaatggctgcattagattcccatctttagcaatcaataatct

SEQ ID NO: 32958 - DNA, 75 bp, Artificial Sequence
  Synthetic
agggccaggtttattagcaacatccactactgtaaatggctgcattagactcccatctttagcaatcaataatct

SEQ ID NO: 32959 - DNA, 75 bp, Artificial Sequence
  Synthetic
agggccaggtttattagcaacatccactactgtaaatggctgcattagagtcccatctttagcaatcaataatct

SEQ ID NO: 32960 - DNA, 75 bp, Artificial Sequence
  Synthetic
gaaaatcttaccaagtactacaaatagggataattactataaattcagatttggtacctgatttgaacccaagag

SEQ ID NO: 32961 - DNA, 75 bp, Artificial Sequence
  Synthetic
atattataaagacaaagttatcttcctcggatatggaggtctagagcatgaagaaaacggggacgtaatatgcaa

SEQ ID NO: 32962 - DNA, 75 bp, Artificial Sequence
  Synthetic
cagtcattcttgattcacaaaaatccagagaaaacccaatcattacctattcaacagctacaaatagggtaaatg

SEQ ID NO: 32963 - DNA, 75 bp, Artificial Sequence
  Synthetic
cagagaaaacccaatcattacctattcaacagctacaaatagggtaaatgaattggctatatacaacagaacact

SEQ ID NO: 32964 - DNA, 75 bp, Artificial Sequence
  Synthetic
gtggaatataagttcatgtgcaaaattggatcctaagttacaatcaatgtattataaaggtaacaatttatggga

SEQ ID NO: 32965 - DNA, 75 bp, Artificial Sequence
  Synthetic
tatcattattagagccacttgcattatcactcattcaaacccatgacccggttaaacagctcagaggagcttttt

SEQ ID NO: 32966 - DNA, 75 bp, Artificial Sequence
  Synthetic
taaatcacgtgttatcagaaatggaattaatatttgaagctgagtgtacaacagaggaaatacctaatgtggatt

SEQ ID NO: 32967 - DNA, 75 bp, Artificial Sequence
  Synthetic
ataaatggatatagagaaagacatggtggtcaatggcctccagtgacattgcctgctcatgcacatgaattcatc

SEQ ID NO: 32968 - DNA, 75 bp, Artificial Sequence
  Synthetic
tggttagatgatcctgaatttaatatttcatatagtttaaaggagaaagaaataaaacaagaaggtagacttttt

SEQ ID NO: 32969 - DNA, 75 bp, Artificial Sequence
  Synthetic
tctaacctatcttccaatcagaagtcaaaaaagtttgaattcaaatcaacagatatatacaatgatggatacgag

SEQ ID NO: 32970 - DNA, 75 bp, Artificial Sequence
  Synthetic
tatccaacaattgtacatagcacttggaatgaatattaatccaactataactcaaaatattaaagatcaatattt

SEQ ID NO: 32971 - DNA, 75 bp, Artificial Sequence
  Synthetic
tgttattcaactgaaggtgtaagcccatatacttggatgtatttaccaggcaatcttaatataggatcagctgaa

SEQ ID NO: 32972 - DNA, 75 bp, Artificial Sequence
  Synthetic
acaggagtagcatccttgagggtcccttactttggatcggttacagatgagagatccgaagcacaattgggatat

SEQ ID NO: 32973 - DNA, 75 bp, Artificial Sequence
  Synthetic
cacattggatagcttaaagattctaacaccagtgacaacatcaacaaatctatcacataggttaaaggatactgc

SEQ ID NO: 32974 - DNA, 75 bp, Artificial Sequence
  Synthetic
tgcatctacatgtagaggatggatgttgtattaaagagagttataatgatgagcatattaatccagagtctacat

SEQ ID NO: 32975 - DNA, 75 bp, Artificial Sequence
  Synthetic
cttcccatcagaagtatcattagtaggtaaaaaactaggaaatgtaacacagattcttaatcgggtgaaggtgtt

SEQ ID NO: 32976 - DNA, 75 bp, Artificial Sequence
  Synthetic
taagtcaattggtttagtacattgtgacatggagggagcgataggcaaatcagaagatactgttttacacgaaca

SEQ ID NO: 32977 - DNA, 75 bp, Artificial Sequence
  Synthetic
tgacaataaaagacataaattaggaggaagatataatctattcccacttaaaaataagggaaagctaagattatt

SEQ ID NO: 32978 - DNA, 75 bp, Artificial Sequence
  Synthetic
aaattattaggaattcctaaacaatacaaggaattagaggatcgaccatttcagagttatgaatatgataacgaa

SEQ ID NO: 32979 - DNA, 75 bp, Artificial Sequence
  Synthetic
tttgatattgattaatatataaataaaaaggacaaaacgcttgatcctcaactattcaccctcagcagaacaaaa

SEQ ID NO: 32980 - DNA, 75 bp, Artificial Sequence
  Synthetic
tcaccctcagcagaacaaaaagtaagaaaaacatataatatatatatatcaaacagagtttttctcttgtttggt

SEQ ID NO: 32981 - DNA, 75 bp, Artificial Sequence
  Synthetic
accaaacaagagaagagacttgcttgggaatattaattcaaataaaaattaacttaggattaaagaactttaccg

SEQ ID NO: 32982 - DNA, 75 bp, Artificial Sequence
  Synthetic
gggaatattaattcaaataaaaattaacttaggattaaagaactttaccgaaaggtaaggggaaagaaatcctaa

SEQ ID NO: 32983 - DNA, 75 bp, Artificial Sequence
  Synthetic
gactgtaatcatgttgagtctattcgacacattcagtgcgcgtaggcaggagaacataacaaaatcagctggtgg

SEQ ID NO: 32984 - DNA, 75 bp, Artificial Sequence
  Synthetic
ggctgttattcccgggcaaaaaaacactgtgtctatatttgctcttggaccatcaataacagatgacaatgacaa

SEQ ID NO: 32985 - DNA, 75 bp, Artificial Sequence
  Synthetic
aatgacattggctcttctctttttgtctcattctttagacaatgaaaagcagcatgcgcaaagagctggattttt

SEQ ID NO: 32986 - DNA, 75 bp, Artificial Sequence
  Synthetic
agtttctctgttatcaatggcttatgccaacccagaattatatttaacatcaaatggtagtaatgcagatgttaa

SEQ ID NO: 32987 - DNA, 75 bp, Artificial Sequence
  Synthetic
atatgtcatctacatgatagagaaagacccaggaagacagaaatatggtgggtttgtcgtcaagactagagagat

SEQ ID NO: 32988 - DNA, 75 bp, Artificial Sequence
  Synthetic
tagaagcacttctacaatcgaggatcttgttcatacttttggatatccatcgtgtcttggagcccttataatcca

SEQ ID NO: 32989 - DNA, 75 bp, Artificial Sequence
  Synthetic
ggtttggataatacttgttaaggctataaccagtatatcaggattgaggaaaggattctttactcggttagaagc

SEQ ID NO: 32990 - DNA, 75 bp, Artificial Sequence
  Synthetic
aaggattctttactcggttagaagcatttcgacaagatggaacagttaaatccagtctagtgttgagcggtgatg

SEQ ID NO: 32991 - DNA, 75 bp, Artificial Sequence
  Synthetic
cagtagaacaaattggatcaattatgaggtcccaacagagcttggtaacactcatggttgaaacactgataacaa

SEQ ID NO: 32992 - DNA, 75 bp, Artificial Sequence
  Synthetic
ctcatggttgaaacactgataacaatgaacacaggcaggaatgacctgacaacaatagaaaagaatatacagatt

SEQ ID NO: 32993 - DNA, 75 bp, Artificial Sequence
  Synthetic
cagatatggcattgagactagaatggcagctctaactctgtctacccttagaccggacatcaacagactcaaggc

SEQ ID NO: 32994 - DNA, 75 bp, Artificial Sequence
  Synthetic
gcagctctaactctgtctacccttagaccggacatcaacagactcaaggcactgatagagctatatctatcaaag

SEQ ID NO: 32995 - DNA, 75 bp, Artificial Sequence
  Synthetic
gggccacgtgctccttttatatgcattttgagagatcctgtgcatggtgagtttgcaccaggcaactatcctgcc

SEQ ID NO: 32996 - DNA, 75 bp, Artificial Sequence
  Synthetic
cagttgtacaaaacaaggccatgcaacagtatgtaacaggaaggtcctatctggatattgaaatgttccaactgg

SEQ ID NO: 32997 - DNA, 75 bp, Artificial Sequence
  Synthetic
gtcaagcagtggcacgtgacgccgagtcgcagatgagttcaatattagaggatgaactgggggtcacacaagaag

SEQ ID NO: 32998 - DNA, 75 bp, Artificial Sequence
  Synthetic
gatgaactgggggtcacacaagaagccaagcaaagcttgaagaaacacatgaagaacatcagcagttcagataca

SEQ ID NO: 32999 - DNA, 75 bp, Artificial Sequence
  Synthetic
accttctataagcctacagggggatcagccatagaaatggcaatagatgaggaagcagagcagcccgaatccaga

SEQ ID NO: 33000 - DNA, 75 bp, Artificial Sequence
  Synthetic
ggagaccaagaccaaggagatgaacctcggtcatccatagttccttatgcatgggcagacgaaaccgggaatgac

SEQ ID NO: 33001 - DNA, 75 bp, Artificial Sequence
  Synthetic
ctcggtcatccatagttccttatgcatgggcagacgaaaccgggaatgacaaccaaactgaatcaaccacagaaa

SEQ ID NO: 33002 - DNA, 75 bp, Artificial Sequence
  Synthetic
ttgacagcatcaaaactgaacaaagaaacatcagagacaggctgaacaaaagactcaacgagaaaaggaaacaga

SEQ ID NO: 33003 - DNA, 75 bp, Artificial Sequence
  Synthetic
aaacatcagagacaggctgaacaaaagactcaacgagaaaaggaaacagagtaacccgggatcaactgacatcac

SEQ ID NO: 33004 - DNA, 75 bp, Artificial Sequence
  Synthetic
aaacaacacaaatcaaactgaaatagatgatttattcagtgcattcggaagcaactagtcacaaagagatgacca

SEQ ID NO: 33005 - DNA, 75 bp, Artificial Sequence
  Synthetic
gatgatttattcagtgcattcggaagcaactagtcacaaagagatgaccaccatcatcagcaacaagtaagaaaa

SEQ ID NO: 33006 - DNA, 75 bp, Artificial Sequence
  Synthetic
acttaggattaatggaaattatccaatccggagacggaaggacaaatccagaatccaaccacaactcaatcaacc

SEQ ID NO: 33007 - DNA, 75 bp, Artificial Sequence
  Synthetic
aaagattcatggaagacaatgttcaaaacaatcaaatcatggattcttgggaagagggatcaggagataaatcat

SEQ ID NO: 33008 - DNA, 75 bp, Artificial Sequence
  Synthetic
tcccaagagaacacggcagacagcaatgaaatcaacacaggagccacaagacttagcacgacaatctaccaactt

SEQ ID NO: 33009 - DNA, 75 bp, Artificial Sequence
  Synthetic
gagtccaaaacaacagaaacaagcaaggaaaatagtggaccagctaacaaaaatcgacagtttggggcatcacac

SEQ ID NO: 33010 - DNA, 75 bp, Artificial Sequence
  Synthetic
gaacgtgccacagagacaaaagatagaaatgttaatcagaagactgtacagggaggatataggagaggaagcagc

SEQ ID NO: 33011 - DNA, 75 bp, Artificial Sequence
  Synthetic
ccagatagtagaactgagactatggtcactcgaggaatctccagaagcagcccagatcctaacaatggaacccaa

SEQ ID NO: 33012 - DNA, 75 bp, Artificial Sequence
  Synthetic
atccaggaagatattgattacaatgaagttggagagatggataaggactctactaagagggaaatgcgacaattt

SEQ ID NO: 33013 - DNA, 75 bp, Artificial Sequence
  Synthetic
aaagatgttccagtcaaggtatcaggaagtgatgccattcctccaacaaaacaagatggagacggtgatgatgga

SEQ ID NO: 33014 - DNA, 75 bp, Artificial Sequence
  Synthetic
agaggcctggaatctatcagtacatctgattcaggatataccagtatagtgactgccgcaacactagatgacgaa

SEQ ID NO: 33015 - DNA, 75 bp, Artificial Sequence
  Synthetic
gaagaactccttatgaagaacaacaggccaagaaagtatcaatcaacaccccagaacagtgacaagggaattaaa

SEQ ID NO: 33016 - DNA, 75 bp, Artificial Sequence
  Synthetic
ccagaacagtgacaagggaattaaaaaagggagtggaaggccaaaagacacagacaaacaatcaccaatattgga

SEQ ID NO: 33017 - DNA, 75 bp, Artificial Sequence
  Synthetic
ctacgaactcaactccaaaggatcgaagaagagccagaaaatcctcaaagccagcacgaatacaggagaaccaac

SEQ ID NO: 33018 - DNA, 75 bp, Artificial Sequence
  Synthetic
aagaagagccagaaaatcctcaaagccagcacgaatacaggagaaccaacaagatcacagagtggatcccagggg

SEQ ID NO: 33019 - DNA, 75 bp, Artificial Sequence
  Synthetic
aagagaatcacatcctggaacatcctcaacagcgagagcggcaatcgagcagaatcaacaaaccaaacccatcag

SEQ ID NO: 33020 - DNA, 75 bp, Artificial Sequence
  Synthetic
agaatcaacaaaccaaacccatcagacatcaatctcgggacagaaccacacaatgggaccaagcagaacaacctc

SEQ ID NO: 33021 - DNA, 75 bp, Artificial Sequence
  Synthetic
caatgggaccaagcagaacaacctcagaaccaaggaccaagacacaaaagacggatggaaaggaaagagaggaca

SEQ ID NO: 33022 - DNA, 75 bp, Artificial Sequence
  Synthetic
aattagacctataccaagacaagagagttgtgtgtgtggcgaatgtcctaaacaatgcagatactgcatcaaaga

SEQ ID NO: 33023 - DNA, 75 bp, Artificial Sequence
  Synthetic
tagacttcctagcaggtttgatgataggagtgtcaatggatcatgatgtcaaattaaatcagattcagaacgaga

SEQ ID NO: 33024 - DNA, 75 bp, Artificial Sequence
  Synthetic
aggagtgtcaatggatcatgatgtcaaattaaatcagattcagaacgagatattaagtttaaaaactgatcttaa

SEQ ID NO: 33025 - DNA, 75 bp, Artificial Sequence
  Synthetic
gaagatggatgaatcacatagaagactaattgagaatcaaaaagaacaattatcactgatcacatcattaatctc

SEQ ID NO: 33026 - DNA, 75 bp, Artificial Sequence
  Synthetic
aaatcttaaaatcatgacagagagaggagggaagaaggaccaaccagaacctagcgggaggacatccatgatcaa

SEQ ID NO: 33027 - DNA, 75 bp, Artificial Sequence
  Synthetic
ggagggaagaaggaccaaccagaacctagcgggaggacatccatgatcaagacaaaggcaaaagaagagagaata

SEQ ID NO: 33028 - DNA, 75 bp, Artificial Sequence
  Synthetic
aagaaagtcaggtttgaccctcttatggaaacacagggcatcgagaaaaacatccctgacctctacagatcaata

SEQ ID NO: 33029 - DNA, 75 bp, Artificial Sequence
  Synthetic
gagaaaacaccagaaaacgacacacagatcaaatcagaaataaacagattgaatgatgaatccaatgccactaga

SEQ ID NO: 33030 - DNA, 75 bp, Artificial Sequence
  Synthetic
gaatgatgaatccaatgccactagattagtacctagaagaataagcagtacaatgagatcactaataataatcat

SEQ ID NO: 33031 - DNA, 75 bp, Artificial Sequence
  Synthetic
ttagtacctagaagaataagcagtacaatgagatcactaataataatcatcaacaacagcaatttatcatcaaaa

SEQ ID NO: 33032 - DNA, 75 bp, Artificial Sequence
  Synthetic
gcaaagcaatcatacatcaacgaactcaagctctgcaagagtgatgaggaagtgtctgagttgatggacatgttc

SEQ ID NO: 33033 - DNA, 75 bp, Artificial Sequence
  Synthetic
aatgaggatgtcagctcccagtaaaccgccaaccaagggtcaacaccaagaaaaccaacagcacaaaacagccaa

SEQ ID NO: 33034 - DNA, 75 bp, Artificial Sequence
  Synthetic
taagagaccatcccaacacaccgaaccaatcaacacataacaaagatctttagatcatagatgactaagaaaaac

SEQ ID NO: 33035 - DNA, 75 bp, Artificial Sequence
  Synthetic
tagatcatagatgactaagaaaaacttaggatgaaaggactgatcaatcctccaaaacaatgagcatcaccagct

SEQ ID NO: 33036 - DNA, 75 bp, Artificial Sequence
  Synthetic
ccacaatctacacattcccagaatcctctttctccgagaatggcaacatagagccgttaccactcaaggtcaatg

SEQ ID NO: 33037 - DNA, 75 bp, Artificial Sequence
  Synthetic
aacagagaaaggccatacctcatattagggttgtcaagataggagatccgcccaaacatggatccagatatctgg

SEQ ID NO: 33038 - DNA, 75 bp, Artificial Sequence
  Synthetic
atgtctttttactgggcttctttgaaatggaaaggtcaaaagacaggtatgggagcataagtgatctagatgatg

SEQ ID NO: 33039 - DNA, 75 bp, Artificial Sequence
  Synthetic
atccaagttacaaggtttgtggctctggatcattgccacttgggttggctagatacactggaaatgatcaggaac

SEQ ID NO: 33040 - DNA, 75 bp, Artificial Sequence
  Synthetic
tcctacaggctgcaaccaagctcgatatagaagtaagaagaactgtaaaggctacggagatgatagtttacactg

SEQ ID NO: 33041 - DNA, 75 bp, Artificial Sequence
  Synthetic
tatagaagtaagaagaactgtaaaggctacggagatgatagtttacactgtgcaaaacatcaaacctgaactata

SEQ ID NO: 33042 - DNA, 75 bp, Artificial Sequence
  Synthetic
tccatggtccagtagattaagaaaagggatgttatttgacgctaacaaggttgcacttgctcctcaatgtcttcc

SEQ ID NO: 33043 - DNA, 75 bp, Artificial Sequence
  Synthetic
actagatagagggataaaattcagggtgatatttgtgaactgcacagcaattggatcaataactctattcaaaat

SEQ ID NO: 33044 - DNA, 75 bp, Artificial Sequence
  Synthetic
ttggatcaataactctattcaaaatccccaagtccatggcattgttatcattgcctaatacaatatcaataaatc

SEQ ID NO: 33045 - DNA, 75 bp, Artificial Sequence
  Synthetic
cagattctagatgaaaaaggtgaaaaatcactaaatttcatggttcatctcgggttgatcaaaaggaagatgggt

SEQ ID NO: 33046 - DNA, 75 bp, Artificial Sequence
  Synthetic
agaatgtactcagttgaatattgtaagcagaagattgagaagatgagattattattctcattgggattagttgga

SEQ ID NO: 33047 - DNA, 75 bp, Artificial Sequence
  Synthetic
gggatcagcttccacgtcaacgcaactggctctatatcaaagacattagcaagtcaattagcatttaaaagagaa

SEQ ID NO: 33048 - DNA, 75 bp, Artificial Sequence
  Synthetic
atctgctatcccctaatggatctgaatccacacttaaatttagttatatgggcatcatcagttgaaattacaaga

SEQ ID NO: 33049 - DNA, 75 bp, Artificial Sequence
  Synthetic
gtagatgcaattctccagccttcattacctggcgaattcagatactacccaaacatcatagcaaaaggggtcggg

SEQ ID NO: 33050 - DNA, 75 bp, Artificial Sequence
  Synthetic
aaaatcagacagtaaaaccaacaaccctgacatccaacactgcaaatcaggctacccacaggagaaaaatcaaaa

SEQ ID NO: 33051 - DNA, 75 bp, Artificial Sequence
  Synthetic
acttaggatcaaagggatcaccacaaaccccgggaaacagccaaaccaaccaacacacaaatcacagacaaaaag

SEQ ID NO: 33052 - DNA, 75 bp, Artificial Sequence
  Synthetic
gaaaaggcactgcaaagaccgagaacaagcagaacgcacacaaccaagcagaggaaagccaaagcccgccattca

SEQ ID NO: 33053 - DNA, 75 bp, Artificial Sequence
  Synthetic
caaacacaccaacaatcctacaaacaagcaccaaaatagaggtcaaaagacaaagagcatcagatatgaccatca

SEQ ID NO: 33054 - DNA, 75 bp, Artificial Sequence
  Synthetic
caaccataatcatagccatactactaatacccctatcattctgtcaaatagacataacaaaactgcaacgtgtag

SEQ ID NO: 33055 - DNA, 75 bp, Artificial Sequence
  Synthetic
gacataacaaaactgcaacgtgtaggtgtattagtcaacaatcccaaaggcatgaaaatttcacaaaattttgaa

SEQ ID NO: 33056 - DNA, 75 bp, Artificial Sequence
  Synthetic
acgagatacctgatattaagtctgatacccaaaatagagaattcacactcatgtggggatcaacagataaaccaa

SEQ ID NO: 33057 - DNA, 75 bp, Artificial Sequence
  Synthetic
tacaagaagttattggatagattgataattcctctatatgatggattaaaattacaaaaagatgtaatagtagta

SEQ ID NO: 33058 - DNA, 75 bp, Artificial Sequence
  Synthetic
agtcatgaaacccataataatactaatcttaggacaaaacgattctttggagagataattgggacaattgcgata

SEQ ID NO: 33059 - DNA, 75 bp, Artificial Sequence
  Synthetic
gggatagccacctcagcgcaaatcaccgcagcagtcgctcttgtcgaagctaaacaggcaaggtcagacatagaa

SEQ ID NO: 33060 - DNA, 75 bp, Artificial Sequence
  Synthetic
aaactcaaagaagctataagagacacaaacaaggcagtacaatcgattcaaagttctgtaggtaacctaattgtt

SEQ ID NO: 33061 - DNA, 75 bp, Artificial Sequence
  Synthetic
gcagttaaatcagttcaagactatgtcaacaatgaaattgtaccttcaatcacaagattaggctgtgaagcagca

SEQ ID NO: 33062 - DNA, 75 bp, Artificial Sequence
  Synthetic
gggttacaattgggaattgcactgacacaacattactcagaattaacaaatatatttggtgataatataggaaca

SEQ ID NO: 33063 - DNA, 75 bp, Artificial Sequence
  Synthetic
ctgaaagaaaaagggataaaattacaggggatagcatcgttatatcatacaaacataacagaaatatttactact

SEQ ID NO: 33064 - DNA, 75 bp, Artificial Sequence
  Synthetic
tcaacagttgaccaatatgatatttatgacctattattcactgaatcaatcaagatgagagtgatagatgttgat

SEQ ID NO: 33065 - DNA, 75 bp, Artificial Sequence
  Synthetic
ttgagtgattactcaattactcttcaagttagacttcctttattaactaaactatcaaatactcagatttataaa

SEQ ID NO: 33066 - DNA, 75 bp, Artificial Sequence
  Synthetic
gtagattctatatcatacaacatccagggcaaagagtggtatattcctcttcccaatcacatcatgacaaaaggg

SEQ ID NO: 33067 - DNA, 75 bp, Artificial Sequence
  Synthetic
gcttttctaggtggtgctgatattaaagaatgcatagaggcattcagcagttatatatgtccttctgatccaggt

SEQ ID NO: 33068 - DNA, 75 bp, Artificial Sequence
  Synthetic
tatatattaaatcacgagatagagaattgtttatcagggaacataacacagtgtcctaagactgttgttacatca

SEQ ID NO: 33069 - DNA, 75 bp, Artificial Sequence
  Synthetic
gatgtggtaccacgatacgcgtttgtgaatggtggattaattgcaaactgcataacaactacatgtacatgcaat

SEQ ID NO: 33070 - DNA, 75 bp, Artificial Sequence
  Synthetic
ggaattgacaatagaattaatcaatcacctgatcaaggaattaagatcataacacataaagaatgccaggtaata

SEQ ID NO: 33071 - DNA, 75 bp, Artificial Sequence
  Synthetic
ggtataaacggaatgttattcaatactaatagagaagggacattagcaacttatacatttgatgacattatatta

SEQ ID NO: 33072 - DNA, 75 bp, Artificial Sequence
  Synthetic
aataactctgttgcacttaatccaattgatatatctatggaacttaacaaggcaaaactagaattagaagaatcg

SEQ ID NO: 33073 - DNA, 75 bp, Artificial Sequence
  Synthetic
aaggaatggataaagaaatcaaatcaaaagttagattccgttggaagttggtatcaatctagtgcaacaatcacc

SEQ ID NO: 33074 - DNA, 75 bp, Artificial Sequence
  Synthetic
gtatcaatctagtgcaacaatcaccataatcatagtgatgataataattctatttataatcaatataacaattat

SEQ ID NO: 33075 - DNA, 75 bp, Artificial Sequence
  Synthetic
tatttataatcaatataacaattattgtagtcataatcaaattctatagaattaagggggaaaatcaaaacgaca

SEQ ID NO: 33076 - DNA, 75 bp, Artificial Sequence
  Synthetic
aaaacagtgagccgtatatactgacaaatagacaataagactatacacgatcaaatatagaaagtacaaaaaact

SEQ ID NO: 33077 - DNA, 75 bp, Artificial Sequence
  Synthetic
taggaacaaagttgttcaacacagcagcagcgaacagacccaaaggcagcgcagaggcgacaccgaacccaaaaa

SEQ ID NO: 33078 - DNA, 75 bp, Artificial Sequence
  Synthetic
tggaatattggaaacacacaaacagcacaaaaaacaccaacaatgaaaccgaaacaaccagaggcaaacacagta

SEQ ID NO: 33079 - DNA, 75 bp, Artificial Sequence
  Synthetic
gaaacaaccagaggcaaacacagtagcaaggttacaaatatcataatgtacaccttctggacaataacatcaaca

SEQ ID NO: 33080 - DNA, 75 bp, Artificial Sequence
  Synthetic
atattattagtcatttttataatgatattgacaaacttaattcaagagaacaatcataataaattaatgttgcag

SEQ ID NO: 33081 - DNA, 75 bp, Artificial Sequence
  Synthetic
gaaataagaaaagaattcgcggcaatagacaccaagattcagaggacctcggatgacattggaacctcaatacag

SEQ ID NO: 33082 - DNA, 75 bp, Artificial Sequence
  Synthetic
tcaggaataaatacaagacttctcacaattcagagtcatgttcaaaactatatcccactatcactaacacaacaa

SEQ ID NO: 33083 - DNA, 75 bp, Artificial Sequence
  Synthetic
atgtcagatctcagaaaatttatcaatgatctaacaaataaaagagaacatcaagaagtgccaatacagagaatg

SEQ ID NO: 33084 - DNA, 75 bp, Artificial Sequence
  Synthetic
actcatgatagaggtatagaacccctaaatccagacaagttctggaggtgtacatctggtaacccatctctaaca

SEQ ID NO: 33085 - DNA, 75 bp, Artificial Sequence
  Synthetic
agtagtcctaagataaggttaataccagggccaggtttattagcaacatctactacagtaaatggctgtattaga

SEQ ID NO: 33086 - DNA, 75 bp, Artificial Sequence
  Synthetic
atcccatcgttagcaatcaatcatttaatctacgcttacacctctaatcttatcacccagggctgtcaaaatata

SEQ ID NO: 33087 - DNA, 75 bp, Artificial Sequence
  Synthetic
taatctacgcttacacctctaatcttatcacccagggctgtcaaaatatagggaaatcttaccaagtactacaaa

SEQ ID NO: 33088 - DNA, 75 bp, Artificial Sequence
  Synthetic
tagggataattactataaattcggacctagtacctgatttaaatcccagagtcacacatacatttaatattgatg

SEQ ID NO: 33089 - DNA, 75 bp, Artificial Sequence
  Synthetic
cctagtacctgatttaaatcccagagtcacacatacatttaatattgatgataataggaaatcttgctctctggc

SEQ ID NO: 33090 - DNA, 75 bp, Artificial Sequence
  Synthetic
actattgaatacagatgtttatcagttatgctcaacaccaaaagttgatgagagatccgattatgcatcaacagg

SEQ ID NO: 33091 - DNA, 75 bp, Artificial Sequence
  Synthetic
tattgaggatattgtacttgacattgtcactaataatggattaattataacaacaaggtttacaaataataatat

SEQ ID NO: 33092 - DNA, 75 bp, Artificial Sequence
  Synthetic
caacaaggtttacaaataataatataacttttgataaaccgtatgcagcattgtatccatcagtaggaccaggaa

SEQ ID NO: 33093 - DNA, 75 bp, Artificial Sequence
  Synthetic
tctattataagggtaaagttatatttctcggatatggaggtctagagcatgaagaaaacggagacgtaatatgta

SEQ ID NO: 33094 - DNA, 75 bp, Artificial Sequence
  Synthetic
atacaactggttgtcctggcaaaacacagagagactgtaatcaggcttcttatagcccatggttctcaaatagga

SEQ ID NO: 33095 - DNA, 75 bp, Artificial Sequence
  Synthetic
gaatggtaaactctattattgttgttgataaaggcatagatgcaacttttagcttgagggtgtggactattccaa

SEQ ID NO: 33096 - DNA, 75 bp, Artificial Sequence
  Synthetic
tgagccaaaattattggggatcagaaggaagattacttttattaggtgacagaatatacatatatactagatcca

SEQ ID NO: 33097 - DNA, 75 bp, Artificial Sequence
  Synthetic
caagttggcacagtaaattacagttaggggtaattgatatttctgattataataatataagaataaattggactt

SEQ ID NO: 33098 - DNA, 75 bp, Artificial Sequence
  Synthetic
ggcataatgtactatcacggccaggaaatgatgaatgtccatggggtcattcatgcccagacggatgtataacag

SEQ ID NO: 33099 - DNA, 75 bp, Artificial Sequence
  Synthetic
gagtttacactgatgcatatccgctaaacccatcggggagtgttgtatcatcagtaattcttgactcacaaaagt

SEQ ID NO: 33100 - DNA, 75 bp, Artificial Sequence
  Synthetic
ctagagaaaacccaatcattacctactcaacagctacaaatagaataaatgaattagctatatataacagaacac

SEQ ID NO: 33101 - DNA, 75 bp, Artificial Sequence
  Synthetic
gaattagctatatataacagaacacttccagctgcatatacaacaacaaattgtatcacacattatgataaaggg

SEQ ID NO: 33102 - DNA, 75 bp, Artificial Sequence
  Synthetic
tattgttttcatatagtagaaataaatcacagaagtttgaatacgtttcaacctatgttattcaaaacagaagtt

SEQ ID NO: 33103 - DNA, 75 bp, Artificial Sequence
  Synthetic
ccaaaaaactgcagctaaattgatcatcgcatatcggatgccagatgacattaaaagagaccaccagacagacaa

SEQ ID NO: 33104 - DNA, 75 bp, Artificial Sequence
  Synthetic
cacaggagatgatgcaagatataaaggaataataaaaaacttaggagaaaagtgtgcaagaaaaatggacactga

SEQ ID NO: 33105 - DNA, 75 bp, Artificial Sequence
  Synthetic
ggaataataaaaaacttaggagaaaagtgtgcaagaaaaatggacactgaatcccacagcggcacaacatctgac

SEQ ID NO: 33106 - DNA, 75 bp, Artificial Sequence
  Synthetic
attctgtaccctgaatgtcacctcaattctcctatagttaaaggaaaaatagcacaactgcatacaataatgagt

SEQ ID NO: 33107 - DNA, 75 bp, Artificial Sequence
  Synthetic
attctcctatagttaaaggaaaaatagcacaactgcatacaataatgagtttgccccaaccctacgatatggatg

SEQ ID NO: 33108 - DNA, 75 bp, Artificial Sequence
  Synthetic
atgattcaatactgattattactagacaaaaaatcaaactcaataaattagataaaagacaacggtcaattagga

SEQ ID NO: 33109 - DNA, 75 bp, Artificial Sequence
  Synthetic
acaaaaaatcaaactcaataaattagataaaagacaacggtcaattaggaaattaagatcagtcttaatggaaag

SEQ ID NO: 33110 - DNA, 75 bp, Artificial Sequence
  Synthetic
gataaaagacaacggtcaattaggaaattaagatcagtcttaatggaaagagtaaatgatcttggtaaatacacc

SEQ ID NO: 33111 - DNA, 75 bp, Artificial Sequence
  Synthetic
tttatcagatatccagaaatgtctagtgaaatgttccaattatgtatacccggaattaataataaaataaatgaa

SEQ ID NO: 33112 - DNA, 75 bp, Artificial Sequence
  Synthetic
ataatcaaatgactgatggattaagagatctatgggttactgtactatcgaagttagcatcgaaaaatgatggaa

SEQ ID NO: 33113 - DNA, 75 bp, Artificial Sequence
  Synthetic
gtaattatgatatcaatgaagatattagcaatatatcaaatgttcacatgacttaccaatcagacaaatggtata

SEQ ID NO: 33114 - DNA, 75 bp, Artificial Sequence
  Synthetic
atccattcaagacatggtttactattaagtatgacatgaggagattacaaaaagccaaaaatgagattacattca

SEQ ID NO: 33115 - DNA, 75 bp, Artificial Sequence
  Synthetic
ataggcataaagattataatctattagaagaccaaaagaatatattgctgatacatccagaactcgtcttaatat

SEQ ID NO: 33116 - DNA, 75 bp, Artificial Sequence
  Synthetic
tagataaacaaaattacaatgggtatataatgactcctgaattggtactaatgtattgtgatgtagttgaaggga

SEQ ID NO: 33117 - DNA, 75 bp, Artificial Sequence
  Synthetic
tataatgactcctgaattggtactaatgtattgtgatgtagttgaagggaggtggaatataagttcatgtgcaaa

SEQ ID NO: 33118 - DNA, 75 bp, Artificial Sequence
  Synthetic
attggatcctaaattacaatcaatgtattataaaggtaacaatttatgggaaataatagatggactattcctgac

SEQ ID NO: 33119 - DNA, 75 bp, Artificial Sequence
  Synthetic
cttaggagaaagaacatttgacataatatcactattagaaccgcttgcattatcgctcattcaaactcatgaccc

SEQ ID NO: 33120 - DNA, 75 bp, Artificial Sequence
  Synthetic
ggttaaacagctcagaggggcttttttaaatcacgtgttatcagaaatggaatcaatattcgcagctgagtgtac

SEQ ID NO: 33121 - DNA, 75 bp, Artificial Sequence
  Synthetic
aacagaggaaatacctaatgtggattatatagataaaattttagatgtattcaaagaatcaacaatagatgaaat

SEQ ID NO: 33122 - DNA, 75 bp, Artificial Sequence
  Synthetic
tcaaagaatcaacaatagatgaaatagcagaaattttctctttcttccgaacttttggacaccctccattagagg

SEQ ID NO: 33123 - DNA, 75 bp, Artificial Sequence
  Synthetic
cgagtatagcagcagagaaagttagaaagtatatgtacactgagaaatgtttgaaatttgatactatcaataaat

SEQ ID NO: 33124 - DNA, 75 bp, Artificial Sequence
  Synthetic
ttgaaatttgatactatcaataaatgtcatgctattttttgtacaataattataaatggatatagagaaagacat

SEQ ID NO: 33125 - DNA, 75 bp, Artificial Sequence
  Synthetic
tataaatggatatagagaaagacatggtggtcaatggcctccagttacattacctattcatgcacatgaatttat

SEQ ID NO: 33126 - DNA, 75 bp, Artificial Sequence
  Synthetic
aaaatttgacaagtttatagagcctcaattggatgaagacttaactatttatatgaaagataaagcattatcccc

SEQ ID NO: 33127 - DNA, 75 bp, Artificial Sequence
  Synthetic
atatgaaagataaagcattatccccaaagaaatctaactgggacacagtctatccagcttcaaacctgttatacc

SEQ ID NO: 33128 - DNA, 75 bp, Artificial Sequence
  Synthetic
gcactaatgtgtctcatgattcacgaagattggttgaagtatttatagcagatagtaaatttgatccccaccaag

SEQ ID NO: 33129 - DNA, 75 bp, Artificial Sequence
  Synthetic
tattagattacgtagaatcaggatattggctagatgatcctgaatttaatatctcatatagtttaaaagagaaag

SEQ ID NO: 33130 - DNA, 75 bp, Artificial Sequence
  Synthetic
ttggctagatgatcctgaatttaatatctcatatagtttaaaagagaaagaaataaaacaagaaggtagactttt

SEQ ID NO: 33131 - DNA, 75 bp, Artificial Sequence
  Synthetic
tattggcgaataatatagggaaattcttccaagagaatgggatggttaaaggagaaattgaattactcaagagac

SEQ ID NO: 33132 - DNA, 75 bp, Artificial Sequence
  Synthetic
ggagaaattgaattactcaagagactgacaacaatatctatgtctggggttccgcggtataatgaggtatacaat

SEQ ID NO: 33133 - DNA, 75 bp, Artificial Sequence
  Synthetic
aattcaaaaagtcacacagaggaacttcaagcttataatgcaattagcagttccaatttatcttctaatcagaag

SEQ ID NO: 33134 - DNA, 75 bp, Artificial Sequence
  Synthetic
tcaaagaagtttgaatttaaatcaacagatatatacaatgatggatacgaaaccgtaagctgcttcttaacgaca

SEQ ID NO: 33135 - DNA, 75 bp, Artificial Sequence
  Synthetic
gggttaaaggaattatttaattggctgcaccctcgccttgaaaagagtacaatatatgttggagatccttattgc

SEQ ID NO: 33136 - DNA, 75 bp, Artificial Sequence
  Synthetic
ccgccatcagatattgaacatttaccacttgatgaccatcctgattcaggattttatgttcataatcctaaagga

SEQ ID NO: 33137 - DNA, 75 bp, Artificial Sequence
  Synthetic
ggtgtaagagttactgcaatggttcaaggggataatcaagccatagctgttaccaccagagtacctaataattat

SEQ ID NO: 33138 - DNA, 75 bp, Artificial Sequence
  Synthetic
gattataaggttaagaaagagattgtttataaagatgtggtaagattttttgattctttgagagaggttatggat

SEQ ID NO: 33139 - DNA, 75 bp, Artificial Sequence
  Synthetic
gatctgggtcatgagctcaaactaaatgaaactataataagtagtaaaatgtttatatatagcaaaaggatatac

SEQ ID NO: 33140 - DNA, 75 bp, Artificial Sequence
  Synthetic
tatgacggaagaatccttcctcaggcgttaaaagcattgtctagatgtgttttttggtctgaaacaatcatagat

SEQ ID NO: 33141 - DNA, 75 bp, Artificial Sequence
  Synthetic
gagacaagatcagcatcctcaaatctggcgacatcgtttgcaaaggccattgagaatggctactcacctgtattg

SEQ ID NO: 33142 - DNA, 75 bp, Artificial Sequence
  Synthetic
tgagaatggctactcacctgtattgggatatgtatgctcaatcttcaaaaatatccaacagttgtatatagcact

SEQ ID NO: 33143 - DNA, 75 bp, Artificial Sequence
  Synthetic
tggaatgaatataaatccaactataacccaaaatattaaagatcaatatttcaggaatattcattggatgcaata

SEQ ID NO: 33144 - DNA, 75 bp, Artificial Sequence
  Synthetic
tcaggaatattcattggatgcaatatgcatctctaatccctgctagtgtcggaggatttaattatatggccatgt

SEQ ID NO: 33145 - DNA, 75 bp, Artificial Sequence
  Synthetic
ggaggatttaattatatggccatgtcaaggtgttttgtcagaaacattggagatcctacagtcgctgcattagct

SEQ ID NO: 33146 - DNA, 75 bp, Artificial Sequence
  Synthetic
gatattaaaagatttataaaagcaaatttgttagatcgaggtgtcctttacagaattatgaatcaggaaccaggc

SEQ ID NO: 33147 - DNA, 75 bp, Artificial Sequence
  Synthetic
atttgttagatcgaggtgtcctttacagaattatgaatcaggaaccaggcgagtcctcctttttagactgggctt

SEQ ID NO: 33148 - DNA, 75 bp, Artificial Sequence
  Synthetic
cagacccctattcatgtaacttaccacaatctcaaaatataaccaccatgataaagaatataactgcaagaaatg

SEQ ID NO: 33149 - DNA, 75 bp, Artificial Sequence
  Synthetic
actatctggattatttacaagtacaatgatagaagaggatgaggaattagctgagttcctaatggacaggagaat

SEQ ID NO: 33150 - DNA, 75 bp, Artificial Sequence
  Synthetic
atgatagaagaggatgaggaattagctgagttcctaatggacaggagaataattctcccaagggttgcgcatgac

SEQ ID NO: 33151 - DNA, 75 bp, Artificial Sequence
  Synthetic
attttagataattctcttactggaattaggaatgctatagctggtatgttggatacaacaaaatcactaattcga

SEQ ID NO: 33152 - DNA, 75 bp, Artificial Sequence
  Synthetic
ttaggaatgctatagctggtatgttggatacaacaaaatcactaattcgagtagggataaacagaggaggattaa

SEQ ID NO: 33153 - DNA, 75 bp, Artificial Sequence
  Synthetic
caactatgatcttgtacaatatgagacacttagtaaaactttaagactaatagtcagtgacaagattaagtatga

SEQ ID NO: 33154 - DNA, 75 bp, Artificial Sequence
  Synthetic
agatatgtgctcagtagacctagccatatcattaagacaaaaaatgtggatgcatttatcaggaggaagaatgat

SEQ ID NO: 33155 - DNA, 75 bp, Artificial Sequence
  Synthetic
aaatggacttgaaactccagatcctttagagttactgtctggagtaataataacaggatctgagcattgtaggat

SEQ ID NO: 33156 - DNA, 75 bp, Artificial Sequence
  Synthetic
ttagagttactgtctggagtaataataacaggatctgagcattgtaggatatgttattcaactgaaggtgaaagc

SEQ ID NO: 33157 - DNA, 75 bp, Artificial Sequence
  Synthetic
ccatatacatggatgtatttaccaggcaatcttaatataggatcagctgaaacaggaatagcatcattaagggtc

SEQ ID NO: 33158 - DNA, 75 bp, Artificial Sequence
  Synthetic
aacaggaatagcatcattaagggtcccttactttggatcagttacggatgagagatctgaagcacaattggggta

SEQ ID NO: 33159 - DNA, 75 bp, Artificial Sequence
  Synthetic
tatcaaaaatctaagcaaaccagctaaggctgctataagaatagcaatgatatatacttgggcatttgggaatga

SEQ ID NO: 33160 - DNA, 75 bp, Artificial Sequence
  Synthetic
tatatacttgggcatttgggaatgacgaaatatcttggatggaagcatcacagattgcacaaacacgtgcgaact

SEQ ID NO: 33161 - DNA, 75 bp, Artificial Sequence
  Synthetic
ttacattagatagcttaaagattttgacaccagtgacaacatcaacaaatctatcacataggttaaaagatactg

SEQ ID NO: 33162 - DNA, 75 bp, Artificial Sequence
  Synthetic
gacaccagtgacaacatcaacaaatctatcacataggttaaaagatactgctactcagatgaaattttctagtac

SEQ ID NO: 33163 - DNA, 75 bp, Artificial Sequence
  Synthetic
atcacttattagagtaagcaggttcatcacaatatctaatgataatatgtctattaaagaggcaaatgaaactaa

SEQ ID NO: 33164 - DNA, 75 bp, Artificial Sequence
  Synthetic
agatacaaatcttatttatcaacaggtaatgttaacagggttaagtgtatttgaatatctatttaggttagagga

SEQ ID NO: 33165 - DNA, 75 bp, Artificial Sequence
  Synthetic
gagtacaggacataaccctatggtcatgcatctacatatagaggatggatgttgtatcaaagagagttacaatga

SEQ ID NO: 33166 - DNA, 75 bp, Artificial Sequence
  Synthetic
tgagcatatcaatccggagtctacattagagttaattaaataccctgagagtaatgaatttatatatgataagga

SEQ ID NO: 33167 - DNA, 75 bp, Artificial Sequence
  Synthetic
ccctttaaaggatatagatctatcaaaattaatggttataagagatcattcttatacaattgacatgaattactg

SEQ ID NO: 33168 - DNA, 75 bp, Artificial Sequence
  Synthetic
ggacgacacagatattgtacatgcaatatcaatatgtactgcagttacaatagcagatacaatgtcgcagctaga

SEQ ID NO: 33169 - DNA, 75 bp, Artificial Sequence
  Synthetic
tcgggataatcttaaggagctggttgtaattgcaaatgatgatgatattaacagtctgataactgaatttctgac

SEQ ID NO: 33170 - DNA, 75 bp, Artificial Sequence
  Synthetic
gtaattgcaaatgatgatgatattaacagtctgataactgaatttctgaccctagatatactagtgtttctcaaa

SEQ ID NO: 33171 - DNA, 75 bp, Artificial Sequence
  Synthetic
acatttggagggttactcgtgaatcaatttgcatataccctttatggattgaaaatagaaggaagggatcccatt

SEQ ID NO: 33172 - DNA, 75 bp, Artificial Sequence
  Synthetic
tgggattatataatgagaacattaaaagacacctcacattcagtacttaaagtattatctaatgcactatctcat

SEQ ID NO: 33173 - DNA, 75 bp, Artificial Sequence
  Synthetic
agtattatctaatgcactatctcatccaaaagtgtttaagagattttgggattgtggagttttgaatcctattta

SEQ ID NO: 33174 - DNA, 75 bp, Artificial Sequence
  Synthetic
tggtcctaatactgctagtcaggaccaagttaagcttgctctctcaatttgcgagtactccttggatctatttat

SEQ ID NO: 33175 - DNA, 75 bp, Artificial Sequence
  Synthetic
acaagcatttctctcaagacaccttgcctttgtgtgttgtttagcagagatagcatcttttggaccaaatttatt

SEQ ID NO: 33176 - DNA, 75 bp, Artificial Sequence
  Synthetic
gcctttgtgtgttgtttagcagagatagcatcttttggaccaaatttattaaatctaacatatctagagagactt

SEQ ID NO: 33177 - DNA, 75 bp, Artificial Sequence
  Synthetic
tagcatcttttggaccaaatttattaaatctaacatatctagagagacttgacgaattaaaacaatacttggatc

SEQ ID NO: 33178 - DNA, 75 bp, Artificial Sequence
  Synthetic
tgaacatcaaagaagatcctactcttaaatatgtgcaagtatcaggactgttaattaaatcattcccctcaactg

SEQ ID NO: 33179 - DNA, 75 bp, Artificial Sequence
  Synthetic
taaatatgtgcaagtatcaggactgttaattaaatcattcccctcaactgttacgtatgtgaggaaaactgcgat

SEQ ID NO: 33180 - DNA, 75 bp, Artificial Sequence
  Synthetic
taagtatctgaggattcgtggcattaatccgcctgaaacgattgaagattgggatcccatagaagatgagaatat

SEQ ID NO: 33181 - DNA, 75 bp, Artificial Sequence
  Synthetic
cttagacaatattgttaaaactgtaaatgacaattgcagtgataatcaaaagagaaataaaagtagttatttctg

SEQ ID NO: 33182 - DNA, 75 bp, Artificial Sequence
  Synthetic
gggattagctctaaagaattatcaagtcgtaaaaataagatccataacgagtgattctgaagttaatgaagcttc

SEQ ID NO: 33183 - DNA, 75 bp, Artificial Sequence
  Synthetic
gaatgttactacacatggaatgacacttcctcagggaggaagttatctatcacatcagctgaggttatttggagt

SEQ ID NO: 33184 - DNA, 75 bp, Artificial Sequence
  Synthetic
cttcctcagggaggaagttatctatcacatcagctgaggttatttggagtaaacagtacaagttgtctgaaagct

SEQ ID NO: 33185 - DNA, 75 bp, Artificial Sequence
  Synthetic
cacatcagctgaggttatttggagtaaacagtacaagttgtctgaaagctcttgaattgtcacaaattttaatga

SEQ ID NO: 33186 - DNA, 75 bp, Artificial Sequence
  Synthetic
gggaagttaaaaaagataaagatagactctttttaggagaaggagcaggagctatgttagcatgttatgatgcta

SEQ ID NO: 33187 - DNA, 75 bp, Artificial Sequence
  Synthetic
cactcggtcctgcaataaattattacaattctggtttaaatattacagatgtaattggtcaacgggaattaaaaa

SEQ ID NO: 33188 - DNA, 75 bp, Artificial Sequence
  Synthetic
caattctggtttaaatattacagatgtaattggtcaacgggaattaaaaatcttcccatcagaagtatcattagt

SEQ ID NO: 33189 - DNA, 75 bp, Artificial Sequence
  Synthetic
ataagtcaattggtttagtacattgtgacatggagggagcaataggcaaatcagaagaaactgttttacatgaac

SEQ ID NO: 33190 - DNA, 75 bp, Artificial Sequence
  Synthetic
attatagtattattaggattacatatttaattggggatgatgatgttgttctagtatcaaaaattataccaacta

SEQ ID NO: 33191 - DNA, 75 bp, Artificial Sequence
  Synthetic
ctagtatcaaaaattataccaactattactccgaattggtctaaaatactctatctatacaggttgtattggaag

SEQ ID NO: 33192 - DNA, 75 bp, Artificial Sequence
  Synthetic
catccaatcctgcctcaacagagctttatttaatttcaaaggatgcttactgtactgtaatggaacccagtaatc

SEQ ID NO: 33193 - DNA, 75 bp, Artificial Sequence
  Synthetic
tgtactgtaatggaacccagtaatcttgttttatcaaaacttaaaaggatatcatcagtagaagaaaataatcta

SEQ ID NO: 33194 - DNA, 75 bp, Artificial Sequence
  Synthetic
ttgttttatcaaaacttaaaaggatatcatcagtagaagaaaataatctattaaaatggataatcttatcaaaaa

SEQ ID NO: 33195 - DNA, 75 bp, Artificial Sequence
  Synthetic
aattaacttaaatcacttagctaaagaatttttatcaactcctgatttaaccaacattaataatataattcaaag

SEQ ID NO: 33196 - DNA, 75 bp, Artificial Sequence
  Synthetic
ttttacaagaacaattaaagatgttatgttcgaatgggtcaatatcactcatgacaataaaagacataaattagg

SEQ ID NO: 33197 - DNA, 75 bp, Artificial Sequence
  Synthetic
aggaagatataatctattcccgcttaaaaataaggggaagttaagattactatcacgaagattagtactaagctg

SEQ ID NO: 33198 - DNA, 75 bp, Artificial Sequence
  Synthetic
gatatcattatctttatcaaccagattactgacaggccgtttcccagatgaaaaatttgaaaatagggcacagac

SEQ ID NO: 33199 - DNA, 75 bp, Artificial Sequence
  Synthetic
cggatatgtatcattggctgatactgatttagaatctttaaagttattatcaagaaatattgtcaaaagttacaa

SEQ ID NO: 33200 - DNA, 75 bp, Artificial Sequence
  Synthetic
agaacacataggattaatatcatactggtttttaaccaaagaggtcaaaatactaatgaaacttatagggggagt

SEQ ID NO: 33201 - DNA, 75 bp, Artificial Sequence
  Synthetic
caaactactaggaattcctaaacagtacaaagagttagaggatcgatcatttcagggttatgaatatgataatga

SEQ ID NO: 33202 - DNA, 75 bp, Artificial Sequence
  Synthetic
atttgatattgattaatacataaaaacaaaaaataaaacacctaatcctctcccattcacttccaacaaaatgaa

SEQ ID NO: 33203 - DNA, 75 bp, Artificial Sequence
  Synthetic
tcacttccaacaaaatgaaaagtaagaaaaacatataatatacatataccaaacagagtttttctcttgtttggt

SEQ ID NO: 33204 - DNA, 75 bp, Artificial Sequence
  Synthetic
accaaacaagagaagagacttgtttgggaatataaatttaaatcaaaattaacttaggattaaagaactttaccg

SEQ ID NO: 33205 - DNA, 75 bp, Artificial Sequence
  Synthetic
aacttaggattaaagaactttaccgaaaggtaaggggaaagagatcctataattgcaacaatgctgagtctattc

SEQ ID NO: 33206 - DNA, 75 bp, Artificial Sequence
  Synthetic
gatacattcagcgcacgcaggcaggagaatataaccaaatcagctggtggagctgttattcctgggcaaaagaat

SEQ ID NO: 33207 - DNA, 75 bp, Artificial Sequence
  Synthetic
actgtgtctatttttgcccttggtccatcaataacagatgacaatgataaaatgacactagctcttcttttcttg

SEQ ID NO: 33208 - DNA, 75 bp, Artificial Sequence
  Synthetic
tctcatgccttagataatgaaaagcaacatgcacagagagctggatttttggtttccttactatccatggcgtat

SEQ ID NO: 33209 - DNA, 75 bp, Artificial Sequence
  Synthetic
gccaacccagaattatacttaacagcaaatggtagtaatgcagatgttaaatatgtgatctacatgatagagaag

SEQ ID NO: 33210 - DNA, 75 bp, Artificial Sequence
  Synthetic
gacccaggaagacaaaaatatggtggattaatcatcaaaaccagagaaatggtctatgagaagactactgattgg

SEQ ID NO: 33211 - DNA, 75 bp, Artificial Sequence
  Synthetic
atgttcgggagtgatcttgagtatgatcaagataacatgctacaaaatggtagaagcacttcaacaattgaagat

SEQ ID NO: 33212 - DNA, 75 bp, Artificial Sequence
  Synthetic
cttgttcacacttttggatatccatcatgtcttggagctcttataatccagatttggataatactagtcaaagcc

SEQ ID NO: 33213 - DNA, 75 bp, Artificial Sequence
  Synthetic
ataaccagcatatcagggttgagaaaagggttcttcactcgactagaggcattcagacaggatggaacagtcaag

SEQ ID NO: 33214 - DNA, 75 bp, Artificial Sequence
  Synthetic
tccagtttggtattaagcggtgatgcagtagagcagatcggatctattatgaggtctcaacagagcttagtaaca

SEQ ID NO: 33215 - DNA, 75 bp, Artificial Sequence
  Synthetic
ctaatggttgagacattgataaccatgaatacaggcagaaacgacctgacaacaatagagaagaacatacagatt

SEQ ID NO: 33216 - DNA, 75 bp, Artificial Sequence
  Synthetic
gttgggaactacatcagagatgcaggtctcgcttcattttttaacacaatcagatatggaattgaaactcgaatg

SEQ ID NO: 33217 - DNA, 75 bp, Artificial Sequence
  Synthetic
gcagctctgactttgtctacccttaggccggatatcaacaggctcaaagcattaatggaattatatttgtcaaaa

SEQ ID NO: 33218 - DNA, 75 bp, Artificial Sequence
  Synthetic
gggccacgcgcacccttcatatgcattttgagagatcctgtgcacggtgaattcgcaccaggaaattaccctgct

SEQ ID NO: 33219 - DNA, 75 bp, Artificial Sequence
  Synthetic
ctctggagttatgctatgggtgtagcagttgtacagaacaaggccatgcaacaatatgtaacaggacgatcttat

SEQ ID NO: 33220 - DNA, 75 bp, Artificial Sequence
  Synthetic
ctagacattgaaatgtttcagctgggccaagcagtagcacgagatgctgaatcacagatgagttcaatactagag

SEQ ID NO: 33221 - DNA, 75 bp, Artificial Sequence
  Synthetic
gatgagttagggataacacaggaagccaaacagagcttgaagaatcacatgaagaggatcagtagttcggataca

SEQ ID NO: 33222 - DNA, 75 bp, Artificial Sequence
  Synthetic
gccttccaaaaaccaacaggaggagcagccatagagatggcaatagatgaagaagcagagcagcctgattccaga

SEQ ID NO: 33223 - DNA, 75 bp, Artificial Sequence
  Synthetic
ggggaccaggaccaaagcaatggaactcagtcatccataatcccctatgcatgggcagatgataccaacaatggc

SEQ ID NO: 33224 - DNA, 75 bp, Artificial Sequence
  Synthetic
actcaaactgaatcagcaacagagatcgacagcatcacaactgagcaaagaaacatcagggacagactgaacaaa

SEQ ID NO: 33225 - DNA, 75 bp, Artificial Sequence
  Synthetic
agactcaatgagaagagaaaacagaacgaactaagatcagatgacaccacagacaatacaaatcagactgaaata

SEQ ID NO: 33226 - DNA, 75 bp, Artificial Sequence
  Synthetic
gatgatctgttcagtgcatttggaagcaactaatcacacagtgagaacaatcatcatctataacaaataagaaaa

SEQ ID NO: 33227 - DNA, 75 bp, Artificial Sequence
  Synthetic
taatccatatatcacttcatcaattggagattcatggaagacaatgctcagaacaatcaaatcatggattcttgg

SEQ ID NO: 33228 - DNA, 75 bp, Artificial Sequence
  Synthetic
gaagagggaacaggggataaatcatctaacatctcatcggccctcgacatcattgaattcatactcagcaccgat

SEQ ID NO: 33229 - DNA, 75 bp, Artificial Sequence
  Synthetic
gcccaagaaggcacggtcgatggcaatgaaatcaacacagggagcacaaagctcagcacaacaatctacagacct

SEQ ID NO: 33230 - DNA, 75 bp, Artificial Sequence
  Synthetic
atgaaatcaacacagggagcacaaagctcagcacaacaatctacagacctgagtacacggcaacagaagcaggca

SEQ ID NO: 33231 - DNA, 75 bp, Artificial Sequence
  Synthetic
aagaagatagtggatcagttaacaaaaatcgacagtcttggacaccatacgaacgtgccacagaaacaaagaata

SEQ ID NO: 33232 - DNA, 75 bp, Artificial Sequence
  Synthetic
gaaatgttaatcaggaaattgtacagggaggagataggggaagaagcagctcagatagtggagttgagactatgg

SEQ ID NO: 33233 - DNA, 75 bp, Artificial Sequence
  Synthetic
tctctggaggaatccccagaggcagctcagatcctaacgatggaacccaaatccaggaagatcctgattacaatg

SEQ ID NO: 33234 - DNA, 75 bp, Artificial Sequence
  Synthetic
atccaggaagatcctgattacaatgaagttagaaagatggataagaacacttctgagaggaaaatgcgacaacct

SEQ ID NO: 33235 - DNA, 75 bp, Artificial Sequence
  Synthetic
gaaaatgttccagtcgagataccaagaagtgatgccgttcctccaacagaatcaaatggaaacagtgatgatgga

SEQ ID NO: 33236 - DNA, 75 bp, Artificial Sequence
  Synthetic
agaagcttggaatctatcagtacatctaatccaagatacactggcatagtgactactgcgacattggatgacgag

SEQ ID NO: 33237 - DNA, 75 bp, Artificial Sequence
  Synthetic
gactactgcgacattggatgacgaggaagagctcttgataaaaaataagaagccaagaaagtaccagtcaatacc

SEQ ID NO: 33238 - DNA, 75 bp, Artificial Sequence
  Synthetic
ccagagagatgataaagaaattaaaaaagggggtggaagacaaatcgagacagctacacaaccatcaatactgga

SEQ ID NO: 33239 - DNA, 75 bp, Artificial Sequence
  Synthetic
cagctacacaaccatcaatactggatcaaggactcgccttcagagaatcgaagaagaaccagacaattatcaaac

SEQ ID NO: 33240 - DNA, 75 bp, Artificial Sequence
  Synthetic
ccaacacgaatacaaaagaatcagcagggccacagggtggacatcgggggaggaggatcacatcttgggacatcc

SEQ ID NO: 33241 - DNA, 75 bp, Artificial Sequence
  Synthetic
gcaacaacgagggcaacagtcgagccgaacagacaaccaagagccccaacaagtcaacacaaggaccgaacaaca

SEQ ID NO: 33242 - DNA, 75 bp, Artificial Sequence
  Synthetic
cagcgggaccaagcagaccagctccagagccacggatcaaagcacagaagacaaatggagaggaaaaagaggaca

SEQ ID NO: 33243 - DNA, 75 bp, Artificial Sequence
  Synthetic
agagccacggatcaaagcacagaagacaaatggagaggaaaaagaggacacagaagagagcactcgatttacaga

SEQ ID NO: 33244 - DNA, 75 bp, Artificial Sequence
  Synthetic
aattagacctataccaagacaagagagttgtgtgtgtggcaaatgtcctgaacaatgcggatactgcatcgaaga

SEQ ID NO: 33245 - DNA, 75 bp, Artificial Sequence
  Synthetic
aacaatgcggatactgcatcgaagatagatttcttggcgggcctgatgatcggagtgtcaatggaccacgataat

SEQ ID NO: 33246 - DNA, 75 bp, Artificial Sequence
  Synthetic
aagttaaaccagattcagagtgaaatattaagtttaaagaatgatcttaagaaaatggacgaatcacacagaaga

SEQ ID NO: 33247 - DNA, 75 bp, Artificial Sequence
  Synthetic
ttaattgaaaatcaaaaagagcaattatcactgatcacatcattaatctcgaatcttaaaattatgacagaaaga

SEQ ID NO: 33248 - DNA, 75 bp, Artificial Sequence
  Synthetic
gaatcttaaaattatgacagaaagaggaggaaagaaggatcaaacggaatctagtggtagaacatccatgataac

SEQ ID NO: 33249 - DNA, 75 bp, Artificial Sequence
  Synthetic
tacaaaggccaaagaagagaaagttaagaaggtcagatttgatcctctcatggaaacacaaggcatcgggaaaaa

SEQ ID NO: 33250 - DNA, 75 bp, Artificial Sequence
  Synthetic
aagaaggtcagatttgatcctctcatggaaacacaaggcatcgggaaaaacattcctgacctttatagacaaatg

SEQ ID NO: 33251 - DNA, 75 bp, Artificial Sequence
  Synthetic
gagaaaacaccagaaaatgatgcacaaatcagatcagaaatgagtagactagatgatgaatccaacgcaactaga

SEQ ID NO: 33252 - DNA, 75 bp, Artificial Sequence
  Synthetic
ctagtacctagaagaatcagcagcacgatgagatcactaatcataatcatcaacaacagtaatctttcatcaaaa

SEQ ID NO: 33253 - DNA, 75 bp, Artificial Sequence
  Synthetic
gccaaacaatcatacataaatgagctcaagctctgcaaaaatgacgaagaggtctctgaactaatggacatgttc

SEQ ID NO: 33254 - DNA, 75 bp, Artificial Sequence
  Synthetic
aatgaagacatcagttccacataaacagcccacagaacaccatcaccaagaaaacaaacaacatcaaacaaaaaa

SEQ ID NO: 33255 - DNA, 75 bp, Artificial Sequence
  Synthetic
acagaatcaattcgaagacaccagatcaaccatgacacaacaagaacttccaaatctcagccgattaagaaaaac

SEQ ID NO: 33256 - DNA, 75 bp, Artificial Sequence
  Synthetic
ttaggggaaaagggctaacaaatcctccaacacaatgagcatcaagaactccgcaatatacacattccctgactc

SEQ ID NO: 33257 - DNA, 75 bp, Artificial Sequence
  Synthetic
tccaacacaatgagcatcaagaactccgcaatatacacattccctgactcatccttcctcgataatgggaacata

SEQ ID NO: 33258 - DNA, 75 bp, Artificial Sequence
  Synthetic
gagccattaccactcaaggtcaatgagcaaaggaaggctgtaccgcacatcagagttgtcaaaataggagatcca

SEQ ID NO: 33259 - DNA, 75 bp, Artificial Sequence
  Synthetic
cccaaacatggatctaggtatctggatgttttcctattaggtttttttgagatggaaagatcaaaggatagatat

SEQ ID NO: 33260 - DNA, 75 bp, Artificial Sequence
  Synthetic
gggagcattagtgatcttgatgatgatccaagttataaggtctgtggttctggatccttaccactcggactggcg

SEQ ID NO: 33261 - DNA, 75 bp, Artificial Sequence
  Synthetic
aaatacaccggaggtgatcaggaacttctacaagctgcaatcaaattagacatagaagtaagaagaacagtcaag

SEQ ID NO: 33262 - DNA, 75 bp, Artificial Sequence
  Synthetic
catagaagtaagaagaacagtcaaggctacagaaatgatagtctacacagtccagaacatcaaacccgaactata

SEQ ID NO: 33263 - DNA, 75 bp, Artificial Sequence
  Synthetic
cccatggtctggaaggctaagaaaagggatgttatttgatgcaaataaagttgcacttgctccccagtgtcttcc

SEQ ID NO: 33264 - DNA, 75 bp, Artificial Sequence
  Synthetic
acttgatagagggataaaatttagagtgatatttgtgaactgcacagcaattggatcaatcacactattcaaaat

SEQ ID NO: 33265 - DNA, 75 bp, Artificial Sequence
  Synthetic
acccaaatctatggcattattatcattgccaaatacgatttcaataaatttgcaagtacacataaagacagggat

SEQ ID NO: 33266 - DNA, 75 bp, Artificial Sequence
  Synthetic
ccaaaccgattccaaaggagtggttcagatcttagatgaaaaaggtgagaaatcactaaactttatggttcatct

SEQ ID NO: 33267 - DNA, 75 bp, Artificial Sequence
  Synthetic
tggactgatcaaacggaaaataggtcggatgtattcagttgagtactgtaaacaaaagattgagaaaatgagatt

SEQ ID NO: 33268 - DNA, 75 bp, Artificial Sequence
  Synthetic
actattctcactaggattggttgggggtattagctttcatgtcaatgcaactggatccatatcaaaaacattggc

SEQ ID NO: 33269 - DNA, 75 bp, Artificial Sequence
  Synthetic
aagccaattggcatttaagagggagatctgttatcctctcatggatttaaacccacatctcaattcagtaatttg

SEQ ID NO: 33270 - DNA, 75 bp, Artificial Sequence
  Synthetic
ggcatcttcaattgaaattacgagggtggacgcaattctccaaccttcactacctggtgaatttagatactaccc

SEQ ID NO: 33271 - DNA, 75 bp, Artificial Sequence
  Synthetic
tacctggtgaatttagatactacccaaatatcatagcaaagggagtcgggaagatcaaacaataggaccaacaat

SEQ ID NO: 33272 - DNA, 75 bp, Artificial Sequence
  Synthetic
gctatccacaagacaagaatcaaaaacttaggatcaaagggatcaatccgaccccagatccgaacccagaacgac

SEQ ID NO: 33273 - DNA, 75 bp, Artificial Sequence
  Synthetic
tcatctatagagcaaaagaaggacaagagaaacacaacaagaaaacacacacacaaggagcaagacaagagaaca

SEQ ID NO: 33274 - DNA, 75 bp, Artificial Sequence
  Synthetic
cacagacaaacagcaaggcgccacaacacatcccacacggacacaacaacaaccccacaaagaaacaccacaaca

SEQ ID NO: 33275 - DNA, 75 bp, Artificial Sequence
  Synthetic
aaggttagagaacaaggaacctctaaaatgatcatcacagtcataacggtgatactattattaacaccttcatca

SEQ ID NO: 33276 - DNA, 75 bp, Artificial Sequence
  Synthetic
aaatgatcatcacagtcataacggtgatactattattaacaccttcatcattgtgtcaaatagatataacaaaat

SEQ ID NO: 33277 - DNA, 75 bp, Artificial Sequence
  Synthetic
tacagaatgtaggagtgttagttaacagtccaaaaggtataaagatttcacaaaactttgaaacaagatacttaa

SEQ ID NO: 33278 - DNA, 75 bp, Artificial Sequence
  Synthetic
tattaagcctaataccaaaaatagatgactcacactcatgtggtaaccaacaaatcgatcaatataagaaattac

SEQ ID NO: 33279 - DNA, 75 bp, Artificial Sequence
  Synthetic
aaaataatactaatctcagaacaaagcgattctttggagagataattggaacaattgcaataggaatagctactt

SEQ ID NO: 33280 - DNA, 75 bp, Artificial Sequence
  Synthetic
cagcccaaataactgcagcagtagctcttgtagaagctaaacaagcaagatcagacatagacaaactcaaagaag

SEQ ID NO: 33281 - DNA, 75 bp, Artificial Sequence
  Synthetic
ccataaaggatacaaataaagcagtacaatcaattcaaagctctgtagggaatctaattgttgcagttaagtcag

SEQ ID NO: 33282 - DNA, 75 bp, Artificial Sequence
  Synthetic
ttcaagattatgttaacaatgaaattgtcccatcaatcacaagattgggttgtgaggcagcgggactacaattgg

SEQ ID NO: 33283 - DNA, 75 bp, Artificial Sequence
  Synthetic
gaattgcattaacacaacattattcagaattgactaatatatttggtgataacataggaacattgagagaaaaag

SEQ ID NO: 33284 - DNA, 75 bp, Artificial Sequence
  Synthetic
gggtcaagctacaaggaattgcatcattataccgtacaaacataactgaagtattcactacttcaacagttgacc

SEQ ID NO: 33285 - DNA, 75 bp, Artificial Sequence
  Synthetic
agtatgacatttatgatttattattcactgaatcaattaagatgagagtcatagatgtagatctaagtgattatt

SEQ ID NO: 33286 - DNA, 75 bp, Artificial Sequence
  Synthetic
caattacgctccaggttagactgcctttattaaccaaagtatcaaacactcaaatatataaagtcgattctatat

SEQ ID NO: 33287 - DNA, 75 bp, Artificial Sequence
  Synthetic
tttattaaccaaagtatcaaacactcaaatatataaagtcgattctatatcatataatatacaaggtaaagaatg

SEQ ID NO: 33288 - DNA, 75 bp, Artificial Sequence
  Synthetic
gtatattccccttccacatcatatcatgacaaagggagcttttttaggtggtgctgatgttaaagaatgtataga

SEQ ID NO: 33289 - DNA, 75 bp, Artificial Sequence
  Synthetic
atcattcagtaactatatatgtccctctgatcctggttttatattaaaccatgaactagaaaattgtttatcagg

SEQ ID NO: 33290 - DNA, 75 bp, Artificial Sequence
  Synthetic
aaacataacacaatgccctaagactattgttacatcagatatagtgccaagatatgcatttgtagatggtggagt

SEQ ID NO: 33291 - DNA, 75 bp, Artificial Sequence
  Synthetic
aatcgctaattgtataccaactacttgtacatgcaatggaattgataatagaatcaatcaatcacctgatcaagg

SEQ ID NO: 33292 - DNA, 75 bp, Artificial Sequence
  Synthetic
gattaagataataacatacaaggagtgtcaaatagtaggtataaatggaatgttattcaaaactaatcaagaagg

SEQ ID NO: 33293 - DNA, 75 bp, Artificial Sequence
  Synthetic
gacattggcaaaatatacatttgatgacattaagttaaacaattctgttgcacttaatccaattgatatatcttt

SEQ ID NO: 33294 - DNA, 75 bp, Artificial Sequence
  Synthetic
agaactcaacaaagccaaatcagagttagaagaatcaaagagatggatagagaaatctaatcacaaattagattc

SEQ ID NO: 33295 - DNA, 75 bp, Artificial Sequence
  Synthetic
tattgggagctggtaccagtcaagtgcaacaatcattataataatagtaatgatagtagttttactcataatcaa

SEQ ID NO: 33296 - DNA, 75 bp, Artificial Sequence
  Synthetic
tgcaataattatcatgatcacgatcaaacaccttagagctcgaaacagacatccaaacaataaagatagtgaacc

SEQ ID NO: 33297 - DNA, 75 bp, Artificial Sequence
  Synthetic
gtatgtattaaccaacagacaataaaagaattcaaaattatgcgttctaaataaaaatagaaaaaacttaggaac

SEQ ID NO: 33298 - DNA, 75 bp, Artificial Sequence
  Synthetic
ataaaaatagaaaaaacttaggaacaaagctgttcaacacggcaacaccagacaagggggaagacggaacaaaga

SEQ ID NO: 33299 - DNA, 75 bp, Artificial Sequence
  Synthetic
cagtcccaaatccaacgatggagtactggaagcacacaaatagtgcaaaagacacaaatgatgggcctgagtcaa

SEQ ID NO: 33300 - DNA, 75 bp, Artificial Sequence
  Synthetic
gcagaggaaaatacaaaaacggagctacaaatatcataatgcatgtattctggacaacaacatcgatcatgctgt

SEQ ID NO: 33301 - DNA, 75 bp, Artificial Sequence
  Synthetic
tggacaacaacatcgatcatgctgttaataatcttcataatgatattagtggacttgattcaggaaaccaatcaa

SEQ ID NO: 33302 - DNA, 75 bp, Artificial Sequence
  Synthetic
aacaagacaacattacaagaaatgaagaaaaaattcgcagctatagaagctaagatacaagagacctctgaagga

SEQ ID NO: 33303 - DNA, 75 bp, Artificial Sequence
  Synthetic
attggtgtctctatacagtcaggaataaacacaagacttctcacaattcaaagtcatgttcaaaattatatccca

SEQ ID NO: 33304 - DNA, 75 bp, Artificial Sequence
  Synthetic
ttatccttgacacagcagatgtcggatctcagaaaattcatcagtgaactaacaaataagagagaacaacaaaac

SEQ ID NO: 33305 - DNA, 75 bp, Artificial Sequence
  Synthetic
ataccaatacagaggatgactcatgatagtggcatagaacctctagatccagataaattctggagatgtacttct

SEQ ID NO: 33306 - DNA, 75 bp, Artificial Sequence
  Synthetic
ggcaatccgtctcttacaagcagtccgaaaataagacttataccaggaccgggcctactagcaacgtctaccact

SEQ ID NO: 33307 - DNA, 75 bp, Artificial Sequence
  Synthetic
gtgaatggctgtattagacttccatctttggtaattaacaatctaatatatgcttacacttccaatcttattact

SEQ ID NO: 33308 - DNA, 75 bp, Artificial Sequence
  Synthetic
cagggttgtcaagatatcgggaaatcttatcaagtattacagatagggatcattactataaatacagatctggta

SEQ ID NO: 33309 - DNA, 75 bp, Artificial Sequence
  Synthetic
cttatcaagtattacagatagggatcattactataaatacagatctggtacctgatttaaatcctagagttacac

SEQ ID NO: 33310 - DNA, 75 bp, Artificial Sequence
  Synthetic
acacattcaatattgatgacaataggaaatcttgttcgttagcactattgaatacagatgtataccaactatgct

SEQ ID NO: 33311 - DNA, 75 bp, Artificial Sequence
  Synthetic
ccactcctaaggtcgatgaaaaatcagactatgcatcaacaggaattgaggatattgtacttgacgttgtcacta

SEQ ID NO: 33312 - DNA, 75 bp, Artificial Sequence
  Synthetic
gcaacgggatgattataacaacaaggtttacgaacaataacataacatttgataaaccatatgcagcactatatc

SEQ ID NO: 33313 - DNA, 75 bp, Artificial Sequence
  Synthetic
catcagtaggaccaggaatatattacaaagacaaaatcatatttcttggctatgggggattagagcacgaagaga

SEQ ID NO: 33314 - DNA, 75 bp, Artificial Sequence
  Synthetic
atggagacgtaatatgtaatttaactggctgccctggcaagacacagagagattgcaatcaagcttcttatagcc

SEQ ID NO: 33315 - DNA, 75 bp, Artificial Sequence
  Synthetic
catggttttcaaataggagaatggtaaattccattattgtggttagtaggggcatagacacaaccttcggtttaa

SEQ ID NO: 33316 - DNA, 75 bp, Artificial Sequence
  Synthetic
gagtgtggactattccgatgagacaaaactattggggatcggaaggaaggttgcttttattaggtaataagatat

SEQ ID NO: 33317 - DNA, 75 bp, Artificial Sequence
  Synthetic
acatatataccagatctacaagttggcatagtaaattacaattgggactaattgatatttctaactacaatgaca

SEQ ID NO: 33318 - DNA, 75 bp, Artificial Sequence
  Synthetic
tcagaatcaactggacctggcataatgtgctatcaagaccaggaaatgatgactgtccatggggtcactcatgcc

SEQ ID NO: 33319 - DNA, 75 bp, Artificial Sequence
  Synthetic
cagccggatgcataacaggagtttacactgatgcatacccattaaatccatcagggagtgttgtatcatctgtca

SEQ ID NO: 33320 - DNA, 75 bp, Artificial Sequence
  Synthetic
tcctcgattcacagaaatccagagaaaatcccataatcacctactcaacagacacgagtagagtgaatgagttag

SEQ ID NO: 33321 - DNA, 75 bp, Artificial Sequence
  Synthetic
cgcatacacaacaacaaactgtatcacgcattatgataaaggatattgctttcacattgttgagataaaccatag

SEQ ID NO: 33322 - DNA, 75 bp, Artificial Sequence
  Synthetic
ttcacattgttgagataaaccatagaagcctaaacacatttcaacctatgctattcaaaacagaagttccaaaga

SEQ ID NO: 33323 - DNA, 75 bp, Artificial Sequence
  Synthetic
attgcaactagaccgaccccaatctaccgagcgctgaacaaaccacaaaaaaatcaccaggcgggctatccagaa

SEQ ID NO: 33324 - DNA, 75 bp, Artificial Sequence
  Synthetic
gatgagacaagaataaaagaaataataaaaaacttaggagaaaagtgtatagagaagatggaaactgagtttcac

SEQ ID NO: 33325 - DNA, 75 bp, Artificial Sequence
  Synthetic
agcggtacaacatctgacattctgtacccagaatgtcatctcaattctcctatagttaaagggaaaatagcacaa

SEQ ID NO: 33326 - DNA, 75 bp, Artificial Sequence
  Synthetic
ttacataccctaatgagtttaccacagccttatgacatggatgatgactcaatattagttataactaggcacaag

SEQ ID NO: 33327 - DNA, 75 bp, Artificial Sequence
  Synthetic
attaggcttaataaattagataaaagacaacgatcaattagaaaattaaagtctgtcctgatggaaaaggtaaat

SEQ ID NO: 33328 - DNA, 75 bp, Artificial Sequence
  Synthetic
gatttaggcaagtatgtttttattaaatatccagagatgtccaatgaaatgttccaattaaatatacctgggatc

SEQ ID NO: 33329 - DNA, 75 bp, Artificial Sequence
  Synthetic
gttccaattaaatatacctgggatcaataacagaataaatgaattgctgaataaagcaagtagaacctacaatca

SEQ ID NO: 33330 - DNA, 75 bp, Artificial Sequence
  Synthetic
aatgactgacggattaagggatctatggatcaatatattttcaaaactagcatcaaaaaatgatggaagtaacta

SEQ ID NO: 33331 - DNA, 75 bp, Artificial Sequence
  Synthetic
tgatgttaatgaggatattagtaacatatcaagtgttcatacagcttatcaatcagacaaatggtataacccatt

SEQ ID NO: 33332 - DNA, 75 bp, Artificial Sequence
  Synthetic
aatcagacaaatggtataacccatttaaaacatggtttacaatcaagtatgacatgaggagattgcaaaaagcca

SEQ ID NO: 33333 - DNA, 75 bp, Artificial Sequence
  Synthetic
taaaacatggtttacaatcaagtatgacatgaggagattgcaaaaagccaaaaacgagataacatgcagtaggac

SEQ ID NO: 33334 - DNA, 75 bp, Artificial Sequence
  Synthetic
caaagattataacctgctagaagatcagaaaaatgtattaataatacattcagaactcatcataattttagataa

SEQ ID NO: 33335 - DNA, 75 bp, Artificial Sequence
  Synthetic
gcagaattataaagggtatttaatgactcctgagctagtactaatgtactgtgatgtagttgaaggaagatggaa

SEQ ID NO: 33336 - DNA, 75 bp, Artificial Sequence
  Synthetic
catcagttcttgtgcaaaattagatcccaaattacactcaatgtattataaaggtaacagtttatgggaaacaat

SEQ ID NO: 33337 - DNA, 75 bp, Artificial Sequence
  Synthetic
agatgaattattcccaattttaggggagaagacttttgatataatatctttattagaaccacttgctttatcact

SEQ ID NO: 33338 - DNA, 75 bp, Artificial Sequence
  Synthetic
tattcagactcatgacccagttaaacaactacgtggggcttttctaaatcatgtgttatcagaaatggaactgat

SEQ ID NO: 33339 - DNA, 75 bp, Artificial Sequence
  Synthetic
actggaaaccgagtttaaaattccagaaatgcctgatatagattatatagataaaatcctagaggtatttaagga

SEQ ID NO: 33340 - DNA, 75 bp, Artificial Sequence
  Synthetic
ttcaacaatagatgagatagcagagattttctcctttttccgaacttttggacaccctccattagaagctagtat

SEQ ID NO: 33341 - DNA, 75 bp, Artificial Sequence
  Synthetic
gacaccctccattagaagctagtatagcggcagaaaaagttagaaaatatatgtacgctgagaagtgcttaaaat

SEQ ID NO: 33342 - DNA, 75 bp, Artificial Sequence
  Synthetic
tcgatactattaataaatgtcatgctatcttttgtacaataattataaatgggtatagagaaagacacggtggac

SEQ ID NO: 33343 - DNA, 75 bp, Artificial Sequence
  Synthetic
agtggccgcccgttacattgcctgctcatgcgcatgaatttatcataaatgcatatgggtcaaactctgctatat

SEQ ID NO: 33344 - DNA, 75 bp, Artificial Sequence
  Synthetic
catatgaaaatgcggtagattattacaagagctttatagggataaagtttaacaaatttatagaaccccaattag

SEQ ID NO: 33345 - DNA, 75 bp, Artificial Sequence
  Synthetic
atgaagatttgactatttatatgaaagataaagcattatctccaaaaaagtcgaactgggacactgtctacccag

SEQ ID NO: 33346 - DNA, 75 bp, Artificial Sequence
  Synthetic
cttcgaacctgctataccgtgccaatgcatctcatgactcaaggagattagtagaggtgtttatagcggatagca

SEQ ID NO: 33347 - DNA, 75 bp, Artificial Sequence
  Synthetic
aatttgatccacaccaagtcttagattatgtagaatcagggtactggttaaatgatcctgaatttaatatatcat

SEQ ID NO: 33348 - DNA, 75 bp, Artificial Sequence
  Synthetic
atagtttaaaggaaaaggaaataaaacaagaaggtagactttttgcaaagatgacatataaaatgagggcaaccc

SEQ ID NO: 33349 - DNA, 75 bp, Artificial Sequence
  Synthetic
atgacatataaaatgagggcaacccaagtattagcagaaacactactagcaaacaacatagggaaatttttccaa

SEQ ID NO: 33350 - DNA, 75 bp, Artificial Sequence
  Synthetic
gagaatgggatggtcaaaggagagattgaattacttaagagactgacaacaatatctatgtctggggtcccacgg

SEQ ID NO: 33351 - DNA, 75 bp, Artificial Sequence
  Synthetic
tataatgaagtatataataatcccaaaagtcacacagaagagcttcggacttataacgcaatcagtaatgctact

SEQ ID NO: 33352 - DNA, 75 bp, Artificial Sequence
  Synthetic
ttatcttccaatcaaaaagcaaaaaagtttgaattcaaatcaacagatatatataatgatggatatgaaactgtg

SEQ ID NO: 33353 - DNA, 75 bp, Artificial Sequence
  Synthetic
agttgttttttaacaacagatcttaaaaaatattgtttaaattggagatatgagtcaaccgccttatttggtgat

SEQ ID NO: 33354 - DNA, 75 bp, Artificial Sequence
  Synthetic
aaaaatattgtttaaattggagatatgagtcaaccgccttatttggtgatacctgcaatcagatctttggattaa

SEQ ID NO: 33355 - DNA, 75 bp, Artificial Sequence
  Synthetic
aggaactatttaactggttacatcctcgtcttgaaaaaagtacaatatatgtcggagatccttattgtccacctt

SEQ ID NO: 33356 - DNA, 75 bp, Artificial Sequence
  Synthetic
cagacactgaacatttaccactcgatgaccaccctgattcaggattttatgttcataaccctcaaggaggcatag

SEQ ID NO: 33357 - DNA, 75 bp, Artificial Sequence
  Synthetic
aagggttttgtcaaaagttatggacacttatatctattagtgcaatacatttagcagctgtcaaaataggtgtca

SEQ ID NO: 33358 - DNA, 75 bp, Artificial Sequence
  Synthetic
gagtcactgcgatggttcaaggagataatcaggctatagctgtcacaacaagagtgccgaataattatgattata

SEQ ID NO: 33359 - DNA, 75 bp, Artificial Sequence
  Synthetic
aggttaagaaagaaattgtttataaagatgtggtgagatttttcgactcattgagagaagtcatggatgatctgg

SEQ ID NO: 33360 - DNA, 75 bp, Artificial Sequence
  Synthetic
gtcatgagctcaaattaaatgagactataataagtagcaaaatgttcatatacagcaaaagaatatactatgatg

SEQ ID NO: 33361 - DNA, 75 bp, Artificial Sequence
  Synthetic
gaagaatccttccccaagctttgaaagcgttgtcaagatgtgttttttggtctgaaacaataatagatgaaacaa

SEQ ID NO: 33362 - DNA, 75 bp, Artificial Sequence
  Synthetic
gatcagcatcttcgaatctggcaacatcatttgcaaaagctattgaaaacggctattcacctgtgttagggtatg

SEQ ID NO: 33363 - DNA, 75 bp, Artificial Sequence
  Synthetic
tgtgttcagtcttcaaaaatatccaacaattatatatagcacttgggatgaatataaacccaactataacccaga

SEQ ID NO: 33364 - DNA, 75 bp, Artificial Sequence
  Synthetic
atatcagagatcaatatttcaggaatactcactggatgcagtatgcttctctaatacctgctagcgttggaggat

SEQ ID NO: 33365 - DNA, 75 bp, Artificial Sequence
  Synthetic
ttaattatatggctatgtcaagatgttttgtaagaaatattggagaccctacagttgctgcattggccgatatca

SEQ ID NO: 33366 - DNA, 75 bp, Artificial Sequence
  Synthetic
ttttgtaagaaatattggagaccctacagttgctgcattggccgatatcaagagatttataaaagtaaatctgtt

SEQ ID NO: 33367 - DNA, 75 bp, Artificial Sequence
  Synthetic
agatcgaggtgttctctacagaattatgaatcaagaaccaggtgaatcttctttcttagactgggcttcagaccc

SEQ ID NO: 33368 - DNA, 75 bp, Artificial Sequence
  Synthetic
atattcatgcaacttaccacaatctcaaaatataactaccatgattaaaaatatcacagcaagaaatgttttgca

SEQ ID NO: 33369 - DNA, 75 bp, Artificial Sequence
  Synthetic
ggatgcaccaaatccattattatctggattattcacaaccacaatgatagaggaggatgaagaattagctgaatt

SEQ ID NO: 33370 - DNA, 75 bp, Artificial Sequence
  Synthetic
cttaatggatcgtagaataatcctcccgagagttgcacatgacattctggataattcccttaccggaatcagaaa

SEQ ID NO: 33371 - DNA, 75 bp, Artificial Sequence
  Synthetic
tgctatagctgggatgttggatacaacaaaatcactaattagagtagggatagacagaggaggattaacctacaa

SEQ ID NO: 33372 - DNA, 75 bp, Artificial Sequence
  Synthetic
tctattgagaaaaatcagcaactatgatcttgtacaatacgagacccttagtaaaactttaagactaatagttag

SEQ ID NO: 33373 - DNA, 75 bp, Artificial Sequence
  Synthetic
tgataagattaaatatgaggatatgtgttcagttgatctagctatatcattgagacaaaaaatgtggatgcatct

SEQ ID NO: 33374 - DNA, 75 bp, Artificial Sequence
  Synthetic
atcaggagggagaatgataaatggacttgaaactccagatcctttggagttattgtcagggataataataacagg

SEQ ID NO: 33375 - DNA, 75 bp, Artificial Sequence
  Synthetic
cttggatgtatttaccaggcaatctaagtataggatcagctgaaacaggaattgcatcattaagagtcccctatt

SEQ ID NO: 33376 - DNA, 75 bp, Artificial Sequence
  Synthetic
aagtataggatcagctgaaacaggaattgcatcattaagagtcccctattttggctcaattacagatgaaaggtc

SEQ ID NO: 33377 - DNA, 75 bp, Artificial Sequence
  Synthetic
ttggctcaattacagatgaaaggtctgaagctcaactaggatatataaagaatttgagcaaaccagccaaagctg

SEQ ID NO: 33378 - DNA, 75 bp, Artificial Sequence
  Synthetic
aatttgagcaaaccagccaaagctgcaataagaatagcaatgatatatacctgggcatttggaaatgacgagata

SEQ ID NO: 33379 - DNA, 75 bp, Artificial Sequence
  Synthetic
gtaacaacatcaacgaatctatcacacagattaaaagatactgctactcagatgaagttttctagtacatcactt

SEQ ID NO: 33380 - DNA, 75 bp, Artificial Sequence
  Synthetic
atcagagtaagtagattcatcacaatatctaatgataatatgtcgattaaagaagcaaacgagaccaaagataca

SEQ ID NO: 33381 - DNA, 75 bp, Artificial Sequence
  Synthetic
aatctcatttatcaacaagtaatgttaacagggttgagcgtgtttgaatatttgttcagattagaggaatgtaca

SEQ ID NO: 33382 - DNA, 75 bp, Artificial Sequence
  Synthetic
ggacacaatcctatggtaatgcatttgcatatagaggacagatgttgtgtcaaagagagttacaatgatgagcat

SEQ ID NO: 33383 - DNA, 75 bp, Artificial Sequence
  Synthetic
ataaatccagaatccacattagagttgattaaataccctgaaagtaatgagtttatatatgataaagaccctcta

SEQ ID NO: 33384 - DNA, 75 bp, Artificial Sequence
  Synthetic
aaagatgtagatttgtcaaagttaatgactataagagatcattcttatactattgatatgaattactgggatgat

SEQ ID NO: 33385 - DNA, 75 bp, Artificial Sequence
  Synthetic
acagatattgtgcatgcaatatcaatatgcactgcggtcacaatagcagatactatgtcacagcttgaccgagat

SEQ ID NO: 33386 - DNA, 75 bp, Artificial Sequence
  Synthetic
aaccttaaagaactagtggtcattgcaaatgatgatgatattaacagcctgataactgaatttctaacccttgac

SEQ ID NO: 33387 - DNA, 75 bp, Artificial Sequence
  Synthetic
atattggtatttcttaagacatttggaggattgctagtaaaccaatttgcttatactctctatggtctaaaagtg

SEQ ID NO: 33388 - DNA, 75 bp, Artificial Sequence
  Synthetic
gaagggagagatcctatatgggattatataatgagaacattaaaggatacttcacattctgtacttaaagtatta

SEQ ID NO: 33389 - DNA, 75 bp, Artificial Sequence
  Synthetic
tctaatgcattatctcatcctaaagtttttaagagattctgggattgtggagttttgaatcccatttatggtcct

SEQ ID NO: 33390 - DNA, 75 bp, Artificial Sequence
  Synthetic
aatactgctagtcaagaccaaattaagcttgctctctccatctgcgaatattccctggatttatttatgagagaa

SEQ ID NO: 33391 - DNA, 75 bp, Artificial Sequence
  Synthetic
aatagctaatgatagaagacaagcatttatctcaagacatctcgcttttgtgtgctgtttagcagaaatagcatc

SEQ ID NO: 33392 - DNA, 75 bp, Artificial Sequence
  Synthetic
ttttgggccaaacttactgaatctgacatatttagaaaggctggatgaattaaaacgctacttagatctaaacat

SEQ ID NO: 33393 - DNA, 75 bp, Artificial Sequence
  Synthetic
tagggaagatccgactcttaaatatgtacaaatatcaggattactgattaaatcattcccctcaaccgttacata

SEQ ID NO: 33394 - DNA, 75 bp, Artificial Sequence
  Synthetic
tgtaaggaaaactgcaatcaagtatctcagaatccgaggaattgatccgcctgaaacaattgaagactgggatcc

SEQ ID NO: 33395 - DNA, 75 bp, Artificial Sequence
  Synthetic
catagaagatgagaacaccttagacaatattgttaaaaccgtaaatgataattgcaataacaatcagaaaaagaa

SEQ ID NO: 33396 - DNA, 75 bp, Artificial Sequence
  Synthetic
aatattgttaaaaccgtaaatgataattgcaataacaatcagaaaaagaacaaacccaattatttctggggattg

SEQ ID NO: 33397 - DNA, 75 bp, Artificial Sequence
  Synthetic
gctttaaagaattatcaagtcataagaataagatctataacatgtgactctaatgttgatgaaacatcaaatgat

SEQ ID NO: 33398 - DNA, 75 bp, Artificial Sequence
  Synthetic
agtgttcatggattaacactccctgaaggaggaagttatctatcacatcagctgaggttatttggggtaaatagt

SEQ ID NO: 33399 - DNA, 75 bp, Artificial Sequence
  Synthetic
acaagttgtttaaaagctcttgagttatcacaaatcttgatgaaagaggttaaaaaggataaggacagactgttt

SEQ ID NO: 33400 - DNA, 75 bp, Artificial Sequence
  Synthetic
ttgggggaaggagcaggagccatgttggcatgttatgacgctacacttggtcccgcaataaattattataattct

SEQ ID NO: 33401 - DNA, 75 bp, Artificial Sequence
  Synthetic
ggcttaaacattacagatgtcgttggacaacgagaattaaaaatattcccatcagaagtatcgttagtaggtaaa

SEQ ID NO: 33402 - DNA, 75 bp, Artificial Sequence
  Synthetic
aagttaggaaatgtaacacagattctcaatcgagtgaaagtattatttaatgggaatccaaattcaacatggata

SEQ ID NO: 33403 - DNA, 75 bp, Artificial Sequence
  Synthetic
ggaaatatggaatgcgagagtttaatatggagtgaattaaatgataaatcaattggtttagtacactgtgacatg

SEQ ID NO: 33404 - DNA, 75 bp, Artificial Sequence
  Synthetic
agactgtattacatgaacattatagcattattaggattacatatttgatcggagacgatgacgtcgttctggtat

SEQ ID NO: 33405 - DNA, 75 bp, Artificial Sequence
  Synthetic
ggagacgatgacgtcgttctggtatcaaaaatcatacctactataactcccaattggtccaagatactttatctg

SEQ ID NO: 33406 - DNA, 75 bp, Artificial Sequence
  Synthetic
tataaattgtattggagagatgtaagtgtagtatcccttaaaacatctaatcctgcttcaacagaattatattta

SEQ ID NO: 33407 - DNA, 75 bp, Artificial Sequence
  Synthetic
atttcaaaagatgcatattgtactgtaatggaacctagcaaccttgttttgtctaaactcaagagaatatcatca

SEQ ID NO: 33408 - DNA, 75 bp, Artificial Sequence
  Synthetic
acagaagaaaacaatttattaaaatggataatcatatccaaaagaaagaataatgaatggttacaacatgaaatc

SEQ ID NO: 33409 - DNA, 75 bp, Artificial Sequence
  Synthetic
aacgaaggagaaagagattacggaataatgagaccatatcatacggcattacaaatattcggattccaaatcaac

SEQ ID NO: 33410 - DNA, 75 bp, Artificial Sequence
  Synthetic
ttaaatcatttggcaaaggagttcttatcaactcctgatttaaccaatattaatattgttatacaaagctttata

SEQ ID NO: 33411 - DNA, 75 bp, Artificial Sequence
  Synthetic
agaacaattaaagatgttatatttgaatgggtcaatataacatctgacagtaaaagacacaaattaggagggaaa

SEQ ID NO: 33412 - DNA, 75 bp, Artificial Sequence
  Synthetic
taaaagacacaaattaggagggaaatataatctatatccactcaaaaataagggtaaattaaaactaatatcgcg

SEQ ID NO: 33413 - DNA, 75 bp, Artificial Sequence
  Synthetic
aagactaatcttaagttggatatcattatctttatcaactaggttattgacaggtcgttttccggatgaaaagtt

SEQ ID NO: 33414 - DNA, 75 bp, Artificial Sequence
  Synthetic
caggtcgttttccggatgaaaagtttgaaagcagagcacagactggatatgtttcattagctgatactgatctgg

SEQ ID NO: 33415 - DNA, 75 bp, Artificial Sequence
  Synthetic
attccttaaagttactatcaagaaatattataaaagattacaaagataatataggattaatatcatactggttct

SEQ ID NO: 33416 - DNA, 75 bp, Artificial Sequence
  Synthetic
tgactaaagagattaaaatattgatgaaacttataggaggagttaagttattaggaattcctaagcaatataaag

SEQ ID NO: 33417 - DNA, 75 bp, Artificial Sequence
  Synthetic
aattagagaatcaatcatctcaaaggaatgaatactatgatgaattcgatattgattagtgtataaaaatacaaa

SEQ ID NO: 33418 - DNA, 75 bp, Artificial Sequence
  Synthetic
tcaatacacttaatccttgtctgtctgtactcaacaaagaaagaaataagaaaaacataaaatatatatatacca

SEQ ID NO: 33419 - DNA, 75 bp, Artificial Sequence
  Synthetic
ctgtactcaacaaagaaagaaataagaaaaacataaaatatatatataccaaacagagtttttctcttgtttggt

SEQ ID NO: 33420 - DNA, 75 bp, Artificial Sequence
  Synthetic
accaaacaagagaagagacttgcttgggaatattaatttaaataaaaattaacttaggattaaagaacttgaccg

SEQ ID NO: 33421 - DNA, 75 bp, Artificial Sequence
  Synthetic
gggaatattaatttaaataaaaattaacttaggattaaagaacttgaccgaaaggtgaggggaaagagatcctaa

SEQ ID NO: 33422 - DNA, 75 bp, Artificial Sequence
  Synthetic
gattgtaatcatgctgagtctatttgacacattcagtgcacgtagacaggagaacataacaaaatcagctggtgg

SEQ ID NO: 33423 - DNA, 75 bp, Artificial Sequence
  Synthetic
gacacattcagtgcacgtagacaggagaacataacaaaatcagctggtggggctgtcattcccgggcaaaaaaat

SEQ ID NO: 33424 - DNA, 75 bp, Artificial Sequence
  Synthetic
tcccattctttggacaacgaaaagcaacatgcacaacgagccggatttctagtctctctgttatcaatggcctat

SEQ ID NO: 33425 - DNA, 75 bp, Artificial Sequence
  Synthetic
gccaacccagaattgtatttaacatcaaatggtagtaatgcagatgttaagtatgtcatctacatgatagagaaa

SEQ ID NO: 33426 - DNA, 75 bp, Artificial Sequence
  Synthetic
gacccaggaagacaaaaatatggtgggttagtagtcaagactagagagatggtttatgaaaagacaaccgactgg

SEQ ID NO: 33427 - DNA, 75 bp, Artificial Sequence
  Synthetic
atgttcgggagtgatcttgagtatgatcaagataatatgttgcaaaatggtagaggcacttctacaattgaggat

SEQ ID NO: 33428 - DNA, 75 bp, Artificial Sequence
  Synthetic
cttgttcatacttttgggtatccatcatgtcttggagctctaataatccagatttggataatacttgtcaaggct

SEQ ID NO: 33429 - DNA, 75 bp, Artificial Sequence
  Synthetic
ataaccagtatatcaggattgaggaaggggttctttactcggttagaagcattcagacaagatggaacagttaaa

SEQ ID NO: 33430 - DNA, 75 bp, Artificial Sequence
  Synthetic
ctcatggttgaaacactgataacaatgaacacaggcagaaatgatttgacaacgatagaaaagaatatacagatt

SEQ ID NO: 33431 - DNA, 75 bp, Artificial Sequence
  Synthetic
gtaggaaactacatcagggatgcaggtcttgcttcatttttcaacacaatcagatatggcattgagactagaatg

SEQ ID NO: 33432 - DNA, 75 bp, Artificial Sequence
  Synthetic
gcagctctaaccctgtctacccttagaccagatatcaacagactcaaggcgctgatagagctatatctatcaaag

SEQ ID NO: 33433 - DNA, 75 bp, Artificial Sequence
  Synthetic
ggaccacgtgctccttttatatgcatcttgagagaccctgtgcatggtgagtttgcaccaggtaactatcctgcc

SEQ ID NO: 33434 - DNA, 75 bp, Artificial Sequence
  Synthetic
ctttggagttatgcgatgggtgtagcagttgtacaaaacaaagccatgcaacagtatgtaacaggaaggtcgtat

SEQ ID NO: 33435 - DNA, 75 bp, Artificial Sequence
  Synthetic
ctagatattgaaatgttccaactgggtcaagcagtggcacgtgatgcagaatcgcagatgagttcaatactagag

SEQ ID NO: 33436 - DNA, 75 bp, Artificial Sequence
  Synthetic
gatgaactaggagttacacaagaagctaagcagagcttgaagaaacacatgaagaacatcagcagctcagataca

SEQ ID NO: 33437 - DNA, 75 bp, Artificial Sequence
  Synthetic
ctaagcagagcttgaagaaacacatgaagaacatcagcagctcagatacaacctttcacaaacccacagggggat

SEQ ID NO: 33438 - DNA, 75 bp, Artificial Sequence
  Synthetic
cagccatagaaatggcaatagacgaagaagcagagcagcccgaatctagaggagatcaagaccaaggagatgagc

SEQ ID NO: 33439 - DNA, 75 bp, Artificial Sequence
  Synthetic
ctcggtcatccatagtcccctatgcatgggcagacgaaaccagaaatgacacacaaactgaattagccacagaaa

SEQ ID NO: 33440 - DNA, 75 bp, Artificial Sequence
  Synthetic
tcgacagcatcaaaactgaacaaagaaacatcagagacaggttgaacaagagactcaacgaaaaaaggaaacaga

SEQ ID NO: 33441 - DNA, 75 bp, Artificial Sequence
  Synthetic
acgactcgagaccaactgacatcgcaaataacacaaatcaaactgaaatagatgacctgttcagtgcattcggaa

SEQ ID NO: 33442 - DNA, 75 bp, Artificial Sequence
  Synthetic
aaataacacaaatcaaactgaaatagatgacctgttcagtgcattcggaaacaactaactatacagaagtgatca

SEQ ID NO: 33443 - DNA, 75 bp, Artificial Sequence
  Synthetic
ccattatcatcaacaagtaagaaaaacttaggattaatggaaatcatccaatccggagacggaaggacaaatcca

SEQ ID NO: 33444 - DNA, 75 bp, Artificial Sequence
  Synthetic
atccggagacggaaggacaaatccagaatccacccacaactcaatcaacccaagattcatggaagacaatgttca

SEQ ID NO: 33445 - DNA, 75 bp, Artificial Sequence
  Synthetic
aaacaatcaaatcatggattcttgggaagaggggtcaagagacaagtcatctgacatctcatcggccctcgacat

SEQ ID NO: 33446 - DNA, 75 bp, Artificial Sequence
  Synthetic
tattgaattcatactcagcaccgattcccaagagaacacggcagacagcaatgaaatcaacacaggagccacaaa

SEQ ID NO: 33447 - DNA, 75 bp, Artificial Sequence
  Synthetic
actcagcacaacaatctaccaacttgaacctaaaacaacagaaacaagcaaagaaaatagtggatcagttaacaa

SEQ ID NO: 33448 - DNA, 75 bp, Artificial Sequence
  Synthetic
agatcgacagcttgggacatcacacgaacgtgccacagagacaaaaaatagaaatgttaatcaagaggctataca

SEQ ID NO: 33449 - DNA, 75 bp, Artificial Sequence
  Synthetic
gggaagagataggagaggaggcaactcagatagtagaactgagactatggtcactagaagaatctccagaagcag

SEQ ID NO: 33450 - DNA, 75 bp, Artificial Sequence
  Synthetic
ctcagatcctaacaatggagcccaaatccaggaaaatattgattacaatgaagttggaaagatggataaggactt

SEQ ID NO: 33451 - DNA, 75 bp, Artificial Sequence
  Synthetic
ggaagcctggaatctgtcagtacatttgattcaggatacaccagcatagtgactgccgcaacaccagatgacgaa

SEQ ID NO: 33452 - DNA, 75 bp, Artificial Sequence
  Synthetic
ttgattcaggatacaccagcatagtgactgccgcaacaccagatgacgaagaagaacttcttatgaggaacaaca

SEQ ID NO: 33453 - DNA, 75 bp, Artificial Sequence
  Synthetic
ggccaagaagacaccaatcaacaccccaaggagacaacaagggaattaaaaaaggggttggagagcaaaaagata

SEQ ID NO: 33454 - DNA, 75 bp, Artificial Sequence
  Synthetic
cagacacacaatcaccaatattggaccacgaactcaactccaaaggatcgaagaggagccagaacactttcaagg

SEQ ID NO: 33455 - DNA, 75 bp, Artificial Sequence
  Synthetic
tcagcacgaatacaggagaaccaacaagagcacagaatggatcccaggggaagagaatcacatcctggaacatcc

SEQ ID NO: 33456 - DNA, 75 bp, Artificial Sequence
  Synthetic
tcaacagcgagagcaccagtcgaaccgaaccgacaaatcaaagttctcagagatcgacctctggacagagtcaca

SEQ ID NO: 33457 - DNA, 75 bp, Artificial Sequence
  Synthetic
cggtgggaccaagcagaacaacccccgaatcaagaatcaagacacaaaagacgggtggaaaggaaagagaggaca

SEQ ID NO: 33458 - DNA, 75 bp, Artificial Sequence
  Synthetic
tagacttcctagcaggtctaatgataggagtatcaatggatcatgataccaaattaaaccagattcaaaatgaga

SEQ ID NO: 33459 - DNA, 75 bp, Artificial Sequence
  Synthetic
tattgggtttaaagactgatcttaaaaagatggacgaatcacatagaagattaatagagaatcaaaaagaacaat

SEQ ID NO: 33460 - DNA, 75 bp, Artificial Sequence
  Synthetic
tatcactgatcacatcattaatctcaaacctcaaaattatgacagagaggggagggaagagagatcaacccgaac

SEQ ID NO: 33461 - DNA, 75 bp, Artificial Sequence
  Synthetic
tcagcggcaggacacccatgatcaagacaaaagcaaaagaagagaaaatcaagaaagtcaggtttgatcctctta

SEQ ID NO: 33462 - DNA, 75 bp, Artificial Sequence
  Synthetic
tggaaacacagggcattgagaaaaacatccctgacctctataggtcaattgagaaaataccagaaaacgacacac

SEQ ID NO: 33463 - DNA, 75 bp, Artificial Sequence
  Synthetic
gagaaaataccagaaaacgacacacagatcaaatcagaaataaacagactgaatgatgaatctaatgcaactaga

SEQ ID NO: 33464 - DNA, 75 bp, Artificial Sequence
  Synthetic
ctagtacccaagagaacaagcaatacaatgaggtcactaatcataatcatcaacaacagtaatttatcatcaaaa

SEQ ID NO: 33465 - DNA, 75 bp, Artificial Sequence
  Synthetic
gctaaacaatcatacatcaatgaactcaagctctgcaagagtgacgaggaagtgtccgaattgatggacatgttt

SEQ ID NO: 33466 - DNA, 75 bp, Artificial Sequence
  Synthetic
aatgaagatgtcaactcacagtgaacaaccagacaaaggtcaacaccacgaagatcaacagcacaagacaatcaa

SEQ ID NO: 33467 - DNA, 75 bp, Artificial Sequence
  Synthetic
tcagagatcaccccaatgcatcgaatcaaacgatacacaacaaagatattgagattacagctaattaagaaaaac

SEQ ID NO: 33468 - DNA, 75 bp, Artificial Sequence
  Synthetic
ttaggataaaagggttaatcaattccccgaaacaatgagcatcaccaactccacgatctacacatttccagaatc

SEQ ID NO: 33469 - DNA, 75 bp, Artificial Sequence
  Synthetic
ctccttctccgacaatggcaacatagagccattaccgcttaaggttaatgaacagagaaaggcaataccacatat

SEQ ID NO: 33470 - DNA, 75 bp, Artificial Sequence
  Synthetic
tagagttgttaagataggggatccacccaaacatgggactagatatctggatgtctttttactgggcttctttga

SEQ ID NO: 33471 - DNA, 75 bp, Artificial Sequence
  Synthetic
gatggaaaggtcaaaggacaagtatggaagtgtaagtgatctagatgatgatccaagttacaaggtttgtggctc

SEQ ID NO: 33472 - DNA, 75 bp, Artificial Sequence
  Synthetic
tggatcgttgccacttgggttagctagatacactggaaatgatcaggaactccttcaggctgcaaccaagctgga

SEQ ID NO: 33473 - DNA, 75 bp, Artificial Sequence
  Synthetic
tatagaagtaaggagaacagtaaaggctacggagatgatagtttacactgtgcagaacatcaagcctgaactata

SEQ ID NO: 33474 - DNA, 75 bp, Artificial Sequence
  Synthetic
tccatggtccagtaggctaagaaaaggaatgttatttgacgctaacaaggttgcacttgctcctcagtgtcttcc

SEQ ID NO: 33475 - DNA, 75 bp, Artificial Sequence
  Synthetic
actagatagagggataaaattccgggtgatattcgtgaactgtacagcgattggatcaataactctattcaaaat

SEQ ID NO: 33476 - DNA, 75 bp, Artificial Sequence
  Synthetic
acctaaatccatggcattgttatcattacctaatacaatatcaataaatctacaagtacatatcaaaacaggaat

SEQ ID NO: 33477 - DNA, 75 bp, Artificial Sequence
  Synthetic
tgggctgatcaagagaaagatgggtagaatgtactcagttgaatattgcaagcagaagattgagaaaatgagatt

SEQ ID NO: 33478 - DNA, 75 bp, Artificial Sequence
  Synthetic
attattctcacttggattggttggagggatcagcttccacgttaatgcaactggctccatatcaaagacattagc

SEQ ID NO: 33479 - DNA, 75 bp, Artificial Sequence
  Synthetic
aagtcaactagcatttaaaagagaaatctgttatccattaatggacctgaatccacatctaaatctggtcatatg

SEQ ID NO: 33480 - DNA, 75 bp, Artificial Sequence
  Synthetic
ggcatcatcaattgaaatcacaagggtagatgcaatcctccagccctcattacctggtgaattcagatactatcc

SEQ ID NO: 33481 - DNA, 75 bp, Artificial Sequence
  Synthetic
aaatatcatagcaaaaggagtcgggaaaattagacagtgaaaccaacaaacttgacatccgacatcgaaaaccag

SEQ ID NO: 33482 - DNA, 75 bp, Artificial Sequence
  Synthetic
gctacacacaggagaagaatcaaaaacttaggatcaaagaggtcaacacaaacgccaggaaacagtcaaaacaac

SEQ ID NO: 33483 - DNA, 75 bp, Artificial Sequence
  Synthetic
caacacacagaccacagacaagaagaaaaagacaccgcaaagatcgagaccaagcagaacacacacagccaaaca

SEQ ID NO: 33484 - DNA, 75 bp, Artificial Sequence
  Synthetic
ggggaaagccaaagtccatcacccacaaacacaccaacaatcctgcaaataggcaccagaacagacaccaaaaca

SEQ ID NO: 33485 - DNA, 75 bp, Artificial Sequence
  Synthetic
caaagagcaccagacatgatcaccacagccacaattgtagccatattactaatacccctatcattttgtcaaata

SEQ ID NO: 33486 - DNA, 75 bp, Artificial Sequence
  Synthetic
cagccacaattgtagccatattactaatacccctatcattttgtcaaatagacataacaaaactgcaacgtgtag

SEQ ID NO: 33487 - DNA, 75 bp, Artificial Sequence
  Synthetic
tatgaagatttcacaaaattttgagacaagatacctaatactgagtcttatacccaaaatagaaaactcacactc

SEQ ID NO: 33488 - DNA, 75 bp, Artificial Sequence
  Synthetic
atgtggggaccaacagataaaccaatataagaagttattggatagattgataattcctctatatgatggattaaa

SEQ ID NO: 33489 - DNA, 75 bp, Artificial Sequence
  Synthetic
taattcctctatatgatggattaaaattacaaaaggatgtgatagtagtaaatcatgaaactcacaataatactg

SEQ ID NO: 33490 - DNA, 75 bp, Artificial Sequence
  Synthetic
attacaaaaggatgtgatagtagtaaatcatgaaactcacaataatactggtcttaggacaaaacgattctttgg

SEQ ID NO: 33491 - DNA, 75 bp, Artificial Sequence
  Synthetic
agagataatcggaactattgcgatagggatagccacctcagcgcaaatcactgcagcagtcgcccttgtcgaggc

SEQ ID NO: 33492 - DNA, 75 bp, Artificial Sequence
  Synthetic
caaacaggcaagatcagacatagaaaaactcaaagaagctgtaagagacacaaataaggcagtacaatcaattca

SEQ ID NO: 33493 - DNA, 75 bp, Artificial Sequence
  Synthetic
aaactcaaagaagctgtaagagacacaaataaggcagtacaatcaattcaaagttctgtaggtaatctaattgtt

SEQ ID NO: 33494 - DNA, 75 bp, Artificial Sequence
  Synthetic
tatatttggtgataatattgggacactaaaagaaaagggggtaaaactacaagggatagcatcactataccacac

SEQ ID NO: 33495 - DNA, 75 bp, Artificial Sequence
  Synthetic
ctaaaagaaaagggggtaaaactacaagggatagcatcactataccacacaaacataacggaaatatttactact

SEQ ID NO: 33496 - DNA, 75 bp, Artificial Sequence
  Synthetic
ttgagtgattactcaattactcttcaagttagacttcctttgttaactaaactatcaaatactcaaatctataag

SEQ ID NO: 33497 - DNA, 75 bp, Artificial Sequence
  Synthetic
gtggattctatatcatacaatatccaaggcaaggagtggtatattcctcttcccaaccatatcatgactaaagga

SEQ ID NO: 33498 - DNA, 75 bp, Artificial Sequence
  Synthetic
tttatcttaaatcatgagatagagaattgtttatcaggtaatataacacaatgtcctaagactgttgttacatca

SEQ ID NO: 33499 - DNA, 75 bp, Artificial Sequence
  Synthetic
gatgtggtaccacgatatgcatttgtgaatggtggattaattgcaaactgtataacaacaacatgcacatgcaat

SEQ ID NO: 33500 - DNA, 75 bp, Artificial Sequence
  Synthetic
ggaatcgacaatagaatcaatcaatcacctgatcagggaataaaaatcataacatataaagaatgtcaggtaatc

SEQ ID NO: 33501 - DNA, 75 bp, Artificial Sequence
  Synthetic
ggtataaatggaatgttattcaataccaatagagagggaacattagcaacctatacatttgataacatcatatta

SEQ ID NO: 33502 - DNA, 75 bp, Artificial Sequence
  Synthetic
aataactctgttgcacttaatccaattgacatatctatggaactcaacaaggcaaaattggaattggaagaatcg

SEQ ID NO: 33503 - DNA, 75 bp, Artificial Sequence
  Synthetic
aaggaatggataaaaaaatcaaatcacaaactggattctgttggaagttggtatcaatctagtgcaacagtcacc

SEQ ID NO: 33504 - DNA, 75 bp, Artificial Sequence
  Synthetic
gtatcaatctagtgcaacagtcaccataatcatagtgatgatagtaatcttattcataatcaatataacaattat

SEQ ID NO: 33505 - DNA, 75 bp, Artificial Sequence
  Synthetic
ataatcatagtgatgatagtaatcttattcataatcaatataacaattattgtaatcataatcaaataccataga

SEQ ID NO: 33506 - DNA, 75 bp, Artificial Sequence
  Synthetic
attcaagggggaaaacaagaagacaaaaacaatgaaccgtatgtactaacaagtagaaaataagatcatacatga

SEQ ID NO: 33507 - DNA, 75 bp, Artificial Sequence
  Synthetic
aagtagaaaataagatcatacatgattcaatataaaaaatataaaaaacttaggaacaaagttgctcaacacagc

SEQ ID NO: 33508 - DNA, 75 bp, Artificial Sequence
  Synthetic
ttcaatataaaaaatataaaaaacttaggaacaaagttgctcaacacagcagcaacaagcaaaccagaaggcaac

SEQ ID NO: 33509 - DNA, 75 bp, Artificial Sequence
  Synthetic
acaaagacaacaccaaactcaaaaatggaatactggaaacacacaaacagcacaaaagaaaccaacaatgaatcc

SEQ ID NO: 33510 - DNA, 75 bp, Artificial Sequence
  Synthetic
tggaatactggaaacacacaaacagcacaaaagaaaccaacaatgaatccggaacaaccataggcatacacagta

SEQ ID NO: 33511 - DNA, 75 bp, Artificial Sequence
  Synthetic
gtaaagctacaaatatcataatgtacatcttctggacagtcatatcaataatattatcagtcatttttataatga

SEQ ID NO: 33512 - DNA, 75 bp, Artificial Sequence
  Synthetic
catcttctggacagtcatatcaataatattatcagtcatttttataatgatattgattaacttaattcaagagaa

SEQ ID NO: 33513 - DNA, 75 bp, Artificial Sequence
  Synthetic
caatcataataaattaatcctgcaggaaattagaaaagaattcgcagcaatagacaccaaaattcagacgacttc

SEQ ID NO: 33514 - DNA, 75 bp, Artificial Sequence
  Synthetic
tgatgacattggtacctcgatacagtcaggaataaacacaagacttctcacgattcagagtcatgttcaaaacta

SEQ ID NO: 33515 - DNA, 75 bp, Artificial Sequence
  Synthetic
tattccactatcattgacacaacaaatgtcagatctcagaaaatttatcaacgatctaacaaataaaagagaaca

SEQ ID NO: 33516 - DNA, 75 bp, Artificial Sequence
  Synthetic
tcaagaagtgccaatacaaagaatgactcatgatagaggtatagaacctctaaatccagacaatttctggagatg

SEQ ID NO: 33517 - DNA, 75 bp, Artificial Sequence
  Synthetic
actcatgatagaggtatagaacctctaaatccagacaatttctggagatgtacatctggtaacccatcattgaca

SEQ ID NO: 33518 - DNA, 75 bp, Artificial Sequence
  Synthetic
agtagtcctaagataaggttaatacccgggccaggtttattagcaacatccactactgtaactggctgtattaga

SEQ ID NO: 33519 - DNA, 75 bp, Artificial Sequence
  Synthetic
cactactgtaactggctgtattagaatcccatcttttgtaatcaataacctaatctatgcttacacctctaatct

SEQ ID NO: 33520 - DNA, 75 bp, Artificial Sequence
  Synthetic
tattacccagggctgtcaagatatagggaaatcttaccaagtactacaaatagggataattaccataaattcaga

SEQ ID NO: 33521 - DNA, 75 bp, Artificial Sequence
  Synthetic
tctagtacctgatttaaaccccagagtcacacatacatttaatattgatgataataggaaatcctgctcactggc

SEQ ID NO: 33522 - DNA, 75 bp, Artificial Sequence
  Synthetic
ataataggaaatcctgctcactggcattattgaacacagatgtttatcagttatgctcaaccccgaaagttgacg

SEQ ID NO: 33523 - DNA, 75 bp, Artificial Sequence
  Synthetic
aaagatcagattatgcatcaacaggtattgaggatattgtactcgatgttgtcactaataatggattaattataa

SEQ ID NO: 33524 - DNA, 75 bp, Artificial Sequence
  Synthetic
caacaaggtttacaaataataatataacgtttgacaaaccttatgcagctttatatccatcagtaggaccaggaa

SEQ ID NO: 33525 - DNA, 75 bp, Artificial Sequence
  Synthetic
tatattataagggtaaagttatattcctcggatatggaggtctagagcatgaagaaaacggagacgtcatatgca

SEQ ID NO: 33526 - DNA, 75 bp, Artificial Sequence
  Synthetic
atacaactggttgtcctggcaaaacacaaagagactgtaatcaggcttcttatagcccgtggttctcgaatagga

SEQ ID NO: 33527 - DNA, 75 bp, Artificial Sequence
  Synthetic
gaatggttaattctattatcgttgttgataagggtatagatacaacttttagcttaagggtgtggactattccaa

SEQ ID NO: 33528 - DNA, 75 bp, Artificial Sequence
  Synthetic
tgagacaaaactattggggatcagaaggaagattgcttttattaggtgacagaatatacatatatactagatcca

SEQ ID NO: 33529 - DNA, 75 bp, Artificial Sequence
  Synthetic
aggaagattgcttttattaggtgacagaatatacatatatactagatccacaagttggcatagcaaattacaatt

SEQ ID NO: 33530 - DNA, 75 bp, Artificial Sequence
  Synthetic
gaatgatgaatgcccatggggtcattcatgcccagacggatgcataacaggggtttacactgatgcatatccatt

SEQ ID NO: 33531 - DNA, 75 bp, Artificial Sequence
  Synthetic
gggtttacactgatgcatatccattaaatccatcggggagtattgtatcctccgtcattcttgattcacaaaaat

SEQ ID NO: 33532 - DNA, 75 bp, Artificial Sequence
  Synthetic
tccgtcattcttgattcacaaaaatctagagaaaacccaatcattacctattcgacagccacaaatagagtaaat

SEQ ID NO: 33533 - DNA, 75 bp, Artificial Sequence
  Synthetic
tattgtttccacatagtagaaataaatcacagaagtttgaatacgtttcaacctatgttattcaaaacagaggtc

SEQ ID NO: 33534 - DNA, 75 bp, Artificial Sequence
  Synthetic
ccaaagaactgcagctaaactgactctcgcatatcgagtgcctgatgatatacaaagaaattataaaacagacat

SEQ ID NO: 33535 - DNA, 75 bp, Artificial Sequence
  Synthetic
gaaattacaaaaaacttaggagaaaagtgtgcaggagaaatggacaccgaatccaacaacggcacaacatctgac

SEQ ID NO: 33536 - DNA, 75 bp, Artificial Sequence
  Synthetic
ctgccccaaccttacgatatggatgatgattcaatactaattataactagacaaaaaattaaactcaataaatta

SEQ ID NO: 33537 - DNA, 75 bp, Artificial Sequence
  Synthetic
gacaaaagacaacggtcaattaggaaattaagatcagtcttaatagaaagagtaagtgatctgggtaaatacact

SEQ ID NO: 33538 - DNA, 75 bp, Artificial Sequence
  Synthetic
tttatcagatatccagaaatgtccaatgaaatgttccaattatgtatacccggaattaataatagaataaatgaa

SEQ ID NO: 33539 - DNA, 75 bp, Artificial Sequence
  Synthetic
atgaaatgttccaattatgtatacccggaattaataatagaataaatgaactgctaagtaaagcaagtaaaacat

SEQ ID NO: 33540 - DNA, 75 bp, Artificial Sequence
  Synthetic
ataatcaaatgactgatgggttaagggatctatgggttactatactatcgaaattagcatcaaaaaatgatggca

SEQ ID NO: 33541 - DNA, 75 bp, Artificial Sequence
  Synthetic
gtgattatgatatcaatggagatattagcaatatatcaaatgttcacacgacctatcaatcagacaaatggtata

SEQ ID NO: 33542 - DNA, 75 bp, Artificial Sequence
  Synthetic
acccatttaagacatggtttactattaagtatgacatgaggagattacaaaagagtaaaaatgagattacattca

SEQ ID NO: 33543 - DNA, 75 bp, Artificial Sequence
  Synthetic
atagaaataaggattataatctattagaagaccaaaagaatatattgctgatacatccagagcttgtcttaatat

SEQ ID NO: 33544 - DNA, 75 bp, Artificial Sequence
  Synthetic
tagataaacaaaattacaacgggtatataatgactcccgagttggtactaatgtattgtgatgtagttgaaggaa

SEQ ID NO: 33545 - DNA, 75 bp, Artificial Sequence
  Synthetic
attagatcctaagttacaatcaatgtattataaaggtaacaatttatgggaaataatagatggactattctcgat

SEQ ID NO: 33546 - DNA, 75 bp, Artificial Sequence
  Synthetic
cttgggagaaagaacatttgacataatatcattattagaaccgcttgcattatcgcttattcagactcacgaccc

SEQ ID NO: 33547 - DNA, 75 bp, Artificial Sequence
  Synthetic
agtcaaacagctcaggggagcttttttaaatcacgtgttatcagaaatggaatcaatattcgaagctgggggtac

SEQ ID NO: 33548 - DNA, 75 bp, Artificial Sequence
  Synthetic
ttaaatcacgtgttatcagaaatggaatcaatattcgaagctgggggtacagcagaaggaatacctaatgtggat

SEQ ID NO: 33549 - DNA, 75 bp, Artificial Sequence
  Synthetic
tacatagataaaattttagatgtatttaaagaatcaacaatagatgaagtagcagaaattttctctttcttccgg

SEQ ID NO: 33550 - DNA, 75 bp, Artificial Sequence
  Synthetic
acttttggacatcctccattagaagcaagtgtggcggcagaaaaggttaggaagtatatgtacactgagaaatgc

SEQ ID NO: 33551 - DNA, 75 bp, Artificial Sequence
  Synthetic
ttgaaatttgacactgtcaataaatgtcacgctattttttgcacaataattataaatggatatagagaaaggcat

SEQ ID NO: 33552 - DNA, 75 bp, Artificial Sequence
  Synthetic
tataaatggatatagagaaaggcatggtggtcaatggcctccagttacattacctgcccatgcacatgaatttat

SEQ ID NO: 33553 - DNA, 75 bp, Artificial Sequence
  Synthetic
cataaatgcgtacggatcaaattctgccatatcatatgagaatgctgtagattattataagagcttcataggaat

SEQ ID NO: 33554 - DNA, 75 bp, Artificial Sequence
  Synthetic
attattataagagcttcataggaataaagtttgacaagttcatagaaccacaattagatgaggatttaactattt

SEQ ID NO: 33555 - DNA, 75 bp, Artificial Sequence
  Synthetic
atatgaaagataaagcattatccccaaataaatcaaactgggacacagtctatccagcttcaaacctgttatatc

SEQ ID NO: 33556 - DNA, 75 bp, Artificial Sequence
  Synthetic
gcactaatggatctcatgattcgagacggttagttgaagtgtttatagcagatagtaagtttgatccccatcaag

SEQ ID NO: 33557 - DNA, 75 bp, Artificial Sequence
  Synthetic
acggttagttgaagtgtttatagcagatagtaagtttgatccccatcaagtattagattatgtagaatcaggata

SEQ ID NO: 33558 - DNA, 75 bp, Artificial Sequence
  Synthetic
tgcaaaaatgacatataagatgagagctgcacaagtattatcagaaacattattagcgaataacatagggaaatt

SEQ ID NO: 33559 - DNA, 75 bp, Artificial Sequence
  Synthetic
tattagcgaataacatagggaaattcttccaagagaatgggatggttaaaggggaaattgaactacttaagagac

SEQ ID NO: 33560 - DNA, 75 bp, Artificial Sequence
  Synthetic
taacaacaatatccatgtctggggttccacgatataatgaggtatacaataattcaaaaagccatacagatgaac

SEQ ID NO: 33561 - DNA, 75 bp, Artificial Sequence
  Synthetic
ttcaagcttacaatacaattagtagttctaacttatcttcgaatcagaagtcaaaaaagtttgaatttaaatcaa

SEQ ID NO: 33562 - DNA, 75 bp, Artificial Sequence
  Synthetic
cagatatatacaatgacggatatgaaactgtaagctgcttcttaactacagatcttaaaaaatattgtttaaatt

SEQ ID NO: 33563 - DNA, 75 bp, Artificial Sequence
  Synthetic
ggaggtatgaatcaacagctttatttggtgaaacttgcaatcagatatttgggttaaaggaattatttaattggt

SEQ ID NO: 33564 - DNA, 75 bp, Artificial Sequence
  Synthetic
tacaccctcgccttgaaaagagtacaatatatgttggagacccttattgcccaccatcagatactgagcatttac

SEQ ID NO: 33565 - DNA, 75 bp, Artificial Sequence
  Synthetic
ccaccatcagatactgagcatttaccactcgacgagcatcctgattcaggattttatgtccataatcccaaagga

SEQ ID NO: 33566 - DNA, 75 bp, Artificial Sequence
  Synthetic
ggtgtcagagttactgcaatggttcaaggagacaatcaagccatagctgttactacaagagtacctaataattat

SEQ ID NO: 33567 - DNA, 75 bp, Artificial Sequence
  Synthetic
gattacaaggttaagaaagagattgtttataaagatgtggtgagattcttcgattctttaagagaggttatggat

SEQ ID NO: 33568 - DNA, 75 bp, Artificial Sequence
  Synthetic
gaaacaaggtcagcatcttcaaatctggcaacatcatttgcaaaggccattgaaaatggttactcacctgtattg

SEQ ID NO: 33569 - DNA, 75 bp, Artificial Sequence
  Synthetic
gggtatgtatgttcaattttcaaaaatatccaacaattgtatatagcgcttggaatgaatataaatccaaccata

SEQ ID NO: 33570 - DNA, 75 bp, Artificial Sequence
  Synthetic
atatccaacaattgtatatagcgcttggaatgaatataaatccaaccataactcaaaatattagagatcaatatt

SEQ ID NO: 33571 - DNA, 75 bp, Artificial Sequence
  Synthetic
caaggtgctttgtcagaaatattggagatcctacagttgctgcattagcggatattaaaagatttataaaagcaa

SEQ ID NO: 33572 - DNA, 75 bp, Artificial Sequence
  Synthetic
agatcctacagttgctgcattagcggatattaaaagatttataaaagcaaatttgttagaccgaggtgtcctcta

SEQ ID NO: 33573 - DNA, 75 bp, Artificial Sequence
  Synthetic
cagaattatgaatcaagaaccaggcgagtcttcttttttagattgggcttcagatccatattcatgtaacttacc

SEQ ID NO: 33574 - DNA, 75 bp, Artificial Sequence
  Synthetic
acaatctcaaaatataactaccatgataaagaatataactgcaagaaatgtattacaggactcaccgaacccatt

SEQ ID NO: 33575 - DNA, 75 bp, Artificial Sequence
  Synthetic
actatctggattatttacaagtacaatgatagaagaggatgaagaactagctgaattcttaatggataggagaat

SEQ ID NO: 33576 - DNA, 75 bp, Artificial Sequence
  Synthetic
aatcctcccgagagttgcacatgatattttagataattctcttactggaatcaggaatgccatagctgggatgtt

SEQ ID NO: 33577 - DNA, 75 bp, Artificial Sequence
  Synthetic
tcaggaatgccatagctgggatgttggatacaacaaaatcactgattcgagtaggaataaatagaggaggattaa

SEQ ID NO: 33578 - DNA, 75 bp, Artificial Sequence
  Synthetic
acacttagtaaaactctaagattaatagtcagtgataagattaagtatgaagatatgtgctcagtagacctagct

SEQ ID NO: 33579 - DNA, 75 bp, Artificial Sequence
  Synthetic
tagtcagtgataagattaagtatgaagatatgtgctcagtagacctagctgtatccttaaggcaaaaaatgtgga

SEQ ID NO: 33580 - DNA, 75 bp, Artificial Sequence
  Synthetic
tgcatttgtcaggaggaagaatgataaatggacttgagactccagatcctttagaactgctgtctggggtaataa

SEQ ID NO: 33581 - DNA, 75 bp, Artificial Sequence
  Synthetic
taacagggtctgaacattgtagggtctgttattcaactgaaggtgaaagcccatatacttggatgtatttaccag

SEQ ID NO: 33582 - DNA, 75 bp, Artificial Sequence
  Synthetic
ccatatacttggatgtatttaccaggtaatcttaatataggatcagctgagacaggaatagcatcattaagggtc

SEQ ID NO: 33583 - DNA, 75 bp, Artificial Sequence
  Synthetic
gacaggaatagcatcattaagggtcccttactttggatcagttacggatgaaagatccgaagcacaattggggta

SEQ ID NO: 33584 - DNA, 75 bp, Artificial Sequence
  Synthetic
cgaaatatcctggatagaagcatcacagattgcacaaacacgtgcaaatttcacattggatagcttaaagattct

SEQ ID NO: 33585 - DNA, 75 bp, Artificial Sequence
  Synthetic
cagattgcacaaacacgtgcaaatttcacattggatagcttaaagattctgacaccagtaacaacatcaacaaat

SEQ ID NO: 33586 - DNA, 75 bp, Artificial Sequence
  Synthetic
ctgtcacacaggttaaaagatactgctactcagatgaaattttctagtacatcacttattagagtgagtaggttc

SEQ ID NO: 33587 - DNA, 75 bp, Artificial Sequence
  Synthetic
atcacaatatccaatgataatatgtctatcaaggaggcaaatgaaactaaggacacaaatcttatttatcaacag

SEQ ID NO: 33588 - DNA, 75 bp, Artificial Sequence
  Synthetic
gtaatgttaacagggttaagtgtatttgaatatctatttaggttagaggagaatacgggacataatcctattgtt

SEQ ID NO: 33589 - DNA, 75 bp, Artificial Sequence
  Synthetic
ttgaatatctatttaggttagaggagaatacgggacataatcctattgttatgcatctacatgtagaggatggat

SEQ ID NO: 33590 - DNA, 75 bp, Artificial Sequence
  Synthetic
gttgtattaaagagagttataatgatgagcatattaatccagagtctactttggagttaattaaatatcctgaaa

SEQ ID NO: 33591 - DNA, 75 bp, Artificial Sequence
  Synthetic
gcaatgaatttatatatgacaaagaccctttaaaggatatagacctatcaaaactaatggttataagagatcatt

SEQ ID NO: 33592 - DNA, 75 bp, Artificial Sequence
  Synthetic
ggatgacacagacattgtacatgcaatatcaatatgtactgcagttacaatagcggatactatgtcgcagctaga

SEQ ID NO: 33593 - DNA, 75 bp, Artificial Sequence
  Synthetic
acatttggggggttactcgtgaatcaatttgcatatactctttatggattaaaaatagaaggaagagaccccatt

SEQ ID NO: 33594 - DNA, 75 bp, Artificial Sequence
  Synthetic
tgggactatataatgagaacattaaaagacacctcacattcagtacttaaggtattatccaatgcactatctcat

SEQ ID NO: 33595 - DNA, 75 bp, Artificial Sequence
  Synthetic
cccaaagtgtttaagagattctgggattgtggagttttaaatcctatttatggtcctaataccgctggtcaggat

SEQ ID NO: 33596 - DNA, 75 bp, Artificial Sequence
  Synthetic
tggtcctaataccgctggtcaggatcaagttaagcttgctctttcaatctgcgagtactctttggatttatttat

SEQ ID NO: 33597 - DNA, 75 bp, Artificial Sequence
  Synthetic
gagagaatggttgaatggagcatcacttgagatctatatctgtgatagtgacatggaaatagcaaatgatagaag

SEQ ID NO: 33598 - DNA, 75 bp, Artificial Sequence
  Synthetic
acaagcatttatctcaagacacctcgcttttgtgtgttgtttagcagagatagcatctttcggaccaaatctatt

SEQ ID NO: 33599 - DNA, 75 bp, Artificial Sequence
  Synthetic
aaatctaacatatttagagagacttgatgaattaaaacaatacttggatttgaacatcaaagaagatcctaccct

SEQ ID NO: 33600 - DNA, 75 bp, Artificial Sequence
  Synthetic
taagtatgtgcaggtatcaggactgttaatcaaatcattcccatcaactgttacatatgtgaggaaaactgcaat

SEQ ID NO: 33601 - DNA, 75 bp, Artificial Sequence
  Synthetic
taagtatctgagaatccgtggaattaatccgcctgaaacaattgaggattgggatcccatagaagatgagaatgt

SEQ ID NO: 33602 - DNA, 75 bp, Artificial Sequence
  Synthetic
gggatcccatagaagatgagaatgttttggacaatattgttcgaactgtgaatgataattgtattgataatcaaa

SEQ ID NO: 33603 - DNA, 75 bp, Artificial Sequence
  Synthetic
agaagaataaaagtagtcatttctgggggttagctctaaaaaattatcaagtcgtaaaaataagatctatagcaa

SEQ ID NO: 33604 - DNA, 75 bp, Artificial Sequence
  Synthetic
gtgattctgaagttaatgaagtttcaaatgttactacacatgggatgacacttcctcagggaggaaattatctat

SEQ ID NO: 33605 - DNA, 75 bp, Artificial Sequence
  Synthetic
aaatgttactacacatgggatgacacttcctcagggaggaaattatctatcacatcaattgaggttatttggagt

SEQ ID NO: 33606 - DNA, 75 bp, Artificial Sequence
  Synthetic
aaatagtactagttgtttaaaagctctcgagttatcacaaatattaatgagagaagtaagaagagataaagatag

SEQ ID NO: 33607 - DNA, 75 bp, Artificial Sequence
  Synthetic
ctcgagttatcacaaatattaatgagagaagtaagaagagataaagatagacttttcttgggagaaggggcaggg

SEQ ID NO: 33608 - DNA, 75 bp, Artificial Sequence
  Synthetic
gctatgttagcatgttatgatgctacacttggtcctgcaataaattattataattctggtttaaatattacagat

SEQ ID NO: 33609 - DNA, 75 bp, Artificial Sequence
  Synthetic
acaaatcaattggtttagtacattgtgacatggaaggagcgataggtaaatcagaagaaactgtcttacatgaac

SEQ ID NO: 33610 - DNA, 75 bp, Artificial Sequence
  Synthetic
tcactccgaactggtctaaaatactctatttatataaattgtattggaaagatgtaagtatagtatcccttaaaa

SEQ ID NO: 33611 - DNA, 75 bp, Artificial Sequence
  Synthetic
catccaatcctgcttcaacagagctgtatttgatttcaaaagatgcatattgtactgtaatggaacctagtaacc

SEQ ID NO: 33612 - DNA, 75 bp, Artificial Sequence
  Synthetic
tgtactgtaatggaacctagtaaccttgttttatcaaaacttaaaagaatatcatcgatagaagaaaataatcta

SEQ ID NO: 33613 - DNA, 75 bp, Artificial Sequence
  Synthetic
tgaaatcaaagaaggagaaagggattatgggataatgagaccatatcataccgcattacaaatctttggattcca

SEQ ID NO: 33614 - DNA, 75 bp, Artificial Sequence
  Synthetic
aatcaacttgaatcacttagctaaagaatttttatcaactcctgatttaaccaacattaaaaatataattcaaag

SEQ ID NO: 33615 - DNA, 75 bp, Artificial Sequence
  Synthetic
ttttacaagaacaatcaaagatgttatatttgaatgggtcaatataacacatgacaataagagacataaattagg

SEQ ID NO: 33616 - DNA, 75 bp, Artificial Sequence
  Synthetic
aggaagatataatttattcccacttaaaaacaaggggaaattaagattattatcacggagattagtactaagctg

SEQ ID NO: 33617 - DNA, 75 bp, Artificial Sequence
  Synthetic
gatatcattatccttatcaaccagattattgacgggtcgtttcccagatgaaaaatttgaaaatagggcacagac

SEQ ID NO: 33618 - DNA, 75 bp, Artificial Sequence
  Synthetic
tggatatgtatcattggccgatactgatttggaatcattaaagctattgtcaagaaatattatcaaaagttataa

SEQ ID NO: 33619 - DNA, 75 bp, Artificial Sequence
  Synthetic
agaacacataggattaatatcatactggtttttaactaaagaggtcaaaatactaatgaaacttataggaggggt

SEQ ID NO: 33620 - DNA, 75 bp, Artificial Sequence
  Synthetic
caagttactaggaattcctaaacagtacaaagaattagaggatcgatcatatcagggttatgaatatgataacga

SEQ ID NO: 33621 - DNA, 75 bp, Artificial Sequence
  Synthetic
atttgatattgattagtatacagatacaacaaacagaacacttaatcctcatccattcactcctagaaaaacaaa

SEQ ID NO: 33622 - DNA, 75 bp, Artificial Sequence
  Synthetic
tcactcctagaaaaacaaaaagtaagaaaaacatacaatatatatatatcaaacagagtttttctcttgtttggt

SEQ ID NO: 33623 - DNA, 75 bp, Artificial Sequence
  Synthetic
accaaacaagagaagagacttgtttaggaatattaatttaaataaaaattaacttaggattaaagaacttgaccg

SEQ ID NO: 33624 - DNA, 75 bp, Artificial Sequence
  Synthetic
tccagtttggtattgagtggtgatgcagtggaacaaattggatcaattatgaggtcccagcagagcttagtaaca

SEQ ID NO: 33625 - DNA, 75 bp, Artificial Sequence
  Synthetic
ctcggtcatccatagtcccctatgcatgggcagatgagaccagaaatgacacacaaactgagtcagccacagaaa

SEQ ID NO: 33626 - DNA, 75 bp, Artificial Sequence
  Synthetic
aaataacacaaatcaaactgaaatagatgatctgttcagtgcattcggaaacaactaactatacagaggtgatca

SEQ ID NO: 33627 - DNA, 75 bp, Artificial Sequence
  Synthetic
atccggagacggaaggacaaatccagaatccacccacaactcaatcaactcgagattcatggaagacaatgttca

SEQ ID NO: 33628 - DNA, 75 bp, Artificial Sequence
  Synthetic
ctcagatcctaacaatggagcccaaatccaggaaaatattgatcacaatgaagctggagagatggataaggactt

SEQ ID NO: 33629 - DNA, 75 bp, Artificial Sequence
  Synthetic
tcaacagcgagagcaccagtcgaacaggaccaacaaatcaaaattctcagagatcgacctctggacagagtcaca

SEQ ID NO: 33630 - DNA, 75 bp, Artificial Sequence
  Synthetic
aggaccaacaaatcaaaattctcagagatcgacctctggacagagtcacacagtgggaccaagcagaacaacccc

SEQ ID NO: 33631 - DNA, 75 bp, Artificial Sequence
  Synthetic
gagaaaataccagaaaacgacacacagatcaaatcagaaataaacagactgaatgatgaatccaatgcaaccaga

SEQ ID NO: 33632 - DNA, 75 bp, Artificial Sequence
  Synthetic
aatgaggatgtcaactcacagtgaacaactagacaaaggtcaacaccacgaagatcaacagcactagacaatcaa

SEQ ID NO: 33633 - DNA, 75 bp, Artificial Sequence
  Synthetic
tcagagatcaccctaatgcatcgaatcaaacgataaacaacaaagatatcaagattacagctaattaagaaaaac

SEQ ID NO: 33634 - DNA, 75 bp, Artificial Sequence
  Synthetic
ttaggataaaagggtcaatcaatcccccgaaacaatgagcatcaccaactccacaatctacacatttccagaatc

SEQ ID NO: 33635 - DNA, 75 bp, Artificial Sequence
  Synthetic
ctccttctcagacaatggcaacatagagccattaccgcttaaagttaatgaacagagaaaggcaatacctcatat

SEQ ID NO: 33636 - DNA, 75 bp, Artificial Sequence
  Synthetic
gctacacacaggagaagaatcaaaaacttaggatcaaagaggtcaacacaaacgccaggaaacagccaaaccaac

SEQ ID NO: 33637 - DNA, 75 bp, Artificial Sequence
  Synthetic
caacacacagaccacagacaagaagaaaaagacaccgcaaagatcaagaccaagcggaacacacacagccaaaca

SEQ ID NO: 33638 - DNA, 75 bp, Artificial Sequence
  Synthetic
agggaaagccaaagtccatcactcacaaacacaccaacaatcctgcaaataggcaccagaacagacatcaaaata

SEQ ID NO: 33639 - DNA, 75 bp, Artificial Sequence
  Synthetic
caaagagcaccagatatgatcatcacagccataattgtagccatattactaatacccctatcattctgtcaaata

SEQ ID NO: 33640 - DNA, 75 bp, Artificial Sequence
  Synthetic
cagccataattgtagccatattactaatacccctatcattctgtcaaatagacatagcaaaactgcaacgtgtag

SEQ ID NO: 33641 - DNA, 75 bp, Artificial Sequence
  Synthetic
attacaaaaggatgtgatagtagtaaatcatgaaactcacaataatactggccttaggacgaaacgattctttgg

SEQ ID NO: 33642 - DNA, 75 bp, Artificial Sequence
  Synthetic
ctaaaagaaaagggggtaaaactacaagggatagcatcactataccacacaaatataacagaaatatttactact

SEQ ID NO: 33643 - DNA, 75 bp, Artificial Sequence
  Synthetic
ataatcatagtgatgatagtaatcttattcataatcaatataataattattataatcataatcaaataccataga

SEQ ID NO: 33644 - DNA, 75 bp, Artificial Sequence
  Synthetic
ttcaatataaaaaatataaaaaacttaggaacaaagttgctcaacacagcagcaacaagtagaccagaaggcaac

SEQ ID NO: 33645 - DNA, 75 bp, Artificial Sequence
  Synthetic
tggaatactggaaacacacaaatagcacaaaagaaaccaacaatgaatccggaacagccataggcaaacacagca

SEQ ID NO: 33646 - DNA, 75 bp, Artificial Sequence
  Synthetic
actcatgatagaggtatagaacctctaaatccagacaatttctggagatgtacatctggtaatccatcgttgaca

SEQ ID NO: 33647 - DNA, 75 bp, Artificial Sequence
  Synthetic
ataataggaaatcctgctcactggcattattgaacacagatgtttatcagttatgctcgaccccgaaagttgatg

SEQ ID NO: 33648 - DNA, 75 bp, Artificial Sequence
  Synthetic
aggaagattgcttttattaggtgacagaatatacatatatactaggtccacaagttggcacagtaaattacaatt

SEQ ID NO: 33649 - DNA, 75 bp, Artificial Sequence
  Synthetic
aggggtaattgacatttctgattacaataatataagaataaattggacttggcataatgtactatcacgaccagg

SEQ ID NO: 33650 - DNA, 75 bp, Artificial Sequence
  Synthetic
ccaaagaactgtagctaaactgactctcgcatatcgagtgccagatgatatacaaagaaatcacaaaacagacat

SEQ ID NO: 33651 - DNA, 75 bp, Artificial Sequence
  Synthetic
tattagcgaataacatagggaaattctttcaagagaatgggatggttaaaggggaaattgaactacttaaaagac

SEQ ID NO: 33652 - DNA, 75 bp, Artificial Sequence
  Synthetic
tatgacggaaggattcttcctcaggcgttaaaagcattgtctagatgtgttttttggtctgaaacaatcatagat

SEQ ID NO: 33653 - DNA, 75 bp, Artificial Sequence
  Synthetic
tagtcagtgataagattaagtatgaagatatgtgctcagtagacctagctatatcattaaggcaaaaaatgtgga

SEQ ID NO: 33654 - DNA, 75 bp, Artificial Sequence
  Synthetic
gttattgcaaatgatgatgatattaacagtctgataactgaatttctgaccctcgatatactagtgtttctcaaa

SEQ ID NO: 33655 - DNA, 75 bp, Artificial Sequence
  Synthetic
taagtatctgagaatccgtggaattaatccgcccgaaacaattgaagattgggatcccatagaagatgagaatgt

SEQ ID NO: 33656 - DNA, 75 bp, Artificial Sequence
  Synthetic
gggatcccatagaagatgagaatgttttagacaatattgttcgaactgtaaatgataattgcattgataatcaaa

SEQ ID NO: 33657 - DNA, 75 bp, Artificial Sequence
  Synthetic
gtgattggtcaacgagaattaaaaatcttcccatcagaagtatcattagtaggtaaaaaactaggaaatgtaaca

SEQ ID NO: 33658 - DNA, 75 bp, Artificial Sequence
  Synthetic
ttaaaatggataatcttatcaaagaggaagaataacgaatggttacagcatgaaatcaaagaaggagaaagggat

SEQ ID NO: 33659 - DNA, 75 bp, Artificial Sequence
  Synthetic
atttgatattgattagtatacaaatacaacaaacaaaacacttaatcctcatccgttcactcctagaagaacaaa

SEQ ID NO: 33660 - DNA, 75 bp, Artificial Sequence
  Synthetic
tcactcctagaagaacaaaaagtaagaaaaacatacaatatatatataccaaacagagtttttctcttgtttggt

SEQ ID NO: 33661 - DNA, 75 bp, Artificial Sequence
  Synthetic
gcagctctaactctgtctacccttagaccggatatcaacagactcaaggcactgatcgagttatatctatcaaag

SEQ ID NO: 33662 - DNA, 75 bp, Artificial Sequence
  Synthetic
ctctggagttatgcgatgggtgtagcagttgtacaaaacaaggccatgcaacagtatgtaacaggaaggtcttat

SEQ ID NO: 33663 - DNA, 75 bp, Artificial Sequence
  Synthetic
cagttgtacaaaacaaggccatgcaacagtatgtaacaggaaggtcttatctggatattgaaatgttccaacttg

SEQ ID NO: 33664 - DNA, 75 bp, Artificial Sequence
  Synthetic
acctttcataagcctacagggggatcagccatagaaatggcgatagatgaagaagcagggcagcctgaatccaga

SEQ ID NO: 33665 - DNA, 75 bp, Artificial Sequence
  Synthetic
ggagatcaggatcaaggagatgagcctcggtcatccatagttccttatgcatgggcagacgaaaccgggaatgac

SEQ ID NO: 33666 - DNA, 75 bp, Artificial Sequence
  Synthetic
ctcggtcatccatagttccttatgcatgggcagacgaaaccgggaatgacaatcaaactgaatcaactacagaaa

SEQ ID NO: 33667 - DNA, 75 bp, Artificial Sequence
  Synthetic
aaacatcagagacaggctgaacaaaagactcaacgagaaaaggaaacagagtgacccgagatcaactgacatcac

SEQ ID NO: 33668 - DNA, 75 bp, Artificial Sequence
  Synthetic
gatgatttgttcagtgcattcggaagcaactagtcacaaagagatgaccactatcaccagcaacaagtaagaaaa

SEQ ID NO: 33669 - DNA, 75 bp, Artificial Sequence
  Synthetic
tcccaagagaacacggcagacagcaatgaaatcaacacaggaaccacaagacttagcacgacaatctaccaacct

SEQ ID NO: 33670 - DNA, 75 bp, Artificial Sequence
  Synthetic
ccagaacagtgacaagggaattaaaaaaggggttggaaggccaaaagacacagacaaacaatcatcaatattgga

SEQ ID NO: 33671 - DNA, 75 bp, Artificial Sequence
  Synthetic
aagaagagccagaaaatcctcaaagccagcacgaatacaggagaaccaacaagaccacagaatggatcccagggg

SEQ ID NO: 33672 - DNA, 75 bp, Artificial Sequence
  Synthetic
tagacttcctagcaggtttgatgataggagtgtcaatggatcatgataccaaattaaatcagattcagaacgaga

SEQ ID NO: 33673 - DNA, 75 bp, Artificial Sequence
  Synthetic
aggagtgtcaatggatcatgataccaaattaaatcagattcagaacgagatattaagtttgaaaactgatcttaa

SEQ ID NO: 33674 - DNA, 75 bp, Artificial Sequence
  Synthetic
ggagggaagaaggaccaaccagaacctagcgggaggacatccatgatcaagacaaaagcaaaagaagagaaaata

SEQ ID NO: 33675 - DNA, 75 bp, Artificial Sequence
  Synthetic
ttagtacctagaagaataagcagtacaatgagatcattaataataatcattaacaacagcaatttatcatcaaaa

SEQ ID NO: 33676 - DNA, 75 bp, Artificial Sequence
  Synthetic
tcagagaccaccccaatacaccaaaccaatcaacacataacaaagatctccagatcatagatgattaagaaaaac

SEQ ID NO: 33677 - DNA, 75 bp, Artificial Sequence
  Synthetic
cagatcatagatgattaagaaaaacttaggatgaaaggactaatcaatcctccgaaacaatgagcatcaccaact

SEQ ID NO: 33678 - DNA, 75 bp, Artificial Sequence
  Synthetic
atctgctatcccctaatggatctgaatccacacttaaattcagttatatgggcatcatcagttgaaattacaagg

SEQ ID NO: 33679 - DNA, 75 bp, Artificial Sequence
  Synthetic
aaaatcagacagtaaaatcaacaaccctgatatccaacattgcaaatcaggctacccacaggagaaaaatcaaaa

SEQ ID NO: 33680 - DNA, 75 bp, Artificial Sequence
  Synthetic
acttaggatcaaagggatcaccacgaaccccggaaaacagccaaacaaaccaacacacaaatcacagacaaaaag

SEQ ID NO: 33681 - DNA, 75 bp, Artificial Sequence
  Synthetic
gagaaggcactgcaaagaccgagaaaaaacagaacgcacacaaccaagcagagaaaagccaaagcccgccattca

SEQ ID NO: 33682 - DNA, 75 bp, Artificial Sequence
  Synthetic
caaacacaccaacaatcctgcaaacaagcaccaaaacagaggtcaaaagacaaagagcaccagatatgaccatca

SEQ ID NO: 33683 - DNA, 75 bp, Artificial Sequence
  Synthetic
caaccacaatcatagccatattactaatacccccatcattttgtcaaatagacataacaaaactgcaacgtgtag

SEQ ID NO: 33684 - DNA, 75 bp, Artificial Sequence
  Synthetic
gacataacaaaactgcaacgtgtaggtgtgttagtcaacaatcctaaaggcatgaagatttcacaaaatttcgaa

SEQ ID NO: 33685 - DNA, 75 bp, Artificial Sequence
  Synthetic
agtcatgaaacccacaacaatactaatcttaggacaaaacgattctttggagagataattgggacaattgcgata

SEQ ID NO: 33686 - DNA, 75 bp, Artificial Sequence
  Synthetic
gggatagccacttcagcacaaatcaccgcagcagtcgctcttgtcgaagctaaacaggcaaagtcagacatagaa

SEQ ID NO: 33687 - DNA, 75 bp, Artificial Sequence
  Synthetic
ctgaaagaaaaagggataaaattacaagggatagcatcattatatcacacaaacataacggaaatatttactact

SEQ ID NO: 33688 - DNA, 75 bp, Artificial Sequence
  Synthetic
tagttataatcaatataacaattattgtagtcataatcaaattccatagaattcaggggaaagatcaaaacgaca

SEQ ID NO: 33689 - DNA, 75 bp, Artificial Sequence
  Synthetic
taggaacaaagttgttcaacacagcagcaccgaatagaccaaaaggcagcgcagaggcgacaccaaactcaaaaa

SEQ ID NO: 33690 - DNA, 75 bp, Artificial Sequence
  Synthetic
tggaatattggaaacacacaaacagcataaataacaccaacaatgaaaccgaaacagccagaggcaaacatagta

SEQ ID NO: 33691 - DNA, 75 bp, Artificial Sequence
  Synthetic
gaaacagccagaggcaaacatagtagcaaggttacaaatatcataatgtacaccttctggacaataacattaaca

SEQ ID NO: 33692 - DNA, 75 bp, Artificial Sequence
  Synthetic
tactacagtaaatggctgtattagaattccatcgttagtaatcaatcatctaatctatgcttacacctctaatct

SEQ ID NO: 33693 - DNA, 75 bp, Artificial Sequence
  Synthetic
cctagtacctgatttaaaccccagagtcacacatacatttaatattgatgataatagaagatcttgctctctggc

SEQ ID NO: 33694 - DNA, 75 bp, Artificial Sequence
  Synthetic
cacaggagacgatgcaagatataaagaaataataaaaaacttaggagaaaagtgtgcaagaaaaatggacaccga

SEQ ID NO: 33695 - DNA, 75 bp, Artificial Sequence
  Synthetic
gaaataataaaaaacttaggagaaaagtgtgcaagaaaaatggacaccgagtcccacagcggcacaacatctgac

SEQ ID NO: 33696 - DNA, 75 bp, Artificial Sequence
  Synthetic
attctcctatagttaaaggaaagatagcacaactgcatacaataatgagtttgcctcagccctacgatatggatg

SEQ ID NO: 33697 - DNA, 75 bp, Artificial Sequence
  Synthetic
gataaaagacaacggtcaattaggaaattaagatcagtcttaatggaaagagtaagtgatctaggtaaatatacc

SEQ ID NO: 33698 - DNA, 75 bp, Artificial Sequence
  Synthetic
attggatcctaagttacaatcaatgtattataagggtaacaatttatgggaaataatagatggactattctcgac

SEQ ID NO: 33699 - DNA, 75 bp, Artificial Sequence
  Synthetic
cttaggagaaagaacatttgacataatatcactattagaaccacttgcattatcgctcattcaaacttatgaccc

SEQ ID NO: 33700 - DNA, 75 bp, Artificial Sequence
  Synthetic
tatcgctcattcaaacttatgacccggttaaacagctcaggggggcttttttaaatcacgtgttatcagaaatgg

SEQ ID NO: 33701 - DNA, 75 bp, Artificial Sequence
  Synthetic
cgagtatagcagcagagaaagttagaaagtatatgtatactgagaaatgcttgaaatttgatactatcaataaat

SEQ ID NO: 33702 - DNA, 75 bp, Artificial Sequence
  Synthetic
tataaatggatatagagaaagacatggtggtcaatggcctccagttacattacctgtccatgcacatgaatttat

SEQ ID NO: 33703 - DNA, 75 bp, Artificial Sequence
  Synthetic
ggagaaattgaattactcaagagactaacaacaatatctatgtctggagttccgcggtataatgaggtatacaat

SEQ ID NO: 33704 - DNA, 75 bp, Artificial Sequence
  Synthetic
ggaatagaagggttttgccaaaagttatggacactcatatctatcagtgcaatacatttagcagctgtcaaaatc

SEQ ID NO: 33705 - DNA, 75 bp, Artificial Sequence
  Synthetic
gattataaagttaagaaagagattgtttataaagatgtggtaagattttttgattccttgagagaggtgatggat

SEQ ID NO: 33706 - DNA, 75 bp, Artificial Sequence
  Synthetic
tgcctccttaatccctgctagtgtcggaggatttaattatatggccatgtcaaggtgttttgtcagaaacattgg

SEQ ID NO: 33707 - DNA, 75 bp, Artificial Sequence
  Synthetic
ggaggatttaattatatggccatgtcaaggtgttttgtcagaaacattggagatcctacagtcgctgcgttagcc

SEQ ID NO: 33708 - DNA, 75 bp, Artificial Sequence
  Synthetic
atttgttagatcgaggtgtcctttacagaattatgaatcaagaaccaggcgagtcttcttttttagactgggcct

SEQ ID NO: 33709 - DNA, 75 bp, Artificial Sequence
  Synthetic
atgatagaagaggatgaggaattagctgagttcctaatggacaggagaataatcctcccaagagttgcacatgac

SEQ ID NO: 33710 - DNA, 75 bp, Artificial Sequence
  Synthetic
gacaggaatagcatcattaagggtcccttactttggatcagttacagatgagagatctgaagcacaattagggta

SEQ ID NO: 33711 - DNA, 75 bp, Artificial Sequence
  Synthetic
cagattgcacaaacacgtgcaaactttacattggatagcttaaagattttgacaccagtgacaacatcaacaaat

SEQ ID NO: 33712 - DNA, 75 bp, Artificial Sequence
  Synthetic
tggtcctaatactgctagtcaagatcaagttaagcttgctctctcgatttgcgagtactccttggatctatttat

SEQ ID NO: 33713 - DNA, 75 bp, Artificial Sequence
  Synthetic
tagcatcttttggaccaaatttattaaatctaacatatctagagagacttgatgaattaaaacaatacttagatc

SEQ ID NO: 33714 - DNA, 75 bp, Artificial Sequence
  Synthetic
cacatcagctgaggttatttggagtaaacagtacaagttgtcttaaagctcttgaattatcacaaatcttaatga

SEQ ID NO: 33715 - DNA, 75 bp, Artificial Sequence
  Synthetic
agtttaatatggagtgaattaaatgataagtcaattggtttagtacattgtgacatggagggagcgataggcaaa

SEQ ID NO: 33716 - DNA, 75 bp, Artificial Sequence
  Synthetic
tcagaagaaactgttctacatgaacattatagtattattaggattacatatttaatcggggatgatgatgttgtc

SEQ ID NO: 33717 - DNA, 75 bp, Artificial Sequence
  Synthetic
atcatcaatagaagaaaataatctattaaagtggataatcttatcaaaaaggaagaataacgagtggttacagca

SEQ ID NO: 33718 - DNA, 75 bp, Artificial Sequence
  Synthetic
aggaagatataatctattcccgcttaaaaataaggggaaattaagattattatcacgaagattagtactaagctg

SEQ ID NO: 33719 - DNA, 75 bp, Artificial Sequence
  Synthetic
gatatcattatccttatcaaccagattactgacgggccgttttccagatgaaaaatttgaaaatagggcacagac

SEQ ID NO: 33720 - DNA, 75 bp, Artificial Sequence
  Synthetic
cggatatgtatcattggctgatattgatttagaatccttaaagttattatcaagaaatattgtcaaaaattacaa

SEQ ID NO: 33721 - DNA, 75 bp, Artificial Sequence
  Synthetic
agaacacataggattaatatcatactggtttttgaccaaagaggtcaaaatactaatgaagcttataggaggagt

SEQ ID NO: 33722 - DNA, 75 bp, Artificial Sequence
  Synthetic
atttgatattgattaatacataaaaacataaaataaaacacctattcctcacccattcacttccaacaaaatgaa

SEQ ID NO: 33723 - DNA, 75 bp, Artificial Sequence
  Synthetic
tcacttccaacaaaatgaaaagtaagaaaaacatgtaatatatatataccaaacagagtttttctcttgtttggt

SEQ ID NO: 33724 - DNA, 75 bp, Artificial Sequence
  Synthetic
accaaacaagagaagagacttgcttggaaatacaaattcaaatcaaaattaacttaggattaaagaactttactg

SEQ ID NO: 33725 - DNA, 75 bp, Artificial Sequence
  Synthetic
agactcaatgagaagagaaaacagaacgaactaagatcagatgacatcacaaacaacacaaatcagactgaaata

SEQ ID NO: 33726 - DNA, 75 bp, Artificial Sequence
  Synthetic
gaagagggaacaggagataaatcatctaacatctcatcggccctcgacatcattgaattcatactcagcaccgat

SEQ ID NO: 33727 - DNA, 75 bp, Artificial Sequence
  Synthetic
gaagagcttttgatgaaaaataagaagccaagaaagtaccagtcaataccccagagagatgataaagaaattaaa

SEQ ID NO: 33728 - DNA, 75 bp, Artificial Sequence
  Synthetic
agccaagaaagtaccagtcaataccccagagagatgataaagaaattaaaaagggggttggaagacaaatcgaga

SEQ ID NO: 33729 - DNA, 75 bp, Artificial Sequence
  Synthetic
gtgatagttgtaaatcatgaatctcacaataatactaatctcagaacaaagcgattctttggagagataattgga

SEQ ID NO: 33730 - DNA, 75 bp, Artificial Sequence
  Synthetic
tggacaacaacatcgatcatgctgttaataatcttcataatgatattagtggacttgattcaggaaaataatcaa

SEQ ID NO: 33731 - DNA, 75 bp, Artificial Sequence
  Synthetic
attggtgtctctatacagtcaggaatcaacacaagactcctcacaattcaaagtcatgttcaaaattatattcca

SEQ ID NO: 33732 - DNA, 75 bp, Artificial Sequence
  Synthetic
aagcttagacacatttcaacctatgctattcaaaacagaagttccaaagaattgcaattagattgacgtcaatct

SEQ ID NO: 33733 - DNA, 75 bp, Artificial Sequence
  Synthetic
attgcaattagattgacgtcaatctaccaggtgttgaacaaaccacaaaaaaattatcaggcggactatccagaa

SEQ ID NO: 33734 - DNA, 75 bp, Artificial Sequence
  Synthetic
taaaacatggtttacaatcaagtatgacatgaggagactgcaaaaagccaaaaacgagataacatgtagtaggac

SEQ ID NO: 33735 - DNA, 75 bp, Artificial Sequence
  Synthetic
atgacatataaaatgagggcaacccaagtattagcagaaacactactagcaaacaatataggaaaatttttccaa

SEQ ID NO: 33736 - DNA, 75 bp, Artificial Sequence
  Synthetic
tggttgaatggggcatcacttgagatttatatctgtgatagtgatatggaaatagctaatgatagaagacaagca

SEQ ID NO: 33737 - DNA, 75 bp, Artificial Sequence
  Synthetic
attgcaataacaatcagaaaaagaataaaaccaattatttctggggattggctttaaagaattatcaagtcataa

SEQ ID NO: 33738 - DNA, 75 bp, Artificial Sequence
  Synthetic
gaaggagcaataggtaaatcagaggagactgtattacatgaacattatagcattattagaattacatatttgatc

SEQ ID NO: 33739 - DNA, 75 bp, Artificial Sequence
  Synthetic
agggtaagttaaaactaatatcgcgaagattaatcttaagttggatatcattatctttatcaactaggttattga

SEQ ID NO: 33740 - DNA, 75 bp, Artificial Sequence
  Synthetic
tcaatacacttaatccctgtctgtctgtactcaacaaagagagaagtaagaaaaacataaaatatatatatacca

SEQ ID NO: 33741 - DNA, 75 bp, Artificial Sequence
  Synthetic
ctgtactcaacaaagagagaagtaagaaaaacataaaatatatatataccaaacagagtttttctcttgtttggt

SEQ ID NO: 33742 - DNA, 75 bp, Artificial Sequence
  Synthetic
atgtttggaagtgatcttgagtatgatcaagataatatgttacagaacggtaggagcacttccacgattgaagat

SEQ ID NO: 33743 - DNA, 75 bp, Artificial Sequence
  Synthetic
ataaccagtatctcaggattgagaaaaggtttttttacccagttagaggcgtttagacaagacgggacagtcaaa

SEQ ID NO: 33744 - DNA, 75 bp, Artificial Sequence
  Synthetic
cagctatagaaatggcaatagacgaggagatagaacaaccagaatccagaggagaccaggatcaaactgatgatc

SEQ ID NO: 33745 - DNA, 75 bp, Artificial Sequence
  Synthetic
ctcagtcatccataatcccctatgcatgggcagatgaggtaagcaacaaaaaccaagcagggtcaaccacagacg

SEQ ID NO: 33746 - DNA, 75 bp, Artificial Sequence
  Synthetic
ctaacagcctcggagttgagcaaagaaacatcagagatagattgaacaaaaggcttaacgaaaaaagaagacaga

SEQ ID NO: 33747 - DNA, 75 bp, Artificial Sequence
  Synthetic
atgaatcaaaatcaactgacataacaaataatgctgatcagactgagatagatgacctgttcagcgcattcggaa

SEQ ID NO: 33748 - DNA, 75 bp, Artificial Sequence
  Synthetic
aaataatgctgatcagactgagatagatgacctgttcagcgcattcggaagtaactgattaaataatggtgatta

SEQ ID NO: 33749 - DNA, 75 bp, Artificial Sequence
  Synthetic
acttaggattaacggagattatccaatcctgacacagcagaccaagaccagactccatccacaacccaaccgatc

SEQ ID NO: 33750 - DNA, 75 bp, Artificial Sequence
  Synthetic
cattgaattcatactcagcaccgatccccaagaaagcgcggtcagcgacaatgagaacggcgcaggggtcacaag

SEQ ID NO: 33751 - DNA, 75 bp, Artificial Sequence
  Synthetic
gaccacagcaacaccagatgatgaagaggagcttctctcgaaaaacaaaaggtcaaaaaggtaccagctaacaaa

SEQ ID NO: 33752 - DNA, 75 bp, Artificial Sequence
  Synthetic
atccagattggactacgaacccgacttcaaaggatcgaagaggaaccagaggaccctcaagaccagcacagatgc

SEQ ID NO: 33753 - DNA, 75 bp, Artificial Sequence
  Synthetic
gggtcccaaaggaagagaatcacatcctggaacatcctcaacaacaagagcagcaatcgagaggaacagacagtc

SEQ ID NO: 33754 - DNA, 75 bp, Artificial Sequence
  Synthetic
cagcaatcgagaggaacagacagtcagaaatccccaacgatcagcatacggacagaagcaaacaatgttatcaga

SEQ ID NO: 33755 - DNA, 75 bp, Artificial Sequence
  Synthetic
agaaatccccaacgatcagcatacggacagaagcaaacaatgttatcagacagatcagctcccgaacaacaaatc

SEQ ID NO: 33756 - DNA, 75 bp, Artificial Sequence
  Synthetic
aaagcacagaagacgaacggagaggaaagaaaggacacagaagagagcactcaatttacagaaagggcgattaca

SEQ ID NO: 33757 - DNA, 75 bp, Artificial Sequence
  Synthetic
cacatcagcaaaccaaagattatcccaaaccaccaagtcaatcaacacaccacagtagttcccagacacaagcca

SEQ ID NO: 33758 - DNA, 75 bp, Artificial Sequence
  Synthetic
agtctgtggttctggatctctaccacttgggctagcaaaatacactgggaatgatcaggaactcctacaagccgc

SEQ ID NO: 33759 - DNA, 75 bp, Artificial Sequence
  Synthetic
atgatcaggaactcctacaagccgcaattaagttagatatagaagtgagaagaactgtcaaagccacggagatga

SEQ ID NO: 33760 - DNA, 75 bp, Artificial Sequence
  Synthetic
agattaagaaaagggatgttatttgacgccaacaaagttgcgcttgcaccccagtgtcttccactcgatagaggg

SEQ ID NO: 33761 - DNA, 75 bp, Artificial Sequence
  Synthetic
gctttgctatcattgccaaacaccatatcaataaacttacaggtacacataaaaacaggaatccaaactgactct

SEQ ID NO: 33762 - DNA, 75 bp, Artificial Sequence
  Synthetic
atgtcaatgcaactgggtctatttcgaagacgttggcgagtcaactagcgttcaaaagggaaatctgttatcctc

SEQ ID NO: 33763 - DNA, 75 bp, Artificial Sequence
  Synthetic
ttcaaaagggaaatctgttatcctctcatggatttaaacccacacctaaatctggttatatgggcatcatcagtt

SEQ ID NO: 33764 - DNA, 75 bp, Artificial Sequence
  Synthetic
aaaggagtcggaaaaatcaagcagtaacaccgacagcctggacaagcaacactacaaatcagatcattcaaaaaa

SEQ ID NO: 33765 - DNA, 75 bp, Artificial Sequence
  Synthetic
acgaacagagcagaagaggcaccaggggaagaaacaacaaacaggaaaggggaaggaacagcagaaaacaggggc

SEQ ID NO: 33766 - DNA, 75 bp, Artificial Sequence
  Synthetic
aaacaccaaagaacaaaggaacaccaccaacgaacacaccagcaaccccacaacagaacacaggaaaaaagaaca

SEQ ID NO: 33767 - DNA, 75 bp, Artificial Sequence
  Synthetic
caacagaacacaggaaaaaagaacagaaaacaaagagtatcaaagatgatcactatagttgcaacaacagtcaca

SEQ ID NO: 33768 - DNA, 75 bp, Artificial Sequence
  Synthetic
aaaggcatgaagatttcacaaaattttgaaacaagatacttaatattaagtttgataccaaagatagagaaccca

SEQ ID NO: 33769 - DNA, 75 bp, Artificial Sequence
  Synthetic
caatcatgtggagaccaacaaataaatcaatataagaaattattagatagattaattattcctttatatgatggg

SEQ ID NO: 33770 - DNA, 75 bp, Artificial Sequence
  Synthetic
attaattattcctttatatgatgggttaaaattacagaaagatgtaatcgtagtaaggcatgagtctaataacag

SEQ ID NO: 33771 - DNA, 75 bp, Artificial Sequence
  Synthetic
ttgttgcggttaagtcagttcaagattatgtcaacaatgagattgtaccatcaatagcaagactaggctgtgaag

SEQ ID NO: 33772 - DNA, 75 bp, Artificial Sequence
  Synthetic
cagcaggattacaactaggaattgcattgacacaacattactcagagttaacaaatatatttggtgataacatag

SEQ ID NO: 33773 - DNA, 75 bp, Artificial Sequence
  Synthetic
cctcttcccaatcacatcatgacaaagggggcatttttaggtggcgctgatataaaagagtgtatagaagcattc

SEQ ID NO: 33774 - DNA, 75 bp, Artificial Sequence
  Synthetic
caggttttatattaaatcgtgagatagaaaactgtctatcagggaatatcacgcagtgtccgaagaccgtcgtta

SEQ ID NO: 33775 - DNA, 75 bp, Artificial Sequence
  Synthetic
aacaaagctaaattggaactagaaaaatcaaaagaatggataaagaagtcaaatcaaaagttggactctgttgga

SEQ ID NO: 33776 - DNA, 75 bp, Artificial Sequence
  Synthetic
atcattataataatctttaaacaattcaagattagcaatagacacccaatcgacaatagcaatgaaccctatgtc

SEQ ID NO: 33777 - DNA, 75 bp, Artificial Sequence
  Synthetic
ctgaccaggaaacagtagggaaatgtagcaccaaacatcaaaggtataaaaaacttaggaacaaagcagttccac

SEQ ID NO: 33778 - DNA, 75 bp, Artificial Sequence
  Synthetic
tagcaccaaacatcaaaggtataaaaaacttaggaacaaagcagttccacccagagacaaagaacaaacaactcg

SEQ ID NO: 33779 - DNA, 75 bp, Artificial Sequence
  Synthetic
gaatcccaacctcaaaaatggaatattggaggcacacaaacaacgccaaaaacaccaacaccgaattccaaacag

SEQ ID NO: 33780 - DNA, 75 bp, Artificial Sequence
  Synthetic
aacaaaatagcatcacaacaaatgagaagagaatttgcagaaatcgagagaaaaattcagcaagctacagatgaa

SEQ ID NO: 33781 - DNA, 75 bp, Artificial Sequence
  Synthetic
aaaaattcagcaagctacagatgaaatcggtacatcaatacaatcgggaataaacacgagactcctaactatcca

SEQ ID NO: 33782 - DNA, 75 bp, Artificial Sequence
  Synthetic
acagcgggattgaacctctaaatcctgacaaattctggagatgtacctctggcaatccatccttggcaagtaacc

SEQ ID NO: 33783 - DNA, 75 bp, Artificial Sequence
  Synthetic
atggtgatgtaatatgcaatttaactggctgtccaggcaaaacacagagagactgcaaccaggcctcctacagcc

SEQ ID NO: 33784 - DNA, 75 bp, Artificial Sequence
  Synthetic
gactgcaaccaggcctcctacagcccatggttttcaaataggagaatggtgaattctattattgttgttaataaa

SEQ ID NO: 33785 - DNA, 75 bp, Artificial Sequence
  Synthetic
acatatatactagatctacaagttggcatagtaaactccaattagggacaattgatattaacaattatagtgata

SEQ ID NO: 33786 - DNA, 75 bp, Artificial Sequence
  Synthetic
ttattcaaaacagaaattccaaagaactgtagttgagttgactctcccatgttaatcatcaaacacagaagacag

SEQ ID NO: 33787 - DNA, 75 bp, Artificial Sequence
  Synthetic
gcatcaacaggtgggggattcaaaaaatgagatgacaaataggggaaaaataaaaaacttaggagaaaagtttgt

SEQ ID NO: 33788 - DNA, 75 bp, Artificial Sequence
  Synthetic
aatagcagaataaatgaattattaagtaaagcacataggacttataatcaaatgactgatggattaaggaattta

SEQ ID NO: 33789 - DNA, 75 bp, Artificial Sequence
  Synthetic
tattttttgtacaatcatcataaatgggtatagagaaagacacggaggacaatggcctccaattacactgcctgc

SEQ ID NO: 33790 - DNA, 75 bp, Artificial Sequence
  Synthetic
catatgaaaatgctgttgattactatagaagctttataggaattaaattcaacaaatttatagaaccccaattag

SEQ ID NO: 33791 - DNA, 75 bp, Artificial Sequence
  Synthetic
cctcaaacttattgtatcgtactagtacatcccatgattcaagaaggttagttgaggtttttatagcagatagta

SEQ ID NO: 33792 - DNA, 75 bp, Artificial Sequence
  Synthetic
aatttgaccctcatcaggtattagattatgtggagtcaggagaatggttgaatgatcctgagttcaatatctcat

SEQ ID NO: 33793 - DNA, 75 bp, Artificial Sequence
  Synthetic
atgacatataaaatgagagctgcgcaagttttgtcagaaacgttactagcaaacaacatagggaaattctttcag

SEQ ID NO: 33794 - DNA, 75 bp, Artificial Sequence
  Synthetic
ttacaacgcaattagtaattctaatttatcttctaaccaaaaatcaagaagattcgaattcaagtcaacagacat

SEQ ID NO: 33795 - DNA, 75 bp, Artificial Sequence
  Synthetic
acggttgccgcattggcggatattaaaagatttataaaagcaaatctgttggatcgtggtgttctttatcgaatt

SEQ ID NO: 33796 - DNA, 75 bp, Artificial Sequence
  Synthetic
gagtataggatcagccgaaaaagggattgcatcattaagagtcccttactttgggtcggtaacagatgagagatc

SEQ ID NO: 33797 - DNA, 75 bp, Artificial Sequence
  Synthetic
ggacacaatcctatggttatgcatctacatatagaagacgggtgttgtattaaagaaagttataatgatgatcat

SEQ ID NO: 33798 - DNA, 75 bp, Artificial Sequence
  Synthetic
acagatattatacacgcagtatcaatatgtacagcaaatcacaatagcagacaccatgtcacagctgaccgggac

SEQ ID NO: 33799 - DNA, 75 bp, Artificial Sequence
  Synthetic
ttctcttgatttatttatgagagaatggctgaatggtgcatcgcttgaaatctatatttgcgatagtgacatgga

SEQ ID NO: 33800 - DNA, 75 bp, Artificial Sequence
  Synthetic
catagaagatgagaatatattagataatattgttaggactgtgaatgataactgtgacaataatccaaggaaatg

SEQ ID NO: 33801 - DNA, 75 bp, Artificial Sequence
  Synthetic
ggataagatctataaccagtgatcctgaagtctatgagacctcagacgatattgaacatggattgacacttcctg

SEQ ID NO: 33802 - DNA, 75 bp, Artificial Sequence
  Synthetic
taaaagagataaggatagacttttcctaggagagggagcaggtgctatgctagcatgttatgatgctacacttgg

SEQ ID NO: 33803 - DNA, 75 bp, Artificial Sequence
  Synthetic
tcccgcaataaattattacaattctggtctaaatattacagatgtaattggtcaaagagaattaaaaatcttccc

SEQ ID NO: 33804 - DNA, 75 bp, Artificial Sequence
  Synthetic
atcagaagtctcactagtaggtaagaaactaggtaatgtgacacagatcctcaatcgtgtgaaagtattatttaa

SEQ ID NO: 33805 - DNA, 75 bp, Artificial Sequence
  Synthetic
cgggaatcctaactcaacatggataggaaatatggaatgtgaaagtttaatatggagtgaattaaatgacaaatc

SEQ ID NO: 33806 - DNA, 75 bp, Artificial Sequence
  Synthetic
aattggtttagtacattgtgatatggaaggagcaataggcaaatcagaggaaactgtcctacatgaacactatag

SEQ ID NO: 33807 - DNA, 75 bp, Artificial Sequence
  Synthetic
aaactgtcctacatgaacactatagtattattagaatcacatatttagttggagatgatgatgttatcttggtat

SEQ ID NO: 33808 - DNA, 75 bp, Artificial Sequence
  Synthetic
aaattggtctaaaatacttcatttatataaattgtattggaaggatgtgagaatcatatcccttaagacatctaa

SEQ ID NO: 33809 - DNA, 75 bp, Artificial Sequence
  Synthetic
tgatggagcccagtaatcttgtgttatcaaaactcagaagaatatcatcaatagaagagaataatctactaaagt

SEQ ID NO: 33810 - DNA, 75 bp, Artificial Sequence
  Synthetic
agaacagtaaaagatgttatattcgaatgggtaaacataactcatgacaacaaaagacataaattaggagggaaa

SEQ ID NO: 33811 - DNA, 75 bp, Artificial Sequence
  Synthetic
tcttatcagagattataaagaacacataggattaatatcatattggtttctaaccaaagagatcaaaatactgat

SEQ ID NO: 33812 - DNA, 75 bp, Artificial Sequence
  Synthetic
attgattaatgtataaatctagtaaatagtgtacttaatccccatctgtatatattaagaaaaacaaacaataag

SEQ ID NO: 33813 - DNA, 75 bp, Artificial Sequence
  Synthetic
atatattaagaaaaacaaacaataagaaaaacatatgatatatatataccaaacagagtttttctcttgtttggt

SEQ ID NO: 33814 - DNA, 75 bp, Artificial Sequence
  Synthetic
accaaacaaggggagagacttgtttggaaatatgaatttaaatagaaattaacttaggattaaagaactttaccg

SEQ ID NO: 33815 - DNA, 75 bp, Artificial Sequence
  Synthetic
acagtctctatatttgcccttggtccctcaataacagatgacaatgataaaatgacattggctctcctattctta

SEQ ID NO: 33816 - DNA, 75 bp, Artificial Sequence
  Synthetic
cttgttcacacatttgggtatccagcatgccttggagctcttataatccagatttggataatacttgttaaagct

SEQ ID NO: 33817 - DNA, 75 bp, Artificial Sequence
  Synthetic
ataaccagtatctcaggattgagaaaaggtttttttactcggttagaggcatttagacaagatgggacagtcaaa

SEQ ID NO: 33818 - DNA, 75 bp, Artificial Sequence
  Synthetic
ttttaagggatcctattcatggcgagtttgcaccaggcaattatcctgctctctggagttatgcaatgggtgtag

SEQ ID NO: 33819 - DNA, 75 bp, Artificial Sequence
  Synthetic
ctctggagttatgcaatgggtgtagcagttgtccagaacaaagctatgcaacaatatgtgacaggacggtcctat

SEQ ID NO: 33820 - DNA, 75 bp, Artificial Sequence
  Synthetic
acttaggattaacggagattatccaatcctgacacagcagaccaagactagactccatctacaacccaaccgatc

SEQ ID NO: 33821 - DNA, 75 bp, Artificial Sequence
  Synthetic
gcgaatgtcctcaacaatgcagatactgcatcgaagatcgattttttagcgggtctgatgattggggtatcgatg

SEQ ID NO: 33822 - DNA, 75 bp, Artificial Sequence
  Synthetic
atcattaatttcgaatcttaagattatgacagagagaggaggaaagaaagatcaggttgagacaagtggaagaac

SEQ ID NO: 33823 - DNA, 75 bp, Artificial Sequence
  Synthetic
acataaatgaactcaagctctgcaagagtgatgaagaagtatctgaattgatggatatgtttaacgaagacatca

SEQ ID NO: 33824 - DNA, 75 bp, Artificial Sequence
  Synthetic
atggatatgtttaacgaagacatcagctcccaatagacagccaaatgacaaccaccaccacagaacacactgata

SEQ ID NO: 33825 - DNA, 75 bp, Artificial Sequence
  Synthetic
aagggggttgtccagatcttagatgaaaaaggtgagaaatcgttaaactttatggtccatcttggattaattaaa

SEQ ID NO: 33826 - DNA, 75 bp, Artificial Sequence
  Synthetic
atgtcaatgcaactgggtccatttcgaaaacgttggcgagtcaactagcgttcaaaagggaaatctgttatcctc

SEQ ID NO: 33827 - DNA, 75 bp, Artificial Sequence
  Synthetic
ccaaaatcaaaaacttaggattaaagagatcacccagatttcacaagcgcaaccaaaccagcatccagagacaac

SEQ ID NO: 33828 - DNA, 75 bp, Artificial Sequence
  Synthetic
cactatagttgcaacaacagttatattattattacctttatcactatgtcagatagatataacaaagttgcaacg

SEQ ID NO: 33829 - DNA, 75 bp, Artificial Sequence
  Synthetic
ttgaaacaagatacttaatattgagtttaataccaaagatagagaactcacaaccatgtggggaccaacaaataa

SEQ ID NO: 33830 - DNA, 75 bp, Artificial Sequence
  Synthetic
aataactgcagcagttgcccttgttgaagccaaacaagcaagagcagatatagataagcttaaggaagccatcag

SEQ ID NO: 33831 - DNA, 75 bp, Artificial Sequence
  Synthetic
gtgatgggattgacaataggatcaaccaggcacccgatcaagggataagggtaataacacataaagaatgtcaag

SEQ ID NO: 33832 - DNA, 75 bp, Artificial Sequence
  Synthetic
ctaaccaggaaacagtaggaaaatgtagcatcgaacatcaagggtataaaaaacttaggaacaaagcagttccac

SEQ ID NO: 33833 - DNA, 75 bp, Artificial Sequence
  Synthetic
tagcatcgaacatcaagggtataaaaaacttaggaacaaagcagttccacttagatacaaagaacagacgacaag

SEQ ID NO: 33834 - DNA, 75 bp, Artificial Sequence
  Synthetic
aacaccaacactgaattccaaacagagacaactaggcgtaataataaagttacaaatatcatgatatccatcttt

SEQ ID NO: 33835 - DNA, 75 bp, Artificial Sequence
  Synthetic
agcaaataagagagatcaacaggaggtaccaatacagagaatgactcatgacagcgggattgaacctctaaaccc

SEQ ID NO: 33836 - DNA, 75 bp, Artificial Sequence
  Synthetic
gtaccaatacagagaatgactcatgacagcgggattgaacctctaaaccctgacaaattctggagatgtacctct

SEQ ID NO: 33837 - DNA, 75 bp, Artificial Sequence
  Synthetic
acagcgggattgaacctctaaaccctgacaaattctggagatgtacctctggcaatccatccttgacaagtaatc

SEQ ID NO: 33838 - DNA, 75 bp, Artificial Sequence
  Synthetic
tgcttacacttccaaccttattgttcaaggttgccaggatatagggaagtcttatcaggtattacaaatcgggat

SEQ ID NO: 33839 - DNA, 75 bp, Artificial Sequence
  Synthetic
acatatatactagatctacaagttggcatagtaaactccaattagggacaattgatattaccaattacagtgata

SEQ ID NO: 33840 - DNA, 75 bp, Artificial Sequence
  Synthetic
gagcctaaatacattccaacctatgttattcaaaacagaaattccaaagaactgtagttgagttgactcccccgt

SEQ ID NO: 33841 - DNA, 75 bp, Artificial Sequence
  Synthetic
gttaattatcaaacacagaagacaaacatcaacaggtaggggattcaaaaaatgagatgacaaatagggggaaaa

SEQ ID NO: 33842 - DNA, 75 bp, Artificial Sequence
  Synthetic
gacttaggtaaatataactttattaggtatccagaaatgtccaatgaaatgttccaattgtgcatacctggaatt

SEQ ID NO: 33843 - DNA, 75 bp, Artificial Sequence
  Synthetic
caagacatggtttaccattaaatacgatatgaggaggctacaaaaagccaaaaatgaggttacatgtaataagta

SEQ ID NO: 33844 - DNA, 75 bp, Artificial Sequence
  Synthetic
caattacgtggagcctttttgaatcatgtattatctgagatggagtcaatattagacaccaggtataagaccgca

SEQ ID NO: 33845 - DNA, 75 bp, Artificial Sequence
  Synthetic
gacatcctccattggaagctagtatagcagcagaaaaagtcaggaaatatatgtatactgagaaatgtcttaatt

SEQ ID NO: 33846 - DNA, 75 bp, Artificial Sequence
  Synthetic
tcatgcacatgaattcattataaatgcttatggatcaaattctgctatatcatacgaaaatgctgttgattacta

SEQ ID NO: 33847 - DNA, 75 bp, Artificial Sequence
  Synthetic
catacgaaaatgctgttgattactataggagctttataggaattaagttcaacaaatttatagagccccaattag

SEQ ID NO: 33848 - DNA, 75 bp, Artificial Sequence
  Synthetic
ttatgtggagtcaggagaatggttgaatgatcctgagtttaatatctcatatagtctaaaagaaaaggagataaa

SEQ ID NO: 33849 - DNA, 75 bp, Artificial Sequence
  Synthetic
ttacaatgcaattagtaattctaatttatcttctaaccaaaaatcaagaagattcgagttcaagtcaacagacat

SEQ ID NO: 33850 - DNA, 75 bp, Artificial Sequence
  Synthetic
tgatcaccctgattcagggttttatgttcataatcctagaggaggaatagaaggattttgtcaaaaattgtggac

SEQ ID NO: 33851 - DNA, 75 bp, Artificial Sequence
  Synthetic
ttctcttgatttatttatgagagaatggctgaatggtgcatcgcttgaaatctatatttgcgacagtgatatgga

SEQ ID NO: 33852 - DNA, 75 bp, Artificial Sequence
  Synthetic
ggataagatctataaccagtgatcctgaagtttatgagacctcagatgatattgaacatggattgacccttcctg

SEQ ID NO: 33853 - DNA, 75 bp, Artificial Sequence
  Synthetic
ggataatcttatctaaaaagaagaataatgaatggttgcagcatgaaattaaagaaggggaaagagactatggtg

SEQ ID NO: 33854 - DNA, 75 bp, Artificial Sequence
  Synthetic
gtgtcattagctgacactgatctcgaacctctaaaattactatccaaaactcttatcagagattataaagaacac

SEQ ID NO: 33855 - DNA, 75 bp, Artificial Sequence
  Synthetic
taaccaaagagatcaaaatactgatgaaacttataggaggagttaaattattggggatccctaaacaatataaag

SEQ ID NO: 33856 - DNA, 75 bp, Artificial Sequence
  Synthetic
ttggggatccctaaacaatataaagaacttgaacaccaatcatatccgaattatgaatatgataatgaatttgat

SEQ ID NO: 33857 - DNA, 75 bp, Artificial Sequence
  Synthetic
atatattaccaaccaaaaacaataagaaaaacatatgatatatatataccaaacagagtttttctcttgtttggt

SEQ ID NO: 33858 - DNA, 75 bp, Artificial Sequence
  Synthetic
accaaacaagagaagagacttgcttgggaatattaattcagataaaaattaacttaggattaaagaactttgccg

SEQ ID NO: 33859 - DNA, 75 bp, Artificial Sequence
  Synthetic
atggacacttatatctatcagtgcaatacacttagcagctgtcaaaatcggtgtaagagttactgccaaggttca

SEQ ID NO: 33860 - DNA, 75 bp, Artificial Sequence
  Synthetic
ctatctggattgtttacaagtacaatgatagaagaggatgaaagactagctgaattcttgatggacaggagaata

SEQ ID NO: 33861 - DNA, 75 bp, Artificial Sequence
  Synthetic
agcggatactatgtcgcagctagatcgggacaatcttaaagagttggtagttattgcaaatgatgatgatattaa

SEQ ID NO: 33862 - DNA, 75 bp, Artificial Sequence
  Synthetic
accaaacaagagaagagactggtttgggaatattaattcaaataaaaattaacttaggattaaagaactttaccg

SEQ ID NO: 33863 - DNA, 75 bp, Artificial Sequence
  Synthetic
ttcagtcatctataatcccctatgcatgggcagacgaggcaggcaacaaaaaccaagcagggtcaaccgcagacg

SEQ ID NO: 33864 - DNA, 75 bp, Artificial Sequence
  Synthetic
ttgacagcctcggagttgagcaaagaaacatcagagatagattgaacaaaaggctcaacgaaaagagaagacaga

SEQ ID NO: 33865 - DNA, 75 bp, Artificial Sequence
  Synthetic
aaataatgctgaccagactgagatagatgacctgttcagcgcattcggaagtagctaattaaatagtggtgatta

SEQ ID NO: 33866 - DNA, 75 bp, Artificial Sequence
  Synthetic
gaagagcttatctcgaaaaacaaaaggtcaaaaaggcaccagctaacaaaccagagagacaacaaagaaattaaa

SEQ ID NO: 33867 - DNA, 75 bp, Artificial Sequence
  Synthetic
ggaccctcaagaccagcacagatgcaggggaaccaacaagaatacagaatgggtcccaaaggaagagaatcacat

SEQ ID NO: 33868 - DNA, 75 bp, Artificial Sequence
  Synthetic
cctggaacatcctcaacaacaagagcagcaatcgagaggaacagacagtcagaaatccccaacgatcagcacatg

SEQ ID NO: 33869 - DNA, 75 bp, Artificial Sequence
  Synthetic
gcgaatgtcctaaacaatgcagatactgcatcgaagatcgattttttagcgggtctgatgattggagtatcgatg

SEQ ID NO: 33870 - DNA, 75 bp, Artificial Sequence
  Synthetic
gatcaagacaacagacttaatcagattcaaaatgagataatagatttaaagactgatctcaaaaagatggatgaa

SEQ ID NO: 33871 - DNA, 75 bp, Artificial Sequence
  Synthetic
tcgatcctcttatggaaacacaaggcatcgaaaagaatgttcctgatttatacagatcgatagagaaggcaccag

SEQ ID NO: 33872 - DNA, 75 bp, Artificial Sequence
  Synthetic
atggatatgtttaatgaagacattagctcccaatagacagccaaacgacaatcaccaccacagaacacactgaca

SEQ ID NO: 33873 - DNA, 75 bp, Artificial Sequence
  Synthetic
cacatcagcaaaccaaagactatccccaactaccaagtcaatcaacacaccacagtagttcccagacacaagcca

SEQ ID NO: 33874 - DNA, 75 bp, Artificial Sequence
  Synthetic
acgccaacaaagttgcgcttgcacctcaatgtcttccactcgatagagggataaaattcagagtaatatttgtga

SEQ ID NO: 33875 - DNA, 75 bp, Artificial Sequence
  Synthetic
aacaccgacagcctggacaagcaacattataaatcagatcatttaaaaaaccaaaatcaaaaacttaggattaaa

SEQ ID NO: 33876 - DNA, 75 bp, Artificial Sequence
  Synthetic
gagattacccagatttcacaagcacaatcaaaccagcacccagagacaacacggacagagcagaagaggcaccag

SEQ ID NO: 33877 - DNA, 75 bp, Artificial Sequence
  Synthetic
gggaagaaccaacaaacaggaaagaggaaggaacaacagaaaacaggggcaaacaccaaagagcaaaggaacacc

SEQ ID NO: 33878 - DNA, 75 bp, Artificial Sequence
  Synthetic
accaacgaacataccagcaaccccacaacagaacacaagaaaaaagaatagaaaacgaagagcaccaaagatgat

SEQ ID NO: 33879 - DNA, 75 bp, Artificial Sequence
  Synthetic
ctgactaggaaacagtagggaaatgtagcaccaaacatcaagggtataaaaaacttaggaacaaagcagtcccac

SEQ ID NO: 33880 - DNA, 75 bp, Artificial Sequence
  Synthetic
tcagagacaaagaacagacgacacggaatcccaacctcaaaaatggaatattggaggcacacaaacaacgccaaa

SEQ ID NO: 33881 - DNA, 75 bp, Artificial Sequence
  Synthetic
aggtttgattcaagaaagcaaccacaacaaaatagcatcacaacaaatgagaagagaattcgcagaaattgagaa

SEQ ID NO: 33882 - DNA, 75 bp, Artificial Sequence
  Synthetic
acagcgggattgaacccctaaaccctgacaaattctggagatgtacctctggcaatccatccttgacaagtagcc

SEQ ID NO: 33883 - DNA, 75 bp, Artificial Sequence
  Synthetic
gttaattatcaaacacggaagacaagcatcaacaggtaggggatccaaaaaatgagatgacaaatagaggaaaaa

SEQ ID NO: 33884 - DNA, 75 bp, Artificial Sequence
  Synthetic
catacaaactcatgatccagttaagcaattacgtggagcctttttgaatcatgtattatctgaaatggagtcaat

SEQ ID NO: 33885 - DNA, 75 bp, Artificial Sequence
  Synthetic
attgcatcattaagagtcccttattttgggtcggtaacagatgagagatctgaggcacaactggggtacattaag

SEQ ID NO: 33886 - DNA, 75 bp, Artificial Sequence
  Synthetic
atcagagtaagcagatttatcacaatatcgaatgataatatgtctatcaaagaagctaacgaaacaaaagataca

SEQ ID NO: 33887 - DNA, 75 bp, Artificial Sequence
  Synthetic
tcccgcaataaattattacaattctggtctaaatattacagatgtaattggtcaaagagaattaaaaatctttcc

SEQ ID NO: 33888 - DNA, 75 bp, Artificial Sequence
  Synthetic
atcagaagtttcattagtaggtaagaaactaggtaatgtgacacagatcctcaatcgtgtgaaaatattatttaa

SEQ ID NO: 33889 - DNA, 75 bp, Artificial Sequence
  Synthetic
gaaacttataggaggagttaaattattggggatccctaaacaatataaagaacttgaacaccaatcatatccaga

SEQ ID NO: 33890 - DNA, 75 bp, Artificial Sequence
  Synthetic
ataaccagtatttcaggattgagaaaaggtttttttactcggttagaggcatttagacaagacggaacagtcaaa

SEQ ID NO: 33891 - DNA, 75 bp, Artificial Sequence
  Synthetic
atgaaaacgggccaggggtcacaaggctcagccaaacaatccaccggcccgaccaaaatcaacaaaaacaaggcg

SEQ ID NO: 33892 - DNA, 75 bp, Artificial Sequence
  Synthetic
ggaagcctggaatctattagtacacctaatccaagacatactagcctagtgaccacagcaacaccaaatgttgaa

SEQ ID NO: 33893 - DNA, 75 bp, Artificial Sequence
  Synthetic
cctggaacatcctcaacaacaagagcagcaatcgagaggaacagacagtcagaaatccccaacgaccagcacacg

SEQ ID NO: 33894 - DNA, 75 bp, Artificial Sequence
  Synthetic
gacagaagcaaacaatggtatcagacagatcagctcccgaacaacaagtcaaagcacagaagacgaacggagagg

SEQ ID NO: 33895 - DNA, 75 bp, Artificial Sequence
  Synthetic
aaaaaggtgagaaatcattaaactttatggtccatcttggattaattaaacggaaggtttgtctaatgttttcat

SEQ ID NO: 33896 - DNA, 75 bp, Artificial Sequence
  Synthetic
ccaaaatcaaaaacttaggattaaagagattacccagatttcacaagcgcaatcaaaccagcatccagagacaac

SEQ ID NO: 33897 - DNA, 75 bp, Artificial Sequence
  Synthetic
ggaaagaacaacagaaaacaggggcaaacaccaaagagcaaaggaacaccaccaacgaacacaccagcaacccca

SEQ ID NO: 33898 - DNA, 75 bp, Artificial Sequence
  Synthetic
caacagaacacaagaaaaaagaacagaaaacgaggagcatcaaagatgatcaccatagctgcaataacagttata

SEQ ID NO: 33899 - DNA, 75 bp, Artificial Sequence
  Synthetic
ggttggcatcagtcaaatacaacaatcaccataataatagtgatgataataattctgtttataatcaacatgatg

SEQ ID NO: 33900 - DNA, 75 bp, Artificial Sequence
  Synthetic
tcaccataataatagtgatgataataattctgtttataatcaacatgatgatcattataataatcttcaaacaat

SEQ ID NO: 33901 - DNA, 75 bp, Artificial Sequence
  Synthetic
aggtttgattcaagaaagcaaccacaacaaaatagtatcacaacaaatgagaaaagaatttgcagaaattgagaa

SEQ ID NO: 33902 - DNA, 75 bp, Artificial Sequence
  Synthetic
gagcctaaacacattccaacctatgctattcaaaacagaaattccaaagaactgtagttgagttgactctcctat

SEQ ID NO: 33903 - DNA, 75 bp, Artificial Sequence
  Synthetic
ctattcaaaacagaaattccaaagaactgtagttgagttgactctcctatgttaattatcaaacacagaagacaa

SEQ ID NO: 33904 - DNA, 75 bp, Artificial Sequence
  Synthetic
attttctcttttttccgaacttttggacatcctccattagaagctagtatagcagcagaaaaggtcaggaaatac

SEQ ID NO: 33905 - DNA, 75 bp, Artificial Sequence
  Synthetic
catcaaacctcacgtataatattagtacatcacatgattcaagaaggttagttgaagtttttatggcagatagta

SEQ ID NO: 33906 - DNA, 75 bp, Artificial Sequence
  Synthetic
cttaaatgggggatatgaaactgtaagttgttttttaacaacagatctaaagaaatattggttgaagtggagata

SEQ ID NO: 33907 - DNA, 75 bp, Artificial Sequence
  Synthetic
tgaatcaacagatcttggaggagataaatgcaataagatttttgggtttaaagaattaattaaatggatgcattc

SEQ ID NO: 33908 - DNA, 75 bp, Artificial Sequence
  Synthetic
tggccttgaaaagaaaacaatatatgttggagatacctattgcccgcccttagatatagaacacttacaacctga

SEQ ID NO: 33909 - DNA, 75 bp, Artificial Sequence
  Synthetic
tgatcgccatgattcagggttttatgttcataatcctagaggaggaatagaaggattttgtcaaaaattatggac

SEQ ID NO: 33910 - DNA, 75 bp, Artificial Sequence
  Synthetic
atataactgcaagaaatgtactacaagattcacctaatccattattatcaggattatttacaagcacgatgatgg

SEQ ID NO: 33911 - DNA, 75 bp, Artificial Sequence
  Synthetic
agattcacctaatccattattatcaggattatttacaagcacgatgatggaagaggatgaaaaactcgctgattt

SEQ ID NO: 33912 - DNA, 75 bp, Artificial Sequence
  Synthetic
gtgactacatcaacaaatttatcacacagattaaaggataccgctacccagatgaaattctccagtacatcactt

SEQ ID NO: 33913 - DNA, 75 bp, Artificial Sequence
  Synthetic
gtcaaagagaattaaaaatctttccatcagaagtttcattagtaggtaaaaaactaggtaatgtgacgcagatcc

SEQ ID NO: 33914 - DNA, 75 bp, Artificial Sequence
  Synthetic
ttatctctatcgaccagattactgacgggtcgtttcccggatgagaagttgaagggtagagcacagactgggttt

SEQ ID NO: 33915 - DNA, 75 bp, Artificial Sequence
  Synthetic
ttatgaatatgataatgaatttgatattgattaatgtataaatctagtaaatagtgaacttaatccctatctgtg

SEQ ID NO: 33916 - DNA, 75 bp, Artificial Sequence
  Synthetic
tcatcatctataacaaataagaaaaacttaggattaacggatcttacccaatccagaaacagagaggcaaatcct

SEQ ID NO: 33917 - DNA, 75 bp, Artificial Sequence
  Synthetic
gactactgcgacattggatgacgaggaagagcttttgatgaaaaataagaagccaaaaaagtaccagtcaatact

SEQ ID NO: 33918 - DNA, 75 bp, Artificial Sequence
  Synthetic
aagatcaaacaataggaccaacaatctagacacacaacactgggaatcaggctatccacaagacaagaatcaaaa

SEQ ID NO: 33919 - DNA, 75 bp, Artificial Sequence
  Synthetic
caaatcgatcaatataagaaattactggacaggctaataattcctttatatgatggattaaagttacaaaaagat

SEQ ID NO: 33920 - DNA, 75 bp, Artificial Sequence
  Synthetic
aaatcccataatcacctactcaacagacacgagtagagtgaatgaattagctattaacaacaggacacttccagc

SEQ ID NO: 33921 - DNA, 75 bp, Artificial Sequence
  Synthetic
attgcaactagaccgaccccaatccaccgggcgctgaacaaaccacaaaaaaatcaccaggcgggccatccagaa

SEQ ID NO: 33922 - DNA, 75 bp, Artificial Sequence
  Synthetic
tattgtcagggataataataacaggatctgaacattgtaggatatgctattcaactgaaggaggaagcccatata

SEQ ID NO: 33923 - DNA, 75 bp, Artificial Sequence
  Synthetic
tcatggatggaagcagcacagattgcacagacgcgtgcaaacttcacgctggatagcttaaagattttgacacca

SEQ ID NO: 33924 - DNA, 75 bp, Artificial Sequence
  Synthetic
aattggtttagtacactgtgacatggagggagcaataggtaaatcagaggagactgtattacatgaacattatag

SEQ ID NO: 33925 - DNA, 75 bp, Artificial Sequence
  Synthetic
aaaggtaaggggaaagaaatcctacaatagcaataatgctgagtttatttgatacattcagcgcacgtaggcaag

SEQ ID NO: 33926 - DNA, 75 bp, Artificial Sequence
  Synthetic
gatacattcagcgcacgtaggcaagagaatataaccaaatcagctggtggagctgtcattcctgggcaaaagaac

SEQ ID NO: 33927 - DNA, 75 bp, Artificial Sequence
  Synthetic
tctcactccttggataatgagaagcaacatgcacagagagctgggtttttggtttctttactatccatggcgtat

SEQ ID NO: 33928 - DNA, 75 bp, Artificial Sequence
  Synthetic
gccaacccggaattatacttaacagcaaatggtagcaatgcagatgttaaatatgtgatctacatgatagaaaag

SEQ ID NO: 33929 - DNA, 75 bp, Artificial Sequence
  Synthetic
gatccaggaagacaaaaatatggtggattaatcatcaagactagagaaatggtctatgagaagaccactgattgg

SEQ ID NO: 33930 - DNA, 75 bp, Artificial Sequence
  Synthetic
atgttcgggagtgatcttgagtatgatcaagacaacatgcttcaaaacggtagaagcactgcaacaattgaagat

SEQ ID NO: 33931 - DNA, 75 bp, Artificial Sequence
  Synthetic
cttgtgcacacttttggatatccatcatgccttggagctctcataatccagatttggataatactagtcaaagcc

SEQ ID NO: 33932 - DNA, 75 bp, Artificial Sequence
  Synthetic
ataaccagcatatcagggctgagaaaggggttctttacccggttagaagcattcagacaggatggaacagtcaag

SEQ ID NO: 33933 - DNA, 75 bp, Artificial Sequence
  Synthetic
tccagcctggtattgagcggtgatgcagtggagcagattggatctattatgaggtctcaacagagcctagtgaca

SEQ ID NO: 33934 - DNA, 75 bp, Artificial Sequence
  Synthetic
ctaatggttgagacattgataaccatgaatactggtagaaatgatttgacaacaatcgaaaagaacatacaaatt

SEQ ID NO: 33935 - DNA, 75 bp, Artificial Sequence
  Synthetic
gttggaaactacatcagagatgcaggtctcgcttcatttttcaacacaatcaggtatggaattgaaactagaatg

SEQ ID NO: 33936 - DNA, 75 bp, Artificial Sequence
  Synthetic
gcagctctaaccttgtctactctcagaccagatatcaacaggctcaaggcattaatggaattgtatttgtcaaaa

SEQ ID NO: 33937 - DNA, 75 bp, Artificial Sequence
  Synthetic
gggccacgtgcacctttcatatgcattttgagggatcctgtacacggtgaatttgcaccgggaaattaccctgct

SEQ ID NO: 33938 - DNA, 75 bp, Artificial Sequence
  Synthetic
ctctggagttatgctatgggtgtagcagttgtacagaacaaggccatgcaacagtatgtgacaggacgatcttat

SEQ ID NO: 33939 - DNA, 75 bp, Artificial Sequence
  Synthetic
ctagacattgaaatgttccaacttggtcaggcagtagcacgggatgctgaatcacagatgagctcaatactagag

SEQ ID NO: 33940 - DNA, 75 bp, Artificial Sequence
  Synthetic
gatgaactagggataacacaggaagccaaacagagcttgaagaatcacatgaaaaggatcagtagttcagataca

SEQ ID NO: 33941 - DNA, 75 bp, Artificial Sequence
  Synthetic
gccttccaaaaaccaacaggaggagcagccatagagatggcaatagatgaagaagtagagcagcttgattccaaa

SEQ ID NO: 33942 - DNA, 75 bp, Artificial Sequence
  Synthetic
ggggatcaagaccaaagcaacggaaatcagtcatccatgatcccctatgcatgggcagatgaaaccaacaatagc

SEQ ID NO: 33943 - DNA, 75 bp, Artificial Sequence
  Synthetic
aatcaaactgaaccaacaacagagattgacagcatcacaaccgagcaaagaaacatcagggacagattgaacaaa

SEQ ID NO: 33944 - DNA, 75 bp, Artificial Sequence
  Synthetic
agactcaacgagaaaagaaaacagaacgaaacaagatcagatgacaccacaaacaatacaaatcagactgaaata

SEQ ID NO: 33945 - DNA, 75 bp, Artificial Sequence
  Synthetic
gatgacctgttcagtgcatttgggagcaactaatcacacagagatgacaactattatctataataaataagaaaa

SEQ ID NO: 33946 - DNA, 75 bp, Artificial Sequence
  Synthetic
acttaggattaacggatcttatccaatccagaaacagagaggcaaatccgaaatccatacatcacttcatcaatt

SEQ ID NO: 33947 - DNA, 75 bp, Artificial Sequence
  Synthetic
aaatccatacatcacttcatcaattggagattcatggaagacaatgctcaaagcaatcaaatcatggattcttgg

SEQ ID NO: 33948 - DNA, 75 bp, Artificial Sequence
  Synthetic
gcccaagaaggcacggtcggtggcaatgaaatcagtacagggagcacaaagctcagcacaccaatctacagacct

SEQ ID NO: 33949 - DNA, 75 bp, Artificial Sequence
  Synthetic
atgaaatcagtacagggagcacaaagctcagcacaccaatctacagacctgagtacaaaacaacagaagcaggca

SEQ ID NO: 33950 - DNA, 75 bp, Artificial Sequence
  Synthetic
gaaatgttaatcaggaaattatacagggaggagataggagaagaagcggcccagatagtggaattgagactatgg

SEQ ID NO: 33951 - DNA, 75 bp, Artificial Sequence
  Synthetic
tccctggaggaatctccagaagcagcccagatcctaacaatggaacccaaatccaggaagatcctgattacaatg

SEQ ID NO: 33952 - DNA, 75 bp, Artificial Sequence
  Synthetic
atccaggaagatcctgattacaatgaaattagaaagatggataaggacacttctgagaggaaagtgcgacaatct

SEQ ID NO: 33953 - DNA, 75 bp, Artificial Sequence
  Synthetic
agaggcctggaatctatcagtacacctaatccaagacacactggcatagtaaccattgcaaccctggatgacgaa

SEQ ID NO: 33954 - DNA, 75 bp, Artificial Sequence
  Synthetic
gaagaacttctgatgaaaaataagaagccaaggaagtaccacttaacacctcagagagatgataaagaaattaaa

SEQ ID NO: 33955 - DNA, 75 bp, Artificial Sequence
  Synthetic
aaagggggtggaagacagatcgagacaatcacacaaccatcaacactggaccaaggactcgccttcagagaatcg

SEQ ID NO: 33956 - DNA, 75 bp, Artificial Sequence
  Synthetic
aagaagaaccaggcaattctcaaaaccagcacgaatgcaggagaaccagcaaagccacagaatggaaatcggggg

SEQ ID NO: 33957 - DNA, 75 bp, Artificial Sequence
  Synthetic
aagaggatcacatcctgggacatccgcaacaacgagggcaacaatcgagccgaacagacaaccaagagctccaac

SEQ ID NO: 33958 - DNA, 75 bp, Artificial Sequence
  Synthetic
aagccagcacagggaccgaacaacacaacaggatcaaacagaccagccctcgagccacggatcaaagcacagaag

SEQ ID NO: 33959 - DNA, 75 bp, Artificial Sequence
  Synthetic
aacaatgcggatactgcatcgaagatagacttcttggcgggcctgatgattggagtatcaatggaccatgataat

SEQ ID NO: 33960 - DNA, 75 bp, Artificial Sequence
  Synthetic
ttaattgaaaatcaaaaagagcaattatcactgatcacatcattaatttcaaatcttaaaattatgacagaaaga

SEQ ID NO: 33961 - DNA, 75 bp, Artificial Sequence
  Synthetic
ggaggaaagaaggaccaaacggaatctagtgggagaacatccatgataacgacaaagaccaaggaagagaaaatt

SEQ ID NO: 33962 - DNA, 75 bp, Artificial Sequence
  Synthetic
aagaaggtcagattcgaccctctcatggaaacacaaggcattgggagaaacgttcctgacctttacagatcaatg

SEQ ID NO: 33963 - DNA, 75 bp, Artificial Sequence
  Synthetic
gacaaaacaccagaaaatgacacccaaatcagatcagaaatgagtagattagacgacgaatccaatgcaactaga

SEQ ID NO: 33964 - DNA, 75 bp, Artificial Sequence
  Synthetic
ttggtacctagaagaatcagtagcacaatgagatcactaatcataatcatcaacaacagtaatctttcatcaaga

SEQ ID NO: 33965 - DNA, 75 bp, Artificial Sequence
  Synthetic
gccaaacaatcgtacataaatgagctcaagctctgcaaaaatgacgaagaagtctccgagctaatggacatgttc

SEQ ID NO: 33966 - DNA, 75 bp, Artificial Sequence
  Synthetic
aatgaggatgtcagttccacataaacagtccgccaaacaccaccactatgaaaacaaacaacaccaaacaaaaaa

SEQ ID NO: 33967 - DNA, 75 bp, Artificial Sequence
  Synthetic
acggaatcgacccaaaggcgcccgaccaatcaagacacaacaagaacatccaaatcccagctgattaagaaaaac

SEQ ID NO: 33968 - DNA, 75 bp, Artificial Sequence
  Synthetic
ttaggaataaagggctaaccactctttcaacaagatgagcatcagaaactccgcaatatacacgttccctgactc

SEQ ID NO: 33969 - DNA, 75 bp, Artificial Sequence
  Synthetic
ttcaacaagatgagcatcagaaactccgcaatatacacgttccctgactcatccttccttgacaatgggaatata

SEQ ID NO: 33970 - DNA, 75 bp, Artificial Sequence
  Synthetic
cctaaacatggatccagatatctagatgtatttctattgggtttttttgaaatggaaagatcaaaggatagatat

SEQ ID NO: 33971 - DNA, 75 bp, Artificial Sequence
  Synthetic
gggagcattagtgatcttgatgatgatccaggctacaaggtctgtggttctgggtctttaccacttggactggca

SEQ ID NO: 33972 - DNA, 75 bp, Artificial Sequence
  Synthetic
aaatacactgggggtgatcaggaacttttacaagctgcaatcaaattagatatagaagtaagaagaacagtcaag

SEQ ID NO: 33973 - DNA, 75 bp, Artificial Sequence
  Synthetic
gccacagaaatgatagtttatacagtgcagaacatcaaacccgaattgtacccatggtcaggaagattaagaaaa

SEQ ID NO: 33974 - DNA, 75 bp, Artificial Sequence
  Synthetic
gggatgttatttgatgccaacaaggttgcactcgctccccagtgtcttccactcgatagagggataaaatttaga

SEQ ID NO: 33975 - DNA, 75 bp, Artificial Sequence
  Synthetic
gtaatatttgtgaactgtacagcaattggatcaataacactctttaaaatacccaaatccatggcattattatca

SEQ ID NO: 33976 - DNA, 75 bp, Artificial Sequence
  Synthetic
ttgccgaatacgatttcaataaacttgcaagtacacattaaaactgggatccaaaccgactctaaaggagtggtt

SEQ ID NO: 33977 - DNA, 75 bp, Artificial Sequence
  Synthetic
cagatcttagatgagaaaggtgaaaaatcactaaactttatggttcatcttggattgatcaagcggaaaataggt

SEQ ID NO: 33978 - DNA, 75 bp, Artificial Sequence
  Synthetic
cggatgtattcagttgagtattgtaaacaaaagattgagaagatgagattactattctcattaggactggttgga

SEQ ID NO: 33979 - DNA, 75 bp, Artificial Sequence
  Synthetic
ggtattagctttcatgtcaatgcaactggatctatatcaaaaaccttggcaagccaattggcattcaagagagag

SEQ ID NO: 33980 - DNA, 75 bp, Artificial Sequence
  Synthetic
atctgttatcctctcatggatcttaatccacatctcaattcagtaatttgggcatcttcaattgaaattacaagg

SEQ ID NO: 33981 - DNA, 75 bp, Artificial Sequence
  Synthetic
gtggatgcagttctccaaccttcactacctggtgaatttagatactacccaaatatcatagcaaagggagtcggg

SEQ ID NO: 33982 - DNA, 75 bp, Artificial Sequence
  Synthetic
aagatcagacaataggatcaacaatctggacacacaacactgggaaccagactgctcacaagacaaaaatcaaaa

SEQ ID NO: 33983 - DNA, 75 bp, Artificial Sequence
  Synthetic
acttaggatcaaaaggatcaacccgaccccagatccgaacccagaacaacccatccaagagacaagagggagaca

SEQ ID NO: 33984 - DNA, 75 bp, Artificial Sequence
  Synthetic
agaaagacacagcaagaaagcacacacacaaagggcaagacaaaagaacacacagacaaacagcaggaatccaca

SEQ ID NO: 33985 - DNA, 75 bp, Artificial Sequence
  Synthetic
acacatcctccacaacaacaacaacaatcccacaaagaagcactacaacaaagatcagagaacaagaaacttcca

SEQ ID NO: 33986 - DNA, 75 bp, Artificial Sequence
  Synthetic
aaatgatcatcatagtcataacaatgatactgtcattgacaccttcatcattatgtcaaatagatataacaaaat

SEQ ID NO: 33987 - DNA, 75 bp, Artificial Sequence
  Synthetic
tacagagtgtaggagtattagttaacagtccaaaaggtattaagatttcacaaaactttgaaacaagatatctaa

SEQ ID NO: 33988 - DNA, 75 bp, Artificial Sequence
  Synthetic
tattaagcctgataccaaaaatagaagattcacactcatgtggtaatcaacaaatcgatcaatacaagaaattgc

SEQ ID NO: 33989 - DNA, 75 bp, Artificial Sequence
  Synthetic
tagatagattaataattcctttgtatgatggattaaagttacaaaaagatgtgatagtagttaatcacgaatctc

SEQ ID NO: 33990 - DNA, 75 bp, Artificial Sequence
  Synthetic
acaataatactaatctcagaacaaagcgattctttggggagataattgggacaattgcaataggaatagctacct

SEQ ID NO: 33991 - DNA, 75 bp, Artificial Sequence
  Synthetic
cagctcaaataaccgcagcagtagctcttgtagaagccaaacaagcaagatcagacatagacaagctcaaagaag

SEQ ID NO: 33992 - DNA, 75 bp, Artificial Sequence
  Synthetic
ccataaaagatacaaataaggcagtacagtcaattcaaagctctgtaggtaatctgatcgttgcagtcaagtcag

SEQ ID NO: 33993 - DNA, 75 bp, Artificial Sequence
  Synthetic
ttcaagattatgttaacaatgaaattgtcccatcaatcacaagattaggctgtgaagcagcaggactacagttgg

SEQ ID NO: 33994 - DNA, 75 bp, Artificial Sequence
  Synthetic
gaattgcattaacacaacattactcagaattgactaatatatttggtgataatatagggacattgggggaaaagg

SEQ ID NO: 33995 - DNA, 75 bp, Artificial Sequence
  Synthetic
gggtcaaactacaaggaatagcatcattataccgtacaaacataaccgaagtattcactacctcaacagttgatc

SEQ ID NO: 33996 - DNA, 75 bp, Artificial Sequence
  Synthetic
caattacacttcaggttagactgcccttattaaccaaagtatcaaacactcaaatatataaagttgattctatat

SEQ ID NO: 33997 - DNA, 75 bp, Artificial Sequence
  Synthetic
cttattaaccaaagtatcaaacactcaaatatataaagttgattctatatcatataatattcagggtaaagaatg

SEQ ID NO: 33998 - DNA, 75 bp, Artificial Sequence
  Synthetic
atcattcagcaattatatatgtccctctgatcctggttttatattaaatcatgaaatggaaaattgcttatccgg

SEQ ID NO: 33999 - DNA, 75 bp, Artificial Sequence
  Synthetic
gaacataacacaatgccctaagactattgttacatcagatatagtaccaagatatgcatttgttgatggtggagt

SEQ ID NO: 34000 - DNA, 75 bp, Artificial Sequence
  Synthetic
aatcgctaattgtataccaactacttgtacgtgcaatggaattgataatagaatcaaccaatcgcctgatcaagg

SEQ ID NO: 34001 - DNA, 75 bp, Artificial Sequence
  Synthetic
gatcaaaataataacatacaaagagtgtcaaatagtagggataaatggaatgttattcaaaactaatcaagaagg

SEQ ID NO: 34002 - DNA, 75 bp, Artificial Sequence
  Synthetic
gacattagcaaaatacacatttgataatattaagttgaataattctgttgcactcaacccaattgacatatccct

SEQ ID NO: 34003 - DNA, 75 bp, Artificial Sequence
  Synthetic
agaactcaacaaagccaaatcagatctagaggaatcaaaaagatggatagagaaatccaatcaaaaactagattc

SEQ ID NO: 34004 - DNA, 75 bp, Artificial Sequence
  Synthetic
tattggaagctggcaccagtcaagtgtaacaattattataataatagttatgatagtagttttacttataatcaa

SEQ ID NO: 34005 - DNA, 75 bp, Artificial Sequence
  Synthetic
tgcaataattatcatgatcatgatcagatatctcagagatcgaaatagacatctaaacaacaaagatagtgaacc

SEQ ID NO: 34006 - DNA, 75 bp, Artificial Sequence
  Synthetic
gtatgtattaaccaacagacagtaaaataacacaaaattgggtgttctaaacgaaaatagaaaaaacttaggaac

SEQ ID NO: 34007 - DNA, 75 bp, Artificial Sequence
  Synthetic
aaagccgttcaaaacagcaacaaaggacaaaagaaaaagaaaaagaaaaagaaaaagaaaagacagaacagagac

SEQ ID NO: 34008 - DNA, 75 bp, Artificial Sequence
  Synthetic
gaccacaaatccagcgatggagtactggaaacacacaaacagtgcaaaaagcacaaacgatgggcttgaagcaag

SEQ ID NO: 34009 - DNA, 75 bp, Artificial Sequence
  Synthetic
cagagacaagtacaaaaacagagctgcaaatatcataatgtatgcactttgggcaacaatatcgcttatactatt

SEQ ID NO: 34010 - DNA, 75 bp, Artificial Sequence
  Synthetic
aataatcttcataatgatattagtgaatttgattcaggacaataatcaaaataagacaacattacaagaaatgaa

SEQ ID NO: 34011 - DNA, 75 bp, Artificial Sequence
  Synthetic
aaaagagttcacagctatagaagccaagattcgagagacctctgaagagattggtgcctctatacagtcgggaat

SEQ ID NO: 34012 - DNA, 75 bp, Artificial Sequence
  Synthetic
aaacacaaggcttctcacaattcaaagtcatgttcaaaattatatcccattgtccttgacacagcagatgtcgga

SEQ ID NO: 34013 - DNA, 75 bp, Artificial Sequence
  Synthetic
agtcatgttcaaaattatatcccattgtccttgacacagcagatgtcggacctcaggaaattcatcagtgaattg

SEQ ID NO: 34014 - DNA, 75 bp, Artificial Sequence
  Synthetic
acaaataagagagaacaacaaaacataccaatacaaaggatgactcatgatagtggcatagaacctctagatcca

SEQ ID NO: 34015 - DNA, 75 bp, Artificial Sequence
  Synthetic
gataaattctggagatgcacttctggcaatccatctcttacaagcagtccaaaaataagactcataccaggacca

SEQ ID NO: 34016 - DNA, 75 bp, Artificial Sequence
  Synthetic
ggcctattagcaacatctaccactgtaaatggttgtattcgactcccatctctggtaatcaacaatctaatatat

SEQ ID NO: 34017 - DNA, 75 bp, Artificial Sequence
  Synthetic
gcttacacttctaatctcattactcagggttgtcaagatatagggaaatcctatcaagtattacagatagggatc

SEQ ID NO: 34018 - DNA, 75 bp, Artificial Sequence
  Synthetic
attactataaatacagatctagtacctgatttaaatcctagagtcacacacacattcaatattgatgataataga

SEQ ID NO: 34019 - DNA, 75 bp, Artificial Sequence
  Synthetic
agatcttgttcattagcactgttgaatgcagatgtataccaactatgctcgactcctaaagtcgatgagagatca

SEQ ID NO: 34020 - DNA, 75 bp, Artificial Sequence
  Synthetic
gactatgcatcaacaggaattgaggatattgtccttgatgttgtaactagcaacgggatgatcataacaacaaga

SEQ ID NO: 34021 - DNA, 75 bp, Artificial Sequence
  Synthetic
tttacaaacaataacataacatttgataaaccatatgcagcactatatccatcagtaggaccaggaatatattat

SEQ ID NO: 34022 - DNA, 75 bp, Artificial Sequence
  Synthetic
aaagataagatcatctttctaggatatggaggattagaacacgaggagaatggagacgtaatatgtaatttaact

SEQ ID NO: 34023 - DNA, 75 bp, Artificial Sequence
  Synthetic
ggctgtcctggcaaaacacagagagattgcaatcaagcttcttatagcccatggttttcaaataggagaatggta

SEQ ID NO: 34024 - DNA, 75 bp, Artificial Sequence
  Synthetic
aattccattattgtagttgataggggtatagatacaacctttggtttaagggtgtggactattccaatgaagcaa

SEQ ID NO: 34025 - DNA, 75 bp, Artificial Sequence
  Synthetic
aactattggggatcagaaggaaggttgcttttattaggtaacaaaatatacatatacaccaggtctacaagttgg

SEQ ID NO: 34026 - DNA, 75 bp, Artificial Sequence
  Synthetic
cacagtaaattgcaattgggactaatagatatctctaactacaatgacatcagaatcaactggacttggcacaat

SEQ ID NO: 34027 - DNA, 75 bp, Artificial Sequence
  Synthetic
gtattatcaagaccaggaaatgacgactgtccatggggtcattcatgcccagccggatgcataacaggagtttac

SEQ ID NO: 34028 - DNA, 75 bp, Artificial Sequence
  Synthetic
aatgatgcatacccattaaacccgtcaggaagtgttgtgtcatctgtcatccttgattcacagaaatctagagag

SEQ ID NO: 34029 - DNA, 75 bp, Artificial Sequence
  Synthetic
aatcccataatcacctattcaacagatacaaacagagtgaatgaactagccatcaacaacaggacacttccagcc

SEQ ID NO: 34030 - DNA, 75 bp, Artificial Sequence
  Synthetic
gcatatacaacaacaaattgtattacacattatgataaaggatattgctttcacattgttgagataaaccataga

SEQ ID NO: 34031 - DNA, 75 bp, Artificial Sequence
  Synthetic
agcttaaacacatttcaacctatgttattcaaaacagaagttccaaagaattgcagttagattgactccaacccg

SEQ ID NO: 34032 - DNA, 75 bp, Artificial Sequence
  Synthetic
ccaagcactggataaatcactcaaacattatcaggcagacaacccggaagatgagacaagaagaaagaaaataat

SEQ ID NO: 34033 - DNA, 75 bp, Artificial Sequence
  Synthetic
aaaaaacttaggagaaaagtgtgtgaggaaaatggaaactgaatttcacagtggcacaacatctgacattttgta

SEQ ID NO: 34034 - DNA, 75 bp, Artificial Sequence
  Synthetic
cccagaatgtcatctcaattctcctatagttaaagggaaaatagcgcaattacacactctaatgagtctgcccca

SEQ ID NO: 34035 - DNA, 75 bp, Artificial Sequence
  Synthetic
accttatgacatggacgatgactcaatattggctataactagacataagattaggcttaataaattagataaaag

SEQ ID NO: 34036 - DNA, 75 bp, Artificial Sequence
  Synthetic
gcaacgatcaattagaaagttaaagtttgttctgatggaaagagtaaacgatttaggcaaatatatttttattaa

SEQ ID NO: 34037 - DNA, 75 bp, Artificial Sequence
  Synthetic
gtatccagagatgtccaatgagatgttccaattacatatacctgggatcaacaacaagataaatgaattgttaaa

SEQ ID NO: 34038 - DNA, 75 bp, Artificial Sequence
  Synthetic
caaagcaagtaaaacttataatcaaatgactgacggattaagagatttatggatcaatatcttctcaaaattagc

SEQ ID NO: 34039 - DNA, 75 bp, Artificial Sequence
  Synthetic
atcaaagaatgatggaagtaactatgatgttaacgaggatattagtaatatatcaagtgttcatacaacttatca

SEQ ID NO: 34040 - DNA, 75 bp, Artificial Sequence
  Synthetic
atcagacaaatggtataacccatttaaaacgtggtttacaatcaagtacgacatgaggagactacaaaaagccaa

SEQ ID NO: 34041 - DNA, 75 bp, Artificial Sequence
  Synthetic
aaacgagattacatgcagtaggtctaaagattataacctgctagaagatcagaagaatgtattgataatacattc

SEQ ID NO: 34042 - DNA, 75 bp, Artificial Sequence
  Synthetic
agaactcatcataattttagataagcaaaattatagggggtatttaatgactcctgaactagtactaatgtactg

SEQ ID NO: 34043 - DNA, 75 bp, Artificial Sequence
  Synthetic
tgatgtagttgaaggaagatggaacattagttcttgtgcaaaactggatcccaaattacattcaatgtattataa

SEQ ID NO: 34044 - DNA, 75 bp, Artificial Sequence
  Synthetic
aggtaacagtttatgggagaccatagatggattattcccaactttaggagagaagacttttgatataatatcttt

SEQ ID NO: 34045 - DNA, 75 bp, Artificial Sequence
  Synthetic
attagaaccacttgctttgtcactcattcagactcatgacccagtcaaacagttacgtggggcatttttaaatca

SEQ ID NO: 34046 - DNA, 75 bp, Artificial Sequence
  Synthetic
tgtattgtcagaaatggaactgatactggaaactgagtttaaaattccagaaatgtctgatatagattatataga

SEQ ID NO: 34047 - DNA, 75 bp, Artificial Sequence
  Synthetic
taaaatcttagaggtatttaaggattcaacaatagatgagatagcagaaattttctcctttttccggacgtttgg

SEQ ID NO: 34048 - DNA, 75 bp, Artificial Sequence
  Synthetic
acaccctccgctagaagctagtatagcagcagaaaaagtcagaaaatatatgtacactgaaaagtgcttaaaatt

SEQ ID NO: 34049 - DNA, 75 bp, Artificial Sequence
  Synthetic
cgatactattaataagtgtcatgctatcttttgtacaataattataaatggatatagagaaagacacggcggaca

SEQ ID NO: 34050 - DNA, 75 bp, Artificial Sequence
  Synthetic
gtggcctcctgtgacattacctgcccatgcacatgaatttattataaatgcatatggatcaaactccgctatatc

SEQ ID NO: 34051 - DNA, 75 bp, Artificial Sequence
  Synthetic
atatgaaaatgcagtggattattacaagagcttcatagggataaagtttaataaatttatagaaccccaattaga

SEQ ID NO: 34052 - DNA, 75 bp, Artificial Sequence
  Synthetic
tgaagatttgactatttatatgaaagataaagcattatctccaaaaaaatcgaactgggacaccgtctatccagc

SEQ ID NO: 34053 - DNA, 75 bp, Artificial Sequence
  Synthetic
ctcaaacctgctataccgtgccaatgcatctcatgactcaagaaggttagtagaagtatttatagcagatagcaa

SEQ ID NO: 34054 - DNA, 75 bp, Artificial Sequence
  Synthetic
atttgatccacaccaagtattggattatgtagaatcaggatactggttaaatgatcctgaattcaatatatcata

SEQ ID NO: 34055 - DNA, 75 bp, Artificial Sequence
  Synthetic
tagtctaaaggagaaagaaataaaacaagaaggtagactttttgcaaagatgacatataaaatgagggcgaccca

SEQ ID NO: 34056 - DNA, 75 bp, Artificial Sequence
  Synthetic
agtattggcagaaacactactagcaaacaatataggaaaatttttccaagagaatggaatggtcaaaggagagat

SEQ ID NO: 34057 - DNA, 75 bp, Artificial Sequence
  Synthetic
tgaattacttaagagattgacaacaatatccatgtctggagttccacggtataatgaagtatacaacaaccctaa

SEQ ID NO: 34058 - DNA, 75 bp, Artificial Sequence
  Synthetic
aagtcacacagaggaacttcgtacctacaacgcactcagcaacgctactctatcttccaatcagaaagctaaaaa

SEQ ID NO: 34059 - DNA, 75 bp, Artificial Sequence
  Synthetic
gtttgaattcaaatcaacagatatctataacgatggatatgagactgtaagttgttttttaacaacagatcttaa

SEQ ID NO: 34060 - DNA, 75 bp, Artificial Sequence
  Synthetic
aaaatattgtttaaattggagatatgagtcaaccgctttgtttggtgatacctgcaatcagatttttgggttgaa

SEQ ID NO: 34061 - DNA, 75 bp, Artificial Sequence
  Synthetic
ggaactatttaactggttacatcctcgtcttgaaaaaagcacaatatatgtcggagatccttattgtccaccttc

SEQ ID NO: 34062 - DNA, 75 bp, Artificial Sequence
  Synthetic
agacactgaacatttaccgcttgatgaccatcctgattcaggattttacgttcataaccctcaaggaggtataga

SEQ ID NO: 34063 - DNA, 75 bp, Artificial Sequence
  Synthetic
aggattttgtcagaaattatggacacttatatctattagtgcaatacatttagcagctgtcaagattggtgtcag

SEQ ID NO: 34064 - DNA, 75 bp, Artificial Sequence
  Synthetic
agtcactgcgatggttcaaggagataatcaagctatagctgtcacaacaagagtaccgaataattatgattataa

SEQ ID NO: 34065 - DNA, 75 bp, Artificial Sequence
  Synthetic
agttaagaaagaaattgtttataaagatgtggtgagattttttgactcattgagagaagtcatggatgatctagg

SEQ ID NO: 34066 - DNA, 75 bp, Artificial Sequence
  Synthetic
tcatgaactcaaattaaatgagactataataagtagcaagatgttcatatacagcaaaagaatatactatgatgg

SEQ ID NO: 34067 - DNA, 75 bp, Artificial Sequence
  Synthetic
aagaatccttcctcaagctttgaaagcattatctagatgtgttttttggtctgaaacaataatagatgaaacaag

SEQ ID NO: 34068 - DNA, 75 bp, Artificial Sequence
  Synthetic
atcagcatcttcaaacctggcaacatcatttgcaaaagccattgaaaacggctattcacctgtgctagggtatgt

SEQ ID NO: 34069 - DNA, 75 bp, Artificial Sequence
  Synthetic
gtgttcagtcttcaaaaatatccaacagttatatatagcacttgggatgaacataaacccaactataactcaaaa

SEQ ID NO: 34070 - DNA, 75 bp, Artificial Sequence
  Synthetic
tatcagagatcaatatttcaggaatactcactggatgcaatatgcttctctaatacctgctagtgttggaggatt

SEQ ID NO: 34071 - DNA, 75 bp, Artificial Sequence
  Synthetic
taattatatggctatgtcaagatgttttgtaaggaatattggagatcctacagttgctgcattggccgatatcaa

SEQ ID NO: 34072 - DNA, 75 bp, Artificial Sequence
  Synthetic
tttgtaaggaatattggagatcctacagttgctgcattggccgatatcaagagattcataagagttaatctttta

SEQ ID NO: 34073 - DNA, 75 bp, Artificial Sequence
  Synthetic
gatcgaggtgttctctacagaattatgaatcaggaaccaggtgaatcttctttcttagactgggcttcagaccca

SEQ ID NO: 34074 - DNA, 75 bp, Artificial Sequence
  Synthetic
tattcatgcaatttaccacaatctcaaaacataactaccatgattaaaaatattactgcaagaaatgttttgcag

SEQ ID NO: 34075 - DNA, 75 bp, Artificial Sequence
  Synthetic
gatgcaccaaatccattattatctgggctattcacaaccacaatgatagaggaggatgaagggttagctgaattc

SEQ ID NO: 34076 - DNA, 75 bp, Artificial Sequence
  Synthetic
ctaatggatcgtagaataattctcccaagagttgcacatgacattctggataattcacttaccggaattagaaat

SEQ ID NO: 34077 - DNA, 75 bp, Artificial Sequence
  Synthetic
gcaatagctgggatgttggatacaacaaaatcgctaatcagagtagggatagacagaggaggcttaacctacaat

SEQ ID NO: 34078 - DNA, 75 bp, Artificial Sequence
  Synthetic
ctattgaggaaaatcggcaactacgatcttgtacaatatgagacccttagtaaaactttaagattaatagtcagt

SEQ ID NO: 34079 - DNA, 75 bp, Artificial Sequence
  Synthetic
gacaaggttaaatacgaggatatgtgctcagtagatctagctatatcactgagacaaaaaatgtggatgcatcta

SEQ ID NO: 34080 - DNA, 75 bp, Artificial Sequence
  Synthetic
tcaggagggagaatgataaatggacttgaaactccagaccctttagagttactgtcagggataataataacaggg

SEQ ID NO: 34081 - DNA, 75 bp, Artificial Sequence
  Synthetic
actgtcagggataataataacagggtctgaacattgtagaatatgctattcaacagaaggaggaagcccatatac

SEQ ID NO: 34082 - DNA, 75 bp, Artificial Sequence
  Synthetic
tggctcaattacagatgaaaggtctgaagctcaattaggatacataaagaatctgagtaaaccagccaaagctgc

SEQ ID NO: 34083 - DNA, 75 bp, Artificial Sequence
  Synthetic
atctgagtaaaccagccaaagctgcgataagaatagcaatgatatacacttgggcatttggaaatgacgagatat

SEQ ID NO: 34084 - DNA, 75 bp, Artificial Sequence
  Synthetic
catggatggaagcagcacagattgcacagacgcgtgcaaacttcacactggatagcttaaagattttgacaccag

SEQ ID NO: 34085 - DNA, 75 bp, Artificial Sequence
  Synthetic
taacaacatcgacgaatctatcacacagattaaaagacactgctactcaaatgaagttttctagtacatcacttg

SEQ ID NO: 34086 - DNA, 75 bp, Artificial Sequence
  Synthetic
tcagagtaagtaggtttatcacaatatctaatgataatatgtcgattaaagaggcaaatgaaaccaaagatacaa

SEQ ID NO: 34087 - DNA, 75 bp, Artificial Sequence
  Synthetic
atctaatttatcaacaagtaatgttaacagggttgagtgtgtttgaatatctgttcagattagaagaaagtacag

SEQ ID NO: 34088 - DNA, 75 bp, Artificial Sequence
  Synthetic
ggcacaaccctgtggtaatgcatttgcatatagaagacagatgctgcgttaaggagagttacaacgatgaacata

SEQ ID NO: 34089 - DNA, 75 bp, Artificial Sequence
  Synthetic
taaatccagaatccacattagagttaattaaataccctgaaagcaatgagtttatatatgataaggaccctctaa

SEQ ID NO: 34090 - DNA, 75 bp, Artificial Sequence
  Synthetic
aagatgtagatttatcaaagttaatgactataagggatcactcttatactattgatatgaattactgggacgata

SEQ ID NO: 34091 - DNA, 75 bp, Artificial Sequence
  Synthetic
cagatatcgtacatgcaatatcaatatgcactgcggtcacaatagcagatactatgtcacagcttgaccgagata

SEQ ID NO: 34092 - DNA, 75 bp, Artificial Sequence
  Synthetic
accttaaggaactagtagttattgcaaatgatgatgacattaacagcctgataactgaattcctaactcttgaca

SEQ ID NO: 34093 - DNA, 75 bp, Artificial Sequence
  Synthetic
tattggtattccttaagacatttggaggattgctagtaaatcaattcgcttatactctttatggtctaaaagtgg

SEQ ID NO: 34094 - DNA, 75 bp, Artificial Sequence
  Synthetic
aagggagagatccaatatgggattatataatgagaacattaaaggatacctcacattctgtacttaaagtattat

SEQ ID NO: 34095 - DNA, 75 bp, Artificial Sequence
  Synthetic
ctaacgcattatctcatcctaaagtttttaagagattttgggactgtggggttttgaatcctatttatggtccta

SEQ ID NO: 34096 - DNA, 75 bp, Artificial Sequence
  Synthetic
atactgccagtcaagaccaaatcaagcttgctctctcaatttgcgaatattccctagatttatttatgagagaat

SEQ ID NO: 34097 - DNA, 75 bp, Artificial Sequence
  Synthetic
atagctaatgatagaagacaagcatttatctcaagacatcttgcttttgtgtgctgtttagcagaaatagcatct

SEQ ID NO: 34098 - DNA, 75 bp, Artificial Sequence
  Synthetic
tttggaccaagcttactaaatctaacatatttagagaggctggatgaattaaaacgctacttagatctaaatatt

SEQ ID NO: 34099 - DNA, 75 bp, Artificial Sequence
  Synthetic
aaggaagatccgactcttaaatatgtacaaatatcaggattactgattaaatcattcccctcaaccgtcacatat

SEQ ID NO: 34100 - DNA, 75 bp, Artificial Sequence
  Synthetic
gtaagaaaaactgcaatcaaatatctaagaatccgaggaattgatccgcctgaaacaattgaagattgggatccc

SEQ ID NO: 34101 - DNA, 75 bp, Artificial Sequence
  Synthetic
tgaaacaattgaagattgggatcccatagaagatgagaacaccctagacaatattgttaaaactgtaaatgataa

SEQ ID NO: 34102 - DNA, 75 bp, Artificial Sequence
  Synthetic
ttgcaataacaatcagaaaaagaataaaaccaattatttctggggattagctttaaagaattatcaagtcataag

SEQ ID NO: 34103 - DNA, 75 bp, Artificial Sequence
  Synthetic
aataagatctataacatgtgaatctagtgttgatgaagcctcgaatgatagtgtccatggattaacactccctga

SEQ ID NO: 34104 - DNA, 75 bp, Artificial Sequence
  Synthetic
aggaggaaattatctatcacatcagttgagattgtttggggtaaatagtacaagttgtttaaaagctcttgaact

SEQ ID NO: 34105 - DNA, 75 bp, Artificial Sequence
  Synthetic
atcacaaatcttgatgaaggaagttaagaaagataaggatagactctttttgggggagggagcaggagccatgtt

SEQ ID NO: 34106 - DNA, 75 bp, Artificial Sequence
  Synthetic
ggcatgttatgacgctacactaggtcccgcaataaattattataattctggattaaacattacagatgtcgttgg

SEQ ID NO: 34107 - DNA, 75 bp, Artificial Sequence
  Synthetic
acagcgagaattaaagatattcccatcagaagtgtcgttagtaggtaaaaaattaggtaatgtaacacaaattct

SEQ ID NO: 34108 - DNA, 75 bp, Artificial Sequence
  Synthetic
aattaggtaatgtaacacaaattcttaatcgcgtgagagtattgtttaatgggaatccaaactcaacatggatag

SEQ ID NO: 34109 - DNA, 75 bp, Artificial Sequence
  Synthetic
ggaatatggaatgcgagagtttaatatggagtgaattaaatgataaatcaattggtttagtacactgtgacatgg

SEQ ID NO: 34110 - DNA, 75 bp, Artificial Sequence
  Synthetic
aaggggcaataggtaaatcagaagagactgtattacatgaacattatagtattattagaattacatatctgattg

SEQ ID NO: 34111 - DNA, 75 bp, Artificial Sequence
  Synthetic
gagacgatgacgttgttctggtatcaaagattatacctactataactcccaattggtccaaaatactttatctat

SEQ ID NO: 34112 - DNA, 75 bp, Artificial Sequence
  Synthetic
ataaattgtattggagagatgtaagtgtagtatctcttaaaacatctaatcctgcttcaacagaattatatttaa

SEQ ID NO: 34113 - DNA, 75 bp, Artificial Sequence
  Synthetic
tttcgaaggatgcatattgtactgtaatggagcctagcaaccttgttttgtctaaactcaaaagaatatcaccaa

SEQ ID NO: 34114 - DNA, 75 bp, Artificial Sequence
  Synthetic
tagaagaaaacaatttattaaaatggataattatatctaaaaggaagaataatgaatggttgcaacatgaaatca

SEQ ID NO: 34115 - DNA, 75 bp, Artificial Sequence
  Synthetic
atgaaggagagagagattacggaataatgagaccatatcatacagcactacaaatatttggattccaaattaact

SEQ ID NO: 34116 - DNA, 75 bp, Artificial Sequence
  Synthetic
taaatcatttggcgaaggaattcttgtcaactcctgatttaaccaatattaatatcgtaatacaaagctttataa

SEQ ID NO: 34117 - DNA, 75 bp, Artificial Sequence
  Synthetic
gaacaattaaagatgttatattcgaatgggtcaatataacatctgatagtaagagacacaaattggggggaaaat

SEQ ID NO: 34118 - DNA, 75 bp, Artificial Sequence
  Synthetic
atgggtcaatataacatctgatagtaagagacacaaattggggggaaaatacaatctatatccactaaaaaataa

SEQ ID NO: 34119 - DNA, 75 bp, Artificial Sequence
  Synthetic
gggtaagttaaaactaatatcacgaagattaatcttaagttggatatcattatctttatcaactaggttattgac

SEQ ID NO: 34120 - DNA, 75 bp, Artificial Sequence
  Synthetic
aggtcgtttcccagatgaaaagtttgaaagcagagcacagactggatatgtatcattagctgatactgatttgga

SEQ ID NO: 34121 - DNA, 75 bp, Artificial Sequence
  Synthetic
atccttaaagttgctatcaagaaatattataaaagactataaagagaacataggattgatatcatactggttctt

SEQ ID NO: 34122 - DNA, 75 bp, Artificial Sequence
  Synthetic
gactaaagaaattaaaatattgatgaaacttataggaggagtcaagttattaggaattccaaaacagtataaaga

SEQ ID NO: 34123 - DNA, 75 bp, Artificial Sequence
  Synthetic
actagggaatcaatcatctcaaaggaatgaatattacgacgaattcgacattgattagtgtacaaaaacatcaac

SEQ ID NO: 34124 - DNA, 75 bp, Artificial Sequence
  Synthetic
cgacacacttaatccttgtctacctgccctcagcaaaaagaaaaataagaaaaacataaaatatatatataccaa

SEQ ID NO: 34125 - DNA, 75 bp, Artificial Sequence
  Synthetic
ctgccctcagcaaaaagaaaaataagaaaaacataaaatatatatataccaaacagagtttttctcttgtttggt

SEQ ID NO: 34126 - DNA, 75 bp, Artificial Sequence
  Synthetic
agacttgcttgggaatattaatttaaataaaaattaacttaggattaaagaacttgaccgaaaggtgaggggaaa

SEQ ID NO: 34127 - DNA, 75 bp, Artificial Sequence
  Synthetic
aacagttaaatccagtttggtattgagtggtgatgcagtggaacaaattggatcaattatgaggtcccagcagag

SEQ ID NO: 34128 - DNA, 75 bp, Artificial Sequence
  Synthetic
ataaggactttactaagagggaaatgcgacaatctaaagatgttccagtcgaggtatcaagaagtgatgccattc

SEQ ID NO: 34129 - DNA, 75 bp, Artificial Sequence
  Synthetic
tctgcagcaaaattagacctataccaagacaagagagttgtgtgtgtggcgaatgtcctaaacaatgcggatact

SEQ ID NO: 34130 - DNA, 75 bp, Artificial Sequence
  Synthetic
taggtcaattgagaaaataccagaaaacgacacacagatcaaatcagaaataaacagactgaatgatgaatctaa

SEQ ID NO: 34131 - DNA, 75 bp, Artificial Sequence
  Synthetic
cgaaaaccaggctacacacaggagaagaatcaaaaacttaggatcaaagaggtcaacacaaacgccaggaaacag

SEQ ID NO: 34132 - DNA, 75 bp, Artificial Sequence
  Synthetic
caacgtgtaggtgtattagtcagtaatcccaaaagtatgaagatttcacaaaattttgagacaagatacctaata

SEQ ID NO: 34133 - DNA, 75 bp, Artificial Sequence
  Synthetic
tctaattgttgcagttaaatcagtccaagattatgtcaacaatgaaattgtaccttcaattacaagattaggttg

SEQ ID NO: 34134 - DNA, 75 bp, Artificial Sequence
  Synthetic
tgaagcagcaggattacaactaggaattgcattgacacaacattactcagaattaacaaatatatttggtgataa

SEQ ID NO: 34135 - DNA, 75 bp, Artificial Sequence
  Synthetic
atttactacttcgacagttgaccaatatgatatttatgatctactattcactgagtcaatcaagatgagagtgat

SEQ ID NO: 34136 - DNA, 75 bp, Artificial Sequence
  Synthetic
agatgttgatttgagtgattactcaattactcttcaagttagacttcctttgttaactaaactatcaaatactca

SEQ ID NO: 34137 - DNA, 75 bp, Artificial Sequence
  Synthetic
aattacaattaggggtaattgacatttctgattataataatataagaataaattggacttggcataatgtactat

SEQ ID NO: 34138 - DNA, 75 bp, Artificial Sequence
  Synthetic
aaacagacatcaaaggggatgatgcaagatacaaagaaattacaaaaaacttaggagaaaagtgtgcaggagaaa

SEQ ID NO: 34139 - DNA, 75 bp, Artificial Sequence
  Synthetic
ttaactatttatatgaaagataaagcattatccccaaataaatcaaactgggacacagtctatccagcttcaaac

SEQ ID NO: 34140 - DNA, 75 bp, Artificial Sequence
  Synthetic
tcagaaacattattagcgaataacatagggaaattcttccaagagaatgggatggttaaaggggaaattgaacta

SEQ ID NO: 34141 - DNA, 75 bp, Artificial Sequence
  Synthetic
ggaggattaacctataacttattaagaaagataagcaactatgatcttgttcaatatgagacacttagtaaaact

SEQ ID NO: 34142 - DNA, 75 bp, Artificial Sequence
  Synthetic
attaagggtcccgtattttggatcagttacggatgaaagatccgaagcacaattggggtatatcaaaaatctaag

SEQ ID NO: 34143 - DNA, 75 bp, Artificial Sequence
  Synthetic
atcaacaaatctgtcacacaggttaaaagatactgctactcagatgaaattttctagtacatcacttattagagt

SEQ ID NO: 34144 - DNA, 75 bp, Artificial Sequence
  Synthetic
agagatcattcctatacgattgacatgaattattgggatgacacagacattgtacatgcaatatcaatatgtact

SEQ ID NO: 34145 - DNA, 75 bp, Artificial Sequence
  Synthetic
tactaagctggatatcattatccttatcaaccagattattgacgggtcgtttcccagatgaaaaatttgaaaata

SEQ ID NO: 34146 - DNA, 75 bp, Artificial Sequence
  Synthetic
catccattcactcctagaaaaacaaaaagtaagaaaaacatacaatatatatataccaaacagaacacttaatcc

SEQ ID NO: 34147 - DNA, 75 bp, Artificial Sequence
  Synthetic
gatgtaagtgtagtgtcccttaaaacatccaatcctgcctcaacagagctttatttaatttcaaaggatgcttac

SEQ ID NO: 34148 - DNA, 75 bp, Artificial Sequence
  Synthetic
accaaacaagagaagagacttgcttgggaatataaattcagataaaaattaacttaggattaaagaactttgccg

SEQ ID NO: 34149 - DNA, 75 bp, Artificial Sequence
  Synthetic
accaaacaagagaagagacttgcttgggaatataaattcagatataaattaacttaggattaaagaactttgccg

SEQ ID NO: 34150 - DNA, 75 bp, Artificial Sequence
  Synthetic
accaaacaagagaagagacttgcttgggaatataaattcagatacaaattaacttaggattaaagaactttgccg

SEQ ID NO: 34151 - DNA, 75 bp, Artificial Sequence
  Synthetic
accaaacaagagaagagacttgcttgggaatataaattcagatagaaattaacttaggattaaagaactttgccg

SEQ ID NO: 34152 - DNA, 75 bp, Artificial Sequence; identical to SEQ ID NO: 33858
  Synthetic

SEQ ID NO: 34153 - DNA, 75 bp, Artificial Sequence
  Synthetic
accaaacaagagaagagacttgcttgggaatattaattcagatataaattaacttaggattaaagaactttgccg

SEQ ID NO: 34154 - DNA, 75 bp, Artificial Sequence
  Synthetic
accaaacaagagaagagacttgcttgggaatattaattcagatacaaattaacttaggattaaagaactttgccg

SEQ ID NO: 34155 - DNA, 75 bp, Artificial Sequence
  Synthetic
accaaacaagagaagagacttgcttgggaatattaattcagatagaaattaacttaggattaaagaactttgccg

SEQ ID NO: 34156 - DNA, 75 bp, Artificial Sequence
  Synthetic
accaaacaagagaagagacttgcttgggaatatcaattcagataaaaattaacttaggattaaagaactttgccg

SEQ ID NO: 34157 - DNA, 75 bp, Artificial Sequence
  Synthetic
accaaacaagagaagagacttgcttgggaatatcaattcagatataaattaacttaggattaaagaactttgccg

SEQ ID NO: 34158 - DNA, 75 bp, Artificial Sequence
  Synthetic
accaaacaagagaagagacttgcttgggaatatcaattcagatacaaattaacttaggattaaagaactttgccg

SEQ ID NO: 34159 - DNA, 75 bp, Artificial Sequence
  Synthetic
accaaacaagagaagagacttgcttgggaatatcaattcagatagaaattaacttaggattaaagaactttgccg

SEQ ID NO: 34160 - DNA, 75 bp, Artificial Sequence
  Synthetic
accaaacaagagaagagacttgcttgggaatatgaattcagataaaaattaacttaggattaaagaactttgccg

SEQ ID NO: 34161 - DNA, 75 bp, Artificial Sequence
  Synthetic
accaaacaagagaagagacttgcttgggaatatgaattcagatataaattaacttaggattaaagaactttgccg

SEQ ID NO: 34162 - DNA, 75 bp, Artificial Sequence
  Synthetic
accaaacaagagaagagacttgcttgggaatatgaattcagatacaaattaacttaggattaaagaactttgccg

SEQ ID NO: 34163 - DNA, 75 bp, Artificial Sequence
  Synthetic
accaaacaagagaagagacttgcttgggaatatgaattcagatagaaattaacttaggattaaagaactttgccg

SEQ ID NO: 34164 - DNA, 75 bp, Artificial Sequence
  Synthetic
caagcatttatctcaagacatcttgcttttgtgtgttgtttagcagagatagcatcttttggaccaaatctactg

SEQ ID NO: 34165 - DNA, 75 bp, Artificial Sequence
  Synthetic
agtagtgaacccctgatgtacacttgcgctaataacataccaaaatggaaccatttaatttacctccacgagatc

SEQ ID NO: 34166 - DNA, 75 bp, Artificial Sequence
  Synthetic
agcagatcaaggaggctgaggccaagtacttagcagaacaacagcagtaaatcggccatattattcataggcagt

SEQ ID NO: 34167 - DNA, 75 bp, Artificial Sequence
  Synthetic
ttgtggttgaatacaataaactcatacggcaatgtcaggacccccacactggcagagacatattaactgctatga

SEQ ID NO: 34168 - DNA, 75 bp, Artificial Sequence
  Synthetic
taattaaccgatcattaattaatctaagtaatcatataagcaaaaaataaaaacaaaaaacaaaaaaagagttat

SEQ ID NO: 34169 - DNA, 75 bp, Artificial Sequence
  Synthetic
ctatggatagacataattactttgccagagaatactgcagagctattaatattgaatatcgagatgatgtacctg

SEQ ID NO: 34170 - DNA, 75 bp, Artificial Sequence
  Synthetic
aaaactacaaaaactacaaaaaacacaaaaaaacaaaaaaatacaaaaaataattaattttaagttagattaagc

SEQ ID NO: 34171 - DNA, 75 bp, Artificial Sequence
  Synthetic
ctgttgatattgttatggagatggtaccagatctcgatcttgggaaaatagaaatacctgatgtcaccccagaca

SEQ ID NO: 34172 - DNA, 75 bp, Artificial Sequence
  Synthetic
cctaatgggcaacaacaaacaacagctagcagcatgttttagtaaatttaagtagctgttaatgcagaggtaaag

SEQ ID NO: 34173 - DNA, 75 bp, Artificial Sequence
  Synthetic
attactatagagatggtgctaaaatctatataatagatttcaaagtatcagtatcagatgaaacagggcaattaa

SEQ ID NO: 34174 - DNA, 75 bp, Artificial Sequence
  Synthetic
cagctagcagcatgttttagtaaatttaagtagctgttaatgcagaggtaaagcgttccaaggaagaacactact

SEQ ID NO: 34175 - DNA, 75 bp, Artificial Sequence
  Synthetic
catacaaaaaatacaacaatatttttggagacatcttcaatcctcttggagttcaatatgaggttgttataataa

SEQ ID NO: 34176 - DNA, 75 bp, Artificial Sequence
  Synthetic
gaatggacccatctacaatgaggatgaccatcagttctgacaatttcatgcaacttttcccacaggttgctatga

SEQ ID NO: 34177 - DNA, 75 bp, Artificial Sequence
  Synthetic
atatagattttaattggtactttagactcaaagacagcctctttgacaaattcagagatgatgaggattttttag

SEQ ID NO: 34178 - DNA, 75 bp, Artificial Sequence
  Synthetic
ccttaacttcccacggcgagttcactccaactatgccgtgggtcacagacgacactccagagctggcagaccacc

SEQ ID NO: 34179 - DNA, 75 bp, Artificial Sequence
  Synthetic
ctatcttcatagaatttatggagtcaatgccaatagatcaacaaagagacttcatgaccgccatgaattacaacg

SEQ ID NO: 34180 - DNA, 75 bp, Artificial Sequence
  Synthetic
cattcaaatcagaaaagtggagcgatcttctacacatatatatgaaaaggtacggtcagaagtacgaaaagttca

SEQ ID NO: 34181 - DNA, 75 bp, Artificial Sequence
  Synthetic
taagagatcaagcaaaagaagtgtttctagtagatggtaactataacaagccaactcaatcagagattctagaag

SEQ ID NO: 34182 - DNA, 75 bp, Artificial Sequence
  Synthetic
gctggaaagaaatgtacaccagaatacaagatgcaagggagattactcaagatatatcaaagcaaaagccaagca

SEQ ID NO: 34183 - DNA, 75 bp, Artificial Sequence
  Synthetic
ttcactttatatggactcatcatgacaataacaaaccaacaggaaatgaggcaaagattattaggttggctaaat

SEQ ID NO: 34184 - DNA, 75 bp, Artificial Sequence
  Synthetic
tattgcaaaagatagatgttaatgataatgcatcaaaagcattcaaagctatgggctttttaatggatttctctt

SEQ ID NO: 34185 - DNA, 75 bp, Artificial Sequence
  Synthetic
cagatgttgaaaaatatagaaatttctgcagtaatctaaagggtgaagcaagatcttcaataaaacctaaaagct

SEQ ID NO: 34186 - DNA, 75 bp, Artificial Sequence
  Synthetic
caaggatagaacctgtccaaataaatcagtgtactatcctatgggagcagcaatttaaaatggatgcgggaataa

SEQ ID NO: 34187 - DNA, 75 bp, Artificial Sequence
  Synthetic
tgaacaaaaatgttcggattagattcttgaaagatttctgtggaattggtggtcataagaattttaaagatagga

SEQ ID NO: 34188 - DNA, 75 bp, Artificial Sequence
  Synthetic
tgatagatgatattgaccttggtaagcctagaatccttgactttgaagataaaaacgtgatacaagcagcagaga

SEQ ID NO: 34189 - DNA, 75 bp, Artificial Sequence
  Synthetic
taatgttcaagcagacaaaaggctacttgtccaaagaatcaggtttggaaaaaataggcaacatattgggagaat

SEQ ID NO: 34190 - DNA, 75 bp, Artificial Sequence
  Synthetic
acaaggacgaaataacaggtgcaagtgagaaaacatggctccatatagaatcaatttctaaatccagattttggc

SEQ ID NO: 34191 - DNA, 75 bp, Artificial Sequence
  Synthetic
agtgtattaatgatatatctgtgctgataaagaatatgttatccgtatctcaatataataagcaccataccttca

SEQ ID NO: 34192 - DNA, 75 bp, Artificial Sequence
  Synthetic
gagtagtaacaagtgctaataacaacttctttggtatagtgtacccatcagcgagcataaaatctaagcaatcca

SEQ ID NO: 34193 - DNA, 75 bp, Artificial Sequence
  Synthetic
ccattgttttttctagtgtatgcttacatcaagacccatatgatgtattgacgtgcgggtcactgtacaggactt

SEQ ID NO: 34194 - DNA, 75 bp, Artificial Sequence
  Synthetic
ataaattgggtccgaatgagtacatatccatatctaaagctattagattagataaagaaaggtgccaaaggctag

SEQ ID NO: 34195 - DNA, 75 bp, Artificial Sequence
  Synthetic
tgacatcaccaggcttattcctaatgacatgccttctttttaaaggagataatgatatattgctggaagaaataa

SEQ ID NO: 34196 - DNA, 75 bp, Artificial Sequence
  Synthetic
tggcattctcattctttacatcattgtcgataacaaagagcatgctttcattgacagagccctcacgttatatga

SEQ ID NO: 34197 - DNA, 75 bp, Artificial Sequence
  Synthetic
taatgaattcacttgccttatcaagtcatgttagagagtatatagcagaaaagtttgccccatacactaagaccc

SEQ ID NO: 34198 - DNA, 75 bp, Artificial Sequence
  Synthetic
tattttcagtctatatgactcaattgatcaaaaagggctgtatgtctgcaaatgatcagaaggacaagattagct

SEQ ID NO: 34199 - DNA, 75 bp, Artificial Sequence
  Synthetic
taaaagatgtcttcttaaatgagttcgagataacacaaaaaggagtctcaatggaaaggaatctgcagtctatct

SEQ ID NO: 34200 - DNA, 75 bp, Artificial Sequence
  Synthetic
ggtttccggggaaagtcaatctacaagaatacataatgcaagtctacttgccattttacttcaatcctaaaggcc

SEQ ID NO: 34201 - DNA, 75 bp, Artificial Sequence
  Synthetic
tacataataaacatcatgttatgattgacctagcaaaaactgttttagagatagaattggagcagaggatagagc

SEQ ID NO: 34202 - DNA, 75 bp, Artificial Sequence
  Synthetic
tcccaaatccatggtctacaacatttataaagcaaagtgcaaatctagatatactaatctactctattgccaaaa

SEQ ID NO: 34203 - DNA, 75 bp, Artificial Sequence
  Synthetic
tgctgaagatggacactgcaaaacataaccacttaagagccagggttgagagtagaaacaattttaagaggtcat

SEQ ID NO: 34204 - DNA, 75 bp, Artificial Sequence
  Synthetic
tgactagtatttctacatttacgagctcgaaatcttgtatcaaaattggagattttgaagagataaaatccaaaa

SEQ ID NO: 34205 - DNA, 75 bp, Artificial Sequence
  Synthetic
ctgttgaccgattggcaaagctaaagaacaaggaagcaaggagaaccagagtagccaactcagattttgttgcag

SEQ ID NO: 34206 - DNA, 75 bp, Artificial Sequence
  Synthetic
aagatgaaatagatctagaagtagcacatagtaactataaagatctgaaaaaatgtgttccaaattacacagatt

SEQ ID NO: 34207 - DNA, 75 bp, Artificial Sequence
  Synthetic
atatgtctacaaaagtctttgatcggttatacgaatcatacagaacaggtttaattgaagataaacctgctatag

SEQ ID NO: 34208 - DNA, 75 bp, Artificial Sequence
  Synthetic
aagttatcatgaagacaatgaagacgcatactgattttaaattttgcttcttcaacaaagggcagaagactgcaa

SEQ ID NO: 34209 - DNA, 75 bp, Artificial Sequence
  Synthetic
aagatcgagagatctttgtaggagagttggaagcaaaattttgcctatatgcagtggaacgaattgcaaaggaga

SEQ ID NO: 34210 - DNA, 75 bp, Artificial Sequence
  Synthetic
gatgcaagcttaatcctgaagagatgatatcagaacctggagacagcaaattaaaaaaactagagctaaactcag

SEQ ID NO: 34211 - DNA, 75 bp, Artificial Sequence
  Synthetic
aatctgagataaggtatctgatagatgcactcagagacaagaacaaggacccagatgcaaaattagatggtatca

SEQ ID NO: 34212 - DNA, 75 bp, Artificial Sequence
  Synthetic
aaattgagatcaatgcagatatgtcaaaatggagtgcacaagatgtgttctttaagtacttttggcttatcgtat

SEQ ID NO: 34213 - DNA, 75 bp, Artificial Sequence
  Synthetic
tagatcctatactgtatcctaaagaaaagaagaggataatctatttcttctgcaattatatgaataaagagctaa

SEQ ID NO: 34214 - DNA, 75 bp, Artificial Sequence
  Synthetic
tcttaccagacgaaatgatgtgctcattacttgatcagaaagcagaaagggaggatgacattatcagacagatga

SEQ ID NO: 34215 - DNA, 75 bp, Artificial Sequence
  Synthetic
caaatggattcagaacaaatacagtaaatataaagcgcaattggctgcaagggaacctaaattacacatctagct

SEQ ID NO: 34216 - DNA, 75 bp, Artificial Sequence
  Synthetic
atgtccacagttgttcaatgatggtttttaaagatattattaaagaaatggccttacttctagatgggcaatgtc

SEQ ID NO: 34217 - DNA, 75 bp, Artificial Sequence
  Synthetic
acgtgagtagcatggtacattcagatgacaatcagacatctatcataatggttcaagataaagtcaataatgaca

SEQ ID NO: 34218 - DNA, 75 bp, Artificial Sequence
  Synthetic
tgctcattcattctttctgtaatttatttgagagagtatgccgaacctttgggaatcaagcaaatatgaaaaaga

SEQ ID NO: 34219 - DNA, 75 bp, Artificial Sequence
  Synthetic
cttatgtcaccaaccacattaaagagtttgtaagcctttttaatatatacggtgaaccattttccatctatggaa

SEQ ID NO: 34220 - DNA, 75 bp, Artificial Sequence
  Synthetic
gattccttcttcctgctgtaggagactgtgcatatattgggccttatgaagacatggcaagtaggttgtctgcta

SEQ ID NO: 34221 - DNA, 75 bp, Artificial Sequence
  Synthetic
cacaaactgcaattaaacacgggtgcccaccaagtcttgcttggactagtatagcccttaatcaatgggtcactt

SEQ ID NO: 34222 - DNA, 75 bp, Artificial Sequence
  Synthetic
ttagcacatataacatgttgccaggacagacgaatgaccctgccaggatttttgaatgcagaagggacgaaatcc

SEQ ID NO: 34223 - DNA, 75 bp, Artificial Sequence
  Synthetic
caatagagttatgtgggctgttaaagtcagagctttcaaccattgcacttgttggtcttgaatcaggtaatatct

SEQ ID NO: 34224 - DNA, 75 bp, Artificial Sequence
  Synthetic
catttttaacatctctaatcaagagaatgtccccagtcaaggtgttaaaagaatcaatacaaactcaatgtcaat

SEQ ID NO: 34225 - DNA, 75 bp, Artificial Sequence
  Synthetic
tcatcaacgaatgggatctggaaaagttgacaaaaatggacatcctgaggttaaaaatattgagatatgtagttc

SEQ ID NO: 34226 - DNA, 75 bp, Artificial Sequence
  Synthetic
ttgacagcgagcttaatgaggaagataaaatgggagagacaagtgaaatgaggagtcgttctttaataacaccta

SEQ ID NO: 34227 - DNA, 75 bp, Artificial Sequence
  Synthetic
ggaagttcactacaacaagctctttagaaaggcttgtatcatacaaagagttccaagatataatatcggatcaaa

SEQ ID NO: 34228 - DNA, 75 bp, Artificial Sequence
  Synthetic
ccagatcaaatgacttatttgaatatcttcttgctaaacctgaactactagtaaccaaaggtgaggatgccaacg

SEQ ID NO: 34229 - DNA, 75 bp, Artificial Sequence
  Synthetic
aatttatgactactattctatatagatataattcaaagaagtttaaagagtcattgtccattcagagccctacgc

SEQ ID NO: 34230 - DNA, 75 bp, Artificial Sequence
  Synthetic
aactctttgtagagcaaatcctattttcaaataagcctacaatcgactattctggtatatatgagaaaattatgt

SEQ ID NO: 34231 - DNA, 75 bp, Artificial Sequence
  Synthetic
cagcagcagacattccacaactgcaaaattacactggtataataggtagaaagacaatcccggagacatttaaag

SEQ ID NO: 34232 - DNA, 75 bp, Artificial Sequence
  Synthetic
ctatacaagaggaccttgaaggattgcagttaacaacatcagacatccacatggtttattccttttgcatcttga

SEQ ID NO: 34233 - DNA, 75 bp, Artificial Sequence
  Synthetic
atgatccgctgaacacaactgcatgtaatgcaattctcttgtcacaagtccaatcattgatggatcgcaccagta

SEQ ID NO: 34234 - DNA, 75 bp, Artificial Sequence
  Synthetic
tgtccgcaatcaccatgcctgaatttcgaagcatgaaactcataacgcattctccagccttagttctccgagcat

SEQ ID NO: 34235 - DNA, 75 bp, Artificial Sequence
  Synthetic
acatccatagagatttcacagtgggaggggcagtagaagatatgatgcagagagatgttttccatctagaagaat

SEQ ID NO: 34236 - DNA, 75 bp, Artificial Sequence
  Synthetic
tcatacagaccacaaggatcagagaaaaagtagaaaggaaaattcaagaaaagaatgcactgacacctgacagag

SEQ ID NO: 34237 - DNA, 75 bp, Artificial Sequence
  Synthetic
acctagtttttgagctcaaagagtggacaaagttctaccaaacatgctatgactatatcaaatcgacagagcaca

SEQ ID NO: 34238 - DNA, 75 bp, Artificial Sequence
  Synthetic
aagtcaaggtttttattctgccaactagagcatacacagcctttgatttttgtgctgcaatacacggaaatctaa

SEQ ID NO: 34239 - DNA, 75 bp, Artificial Sequence
  Synthetic
tgaaagacaagggttggtatgctatacattacttgaagcagatagtttctggatcaaagaaagcatttgttagta

SEQ ID NO: 34240 - DNA, 75 bp, Artificial Sequence
  Synthetic
ccacacccacaggtgagcaattagtcatagacgaatgttttagactggtgtcacattttgcagatacatttatag

SEQ ID NO: 34241 - DNA, 75 bp, Artificial Sequence
  Synthetic
attcttcatcacgtagatattttgttcagacagtggtcgagcaattcacatataaaaatttaccagtctcagagt

SEQ ID NO: 34242 - DNA, 75 bp, Artificial Sequence
  Synthetic
tatacagaaaaatgaaaaacagcagtcagaggaagcatttcctcccgctcttgttcaacatgaaggacataaagc

SEQ ID NO: 34243 - DNA, 75 bp, Artificial Sequence
  Synthetic
aaaacgaccttgacaaatataatgcagataaaacagctaataaagcaacatggaacgattggcagattaataggc

SEQ ID NO: 34244 - DNA, 75 bp, Artificial Sequence
  Synthetic
atttaaacactggacccatcgacttgacaatcaaaggcgacactagaaccatgagaattgtaggtgaagataacc

SEQ ID NO: 34245 - DNA, 75 bp, Artificial Sequence
  Synthetic
aacttatcctggccgaattgtatataaatgaaggtgactatacaccaccagaaaaccatgctcgcaaattattaa

SEQ ID NO: 34246 - DNA, 75 bp, Artificial Sequence
  Synthetic
acacaaaacacaatttgaggtttgaagcaatgaaagaaataccagtcatggaaccagattgctattatatatgtt

SEQ ID NO: 34247 - DNA, 75 bp, Artificial Sequence
  Synthetic
ggcagaaaaaatcaaagtactacacacattaccaaatgttgttatcaaatgttataaatgctagaaatgaagcac

SEQ ID NO: 34248 - DNA, 75 bp, Artificial Sequence
  Synthetic
aggcaactggtgccaacaagtataatagactaatcccagtttgtatcgtccatgttgcaagagtacagccagaat

SEQ ID NO: 34249 - DNA, 75 bp, Artificial Sequence
  Synthetic
cgaaagtacttgtagcagatctacaatatatgaatgacatagcttcatttactagattgaagatgagtgaaacag

SEQ ID NO: 34250 - DNA, 75 bp, Artificial Sequence
  Synthetic
attatgccatggttagaagatgccatttctcaaaaatggtcttcttttctggtccagagataggagttggtcgcg

SEQ ID NO: 34251 - DNA, 75 bp, Artificial Sequence
  Synthetic
tcaatatcacgagacttctcagaaatccaagtctcttgacaatcaattattcttcattaagtcagacaccactgc

SEQ ID NO: 34252 - DNA, 75 bp, Artificial Sequence
  Synthetic
cagcattaatagacatctttgaatgtaatggtgttgaaatagaggatgatgaatttaattttttatctgatgaaa

SEQ ID NO: 34253 - DNA, 75 bp, Artificial Sequence
  Synthetic
tcttagaagaaacagaaacacagaccatcaatgctgtaccaatgttcaacataagttattcagttaaaactagga

SEQ ID NO: 34254 - DNA, 75 bp, Artificial Sequence
  Synthetic
gaggccatacttacaagaatgcgatacaagaagccattgccagaggtgttaatgattttgaggaacagtttgatt

SEQ ID NO: 34255 - DNA, 75 bp, Artificial Sequence
  Synthetic
tcagtggagaaggatttttctcatctaagggactgtcaatctgtgctctaatagttagcctcattgaccgatgca

SEQ ID NO: 34256 - DNA, 75 bp, Artificial Sequence
  Synthetic
acatgacagaatggtctgctgtgattaaaaaatgcatacatttgacatgctacacgaatgggaatgatagaatct

SEQ ID NO: 34257 - DNA, 75 bp, Artificial Sequence
  Synthetic
tccacaattttaaaatacctaggatttatttattggatcccatcaactatacaatagactgggagaaagtgagac

SEQ ID NO: 34258 - DNA, 75 bp, Artificial Sequence
  Synthetic
tgttcatattagggataaagatcagagacgaaaacaaccattggggtactgttttcaaaaatttcttcaaagatt

SEQ ID NO: 34259 - DNA, 75 bp, Artificial Sequence
  Synthetic
tattagatgccatggatgagcaaaggaaggtagagggcctgtcgtgggcagacctaatggaacaaatggatgaat

SEQ ID NO: 34260 - DNA, 75 bp, Artificial Sequence
  Synthetic
ataagggagcttgcgggattgactaccaagaataagctcaaaacaacaaccagatacagacatatttgccattgt

SEQ ID NO: 34261 - DNA, 75 bp, Artificial Sequence
  Synthetic
ctcaaaagaggcaatggcaaaaaaacaacattagacagcatacaaaatagacaactggtcaaaacatacatcagg

SEQ ID NO: 34262 - DNA, 75 bp, Artificial Sequence
  Synthetic
caatggcaaaaaaacaacattagacagcatacaaaatagacaactggtcaaaacatacatcaggggaacactact

SEQ ID NO: 34263 - DNA, 75 bp, Artificial Sequence
  Synthetic
agtagtgaactgctgttttacgtattcccgtctttggaaaacatataaacccatcgtgatgagcttcatcatctt

SEQ ID NO: 34264 - DNA, 75 bp, Artificial Sequence
  Synthetic
tttgttatcatgggcgctgagccctgctttgaccatcccaattgacaatcgctgttttgatgacggcttgttgat

SEQ ID NO: 34265 - DNA, 75 bp, Artificial Sequence
  Synthetic
agaggaaatggtcaagccatatggaatttcagaagtgtgcgttaaggatgatattagtttgataaaaacaattag

SEQ ID NO: 34266 - DNA, 75 bp, Artificial Sequence
  Synthetic
taaacaacatgataatggtacgtattattcaaatataataatgaggaaaatggttatccagaattatgaagaatg

SEQ ID NO: 34267 - DNA, 75 bp, Artificial Sequence
  Synthetic
caatcctgttgaagttgccaatggtcctataatgatattccgaccaaatacagatttgatgctgattcctcacac

SEQ ID NO: 34268 - DNA, 75 bp, Artificial Sequence
  Synthetic
atatgcctgcagagctgaatgtactatatctctagataaggacgatgcctctatcatactgcattcagaaaaatt

SEQ ID NO: 34269 - DNA, 75 bp, Artificial Sequence
  Synthetic
aaatcattacgaagttatgggaactacaactgctaccagatggtttcaagggagcacaacttattcattagagca

SEQ ID NO: 34270 - DNA, 75 bp, Artificial Sequence
  Synthetic
tacttgtgaacatattcaagttacttgtggtaatagggttctcacattccattcttgcttcaaacaccatatggc

SEQ ID NO: 34271 - DNA, 75 bp, Artificial Sequence
  Synthetic
atgcgttaggctattaaacaaaagctacatgccggcatttatgattaactctatatgtcagaataaggagcttat

SEQ ID NO: 34272 - DNA, 75 bp, Artificial Sequence
  Synthetic
aatcatgacagttgtagttttgattatattctcacttctatatattttaacattcacatatatttcttatctgtt

SEQ ID NO: 34273 - DNA, 75 bp, Artificial Sequence
  Synthetic
actgcccatcttcatgccagccacatatgtgtatgctaaaatctatgatagactttgcaagaaatgcgcatactg

SEQ ID NO: 34274 - DNA, 75 bp, Artificial Sequence
  Synthetic
tggtctagcatatcatccatttactaaatgtggagaaaactgtgtatgcggagcgagatttgagaattcagaaag

SEQ ID NO: 34275 - DNA, 75 bp, Artificial Sequence
  Synthetic
aatgaaaaaacatagagagtctaaaatgtgcaaaggttataaatatatgaggtcagcaagactgttgtgcaagaa

SEQ ID NO: 34276 - DNA, 75 bp, Artificial Sequence
  Synthetic
taaaggctctaatttctgtctagcaatagttttagcattcctattactgtctttcattcagcctatagaaggagt

SEQ ID NO: 34277 - DNA, 75 bp, Artificial Sequence
  Synthetic
ccaactgacatataatgggactactctagaactagaatcattaagtcaggaattagacaacatgatagctttgat

SEQ ID NO: 34278 - DNA, 75 bp, Artificial Sequence
  Synthetic
caacttggggaggctttacccgataattgcttcaattgtcttaggaacattcttgctgtttattataattttcaa

SEQ ID NO: 34279 - DNA, 75 bp, Artificial Sequence
  Synthetic
agcaatttcaaataagattgaagataagtatctccacagctttttatattattgcacagaatgcgatatgactca

SEQ ID NO: 34280 - DNA, 75 bp, Artificial Sequence
  Synthetic
tccaaaacgtggtctccatttttatctaggtggggaatttacaaataaatgcaattcatgcatgtgcggagtgat

SEQ ID NO: 34281 - DNA, 75 bp, Artificial Sequence
  Synthetic
atacccccaagaagatatcaataatgacccagattactgcattcctatcacacatcaaataaatgtgggctgcta

SEQ ID NO: 34282 - DNA, 75 bp, Artificial Sequence
  Synthetic
tgctcctgctagatatcatactagaaggtctatgtacaatttgacacattatatatatattgtggtgttgataat

SEQ ID NO: 34283 - DNA, 75 bp, Artificial Sequence
  Synthetic
attagtctgtatctctagttctattgctgatgatacagcaaaatgcatcaaacctgctgaatttagagaagtggc

SEQ ID NO: 34284 - DNA, 75 bp, Artificial Sequence
  Synthetic
cgatcctttaacttgttcagtttgggcaaaagcaaaatcttgttctgctgccgatattcagtctgctataactcg

SEQ ID NO: 34285 - DNA, 75 bp, Artificial Sequence
  Synthetic
agattctcttcctgctagagaaatatctatatttgaaaaaatgaatcatcctttaaataaaatgttggagttgac

SEQ ID NO: 34286 - DNA, 75 bp, Artificial Sequence
  Synthetic
tgagaaatcaacaggattactgcaagcatatttgatcgaagatgtggcatcaaaactccattgcaatgaaattag

SEQ ID NO: 34287 - DNA, 75 bp, Artificial Sequence
  Synthetic
agatattgatcaagagacaggcaaatacaataaattattcaaggaattactgacagaagcaaatcttgaaatatg

SEQ ID NO: 34288 - DNA, 75 bp, Artificial Sequence
  Synthetic
tgcccaaaagaaggaaacaaaactatgcgactgtttcacaggaggatcaacatgcaaacctgatgatacagctga

SEQ ID NO: 34289 - DNA, 75 bp, Artificial Sequence
  Synthetic
ccatactgtaggcttctacaccagcaatgaagtggcttacagatctgatgtaaagaagattatgaaatctttgat

SEQ ID NO: 34290 - DNA, 75 bp, Artificial Sequence
  Synthetic
caaaacgtttcctggcatagctgctaaagaagcattgcttgctatgaatgcaacatcctttactggtataaagaa

SEQ ID NO: 34291 - DNA, 75 bp, Artificial Sequence
  Synthetic
ttttacagagagaatcaaaacgttcttctctggagcaaaggctatcaaagcagcattgacattattgtgtaaagc

SEQ ID NO: 34292 - DNA, 75 bp, Artificial Sequence
  Synthetic
agttgcagacgggactctagaggcgaagcagttgcaacctgacaaggtgctgactcgatcattggtgccttttaa

SEQ ID NO: 34293 - DNA, 75 bp, Artificial Sequence
  Synthetic
cccagagtggaaaacaaagagtgtttttgaccaaattcaagaggcatcaccagtgaaagagtgcataacacccca

SEQ ID NO: 34294 - DNA, 75 bp, Artificial Sequence
  Synthetic
cataattcgatgcacgttcccaatgtcattaagatttcaattgttcgtcagttgtaagagtgaaggacataaatt

SEQ ID NO: 34295 - DNA, 75 bp, Artificial Sequence
  Synthetic
ctactatattcctgatactggatatgcagtaaagtatgatgcacagaatttatgtgtagcagatgcattctgcga

SEQ ID NO: 34296 - DNA, 75 bp, Artificial Sequence
  Synthetic
tgtagactttcaaccagtgcctacatcagaaaaaaccaaattacaggcattaagttgtctccgtataaattttga

SEQ ID NO: 34297 - DNA, 75 bp, Artificial Sequence
  Synthetic
taaaagcaagatgcaaaattcaataagtcaagtaaagtgtcaaaaaattgcactccatatttgctcatataagag

SEQ ID NO: 34298 - DNA, 75 bp, Artificial Sequence
  Synthetic
tcaaaatactacatttatggaatgtaaaaatgggttcttttatgaggttgataatgacatatttcaaagtgctaa

SEQ ID NO: 34299 - DNA, 75 bp, Artificial Sequence
  Synthetic
agatgaaataggcacatattgctttagtaagaattgtaaagccatgagatatcctcatcataaaagcaatctaca

SEQ ID NO: 34300 - DNA, 75 bp, Artificial Sequence
  Synthetic
agaatgtaggctgcatgggaaaagaatgcagttgaagtctttaaggagagtaagttatgatgatatagagcaata

SEQ ID NO: 34301 - DNA, 75 bp, Artificial Sequence
  Synthetic
caaacatagcttagaagaggctataaagacagacttggtggaacacaaatatactttaacagaaaatctgcccta

SEQ ID NO: 34302 - DNA, 75 bp, Artificial Sequence
  Synthetic
tactatgcccacattcattccagtatctatccagggtgttgaaactgatgcaggtgttgaaaattcatacattga

SEQ ID NO: 34303 - DNA, 75 bp, Artificial Sequence
  Synthetic
gtcaaatgttattgtacaaactggttcagccacaggctttaaaataaaaacaaaaaatggtgataatctattcga

SEQ ID NO: 34304 - DNA, 75 bp, Artificial Sequence
  Synthetic
gtcatatgttattgtacaaactggttcagccacaggctttaaaataaaaacaaaaaatggtgataatctattcga

SEQ ID NO: 34305 - DNA, 75 bp, Artificial Sequence
  Synthetic
gtcacatgttattgtacaaactggttcagccacaggctttaaaataaaaacaaaaaatggtgataatctattcga

SEQ ID NO: 34306 - DNA, 75 bp, Artificial Sequence
  Synthetic
gtcagatgttattgtacaaactggttcagccacaggctttaaaataaaaacaaaaaatggtgataatctattcga

SEQ ID NO: 34307 - DNA, 75 bp, Artificial Sequence
  Synthetic
tattatagtattcgtaaagagtgctcattatgaagcagtaatggatgaaatttaccaaactgggcccactattgg

SEQ ID NO: 34308 - DNA, 75 bp, Artificial Sequence
  Synthetic
gatgaatgttcaacacaatgagaaatgcacagggagctgcccagaaaacagagtaccccctggctggttatcatt

SEQ ID NO: 34309 - DNA, 75 bp, Artificial Sequence
  Synthetic
taaaagagagcgaacaagtcaatggggatgtgaagagtttggatgtatggccatcaatgaaggttgcgtgtgggg

SEQ ID NO: 34310 - DNA, 75 bp, Artificial Sequence
  Synthetic
taagtgtcaggacatcataaagccagacatgactatattgaggaaagcaactacagaaaacccagctattgaaat

SEQ ID NO: 34311 - DNA, 75 bp, Artificial Sequence
  Synthetic
atgtattgtgcttcctagcagtacttactgtcattccatctctagtttcaattcggtaataacacaaaagataga

SEQ ID NO: 34312 - DNA, 75 bp, Artificial Sequence
  Synthetic
aatgcaatttatatctaacgaatctgggaaggttccaaaacttgtgggttataagtcccataaagttttcaccgg

SEQ ID NO: 34313 - DNA, 75 bp, Artificial Sequence
  Synthetic
catgataaacgattatggctcgttttcaaaaatgtgtgggagtgttcaaatgatgaataaaagtatcaatggtgc

SEQ ID NO: 34314 - DNA, 75 bp, Artificial Sequence
  Synthetic
tggtaatcctaggtttgattatgtttgtcatagcgccagcagaaaggaagtaattatgagtaggtgctttgataa

SEQ ID NO: 34315 - DNA, 75 bp, Artificial Sequence
  Synthetic
tttttatgattcatgtcttcaattaaaaccagaacatgatttaatttatgacacacaatccaggaaaatctctct

SEQ ID NO: 34316 - DNA, 75 bp, Artificial Sequence
  Synthetic
gctgaacaagcttatgggagaaataaaattaaaaattaaattaggagatatcgcatataaagtatttgaaaagaa

SEQ ID NO: 34317 - DNA, 75 bp, Artificial Sequence
  Synthetic
gccccaatttgacctcaaaggttcttgtgttggttgtataaattgcatagaagggattgactgccaattagatat

SEQ ID NO: 34318 - DNA, 75 bp, Artificial Sequence
  Synthetic
agctgcagatatagatgcattgtgcccaattgtatccaattgtcaattttaccacagcaatattcagatattaat

SEQ ID NO: 34319 - DNA, 75 bp, Artificial Sequence
  Synthetic
ttcaactaataaatatggtttaaaagctaaatgctcatcagaaactatcaatatagatatatgtggaaataaggc

SEQ ID NO: 34320 - DNA, 75 bp, Artificial Sequence
  Synthetic
agaaattcaaatatctataatccagccacatgatacaattcaagtaggcaatagtgaccaaacttactttgttaa

SEQ ID NO: 34321 - DNA, 75 bp, Artificial Sequence
  Synthetic
agagaatgacttaagatgtggaacttggctgtgcaaagtaaaggatcagggaatttcagcactgctatcgccgct

SEQ ID NO: 34322 - DNA, 75 bp, Artificial Sequence
  Synthetic
gtatagcatattcggtaattatgcaaatattgctttttatgttattttgggagtagtggttttctttctaatttt

SEQ ID NO: 34323 - DNA, 75 bp, Artificial Sequence
  Synthetic
ttattttatgattcccgtattcggaagaattagggatgctttaaagaagaatgaattagaatacactatggaaaa

SEQ ID NO: 34324 - DNA, 75 bp, Artificial Sequence
  Synthetic
cttgatacctatacaacatattagaaataagcaaggtcaaaggagaccacttctgaaggaaaaacaatatataaa

SEQ ID NO: 34325 - DNA, 75 bp, Artificial Sequence
  Synthetic
ataactggtaaactgaattggaataagacacaaaattcaacaaaaacacaactcaacaaacaataaaggaataaa

SEQ ID NO: 34326 - DNA, 75 bp, Artificial Sequence
  Synthetic
atgcaaaacacaaaacaaaaataacaataaaataataaaaagagggttcattagccctctaacgaaagtagaaca

SEQ ID NO: 34327 - DNA, 75 bp, Artificial Sequence
  Synthetic
gctgctataataatagcagctgttcataacagatttaagttttaccactatcagacgagaaacgtaacacagcag

SEQ ID NO: 34328 - DNA, 75 bp, Artificial Sequence
  Synthetic
ataatagcagctgttcataacagatttaagttttaccactatcagacgagaaacgtaacacagcagaacactact

SEQ ID NO: 34329 - DNA, 75 bp, Artificial Sequence
  Synthetic
agtagtgaacttccttggaagaatcgctatatgttcgagagttatatccagttgtatccaattgtacaaacatgt

SEQ ID NO: 34330 - DNA, 75 bp, Artificial Sequence
  Synthetic
ccttatcggtcactcagggttttgactttgctgacgatcaaccaggggaccctcaatttgtttttgatcctagac

SEQ ID NO: 34331 - DNA, 75 bp, Artificial Sequence
  Synthetic
aggcataccaagtgtttatcagtacttacggacaagggctacaggacctcagtgcggtacgtatcttcttgtcta

SEQ ID NO: 34332 - DNA, 75 bp, Artificial Sequence
  Synthetic
aggctagacaatgtaagcttaagatgcgtgaaaagaggataccacaaattaatactcgctttggagcactggtac

SEQ ID NO: 34333 - DNA, 75 bp, Artificial Sequence
  Synthetic
ttccgctggttaattgccatcatcccgacttcaggcagaatcgtatccctgggacagcactcacccttcgacgtg

SEQ ID NO: 34334 - DNA, 75 bp, Artificial Sequence
  Synthetic
tgtccgggttcattgccatgtacatcatgttccagtacgaagtttcccctgccaaccgagctatcatcgaaagaa

SEQ ID NO: 34335 - DNA, 75 bp, Artificial Sequence
  Synthetic
ctatcgttaatccaattgcaagagcaaaaaatcttgactgggacatcgggtataagctatatctatcgttcttgc

SEQ ID NO: 34336 - DNA, 75 bp, Artificial Sequence
  Synthetic
caggagcagaattctacctcttagagcttgacttctttcctctgtgcattgctatgtacagagttaaagatggaa

SEQ ID NO: 34337 - DNA, 75 bp, Artificial Sequence
  Synthetic
agcttgatgaagatttcctggacagaatcatggctcagcaggtggaaggcatgaaccaagacctatggactgtca

SEQ ID NO: 34338 - DNA, 75 bp, Artificial Sequence
  Synthetic
aatatgaagggttgattgagaaatctgagaagatcgtcaacaatctccaatggaaagacaagcctgctggcagaa

SEQ ID NO: 34339 - DNA, 75 bp, Artificial Sequence
  Synthetic
tcacacaggctggccttgaattcctaagaaagagaggaattgcaatgagaaagtatggcccctctgcaccgctat

SEQ ID NO: 34340 - DNA, 75 bp, Artificial Sequence
  Synthetic
caattcagggagccactgctcttcccatgctaacaagtacacagagtcagcaacaacaattgcagagccagcaga

SEQ ID NO: 34341 - DNA, 75 bp, Artificial Sequence
  Synthetic
gcgccacaccagctgcttacaccttcccaggtatgcagtatttccaaccgcaaatgtatcagagtatccctcagg

SEQ ID NO: 34342 - DNA, 75 bp, Artificial Sequence
  Synthetic
ctagtatataccaacctcagatccaacttcagcaaccaatgatcaaccagcagcaatatgcttctctaggagcta

SEQ ID NO: 34343 - DNA, 75 bp, Artificial Sequence
  Synthetic
agccaaaggtcaacagtcagctgatgaccccgataagctttggtgctccacaggtggccccaagacagcaaggtt

SEQ ID NO: 34344 - DNA, 75 bp, Artificial Sequence
  Synthetic
tgccatttctgaatgcagcaggacccaatttgcaaagtgtgattccacctcaacaaaaattacaagctgccccac

SEQ ID NO: 34345 - DNA, 75 bp, Artificial Sequence
  Synthetic
taccacagctgacggtcactcaggaagagagtgacgcaggggcttctgcagggagtctagatgatatgactgaag

SEQ ID NO: 34346 - DNA, 75 bp, Artificial Sequence
  Synthetic
aacagctgacatttggagatttctctgcaggagaggatcgcctatcctactatgagaagcttgggtacacacctg

SEQ ID NO: 34347 - DNA, 75 bp, Artificial Sequence
  Synthetic
acgcgaaaaaatgcgtataacaaacctgtacatccaaaaaagatcggggcaaataaaaccttgaaagggagtttt

SEQ ID NO: 34348 - DNA, 75 bp, Artificial Sequence
  Synthetic
taatttagtgttagtgcacaaaatgtctgattactttttgcataagtatgttttaagcacaaacttagcaggaca

SEQ ID NO: 34349 - DNA, 75 bp, Artificial Sequence
  Synthetic
cccctctcttctttctacagaaaatgggcagtgaaacattgagtgtaattcaagtcagattaaggaatatatatg

SEQ ID NO: 34350 - DNA, 75 bp, Artificial Sequence
  Synthetic
ttggataatgatcatacagcttatgaaagattctaaagggatttttgagaaggattggggtgaaggatatataac

SEQ ID NO: 34351 - DNA, 75 bp, Artificial Sequence
  Synthetic
ataatgataaagtagcattgcttaaaataacatgtcataccaatagattaatacttctaactcacacattggcca

SEQ ID NO: 34352 - DNA, 75 bp, Artificial Sequence
  Synthetic
tgatcatatgtttttagatttaaatgtcttttttgatgcatataaaacatatttgttatgttttcataaaggtta

SEQ ID NO: 34353 - DNA, 75 bp, Artificial Sequence
  Synthetic
aatcagtcatacatacaattaaattaagtggtatagtattcatacatattataaccagtagtgattactgtccta

SEQ ID NO: 34354 - DNA, 75 bp, Artificial Sequence
  Synthetic
tggaaaagctaaattagaatgtgatatgaatacatcagatcttttttgtacattagagttaatagatatcagcta

SEQ ID NO: 34355 - DNA, 75 bp, Artificial Sequence
  Synthetic
catctgatattatcaatagtgccaatttcacttcaatgcctatattacaaaatggaggatatatatgggaattga

SEQ ID NO: 34356 - DNA, 75 bp, Artificial Sequence
  Synthetic
ttggaaatccatgtccaaggtgttcttagaacaaaaagtagtgaagcacataattaatcaagattctagtctaca

SEQ ID NO: 34357 - DNA, 75 bp, Artificial Sequence
  Synthetic
tggagttaacacattgtttccaaacaaacggtttaatagatgataattgtgaaataacattttctaaaaggttaa

SEQ ID NO: 34358 - DNA, 75 bp, Artificial Sequence
  Synthetic
tagagtaagagggtgccatagttttaagttatggttccttaagcgtcttaatacatctaagttcattgtttgtcc

SEQ ID NO: 34359 - DNA, 75 bp, Artificial Sequence
  Synthetic
gtgattcagaattagctaaatattcaaatcaattatctactcttcttggtctgaattagagccctaaatcaatag

SEQ ID NO: 34360 - DNA, 75 bp, Artificial Sequence
  Synthetic
ttgggtagtcaatatagattatcatccaactcatatgaaagccatattgacttacatggagttgactactatggg

SEQ ID NO: 34361 - DNA, 75 bp, Artificial Sequence
  Synthetic
ccaacaccagatggactaagctaactaaatgtaatagtttataaaaattaattggggcaaataaatcagttcccc

SEQ ID NO: 34362 - DNA, 75 bp, Artificial Sequence
  Synthetic
gttagtccatgtagacaaactatacacagaccaaaaacataaactaaatgatggattttacacatcaaatctatt

SEQ ID NO: 34363 - DNA, 75 bp, Artificial Sequence
  Synthetic
aaccagccatgagcaccccaaatcccgaaaccactgctcagagattgatagtaaatgatatgaggccattatcaa

SEQ ID NO: 34364 - DNA, 75 bp, Artificial Sequence
  Synthetic
ttatatcaattataatttttcagataatacacacttgttaactaaacagataagagtagcaaattcagagttaat

SEQ ID NO: 34365 - DNA, 75 bp, Artificial Sequence
  Synthetic
tagaaacagaaataatatctttgaccaaagatattattacacatacattcatatatctaataaaccatgagtgta

SEQ ID NO: 34366 - DNA, 75 bp, Artificial Sequence
  Synthetic
agataactataatacattgtatcatccatctcctgaatctttagaaagtattttaaaaaggtctaatcaaagtaa

SEQ ID NO: 34367 - DNA, 75 bp, Artificial Sequence
  Synthetic
tagtacgcaaactcgatgaacgacaggccacatttacattccttgtcaattatgaaatgaagctattgcataaag

SEQ ID NO: 34368 - DNA, 75 bp, Artificial Sequence
  Synthetic
taatgtaattgaattgaaagactatcccatagataaattccaatctccaaagggacggggggtctcagacataac

SEQ ID NO: 34369 - DNA, 75 bp, Artificial Sequence
  Synthetic
tgggtagcacaaaatacaataaatacacagaatacaacagaaaatatggtacatttccaatgcctatatttatca

SEQ ID NO: 34370 - DNA, 75 bp, Artificial Sequence
  Synthetic
atgcataagctctaaccaaaaaataaaacaaggttataacaatcaagatctgtacaatctatttccagcagtaat

SEQ ID NO: 34371 - DNA, 75 bp, Artificial Sequence
  Synthetic
accatgatggttttttagagtgtataggtatcaagcctacaagaaatactcctataatatataagtatgatttaa

SEQ ID NO: 34372 - DNA, 75 bp, Artificial Sequence
  Synthetic
aatagacaagattgtagatcattcaggtaacattgcaaacatcaaccaaatgtatacaattactccaaatcaact

SEQ ID NO: 34373 - DNA, 75 bp, Artificial Sequence
  Synthetic
atccataggcacttttcaaaatttaattcacacagtgttatcttttggtaccaatgtcaaccaaattcccacata

SEQ ID NO: 34374 - DNA, 75 bp, Artificial Sequence
  Synthetic
tacattaataagtaatggtacttcattatactgtatgcttccgtggcatcatataaataggtttaattttgtgtt

SEQ ID NO: 34375 - DNA, 75 bp, Artificial Sequence
  Synthetic
gtgcatagtagtaattaaaaaagaaccaggttagaaacaaaaaaaggtagagaataacaacaaacaaaaatgaaa

SEQ ID NO: 34376 - DNA, 75 bp, Artificial Sequence
  Synthetic
tagctccactggttgcaaaattagtacaaaacttatacttaaggatcttaaaataaaggatcctcattgtatagc

SEQ ID NO: 34377 - DNA, 75 bp, Artificial Sequence
  Synthetic
tgtggggcaaatacaaaaatggctcttagcaaggtcaaactaaatgacactttcaacaaggatcaactgttgtca

SEQ ID NO: 34378 - DNA, 75 bp, Artificial Sequence
  Synthetic
ctttataggggaaggggcaggaaatttgttgttacgcacagtagtggaattacatccagacataaaatatattta

SEQ ID NO: 34379 - DNA, 75 bp, Artificial Sequence
  Synthetic
accagcaaatatactattcaacgtagtacaggtgacaacattgatatacccaattacgatgtgcaaaaacatctc

SEQ ID NO: 34380 - DNA, 75 bp, Artificial Sequence
  Synthetic
tagaagtctaaaagattgtaatgatcatagtttaccaattgagtttctaagattatacaatggccatataagtat

SEQ ID NO: 34381 - DNA, 75 bp, Artificial Sequence
  Synthetic
aataagttgtgtggtatgctattaataacagaagatgccaatcataaatttacaggactgataggtatgttatat

SEQ ID NO: 34382 - DNA, 75 bp, Artificial Sequence
  Synthetic
agattatggagaaaatctaactataccagccactgatgcaaccaatgctatacattggtcttacttacatataag

SEQ ID NO: 34383 - DNA, 75 bp, Artificial Sequence
  Synthetic
gctatgtcccgattggggagagaagatacccttaaaatactcaaagatgcaggctaccaagtgagggccaatggg

SEQ ID NO: 34384 - DNA, 75 bp, Artificial Sequence
  Synthetic
atatgcagaacccataaatctttttgtatgtgatgctgagttacctgatttaactaactggagtagaattgtttc

SEQ ID NO: 34385 - DNA, 75 bp, Artificial Sequence
  Synthetic
gttgatgtgataacacatcgacaggatgtgaatggaaaagaaatgaaatttgaagtgctaacattagtcagctta

SEQ ID NO: 34386 - DNA, 75 bp, Artificial Sequence
  Synthetic
agaatggtataagcatgttagatgttgcaagtattgctctacaattgaccgaagtaaattaattgtaaaatatca

SEQ ID NO: 34387 - DNA, 75 bp, Artificial Sequence
  Synthetic
acatcagaagttcaaggtaatatagaaatagagtcaaggaagtcttacaaaaagatgctaaaagagatgggagag

SEQ ID NO: 34388 - DNA, 75 bp, Artificial Sequence
  Synthetic
tgcacaagatatcactgatttcaaattaaataacatatcaatagtcaaaacatatgtgtgcttaggtagtaagct

SEQ ID NO: 34389 - DNA, 75 bp, Artificial Sequence
  Synthetic
gtagctccagaatacagacatgactctcctgattgtggtatgatagtgctatgtgttgctgctttggttataaca

SEQ ID NO: 34390 - DNA, 75 bp, Artificial Sequence
  Synthetic
gaaaggttctgaggtttatttagtccttacagttggtccatctaatatatttccatctttcaatgtagtgcagaa

SEQ ID NO: 34391 - DNA, 75 bp, Artificial Sequence
  Synthetic
aaattagcagcaggtgataggtcaggcctcactgcagtcattaggagagccaacaatgtactaaggaatgaaatg

SEQ ID NO: 34392 - DNA, 75 bp, Artificial Sequence
  Synthetic
tgctaagttgatactttcaaggacacaaaattttcccatgcctaagaagattgacaaggattcagtagatgcaaa

SEQ ID NO: 34393 - DNA, 75 bp, Artificial Sequence
  Synthetic
aaacgatacaaaggactcatcccgaaagatatagccaacagcttctatgaagtatttgaaaagtaccctcattac

SEQ ID NO: 34394 - DNA, 75 bp, Artificial Sequence
  Synthetic
tatcaaaagtttgataccgtttctttgttatcctataactaagaaagggataaaggcagcattatctaagttaaa

SEQ ID NO: 34395 - DNA, 75 bp, Artificial Sequence
  Synthetic
atagatgtattcgtacattttggcattgctcaatcctcaactagaggaggtagtagggtagaaggaatctttgca

SEQ ID NO: 34396 - DNA, 75 bp, Artificial Sequence
  Synthetic
agatgtggtagatggaaacattttatcatattctatagcagggcgaaatgaagtttatagtaacaagcttataaa

SEQ ID NO: 34397 - DNA, 75 bp, Artificial Sequence
  Synthetic
gggttattcatgaatgcatatggagcaggtcaagtgatgttaagatggggtgtactagccaaatcagtcaagaat

SEQ ID NO: 34398 - DNA, 75 bp, Artificial Sequence
  Synthetic
ctataaattgttaaacatcctaaaatggttagatcatatattaaattttcgatctctagagttcagctataatca

SEQ ID NO: 34399 - DNA, 75 bp, Artificial Sequence
  Synthetic
attatgcttggtcatgccagcgtacaagcagaaatggaacaggttgtagaagtctatgaatatgcacaaaagtta

SEQ ID NO: 34400 - DNA, 75 bp, Artificial Sequence
  Synthetic
cttatatatgattgaatcaacatatcctttcttaagtgagttactaaacagtttgactactaatgaacttaaaaa

SEQ ID NO: 34401 - DNA, 75 bp, Artificial Sequence
  Synthetic
ggtggagaagctggtttttatcacatactgaacaaccctaaagcatcattgttatccttaacacaattccccaat

SEQ ID NO: 34402 - DNA, 75 bp, Artificial Sequence
  Synthetic
attaattaaggtaacagggagtgtattatatagtcttcagcatgaattgtaagactcataacactttggtgtgat

SEQ ID NO: 34403 - DNA, 75 bp, Artificial Sequence
  Synthetic
ttctctagtgtagtcctaggcaatgctgcaggactaggtataatgggtgagtatagaggtacaccaagaaaccaa

SEQ ID NO: 34404 - DNA, 75 bp, Artificial Sequence
  Synthetic
tcattttacaaccatgattatatgtaatgtaatatcaatatagttatttaaaaactcacattatctatatagttg

SEQ ID NO: 34405 - DNA, 75 bp, Artificial Sequence
  Synthetic
gacttgtatgatgctgccaaagcatatgcagaacaactaaaagagaatggggtcatcaattacagtgtattggat

SEQ ID NO: 34406 - DNA, 75 bp, Artificial Sequence
  Synthetic
ttaatcttaaattcccacatatctgtgttccaactcaaattccactggtcaagatctaaaccagaaaatcaaaaa

SEQ ID NO: 34407 - DNA, 75 bp, Artificial Sequence
  Synthetic
ctgactacagaggaattagaggcaatcaagaaccaattgaatcccaaagataatgatgtggaattgtgagttaat

SEQ ID NO: 34408 - DNA, 75 bp, Artificial Sequence
  Synthetic
aaatcaaaaatttaatggtacgagaatatgtcctttatgttgcaagaggatagtttttgatactttttttctcgt

SEQ ID NO: 34409 - DNA, 75 bp, Artificial Sequence
  Synthetic
tatacaagtgtggtaacaatagagttgagcaaaatacaaaaaaatgtgtgtaatagtactgattcaaaagtgaaa

SEQ ID NO: 34410 - DNA, 75 bp, Artificial Sequence
  Synthetic
aaaaacatggggcaaatacgtcagtatggaaaaatttgcacctgagtttcatggagaagatgccaatacaaaagc

SEQ ID NO: 34411 - DNA, 75 bp, Artificial Sequence
  Synthetic
ctaatgggcaagaagagaaaaaggagatttttaggattcttgctaggtattggatctgctattgcaagtggtgta

SEQ ID NO: 34412 - DNA, 75 bp, Artificial Sequence
  Synthetic
aaccaagtttcttgaatccctaaaagggaaatttacttcttctaaggattctaggaaaaaagatagtataatatc

SEQ ID NO: 34413 - DNA, 75 bp, Artificial Sequence
  Synthetic
agttaattccgtagacatagaattacctaaagagagtcctataacatctaccaatcaaaatatcaaccaaccaag

SEQ ID NO: 34414 - DNA, 75 bp, Artificial Sequence
  Synthetic
tctaaagaactatatagacaaagagcttctacctaaagttaacaatcatgattgtaggatatccaaaatagaaac

SEQ ID NO: 34415 - DNA, 75 bp, Artificial Sequence
  Synthetic
tgagatcaatgacactattgctacaaatcaagttcatataagaaagcctttggtaagcttcaaagaagaactgcc

SEQ ID NO: 34416 - DNA, 75 bp, Artificial Sequence
  Synthetic
atcaagtgaaaacccctttacaaggctgtataaggaaactatagaaacatttgacaataatgaagaagaatcaag

SEQ ID NO: 34417 - DNA, 75 bp, Artificial Sequence
  Synthetic
ctactcatatgatgagataaatgatcaaacaaatgataatataacagcaagactagataggatagatgaaaaatt

SEQ ID NO: 34418 - DNA, 75 bp, Artificial Sequence
  Synthetic
aagcgagataataggaatgctccatacattagttgtggctagtgcaggaccaacagctgctcgtgacggtataag

SEQ ID NO: 34419 - DNA, 75 bp, Artificial Sequence
  Synthetic
agatgccatggtagggctccgagaagagatgattgagaaaataagatcagaagctttaatgaccaacgataggtt

SEQ ID NO: 34420 - DNA, 75 bp, Artificial Sequence
  Synthetic
agaagcaatggccaggcttagggatgaagaaagtgaaaagatgacaaaagatacatcagatgaagtaaaattaac

SEQ ID NO: 34421 - DNA, 75 bp, Artificial Sequence
  Synthetic
ccctacctcagagaagctgaacatggtattagaagatgaaagtagtgacaatgatctatcacttgaagatttctg

SEQ ID NO: 34422 - DNA, 75 bp, Artificial Sequence
  Synthetic
aatagcaaccagcccacccactaacagattagtcagatagatcaaccatcaatgataaagccacctaatcaacca

SEQ ID NO: 34423 - DNA, 75 bp, Artificial Sequence
  Synthetic
gccaaccagtcactcaaccagcctgtgattccacatagttagtaaaaataaagtaaaattggggcaaatatggag

SEQ ID NO: 34424 - DNA, 75 bp, Artificial Sequence
  Synthetic
acatacgtgaacaaactccatgaaggatcaacttacacagctgctgttcagtacaatgtcatagaaaaagatgat

SEQ ID NO: 34425 - DNA, 75 bp, Artificial Sequence
  Synthetic
gatcctgcatctctcacaatatgggttcctatgttccaatcatccatctctgctgatttgcttataaaagaacta

SEQ ID NO: 34426 - DNA, 75 bp, Artificial Sequence
  Synthetic
atcaatgtgaacatattagttcgacaaatttctactctgaaaggtccttcattgaagattatgataaactcaaga

SEQ ID NO: 34427 - DNA, 75 bp, Artificial Sequence
  Synthetic
agtgctgtactagcccaaatgcccagcaaatttaccataagtgcaaatgtatcattggatgaacgaagcaaatta

SEQ ID NO: 34428 - DNA, 75 bp, Artificial Sequence
  Synthetic
gcatatgacataactactccttgtgaaattaaggcttgtagtttaacatgtttaaaggtgaaaaatatgctcaca

SEQ ID NO: 34429 - DNA, 75 bp, Artificial Sequence
  Synthetic
actgtgaaagatctcaccatgaaaacattcaatcctacccatgagatcattgcactgtgtgaatttgaaaatatc

SEQ ID NO: 34430 - DNA, 75 bp, Artificial Sequence
  Synthetic
atgacatccaaaagagttgttataccaactttcttaaggtcaatcaatgtaaaagcaaaggatttggactcacta

SEQ ID NO: 34431 - DNA, 75 bp, Artificial Sequence
  Synthetic
gagaatatagctaccacagagttcaaaaatgccatcactaatgctaaaattataccttatgctgggttggtatta

SEQ ID NO: 34432 - DNA, 75 bp, Artificial Sequence
  Synthetic
gttatcactgtaactgacaataaaggggcattcaagtacattaaaccacaaagtcaatttatagtagatcttggt

SEQ ID NO: 34433 - DNA, 75 bp, Artificial Sequence
  Synthetic
gcatatctagagaaagagagcatatattatgtaactacaaattggaaacacacggccactaaattctccattaag

SEQ ID NO: 34434 - DNA, 75 bp, Artificial Sequence
  Synthetic
cctatagaggactgattctcacacaacttatcttaacacaacagaagactcccttaataacttactaatcatcat

SEQ ID NO: 34435 - DNA, 75 bp, Artificial Sequence
  Synthetic
tgtaatcgaatcttatttgctgctctatcaaccataatcatcatattttctcaacctgattaacccttcaattca

SEQ ID NO: 34436 - DNA, 75 bp, Artificial Sequence
  Synthetic
tcttgtagattatacctcagttagataaataaaaattatgaatgccaacaaagattatgtggggcaaataaaatc

SEQ ID NO: 34437 - DNA, 75 bp, Artificial Sequence
  Synthetic
tgcatccaatcaagtacagcatacaccagaaactcctcgaatccaccagctggttgaacttattacaatgaacaa

SEQ ID NO: 34438 - DNA, 75 bp, Artificial Sequence
  Synthetic
tacatctaccataatagagtttactggtgaattttggacttactttacattagcctttatgatgttaaccatagg

SEQ ID NO: 34439 - DNA, 75 bp, Artificial Sequence
  Synthetic
ttttttctttattgtcacatcattagtggcagcaatactgaacaaattatgtgacttcaacgatcatcatacaaa

SEQ ID NO: 34440 - DNA, 75 bp, Artificial Sequence
  Synthetic
tagtctagacatcagaactaggcttagaaatgatacacaattgataacaagagcacatgaaggatccatcaacca

SEQ ID NO: 34441 - DNA, 75 bp, Artificial Sequence
  Synthetic
atcaagcaactaagaggacaacaaaacaaaagaaaatagcaacatgcatcaaagttaagcaaaggaaaaccacaa

SEQ ID NO: 34442 - DNA, 75 bp, Artificial Sequence
  Synthetic
agaatcagacaatcatcactcatatctttttagtctacaaatgctgcattatgtactgttaattagttatttaaa

SEQ ID NO: 34443 - DNA, 75 bp, Artificial Sequence
  Synthetic
attaaacttaaaaatggtttatggttacatacagatgttggggcaaatacaagtatgtccaaccatacccaccat

SEQ ID NO: 34444 - DNA, 75 bp, Artificial Sequence
  Synthetic
cttaaattcaagacattaaagagggcttggaaagcctcaaaatacttcatagtaggattatcatgtttatataag

SEQ ID NO: 34445 - DNA, 75 bp, Artificial Sequence
  Synthetic
ttcaatttaaaatcccttgtccaaacggctttgaccaccttagcaatgataaccttgacatcactcgtcataaca

SEQ ID NO: 34446 - DNA, 75 bp, Artificial Sequence
  Synthetic
gccattatttacattagtgtgggaaatgctaaagccaagcccacatccaaaccaaccatccaacaaacacaacag

SEQ ID NO: 34447 - DNA, 75 bp, Artificial Sequence
  Synthetic
ccccaaaaccatacctcaccatttttcacagagcacaactacaaatcaactcacacatcaattcaaagcaccaca

SEQ ID NO: 34448 - DNA, 75 bp, Artificial Sequence
  Synthetic
ctgtcccaactaccaaacacagacaccactagagaaactacatacagtcactcaatcaacgaaacccaaaacaga

SEQ ID NO: 34449 - DNA, 75 bp, Artificial Sequence
  Synthetic
aaaatcaaaagccaatccactctacccgccaccagaaaaccaccaattaacccatcgggaagcaacccccctgaa

SEQ ID NO: 34450 - DNA, 75 bp, Artificial Sequence
  Synthetic
aaccaccaagaccacaacaactcccaaacactcccctatgtgccttgcagtacatgtgaaggtaatcttgcttgt

SEQ ID NO: 34451 - DNA, 75 bp, Artificial Sequence
  Synthetic
ttatcactctgccaaatcgggccggagagagcaccaagcagagcccctacaatcaccctcaaaaagactccaaaa

SEQ ID NO: 34452 - DNA, 75 bp, Artificial Sequence
  Synthetic
cccaaaaccaccaaaaagccaaccaagacaacaatccaccacagaaccagccctgaagccaaactgcaacccaaa

SEQ ID NO: 34453 - DNA, 75 bp, Artificial Sequence
  Synthetic
aacaacacggcagctccacaacaaggcatcctctcttcaccagaacaccacacaaatcaatcaactacacagatc

SEQ ID NO: 34454 - DNA, 75 bp, Artificial Sequence
  Synthetic
taacaacacacctccatataatatcaattatgttcatatatagttatttaaaaagatatgtataattcactaatt

SEQ ID NO: 34455 - DNA, 75 bp, Artificial Sequence
  Synthetic
aaaactggggcaaataaggatggcgacaacagccatgaggatgatcatcagcattatcttcatctctacctatgt

SEQ ID NO: 34456 - DNA, 75 bp, Artificial Sequence
  Synthetic
gacacatatcactttatgccaaaacataacagaagaattttatcaatcaacatgcagtgcagttagtagaggtta

SEQ ID NO: 34457 - DNA, 75 bp, Artificial Sequence
  Synthetic
ccttagtgcattaagaactggatggtatacaagtgtggtaacaatagagttgagcaaaatacaaaaaaatgtgtg

SEQ ID NO: 34458 - DNA, 75 bp, Artificial Sequence
  Synthetic
tatacaagtgtggtaacaatagagttgagcaaaatacaaaaaaatgtgtgtaaaagtactgattcaaaagtgaaa

SEQ ID NO: 34459 - DNA, 75 bp, Artificial Sequence
  Synthetic
ttaataaagcaagaactagaaagatacaacaatgcagtagtggaattgcagtcacttatgcaaaatgaaccggcc

SEQ ID NO: 34460 - DNA, 75 bp, Artificial Sequence
  Synthetic
tccttcagtagagcaaaaagagggataccagagttgatacattatacaagaaactctacaaaaaagttttatggg

SEQ ID NO: 34461 - DNA, 75 bp, Artificial Sequence
  Synthetic
aaactctacaaaaaagttttatgggctaatgggcaagaagagaaaaaggagatttttaggattcttgctaggtat

SEQ ID NO: 34462 - DNA, 75 bp, Artificial Sequence
  Synthetic
ctaatgggcaagaagagaaaaaggagatttttaggattcttgctaggtattggatctgctgttgcaagtggtgta

SEQ ID NO: 34463 - DNA, 75 bp, Artificial Sequence
  Synthetic
gcagtgtccaaagtactacacctggagggagaggtgaataaaattaaaaatgcactgctatccacaaataaagca

SEQ ID NO: 34464 - DNA, 75 bp, Artificial Sequence
  Synthetic
gtagttagtctatccaatggagttagtgtccttactagcaaagtacttgatctaaagaactatatagacaaagag

SEQ ID NO: 34465 - DNA, 75 bp, Artificial Sequence
  Synthetic
tctaaagaactatatagacaaagagcttctacctcaagttaacaatcatgattgtaggatatccaacatagaaac

SEQ ID NO: 34466 - DNA, 75 bp, Artificial Sequence
  Synthetic
tgtgatagaattccaacaaaaaaacaatagattgttagaaattgctagggaatttagtgtaaatgctggtattac

SEQ ID NO: 34467 - DNA, 75 bp, Artificial Sequence
  Synthetic
cacacctctcagtacatacatgttgaccaatagtgaattactatcactaattaatgatatgcctataacgaatga

SEQ ID NO: 34468 - DNA, 75 bp, Artificial Sequence
  Synthetic
ccaaaaaaagctaatgtcaagtaatgttcaaatagtcaggcaacagagttattccattatgtcagtggtcaaaga

SEQ ID NO: 34469 - DNA, 75 bp, Artificial Sequence
  Synthetic
agaagtcatagcttatgttgtacaattgcctatttatggagttatagacaccccctgttggaaactacacacctc

SEQ ID NO: 34470 - DNA, 75 bp, Artificial Sequence
  Synthetic
tccgttatgcaccactgataataaagaagggtcaaacatctgcttaactaggacagatcgtgggtggtattgtga

SEQ ID NO: 34471 - DNA, 75 bp, Artificial Sequence
  Synthetic
caatgcaggctctgtgtcttttttcccacagacagagacatgtaaggtacaatcaaatagagtgttctgtgacac

SEQ ID NO: 34472 - DNA, 75 bp, Artificial Sequence
  Synthetic
aatgaacagtttaactctgcctactgacgttaacttatgcaacactgacatattcaatacaaagtatgactgtaa

SEQ ID NO: 34473 - DNA, 75 bp, Artificial Sequence
  Synthetic
aataatgacatctaaaactgacataagtagctctgtgataacttcaattggagctattgtatcatgctatgggaa

SEQ ID NO: 34474 - DNA, 75 bp, Artificial Sequence
  Synthetic
gacaaaatgtacagcttctaataaaaatcgtggaatcataaagactttttccaatgggtgtgattatgtatcaaa

SEQ ID NO: 34475 - DNA, 75 bp, Artificial Sequence
  Synthetic
caaaggagtagatactgtatctgttggtaacacactatattatgtaaataagctagaggggaaagcactctatat

SEQ ID NO: 34476 - DNA, 75 bp, Artificial Sequence
  Synthetic
aaagggtgaaccaattattaattactatgatccactagtgtttccttctgatgagtttgatgcatcaattgccca

SEQ ID NO: 34477 - DNA, 75 bp, Artificial Sequence
  Synthetic
agtaaacgcaaaaataaaccaaagcctggccttcatacgtcgatctgatgagttacttcacagtgtagatgtagg

SEQ ID NO: 34478 - DNA, 75 bp, Artificial Sequence
  Synthetic
aaaatccaccacaaatgtagtaattactactattatcatagtgatagttgtagtgatattaatgttaatagctgt

SEQ ID NO: 34479 - DNA, 75 bp, Artificial Sequence
  Synthetic
aggattactgttttactgtaagaccaagagtactcctatcatgttagggaaggatcagctcagtggtatcaacaa

SEQ ID NO: 34480 - DNA, 75 bp, Artificial Sequence
  Synthetic
tctttcctttagtaaatgaaatgcataatgtttacaatctaaacctcagaatcataaatgtgatgagctaaattt

SEQ ID NO: 34481 - DNA, 75 bp, Artificial Sequence
  Synthetic
actaatacattcaaaagttctatccgccaagacctgcatttttatcaggtcttacataagctaaccttacatgct

SEQ ID NO: 34482 - DNA, 75 bp, Artificial Sequence
  Synthetic
acactcaactccatgttgatagttatataaaaatattatattagtctcaaagaataaaattatttaacaaccaat

SEQ ID NO: 34483 - DNA, 75 bp, Artificial Sequence
  Synthetic
cattcaaaaagatggggcaaatatgtcacgaagaaatccctgcaaatatgagattaggggacattgcttaaatgg

SEQ ID NO: 34484 - DNA, 75 bp, Artificial Sequence
  Synthetic
taaaaaatgtcattttagtcataattactttgaatggcctccacatgctttattagtgaggcaaaattttatgct

SEQ ID NO: 34485 - DNA, 75 bp, Artificial Sequence
  Synthetic
aaataagatattaaaatctatggacaggaacaacgataccctgtcagaaataagtggtgcagcagagttggatag

SEQ ID NO: 34486 - DNA, 75 bp, Artificial Sequence
  Synthetic
aacagaagaatatgcattgggtgtaataggagttttggaaagttacctaggctctatcaataatataacaaaaca

SEQ ID NO: 34487 - DNA, 75 bp, Artificial Sequence
  Synthetic
atcagcctgtgttgctatgagtaaactattagccgagattaacaatgatgacataaagagattgaggaacaagga

SEQ ID NO: 34488 - DNA, 75 bp, Artificial Sequence
  Synthetic
agtgccaacatcacctaagataagaatatataacacagttatatcatatattgatagcaacaagagaaacacaaa

SEQ ID NO: 34489 - DNA, 75 bp, Artificial Sequence
  Synthetic
acaaactatacatttgcttaagagattgcctgcagacgtacttaaaaagacaatcaagaacactatagatattca

SEQ ID NO: 34490 - DNA, 75 bp, Artificial Sequence
  Synthetic
caacgaaataaatggtaataaccaaggtgacataattgttaatgaacaaaatgaataactccaacattattattt

SEQ ID NO: 34491 - DNA, 75 bp, Artificial Sequence
  Synthetic
tcccagaaaaatacccttgtagcatatcctctttgctaattaagaatgaaaatgatgttattgtactaagtcatc

SEQ ID NO: 34492 - DNA, 75 bp, Artificial Sequence
  Synthetic
aaaatgttcttgactacttacagtttcaatatccatgtaatatgtattctcaaaatcatatgcttgatgatatct

SEQ ID NO: 34493 - DNA, 75 bp, Artificial Sequence
  Synthetic
attggacatcacaggagctaattgaggatgtacttaagattcttcatctttctggcatatccataagtaagtatg

SEQ ID NO: 34494 - DNA, 75 bp, Artificial Sequence
  Synthetic
tgatatatgttttagtgctatagtatataagtcactcaactattaatcaacagccacttcttcatagctagcaat

SEQ ID NO: 34495 - DNA, 75 bp, Artificial Sequence
  Synthetic
atataaggacaaaatggatacactcattcatgagaactcaactaatgtttacttaacagatagttatttaaaagg

SEQ ID NO: 34496 - DNA, 75 bp, Artificial Sequence
  Synthetic
tgtcatctctttttctgagtgcaatgccctgggaagctacttgttggatggaccttatctaaaaaatgattatac

SEQ ID NO: 34497 - DNA, 75 bp, Artificial Sequence
  Synthetic
caacatcataagtagacagaaaccattgatagaacatataaacttaaaaaaattgtctatcatacagtcttttgt

SEQ ID NO: 34498 - DNA, 75 bp, Artificial Sequence
  Synthetic
aactaagtataacaaaggagagctgggtttagaagaacccacttactttcaatctttacttatgacttacaaaag

SEQ ID NO: 34499 - DNA, 75 bp, Artificial Sequence
  Synthetic
tctgtctacatcagaattaatcacaactacaactctgtttaaaaagataattcgtagagctatagaaataagtga

SEQ ID NO: 34500 - DNA, 75 bp, Artificial Sequence
  Synthetic
tgtcaaagtatatgctatattgaacaaattgggtttaaaagaaaagggaaaagttgatagatgtgatgacactaa

SEQ ID NO: 34501 - DNA, 75 bp, Artificial Sequence
  Synthetic
cacaacgctatctaacatagtaagagataatatactctcagtcataagtgacaatactcccagtactaaaaaacc

SEQ ID NO: 34502 - DNA, 75 bp, Artificial Sequence
  Synthetic
aaataattcatcgtgtaaaccagatcagccaattaaaacaacaattttatgcaagcttttaagttcgatgagtca

SEQ ID NO: 34503 - DNA, 75 bp, Artificial Sequence
  Synthetic
tccccctacatggttaatacattggtttaatttatacacaaaattaaatgacatcttgacccaatacagaacaaa

SEQ ID NO: 34504 - DNA, 75 bp, Artificial Sequence
  Synthetic
tgaagcaagaaatcatggttacatacttatagatactagaaccttgggtgaattccaatttatattaaatcaata

SEQ ID NO: 34505 - DNA, 75 bp, Artificial Sequence
  Synthetic
tggttgcattgtatatcataagaaattaaagaaaattacaatcaccacatataatcaatttctaacatggaaaga

SEQ ID NO: 34506 - DNA, 75 bp, Artificial Sequence
  Synthetic
cattagcctcagtagattaaatgtttgtatgatcacctggataagcaattgtttaaataccttgaataaaagcct

SEQ ID NO: 34507 - DNA, 75 bp, Artificial Sequence
  Synthetic
tggattgagatgtgagtttaacaatgtcactctatctcaattattccttcatggggattgtatattgaaattatt

SEQ ID NO: 34508 - DNA, 75 bp, Artificial Sequence
  Synthetic
tcataatgaaggttactatattataaaagaagttgaaggttttataatgtcattaattttgaacctaacggaaga

SEQ ID NO: 34509 - DNA, 75 bp, Artificial Sequence
  Synthetic
agatcaattcagaaaaagattcttcaacagtatgctaaataatattacagatgctgcagcaagagctcaacaaga

SEQ ID NO: 34510 - DNA, 75 bp, Artificial Sequence
  Synthetic
tttattatcaagagcccgccatactatattagacaaaacaatatcagataacatattaaatggtaaatggttaat

SEQ ID NO: 34511 - DNA, 75 bp, Artificial Sequence
  Synthetic
tttattaggtaagtttcttaaattgattaaattagctggtgctaataatcttaataacctaagtgaactctactt

SEQ ID NO: 34512 - DNA, 75 bp, Artificial Sequence
  Synthetic
tctctttagaatatttggacatcccatggtagatgaacggcaagcaatggatgctgtgagattaaactgtaatga

SEQ ID NO: 34513 - DNA, 75 bp, Artificial Sequence
  Synthetic
aactaaattttacttattgagtagccttagcatgttaagaggtgcattcatttatagaattataaagggatttgt

SEQ ID NO: 34514 - DNA, 75 bp, Artificial Sequence
  Synthetic
aaacacatataataggtggcctaccttaaggaatgctatagttttacccttaagatggataaattactacaaact

SEQ ID NO: 34515 - DNA, 75 bp, Artificial Sequence
  Synthetic
caatacttacccatcattattagaattaacagaagctgatttgattatattgtctggactgagattttatagaga

SEQ ID NO: 34516 - DNA, 75 bp, Artificial Sequence
  Synthetic
attccatctaccgaaaaaagtagatttagaagtcataataaatgataaagcaatatcacctcccaaaaaccttat

SEQ ID NO: 34517 - DNA, 75 bp, Artificial Sequence
  Synthetic
ctggaccagttttcccaaaaactatatgccatcacacatacagatttacatagaacatgaaagactaaagtttac

SEQ ID NO: 34518 - DNA, 75 bp, Artificial Sequence
  Synthetic
tgagagtgatagatctagaagggttctggaatattatttaaggaataatagattcagtgagagtgacctatataa

SEQ ID NO: 34519 - DNA, 75 bp, Artificial Sequence
  Synthetic
ctgtatagtaaaccaggaatatcttaataatccaaaccatgtaatatcattaacaggaaaagaaagagaacttag

SEQ ID NO: 34520 - DNA, 75 bp, Artificial Sequence
  Synthetic
tgtaggtaggatgtttgcaatgcagccaggcatgttcagacaggttcaaatcatggctgagaaattgatagctga

SEQ ID NO: 34521 - DNA, 75 bp, Artificial Sequence
  Synthetic
gaacatcttacaatttttccctgagagtttaacacggtatggagatcttgaattacagaaaatattagaattaaa

SEQ ID NO: 34522 - DNA, 75 bp, Artificial Sequence
  Synthetic
agcaggcattagcaacaaagcaaatcgctgtaatgataactataacaattatatcagtaaatgttctataatcac

SEQ ID NO: 34523 - DNA, 75 bp, Artificial Sequence
  Synthetic
tgatcttagcaagttcaatcaggcattcaggtatgaaacgtcatgcatttgtagcgatgttttagatgaattaca

SEQ ID NO: 34524 - DNA, 75 bp, Artificial Sequence
  Synthetic
tggtgtacaatctctcttttcttggttgcatttaactattccttttgccactgttatatgtacttatagacatgc

SEQ ID NO: 34525 - DNA, 75 bp, Artificial Sequence
  Synthetic
tccaccttacataagaaatcatataacagatcttaataaggttgatgagcaaagtggactgtatagatatcatat

SEQ ID NO: 34526 - DNA, 75 bp, Artificial Sequence
  Synthetic
gggtggtatagaaggttggtgtcaaaaattgtggactattgaagcgatatctttattagatttaatatctatcaa

SEQ ID NO: 34527 - DNA, 75 bp, Artificial Sequence
  Synthetic
ggggaaattttcaatcacagctttaatcaatggtgataatcaatcaattgatataagtaagcctatcaaattaaa

SEQ ID NO: 34528 - DNA, 75 bp, Artificial Sequence
  Synthetic
tgaaggacaaactcatgcacaggctgattatctattagcacttaaaagccttaagttgttgtataaagaatatgc

SEQ ID NO: 34529 - DNA, 75 bp, Artificial Sequence
  Synthetic
tagtataggtcataaacttaaaggtacggagacatatatatcccgtgatatgcaatttatgagtaaaaccattca

SEQ ID NO: 34530 - DNA, 75 bp, Artificial Sequence
  Synthetic
gcataatggtgtatactatcctgcaagcatcaaaaaagtgctacgagtaggtccatggataaacacaatactgga

SEQ ID NO: 34531 - DNA, 75 bp, Artificial Sequence
  Synthetic
tgattttaaagtaagtatggagtctataggtagtttgactcaagagttagaatatagaggagaaagtttactatg

SEQ ID NO: 34532 - DNA, 75 bp, Artificial Sequence
  Synthetic
cagtttgatttttaggaatgtctggttgtataatcaaattgctttgcaacttaagaatcatgcattatgtcacaa

SEQ ID NO: 34533 - DNA, 75 bp, Artificial Sequence
  Synthetic
caaactgtatctagatatcttgaaagtgttagcacacttaaaaatgttttttaaccttgataatatagatactgc

SEQ ID NO: 34534 - DNA, 75 bp, Artificial Sequence
  Synthetic
cctaacactatatatgaatttgccaatgttatttggtggtggagacccaaatttattatatcggagtttctatag

SEQ ID NO: 34535 - DNA, 75 bp, Artificial Sequence
  Synthetic
aagaactccggattttcttacagaagctatagcacattctgtctttgtgcttagttattatacaggacatgatct

SEQ ID NO: 34536 - DNA, 75 bp, Artificial Sequence
  Synthetic
tcaagataaattacaagatttaccagatgataaattaaataagtttcttacatgtatcataacttttgataagaa

SEQ ID NO: 34537 - DNA, 75 bp, Artificial Sequence
  Synthetic
ccctaatgcagaatttgtaacattgatgagagatccacaagctttagggtctgagagacaagctaaagtcactag

SEQ ID NO: 34538 - DNA, 75 bp, Artificial Sequence
  Synthetic
tgaaattaatagattagcagtgacagaagtattaagcaatgcaccaaataaaatatttgctaaaagtgcacaaca

SEQ ID NO: 34539 - DNA, 75 bp, Artificial Sequence
  Synthetic
ttacactactactgaagttgatttaaatgatgtaatgcaaaaaatagagccgacttacccgcatggattaagagt

SEQ ID NO: 34540 - DNA, 75 bp, Artificial Sequence
  Synthetic
ggtctatgaaagtcttcctttctacaaagcagaaaaaattgttaatttaatatcaggcactaaatctatcaccaa

SEQ ID NO: 34541 - DNA, 75 bp, Artificial Sequence
  Synthetic
tatacttgaaaaaacatctgctattgattatacagacattgagagagctatagatatgatgagaaagaatataac

SEQ ID NO: 34542 - DNA, 75 bp, Artificial Sequence
  Synthetic
tttgctaattagaattcttccattagattacaataaagccaagttgggattgttaagtctcaacaatcttagtat

SEQ ID NO: 34543 - DNA, 75 bp, Artificial Sequence
  Synthetic
cactgatataagtaaatatgtaagagaaagatcttggtcactgtctaacattgtaggtattacatctcctagcat

SEQ ID NO: 34544 - DNA, 75 bp, Artificial Sequence
  Synthetic
attatatacaatggatattaaatacaccactagcactataactagtggtataataattgaaaaatacaattccaa

SEQ ID NO: 34545 - DNA, 75 bp, Artificial Sequence
  Synthetic
ttttttgactcgtggtgagaggggtcccactaaaccatgggtaggatcatcaacccaagaaaagaaaacaatgcc

SEQ ID NO: 34546 - DNA, 75 bp, Artificial Sequence
  Synthetic
tgtatacaataggcaggttttaactaagaaacaaaaggatcaaattgatttgttggcaaaactagattgggttta

SEQ ID NO: 34547 - DNA, 75 bp, Artificial Sequence
  Synthetic
tgcctctatagataacaaagatgagtttatggaagtattatgtttgggaacacttggactatcctatgaaaaagc

SEQ ID NO: 34548 - DNA, 75 bp, Artificial Sequence
  Synthetic
caagaaattgttccctcaatacctgagtgtaaactacctgcatcgtcttacagttagtagtagaccatgtgagtt

SEQ ID NO: 34549 - DNA, 75 bp, Artificial Sequence
  Synthetic
tccagcctcaataccagcttacagaacaactaattaccactttgacacaagtccaattaatcgaatactaactga

SEQ ID NO: 34550 - DNA, 75 bp, Artificial Sequence
  Synthetic
aaaatatggtgatgaagacattgatatagtgtttcagaattgtatcagttttggtcttagcttaatgtcagttgt

SEQ ID NO: 34551 - DNA, 75 bp, Artificial Sequence
  Synthetic
agaacaatttacaaatgtatgcccaaatagaattattctaataccaaaacttaatgaaattcatttgatgaagcc

SEQ ID NO: 34552 - DNA, 75 bp, Artificial Sequence
  Synthetic
acccatatttacaggtgatgttgacatttgtaagcttaatcaggtgatacagaaacagcatatgtttttacctga

SEQ ID NO: 34553 - DNA, 75 bp, Artificial Sequence
  Synthetic
taaaatcagtttgtctcaatatgttgaattgttccttagcaataaaacacttaagaatagtccacatataagctc

SEQ ID NO: 34554 - DNA, 75 bp, Artificial Sequence
  Synthetic
aacagccacagttgctaaagacatcagtgctgatatccttgaggcaaggcatgactattttggtcgggagctttg

SEQ ID NO: 34555 - DNA, 75 bp, Artificial Sequence
  Synthetic
agtgctgatatccttgaggcaaggcatgactattttggtcgggagctttgtaactctttaggaattgaatacaaa

SEQ ID NO: 34556 - DNA, 75 bp, Artificial Sequence
  Synthetic
tccttgatgttgtgccaggtgttaacttgttaaactataacatacccaatgtgacaccagacaactatatatggg

SEQ ID NO: 34557 - DNA, 75 bp, Artificial Sequence
  Synthetic
atttgtatcacttttcaaagaagcaattaattttagtgcgtattcttcagaaagatggaatacattcttatataa

SEQ ID NO: 34558 - DNA, 75 bp, Artificial Sequence
  Synthetic
aaagatggaatacattcttatataaagccagagcagagacagaggtggattataatcaatttctatcagacaagg

SEQ ID NO: 34559 - DNA, 75 bp, Artificial Sequence
  Synthetic
tataatcaatttctatcagacaaggcacataagatttttatgctagagggagactatatgagaccaacgcaagct

SEQ ID NO: 34560 - DNA, 75 bp, Artificial Sequence
  Synthetic
tgagtcagagagtttacacagagagggaaattataacggatgtgacaaaacagaagccgtctatccactttattt

SEQ ID NO: 34561 - DNA, 75 bp, Artificial Sequence
  Synthetic
aataggttcaacagcaaaattaatatacctatccaatagtttacaaagtatcaccgaacagtcaacttggacaga

SEQ ID NO: 34562 - DNA, 75 bp, Artificial Sequence
  Synthetic
atggatattgatggtaaagtagggcagtacgaaaccttatgtgctgaaagaaaaatgattgccaggtctactggc

SEQ ID NO: 34563 - DNA, 75 bp, Artificial Sequence
  Synthetic
aaaaatgattgccaggtctactggcaaaaaggtagataacaagaggttggaagcggttaagattggcaatgcact

SEQ ID NO: 34564 - DNA, 75 bp, Artificial Sequence
  Synthetic
tgtattatgggaacaacaattcatcttagcaaatgacttatttaaaaatcaagaaaggcagaagtttatgaagaa

SEQ ID NO: 34565 - DNA, 75 bp, Artificial Sequence
  Synthetic
agttttaaagataagacatccagtgacattgaaacagataagcctaaaatcttagatttcaataacactatagtc

SEQ ID NO: 34566 - DNA, 75 bp, Artificial Sequence
  Synthetic
ataagaacaaggctctactagctaaggataacacattgcaagacctacatcctattatcatgcagtatgcttcag

SEQ ID NO: 34567 - DNA, 75 bp, Artificial Sequence
  Synthetic
ggataacacattgcaagacctacatcctattatcatgcagtatgcttcagaaataaaagaggcatctaaagacac

SEQ ID NO: 34568 - DNA, 75 bp, Artificial Sequence
  Synthetic
cctattatcatgcagtatgcttcagaaataaaagaggcatctaaagacacatttgatgcgctattaaaaatttcc

SEQ ID NO: 34569 - DNA, 75 bp, Artificial Sequence
  Synthetic
aaaacaaaaagagcaacagtagtctttagtatagtttgcatgcataaagagagaaacgacttgatggatgcaggt

SEQ ID NO: 34570 - DNA, 75 bp, Artificial Sequence
  Synthetic
ttacattctatactagcttgtctataacaaaaagtatgctttcactgactgagccatctagatatatgataatga

SEQ ID NO: 34571 - DNA, 75 bp, Artificial Sequence
  Synthetic
tagagattatatagctgagaaattctccccatacaccaaaacgctttttagtgtatacatggtcaatttgataaa

SEQ ID NO: 34572 - DNA, 75 bp, Artificial Sequence
  Synthetic
gtgtatacatggtcaatttgataaagagaggatgcgcatctgcaaatgagcaatcatcaaagatccaactgagaa

SEQ ID NO: 34573 - DNA, 75 bp, Artificial Sequence
  Synthetic
atatatatctttcagattatgatattacacaaaaaggtgttaatgatgataggaacttagactctatttggttcc

SEQ ID NO: 34574 - DNA, 75 bp, Artificial Sequence
  Synthetic
tatcaaccaaatatatctaccattttacttcaatgcaaaaggccttcatgagaaacatcacgtaatgattgactt

SEQ ID NO: 34575 - DNA, 75 bp, Artificial Sequence
  Synthetic
gtatatggtctaaagcagaaaaaaaacaacatgtcaatctaccaatattaatacactctatagcaaaatctttaa

SEQ ID NO: 34576 - DNA, 75 bp, Artificial Sequence
  Synthetic
cttgcgaaaccgtgtagaaagtagaaataattttagaagaagcatcacaacaataagcactttcacaagctctaa

SEQ ID NO: 34577 - DNA, 75 bp, Artificial Sequence
  Synthetic
cagtaaaggtgtttgatcgcctatatgaattgctaaaagatggagtcttaacagacaagcctttcattgaattag

SEQ ID NO: 34578 - DNA, 75 bp, Artificial Sequence
  Synthetic
tgaattgctaaaagatggagtcttaacagacaagcctttcattgaattagctatggaaatgatgaagaatcacaa

SEQ ID NO: 34579 - DNA, 75 bp, Artificial Sequence
  Synthetic
aagggccaaaagacagccaaagatagagagatattcgttggagaatttgaagctaaaatgtgtatgtatgtagtg

SEQ ID NO: 34580 - DNA, 75 bp, Artificial Sequence
  Synthetic
aactgaacacggacgagatgataagtgaaccaggtgattcaaaattgaaaatattggaaaagaaagcagaagagg

SEQ ID NO: 34581 - DNA, 75 bp, Artificial Sequence
  Synthetic
tgaaccaggtgattcaaaattgaaaatattggaaaagaaagcagaagaggaaatccgctatattgttgagagaac

SEQ ID NO: 34582 - DNA, 75 bp, Artificial Sequence
  Synthetic
ccatcaaaagcattgaaattggaaataaatgcagacatgtcaaaatggagtgctcaagatgtattttacaaatat

SEQ ID NO: 34583 - DNA, 75 bp, Artificial Sequence
  Synthetic
atgcaaaaactactaatacttccagatgatttaattgcaaatatcttagatcaaaaaagaccttataatgatgat

SEQ ID NO: 34584 - DNA, 75 bp, Artificial Sequence
  Synthetic
taaattacaattatgtccaaattaaaagaaactggctccagggcaatttcaattacatttctagttatgtgcata

SEQ ID NO: 34585 - DNA, 75 bp, Artificial Sequence
  Synthetic
gttgtgcaatgcttgtctacaaggatatcctcaaagaatgtatgaagttactagacggagactgcttgatcaact

SEQ ID NO: 34586 - DNA, 75 bp, Artificial Sequence
  Synthetic
tatcctcaaagaatgtatgaagttactagacggagactgcttgatcaactcaatggtgcattcagatgacaatca

SEQ ID NO: 34587 - DNA, 75 bp, Artificial Sequence
  Synthetic
ctagacggagactgcttgatcaactcaatggtgcattcagatgacaatcaaacatcgttagcaattattcaaaat

SEQ ID NO: 34588 - DNA, 75 bp, Artificial Sequence
  Synthetic
aatatgcagcaaacacatttgagtctgtttgtttgacatttggatgtcaggcaaacatgaaaaaaacatatatta

SEQ ID NO: 34589 - DNA, 75 bp, Artificial Sequence
  Synthetic
gcaaacatgaaaaaaacatatattactcatacatgcaaggaatttgtctcacttttcaatttacatggagaacca

SEQ ID NO: 34590 - DNA, 75 bp, Artificial Sequence
  Synthetic
tgcctagtgtaggtgattgtgcttacattgggccatatgaagatttagctagccgtttatctgcagcacaacaga

SEQ ID NO: 34591 - DNA, 75 bp, Artificial Sequence
  Synthetic
gcttaaagcatgggtgccctccaagtctagtttggttagcaataagctgtagccactggataacatttttcacct

SEQ ID NO: 34592 - DNA, 75 bp, Artificial Sequence
  Synthetic
agccactggataacatttttcacctacaacatgctggatgatcaaattaatgcaccacagcagcatttgccattc

SEQ ID NO: 34593 - DNA, 75 bp, Artificial Sequence
  Synthetic
tgcaccacagcagcatttgccattcaataatcgaaaggaaataccagtcgagttaaatgggtacttgaatgcacc

SEQ ID NO: 34594 - DNA, 75 bp, Artificial Sequence
  Synthetic
gccattggataaacagaaggaaaccatacaaagccaatgtttacacttatgcaattcaatagataagctaacaga

SEQ ID NO: 34595 - DNA, 75 bp, Artificial Sequence
  Synthetic
ttgaggtatcttactcttgacactgaaatgtcagttgataacaacatgggggagacaagtgatatgcgaagtaga

SEQ ID NO: 34596 - DNA, 75 bp, Artificial Sequence
  Synthetic
ggagacaagtgatatgcgaagtagatcacttttaacacctcgcaaatttacaacattggggtccttaaataagct

SEQ ID NO: 34597 - DNA, 75 bp, Artificial Sequence
  Synthetic
aagatttaaggaaagcctttctatccaaaatccagcacaattatttatcgagcagatactattttcccataaacc

SEQ ID NO: 34598 - DNA, 75 bp, Artificial Sequence
  Synthetic
gatcattggaagagttacatttcctcaggcataccaaatgataaatagagatattggccaactacctttagatat

SEQ ID NO: 34599 - DNA, 75 bp, Artificial Sequence
  Synthetic
tgatcacagctgcaaatacctccttattatgtgttaaaggaacaccacaagatagaactggccttagtgcaaatc

SEQ ID NO: 34600 - DNA, 75 bp, Artificial Sequence
  Synthetic
gcttattcatcattcccctgctctggttcttaaggcatttagtaaagggacatcagacattcctggggctgatcc

SEQ ID NO: 34601 - DNA, 75 bp, Artificial Sequence
  Synthetic
ttaatagggaatgaaatcctaatttatagaatcagagagatgaccaaactctatcaagtttgttacgattatgtt

SEQ ID NO: 34602 - DNA, 75 bp, Artificial Sequence
  Synthetic
gctgattcctttgtggaagaggcaagcagattgagctttattaatgaagttcttgataatttcacatataaaaac

SEQ ID NO: 34603 - DNA, 75 bp, Artificial Sequence
  Synthetic
gcagattgagctttattaatgaagttcttgataatttcacatataaaaacataagtgttaactccttgtttaaca

SEQ ID NO: 34604 - DNA, 75 bp, Artificial Sequence
  Synthetic
tcttgataatttcacatataaaaacataagtgttaactccttgtttaacactctattagccagcactacaagatt

SEQ ID NO: 34605 - DNA, 75 bp, Artificial Sequence
  Synthetic
taatgaaagagtttcatggaataactggcagacaaatcgttccttaaattcaggtctgattgatttgacaatatc

SEQ ID NO: 34606 - DNA, 75 bp, Artificial Sequence
  Synthetic
gtgggggaagataataaactcaaaattgctgaactaacaatacctaatttctatccaaacacagtattccatgca

SEQ ID NO: 34607 - DNA, 75 bp, Artificial Sequence
  Synthetic
ccagaggccctagatataacaagatggttcctgtctgtccagttgttttaagtgttagggatgaattatttagaa

SEQ ID NO: 34608 - DNA, 75 bp, Artificial Sequence
  Synthetic
aaatatgacaaactttagcatgtctagattatttgtttcacctgacgaagttgctactgtaaagaaagctcatat

SEQ ID NO: 34609 - DNA, 75 bp, Artificial Sequence
  Synthetic
ccaacaataaaagcaggaattattaatttaacatctttgatgaggacccaagagcttttaacattgaattatgat

SEQ ID NO: 34610 - DNA, 75 bp, Artificial Sequence
  Synthetic
aatctatgcaaatctagcattgtcccgttttgtagaatattagaatgcaatggtgacgagcaaggagaactaata

SEQ ID NO: 34611 - DNA, 75 bp, Artificial Sequence
  Synthetic
tatgccattattcacaataaggtatcagaaaagaggcactgaaattatgacttataaaaatgccataatgaagtt

SEQ ID NO: 34612 - DNA, 75 bp, Artificial Sequence
  Synthetic
aaagaagtttttgacttttcaaaacaagggttttattcaaagaaaaatctaggtataataaatacaatttgctcc

SEQ ID NO: 34613 - DNA, 75 bp, Artificial Sequence
  Synthetic
tcacattaccaggagccttcttcataaatgtggcaggtggtattattaattggactaagctgctaaaatttataa

SEQ ID NO: 34614 - DNA, 75 bp, Artificial Sequence
  Synthetic
tagaaagagaaatgaacaaagatgttgatttcactgacttcctagatgaattagaatttagttcaggaaaatctc

SEQ ID NO: 34615 - DNA, 75 bp, Artificial Sequence
  Synthetic
agtagtgtactccacactaataactttcaaactttggtaaacttgagaattgcaaggtgtaacttggcattctaa

SEQ ID NO: 34616 - DNA, 75 bp, Artificial Sequence
  Synthetic
ttcaaactttggtaaacttgagaattgcaaggtgtaacttggcattctaatgattgagttggaatttaatgatgt

SEQ ID NO: 34617 - DNA, 75 bp, Artificial Sequence
  Synthetic
tgcaaggtgtaacttggcattctaatgattgagttggaatttaatgatgtcgctgctaacaccagcagtactttt

SEQ ID NO: 34618 - DNA, 75 bp, Artificial Sequence
  Synthetic
tacattaaaggacgcgagattaaaactagtctcacaaaaagaagtgaatgggaggttacgcttaaccttgggggc

SEQ ID NO: 34619 - DNA, 75 bp, Artificial Sequence
  Synthetic
tggaaggttactgtatttaatacaaattttcctggcaacaggaacagtccagttccagacgatggtcttaccctc

SEQ ID NO: 34620 - DNA, 75 bp, Artificial Sequence
  Synthetic
attttcctggcaacaggaacagtccagttccagacgatggtcttaccctccacagactcagtggataccttgcca

SEQ ID NO: 34621 - DNA, 75 bp, Artificial Sequence
  Synthetic
ggtgagtgacccagagaaagtcattataaaatcaaaaataataaatccactagctgaaaagaatggaataacctg

SEQ ID NO: 34622 - DNA, 75 bp, Artificial Sequence
  Synthetic
ataaaatcaaaaataataaatccactagctgaaaagaatggaataacctggtctgatggcgaagaggtttacctc

SEQ ID NO: 34623 - DNA, 75 bp, Artificial Sequence
  Synthetic
tcttaggaacatttaaattttaccctctggcaataggaatttacaaagttcagaggaaagagatggaacctaagt

SEQ ID NO: 34624 - DNA, 75 bp, Artificial Sequence
  Synthetic
tctggcaataggaatttacaaagttcagaggaaagagatggaacctaagtacttggagaagacaatgcgccagag

SEQ ID NO: 34625 - DNA, 75 bp, Artificial Sequence
  Synthetic
tggacaatcagtaaagtcaatgaagttcaggctgcccttacagtggtttctgggctaggctggaagaagactaac

SEQ ID NO: 34626 - DNA, 75 bp, Artificial Sequence
  Synthetic
ttcaggctgcccttacagtggtttctgggctaggctggaagaagactaacgtcagtgctgcagccagagaattct

SEQ ID NO: 34627 - DNA, 75 bp, Artificial Sequence
  Synthetic
attgagtcctaaatttcaatctggaaaaattaaacattttattcaatttggctaaaagagtcttcggactcacaa

SEQ ID NO: 34628 - DNA, 75 bp, Artificial Sequence
  Synthetic
ggggacagaaatactacggtatatatattccaaattcattattgctgttttaagttttaggtggagcacactact

SEQ ID NO: 34629 - DNA, 75 bp, Artificial Sequence
  Synthetic
actacaaacttgctattgctgagaattattatcacatctattccaatagaaaatcatcttgaactctttaatgat

SEQ ID NO: 34630 - DNA, 75 bp, Artificial Sequence
  Synthetic
aaatcatcttgaactctttaatgattgaattagagtttcatgatgtcactgctaacaccagcagtacttttgacc

SEQ ID NO: 34631 - DNA, 75 bp, Artificial Sequence
  Synthetic
gctaacaccagcagtacttttgacccagaggttgcatacgctaactttaagcgtatccacaccaatgggcttaac

SEQ ID NO: 34632 - DNA, 75 bp, Artificial Sequence
  Synthetic
ttaaaggacgcgagattaaaactagtctcgcaaaaagaagtgaatgggaggttacacttaaccttgggggctgga

SEQ ID NO: 34633 - DNA, 75 bp, Artificial Sequence
  Synthetic
gcctcagtggataccttgccaggtacctacttgagaagatgctaaaagtcagtgaaccggaaaaacaaattatca

SEQ ID NO: 34634 - DNA, 75 bp, Artificial Sequence
  Synthetic
agaaaaaaacggaataacttgggatgatggtgaagaagtttacttatctttcttccctggttctgagatgttctt

SEQ ID NO: 34635 - DNA, 75 bp, Artificial Sequence
  Synthetic
gatggtgaagaagtttacttatctttcttccctggttctgagatgttcttagggacttttagattctacccattg

SEQ ID NO: 34636 - DNA, 75 bp, Artificial Sequence
  Synthetic
gcaaagagatggaaccgaaataccttgaaaaaacaatgagacaaagatacatgggcttagaagcatcaacctgga

SEQ ID NO: 34637 - DNA, 75 bp, Artificial Sequence
  Synthetic
taaatttggaatcaacatgtaagggagagagggaaacaatttcaatcaggtaaaaattcaaaaaataaaatttgg

SEQ ID NO: 34638 - DNA, 75 bp, Artificial Sequence
  Synthetic
tagggtgggtggttggggacagaaaaatgctggcttaatttaatatagtctcataaatgatattttaagttttag

SEQ ID NO: 34639 - DNA, 75 bp, Artificial Sequence
  Synthetic
acagtggtctctggcttgggttggaagaaaactaatgttagtgctgcagctagagacttccttgctaaatttgga

SEQ ID NO: 34640 - DNA, 75 bp, Artificial Sequence
  Synthetic
atcaacatgtaagggagagagggaaacaatttcaatcaggtaaaaaattttaaaaataaaatttggctaaaaaag

SEQ ID NO: 34641 - DNA, 75 bp, Artificial Sequence
  Synthetic
agtagtgtactccacactaaaaacttgcgattgctaatctttacaaactcatatagaaaatctattcaatgattg

SEQ ID NO: 34642 - DNA, 75 bp, Artificial Sequence
  Synthetic
tgacccagaaaagctgataataaaatcaaagataatcaatccacttgctgaaaaaaacggtattacttggtctga

SEQ ID NO: 34643 - DNA, 75 bp, Artificial Sequence
  Synthetic
tcaaagataatcaatccacttgctgaaaaaaacggtattacttggtctgacggagaagaagtttacctctccttc

SEQ ID NO: 34644 - DNA, 75 bp, Artificial Sequence
  Synthetic
ggacattcagattttaccccttagcaattgggatttataaagttcagaggaaagaaatggaaccaaaatatcttg

SEQ ID NO: 34645 - DNA, 75 bp, Artificial Sequence
  Synthetic
aattgggatttataaagttcagaggaaagaaatggaaccaaaatatcttgagaaaactatgcgccaaaggtacat

SEQ ID NO: 34646 - DNA, 75 bp, Artificial Sequence
  Synthetic
gttagcaaattaaacgaggtccagtctgcactcactgtggtttcaggccttggttggaagaaaacaaatgtgagc

SEQ ID NO: 34647 - DNA, 75 bp, Artificial Sequence
  Synthetic
ctgcactcactgtggtttcaggccttggttggaagaaaacaaatgtgagcagtgctgctagggaattcctagcca

SEQ ID NO: 34648 - DNA, 75 bp, Artificial Sequence
  Synthetic
cagtcagaactagatttggcaaaatttaagatattaatttggctaaaagagtcctaggactcaacaaatcaaaca

SEQ ID NO: 34649 - DNA, 75 bp, Artificial Sequence
  Synthetic
gcttgttgggtgggtggttggggacagaaagaatacagcaatttattcttgaatcattgcagttcttttaagttt

SEQ ID NO: 34650 - DNA, 75 bp, Artificial Sequence
  Synthetic
ctcctacatatagaaaatttaaaaacataaccagtaagagtatggaggaccaagcttatgatcaatacctacaca

SEQ ID NO: 34651 - DNA, 75 bp, Artificial Sequence
  Synthetic
gacaactatatatgggatggtcacttcttgataattcttgactacaaagtctcagttgggaatgatagtagtgaa

SEQ ID NO: 34652 - DNA, 75 bp, Artificial Sequence
  Synthetic
tgattctcccagtgatgtctgaattgggtatagatacagaaatagctattattagggcaaatcctgttacatatc

SEQ ID NO: 34653 - DNA, 75 bp, Artificial Sequence
  Synthetic
caagtttgctgatgatgaggaatttctgatgatgatagcacatggggatttcactttgacagcaccatggtgcac

SEQ ID NO: 34654 - DNA, 75 bp, Artificial Sequence
  Synthetic
atctgacacccctgaactagaggaccacgaaatatttcaagagtttattaactccatgccaccaagatttgtatc

SEQ ID NO: 34655 - DNA, 75 bp, Artificial Sequence
  Synthetic
aacggatgtgacaaaacagaagccttctatccactttatttgggcaaagaatgcggatagaaagctaataggttc

SEQ ID NO: 34656 - DNA, 75 bp, Artificial Sequence
  Synthetic
caacaataatgaggaatatattagctgtgtcacagtataatagacataatacatttagagttgcaatgtgtgcta

SEQ ID NO: 34657 - DNA, 75 bp, Artificial Sequence
  Synthetic
tagattagataaagagaggtgccaaaggattgtgtcatcacctgggcttttcatattaagttctatgttacttta

SEQ ID NO: 34658 - DNA, 75 bp, Artificial Sequence
  Synthetic
gtggatgttctaaattttacattctatactagcttgtctataacaaaaagtatgctttcactgactgagccatct

SEQ ID NO: 34659 - DNA, 75 bp, Artificial Sequence
  Synthetic
gcaaaaggccttcatgagaaacatcacgtaatgattgacttagcaaaaactgttctggaaatagagatgaaccaa

SEQ ID NO: 34660 - DNA, 75 bp, Artificial Sequence
  Synthetic
acgtaatgattgacttagcaaaaactgttctggaaatagagatgaaccaaagaggtgataatttaggtatatggt

SEQ ID NO: 34661 - DNA, 75 bp, Artificial Sequence
  Synthetic
ctaaagcagaaaaaaaacaacatgtcaatctaccaatattaatacactctatagcaaaatctttgatattggata

SEQ ID NO: 34662 - DNA, 75 bp, Artificial Sequence
  Synthetic
ctttcacaagctctaaatcttgtataaaggtcggtgatttcagggaaattaaagataaacaaacagaaaaatcaa

SEQ ID NO: 34663 - DNA, 75 bp, Artificial Sequence
  Synthetic
agaaagcaactgagaaatttgacaaaaagttcagactttcaaatccattattcttagaagatgaagaagctaacc

SEQ ID NO: 34664 - DNA, 75 bp, Artificial Sequence
  Synthetic
ggctctgatacaaaaaattcctaattataaagactatatttcagtaaaggtgtttgatcgtctatatgaattgct

SEQ ID NO: 34665 - DNA, 75 bp, Artificial Sequence
  Synthetic
cctttcattgaattagctatggaaatgatgaagaatcacaaagaattctctttcacattctttaataagggccaa

SEQ ID NO: 34666 - DNA, 75 bp, Artificial Sequence
  Synthetic
tgatatgcgaagtagatcactcttaacacctcgcaaatttacaacattgggatccttaaataagctagtttccta

SEQ ID NO: 34667 - DNA, 75 bp, Artificial Sequence
  Synthetic
gatccttaaataagctagtttcctataatgactttagatcttctttagatgaccaaagatttactgataatttga

SEQ ID NO: 34668 - DNA, 75 bp, Artificial Sequence
  Synthetic
gaccaaagatttactgataatttgaacttcatgctcaataacccagaattgttagttactaaaggtgaaaataaa

SEQ ID NO: 34669 - DNA, 75 bp, Artificial Sequence
  Synthetic
tcagatataattcaaaaagatttaaagaaagcctttctatccaaaatccagcacaattatttatcgagcagatac

SEQ ID NO: 34670 - DNA, 75 bp, Artificial Sequence
  Synthetic
tgttttcccataaaccaatcatagattatagcagtatatttgataaattgacttcacttgcagaggcagacatca

SEQ ID NO: 34671 - DNA, 75 bp, Artificial Sequence
  Synthetic
ttcctggggctgatcctatagaattggaaaaagatcttcaccacttaaatgaatttgttgaaacaacagcaatca

SEQ ID NO: 34672 - DNA, 75 bp, Artificial Sequence
  Synthetic
aagagaagattttgcacaacatagacaatcctcctaagcatttaatagggaatgaaatcctaatttatagaatca

SEQ ID NO: 34673 - DNA, 75 bp, Artificial Sequence
  Synthetic
caatcctcctaagcatttaatagggaatgaaatcctaatttatagaatcagagagatgaccaaactctatcaagt

SEQ ID NO: 34674 - DNA, 75 bp, Artificial Sequence
  Synthetic
tgccaatgaaatcttatactgcaatcgacttttgcacattaattcagggcaacactatctctgataataaatggt

SEQ ID NO: 34675 - DNA, 75 bp, Artificial Sequence
  Synthetic
aaataatagcaaatgagtgttttagagtgctttgccactttgctgattcctttgtggaagaggcaagcagattga

SEQ ID NO: 34676 - DNA, 75 bp, Artificial Sequence
  Synthetic
ttaactcagacagatttaaatagatttgatgcccttaaaactaatgaaagagtttcatggaataactggcagaca

SEQ ID NO: 34677 - DNA, 75 bp, Artificial Sequence
  Synthetic
atatctatacatatcaagtatctacaatagaacacattttgagaaggaataatgaaggattacaatccagaggcc

SEQ ID NO: 34678 - DNA, 75 bp, Artificial Sequence
  Synthetic
aaatctagcattgtcccgttttgtagaattttagaatgtaatggtgacgagcaaggagaactaatatttctctcc

SEQ ID NO: 34679 - DNA, 75 bp, Artificial Sequence
  Synthetic
gatgaagtcatggatttcacaatttctgaggagatagaatctatgccattatttacaataaggtatcagaaaaga

SEQ ID NO: 34680 - DNA, 75 bp, Artificial Sequence
  Synthetic
caattctatataattccttccatatagcaatgttattagagtctatggatcgagaattccatatgttcacattac

SEQ ID NO: 34681 - DNA, 75 bp, Artificial Sequence
  Synthetic
agcaatgttattagagtctatggatcgagaattccatatgttcacattaccagaagccttcttcataaatgtggc

SEQ ID NO: 34682 - DNA, 75 bp, Artificial Sequence
  Synthetic
cagaagccttcttcataaatgtggcaggtggtattgttaattggactaagctgctaaaatttataaagtcattgc

SEQ ID NO: 34683 - DNA, 75 bp, Artificial Sequence
  Synthetic
aatgatgatgtcaagatttgtagaaaaaactgtgtatttaatagaaagagaaatgaacaaagatgttgatttcac

SEQ ID NO: 34684 - DNA, 75 bp, Artificial Sequence
  Synthetic
tgatttcctagatgaattagaatttagttcaggaaagtctctgtttacctttttctgaagcatatcttcattggt

SEQ ID NO: 34685 - DNA, 75 bp, Artificial Sequence
  Synthetic
cactatgtggcaaaaatgatgacagcattaaaaaaagtacaattttcttatgtaggagcacactacaggttccct

SEQ ID NO: 34686 - DNA, 75 bp, Artificial Sequence
  Synthetic
ccaaggttaagtgtactccacactacaaacttgctattgttgaaaatcgctgtgctatcaaatctaacagaaggt

SEQ ID NO: 34687 - DNA, 75 bp, Artificial Sequence
  Synthetic
ggcaaccggaacaacccagttcctgacgatggtcttaccctccaccgcctcagtggattccttgccaggtaccta

SEQ ID NO: 34688 - DNA, 75 bp, Artificial Sequence
  Synthetic
aaccagaaaaattgatcatcaaatcaaaaataatcaatccattggcagaaaaaaatgggatcacttggaatgatg

SEQ ID NO: 34689 - DNA, 75 bp, Artificial Sequence
  Synthetic
tccaggatcagaaatgttcctaggaactttcagattctatcccttggcaattgggatctacaaagttcagcgcaa

SEQ ID NO: 34690 - DNA, 75 bp, Artificial Sequence
  Synthetic
ggaaatggaaccaaaataccttgaaaagacaatgcgacagagatatatgggactagaagcagcaacttggactgt

SEQ ID NO: 34691 - DNA, 75 bp, Artificial Sequence
  Synthetic
tttggaatcaatatgtaagcaaggaagcattttaaatcaggctaaaatcatcagttttaatttggctaaaagggt

SEQ ID NO: 34692 - DNA, 75 bp, Artificial Sequence
  Synthetic
atgaggattctaatactgcttttagcagttactaaactggctgtgggtagcccagttgtcactagatgctttcat

SEQ ID NO: 34693 - DNA, 75 bp, Artificial Sequence
  Synthetic
cagttactaaactggctgtgggtagcccagttgtcactagatgctttcatggtgggcaactgattgcagaaagga

SEQ ID NO: 34694 - DNA, 75 bp, Artificial Sequence
  Synthetic
ctgcattaaagatgacgtttctatgttaaaatcagagattgtctacacaaaaaatgatactgggatttttggcca

SEQ ID NO: 34695 - DNA, 75 bp, Artificial Sequence
  Synthetic
atcacagactggaaagcatgcaaccctgttgttacagccggtggtagtataaatgttatagaggttgataaaaat

SEQ ID NO: 34696 - DNA, 75 bp, Artificial Sequence
  Synthetic
ctgttgttacagccggtggtagtataaatgttatagaggttgataaaaatctaaaccttgtaactagaaattatg

SEQ ID NO: 34697 - DNA, 75 bp, Artificial Sequence
  Synthetic
agttgataaggaaaatgcccagattatatttcagacagacagactgaaccattttgaagtgacaggaaccaccat

SEQ ID NO: 34698 - DNA, 75 bp, Artificial Sequence
  Synthetic
gcatctgttactctcgatagaacatgcgaacatataaaagtaagctgtggaaagaaaacattacaattccatgct

SEQ ID NO: 34699 - DNA, 75 bp, Artificial Sequence
  Synthetic
ttcgattcttacacaggagcatactaccagggtcaatggcaatttcgatctgccaaaatattgagttgattataa

SEQ ID NO: 34700 - DNA, 75 bp, Artificial Sequence
  Synthetic
tgccaaaatattgagttgattataataacaatattagcattatgcatatttataattatgataatattaacaaaa

SEQ ID NO: 34701 - DNA, 75 bp, Artificial Sequence
  Synthetic
cagtatttatgcccatagcttttgcttatggatgggcgtacaacaggagttgtaagaaatgcacttgttgcggat

SEQ ID NO: 34702 - DNA, 75 bp, Artificial Sequence
  Synthetic
ttatggatgggcgtacaacaggagttgtaagaaatgcacttgttgcggattggcataccacccctttacaaactg

SEQ ID NO: 34703 - DNA, 75 bp, Artificial Sequence
  Synthetic
aaatttgaaacatcagacagaatgagaatgcaccgagaatcagggttgtgccagggttttaaaagcctgagagta

SEQ ID NO: 34704 - DNA, 75 bp, Artificial Sequence
  Synthetic
gaatgcaccgagaatcagggttgtgccagggttttaaaagcctgagagtagcaagaaggctttgcaaatcaaaag

SEQ ID NO: 34705 - DNA, 75 bp, Artificial Sequence
  Synthetic
actctcagtgttgattctatcctttgtaacacccatagaggggactcttacaaattaccctactgatcagaaata

SEQ ID NO: 34706 - DNA, 75 bp, Artificial Sequence
  Synthetic
gtaacacccatagaggggactcttacaaattaccctactgatcagaaatatactttagatgaaatagcagatgtc

SEQ ID NO: 34707 - DNA, 75 bp, Artificial Sequence
  Synthetic
ctacaaaatactatataatattatatacatcactttttggtgcaggtttgactatcatttttgcaggagtagcat

SEQ ID NO: 34708 - DNA, 75 bp, Artificial Sequence
  Synthetic
tacatcactttttggtgcaggtttgactatcatttttgcaggagtagcattgggattaacaattatactggaagt

SEQ ID NO: 34709 - DNA, 75 bp, Artificial Sequence
  Synthetic
tgcaacgagtgcaatatgtaccatagcaaaaaatcaatcaaatatgttggtgatttcactaacaaatgtgggttt

SEQ ID NO: 34710 - DNA, 75 bp, Artificial Sequence
  Synthetic
tgtacatgcgggctactagaggatccagagggtgttgttgtacataaagccaagaaatcctgtacatattcatat

SEQ ID NO: 34711 - DNA, 75 bp, Artificial Sequence
  Synthetic
tgatatttgttgcctttttatttgtaatacagaatacaattataatggtcgcagcagaagaagactgctggaaaa

SEQ ID NO: 34712 - DNA, 75 bp, Artificial Sequence
  Synthetic
gcagcagaagaagactgctggaaaaatgaagaattaaaagaggattgtgtagggcctttaattgcacctaaggat

SEQ ID NO: 34713 - DNA, 75 bp, Artificial Sequence
  Synthetic
acttgagtgaggcttcattgttagcaacagcaaagaaaataactcaggtggatgctgaaaatgtagagatattgg

SEQ ID NO: 34714 - DNA, 75 bp, Artificial Sequence
  Synthetic
ggaaaactatggaatcagcaattagagtgattgaaagacagaagacataccacagaatgcacttgcttgaggcag

SEQ ID NO: 34715 - DNA, 75 bp, Artificial Sequence
  Synthetic
ttataaaatgtttgaacataacagtggatattcccaagtaaagtggaggatgatgataaaaacacaacactttga

SEQ ID NO: 34716 - DNA, 75 bp, Artificial Sequence
  Synthetic
ccattttgtgctcagtgtattgctgacaattcttgtgcacaaggctcttgggaatttgacacacatatgaattcc

SEQ ID NO: 34717 - DNA, 75 bp, Artificial Sequence
  Synthetic
ttaaacatgacttctctctattcctcagaatttttgaagcagcatttccaggcactgcttatgttcacttgctaa

SEQ ID NO: 34718 - DNA, 75 bp, Artificial Sequence
  Synthetic
cagaatttttgaagcagcatttccaggcactgcttatgttcacttgctaacaaatataaaagaaaagaagcccta

SEQ ID NO: 34719 - DNA, 75 bp, Artificial Sequence
  Synthetic
ataaagaagaagtttccgaataataaattgcttattggatatttagattttggcaagtacttgctaggcttaagt

SEQ ID NO: 34720 - DNA, 75 bp, Artificial Sequence
  Synthetic
aattgcttattggatatttagattttggcaagtacttgctaggcttaagtcatgcaagcacatacgagttgcaac

SEQ ID NO: 34721 - DNA, 75 bp, Artificial Sequence
  Synthetic
gccaacagaactaacccgatctggtggtcaacaaacatcattagcaagttctgtggtaggtcaagcaacgaaaga

SEQ ID NO: 34722 - DNA, 75 bp, Artificial Sequence
  Synthetic
ctgtggtaggtcaagcaacgaaagaatgtaaaaaatacaaagatgttagttgcttaagcccaagatttggaattc

SEQ ID NO: 34723 - DNA, 75 bp, Artificial Sequence
  Synthetic
tgaccaaccaaattacaatatttataaaaagccaaaaaaagtctacaaagctcataacaaagaagaaacatggtg

SEQ ID NO: 34724 - DNA, 75 bp, Artificial Sequence
  Synthetic
ctgtggaaaaattaaaacctatgaaatgttggttagttgaccctggcaagaatgatgatgtttactccattgcaa

SEQ ID NO: 34725 - DNA, 75 bp, Artificial Sequence
  Synthetic
atgttggttagttgaccctggcaagaatgatgatgtttactccattgcaataaaaacatgtagagtgattgacaa

SEQ ID NO: 34726 - DNA, 75 bp, Artificial Sequence
  Synthetic
aaatggaatataatcaagtgtgattctgatctgctctactacagtgaccatgtaccaggggaagatacaggaaat

SEQ ID NO: 34727 - DNA, 75 bp, Artificial Sequence
  Synthetic
ctgatctgctctactacagtgaccatgtaccaggggaagatacaggaaatgatataggacattattgtgtatcag

SEQ ID NO: 34728 - DNA, 75 bp, Artificial Sequence
  Synthetic
aattaatcctgatgttgtcactgactgtgtatgggaatttacttctaggagatcacaatatataggcaagatctc

SEQ ID NO: 34729 - DNA, 75 bp, Artificial Sequence
  Synthetic
catgcagtctcttgaagattacaaaaaagctttaactgacagattgacccataccttggaaacctatagttttgc

SEQ ID NO: 34730 - DNA, 75 bp, Artificial Sequence
  Synthetic
aaaccagtttacaaatatatcactgcacaaggagtcgaaaactcagacggtatagaaggggcattcataacagcc

SEQ ID NO: 34731 - DNA, 75 bp, Artificial Sequence
  Synthetic
cacaaggagtcgaaaactcagacggtatagaaggggcattcataacagccagtattccagctgctgggggtacta

SEQ ID NO: 34732 - DNA, 75 bp, Artificial Sequence
  Synthetic
ggatggctttccactccttgatctaatagtgtttgtaaagagtgctgtgatcaaaagcacatacaaccatatata

SEQ ID NO: 34733 - DNA, 75 bp, Artificial Sequence
  Synthetic
atagtgtttgtaaagagtgctgtgatcaaaagcacatacaaccatatatacgatactgggccaacaattagcata

SEQ ID NO: 34734 - DNA, 75 bp, Artificial Sequence
  Synthetic
ctggtcaatgtcccagcaatatagaacatgaggctaattggttgacattttcacaagaaagaactagcagatggg

SEQ ID NO: 34735 - DNA, 75 bp, Artificial Sequence
  Synthetic
acatgaggctaattggttgacattttcacaagaaagaactagcagatggggatgtgaagagtttgggtgcttggc

SEQ ID NO: 34736 - DNA, 75 bp, Artificial Sequence
  Synthetic
tcctgtcaagatgtaattagaccagaaacaaaagtttacaggaaagctgtagatgaaattgttattttaacagtt

SEQ ID NO: 34737 - DNA, 75 bp, Artificial Sequence
  Synthetic
tttgtacagaaattaatgcaatagagccaaaaataacagaagaaattgagctccagtttaaaacagttgacacga

SEQ ID NO: 34738 - DNA, 75 bp, Artificial Sequence
  Synthetic
gccaaaaataacagaagaaattgagctccagtttaaaacagttgacacgaaaacactaccgtatatagtagctgt

SEQ ID NO: 34739 - DNA, 75 bp, Artificial Sequence
  Synthetic
cagataaatgacttagggacatttgggcaaatgtgcggaaatgtccaaaaaacaaacagcagcattttaggaact

SEQ ID NO: 34740 - DNA, 75 bp, Artificial Sequence
  Synthetic
ggcaaatgtgcggaaatgtccaaaaaacaaacagcagcattttaggaactgggacaccaaagtttgattatactt

SEQ ID NO: 34741 - DNA, 75 bp, Artificial Sequence
  Synthetic
aacaaacagcagcattttaggaactgggacaccaaagtttgattatacttgtcatggtgccagtcggaaggatat

SEQ ID NO: 34742 - DNA, 75 bp, Artificial Sequence
  Synthetic
aattttgactcctgcaaacttctaaaggaagaaacacagcttatatttaatgatgatcatgatacaataactgtt

SEQ ID NO: 34743 - DNA, 75 bp, Artificial Sequence
  Synthetic
tacaatacaaatcacttaattggtgagttagctataaaattgatattaggggatatccaatataaattgttcaca

SEQ ID NO: 34744 - DNA, 75 bp, Artificial Sequence
  Synthetic
cgaaatgtgttggctgccctgattgctttgagagctattcctgcaatttccagatagtatcaaatatagacacaa

SEQ ID NO: 34745 - DNA, 75 bp, Artificial Sequence
  Synthetic
cacattccataatagaatatcaatcaaggcaatgcagcaaaattatgctgtaaaactctcctgccagaaagatcc

SEQ ID NO: 34746 - DNA, 75 bp, Artificial Sequence
  Synthetic
aaggcaatgcagcaaaattatgctgtaaaactctcctgccagaaagatccagggccatcagggacttttaaaatt

SEQ ID NO: 34747 - DNA, 75 bp, Artificial Sequence
  Synthetic
tccatacagtagcaaaagatgataaaatagaaataaatgttggagaccagacttcattcattaaagagaaagatg

SEQ ID NO: 34748 - DNA, 75 bp, Artificial Sequence
  Synthetic
ggtcagagatgaaggtattagtgtaatttttgaaccaattaaagccttctttgggagttatttcagcatcttttt

SEQ ID NO: 34749 - DNA, 75 bp, Artificial Sequence
  Synthetic
ggatttttaataatatatatttttatgccgatgtttatgaagttgaaggaagtgttgaaagcaaatgagaagctt

SEQ ID NO: 34750 - DNA, 75 bp, Artificial Sequence
  Synthetic
tgccgatgtttatgaagttgaaggaagtgttgaaagcaaatgagaagctttacttgcaggaaattaagcaaaagt

SEQ ID NO: 34751 - DNA, 75 bp, Artificial Sequence
  Synthetic
atggaggaccaagcttatgatcaatacttgcacagaatccaagcagctagaacagccacagttgctaaagacatc

SEQ ID NO: 34752 - DNA, 75 bp, Artificial Sequence
  Synthetic
acttgcacagaatccaagcagctagaacagccacagttgctaaagacatcagtgctgatatccttgaggcaaggc

SEQ ID NO: 34753 - DNA, 75 bp, Artificial Sequence
  Synthetic
agtgctgatatccttgaggcaaggcatgactactttggtcgggagctttgtaactcgctaggaattgaatacaaa

SEQ ID NO: 34754 - DNA, 75 bp, Artificial Sequence
  Synthetic
atggccatttcttgataattcttgattacaaagtctcagttgggaatgatagtagtgaaatcacatataaaaaat

SEQ ID NO: 34755 - DNA, 75 bp, Artificial Sequence
  Synthetic
aatatacccatacaattagattttggtaggttctttgaactgagaaaaatgttgctggacaagtttgctgatgat

SEQ ID NO: 34756 - DNA, 75 bp, Artificial Sequence
  Synthetic
gtaggttctttgaactgagaaaaatgttgctggacaagtttgctgatgatgaggaatttttgatgatgatagcac

SEQ ID NO: 34757 - DNA, 75 bp, Artificial Sequence
  Synthetic
atggtgcacatctgacacccctgaactagaagagcatgaaatatttcaagagtttattaattccatgccaccaag

SEQ ID NO: 34758 - DNA, 75 bp, Artificial Sequence
  Synthetic
ctagaagagcatgaaatatttcaagagtttattaattccatgccaccaagatttgtatcacttttcaaagaagct

SEQ ID NO: 34759 - DNA, 75 bp, Artificial Sequence
  Synthetic
aaagatggaatacattcttatataaagccagagcagagacagaggtggattataatcaattcctatcggacaagg

SEQ ID NO: 34760 - DNA, 75 bp, Artificial Sequence
  Synthetic
agccagagcagagacagaggtggattataatcaattcctatcggacaaggcacataagattttcatgctagaagg

SEQ ID NO: 34761 - DNA, 75 bp, Artificial Sequence
  Synthetic
aataggttcaacagcaaaattaatatacctatctaacagtttacaaagtatcactgaacaatcaacttggacaga

SEQ ID NO: 34762 - DNA, 75 bp, Artificial Sequence
  Synthetic
atggatattgatggtaaagtggggcaatatgaaaccttatgtgctgaaagaaaaatgattgccaggtcaactggc

SEQ ID NO: 34763 - DNA, 75 bp, Artificial Sequence
  Synthetic
aatatgaaaccttatgtgctgaaagaaaaatgattgccaggtcaactggcaaaaaggtagataacaagaggttag

SEQ ID NO: 34764 - DNA, 75 bp, Artificial Sequence
  Synthetic
cgtgttatgggaacaacaattcatcttagcaaacgacctatttaaaaatcaagaaaggcagaagtttatgaagaa

SEQ ID NO: 34765 - DNA, 75 bp, Artificial Sequence
  Synthetic
ttagcaaacgacctatttaaaaatcaagaaaggcagaagtttatgaagaacttctttggcataggaaaacataag

SEQ ID NO: 34766 - DNA, 75 bp, Artificial Sequence
  Synthetic
acatcgaaacggataagcccaaaatcctagatttcaacaacactatagtcttgatggccgcaaggacaatggtta

SEQ ID NO: 34767 - DNA, 75 bp, Artificial Sequence
  Synthetic
ggataacacattgcaggacctacatcctattatcatgcaatatgcttcagaaataaaagaggcatctaaggatac

SEQ ID NO: 34768 - DNA, 75 bp, Artificial Sequence
  Synthetic
aaaacttgcttctggcaatgtatagtagatatttcaacaataatgaggaatatattagctgtgtcacaatataat

SEQ ID NO: 34769 - DNA, 75 bp, Artificial Sequence
  Synthetic
tgtgtgctaatgactctgtttatgcattagtatttccttcatctgacataaaaacaaaaagagcaacagtagtct

SEQ ID NO: 34770 - DNA, 75 bp, Artificial Sequence
  Synthetic
attagtatttccttcatctgacataaaaacaaaaagagcaacagtagtctttagtatagtttgcatgcataaaga

SEQ ID NO: 34771 - DNA, 75 bp, Artificial Sequence
  Synthetic
taaagcaattagattagataaagagaggtgtcaaaggattgtatcatcacctgggctttttatattaagttctat

SEQ ID NO: 34772 - DNA, 75 bp, Artificial Sequence
  Synthetic
gtaaatttagtagacgttctaaatttcacattctatactagcttgtctataacaaaaagtatgctttcgctgact

SEQ ID NO: 34773 - DNA, 75 bp, Artificial Sequence
  Synthetic
tcacattctatactagcttgtctataacaaaaagtatgctttcgctgactgagccatctagatatatgataatga

SEQ ID NO: 34774 - DNA, 75 bp, Artificial Sequence
  Synthetic
gtgtatacatggtcaatttgataaagagaggatgtgcatccgcaaatgagcaatcatcgaagatccagctgagaa

SEQ ID NO: 34775 - DNA, 75 bp, Artificial Sequence
  Synthetic
acagcatgtcaatctaccaatattaatacactctatagcaaaatctttgatattggacacatcaaggcataatca

SEQ ID NO: 34776 - DNA, 75 bp, Artificial Sequence
  Synthetic
tttgcgaaatcgtgtagaaagtagaaataactttagaagaagtatcacaacaataagcactttcacaagctctaa

SEQ ID NO: 34777 - DNA, 75 bp, Artificial Sequence
  Synthetic
agagaaattaaagataaagaaacagaaaaatcaaaaaaatcaactgagaaatttgataaaaagttcagactttca

SEQ ID NO: 34778 - DNA, 75 bp, Artificial Sequence
  Synthetic
aaaaatcaaaaaaatcaactgagaaatttgataaaaagttcagactttcaaatccattattcttggaagatgagg

SEQ ID NO: 34779 - DNA, 75 bp, Artificial Sequence
  Synthetic
caattatagggctttgatacaaaaaattcctaattataaagactatatttcagtgaaggtgtttgaccgtctata

SEQ ID NO: 34780 - DNA, 75 bp, Artificial Sequence
  Synthetic
attcctaattataaagactatatttcagtgaaggtgtttgaccgtctatatgagttgctaaaaaacggagtctta

SEQ ID NO: 34781 - DNA, 75 bp, Artificial Sequence
  Synthetic
ctatggaaatgatgaagaaccacaaggaattctctttcacattctttaataaaggccaaaagacagctaaagaca

SEQ ID NO: 34782 - DNA, 75 bp, Artificial Sequence
  Synthetic
aaaggccaaaagacagctaaagacagagagatatttgttggagaatttgaagctaaaatgtgtatgtatgtagta

SEQ ID NO: 34783 - DNA, 75 bp, Artificial Sequence
  Synthetic
tattctgtattttatgtgtaattatatgcaaaagctactaatacttccagatgatttaattgcaaatatattgga

SEQ ID NO: 34784 - DNA, 75 bp, Artificial Sequence
  Synthetic
ttgatccttgagatgactaatggtctaaattataattatgtccaaattaaaagaaactggctccagggcaatttc

SEQ ID NO: 34785 - DNA, 75 bp, Artificial Sequence
  Synthetic
gctgtgcaatgcttgtctacaaagatatcctcaaagagtgtatgaagttactagacggagactgtttaattaact

SEQ ID NO: 34786 - DNA, 75 bp, Artificial Sequence
  Synthetic
ctatctgtctatggcagatttttattgcctagtgtaggtgattgtgcttatattgggccatatgaggatttagcc

SEQ ID NO: 34787 - DNA, 75 bp, Artificial Sequence
  Synthetic
gcttgaagcatgggtgccctccaagtctagtttggttggcaataagttgtagccactggataacatttttcactt

SEQ ID NO: 34788 - DNA, 75 bp, Artificial Sequence
  Synthetic
agccactggataacatttttcacttacaatatgctggatgaccaaattaatgcaccacagcagcatttaccattc

SEQ ID NO: 34789 - DNA, 75 bp, Artificial Sequence
  Synthetic
attatatttgatagcattagtcggcttggaagctggcaacttatggtttttaataaatatattaaagaaattggt

SEQ ID NO: 34790 - DNA, 75 bp, Artificial Sequence
  Synthetic
atacaaagccaatgtctacacttatgcaattcaattgataagctgacagaatcagaaaagttcaaattaaaaata

SEQ ID NO: 34791 - DNA, 75 bp, Artificial Sequence
  Synthetic
gcaattcaattgataagctgacagaatcagaaaagttcaaattaaaaatattgagatatcttactcttgatactg

SEQ ID NO: 34792 - DNA, 75 bp, Artificial Sequence
  Synthetic
agaaacaagtgatatgcgaagtaggtcgctcctaacacctcgtaaatttacaacattgggatctttaaacaaact

SEQ ID NO: 34793 - DNA, 75 bp, Artificial Sequence
  Synthetic
tcgctcctaacacctcgtaaatttacaacattgggatctttaaacaaactagtttcctataatgactttagatct

SEQ ID NO: 34794 - DNA, 75 bp, Artificial Sequence
  Synthetic
ataatttgaacttcatgcttaacaatcctgaattgttagtcactaaaggcgaaaataaagagcagttcatgcaat

SEQ ID NO: 34795 - DNA, 75 bp, Artificial Sequence
  Synthetic
caaaacccagcacaattatttatcgagcagatactgttttcccataaaccaatcatagattacagcagtatattt

SEQ ID NO: 34796 - DNA, 75 bp, Artificial Sequence
  Synthetic
cagatatcattgaagagttaccagagatcattggaagagttacattccctcaagcataccaaatgataaatagag

SEQ ID NO: 34797 - DNA, 75 bp, Artificial Sequence
  Synthetic
gatcattggaagagttacattccctcaagcataccaaatgataaatagagatattggccaactacctttagatat

SEQ ID NO: 34798 - DNA, 75 bp, Artificial Sequence
  Synthetic
tattgtatattgaatgatccactaatgatcacagctgcaaacacctccttattatgtgttaaaggaacaccacaa

SEQ ID NO: 34799 - DNA, 75 bp, Artificial Sequence
  Synthetic
attatgtgttaaaggaacaccacaagatagaactggtctcagtgcaagtcaaatgcctgaatttaggaatatgaa

SEQ ID NO: 34800 - DNA, 75 bp, Artificial Sequence
  Synthetic
ctatcaggtttgttatgattatgtcaaatctacagagcataaggttaagatatttatattaccaatgaaatctta

SEQ ID NO: 34801 - DNA, 75 bp, Artificial Sequence
  Synthetic
attcagggcaacactatctctgataataagtggtacacaatgcattatttaaaacagattgctagcggatctatc

SEQ ID NO: 34802 - DNA, 75 bp, Artificial Sequence
  Synthetic
gcagattgagctttattaatgaagttcttgataatttcacatataaaaatataagtgttaactctctgtttaata

SEQ ID NO: 34803 - DNA, 75 bp, Artificial Sequence
  Synthetic
agacttcattcctctattatttagactcaaagttttaactcagacagatttaaatagatttgatgcccttaaaac

SEQ ID NO: 34804 - DNA, 75 bp, Artificial Sequence
  Synthetic
taatgaaagagtctcatggaataactggcagacaaaccgttccctgaattcaggtctgattgatttgacaatatc

SEQ ID NO: 34805 - DNA, 75 bp, Artificial Sequence
  Synthetic
gggaataaacttttaaattctagacatggattaaaatttgaatacatggaggaaaccattctagatgaaaaatat

SEQ ID NO: 34806 - DNA, 75 bp, Artificial Sequence
  Synthetic
agtatctacaatagaacatattttgagaaggaataatgaaggattacaatccagaggccctaggtataacaaaat

SEQ ID NO: 34807 - DNA, 75 bp, Artificial Sequence
  Synthetic
agaaggaataatgaaggattacaatccagaggccctaggtataacaaaatggttcctgtttgtccagttgtttta

SEQ ID NO: 34808 - DNA, 75 bp, Artificial Sequence
  Synthetic
ttgccactgtaaagaaagctcatatgtccaaaatgatgttcttttccgggccgacaataaaagcaggaattatca

SEQ ID NO: 34809 - DNA, 75 bp, Artificial Sequence
  Synthetic
agagcttttaacattgaattatgataatctatgcaaatctagcattgtcccgttttgtagaatattagaatgtaa

SEQ ID NO: 34810 - DNA, 75 bp, Artificial Sequence
  Synthetic
tggcgatgagcaaggagaactaatattcctttcagatgaagtcatggatttcacaatttctgaggagatagaatc

SEQ ID NO: 34811 - DNA, 75 bp, Artificial Sequence
  Synthetic
cagaaaagaggcactgaaattatgacttataaaaatgctataatgaagttagtttcagcaggggtagatgagatc

SEQ ID NO: 34812 - DNA, 75 bp, Artificial Sequence
  Synthetic
aagggttctattcaaagaaaaacttaggtataataaatacaatttgttctataataaatatactagaaacaaatg

SEQ ID NO: 34813 - DNA, 75 bp, Artificial Sequence
  Synthetic
aggtataataaatacaatttgttctataataaatatactagaaacaaatgaatggtccacaattttatacaattc

SEQ ID NO: 34814 - DNA, 75 bp, Artificial Sequence
  Synthetic
tccatggatcgagaattccatatgttcacattacccgaagccttttttataaatgtggcaggtggtgttgttaac

SEQ ID NO: 34815 - DNA, 75 bp, Artificial Sequence
  Synthetic
agtcgttgccagtgatagagcaagagccttggtcaatgatgatgtcaagatttgtagaaaaaactgtgtatttga

SEQ ID NO: 34816 - DNA, 75 bp, Artificial Sequence
  Synthetic
gccttggtcaatgatgatgtcaagatttgtagaaaaaactgtgtatttgatagaaagagaaatgaacaaagatgt

SEQ ID NO: 34817 - DNA, 75 bp, Artificial Sequence
  Synthetic
agtagtgtactcctacatatagaaaatttaaaaatataaccagtaggagtatggaggaccaagcttatgatcaat

SEQ ID NO: 34818 - DNA, 75 bp, Artificial Sequence
  Synthetic
atggaggaccaagcttatgatcaatacctgcacagaattcaagcagctagaacagccacagttgctaaagacatc

SEQ ID NO: 34819 - DNA, 75 bp, Artificial Sequence
  Synthetic
gtctgaattgggtatagatacagaaatagctattattagggcaaatcctgttacatatcagatatctataattgg

SEQ ID NO: 34820 - DNA, 75 bp, Artificial Sequence
  Synthetic
ttacatatcagatatctataattggagaagaattcaaacaaagattcccaaatatacccatacaattagattttg

SEQ ID NO: 34821 - DNA, 75 bp, Artificial Sequence
  Synthetic
tgcactaaaagcaataggaaagagtatggatattgatggtaaagtagggcaatacgaaaccttatgtgctgaaag

SEQ ID NO: 34822 - DNA, 75 bp, Artificial Sequence
  Synthetic
aagcggttaagattggcaatgcacttgtattatgggaacaacaattcatcttagcaaacgacttatttaaaaatc

SEQ ID NO: 34823 - DNA, 75 bp, Artificial Sequence
  Synthetic
gaaaaacgacctgatggatgcaggtgcattattcactactttagaatgtaaaaataaagaatatatatctataag

SEQ ID NO: 34824 - DNA, 75 bp, Artificial Sequence
  Synthetic
aaaataaagaatatatatctataagtaaagcaattagattagataaagagaggtgccaaaggattgtatcatcac

SEQ ID NO: 34825 - DNA, 75 bp, Artificial Sequence
  Synthetic
aaaaatcaaaaaaatcaactgagaaatttgacaaaaagttcagactttcaaatccattattcttagaagatgagg

SEQ ID NO: 34826 - DNA, 75 bp, Artificial Sequence
  Synthetic
aatccattattcttagaagatgaggaagctaaccttgaagttcaacattgcaattatagggctttgatacaaaaa

SEQ ID NO: 34827 - DNA, 75 bp, Artificial Sequence
  Synthetic
gagagaatatcaaaagagagatgcaaactgaacacggacgagatgataagtgaaccaggtgattcaaaattgaaa

SEQ ID NO: 34828 - DNA, 75 bp, Artificial Sequence
  Synthetic
tattctgtattttatgtgcaattatatgcaaaaactactaatacttccggatgatttaattgcaaatatcttaga

SEQ ID NO: 34829 - DNA, 75 bp, Artificial Sequence
  Synthetic
aacatcgttagcaattatccaaaataaagtctctgatcaaatagtaattcaatatgcagcaaacacatttgaatc

SEQ ID NO: 34830 - DNA, 75 bp, Artificial Sequence
  Synthetic
acttttcaatttacatggggaaccactatctgtctatggcagatttttattgcctagtgtaggtgattgtgctta

SEQ ID NO: 34831 - DNA, 75 bp, Artificial Sequence
  Synthetic
ttggaagctgggaacttatggtttttaataaatatattgaaaaaattggtgccattggataaacagaaagaaacc

SEQ ID NO: 34832 - DNA, 75 bp, Artificial Sequence
  Synthetic
ataatttgaacttcatgctcaataacccagaattgttagttactaaaggtgaaaataaagagcagttcatgcaat

SEQ ID NO: 34833 - DNA, 75 bp, Artificial Sequence
  Synthetic
cccagaattgttagttactaaaggtgaaaataaagagcagttcatgcaatctgtccttttcagatataattcaaa

SEQ ID NO: 34834 - DNA, 75 bp, Artificial Sequence
  Synthetic
cagatatcattgaggagttaccagagatcattggaagagttacatttcctcaggcataccaaatgataaatagag

SEQ ID NO: 34835 - DNA, 75 bp, Artificial Sequence
  Synthetic
aaatgcctgaatttaggaatatgaagcttattcaccattcccctgctctggttcttaaggcatttagcaaaggga

SEQ ID NO: 34836 - DNA, 75 bp, Artificial Sequence
  Synthetic
gttcttaaggcatttagcaaagggacatcagatattcctggggctgatcctatagaattggaaaaagatcttcat

SEQ ID NO: 34837 - DNA, 75 bp, Artificial Sequence
  Synthetic
atagaatcagagagatgaccaaactctatcaagtttgttatgattatgttaaatctacagagcataaggttaaaa

SEQ ID NO: 34838 - DNA, 75 bp, Artificial Sequence
  Synthetic
tactgcaatcgacttttgcacattgattcagggcaacactatctctgataataaatggtacacaatgcattattt

SEQ ID NO: 34839 - DNA, 75 bp, Artificial Sequence
  Synthetic
aaaacagattgccagcgggtctatcaaagggaatatagtaacaactagtacaagtgagcaaataatagcaaatga

SEQ ID NO: 34840 - DNA, 75 bp, Artificial Sequence
  Synthetic
atggattaaaatttgaatacatggaggaaattattctagatgaaaaatataattattatataacataccaaaaaa

SEQ ID NO: 34841 - DNA, 75 bp, Artificial Sequence
  Synthetic
cttataaaaatgccataatgaagttagttgcagcaggggtagatgagatcaaagaagtttttgatttttcaaaac

SEQ ID NO: 34842 - DNA, 75 bp, Artificial Sequence
  Synthetic
agttgcagcaggggtagatgagatcaaagaagtttttgatttttcaaaacaagggttctattcaaagaaaaacct

SEQ ID NO: 34843 - DNA, 75 bp, Artificial Sequence
  Synthetic
aggtataataaatacaatttgctctataataaatatactagagacaaatgaatggtctacaattctatacaattc

SEQ ID NO: 34844 - DNA, 75 bp, Artificial Sequence
  Synthetic
aaatgtggcaggtggtattgttaattggactaagctgctaaaatttataaagtcattgccagtgatagagcaaga

SEQ ID NO: 34845 - DNA, 75 bp, Artificial Sequence
  Synthetic
tagaaagagaaatgaacaaagatgttgatttcactgatttcttagatgaattagaatttagttcaggaaagtctc

SEQ ID NO: 34846 - DNA, 75 bp, Artificial Sequence
  Synthetic
tgatttcactgatttcttagatgaattagaatttagttcaggaaagtctctatttacctttttctgaagcatatc

SEQ ID NO: 34847 - DNA, 75 bp, Artificial Sequence
  Synthetic
tccaaaagccactatgtggcaaaaatgatgacagcattcaaaaaagtacaattttcttatgtaggagcacactac

SEQ ID NO: 34848 - DNA, 75 bp, Artificial Sequence
  Synthetic
atcaaatctaacagaaggtcattaaaggctctttaatgattgagttagaatttcatgatgtcgctgctaacacca

SEQ ID NO: 34849 - DNA, 75 bp, Artificial Sequence
  Synthetic
cgagattaaaactagtctcgcaaaaagaagtgaatgggaagttacacttaaccttgggggctggaagattactgt

SEQ ID NO: 34850 - DNA, 75 bp, Artificial Sequence
  Synthetic
atataatacgaattttcctggcaaccggaacaacccagttcctgacgatggtcttaccctccaccgcctcagtgg

SEQ ID NO: 34851 - DNA, 75 bp, Artificial Sequence
  Synthetic
aaaaattgatcatcaaatcaaaaataatcaatccattggctgaaaaaaacgggatcacttggaatgatggggagg

SEQ ID NO: 34852 - DNA, 75 bp, Artificial Sequence
  Synthetic
acagttgtctccagcttgggttggaagaaaactaatgttagtgcagctgccagggacttccttgctaaatttgga

SEQ ID NO: 34853 - DNA, 75 bp, Artificial Sequence
  Synthetic
agaaaactaatgttagtgcagctgccagggacttccttgctaaatttggaatcaacatgtaagcagggaagcatt

SEQ ID NO: 34854 - DNA, 75 bp, Artificial Sequence
  Synthetic
ttaatttggctaaaagggttgtttcaacccacaaaataacagctgtttgggtgggtggttggggacagaaagaca

SEQ ID NO: 34855 - DNA, 75 bp, Artificial Sequence
  Synthetic
agtagtgtactcctatataaagaaattacaataaaacccatcaaaaaaatggatgatcagatgtatgatcaattc

SEQ ID NO: 34856 - DNA, 75 bp, Artificial Sequence
  Synthetic
ttacaataaaacccatcaaaaaaatggatgatcagatgtatgatcaattcttgaggagaatccaagcttcaagga

SEQ ID NO: 34857 - DNA, 75 bp, Artificial Sequence
  Synthetic
cactgatatccttgaagcaagacatgattactttggtcgtgagctatgctcagccatagggattgaatacaagaa

SEQ ID NO: 34858 - DNA, 75 bp, Artificial Sequence
  Synthetic
gattactttggtcgtgagctatgctcagccatagggattgaatacaagaataatgttcttttagatgagattgtc

SEQ ID NO: 34859 - DNA, 75 bp, Artificial Sequence
  Synthetic
ttatggattataatatcccaaatgtgaccccggacaactacatctgggatggcgatttcttgattataatggact

SEQ ID NO: 34860 - DNA, 75 bp, Artificial Sequence
  Synthetic
gaccccggacaactacatctgggatggcgatttcttgattataatggactacaaggtctcagtcggaactgatag

SEQ ID NO: 34861 - DNA, 75 bp, Artificial Sequence
  Synthetic
accaccttgatcctaccaattatggagagtttaggcatccccacagaagtagctataatacgtgctaacccactg

SEQ ID NO: 34862 - DNA, 75 bp, Artificial Sequence
  Synthetic
agctataatacgtgctaacccactgacataccaattgacaattataggggagaatttccgtgaaagatatccaaa

SEQ ID NO: 34863 - DNA, 75 bp, Artificial Sequence
  Synthetic
aaattctttgaattgcgtaagatgctgctagacaaatttgcagatgacgaggaatttttgttaatgattgcacat

SEQ ID NO: 34864 - DNA, 75 bp, Artificial Sequence
  Synthetic
tgctagacaaatttgcagatgacgaggaatttttgttaatgattgcacatggtgatttcactttgacagcaccct

SEQ ID NO: 34865 - DNA, 75 bp, Artificial Sequence
  Synthetic
atcagatcatcctatatatcaagagttcctagggtccatgcctaggagatttgttaatttattcaatgaggctat

SEQ ID NO: 34866 - DNA, 75 bp, Artificial Sequence
  Synthetic
aggtggaatacattgctgtacaaagcaaaatctgtaacagatgaagattatcaagattacttatcaagaaaggca

SEQ ID NO: 34867 - DNA, 75 bp, Artificial Sequence
  Synthetic
atatcataaccgatacaacaaaacagaaaccttctgtgcattttatttggactagaaacaacaataggaaactaa

SEQ ID NO: 34868 - DNA, 75 bp, Artificial Sequence
  Synthetic
cttgtcaaactcactcaaatctataaatgaacaatccacttggtcagaatcattgattgcaattggcatgagcat

SEQ ID NO: 34869 - DNA, 75 bp, Artificial Sequence
  Synthetic
aatgaacaatccacttggtcagaatcattgattgcaattggcatgagcatggatatagaaaataacataggtcaa

SEQ ID NO: 34870 - DNA, 75 bp, Artificial Sequence
  Synthetic
agatgattgctagatcaacagggaaaaagatagataataagagacttgatgcagtcaaaatcggtaatgctcttg

SEQ ID NO: 34871 - DNA, 75 bp, Artificial Sequence
  Synthetic
aaagatagataataagagacttgatgcagtcaaaatcggtaatgctcttgtcttatgggagcaacaatttatttt

SEQ ID NO: 34872 - DNA, 75 bp, Artificial Sequence
  Synthetic
gaaaggcaaagatttctaaaaaacttttttggaattggtaaacacaagtcatttaaggacaagactgccacagat

SEQ ID NO: 34873 - DNA, 75 bp, Artificial Sequence
  Synthetic
tttttggaattggtaaacacaagtcatttaaggacaagactgccacagatattgacattgaaaagccgaaaatac

SEQ ID NO: 34874 - DNA, 75 bp, Artificial Sequence
  Synthetic
aatggcagccaaggctatggtaaataagaataaagtgttcctctcccagcaaaacactttaaatgacttccatcc

SEQ ID NO: 34875 - DNA, 75 bp, Artificial Sequence
  Synthetic
atagaagaggcatctgaagagacagcagagattctaaagaaaatctcaaaaacttgtttttggcaatgcattact

SEQ ID NO: 34876 - DNA, 75 bp, Artificial Sequence
  Synthetic
aacttgtttttggcaatgcattactgatatatctacattaatgcgcaatatattgtcagtttctcaatataatag

SEQ ID NO: 34877 - DNA, 75 bp, Artificial Sequence
  Synthetic
acacaatacttttagagtagcaatgtgtgcaaatgattcagtttatgggttgggtttcccgtcttcagatataaa

SEQ ID NO: 34878 - DNA, 75 bp, Artificial Sequence
  Synthetic
tgtgcaaatgattcagtttatgggttgggtttcccgtcttcagatataaagactaaaagagccacagtggtcttc

SEQ ID NO: 34879 - DNA, 75 bp, Artificial Sequence
  Synthetic
aaaaagatattatggatgcaggggccctgttcacaacacttgaattgaaaacaaaaaattacatatccatcagta

SEQ ID NO: 34880 - DNA, 75 bp, Artificial Sequence
  Synthetic
atgtcaaagaattgtatcgtcacccggtttatttctattaagttcattactattatataataataaccctttaat

SEQ ID NO: 34881 - DNA, 75 bp, Artificial Sequence
  Synthetic
ggtttatttctattaagttcattactattatataataataaccctttaatatctcttaatgatgtactgaatttc

SEQ ID NO: 34882 - DNA, 75 bp, Artificial Sequence
  Synthetic
ctaagagtatgctatcattgactgagccctctcgatatatgataatgaactctttagctatatctagtcatgtca

SEQ ID NO: 34883 - DNA, 75 bp, Artificial Sequence
  Synthetic
gccctctcgatatatgataatgaactctttagctatatctagtcatgtcaaagattatatagcagagaaattttc

SEQ ID NO: 34884 - DNA, 75 bp, Artificial Sequence
  Synthetic
gtgtacatggttaatttaataaaaatgggatgcagttctgcaaatgagcaatctagcaaaatacaattgagaaac

SEQ ID NO: 34885 - DNA, 75 bp, Artificial Sequence
  Synthetic
tgggatgcagttctgcaaatgagcaatctagcaaaatacaattgagaaacatttatttatccgattatgacataa

SEQ ID NO: 34886 - DNA, 75 bp, Artificial Sequence
  Synthetic
gaacttagagtccatatggttcccaggtaaagttaatcttaaagagtacataaaccagatttatctaccttttta

SEQ ID NO: 34887 - DNA, 75 bp, Artificial Sequence
  Synthetic
ggtaaagttaatcttaaagagtacataaaccagatttatctacctttttatttcaatgctaaggggctacatgaa

SEQ ID NO: 34888 - DNA, 75 bp, Artificial Sequence
  Synthetic
caaagacagttttagaaattgaaataaaccagcgctctgaaaatttagggatatggtcaaaagcagagaagaagc

SEQ ID NO: 34889 - DNA, 75 bp, Artificial Sequence
  Synthetic
aaaccagcgctctgaaaatttagggatatggtcaaaagcagagaagaagcaacatgtgaatttaccgattttgat

SEQ ID NO: 34890 - DNA, 75 bp, Artificial Sequence
  Synthetic
ttagatacatcaagacataatcatcttagaaatagagtggaaagtagaaataatttcagaaggagcataactact

SEQ ID NO: 34891 - DNA, 75 bp, Artificial Sequence
  Synthetic
ttagaaatagagtggaaagtagaaataatttcagaaggagcataactactattagtacctttactagttcaaaat

SEQ ID NO: 34892 - DNA, 75 bp, Artificial Sequence
  Synthetic
ggatttgaaatctaaaaattttcaaaaacaaaagaagacaaataacaaagccctagaaaaatataggctatcaaa

SEQ ID NO: 34893 - DNA, 75 bp, Artificial Sequence
  Synthetic
aaacaaaagaagacaaataacaaagccctagaaaaatataggctatcaaatcctctatttctagaagacgaagaa

SEQ ID NO: 34894 - DNA, 75 bp, Artificial Sequence
  Synthetic
attatgaatcattaatcaaaaagataccgaattataaagattatatatctgttaaggtattcgacagactttatg

SEQ ID NO: 34895 - DNA, 75 bp, Artificial Sequence
  Synthetic
aattattaaaaaatgggacattaaataatgactcttttattgagcaagcaatgtcgatgatgaagaatcacaaag

SEQ ID NO: 34896 - DNA, 75 bp, Artificial Sequence
  Synthetic
agggcagaaaacagcaaaagatagggaaatttttgtgggagaatttgaagccaagatgtgcatgtatgttgtaga

SEQ ID NO: 34897 - DNA, 75 bp, Artificial Sequence
  Synthetic
gaaatttttgtgggagaatttgaagccaagatgtgcatgtatgttgtagaaagaatatcaaaagagaggtgcaaa

SEQ ID NO: 34898 - DNA, 75 bp, Artificial Sequence
  Synthetic
cacaaaagcattaaaacttgaaataaatgcggacatgtcaaaatggagtgcccaagatgttttttacaaatactt

SEQ ID NO: 34899 - DNA, 75 bp, Artificial Sequence
  Synthetic
ttttattttttatgtcaaactacatgcagaagcatttaataataccagatgatcttattgcgaatatcttagacc

SEQ ID NO: 34900 - DNA, 75 bp, Artificial Sequence
  Synthetic
gcagaagcatttaataataccagatgatcttattgcgaatatcttagaccaaaaaaccccctataaaaatgactt

SEQ ID NO: 34901 - DNA, 75 bp, Artificial Sequence
  Synthetic
gatcttattgcgaatatcttagaccaaaaaaccccctataaaaatgacttgatacttgaggccacaaatggattg

SEQ ID NO: 34902 - DNA, 75 bp, Artificial Sequence
  Synthetic
tgtgcaatgttggtctacaaggatataattaaagaatctttaaaactacttgaaggggattgtttagtcaactcc

SEQ ID NO: 34903 - DNA, 75 bp, Artificial Sequence
  Synthetic
cttcattagcaatcttacaaaataaggtctcagatgatatggttatacaattttcaacaataacttttgaacaag

SEQ ID NO: 34904 - DNA, 75 bp, Artificial Sequence
  Synthetic
ttttcaacaataacttttgaacaagtctgcttatcatttggttgtcaagcaaatatgaaaaaaacatatgtgaca

SEQ ID NO: 34905 - DNA, 75 bp, Artificial Sequence
  Synthetic
catacctgtaaaggatttgtttcactcttcaatcttcatggggagcctctatctgtttatggtcgatttctgcta

SEQ ID NO: 34906 - DNA, 75 bp, Artificial Sequence
  Synthetic
ttggcccttatgaagatttagcaagcagattatcagcagcacaacaaagtataaaacatggttgcccaccgagtt

SEQ ID NO: 34907 - DNA, 75 bp, Artificial Sequence
  Synthetic
tcactggataacatacttgacatacaatatgctagatgatcaaataaactctcctcttaactatctccccttcaa

SEQ ID NO: 34908 - DNA, 75 bp, Artificial Sequence
  Synthetic
aatatgctagatgatcaaataaactctcctcttaactatctccccttcaagagtcgtcatgatataccggtagaa

SEQ ID NO: 34909 - DNA, 75 bp, Artificial Sequence
  Synthetic
agaagcaggaaacctttggtttttgatgaatatcttaaaaaaacttgtcccactggacaagcaaagagaaacaat

SEQ ID NO: 34910 - DNA, 75 bp, Artificial Sequence
  Synthetic
cactggacaagcaaagagaaacaatccagacccaatttcaaacaataggatcattaaaaggcttaaacgattcag

SEQ ID NO: 34911 - DNA, 75 bp, Artificial Sequence
  Synthetic
atacttaaccttggatacagaaataactggtgacaacaatatgggagaaactagtgatatgagaagcaggtcatt

SEQ ID NO: 34912 - DNA, 75 bp, Artificial Sequence
  Synthetic
acttacaccaagaaagttcactactgttggttcattaaacaagttagtatcatataatgattttaaagaatctat

SEQ ID NO: 34913 - DNA, 75 bp, Artificial Sequence
  Synthetic
cttacatacatgttgggtaacccagagttgttagtcacaaaaggtgaagacaaagaacaatttatgcaatctata

SEQ ID NO: 34914 - DNA, 75 bp, Artificial Sequence
  Synthetic
tcctgctcaattgttcatagagcaaatactattctcccataagccaattatagattacagtagtatctttgataa

SEQ ID NO: 34915 - DNA, 75 bp, Artificial Sequence
  Synthetic
ttgattgcagagctgccagaaattataagaagagtaacatttccacaagcctatcagatgatcaatagggatatt

SEQ ID NO: 34916 - DNA, 75 bp, Artificial Sequence
  Synthetic
taagaagagtaacatttccacaagcctatcagatgatcaatagggatattagccaattgccattggacataaatg

SEQ ID NO: 34917 - DNA, 75 bp, Artificial Sequence
  Synthetic
tattttgaatgatccattgatgataactgctgcaaacacagctctgctatgtgttaggggaaccccacaggacag

SEQ ID NO: 34918 - DNA, 75 bp, Artificial Sequence
  Synthetic
actgctgcaaacacagctctgctatgtgttaggggaaccccacaggacagaacagggttgagtgctaaccaaatg

SEQ ID NO: 34919 - DNA, 75 bp, Artificial Sequence
  Synthetic
tccaccattccccagcattagttctcaaggcattcagcaagtctaccactgatatagcaggtgctgatccaatag

SEQ ID NO: 34920 - DNA, 75 bp, Artificial Sequence
  Synthetic
caaggcattcagcaagtctaccactgatatagcaggtgctgatccaatagagttggcaaaggacctacaccacct

SEQ ID NO: 34921 - DNA, 75 bp, Artificial Sequence
  Synthetic
atacaagacaaaataaatcaaaatatagacaatccaccaaagcatcttgctgatgcagaaatcctcatgtacaaa

SEQ ID NO: 34922 - DNA, 75 bp, Artificial Sequence
  Synthetic
tagacaatccaccaaagcatcttgctgatgcagaaatcctcatgtacaaaataagagagataacaaagctatatc

SEQ ID NO: 34923 - DNA, 75 bp, Artificial Sequence
  Synthetic
aactgaacacaaggttaaagttttcatactgccaatgaaatcatatacatctgtcgacttctgtaccttgataca

SEQ ID NO: 34924 - DNA, 75 bp, Artificial Sequence
  Synthetic
atactgccaatgaaatcatatacatctgtcgacttctgtaccttgatacaaggtaacactattagagatgataaa

SEQ ID NO: 34925 - DNA, 75 bp, Artificial Sequence
  Synthetic
agattgtcagtggttcagtgaaaggtacaatagttacaactagtactactgaacaattgattgcatcagagtgtt

SEQ ID NO: 34926 - DNA, 75 bp, Artificial Sequence
  Synthetic
tacaatagttacaactagtactactgaacaattgattgcatcagagtgttttagagtattgtgtcattttgcaga

SEQ ID NO: 34927 - DNA, 75 bp, Artificial Sequence
  Synthetic
ttgagtttcatcacagaagtcatagacaactttacttacaagaatataagcgtcaattccctatataacataata

SEQ ID NO: 34928 - DNA, 75 bp, Artificial Sequence
  Synthetic
acaactttacttacaagaatataagcgtcaattccctatataacataatattaggaagtaatatgagacttgact

SEQ ID NO: 34929 - DNA, 75 bp, Artificial Sequence
  Synthetic
atctttgacacaatcagatttgaacaagtttgatgcattaaaaacaaacgaaagagtttcatggaacaattggca

SEQ ID NO: 34930 - DNA, 75 bp, Artificial Sequence
  Synthetic
aagtttgatgcattaaaaacaaacgaaagagtttcatggaacaattggcaaacaaatcggtctctgaattcaggc

SEQ ID NO: 34931 - DNA, 75 bp, Artificial Sequence
  Synthetic
atttaaggtcaatacggatagtgggggaagataaaacattgaaaattgcagaacttatagtgcctaatttttatc

SEQ ID NO: 34932 - DNA, 75 bp, Artificial Sequence
  Synthetic
ggaagataaaacattgaaaattgcagaacttatagtgcctaatttttatccaaacacagtatttcatgctggaaa

SEQ ID NO: 34933 - DNA, 75 bp, Artificial Sequence
  Synthetic
ctgaagtttgaatatatgcaggaagtattgttggatgaaaaatacaactattacataacattccaaaaaaagaga

SEQ ID NO: 34934 - DNA, 75 bp, Artificial Sequence
  Synthetic
tattgttggatgaaaaatacaactattacataacattccaaaaaaagagagcacacatctacacctatcaggttt

SEQ ID NO: 34935 - DNA, 75 bp, Artificial Sequence
  Synthetic
aaatgaagaaggactatcagctagaggtataaggtttaataagctgattccagtctgtcctgttgtattatcagt

SEQ ID NO: 34936 - DNA, 75 bp, Artificial Sequence
  Synthetic
cagtctgtcctgttgtattatcagtcagagatgagcttttcaggatgaatatggacaatgtctttagtttaaata

SEQ ID NO: 34937 - DNA, 75 bp, Artificial Sequence
  Synthetic
gcatgtgtcacctgatgaaatggcgaccataaagaaagcacacatgtctaaaatgatgttttttaatggtcctga

SEQ ID NO: 34938 - DNA, 75 bp, Artificial Sequence
  Synthetic
accataaagaaagcacacatgtctaaaatgatgttttttaatggtcctgatataaaggcaggcattgtaaatctg

SEQ ID NO: 34939 - DNA, 75 bp, Artificial Sequence
  Synthetic
aaatgatgttttttaatggtcctgatataaaggcaggcattgtaaatctgacagcattgatgagaacccaagaat

SEQ ID NO: 34940 - DNA, 75 bp, Artificial Sequence
  Synthetic
ttgtaaatcaagtattataccattttgcaggatactagactgctctggtgaggaacaaggggaactcatctttct

SEQ ID NO: 34941 - DNA, 75 bp, Artificial Sequence
  Synthetic
tgcaggatactagactgctctggtgaggaacaaggggaactcatctttctctcagatgaaattatggattttact

SEQ ID NO: 34942 - DNA, 75 bp, Artificial Sequence
  Synthetic
aggaacaaggggaactcatctttctctcagatgaaattatggattttactatttcagaggaaatagaatctacgc

SEQ ID NO: 34943 - DNA, 75 bp, Artificial Sequence
  Synthetic
gaaaggttcagagaagatgacatataaaaatgcaatatcaaagttagtaaccagaggtgtagaggaaataaaaga

SEQ ID NO: 34944 - DNA, 75 bp, Artificial Sequence
  Synthetic
atatagccatgttattagaagggatggatagagagtttcacttgttcactctaccagctgcattctacataaaca

SEQ ID NO: 34945 - DNA, 75 bp, Artificial Sequence
  Synthetic
cagctgcagggataattaactggaccaagatgctgaagtttataaaatcactaccggagataagtagtgaaccat

SEQ ID NO: 34946 - DNA, 75 bp, Artificial Sequence
  Synthetic
tgagaagactatattccttattgaaaaagaaatgaacaaagaagcaaactttgaagatttcttagatgagttaga

SEQ ID NO: 34947 - DNA, 75 bp, Artificial Sequence
  Synthetic
aaagaaatgaacaaagaagcaaactttgaagatttcttagatgagttagaattttcatcaggtaaatctatgttc

SEQ ID NO: 34948 - DNA, 75 bp, Artificial Sequence
  Synthetic
agtagtgtactccacactataaactttcaattgctgattttcaaaactttgtgcaaagggtatatccgatgattg

SEQ ID NO: 34949 - DNA, 75 bp, Artificial Sequence
  Synthetic
ctgggaacaggaacagtccagttccagacgatggtcttaccctccacagactcagtggattccttgccaggtact

SEQ ID NO: 34950 - DNA, 75 bp, Artificial Sequence
  Synthetic
agacgatggtcttaccctccacagactcagtggattccttgccaggtacttacttgagaagattctgaaagtgag

SEQ ID NO: 34951 - DNA, 75 bp, Artificial Sequence
  Synthetic
tgacccggaaaagttgattataaaatcaaaaattgttaatccacttgcagagaaaaacggcataacctgggcaga

SEQ ID NO: 34952 - DNA, 75 bp, Artificial Sequence
  Synthetic
tttccagggtctgaaatgttcttaggaactttcagattctatcccttagcaattggcatttacaaagtgcagagg

SEQ ID NO: 34953 - DNA, 75 bp, Artificial Sequence
  Synthetic
aattggcatttacaaagtgcagaggaaagagatggaaccaaagtatctggagaaaaccatgcgccaaagatatat

SEQ ID NO: 34954 - DNA, 75 bp, Artificial Sequence
  Synthetic
aaagagatggaaccaaagtatctggagaaaaccatgcgccaaagatatatgggtttagaagcatcaacttggaca

SEQ ID NO: 34955 - DNA, 75 bp, Artificial Sequence
  Synthetic
ctgcactgactgtagtatcaggacttgggtggaagaagacaaatgtgagcagtgctgctagagaattcctagcaa

SEQ ID NO: 34956 - DNA, 75 bp, Artificial Sequence
  Synthetic
agttcggcattagcatgtaaatgtattgccagaattgtaatctggataaattgtattttttaaatttggctaaaa

SEQ ID NO: 34957 - DNA, 75 bp, Artificial Sequence
  Synthetic
gcagcttgttgggtgggtggttggggacagaaagagcacagcaaattgtttttgaagcattgcagtttcttttaa

SEQ ID NO: 34958 - DNA, 75 bp, Artificial Sequence
  Synthetic
ggggacagaaagagcacagcaaattgtttttgaagcattgcagtttcttttaagttttaggtggagcacactact

SEQ ID NO: 34959 - DNA, 75 bp, Artificial Sequence
  Synthetic
agtagtgtactcctacataaagaaaattccaaaaatacaatcaataaaaacatggaggaccaggtctatgatcaa

SEQ ID NO: 34960 - DNA, 75 bp, Artificial Sequence
  Synthetic
attccaaaaatacaatcaataaaaacatggaggaccaggtctatgatcaatatttacatagaatccaagcagcta

SEQ ID NO: 34961 - DNA, 75 bp, Artificial Sequence
  Synthetic
catggaggaccaggtctatgatcaatatttacatagaatccaagcagctagaacagctgtggttgcaaaagacat

SEQ ID NO: 34962 - DNA, 75 bp, Artificial Sequence
  Synthetic
catgattactttgggcgtgagctttgtaactctttgggaattgaatacaagaataatgttcttttggatgagatc

SEQ ID NO: 34963 - DNA, 75 bp, Artificial Sequence
  Synthetic
gtaactctttgggaattgaatacaagaataatgttcttttggatgagatcatccttgatgttatgcctggcatca

SEQ ID NO: 34964 - DNA, 75 bp, Artificial Sequence
  Synthetic
tgtcacacctgataactacatatgggatggccatcttttaatcatcctggattataaagtatcagttggcaatga

SEQ ID NO: 34965 - DNA, 75 bp, Artificial Sequence
  Synthetic
gatggccatcttttaatcatcctggattataaagtatcagttggcaatgacagcagcgagataactcataaaaag

SEQ ID NO: 34966 - DNA, 75 bp, Artificial Sequence
  Synthetic
tgtctgacattgggatagatactgagatagctataattagagccaaccctgtcacttatcaaatctctataatgg

SEQ ID NO: 34967 - DNA, 75 bp, Artificial Sequence
  Synthetic
gatagctataattagagccaaccctgtcacttatcaaatctctataatgggggaagaattcaagcaaaggtattc

SEQ ID NO: 34968 - DNA, 75 bp, Artificial Sequence
  Synthetic
agtagattttttgagttgagaaaaatgttactggacaaatttgcagatgatgaagaatttctagcaatgatagca

SEQ ID NO: 34969 - DNA, 75 bp, Artificial Sequence
  Synthetic
tgttactggacaaatttgcagatgatgaagaatttctagcaatgatagcacatggcgattttacactgactgcac

SEQ ID NO: 34970 - DNA, 75 bp, Artificial Sequence
  Synthetic
gttaaaaaaccatgagatatttcaagaattcatcagttctatgccaccaagatttgttgcattatttcaagaagc

SEQ ID NO: 34971 - DNA, 75 bp, Artificial Sequence
  Synthetic
gaattcatcagttctatgccaccaagatttgttgcattatttcaagaagcaatagaatttagtgcttattctgca

SEQ ID NO: 34972 - DNA, 75 bp, Artificial Sequence
  Synthetic
aagcaaaaatggaaacaagctctgattataatcaatttctgtcagataaagcacacaaagtgtttgtgttagatg

SEQ ID NO: 34973 - DNA, 75 bp, Artificial Sequence
  Synthetic
ttataatcaatttctgtcagataaagcacacaaagtgtttgtgttagatggagattacatgaaaccaacacaggc

SEQ ID NO: 34974 - DNA, 75 bp, Artificial Sequence
  Synthetic
atgagccagagaatatacactgaaagagatataataacagatataacaaaacagaaaccatcaatccattttatt

SEQ ID NO: 34975 - DNA, 75 bp, Artificial Sequence
  Synthetic
gagatataataacagatataacaaaacagaaaccatcaatccattttatttggacaaggaatgcagatagaaggc

SEQ ID NO: 34976 - DNA, 75 bp, Artificial Sequence
  Synthetic
atatctatcaaatacattgcagagtatttcagaatcatcaacatggacagacactctaagagcaataggtaaaag

SEQ ID NO: 34977 - DNA, 75 bp, Artificial Sequence
  Synthetic
atttcagaatcatcaacatggacagacactctaagagcaataggtaaaagcatggacataaatggcaaagtaggg

SEQ ID NO: 34978 - DNA, 75 bp, Artificial Sequence
  Synthetic
gaaagattattgcaagatcaacaggaaaaaaaatagacaataaaaggcttgaggctgtcaaaattggtaatgcac

SEQ ID NO: 34979 - DNA, 75 bp, Artificial Sequence
  Synthetic
aaaaaaaatagacaataaaaggcttgaggctgtcaaaattggtaatgcactcgttctttgggaacaacaatttat

SEQ ID NO: 34980 - DNA, 75 bp, Artificial Sequence
  Synthetic
caagaaagacaaaaattcatgaaaaatttccttggtataggcaaacataagaactttagagatagaacatctagt

SEQ ID NO: 34981 - DNA, 75 bp, Artificial Sequence
  Synthetic
atttccttggtataggcaaacataagaactttagagatagaacatctagtgatattgaactagataagcctaaaa

SEQ ID NO: 34982 - DNA, 75 bp, Artificial Sequence
  Synthetic
gttaatggcagcaaggactatggtaaataagaataaaaaattattagcaaaagaaaatacattgcaagagcttca

SEQ ID NO: 34983 - DNA, 75 bp, Artificial Sequence
  Synthetic
aataagaataaaaaattattagcaaaagaaaatacattgcaagagcttcatcctataatcaagcaatatgcagct

SEQ ID NO: 34984 - DNA, 75 bp, Artificial Sequence
  Synthetic
catttaattctctaataaagatttcaaaaacttgcttttggcaatgtataatagacatatcaacaattatgagga

SEQ ID NO: 34985 - DNA, 75 bp, Artificial Sequence
  Synthetic
aaaaacttgcttttggcaatgtataatagacatatcaacaattatgaggaatatattagctgtatcacaatataa

SEQ ID NO: 34986 - DNA, 75 bp, Artificial Sequence
  Synthetic
atgtgtgcaaatgactcagtttatgctttagttttcccatcttctgatataaaaaccaaaagagcaacagttgtc

SEQ ID NO: 34987 - DNA, 75 bp, Artificial Sequence
  Synthetic
ctttagttttcccatcttctgatataaaaaccaaaagagcaacagttgtctttagtattgtctgtactcacaagg

SEQ ID NO: 34988 - DNA, 75 bp, Artificial Sequence
  Synthetic
ggcattatttactacattagaatgcaaaaataaagaatacatatctataagcaaagcaattagattagacaaaga

SEQ ID NO: 34989 - DNA, 75 bp, Artificial Sequence
  Synthetic
aaaaataaagaatacatatctataagcaaagcaattagattagacaaagaaagatgccagagaatagtatcttcc

SEQ ID NO: 34990 - DNA, 75 bp, Artificial Sequence
  Synthetic
tgctactatataataataatcctgagattaatttaatggatgttttaaattttacattttatactagtttgtcca

SEQ ID NO: 34991 - DNA, 75 bp, Artificial Sequence
  Synthetic
gattaatttaatggatgttttaaattttacattttatactagtttgtccatcacaaaaagcatgctctcattaac

SEQ ID NO: 34992 - DNA, 75 bp, Artificial Sequence
  Synthetic
aactcgcttgctatttcaagccatgttagggattacatagcagaaaaattctcaccttatacaaagacactcttt

SEQ ID NO: 34993 - DNA, 75 bp, Artificial Sequence
  Synthetic
ttagggattacatagcagaaaaattctcaccttatacaaagacactctttagtgtatacatggttaatttaataa

SEQ ID NO: 34994 - DNA, 75 bp, Artificial Sequence
  Synthetic
acagtcctcaaaaatccaattaagaaatatttatctatctgactatgacataactcaaaaaggtgtcaatgatga

SEQ ID NO: 34995 - DNA, 75 bp, Artificial Sequence
  Synthetic
aatatttatctatctgactatgacataactcaaaaaggtgtcaatgatgataggaacttggattctatatggttc

SEQ ID NO: 34996 - DNA, 75 bp, Artificial Sequence
  Synthetic
atattaaccagatttatttaccattctacttcaatgcaaaggggttacatgagaaacatcatgtaatgatagatt

SEQ ID NO: 34997 - DNA, 75 bp, Artificial Sequence
  Synthetic
ctacttcaatgcaaaggggttacatgagaaacatcatgtaatgatagatttggcaaaaacagtattagatataga

SEQ ID NO: 34998 - DNA, 75 bp, Artificial Sequence
  Synthetic
ggaatctggtctaaagcagaaaaaaaacaacatgtcaatctacctatattagtacattctatagcaaagtcttta

SEQ ID NO: 34999 - DNA, 75 bp, Artificial Sequence
  Synthetic
aacaacatgtcaatctacctatattagtacattctatagcaaagtctttaatattagatacatcaagacacaacc

SEQ ID NO: 35000 - DNA, 75 bp, Artificial Sequence
  Synthetic
aaataatttcagaagaagtattacaacaataagcacctttacaagttcaaaatcttgtataaaagttggtgattt

SEQ ID NO: 35001 - DNA, 75 bp, Artificial Sequence
  Synthetic
acaataagcacctttacaagttcaaaatcttgtataaaagttggtgatttcaaaaatatcaagagcaaagaagtt

SEQ ID NO: 35002 - DNA, 75 bp, Artificial Sequence
  Synthetic
aatttgataagaaatttagactttcaaatcctttgttcttagaaagtgaggaatttgaccttgaagttcaacatt

SEQ ID NO: 35003 - DNA, 75 bp, Artificial Sequence
  Synthetic
aaatcctttgttcttagaaagtgaggaatttgaccttgaagttcaacattgtaattataaagcactaattgaaaa

SEQ ID NO: 35004 - DNA, 75 bp, Artificial Sequence
  Synthetic
tctgtgaaagtgtttgatcgattatatgaattactgaaaactgaagaattaacagaaagacccttcatagaatta

SEQ ID NO: 35005 - DNA, 75 bp, Artificial Sequence
  Synthetic
atgaattactgaaaactgaagaattaacagaaagacccttcatagaattagctatggacatgatgttgaaacata

SEQ ID NO: 35006 - DNA, 75 bp, Artificial Sequence
  Synthetic
taagggacagaaaactgcaaaggatagggaaatatttgttggggagtttgaagctaaaatgtgcatgtatgttgt

SEQ ID NO: 35007 - DNA, 75 bp, Artificial Sequence
  Synthetic
agggaaatatttgttggggagtttgaagctaaaatgtgcatgtatgttgtagaaagaatatcaaaggaaaggtgt

SEQ ID NO: 35008 - DNA, 75 bp, Artificial Sequence
  Synthetic
gtgaacctggtgattctaaattaaagattttagagaagaaagcagaagaagagattcgatatattgttgaaagaa

SEQ ID NO: 35009 - DNA, 75 bp, Artificial Sequence
  Synthetic
gattttagagaagaaagcagaagaagagattcgatatattgttgaaagaacaaaagatagtataatcaaaggaga

SEQ ID NO: 35010 - DNA, 75 bp, Artificial Sequence
  Synthetic
atcaatgcagatatgtcaaaatggagtgcccaagatgttttttataaatacttttggttaatagcaatggaccct

SEQ ID NO: 35011 - DNA, 75 bp, Artificial Sequence
  Synthetic
gtgcccaagatgttttttataaatacttttggttaatagcaatggaccctatcttatacccaacagaaaaaaaga

SEQ ID NO: 35012 - DNA, 75 bp, Artificial Sequence
  Synthetic
tatgttgaagatattaatactacctgatgatcttattgcaaatatcctagatcagaagaggccttataacaatga

SEQ ID NO: 35013 - DNA, 75 bp, Artificial Sequence
  Synthetic
gatgatcttattgcaaatatcctagatcagaagaggccttataacaatgatttaatattggagatgaccaatggg

SEQ ID NO: 35014 - DNA, 75 bp, Artificial Sequence
  Synthetic
aaaggaattggctccaaggaaatttcaattacatttcaagttatgtacatagttgtgcaatgcttgtttataaag

SEQ ID NO: 35015 - DNA, 75 bp, Artificial Sequence
  Synthetic
caattacatttcaagttatgtacatagttgtgcaatgcttgtttataaagatatttttaaagaatgtatgaaatt

SEQ ID NO: 35016 - DNA, 75 bp, Artificial Sequence
  Synthetic
tcaatggtacattcagatgataatcaaacatctttagcaattatacaaaataaactatctgataacactatgata

SEQ ID NO: 35017 - DNA, 75 bp, Artificial Sequence
  Synthetic
aaacatctttagcaattatacaaaataaactatctgataacactatgatacagtatgcagcaaacatatttgagt

SEQ ID NO: 35018 - DNA, 75 bp, Artificial Sequence
  Synthetic
agcaaacatgaaaaaaacatatattactcatacatgtaaagaatttgtctcactgtttaatctacatggtgaacc

SEQ ID NO: 35019 - DNA, 75 bp, Artificial Sequence
  Synthetic
actcatacatgtaaagaatttgtctcactgtttaatctacatggtgaacccttatccatttacggtagattttta

SEQ ID NO: 35020 - DNA, 75 bp, Artificial Sequence
  Synthetic
acattggcccttatgaggatctagcaagtcgtttatcagcagctcaacaaagtctaaaacatgggtgtcccccca

SEQ ID NO: 35021 - DNA, 75 bp, Artificial Sequence
  Synthetic
aagtcgtttatcagcagctcaacaaagtctaaaacatgggtgtccccccagtttggcctggctagctattagttg

SEQ ID NO: 35022 - DNA, 75 bp, Artificial Sequence
  Synthetic
tataatatgttagatgaccaaataaatgcaccccaacaatacttaccattcaacaatagaaaagaaattcctgta

SEQ ID NO: 35023 - DNA, 75 bp, Artificial Sequence
  Synthetic
atgcaccccaacaatacttaccattcaacaatagaaaagaaattcctgtagaattgaatggttatctaaatgcac

SEQ ID NO: 35024 - DNA, 75 bp, Artificial Sequence
  Synthetic
cttagaagcaggaaatttatggtttttaatcaacattttaaagaaactcgtgccattggacaaacaaaaagaaac

SEQ ID NO: 35025 - DNA, 75 bp, Artificial Sequence
  Synthetic
ttaatcaacattttaaagaaactcgtgccattggacaaacaaaaagaaacagttcagagccaatgcctacattta

SEQ ID NO: 35026 - DNA, 75 bp, Artificial Sequence
  Synthetic
aatcagaaaaatttaagcttaaaatattgagatatttaactttagatactgaaatatctgttgataataatatgg

SEQ ID NO: 35027 - DNA, 75 bp, Artificial Sequence
  Synthetic
attgagatatttaactttagatactgaaatatctgttgataataatatgggggaaactagtgatatgagaagcag

SEQ ID NO: 35028 - DNA, 75 bp, Artificial Sequence
  Synthetic
acaactttagggtcgttgaataaattgatctcatataatgattttaaatcatccctagatgatcaaaggttcact

SEQ ID NO: 35029 - DNA, 75 bp, Artificial Sequence
  Synthetic
tgatctcatataatgattttaaatcatccctagatgatcaaaggttcactaacaatttgaattatatgttaaaca

SEQ ID NO: 35030 - DNA, 75 bp, Artificial Sequence
  Synthetic
agaaactaaagaccaatttatgcaatctgttttatttagatataattcaaaaaggtttaaagagagcctatctat

SEQ ID NO: 35031 - DNA, 75 bp, Artificial Sequence
  Synthetic
tctgttttatttagatataattcaaaaaggtttaaagagagcctatctatacaaaacccagcacaattgttcatt

SEQ ID NO: 35032 - DNA, 75 bp, Artificial Sequence
  Synthetic
cagtgatagactatagcagcatatttgataaattaacatcacttgctgaagcagaaatcatagaagaattaccag

SEQ ID NO: 35033 - DNA, 75 bp, Artificial Sequence
  Synthetic
tgataaattaacatcacttgctgaagcagaaatcatagaagaattaccagaaattattggaagagttacatttcc

SEQ ID NO: 35034 - DNA, 75 bp, Artificial Sequence
  Synthetic
gatatttctcaacttccattagacttagatgatattaaattgatatttcgctattgtattctaaatgacccacta

SEQ ID NO: 35035 - DNA, 75 bp, Artificial Sequence
  Synthetic
tagatgatattaaattgatatttcgctattgtattctaaatgacccactaatgattatagcagcaaacacctcat

SEQ ID NO: 35036 - DNA, 75 bp, Artificial Sequence
  Synthetic
ggatagaactggtctcagtgcaaatcaaatgccagaatttagaaatatgaaacttatccatcattctcctgcctt

SEQ ID NO: 35037 - DNA, 75 bp, Artificial Sequence
  Synthetic
caaatgccagaatttagaaatatgaaacttatccatcattctcctgccttagtcctcaaagcttttagcaaagga

SEQ ID NO: 35038 - DNA, 75 bp, Artificial Sequence
  Synthetic
ctatagaattagaaaaagatttacatcatttaaatgaatttgttgaaacgacaactatcaaagacaaaattttgc

SEQ ID NO: 35039 - DNA, 75 bp, Artificial Sequence
  Synthetic
tcatttaaatgaatttgttgaaacgacaactatcaaagacaaaattttgcaaaatatagataatcccccgaagca

SEQ ID NO: 35040 - DNA, 75 bp, Artificial Sequence
  Synthetic
tataaaataagagaaatgaccaagctctatcaggtttgctatgattatgttaaatctacagaacataaggtcaaa

SEQ ID NO: 35041 - DNA, 75 bp, Artificial Sequence
  Synthetic
tctatcaggtttgctatgattatgttaaatctacagaacataaggtcaaagtatttatactaccaatgaaatcat

SEQ ID NO: 35042 - DNA, 75 bp, Artificial Sequence
  Synthetic
aattcaagggaacactatttcagatagtaaatggtacacaatgcattatttgaaacaaattgcaagtggatcaat

SEQ ID NO: 35043 - DNA, 75 bp, Artificial Sequence
  Synthetic
agtaaatggtacacaatgcattatttgaaacaaattgcaagtggatcaataaaaggtcacattatcactactagt

SEQ ID NO: 35044 - DNA, 75 bp, Artificial Sequence
  Synthetic
aatgttttagagtcttatgccactttgcagactcttttgtagaggaagcaagtaggctaagtttcattaatgaag

SEQ ID NO: 35045 - DNA, 75 bp, Artificial Sequence
  Synthetic
tgcagactcttttgtagaggaagcaagtaggctaagtttcattaatgaagtattggacaattttacatacaaaaa

SEQ ID NO: 35046 - DNA, 75 bp, Artificial Sequence
  Synthetic
actttattagctagcactacaagattggattttattcctttattattccggctcaaagttttaactcaaacggat

SEQ ID NO: 35047 - DNA, 75 bp, Artificial Sequence
  Synthetic
tggattttattcctttattattccggctcaaagttttaactcaaacggatttaaacagattcgatgcccttaaga

SEQ ID NO: 35048 - DNA, 75 bp, Artificial Sequence
  Synthetic
ctggcagacaaatcgttctctaaattcaggactgattgacttaactatatcaggttatctgagatcaatccgaat

SEQ ID NO: 35049 - DNA, 75 bp, Artificial Sequence
  Synthetic
tcaggactgattgacttaactatatcaggttatctgagatcaatccgaattgttggagaagacaataagattaaa

SEQ ID NO: 35050 - DNA, 75 bp, Artificial Sequence
  Synthetic
tttatcctaatacagttttccatgctggaaataaacttttaaattcgaaacatgggctaaaatttgaatatatgg

SEQ ID NO: 35051 - DNA, 75 bp, Artificial Sequence
  Synthetic
tggaaataaacttttaaattcgaaacatgggctaaaatttgaatatatggaggaatttatattagatgaaagata

SEQ ID NO: 35052 - DNA, 75 bp, Artificial Sequence
  Synthetic
aagagagctcatatatacacatatcagatatcaacaatagaacatattgtgagaagaaataaagagggtttgcaa

SEQ ID NO: 35053 - DNA, 75 bp, Artificial Sequence
  Synthetic
agatatcaacaatagaacatattgtgagaagaaataaagagggtttgcaatcaagaggcaatagatacaataaaa

SEQ ID NO: 35054 - DNA, 75 bp, Artificial Sequence
  Synthetic
aagtgtcagagatgagttatttagaatgtctttagacaatgtttttagcttgaacatgactaacttcaacatatc

SEQ ID NO: 35055 - DNA, 75 bp, Artificial Sequence
  Synthetic
atgtctttagacaatgtttttagcttgaacatgactaacttcaacatatctagactatatgtctcaccagacgaa

SEQ ID NO: 35056 - DNA, 75 bp, Artificial Sequence
  Synthetic
tgtccaaaatgatgtttttttctggacctacaataaaagctgggatcgtcaatttaacctctttgatgagaactc

SEQ ID NO: 35057 - DNA, 75 bp, Artificial Sequence
  Synthetic
acctacaataaaagctgggatcgtcaatttaacctctttgatgagaactcaggaacttttaacattgaattatga

SEQ ID NO: 35058 - DNA, 75 bp, Artificial Sequence
  Synthetic
cctttttgtaggatattagaatgtgatggtacagaacaaggggaattaatattcttatcagatgaaatcatggat

SEQ ID NO: 35059 - DNA, 75 bp, Artificial Sequence
  Synthetic
atggtacagaacaaggggaattaatattcttatcagatgaaatcatggattttacaatttctgaagaaattgagt

SEQ ID NO: 35060 - DNA, 75 bp, Artificial Sequence
  Synthetic
tcaaaaaaggggtactgaaattatgacatataaaaatgcaataacaaagttggtcacaaaaggggtagacgaaat

SEQ ID NO: 35061 - DNA, 75 bp, Artificial Sequence
  Synthetic
acatataaaaatgcaataacaaagttggtcacaaaaggggtagacgaaatcaaagaaatttttgatttttctaag

SEQ ID NO: 35062 - DNA, 75 bp, Artificial Sequence
  Synthetic
taggtattataaatactatttgttcaattattaatatcttggaaacaaatgagtggtcaacaatattatataatt

SEQ ID NO: 35063 - DNA, 75 bp, Artificial Sequence
  Synthetic
aattattaatatcttggaaacaaatgagtggtcaacaatattatataattctttccatatagctatgctgttgga

SEQ ID NO: 35064 - DNA, 75 bp, Artificial Sequence
  Synthetic
ttcacattaccagaagctttttttgtcaatatagcaggaggtgttatcaattgggccaaattattaaaatttata

SEQ ID NO: 35065 - DNA, 75 bp, Artificial Sequence
  Synthetic
tcaatatagcaggaggtgttatcaattgggccaaattattaaaatttataaaatcattacctacaatagagcaag

SEQ ID NO: 35066 - DNA, 75 bp, Artificial Sequence
  Synthetic
attcatagagaaaaccatatttttgatagagagagagatgaacaaggatgttgattttgcagattttcttgaaga

SEQ ID NO: 35067 - DNA, 75 bp, Artificial Sequence
  Synthetic
atagagagagagatgaacaaggatgttgattttgcagattttcttgaagaattagaattcagctctggcaagtcc

SEQ ID NO: 35068 - DNA, 75 bp, Artificial Sequence
  Synthetic
actacaaacttatttgattggacatgccaaaatctacaagttataataatcaataaaatataaaatatatatata

SEQ ID NO: 35069 - DNA, 75 bp, Artificial Sequence
  Synthetic
gccaaaatctacaagttataataatcaataaaatataaaatatatatataaaaaaacatacaattttcttatgta

SEQ ID NO: 35070 - DNA, 75 bp, Artificial Sequence
  Synthetic
agtagtgtactaccgatacaatacacaactagttgaaggattttgaaatatggagttacttataattatcttgct

SEQ ID NO: 35071 - DNA, 75 bp, Artificial Sequence
  Synthetic
caactagttgaaggattttgaaatatggagttacttataattatcttgctgttagggagcgcagccagtagccct

SEQ ID NO: 35072 - DNA, 75 bp, Artificial Sequence
  Synthetic
tggagttacttataattatcttgctgttagggagcgcagccagtagccctatatccactagatgttttcatggag

SEQ ID NO: 35073 - DNA, 75 bp, Artificial Sequence
  Synthetic
tgcaacctctatatcagagttctgcttaaaggatgatgtttcaatgatcaaatcagaagtcacttatataaaaaa

SEQ ID NO: 35074 - DNA, 75 bp, Artificial Sequence
  Synthetic
ttaaaggatgatgtttcaatgatcaaatcagaagtcacttatataaaaaatgatacaggtatatatggccacaat

SEQ ID NO: 35075 - DNA, 75 bp, Artificial Sequence
  Synthetic
aagattggaaattgtgcaaccctatcccaacagcaggaggcagtatcaatgtaattgaagtaaattcagacctga

SEQ ID NO: 35076 - DNA, 75 bp, Artificial Sequence
  Synthetic
cccaacagcaggaggcagtatcaatgtaattgaagtaaattcagacctgagcttagcaacaagggcctatgtttg

SEQ ID NO: 35077 - DNA, 75 bp, Artificial Sequence
  Synthetic
gataaagaagatgcccagataatattccaaactgataaattaaaccattttgaagtctctggaacaaccttgagt

SEQ ID NO: 35078 - DNA, 75 bp, Artificial Sequence
  Synthetic
tccaaactgataaattaaaccattttgaagtctctggaacaaccttgagttcaggttggtttaagactaaggcct

SEQ ID NO: 35079 - DNA, 75 bp, Artificial Sequence
  Synthetic
acatattaaagtcacttgtgggaagaaatctctacagtttcacgcctgttttaaacaccacatgtcatgcataag

SEQ ID NO: 35080 - DNA, 75 bp, Artificial Sequence
  Synthetic
aaatctctacagtttcacgcctgttttaaacaccacatgtcatgcataagattcttccatcacactatactacct

SEQ ID NO: 35081 - DNA, 75 bp, Artificial Sequence
  Synthetic
aaaatattgaattaataataataattggactcaccttagtcatatttatacttatggttatcttaaccaaaacat

SEQ ID NO: 35082 - DNA, 75 bp, Artificial Sequence
  Synthetic
tggactcaccttagtcatatttatacttatggttatcttaaccaaaacatacatatgctacctgttaatgccagt

SEQ ID NO: 35083 - DNA, 75 bp, Artificial Sequence
  Synthetic
ggctgggcatataataagagctgcaagaaatgtaattgctgtggcttagcttatcatccatttacaaactgtggc

SEQ ID NO: 35084 - DNA, 75 bp, Artificial Sequence
  Synthetic
agaaatgtaattgctgtggcttagcttatcatccatttacaaactgtggctcccattgtgtctgtgggctcaaat

SEQ ID NO: 35085 - DNA, 75 bp, Artificial Sequence
  Synthetic
acatagggagtcaggattgtgccaaggctacaaaagtctcaggatagcgaggatgctatgtaaatctaagggctc

SEQ ID NO: 35086 - DNA, 75 bp, Artificial Sequence
  Synthetic
ggatgctatgtaaatctaagggctcatcccttgttatctcaggattactttcgatgctattattgagctttataa

SEQ ID NO: 35087 - DNA, 75 bp, Artificial Sequence
  Synthetic
ctaccactccaggaaatccaaatatatctctacagtaagtttagaatcattagatgaatttagaagagctatgtc

SEQ ID NO: 35088 - DNA, 75 bp, Artificial Sequence
  Synthetic
atctctacagtaagtttagaatcattagatgaatttagaagagctatgtcagataagctatcacacaccttgatg

SEQ ID NO: 35089 - DNA, 75 bp, Artificial Sequence
  Synthetic
atctcccccatataaagccaacttataaatttataaccgctaatggtatagagaattcagatgggatagattcag

SEQ ID NO: 35090 - DNA, 75 bp, Artificial Sequence
  Synthetic
taaatttataaccgctaatggtatagagaattcagatgggatagattcagcatacatattatctagcataccagc

SEQ ID NO: 35091 - DNA, 75 bp, Artificial Sequence
  Synthetic
aacattcagacaaaagataatttcccattattagatattatagttttcatcaagagtgctattattaaaacaacc

SEQ ID NO: 35092 - DNA, 75 bp, Artificial Sequence
  Synthetic
cattattagatattatagttttcatcaagagtgctattattaaaacaacctacaatcatatatatgacacaggtc

SEQ ID NO: 35093 - DNA, 75 bp, Artificial Sequence
  Synthetic
tgatgaacactgcactggaccatgccctacattaatactccataaagagaactggttaacattctcccaagaaag

SEQ ID NO: 35094 - DNA, 75 bp, Artificial Sequence
  Synthetic
cctacattaatactccataaagagaactggttaacattctcccaagaaaggacaagcaggtggggttgtgaagaa

SEQ ID NO: 35095 - DNA, 75 bp, Artificial Sequence
  Synthetic
ggtgtgtttttggctcatgccaggacattattcatcccgaggctaaagtatacaggaaagctatcgaggaggaag

SEQ ID NO: 35096 - DNA, 75 bp, Artificial Sequence
  Synthetic
cattattcatcccgaggctaaagtatacaggaaagctatcgaggaggaagtagtcttaactgtctgtataacatt

SEQ ID NO: 35097 - DNA, 75 bp, Artificial Sequence
  Synthetic
ataaatgcaatagagccaaaaataacagatgaaatagaactacagtttaagacagtagatactaaaacattacca

SEQ ID NO: 35098 - DNA, 75 bp, Artificial Sequence
  Synthetic
cagatgaaatagaactacagtttaagacagtagatactaaaacattaccaaatttgctaatggttcagaatcata

SEQ ID NO: 35099 - DNA, 75 bp, Artificial Sequence
  Synthetic
tcttggttccttttcccagggatgtggcaatgtgcaaaagactaatcagtctgtaattggagctggaactgcaaa

SEQ ID NO: 35100 - DNA, 75 bp, Artificial Sequence
  Synthetic
ggcaatgtgcaaaagactaatcagtctgtaattggagctggaactgcaaaatttgattatgtctgtcatggagct

SEQ ID NO: 35101 - DNA, 75 bp, Artificial Sequence
  Synthetic
gctgttacaacaataattatgaatcctgcaagctattaaaagaggaaacctctcttatatttgcagataatcatg

SEQ ID NO: 35102 - DNA, 75 bp, Artificial Sequence
  Synthetic
ctgcaagctattaaaagaggaaacctctcttatatttgcagataatcatgaaacattagaagtagcgaatacaaa

SEQ ID NO: 35103 - DNA, 75 bp, Artificial Sequence
  Synthetic
aaaattatgttgggagacattagatacaagtcatttgctgaatcaccagaattagaagtagatgcaaaatgtgta

SEQ ID NO: 35104 - DNA, 75 bp, Artificial Sequence
  Synthetic
acaagtcatttgctgaatcaccagaattagaagtagatgcaaaatgtgtaggctgtccttcatgttttgaaagct

SEQ ID NO: 35105 - DNA, 75 bp, Artificial Sequence
  Synthetic
aaatattgatactgtttgttctgttgatgggccttgtacactcttccataacagactgataataagtgcaacaaa

SEQ ID NO: 35106 - DNA, 75 bp, Artificial Sequence
  Synthetic
gatgggccttgtacactcttccataacagactgataataagtgcaacaaagcaatcttatggttttaaaatgagt

SEQ ID NO: 35107 - DNA, 75 bp, Artificial Sequence
  Synthetic
aagaattccagatatgtaaccgtaagtacaatgtcctttttactacaattgataaaaatgataaaattgaaatca

SEQ ID NO: 35108 - DNA, 75 bp, Artificial Sequence
  Synthetic
gtacaatgtcctttttactacaattgataaaaatgataaaattgaaatcaacacaggagaccagacttcttatat

SEQ ID NO: 35109 - DNA, 75 bp, Artificial Sequence
  Synthetic
acatggctttgtagagttagggatgagggaatcagtgttatttttgagcctttaaaggcattttttggcagttac

SEQ ID NO: 35110 - DNA, 75 bp, Artificial Sequence
  Synthetic
agggaatcagtgttatttttgagcctttaaaggcattttttggcagttactttagcatcatattttatgttgttg

SEQ ID NO: 35111 - DNA, 75 bp, Artificial Sequence
  Synthetic
tatttatattttcttacccatgttcttcaagttaagagatatattaaaaagaaatgagtatctgtacctacagga

SEQ ID NO: 35112 - DNA, 75 bp, Artificial Sequence
  Synthetic
agtagtgtactaccgatatttacaagcctcacaaagtttaattatgaagatgctgactctgattattattgtttc

SEQ ID NO: 35113 - DNA, 75 bp, Artificial Sequence
  Synthetic
gcctcacaaagtttaattatgaagatgctgactctgattattattgtttcatgctgggttgcaactttgcaaaac

SEQ ID NO: 35114 - DNA, 75 bp, Artificial Sequence
  Synthetic
tgctgactctgattattattgtttcatgctgggttgcaactttgcaaaacccactcatctcaagatgtttccacg

SEQ ID NO: 35115 - DNA, 75 bp, Artificial Sequence
  Synthetic
atcattgacatcgatatctgaattctgcatcaaagatgatgtatctatgttaaaatcagaagtgatataccaaaa

SEQ ID NO: 35116 - DNA, 75 bp, Artificial Sequence
  Synthetic
tgcatcaaagatgatgtatctatgttaaaatcagaagtgatataccaaaaaaatgatactggaatctatggtcat

SEQ ID NO: 35117 - DNA, 75 bp, Artificial Sequence
  Synthetic
ttgcagattggaaatactgtaacccagtccctacagcaggaggcagcattaatgtaattgagttggataaaaact

SEQ ID NO: 35118 - DNA, 75 bp, Artificial Sequence
  Synthetic
agtccctacagcaggaggcagcattaatgtaattgagttggataaaaacttgaatctgatagcaaaaaactatgt

SEQ ID NO: 35119 - DNA, 75 bp, Artificial Sequence
  Synthetic
gtagacaaagaaaatgcacagattgtgttccagactgacaaacttaatcattttgaagtgactggtacaacaata

SEQ ID NO: 35120 - DNA, 75 bp, Artificial Sequence
  Synthetic
tgttccagactgacaaacttaatcattttgaagtgactggtacaacaataagtacggggtggttcaaaaccaaag

SEQ ID NO: 35121 - DNA, 75 bp, Artificial Sequence
  Synthetic
tgaacatatcaaagtcagttgcggaaagaaaacactgcaattccatgcttgcttcaaacaacacatgtcatgtgt

SEQ ID NO: 35122 - DNA, 75 bp, Artificial Sequence
  Synthetic
aagaaaacactgcaattccatgcttgcttcaaacaacacatgtcatgtgttagatttttacacagaagtatgcta

SEQ ID NO: 35123 - DNA, 75 bp, Artificial Sequence
  Synthetic
gccagaatatagagttaattataattataacattgacattagttatatttatacttatgttgatagcaactagat

SEQ ID NO: 35124 - DNA, 75 bp, Artificial Sequence
  Synthetic
tataacattgacattagttatatttatacttatgttgatagcaactagattttatatatgttatcttctaatacc

SEQ ID NO: 35125 - DNA, 75 bp, Artificial Sequence
  Synthetic
tatggctgggcttacaatcgtagttgtaagaaatgtagttgttgtggcttagcataccacccgtttacaaactgt

SEQ ID NO: 35126 - DNA, 75 bp, Artificial Sequence
  Synthetic
gtaagaaatgtagttgttgtggcttagcataccacccgtttacaaactgtggatcttattgtgtatgtggagcta

SEQ ID NO: 35127 - DNA, 75 bp, Artificial Sequence
  Synthetic
gctacatagggaatcagggctatgtcaaggctttaaaagtcttaggatggcacgaagattatgtaaatcaaaagg

SEQ ID NO: 35128 - DNA, 75 bp, Artificial Sequence
  Synthetic
caaggctttaaaagtcttaggatggcacgaagattatgtaaatcaaaagggtcttcccttgttatatctattttg

SEQ ID NO: 35129 - DNA, 75 bp, Artificial Sequence
  Synthetic
taacaccaatagaaggtacaatgacaaattaccctaccaatgagaaatactctctagatgaaattgcagatgttc

SEQ ID NO: 35130 - DNA, 75 bp, Artificial Sequence
  Synthetic
aaattaccctaccaatgagaaatactctctagatgaaattgcagatgttctaaaatggaaagaacaagaaagtga

SEQ ID NO: 35131 - DNA, 75 bp, Artificial Sequence
  Synthetic
gcttctataattggtgcgtgttttacagtattatttgcaggcactgctttagccctcaacatagtgttagagtta

SEQ ID NO: 35132 - DNA, 75 bp, Artificial Sequence
  Synthetic
cagtattatttgcaggcactgctttagccctcaacatagtgttagagttattgacaaaaataaatgttatatatt

SEQ ID NO: 35133 - DNA, 75 bp, Artificial Sequence
  Synthetic
caagtcaaatataaagtatattggtgattttacaaacaaatgtgggttttgcacatgtggattactagaagatcc

SEQ ID NO: 35134 - DNA, 75 bp, Artificial Sequence
  Synthetic
gattttacaaacaaatgtgggttttgcacatgtggattactagaagatccagatggtgttgtggtccataaggtg

SEQ ID NO: 35135 - DNA, 75 bp, Artificial Sequence
  Synthetic
aactcacttgggttaaaacaataatgatagtgttatctattttattcttgctacaaaatattatagttatagttg

SEQ ID NO: 35136 - DNA, 75 bp, Artificial Sequence
  Synthetic
gatagtgttatctattttattcttgctacaaaatattatagttatagttgctgcagatagtgattgttggactaa

SEQ ID NO: 35137 - DNA, 75 bp, Artificial Sequence
  Synthetic
gggcctctaattgcaccagcagattgtaccgaaaaagataagaagacatacctaacagaagcagctgcattggta

SEQ ID NO: 35138 - DNA, 75 bp, Artificial Sequence
  Synthetic
gtaccgaaaaagataagaagacatacctaacagaagcagctgcattggtaaaaactaaaaagatatcacaggtag

SEQ ID NO: 35139 - DNA, 75 bp, Artificial Sequence
  Synthetic
aaagacgatagagtcagcaataaaggctatagaaaagcaaaaaacctaccacaggatgcacctcttggaagcagt

SEQ ID NO: 35140 - DNA, 75 bp, Artificial Sequence
  Synthetic
gctatagaaaagcaaaaaacctaccacaggatgcacctcttggaagcagtttttttaaataaacattgcgattat

SEQ ID NO: 35141 - DNA, 75 bp, Artificial Sequence
  Synthetic
gttactcacaagtaaagtggagaatgttagcaaaaacccaacactttgatatatgtgcttttgcaaaagaaagca

SEQ ID NO: 35142 - DNA, 75 bp, Artificial Sequence
  Synthetic
gttagcaaaaacccaacactttgatatatgtgcttttgcaaaagaaagcaaattctgcaaatgtatggctggtgg

SEQ ID NO: 35143 - DNA, 75 bp, Artificial Sequence
  Synthetic
tttgatacaaccatgaattcaacatatacatcgaaaggagacaattttaaacatgacatgtctctatttttaaaa

SEQ ID NO: 35144 - DNA, 75 bp, Artificial Sequence
  Synthetic
atacatcgaaaggagacaattttaaacatgacatgtctctatttttaaaaatatttgaggcagcatttccaggta

SEQ ID NO: 35145 - DNA, 75 bp, Artificial Sequence
  Synthetic
aatcaaggaaaagaaaccttaccaatcagtaactatgatagacaaaatcaaaactaaatatcctaataataaaat

SEQ ID NO: 35146 - DNA, 75 bp, Artificial Sequence
  Synthetic
tcagtaactatgatagacaaaatcaaaactaaatatcctaataataaaatgctggtagcttacctagagtttgga

SEQ ID NO: 35147 - DNA, 75 bp, Artificial Sequence
  Synthetic
catcaacctttgaacttcaacagagtcaactagaaagattataccaaccagcagagctgagtagatcggttggtc

SEQ ID NO: 35148 - DNA, 75 bp, Artificial Sequence
  Synthetic
tcaactagaaagattataccaaccagcagagctgagtagatcggttggtcaacttacttcattatcaaatgcaca

SEQ ID NO: 35149 - DNA, 75 bp, Artificial Sequence
  Synthetic
tctaagtataaagatataagttgcttaagtccaaggtttggaatacctatggaaaatatggttgcctgtggggat

SEQ ID NO: 35150 - DNA, 75 bp, Artificial Sequence
  Synthetic
taagtccaaggtttggaatacctatggaaaatatggttgcctgtggggatagtccaaattataaaatatataaaa

SEQ ID NO: 35151 - DNA, 75 bp, Artificial Sequence
  Synthetic
tgatagagtagaaacatggtgtattaaagaccagcattgtttggtagactacacgccagcagaggcagatgtggt

SEQ ID NO: 35152 - DNA, 75 bp, Artificial Sequence
  Synthetic
aaagaccagcattgtttggtagactacacgccagcagaggcagatgtggtaaaaaaactcaaaacaatgaagtgt

SEQ ID NO: 35153 - DNA, 75 bp, Artificial Sequence
  Synthetic
ctgatgcctacaccactgctattaaaagttgcaggatcatggacaaaggtgtttgtacagttaatgggcaaaaat

SEQ ID NO: 35154 - DNA, 75 bp, Artificial Sequence
  Synthetic
aagttgcaggatcatggacaaaggtgtttgtacagttaatgggcaaaaatggtcaataataaaatgtgactctga

SEQ ID NO: 35155 - DNA, 75 bp, Artificial Sequence
  Synthetic
gagggagaggatactggaaatgacattggccactattgtatatctgttggttgcaaaacagatagatacccaatt

SEQ ID NO: 35156 - DNA, 75 bp, Artificial Sequence
  Synthetic
ttggccactattgtatatctgttggttgcaaaacagatagatacccaattaatccagatatagttactgattgta

SEQ ID NO: 35157 - DNA, 75 bp, Artificial Sequence
  Synthetic
atcttacataggtaaaatatcaatgcaatcattagaagattataaaaaagcactcacagacaaattaacacacac

SEQ ID NO: 35158 - DNA, 75 bp, Artificial Sequence
  Synthetic
caatcattagaagattataaaaaagcactcacagacaaattaacacacacacttgaaacatacagctttgcacca

SEQ ID NO: 35159 - DNA, 75 bp, Artificial Sequence
  Synthetic
ccatttataaatatattacagcacaaggtgtcgaaaactctgatggaatagagggtgcttatataacagcaacca

SEQ ID NO: 35160 - DNA, 75 bp, Artificial Sequence
  Synthetic
aggtgtcgaaaactctgatggaatagagggtgcttatataacagcaaccatccctgcactggggggaactagcat

SEQ ID NO: 35161 - DNA, 75 bp, Artificial Sequence
  Synthetic
ggtttccctctattagacctgattatatatataaaagctgcagttattagaagcacatatatacacttatatgat

SEQ ID NO: 35162 - DNA, 75 bp, Artificial Sequence
  Synthetic
tatatataaaagctgcagttattagaagcacatatatacacttatatgatactgggccaactattagcataaata

SEQ ID NO: 35163 - DNA, 75 bp, Artificial Sequence
  Synthetic
ccaatgcccagcagaaatagaacatgaagctaattggttgactttctcacaagagagaactagcagatggggttg

SEQ ID NO: 35164 - DNA, 75 bp, Artificial Sequence
  Synthetic
gaagctaattggttgactttctcacaagagagaactagcagatggggttgtgaagaatttgggtgtttagcaatc

SEQ ID NO: 35165 - DNA, 75 bp, Artificial Sequence
  Synthetic
gccaagacgtgataaggccagaaactaaagtatacagaaagtcagtagaagaagaagttgttctaactgtctgta

SEQ ID NO: 35166 - DNA, 75 bp, Artificial Sequence
  Synthetic
taaagtatacagaaagtcagtagaagaagaagttgttctaactgtctgtataaattatcctggcaacacattctg

SEQ ID NO: 35167 - DNA, 75 bp, Artificial Sequence
  Synthetic
aaaataactgaagaggtagagctccagtttaagactgtagacacaaaaacactaccaactttactagcagtgaca

SEQ ID NO: 35168 - DNA, 75 bp, Artificial Sequence
  Synthetic
agtttaagactgtagacacaaaaacactaccaactttactagcagtgacaaatcataaattatttagtggccaaa

SEQ ID NO: 35169 - DNA, 75 bp, Artificial Sequence
  Synthetic
gatgtgtggtaatgtacagaaaactaactctagcatcttaggctccggcacacctaagtttgattacacatgcca

SEQ ID NO: 35170 - DNA, 75 bp, Artificial Sequence
  Synthetic
aactctagcatcttaggctccggcacacctaagtttgattacacatgccatggtgctagtagaaaagacataatt

SEQ ID NO: 35171 - DNA, 75 bp, Artificial Sequence
  Synthetic
atgattcttgtaaactgctgaaggaagagaagcagcttgtatttaatgacgaccatgagactataactgttgtaa

SEQ ID NO: 35172 - DNA, 75 bp, Artificial Sequence
  Synthetic
agagaagcagcttgtatttaatgacgaccatgagactataactgttgtaaataaccgacatttggttggggaatt

SEQ ID NO: 35173 - DNA, 75 bp, Artificial Sequence
  Synthetic
atacagtacaagctttttacagaaaaattagaccttcagatagatgcaaaatgtgttgggtgcccagattgcttt

SEQ ID NO: 35174 - DNA, 75 bp, Artificial Sequence
  Synthetic
aattagaccttcagatagatgcaaaatgtgttgggtgcccagattgctttgagagttatgcctgcaatttccaga

SEQ ID NO: 35175 - DNA, 75 bp, Artificial Sequence
  Synthetic
tgctattaatgggccatgtgacatattccacaatagaatttctattcgatcaacgcagcaaaattatggtgttaa

SEQ ID NO: 35176 - DNA, 75 bp, Artificial Sequence
  Synthetic
ttccacaatagaatttctattcgatcaacgcagcaaaattatggtgttaaaatgtcttgtaaaagaacaccagat

SEQ ID NO: 35177 - DNA, 75 bp, Artificial Sequence
  Synthetic
gaagggagtacagtgtctttttccatactgttcaaaagaatgataaaattgaaataaacactggcgatcagacct

SEQ ID NO: 35178 - DNA, 75 bp, Artificial Sequence
  Synthetic
tactgttcaaaagaatgataaaattgaaataaacactggcgatcagacctcttatataaaggagatggatactag

SEQ ID NO: 35179 - DNA, 75 bp, Artificial Sequence
  Synthetic
agggatgaaggccttagtgttatatttgagcctattaaagccttctttggtagttacttcagtattgctttttat

SEQ ID NO: 35180 - DNA, 75 bp, Artificial Sequence
  Synthetic
ttgagcctattaaagccttctttggtagttacttcagtattgctttttatatagtactattcataattatagcct

SEQ ID NO: 35181 - DNA, 75 bp, Artificial Sequence
  Synthetic
aatgttcatgaagctaagggatatattaaagcagaatgaaaagctttatcttcaagaaatcaaacagaaataatt

SEQ ID NO: 35182 - DNA, 75 bp, Artificial Sequence
  Synthetic
gttgtacataggcagataaaaaacgatgcatagcatcaacataagaagcagtaaggttatcggtagcacactact

SEQ ID NO: 35183 - DNA, 75 bp, Artificial Sequence
  Synthetic
agtagtgtactccacactataaacttgcttgagagatacaaagagaattatcaaagggtgaggcctttaaatgat

SEQ ID NO: 35184 - DNA, 75 bp, Artificial Sequence
  Synthetic
cagaggtcgcatacgctaactttaagcgtgtccacaccactgggcttagttatgaccacgtacgaatcttctaca

SEQ ID NO: 35185 - DNA, 75 bp, Artificial Sequence
  Synthetic
tctctcaaaaagaagtgaatgggaagttacacttaaccttgggggctggaagattgctgtatataatacgaattt

SEQ ID NO: 35186 - DNA, 75 bp, Artificial Sequence
  Synthetic
agcgaaccagagaaactgctaataaaatcaaagattataaaccccctggctgagaaaaatgggatcacatgggca

SEQ ID NO: 35187 - DNA, 75 bp, Artificial Sequence
  Synthetic
aatcaaagattataaaccccctggctgagaaaaatgggatcacatgggcagatggtgaggagatttacctctcat

SEQ ID NO: 35188 - DNA, 75 bp, Artificial Sequence
  Synthetic
tgggactttcaaattttaccccttggcaattggcatatacaaagtccagaggaaggagatggagccaaaatatct

SEQ ID NO: 35189 - DNA, 75 bp, Artificial Sequence
  Synthetic
gcaattggcatatacaaagtccagaggaaggagatggagccaaaatatctagaaaaaacaatgcgccagagatac

SEQ ID NO: 35190 - DNA, 75 bp, Artificial Sequence
  Synthetic
cggttagcaaggttaatgaagtacaggctgcagttaatgtagtctccacactaggttggaagaaaacaaatgtca

SEQ ID NO: 35191 - DNA, 75 bp, Artificial Sequence
  Synthetic
ggctgcagttaatgtagtctccacactaggttggaagaaaacaaatgtcagtgctgctgccagagaattcctggc

SEQ ID NO: 35192 - DNA, 75 bp, Artificial Sequence
  Synthetic
agttgtttccctaattggctcagtttttccagtgttaattggctattccaaaagaggttcaaacctcaaaacgta

SEQ ID NO: 35193 - DNA, 75 bp, Artificial Sequence
  Synthetic
tggggacagatattcttcggattatcagaatggttattttttgaagctgttaagttttaggtggagcacactact

SEQ ID NO: 35194 - DNA, 75 bp, Artificial Sequence
  Synthetic
agtagtgtactcctatataaagaaaattaaattcttaaattattaaaaacatggaggattcaatgtatgatcaat

SEQ ID NO: 35195 - DNA, 75 bp, Artificial Sequence
  Synthetic
attaaattcttaaattattaaaaacatggaggattcaatgtatgatcaattcttaaagaggatccaatcagctag

SEQ ID NO: 35196 - DNA, 75 bp, Artificial Sequence
  Synthetic
atggaggattcaatgtatgatcaattcttaaagaggatccaatcagctagatctgcagtcatcgcaaaggatatt

SEQ ID NO: 35197 - DNA, 75 bp, Artificial Sequence
  Synthetic
atgattatttcgggagagaactgtgccaagcaattgacattccctatcggaacaatgttcttctagacgaaatcc

SEQ ID NO: 35198 - DNA, 75 bp, Artificial Sequence
  Synthetic
ccaagcaattgacattccctatcggaacaatgttcttctagacgaaatcctcttggaagtggttcctggaataaa

SEQ ID NO: 35199 - DNA, 75 bp, Artificial Sequence
  Synthetic
gtcactccagacaattatatttgggatggcaatttcttgatcatattggattacaaagtttcagtaggacacgat

SEQ ID NO: 35200 - DNA, 75 bp, Artificial Sequence
  Synthetic
atggcaatttcttgatcatattggattacaaagtttcagtaggacacgatagcagtgaaataacctacaaaaagt

SEQ ID NO: 35201 - DNA, 75 bp, Artificial Sequence
  Synthetic
gtctgaactagggatttcatcagaaattgctattataagagcaaaccctgtaacttaccagatatctataattgg

SEQ ID NO: 35202 - DNA, 75 bp, Artificial Sequence
  Synthetic
attgctattataagagcaaaccctgtaacttaccagatatctataattggagatgaatttaaaaataggttccct

SEQ ID NO: 35203 - DNA, 75 bp, Artificial Sequence
  Synthetic
gcaaatattttgagctacggaagatgctattagacaaatttgccgatgatgatgaattcctactgatgatagccc

SEQ ID NO: 35204 - DNA, 75 bp, Artificial Sequence
  Synthetic
gctattagacaaatttgccgatgatgatgaattcctactgatgatagcccatggggattttactcttacagcacc

SEQ ID NO: 35205 - DNA, 75 bp, Artificial Sequence
  Synthetic
ctagaatcacatcctatctttaaggaatttatttactctatgccctccaggtttgttaagttgtttataacatcg

SEQ ID NO: 35206 - DNA, 75 bp, Artificial Sequence
  Synthetic
aatttatttactctatgccctccaggtttgttaagttgtttataacatcgttggatttcagtgcgtactctgcag

SEQ ID NO: 35207 - DNA, 75 bp, Artificial Sequence
  Synthetic
agcaaagtcagaaactgaagaagattacaatgaatttctaaataaaaagtcacatgaagtgttcaatttggatgg

SEQ ID NO: 35208 - DNA, 75 bp, Artificial Sequence
  Synthetic
tacaatgaatttctaaataaaaagtcacatgaagtgttcaatttggatggaaattatagtaaacctactcagaat

SEQ ID NO: 35209 - DNA, 75 bp, Artificial Sequence
  Synthetic
tgagtaaacgaattagagatgagagagaaataataactgatgtgacaaagcaaaaaccatctatacactttatct

SEQ ID NO: 35210 - DNA, 75 bp, Artificial Sequence
  Synthetic
agaaataataactgatgtgacaaagcaaaaaccatctatacactttatctgggtaaagaaccataacagaaaatt

SEQ ID NO: 35211 - DNA, 75 bp, Artificial Sequence
  Synthetic
ttcttatccaattcgttacagggaattatagaagcttctacttggacagactcgttaaaagctataggtaaaagt

SEQ ID NO: 35212 - DNA, 75 bp, Artificial Sequence
  Synthetic
ttatagaagcttctacttggacagactcgttaaaagctataggtaaaagtatggatatatgtggaaaagttggtc

SEQ ID NO: 35213 - DNA, 75 bp, Artificial Sequence
  Synthetic
gaaaatggtatcaagatcaacagggaaaaagatagataacaagagattggaggctgtaaaaattggggacgcttt

SEQ ID NO: 35214 - DNA, 75 bp, Artificial Sequence
  Synthetic
aaaaagatagataacaagagattggaggctgtaaaaattggggacgctttagtattgtgggaacaacaattcata

SEQ ID NO: 35215 - DNA, 75 bp, Artificial Sequence
  Synthetic
aagagagacaaaaattcttaaaaaacttttttggtatagggaagcataagcgctttaaggataagacatctagtg

SEQ ID NO: 35216 - DNA, 75 bp, Artificial Sequence
  Synthetic
cttttttggtatagggaagcataagcgctttaaggataagacatctagtgatctaaatgatgaaaagcccaaaat

SEQ ID NO: 35217 - DNA, 75 bp, Artificial Sequence
  Synthetic
ttaatggcagcaagaaccatggtaaacaagaacaaagtccttttatcaaaagataacaatttaaatgagcatcac

SEQ ID NO: 35218 - DNA, 75 bp, Artificial Sequence
  Synthetic
acaagaacaaagtccttttatcaaaagataacaatttaaatgagcatcaccctaccatagggttatatctcaaca

SEQ ID NO: 35219 - DNA, 75 bp, Artificial Sequence
  Synthetic
agctagtgcactaaagaaaatatcaaagacatgtttttggcagtgtgtattggatatctcaactttaatgagaaa

SEQ ID NO: 35220 - DNA, 75 bp, Artificial Sequence
  Synthetic
aagacatgtttttggcagtgtgtattggatatctcaactttaatgagaaatatattagctgtatctcaatacaat

SEQ ID NO: 35221 - DNA, 75 bp, Artificial Sequence
  Synthetic
tgtgtgcaaatgattcattttatgcattggtttttccttcttctgatataaaaacaaggaaagcaacagtagttt

SEQ ID NO: 35222 - DNA, 75 bp, Artificial Sequence
  Synthetic
attggtttttccttcttctgatataaaaacaaggaaagcaacagtagttttctcaattgtgtgtattcatacaaa

SEQ ID NO: 35223 - DNA, 75 bp, Artificial Sequence
  Synthetic
gctctatttacaacactagagcttaatactaaagagtacatatcaataagcaaagcaattagattagataaggaa

SEQ ID NO: 35224 - DNA, 75 bp, Artificial Sequence
  Synthetic
atactaaagagtacatatcaataagcaaagcaattagattagataaggaaagatgccaaaggatagtctcttcac

SEQ ID NO: 35225 - DNA, 75 bp, Artificial Sequence
  Synthetic
actgctttataataacaataaggacatatcactatttgatgttatcaatttttgtttttatactagtttgtcaat

SEQ ID NO: 35226 - DNA, 75 bp, Artificial Sequence
  Synthetic
atatcactatttgatgttatcaatttttgtttttatactagtttgtcaattactaagagcatgttgtcactaaca

SEQ ID NO: 35227 - DNA, 75 bp, Artificial Sequence
  Synthetic
attctttagctgtgtcaagccatgtcaaagattacattgcagaaaaattctcaccctacactaaaactttattca

SEQ ID NO: 35228 - DNA, 75 bp, Artificial Sequence
  Synthetic
caaagattacattgcagaaaaattctcaccctacactaaaactttattcagtgtatacatggtgaatttaataaa

SEQ ID NO: 35229 - DNA, 75 bp, Artificial Sequence
  Synthetic
caatctggaaagatacaacttagaaatatttacttatcagactatgatataacacaaaaaggtgtcaacgatgaa

SEQ ID NO: 35230 - DNA, 75 bp, Artificial Sequence
  Synthetic
atatttacttatcagactatgatataacacaaaaaggtgtcaacgatgaacgaaatttagattcaatatggtttc

SEQ ID NO: 35231 - DNA, 75 bp, Artificial Sequence
  Synthetic
cataaaccaaatttatctgcccttttactttaatgcaaaaggattgcatgagaaacaccatgtaatgatagactt

SEQ ID NO: 35232 - DNA, 75 bp, Artificial Sequence
  Synthetic
tactttaatgcaaaaggattgcatgagaaacaccatgtaatgatagacttagcaaaaacagttcttgagattgag

SEQ ID NO: 35233 - DNA, 75 bp, Artificial Sequence
  Synthetic
gtatttggtccaaatatgaaaagaaacaacacgtaaacttaccaattctagtccattcattggcaaaatcattaa

SEQ ID NO: 35234 - DNA, 75 bp, Artificial Sequence
  Synthetic
acaacacgtaaacttaccaattctagtccattcattggcaaaatcattaattctagacacttctagacataatca

SEQ ID NO: 35235 - DNA, 75 bp, Artificial Sequence
  Synthetic
aataattttagaagaaatataactactattagtacttttacaagctcaaaggcctgtatcaaaataggtgatttt

SEQ ID NO: 35236 - DNA, 75 bp, Artificial Sequence
  Synthetic
ctattagtacttttacaagctcaaaggcctgtatcaaaataggtgattttgaaaacataaaaaaagagaacaata

SEQ ID NO: 35237 - DNA, 75 bp, Artificial Sequence
  Synthetic
agttgaccaaaaatacaggctatctaatcccctgttcgtgaatgatcaagaatctaatctagaaattcaacattg

SEQ ID NO: 35238 - DNA, 75 bp, Artificial Sequence
  Synthetic
aatcccctgttcgtgaatgatcaagaatctaatctagaaattcaacattgtaattatgctatgttaaaatctaaa

SEQ ID NO: 35239 - DNA, 75 bp, Artificial Sequence
  Synthetic
ctgtcaaagtctttgatagattatatgagttaataaaaatggggaaaataaatgacaaaccatttatagaacaag

SEQ ID NO: 35240 - DNA, 75 bp, Artificial Sequence
  Synthetic
tgagttaataaaaatggggaaaataaatgacaaaccatttatagaacaagcaatggtaatgatgaaggatcataa

SEQ ID NO: 35241 - DNA, 75 bp, Artificial Sequence
  Synthetic
aaagggcaaaaaacagcaaaagatcgggagatttttgtaggtgaatttgaagcaaaaatgtgtatgtatgttata

SEQ ID NO: 35242 - DNA, 75 bp, Artificial Sequence
  Synthetic
gggagatttttgtaggtgaatttgaagcaaaaatgtgtatgtatgttatagaaagaatttcaaaagaaagatgca

SEQ ID NO: 35243 - DNA, 75 bp, Artificial Sequence
  Synthetic
tgaacctggggattctaaacttaggatattggagaaaaaggctgaagaagaaataagatatatagtcgaaaaaac

SEQ ID NO: 35244 - DNA, 75 bp, Artificial Sequence
  Synthetic
atattggagaaaaaggctgaagaagaaataagatatatagtcgaaaaaacaaaggacaggatgagtaaaggtgac

SEQ ID NO: 35245 - DNA, 75 bp, Artificial Sequence
  Synthetic
tcaatgcagatatgtctaaatggagtgctcaggatgttttttataaatacttctggttaattgcattagatccta

SEQ ID NO: 35246 - DNA, 75 bp, Artificial Sequence
  Synthetic
tgctcaggatgttttttataaatacttctggttaattgcattagatcctattttataccctaaagaaaagaagag

SEQ ID NO: 35247 - DNA, 75 bp, Artificial Sequence
  Synthetic
atggagaaaaatttgattttaccagatgatttgatagctaatattttagaccaaaaaacaccatatagaaatgat

SEQ ID NO: 35248 - DNA, 75 bp, Artificial Sequence
  Synthetic
atgatttgatagctaatattttagaccaaaaaacaccatatagaaatgatattattttggaagcaactaatggct

SEQ ID NO: 35249 - DNA, 75 bp, Artificial Sequence
  Synthetic
aagaaattggttacaaggtaatttcaattatatatctagctatgtacacagctgtgcaatgttagtttataagga

SEQ ID NO: 35250 - DNA, 75 bp, Artificial Sequence
  Synthetic
aattatatatctagctatgtacacagctgtgcaatgttagtttataaggatgtaatgaagaaaacaatggattta

SEQ ID NO: 35251 - DNA, 75 bp, Artificial Sequence
  Synthetic
ctatggttcattcagatgataaccaaacatcactttcaatattacagaataaagttagtgataatgttattatac

SEQ ID NO: 35252 - DNA, 75 bp, Artificial Sequence
  Synthetic
aacatcactttcaatattacagaataaagttagtgataatgttattatacaatttactgcaaatacttttgaatc

SEQ ID NO: 35253 - DNA, 75 bp, Artificial Sequence
  Synthetic
gctaatatgaaaaaaacttatattacacatacatgcaaggaatttgtctccttgtttaatcttcatggagaacct

SEQ ID NO: 35254 - DNA, 75 bp, Artificial Sequence
  Synthetic
cacatacatgcaaggaatttgtctccttgtttaatcttcatggagaacctctatcaatatatggtagattcttac

SEQ ID NO: 35255 - DNA, 75 bp, Artificial Sequence
  Synthetic
tattggaccatatgaagatttagcaagtcgattatctgctgcacaacaaagcttaaaacatggatgcccacctag

SEQ ID NO: 35256 - DNA, 75 bp, Artificial Sequence
  Synthetic
agtcgattatctgctgcacaacaaagcttaaaacatggatgcccacctagtttagtatggttagctataagctgt

SEQ ID NO: 35257 - DNA, 75 bp, Artificial Sequence
  Synthetic
ataatatgttagatgatcagataaatgctcctaataattacttgccattcgagaatagacatgatataccagttg

SEQ ID NO: 35258 - DNA, 75 bp, Artificial Sequence
  Synthetic
tgctcctaataattacttgccattcgagaatagacatgatataccagttgagttaaatggttatttagatgctcc

SEQ ID NO: 35259 - DNA, 75 bp, Artificial Sequence
  Synthetic
ttagaagcagggaatttatggtttttaatgaaaattctgaagaaacttgtacctctagataaacagaaagaaaca

SEQ ID NO: 35260 - DNA, 75 bp, Artificial Sequence
  Synthetic
taatgaaaattctgaagaaacttgtacctctagataaacagaaagaaacaattcaaacccaatgtttacacataa

SEQ ID NO: 35261 - DNA, 75 bp, Artificial Sequence
  Synthetic
gtcagacatatttagattaaaacttctccgctatctaacattagatactgaagtttcagcagataataacatggg

SEQ ID NO: 35262 - DNA, 75 bp, Artificial Sequence
  Synthetic
ctccgctatctaacattagatactgaagtttcagcagataataacatgggtgagaccagtgatatgaggagtagg

SEQ ID NO: 35263 - DNA, 75 bp, Artificial Sequence
  Synthetic
caactattgggacattgtccaaattaatttcatacaatgattttaaaaataacatgtctaccaatggatttaaag

SEQ ID NO: 35264 - DNA, 75 bp, Artificial Sequence
  Synthetic
aatttcatacaatgattttaaaaataacatgtctaccaatggatttaaagacaatttagaatatatgttaaagaa

SEQ ID NO: 35265 - DNA, 75 bp, Artificial Sequence
  Synthetic
gaaaccaatgaccagtttgtaaattctatattgtttaggtataactcaaagagatttaaggaaagtctatctatc

SEQ ID NO: 35266 - DNA, 75 bp, Artificial Sequence
  Synthetic
ctatattgtttaggtataactcaaagagatttaaggaaagtctatctatccagaacccagcacaattgtttatag

SEQ ID NO: 35267 - DNA, 75 bp, Artificial Sequence
  Synthetic
aataatagattacagtagtatttttgacaagcttacatcattggcagaatcggatataatagaagaattacctga

SEQ ID NO: 35268 - DNA, 75 bp, Artificial Sequence
  Synthetic
gacaagcttacatcattggcagaatcggatataatagaagaattacctgaaattataggtagagtgactttccca

SEQ ID NO: 35269 - DNA, 75 bp, Artificial Sequence
  Synthetic
atttgagtcaactaccattacaattggatgacatacagataatattcaggtattgtattttaaatgatccattaa

SEQ ID NO: 35270 - DNA, 75 bp, Artificial Sequence
  Synthetic
ggatgacatacagataatattcaggtattgtattttaaatgatccattaatgattactgcagcaaacactgtgct

SEQ ID NO: 35271 - DNA, 75 bp, Artificial Sequence
  Synthetic
gacaggacaggtttgagtgcaaatcaaatgccagaattccgaaatatgaagttgatacaccattcaccagcatta

SEQ ID NO: 35272 - DNA, 75 bp, Artificial Sequence
  Synthetic
aaatgccagaattccgaaatatgaagttgatacaccattcaccagcattagtattaaaagcattcagtaaaggct

SEQ ID NO: 35273 - DNA, 75 bp, Artificial Sequence
  Synthetic
tatagaactggaaaaggatttgcatcatctaaatgagtttgtggattcaacatctattaagcaaaaaatattcca

SEQ ID NO: 35274 - DNA, 75 bp, Artificial Sequence
  Synthetic
catctaaatgagtttgtggattcaacatctattaagcaaaaaatattccagaacatggataatccgccaaaacat

SEQ ID NO: 35275 - DNA, 75 bp, Artificial Sequence
  Synthetic
ataagattagagaactaacaaaattataccaagtatgttacgactatgtaaagtcaacagagcataaagtcaaag

SEQ ID NO: 35276 - DNA, 75 bp, Artificial Sequence
  Synthetic
ataccaagtatgttacgactatgtaaagtcaacagagcataaagtcaaagtctttatattaccaatgaaatcata

SEQ ID NO: 35277 - DNA, 75 bp, Artificial Sequence
  Synthetic
atacaggggaatacactgtctgataataaatggtatacaatgcattacctaaagcaagttttaggtggtaatgta

SEQ ID NO: 35278 - DNA, 75 bp, Artificial Sequence
  Synthetic
ataaatggtatacaatgcattacctaaagcaagttttaggtggtaatgtaaaaggtaatataattacaacaagta

SEQ ID NO: 35279 - DNA, 75 bp, Artificial Sequence
  Synthetic
atgcttccgagtactatgtcactttgctgattcctttatagaagaaggaagtagacccagttttgttaatgaagt

SEQ ID NO: 35280 - DNA, 75 bp, Artificial Sequence
  Synthetic
gctgattcctttatagaagaaggaagtagacccagttttgttaatgaagtaattgataatttcacttataagaat

SEQ ID NO: 35281 - DNA, 75 bp, Artificial Sequence
  Synthetic
ccatactaaatagctcatcaaggttagattttatacccttgttattccgattacggcatctgactcaaatggatc

SEQ ID NO: 35282 - DNA, 75 bp, Artificial Sequence
  Synthetic
agattttatacccttgttattccgattacggcatctgactcaaatggatctcaataaatttgacgccctcaaaac

SEQ ID NO: 35283 - DNA, 75 bp, Artificial Sequence
  Synthetic
tggcaaaccaatagatctttgaattctgggttgatagaccttactatatctgggtatttaagatctattaggata

SEQ ID NO: 35284 - DNA, 75 bp, Artificial Sequence
  Synthetic
ctgggttgatagaccttactatatctgggtatttaagatctattaggatagtgggtgaagatagatatctaaaag

SEQ ID NO: 35285 - DNA, 75 bp, Artificial Sequence
  Synthetic
ttaccctaatactgtgttccatgctggaaataaattattaaactcaagacatggtttaaaatttgagtatatgga

SEQ ID NO: 35286 - DNA, 75 bp, Artificial Sequence
  Synthetic
ggaaataaattattaaactcaagacatggtttaaaatttgagtatatggaagaatgtgtattggatgacaaatac

SEQ ID NO: 35287 - DNA, 75 bp, Artificial Sequence
  Synthetic
aaagagctcatctatatacttatcaagtgtctacaatagatcacataaacagaaggaatattgaaggcttaacat

SEQ ID NO: 35288 - DNA, 75 bp, Artificial Sequence
  Synthetic
agtgtctacaatagatcacataaacagaaggaatattgaaggcttaacatcaaggggatcaagattcaacaaaat

SEQ ID NO: 35289 - DNA, 75 bp, Artificial Sequence
  Synthetic
agtgtcagagatgaattatttagaatgtcactagagaatatattcagtctaaatatgacaaactttagcatgtca

SEQ ID NO: 35290 - DNA, 75 bp, Artificial Sequence
  Synthetic
tgtcactagagaatatattcagtctaaatatgacaaactttagcatgtcaagattattggtttcaccagatgagg

SEQ ID NO: 35291 - DNA, 75 bp, Artificial Sequence
  Synthetic
gtcaaaaatgatgtttttccaaggccctagtataaaggctggcataattaatataacttcacttatgagaacaca

SEQ ID NO: 35292 - DNA, 75 bp, Artificial Sequence
  Synthetic
cctagtataaaggctggcataattaatataacttcacttatgagaacacaagaactactaacattaaattatgat

SEQ ID NO: 35293 - DNA, 75 bp, Artificial Sequence
  Synthetic
ccttttgtagaatcttggaatgtgatgggtctgagcagggtgaattgattttcttgtcagatgaaataatggact

SEQ ID NO: 35294 - DNA, 75 bp, Artificial Sequence
  Synthetic
tgggtctgagcagggtgaattgattttcttgtcagatgaaataatggacttcactatctcagaagaaatagaatc

SEQ ID NO: 35295 - DNA, 75 bp, Artificial Sequence
  Synthetic
cagaagaaaggacatgaacatatgacttacaagaatgctataatgaaattagtaaataatggtgtggaggaaata

SEQ ID NO: 35296 - DNA, 75 bp, Artificial Sequence
  Synthetic
cttacaagaatgctataatgaaattagtaaataatggtgtggaggaaataaaggaagtctttgatttttcaggtg

SEQ ID NO: 35297 - DNA, 75 bp, Artificial Sequence
  Synthetic
ggggattatcaacactatctgctcagtaataagtttgttagaaacaaatgagtggtcatctattttgtacaattc

SEQ ID NO: 35298 - DNA, 75 bp, Artificial Sequence
  Synthetic
gtaataagtttgttagaaacaaatgagtggtcatctattttgtacaattcattccacatagctatgttgttagag

SEQ ID NO: 35299 - DNA, 75 bp, Artificial Sequence
  Synthetic
tcactctacctaaagcattcttcaacaacactgcagctggttctataaactggactaaattgctaaaatttgtaa

SEQ ID NO: 35300 - DNA, 75 bp, Artificial Sequence
  Synthetic
caacactgcagctggttctataaactggactaaattgctaaaatttgtaagatcactcccaagtataggaaaaga

SEQ ID NO: 35301 - DNA, 75 bp, Artificial Sequence
  Synthetic
tttatagaaaaaacattatatttaatagaaaaaaagataaatgaagatgttagttttaatgattttctagatgag

SEQ ID NO: 35302 - DNA, 75 bp, Artificial Sequence
  Synthetic
tagaaaaaaagataaatgaagatgttagttttaatgattttctagatgagttagagttccaaacaggcaaatcaa

SEQ ID NO: 35303 - DNA, 75 bp, Artificial Sequence
  Synthetic
tatcctcactaattgactatatccaaaagccatttaatggcaataaaaaactgctgtattaaaatactttacaat

SEQ ID NO: 35304 - DNA, 75 bp, Artificial Sequence
  Synthetic
aaaagccatttaatggcaataaaaaactgctgtattaaaatactttacaattttcttatataggagcacactact

SEQ ID NO: 35305 - DNA, 75 bp, Artificial Sequence
  Synthetic
ttgaggaggatccaagcttcaaggacagcagttgttgctaaggatatcagcactgatatccttgaagcaagacat

SEQ ID NO: 35306 - DNA, 75 bp, Artificial Sequence
  Synthetic
cagcagttgttgctaaggatatcagcactgatatccttgaagcaagacatgattactttggtcgtgagctatgca

SEQ ID NO: 35307 - DNA, 75 bp, Artificial Sequence
  Synthetic
taatgttcttttagatgagattgtcttagatgtgtgccctggggtgaatctcatggattataatatcccgaatgt

SEQ ID NO: 35308 - DNA, 75 bp, Artificial Sequence
  Synthetic
ttagatgtgtgccctggggtgaatctcatggattataatatcccgaatgtgactccggacaactacatctgggat

SEQ ID NO: 35309 - DNA, 75 bp, Artificial Sequence
  Synthetic
acaaggtctcagttggaactgacagcagcgagattacttataaaaaatacaccaccttgatcctaccaattatgg

SEQ ID NO: 35310 - DNA, 75 bp, Artificial Sequence
  Synthetic
cagcgagattacttataaaaaatacaccaccttgatcctaccaattatggagagtttgggcatccccacagaaat

SEQ ID NO: 35311 - DNA, 75 bp, Artificial Sequence
  Synthetic
acatatcaattaacaatcataggggagaatttccgtgaaagatatccaaacattccactacagctggatttcaca

SEQ ID NO: 35312 - DNA, 75 bp, Artificial Sequence
  Synthetic
agaatttccgtgaaagatatccaaacattccactacagctggatttcacaaaattctttgagttacgtaagatgc

SEQ ID NO: 35313 - DNA, 75 bp, Artificial Sequence
  Synthetic
ggaatttttgttaatgattgcacatggtgacttcactttgacagcaccctggtgtgtagatgacaccccagaact

SEQ ID NO: 35314 - DNA, 75 bp, Artificial Sequence
  Synthetic
ggtgacttcactttgacagcaccctggtgtgtagatgacaccccagaactatcagatcatcctatatatcaagag

SEQ ID NO: 35315 - DNA, 75 bp, Artificial Sequence
  Synthetic
ttgttgatctattcaatgaggctatcgagttcagtgcttactctgctgagaggtggaatacattgctttacaaag

SEQ ID NO: 35316 - DNA, 75 bp, Artificial Sequence
  Synthetic
tcaagattacttatcaagaaaggcacataacatattcaatatggacggaaattatatgaagccaactcagaatga

SEQ ID NO: 35317 - DNA, 75 bp, Artificial Sequence
  Synthetic
atatcataactgatacaacaaaacagaaaccttctgtgcattttatttggactagaaacaataataggaaactct

SEQ ID NO: 35318 - DNA, 75 bp, Artificial Sequence
  Synthetic
aatgaacaatccacttggtcagaatcattgattgcaattggtatgagcatggatataggaaataatataggtcag

SEQ ID NO: 35319 - DNA, 75 bp, Artificial Sequence
  Synthetic
agatgattgctagatcaacaggaaaaaagatagataataagagacttgatgcagtcaagattggtaatgctcttg

SEQ ID NO: 35320 - DNA, 75 bp, Artificial Sequence
  Synthetic
aaagatagataataagagacttgatgcagtcaagattggtaatgctcttgtcttatgggaacaacaatttatttt

SEQ ID NO: 35321 - DNA, 75 bp, Artificial Sequence
  Synthetic
gagaggcaaaaattcttaaaaaacttttttgggattggtaaacacaagtcatttaaggacaagactgccacagat

SEQ ID NO: 35322 - DNA, 75 bp, Artificial Sequence
  Synthetic
tttttgggattggtaaacacaagtcatttaaggacaagactgccacagatattgacattgaaaaaccgaagatac

SEQ ID NO: 35323 - DNA, 75 bp, Artificial Sequence
  Synthetic
aacttatttttggcaatgcattactgatatatctacgttaatgcgcaatatattgtcagtttctcaatataatag

SEQ ID NO: 35324 - DNA, 75 bp, Artificial Sequence
  Synthetic
tgtgcaaatgattcagtttatgggttagttttcccatcttcagacataaagactaaaagagccacagtagtcttc

SEQ ID NO: 35325 - DNA, 75 bp, Artificial Sequence
  Synthetic
gactaaaagagccacagtagtcttctgcattgtatgtatccatgaagataaaaaagatattatggatgcaggggc

SEQ ID NO: 35326 - DNA, 75 bp, Artificial Sequence
  Synthetic
acaaaaaattacatatctatcagtaaggctatcaggttagataaagagagatgtcaaagaattgtatcatcaccc

SEQ ID NO: 35327 - DNA, 75 bp, Artificial Sequence
  Synthetic
ggcttattcctattaagctcattactattatataataataaccctttaatatctcttactgatgtactgaatttt

SEQ ID NO: 35328 - DNA, 75 bp, Artificial Sequence
  Synthetic
gtttatatggttaacttaattaaaatgggatgcagttctgcaaatgagcaatctagtaaaatacaattgagaaac

SEQ ID NO: 35329 - DNA, 75 bp, Artificial Sequence
  Synthetic
tgggatgcagttctgcaaatgagcaatctagtaaaatacaattgagaaacatttacttatctgattatgacataa

SEQ ID NO: 35330 - DNA, 75 bp, Artificial Sequence
  Synthetic
gaacttggagtctatatggttcccaggtaaggttaatcttaaagagtacataaaccagatttacctaccttttta

SEQ ID NO: 35331 - DNA, 75 bp, Artificial Sequence
  Synthetic
ggtaaggttaatcttaaagagtacataaaccagatttacctacctttttatttcaatgctaaggggctacatgaa

SEQ ID NO: 35332 - DNA, 75 bp, Artificial Sequence
  Synthetic
caaagacagttttagaaattgaaatgaaccagcgctctgaaaatttggggatatggtcaaaagcagagaagaagc

SEQ ID NO: 35333 - DNA, 75 bp, Artificial Sequence
  Synthetic
gaaccagcgctctgaaaatttggggatatggtcaaaagcagagaagaagcaacatgtgaatttaccgatattgat

SEQ ID NO: 35334 - DNA, 75 bp, Artificial Sequence
  Synthetic
ttagacacatcgagacacaatcatcttagaaatagagtggaaagtagaaataattttagaaggagcataactact

SEQ ID NO: 35335 - DNA, 75 bp, Artificial Sequence
  Synthetic
taattttagaaggagcataactactatcagcacctttactagttcaaaatcttgcgttaaagttggagattttaa

SEQ ID NO: 35336 - DNA, 75 bp, Artificial Sequence
  Synthetic
aaacaaaagaaaacaaacaacaaagccctagaaaaatataggctgtcaaaccctctgtttctagaagatgaagaa

SEQ ID NO: 35337 - DNA, 75 bp, Artificial Sequence
  Synthetic
ccctagaaaaatataggctgtcaaaccctctgtttctagaagatgaagaacaaacattggagacacaacactgca

SEQ ID NO: 35338 - DNA, 75 bp, Artificial Sequence
  Synthetic
accaaattataaagattatatatctgttaaggtattcgacagactttacgaattattaaaaaatgagacattaaa

SEQ ID NO: 35339 - DNA, 75 bp, Artificial Sequence
  Synthetic
aattattaaaaaatgagacattaaataatgacccttttattgagcaagcaatgtcgatgatgaagaatcacaaag

SEQ ID NO: 35340 - DNA, 75 bp, Artificial Sequence
  Synthetic
agcctggtgatgcaaaattgagaatcctagaaaagaaagctgaagaggaaataaggttcattgttgaaaggacaa

SEQ ID NO: 35341 - DNA, 75 bp, Artificial Sequence
  Synthetic
aatgcggacatgtcaaaatggagtgcccaagatgttttttacaaatacttttggttgattgctttagacccaata

SEQ ID NO: 35342 - DNA, 75 bp, Artificial Sequence
  Synthetic
gatcttattgcgaatatcttagaccagaaaaccccctataaaaatgacttaatacttgaggccacaaatggattg

SEQ ID NO: 35343 - DNA, 75 bp, Artificial Sequence
  Synthetic
gaaattggctccagggtaattttaattatatatccagttatgtgcatagctgtgcaatgttggtctacaaggaca

SEQ ID NO: 35344 - DNA, 75 bp, Artificial Sequence
  Synthetic
catacctgtaaggaatttgtttcactttttaatcttcatggggagcctctatctgtttatggtcgattcttgcta

SEQ ID NO: 35345 - DNA, 75 bp, Artificial Sequence
  Synthetic
ccactggataacttacttgacatacaatatgctagatgatcaaataaactctcctctcaactatctccccttcaa

SEQ ID NO: 35346 - DNA, 75 bp, Artificial Sequence
  Synthetic
aatatgctagatgatcaaataaactctcctctcaactatctccccttcaagagccgtcatgatataccggtagaa

SEQ ID NO: 35347 - DNA, 75 bp, Artificial Sequence
  Synthetic
cactggacaagcagagagaaacgatccagacccagtttcagacaatagggtcattgaaaagcttaaatgattctg

SEQ ID NO: 35348 - DNA, 75 bp, Artificial Sequence
  Synthetic
acttacaccaaggaagtttactactgtaggttcattaaataagttagtatcatataatgattttaaagaatccat

SEQ ID NO: 35349 - DNA, 75 bp, Artificial Sequence
  Synthetic
gtctactgataattataaggagaaccttacatacatgttggataacccagagttgttagtcacaaaaggtgaaga

SEQ ID NO: 35350 - DNA, 75 bp, Artificial Sequence
  Synthetic
ttaaagaaagtttgtccatacagaatcctgctcaattgtttatagagcaaatactattctcccataagccaatta

SEQ ID NO: 35351 - DNA, 75 bp, Artificial Sequence
  Synthetic
tagattacagtagtatctttgacaaattaacatctttagcagaatcagacttgattgcagaactaccagaaatta

SEQ ID NO: 35352 - DNA, 75 bp, Artificial Sequence
  Synthetic
ttatcaaatgatcaatagagatattagccaactgccattggatataaatgatgtgaaagtggtatttaaatattg

SEQ ID NO: 35353 - DNA, 75 bp, Artificial Sequence
  Synthetic
agccaactgccattggatataaatgatgtgaaagtggtatttaaatattgtattttaaatgatccattgatgata

SEQ ID NO: 35354 - DNA, 75 bp, Artificial Sequence
  Synthetic
gtgttagaggaaccccacaggacagaacagggttgagtgctaaccaaatgcctgaatttagaaatatgaaactta

SEQ ID NO: 35355 - DNA, 75 bp, Artificial Sequence
  Synthetic
tccaccattccccagcattagttctcaaggcattcagcaaatctactaccgatatagcaggtgctgatccaatag

SEQ ID NO: 35356 - DNA, 75 bp, Artificial Sequence
  Synthetic
tgaggaatttttatcaaacacagggatacaagacaaaataaatcaaaacatagacaacccaccaaagcatcttgt

SEQ ID NO: 35357 - DNA, 75 bp, Artificial Sequence
  Synthetic
ataagagagataacaaagctatatcagctctgctatgattacataaaatcaacagaacacaaagttaaagttttc

SEQ ID NO: 35358 - DNA, 75 bp, Artificial Sequence
  Synthetic
agctctgctatgattacataaaatcaacagaacacaaagttaaagttttcatactaccgatgaaatcatatacat

SEQ ID NO: 35359 - DNA, 75 bp, Artificial Sequence
  Synthetic
aggtaacactattagagatgataaatggtacacaatgcattatttgaagcagattgttagtggttcagtgaaagg

SEQ ID NO: 35360 - DNA, 75 bp, Artificial Sequence
  Synthetic
tggtacacaatgcattatttgaagcagattgttagtggttcagtgaaaggtacaatagttacaactagtactact

SEQ ID NO: 35361 - DNA, 75 bp, Artificial Sequence
  Synthetic
ttagggtattatgtcattttgcagattcgtttgtagaagaagggagtcgcttgagtttcatcacagaagtcatag

SEQ ID NO: 35362 - DNA, 75 bp, Artificial Sequence
  Synthetic
ttcgtttgtagaagaagggagtcgcttgagtttcatcacagaagtcatagacaactttacttacaagaatataag

SEQ ID NO: 35363 - DNA, 75 bp, Artificial Sequence
  Synthetic
ttaggaagtaatatgagacttgacttcttacctctattatttagaatgcaatctttgacacaatcagatctgaac

SEQ ID NO: 35364 - DNA, 75 bp, Artificial Sequence
  Synthetic
aagtttgatgcattaaaaacaaacgaaagagtttcatggaacaattggcaaacaaatcgatccctgaattcaggc

SEQ ID NO: 35365 - DNA, 75 bp, Artificial Sequence
  Synthetic
atttaaggtcaatacgaatagtgggggaagataaaacattaaaaattgctgaacttacagtgcctaatttttatc

SEQ ID NO: 35366 - DNA, 75 bp, Artificial Sequence
  Synthetic
ggaagataaaacattaaaaattgctgaacttacagtgcctaatttttatccaaacacagtatttcatgctggaaa

SEQ ID NO: 35367 - DNA, 75 bp, Artificial Sequence
  Synthetic
ctgaagtttgaatatatgcaggaagtactgttagatgaaaaatacaactattacataacatttcaaaaaaagaga

SEQ ID NO: 35368 - DNA, 75 bp, Artificial Sequence
  Synthetic
gcacacatatacacttatcaagtctctactatagatcatataataaaaagaaatgaggaaggactatcaactaga

SEQ ID NO: 35369 - DNA, 75 bp, Artificial Sequence
  Synthetic
cagtctgtcctgttgtattatctgtcagagatgaacttttcaggatgaatatggacaatgtcttcagtttaaata

SEQ ID NO: 35370 - DNA, 75 bp, Artificial Sequence
  Synthetic
tattgtcattaagctttgataacatttgtaaatcaagtattataccattttgcaggatactagattgctccggtg

SEQ ID NO: 35371 - DNA, 75 bp, Artificial Sequence
  Synthetic
aggaacaaggagaactcatttttctctcagatgaaattatggattttactatttcagaggaaatagaatccatgc

SEQ ID NO: 35372 - DNA, 75 bp, Artificial Sequence
  Synthetic
tgagaagactatattccttattgaaaaggaaatgaacaaagaagcaaactttgaagatttcttggatgagttaga

SEQ ID NO: 35373 - DNA, 75 bp, Artificial Sequence
  Synthetic
aaggaaatgaacaaagaagcaaactttgaagatttcttggatgagttagaattttcatcaggtaaatccatgttc

SEQ ID NO: 35374 - DNA, 75 bp, Artificial Sequence
  Synthetic
acacaatcataattggccattctcaaaagccactctgtggcactaccataaaacagcatttgaaatcaatttctt

SEQ ID NO: 35375 - DNA, 75 bp, Artificial Sequence
  Synthetic
ctcagtggattccttgccaggtacttacttgagaagattctaaaagtgagtgacccggaaaaattgattataaaa

SEQ ID NO: 35376 - DNA, 75 bp, Artificial Sequence
  Synthetic
aaaaaaacggtataacctgggcagatggggaggaggtttacctctcattctttccagggtctgaaatgttcttag

SEQ ID NO: 35377 - DNA, 75 bp, Artificial Sequence
  Synthetic
aattggcatttacaaggtgcagaggaaagagatggagccaaagtatctggagaagaccatgcgccaaagatatat

SEQ ID NO: 35378 - DNA, 75 bp, Artificial Sequence
  Synthetic
aaagagatggagccaaagtatctggagaagaccatgcgccaaagatatatgggcttggaagcatcaacttggaca

SEQ ID NO: 35379 - DNA, 75 bp, Artificial Sequence
  Synthetic
tgggtggaagaagacaaatgtgagcagtgccgctagagaattcctagcaaagtttggcatcagcatgtaaatgca

SEQ ID NO: 35380 - DNA, 75 bp, Artificial Sequence
  Synthetic
ttgtatttttaaaatttggctaaaagagtccctggactcaaaaagtaaaaacagcttgttgggtgggtggttggg

SEQ ID NO: 35381 - DNA, 75 bp, Artificial Sequence
  Synthetic
gccaaaatctacaagttataataatcaataaaatataaaatatatatataaaaaacatacaattttcttatgtag

SEQ ID NO: 35382 - DNA, 75 bp, Artificial Sequence
  Synthetic
agtagtgtactcctacatatagaaaatttaaaaatataaccagtaagagtatggaggaccaagcttatgatcaat

SEQ ID NO: 35383 - DNA, 75 bp, Artificial Sequence
  Synthetic
ctacaaagtctcagttgggaatgatagtagtgaaatcacatataagaaatacaccagtttgattctcccggtgat

SEQ ID NO: 35384 - DNA, 75 bp, Artificial Sequence
  Synthetic
agactatatgagaccaacacaagctgaaatcgataagggttgggagctaatgagtcaaagagtttacacagagag

SEQ ID NO: 35385 - DNA, 75 bp, Artificial Sequence
  Synthetic
gggcaaagaatgcggatagaaagctaataggttcaacagcaaaattaatatacctatctaatagtttacaaagta

SEQ ID NO: 35386 - DNA, 75 bp, Artificial Sequence
  Synthetic
cttagatttcaataacactatagtcttgatggctgcaaggacaatggttaataagaacaaagctctattagctaa

SEQ ID NO: 35387 - DNA, 75 bp, Artificial Sequence
  Synthetic
tagagattatatagctgagaaattctctccatacaccaaaacacttttcagtgtatacatggtcaatttgataaa

SEQ ID NO: 35388 - DNA, 75 bp, Artificial Sequence
  Synthetic
taaatgcagacatgtcaaaatggagtgctcaagatgtattttacaaatatttttggctgatagcaatggacccta

SEQ ID NO: 35389 - DNA, 75 bp, Artificial Sequence
  Synthetic
tgctcaagatgtattttacaaatatttttggctgatagcaatggaccctatactttatccagcagaaaaaacacg

SEQ ID NO: 35390 - DNA, 75 bp, Artificial Sequence
  Synthetic
gttgtgcaatgcttgtctacaaggatatcctcagagaatgtatgaagttattagacggagactgcttgatcaatt

SEQ ID NO: 35391 - DNA, 75 bp, Artificial Sequence
  Synthetic
ttgaggtatcttactcttgacactgagatgtcagttgataacaacatgggagaaacaagtgatatgcgaagtaga

SEQ ID NO: 35392 - DNA, 75 bp, Artificial Sequence
  Synthetic
taatgaaagagtttcatggaataactggcagacaaaccgttccttaaattcaggtctgattgatttgacaatatc

SEQ ID NO: 35393 - DNA, 75 bp, Artificial Sequence
  Synthetic
gtgggggaagataataaactcaaaattgctgaactaacaatacctaatttctatccaaacacagtgttccatgca

SEQ ID NO: 35394 - DNA, 75 bp, Artificial Sequence
  Synthetic
atggattaaaatttgaatacatggaggaaattgttctagatgaaaaatataattattatataacataccaaaaaa

SEQ ID NO: 35395 - DNA, 75 bp, Artificial Sequence
  Synthetic
ggttcctgtctgtccagttgttctaagtgttagggatgaattatttagaatgtctttagaaaatgtttttagttt

SEQ ID NO: 35396 - DNA, 75 bp, Artificial Sequence
  Synthetic
tcacaatttctgaggagatagaatctatgccattatttacaataaggtatcagaaaagaggcactgaaattatga

SEQ ID NO: 35397 - DNA, 75 bp, Artificial Sequence
  Synthetic
agtagtgtactccacactacaaacttgctattgttgaaaattgctgtgctatcaaatctaacaaaaggtcattaa

SEQ ID NO: 35398 - DNA, 75 bp, Artificial Sequence
  Synthetic
gtgggtggttggggacagaaagacagcggactaaattaacattacattattaatggtattttaagttttaggtgg

SEQ ID NO: 35399 - DNA, 75 bp, Artificial Sequence
  Synthetic
agtagtgtactaccgatatacacaaaccaattgtttttatagatttatttcatcaagaatggctatctcaacatc

SEQ ID NO: 35400 - DNA, 75 bp, Artificial Sequence
  Synthetic
accaattgtttttatagatttatttcatcaagaatggctatctcaacatcactgttgattgttgcccttctaatc

SEQ ID NO: 35401 - DNA, 75 bp, Artificial Sequence
  Synthetic
catcaagaatggctatctcaacatcactgttgattgttgcccttctaatcaagttgtgtttggtcaacactgctc

SEQ ID NO: 35402 - DNA, 75 bp, Artificial Sequence
  Synthetic
tgggattctgatagcagaactaaagagctcatctggaatatcagaattttgtataaaggatgatatatctatcct

SEQ ID NO: 35403 - DNA, 75 bp, Artificial Sequence
  Synthetic
agctcatctggaatatcagaattttgtataaaggatgatatatctatcctgaaatcagaaatcacttactcaaaa

SEQ ID NO: 35404 - DNA, 75 bp, Artificial Sequence
  Synthetic
gtaaggtatttagacattggactgtagcagactggaaacaatgcaaccatacttctgctggtggtagcactaatg

SEQ ID NO: 35405 - DNA, 75 bp, Artificial Sequence
  Synthetic
agcagactggaaacaatgcaaccatacttctgctggtggtagcactaatgtgctagaagttgataaaaatttaaa

SEQ ID NO: 35406 - DNA, 75 bp, Artificial Sequence
  Synthetic
acaaggccatgtgtcataacaattgataaggagaatgctcaacttttgttccagacagagcaattgaatcaattt

SEQ ID NO: 35407 - DNA, 75 bp, Artificial Sequence
  Synthetic
ataaggagaatgctcaacttttgttccagacagagcaattgaatcaatttgaagtaacaggcacaactataagca

SEQ ID NO: 35408 - DNA, 75 bp, Artificial Sequence
  Synthetic
ggtctcactagacaacacatgtgaacatataaaggtaacttgtggaaaaaagagcctacaatttcatgcatgctt

SEQ ID NO: 35409 - DNA, 75 bp, Artificial Sequence
  Synthetic
catataaaggtaacttgtggaaaaaagagcctacaatttcatgcatgcttcaaacaacatatgtcttgtgttcgc

SEQ ID NO: 35410 - DNA, 75 bp, Artificial Sequence
  Synthetic
ggtacatggcaagttccatatgtcaaaatatagagctcataattattattattttaacgctggcaatatttatat

SEQ ID NO: 35411 - DNA, 75 bp, Artificial Sequence
  Synthetic
aaatatagagctcataattattattattttaacgctggcaatatttatattcatgtgcattattacaagaacata

SEQ ID NO: 35412 - DNA, 75 bp, Artificial Sequence
  Synthetic
tttgcccccattgcatatctatacggttggctgtacaacaggagctgcaaaaaatgcatatgttgtgggcttgct

SEQ ID NO: 35413 - DNA, 75 bp, Artificial Sequence
  Synthetic
gttggctgtacaacaggagctgcaaaaaatgcatatgttgtgggcttgcttatcacccattcacaaattgtggct

SEQ ID NO: 35414 - DNA, 75 bp, Artificial Sequence
  Synthetic
tgaaacatctgatagaatgcgactacatagggaatcggggttgtgtcaaggattcaaatcactcagagtcgccag

SEQ ID NO: 35415 - DNA, 75 bp, Artificial Sequence
  Synthetic
catagggaatcggggttgtgtcaaggattcaaatcactcagagtcgccagatcactatgcaaatctaagggctct

SEQ ID NO: 35416 - DNA, 75 bp, Artificial Sequence
  Synthetic
ctatgttaatattgtcatttataacaccactcgaagcaatgaccacgaactaccctgatgataaaaaatttacac

SEQ ID NO: 35417 - DNA, 75 bp, Artificial Sequence
  Synthetic
accactcgaagcaatgaccacgaactaccctgatgataaaaaatttacacttaaagaagtaaatgatattgtcct

SEQ ID NO: 35418 - DNA, 75 bp, Artificial Sequence
  Synthetic
aaatcttcgatattgattttaatgtccatatgtggaatagggattatactgatattcttcggcttaactgtactc

SEQ ID NO: 35419 - DNA, 75 bp, Artificial Sequence
  Synthetic
ccatatgtggaatagggattatactgatattcttcggcttaactgtactcttggagattgtactagagctaattg

SEQ ID NO: 35420 - DNA, 75 bp, Artificial Sequence
  Synthetic
agaatgcaacttaatacacgacaagaaatcaatgacatacaggggcgattttactaataaatgcggtttttgccc

SEQ ID NO: 35421 - DNA, 75 bp, Artificial Sequence
  Synthetic
aaatcaatgacatacaggggcgattttactaataaatgcggtttttgcccatgtggagaattagaggacccagag

SEQ ID NO: 35422 - DNA, 75 bp, Artificial Sequence
  Synthetic
aatcatgtacatattatatcaagataaggaatcttaaactaataatgctaatcttctcaattgtaattttgatgc

SEQ ID NO: 35423 - DNA, 75 bp, Artificial Sequence
  Synthetic
aaggaatcttaaactaataatgctaatcttctcaattgtaattttgatgcaaaatgcaactatgcttgtagttgc

SEQ ID NO: 35424 - DNA, 75 bp, Artificial Sequence
  Synthetic
gagattaaagctgactgtgttgggcctttgatagggccatcagcatgcacaaacaaaggctcaaaaacatacaag

SEQ ID NO: 35425 - DNA, 75 bp, Artificial Sequence
  Synthetic
ctttgatagggccatcagcatgcacaaacaaaggctcaaaaacatacaagacagtcgcacaagaattagtgactg

SEQ ID NO: 35426 - DNA, 75 bp, Artificial Sequence
  Synthetic
tgataaatatgtcttgctaggagatactatagaaagtgccctggatgctataacaagccaaaaacattactcggc

SEQ ID NO: 35427 - DNA, 75 bp, Artificial Sequence
  Synthetic
actatagaaagtgccctggatgctataacaagccaaaaacattactcggcaatgcacctattagagacaatgttc

SEQ ID NO: 35428 - DNA, 75 bp, Artificial Sequence
  Synthetic
aagtgtatgaacacaatagtggctactcacaaacaaagtggagactaattgcaatagcaaatagtttcgatatat

SEQ ID NO: 35429 - DNA, 75 bp, Artificial Sequence
  Synthetic
ctcacaaacaaagtggagactaattgcaatagcaaatagtttcgatatatgtactaatacaccaacaccaaactt

SEQ ID NO: 35430 - DNA, 75 bp, Artificial Sequence
  Synthetic
tgctcaacaactacgctaaactttgccacatcaatgaatgccacatatacgagcaaggtagaattctttaaccat

SEQ ID NO: 35431 - DNA, 75 bp, Artificial Sequence
  Synthetic
ccacatcaatgaatgccacatatacgagcaaggtagaattctttaaccatgacttcacacttttcctggacattt

SEQ ID NO: 35432 - DNA, 75 bp, Artificial Sequence
  Synthetic
tactgcattcctttttaaaaagattaaagaaaagaacccataccaggcatttgaaatgatggggaaaatcgctaa

SEQ ID NO: 35433 - DNA, 75 bp, Artificial Sequence
  Synthetic
aaagaaaagaacccataccaggcatttgaaatgatggggaaaatcgctaataaatatccaaacaataagctattg

SEQ ID NO: 35434 - DNA, 75 bp, Artificial Sequence
  Synthetic
atatggttggcctgagccatgcatctacatatcaattgaaacaagaatgggttgccaaatcactgagcttaacta

SEQ ID NO: 35435 - DNA, 75 bp, Artificial Sequence
  Synthetic
tacatatcaattgaaacaagaatgggttgccaaatcactgagcttaactagagcacagagaactggcctaaaaat

SEQ ID NO: 35436 - DNA, 75 bp, Artificial Sequence
  Synthetic
cctgccactaaagaatgttcagatgcaaagacaattgcttgcttgaccccaaagttccaagtagaagtcaataat

SEQ ID NO: 35437 - DNA, 75 bp, Artificial Sequence
  Synthetic
caaagacaattgcttgcttgaccccaaagttccaagtagaagtcaataatctcatgagctgtggtgcatcaccaa

SEQ ID NO: 35438 - DNA, 75 bp, Artificial Sequence
  Synthetic
tgaattgtacaaggctcatgataggaattctgtatggtgtttaaatgatatgcattgtctaaccccttacacacc

SEQ ID NO: 35439 - DNA, 75 bp, Artificial Sequence
  Synthetic
aattctgtatggtgtttaaatgatatgcattgtctaaccccttacacaccagcaaatgcagaaataattacgacc

SEQ ID NO: 35440 - DNA, 75 bp, Artificial Sequence
  Synthetic
acaacccgaaacaacctacagatgaatatgctatccctaagaggagctgccagatgaaagacaggggcttatgca

SEQ ID NO: 35441 - DNA, 75 bp, Artificial Sequence
  Synthetic
atatgctatccctaagaggagctgccagatgaaagacaggggcttatgcaactcaggtgcagacaaatggaagat

SEQ ID NO: 35442 - DNA, 75 bp, Artificial Sequence
  Synthetic
ttctatacagatgcactagagagacgtgatccagctagcatagtgggttccaatcactgcttctcagaaaaatgc

SEQ ID NO: 35443 - DNA, 75 bp, Artificial Sequence
  Synthetic
gtgatccagctagcatagtgggttccaatcactgcttctcagaaaaatgccaaatagagaggtacccaatcaacc

SEQ ID NO: 35444 - DNA, 75 bp, Artificial Sequence
  Synthetic
gttgtacagggctgttaggcccgaatacattaaaaaactctctttgcaaactattgaggaatataaaaaagctat

SEQ ID NO: 35445 - DNA, 75 bp, Artificial Sequence
  Synthetic
tacattaaaaaactctctttgcaaactattgaggaatataaaaaagctattgcagataaactaacacatacactg

SEQ ID NO: 35446 - DNA, 75 bp, Artificial Sequence
  Synthetic
tagagaacctgccacacataaaaccaacgtataagtatatcacagcacaaggaacatatacagcagatggtatag

SEQ ID NO: 35447 - DNA, 75 bp, Artificial Sequence
  Synthetic
aacgtataagtatatcacagcacaaggaacatatacagcagatggtatagagggtgctagtatcacaacttcgat

SEQ ID NO: 35448 - DNA, 75 bp, Artificial Sequence
  Synthetic
ggattcaaaataaatgctaaggatggaactgaccttctagacattgttgtttacataaaggcttcagttgtcaaa

SEQ ID NO: 35449 - DNA, 75 bp, Artificial Sequence
  Synthetic
gaactgaccttctagacattgttgtttacataaaggcttcagttgtcaaaagtatttacaaccatatatatgaca

SEQ ID NO: 35450 - DNA, 75 bp, Artificial Sequence
  Synthetic
aaaacatgatgagctatgcactggtcaatgcccaaaaaagatacctgctgacccaaattggcttacattttctca

SEQ ID NO: 35451 - DNA, 75 bp, Artificial Sequence
  Synthetic
caatgcccaaaaaagatacctgctgacccaaattggcttacattttctcaggagagaactagcagatggggctgc

SEQ ID NO: 35452 - DNA, 75 bp, Artificial Sequence
  Synthetic
atactggatgtgtttatgggtcatgtcaggatgtgattaggacagaaacaaaagtatacaggaaagcaaatgagg

SEQ ID NO: 35453 - DNA, 75 bp, Artificial Sequence
  Synthetic
tcaggatgtgattaggacagaaacaaaagtatacaggaaagcaaatgaggaaactgtcatgctaacagtgtgcat

SEQ ID NO: 35454 - DNA, 75 bp, Artificial Sequence
  Synthetic
actgatgtaaatgcccatgaaccaaaaataacagatgaattagaattacagttcaagacaattgatatcaagagt

SEQ ID NO: 35455 - DNA, 75 bp, Artificial Sequence
  Synthetic
aaataacagatgaattagaattacagttcaagacaattgatatcaagagtttaccgaacctagtagcagtcacta

SEQ ID NO: 35456 - DNA, 75 bp, Artificial Sequence
  Synthetic
taacgatttaggtacatttggacaaatgtgtggcaatgtacaaaagaccaacacaagccacactggtgcaggaac

SEQ ID NO: 35457 - DNA, 75 bp, Artificial Sequence
  Synthetic
atgtgtggcaatgtacaaaagaccaacacaagccacactggtgcaggaacaccaaagtttgactacacttgttat

SEQ ID NO: 35458 - DNA, 75 bp, Artificial Sequence
  Synthetic
tcaggagatgttataataataattatgactcatgtaggcttttaaatcaagagagtgatctcttattcgacgaca

SEQ ID NO: 35459 - DNA, 75 bp, Artificial Sequence
  Synthetic
tgactcatgtaggcttttaaatcaagagagtgatctcttattcgacgacaatcatgaaactttggttgtatataa

SEQ ID NO: 35460 - DNA, 75 bp, Artificial Sequence
  Synthetic
gctctcaagttattgcttggagatattcaatacaaactttatacagaaaacatggagctagagttggaagctaag

SEQ ID NO: 35461 - DNA, 75 bp, Artificial Sequence
  Synthetic
ttcaatacaaactttatacagaaaacatggagctagagttggaagctaagtgtgttggttgtgtagggtgctttg

SEQ ID NO: 35462 - DNA, 75 bp, Artificial Sequence
  Synthetic
aacatcaagcctagacgaaactgcgctatatctggtccctgtgagccactttcatgataggattcaaattaaaac

SEQ ID NO: 35463 - DNA, 75 bp, Artificial Sequence
  Synthetic
ctatatctggtccctgtgagccactttcatgataggattcaaattaaaactacaaagaaagattacgctatgaaa

SEQ ID NO: 35464 - DNA, 75 bp, Artificial Sequence
  Synthetic
ataaagcatcattcagagtgtgtgggaagagttatgactttaattttcatacagtaccaaagaatgacaaaatag

SEQ ID NO: 35465 - DNA, 75 bp, Artificial Sequence
  Synthetic
gaagagttatgactttaattttcatacagtaccaaagaatgacaaaatagaagttaatgttggggatgagacatc

SEQ ID NO: 35466 - DNA, 75 bp, Artificial Sequence
  Synthetic
tgtgggagatggttatgtagagttcgagatgagggattgagtgttatatttgaaccattaaacaatttctttggg

SEQ ID NO: 35467 - DNA, 75 bp, Artificial Sequence
  Synthetic
gagatgagggattgagtgttatatttgaaccattaaacaatttctttgggaattacctcaatatgtttttatata

SEQ ID NO: 35468 - DNA, 75 bp, Artificial Sequence
  Synthetic
tctggccctctatatactgatgcccatgtgtgctagattgagggatgagctaaagagaaatgaaaggctacatca

SEQ ID NO: 35469 - DNA, 75 bp, Artificial Sequence
  Synthetic
atgtgtgctagattgagggatgagctaaagagaaatgaaaggctacatcagatggaaatgaagaagagataaatt

SEQ ID NO: 35470 - DNA, 75 bp, Artificial Sequence
  Synthetic
gaactataaaagttaaaataaaaacaataaaataaataaaaatacaaaaacaaattaaataagcagcttagaaat

SEQ ID NO: 35471 - DNA, 75 bp, Artificial Sequence
  Synthetic
caaattaaataagcagcttagaaatttctatgaattacagctgctgtgttgttatgtgtttgcttttatcggtag

SEQ ID NO: 35472 - DNA, 75 bp, Artificial Sequence
  Synthetic
agtagtgtactccacactacacacttgctattgctgaaaattattatgacatctattccaatagaagatcatctt

SEQ ID NO: 35473 - DNA, 75 bp, Artificial Sequence
  Synthetic
agaaaactaatgttagtgctgcagctagagacttccttgctaaatttggaatcaacatgtaagcagaaaaacaat

SEQ ID NO: 35474 - DNA, 75 bp, Artificial Sequence
  Synthetic
aaaatttggctaaaagggttggttcaacccgcaaaataacaggttattgggtgggtggttggggacaggaaaaca

SEQ ID NO: 35475 - DNA, 75 bp, Artificial Sequence
  Synthetic
gtgggtggttggggacaggaaaacagccagcttccccttccataacttcttccatgtctcccgaggttaaagtgg

SEQ ID NO: 35476 - DNA, 75 bp, Artificial Sequence
  Synthetic
tttcatcatgtcgctgctaacaccagcagtacttttgacccagaggtcgcatatgctaactttaagcgtatccac

SEQ ID NO: 35477 - DNA, 75 bp, Artificial Sequence
  Synthetic
agaaattgattattaagacaaaaataataaatccattggctgaaaaaaatggcatcacatggaaagacggagaag

SEQ ID NO: 35478 - DNA, 75 bp, Artificial Sequence
  Synthetic
aataaatccattggctgaaaaaaatggcatcacatggaaagacggagaagaagtttacttatctttcttcccggg

SEQ ID NO: 35479 - DNA, 75 bp, Artificial Sequence
  Synthetic
aaattctacccacttgcaatcggcatctacaaggttcaaaagaaggaaatggatccaaaatatctggaaaagaca

SEQ ID NO: 35480 - DNA, 75 bp, Artificial Sequence
  Synthetic
tctacaaggttcaaaagaaggaaatggatccaaaatatctggaaaagacaatgcggcagcgctatatggggttag

SEQ ID NO: 35481 - DNA, 75 bp, Artificial Sequence
  Synthetic
agtctcagaagttcagagtgctttaacagttgtctcaagcttaggctggaagaaaaccaacgttactgctgcagc

SEQ ID NO: 35482 - DNA, 75 bp, Artificial Sequence
  Synthetic
acagttgtctcaagcttaggctggaagaaaaccaacgttactgctgcagctcgggacttctttgctaaattcgga

SEQ ID NO: 35483 - DNA, 75 bp, Artificial Sequence
  Synthetic
ttgaatctggctaaaaatttctactttaaattggcaaaaagggcaatagcaaccacaacaatagcagctgcttgg

SEQ ID NO: 35484 - DNA, 75 bp, Artificial Sequence
  Synthetic
aagatttaaagaaagcctttctatccaaaacccagcacaattatttatcgagcagatactgttttcccataaacc

SEQ ID NO: 35485 - DNA, 75 bp, Artificial Sequence
  Synthetic
agtagtgtactccacactaataacttgcaaactttgacaaacttgagaatatctgaacatagcttggtctttcaa

SEQ ID NO: 35486 - DNA, 75 bp, Artificial Sequence
  Synthetic
tagttatgaccacattcgaatcttctacattaaaggacgtgagattaaaactagtctcacaaagagaagtgaatg

SEQ ID NO: 35487 - DNA, 75 bp, Artificial Sequence
  Synthetic
cacagactcagtggattccttgccaggtacttacttgagaagatactgaaagtgagcgaaccagaaaaacttata

SEQ ID NO: 35488 - DNA, 75 bp, Artificial Sequence
  Synthetic
ttgcagaaaaaaatggcataacttggacagatggagaggaggtttacctgtctttcttccctggctcagagatgt

SEQ ID NO: 35489 - DNA, 75 bp, Artificial Sequence
  Synthetic
gacagatggagaggaggtttacctgtctttcttccctggctcagagatgtttttaggaacattcaaattttaccc

SEQ ID NO: 35490 - DNA, 75 bp, Artificial Sequence
  Synthetic
cagaggaaggagatggaaccaaaatatctggaaaaaacaatgcgccagagatacatgggccttgaggcttctact

SEQ ID NO: 35491 - DNA, 75 bp, Artificial Sequence
  Synthetic
atctggaaaaaacaatgcgccagagatacatgggccttgaggcttctacttggaccatcagcaaagtcaatgaag

SEQ ID NO: 35492 - DNA, 75 bp, Artificial Sequence
  Synthetic
tggattgggatggaagaaaactaacgtcagtgctgcagccagagaattcctggctaaatttggaattaacatgta

SEQ ID NO: 35493 - DNA, 75 bp, Artificial Sequence
  Synthetic
gtcagtgctgcagccagagaattcctggctaaatttggaattaacatgtaatcaggccaggaaaattaaatcagg

SEQ ID NO: 35494 - DNA, 75 bp, Artificial Sequence
  Synthetic
aagagtcttcggactcaaaataaacagcattttgggtgggtggttggggacagaaatatttcagcatacattgtg

SEQ ID NO: 35495 - DNA, 75 bp, Artificial Sequence
  Synthetic
agcattttgggtgggtggttggggacagaaatatttcagcatacattgtgataaatcatgatatttattttaagt

SEQ ID NO: 35496 - DNA, 75 bp, Artificial Sequence
  Synthetic
agtagtgtactccacgctacaaacttgccattgctgagaattacactgctattgaatccaacaaaaagtcattca

SEQ ID NO: 35497 - DNA, 75 bp, Artificial Sequence
  Synthetic
ggaacaacccagttcctgacgatggtcttaccctccacagactcagtggattccttgccaggtacctacttgaga

SEQ ID NO: 35498 - DNA, 75 bp, Artificial Sequence
  Synthetic
tcttaccctccacagactcagtggattccttgccaggtacctacttgagaaaatgctgaaggtgagtgaaccaga

SEQ ID NO: 35499 - DNA, 75 bp, Artificial Sequence
  Synthetic
atcaacccattggcagaaaaaaatggaataacctggactgatggagaggaagtttacctctcctttttcccagga

SEQ ID NO: 35500 - DNA, 75 bp, Artificial Sequence
  Synthetic
gaataacctggactgatggagaggaagtttacctctcctttttcccaggagctgaaatgttcttagggaccttta

SEQ ID NO: 35501 - DNA, 75 bp, Artificial Sequence
  Synthetic
ctacaaagtccagcgtaaagagatggagcctaaatacctggaaaaaacaatgaggcaaaggtacatgggcttgga

SEQ ID NO: 35502 - DNA, 75 bp, Artificial Sequence
  Synthetic
gagcctaaatacctggaaaaaacaatgaggcaaaggtacatgggcttggaagcagcaacttggactgttagcaag

SEQ ID NO: 35503 - DNA, 75 bp, Artificial Sequence
  Synthetic
cagttgtttcaggcttaggatggaagaaaactaacgtcagtgcagcagctcgagatttccttgctaagtttggaa

SEQ ID NO: 35504 - DNA, 75 bp, Artificial Sequence
  Synthetic
gaaaactaacgtcagtgcagcagctcgagatttccttgctaagtttggaatcagcatgtaagcaaggattcattt

SEQ ID NO: 35505 - DNA, 75 bp, Artificial Sequence
  Synthetic
caatttggctaaaagggttgtatcaacccacaaataacagcatgatgggtgggtggttggggacagaaagacagc

SEQ ID NO: 35506 - DNA, 75 bp, Artificial Sequence
  Synthetic
gggtggttggggacagaaagacagcggcaaaaatcattatgcgtcattattggtattataagttttaggtggagc

SEQ ID NO: 35507 - DNA, 75 bp, Artificial Sequence
  Synthetic
cttcttgtcttattaatcccctgctatgtatcagcctctcctgtagtaacaagatgcttccatggagggcaattg

SEQ ID NO: 35508 - DNA, 75 bp, Artificial Sequence
  Synthetic
ctgtatcagaattttgcctgaaagatgatgtctctactattaagtcagaaataacatatgagaagaacaacactg

SEQ ID NO: 35509 - DNA, 75 bp, Artificial Sequence
  Synthetic
tgatgtctctactattaagtcagaaataacatatgagaagaacaacactggtttatttgcccatagcaaagtttt

SEQ ID NO: 35510 - DNA, 75 bp, Artificial Sequence
  Synthetic
aaaaattgcaaccctgttcccacagcagggggcagcataaatgttatagaagtcaatacagatctgagcttgacc

SEQ ID NO: 35511 - DNA, 75 bp, Artificial Sequence
  Synthetic
cagggggcagcataaatgttatagaagtcaatacagatctgagcttgaccacaaaaacatatgtgtgtagcagag

SEQ ID NO: 35512 - DNA, 75 bp, Artificial Sequence
  Synthetic
ggatgctcagataattttccaaaccgagaagttgaaccatttcgaggtctctgggactacattaagctcaggctg

SEQ ID NO: 35513 - DNA, 75 bp, Artificial Sequence
  Synthetic
ttggacaggacttgtgaacatattaaagtaacatgtgggaaaaagactctgcaattccatgcttgctttaagcac

SEQ ID NO: 35514 - DNA, 75 bp, Artificial Sequence
  Synthetic
atggcactattcttcctggaacaatggctacttccatttgtcaaaatatagaactcataattataataagtctga

SEQ ID NO: 35515 - DNA, 75 bp, Artificial Sequence
  Synthetic
ggctacttccatttgtcaaaatatagaactcataattataataagtctgacattgattatctttatcctgatgat

SEQ ID NO: 35516 - DNA, 75 bp, Artificial Sequence
  Synthetic
tatctattgatgccactatttatgccgattgcatacttttatggttggtcatataacaaaagctgcaaaaaatgc

SEQ ID NO: 35517 - DNA, 75 bp, Artificial Sequence
  Synthetic
cgattgcatacttttatggttggtcatataacaaaagctgcaaaaaatgctcatgctgtggtctagcttatcacc

SEQ ID NO: 35518 - DNA, 75 bp, Artificial Sequence
  Synthetic
tgtatgcgggttaaaatttgaagcgtcagataggatgagaatacacagagaatccggattatgtcaaggttataa

SEQ ID NO: 35519 - DNA, 75 bp, Artificial Sequence
  Synthetic
tcagataggatgagaatacacagagaatccggattatgtcaaggttataagagtctacgtgtggctagattgttg

SEQ ID NO: 35520 - DNA, 75 bp, Artificial Sequence
  Synthetic
taatctcaatattattatctatgttgatactaagctttgtcacaccaatagaggggacattaactaactacccag

SEQ ID NO: 35521 - DNA, 75 bp, Artificial Sequence
  Synthetic
gatactaagctttgtcacaccaatagaggggacattaactaactacccagaatcaaggaagtatgatctggagga

SEQ ID NO: 35522 - DNA, 75 bp, Artificial Sequence
  Synthetic
attgtagaaaaagggataaaagaatacgtagttttttatacttctatttttggggctttactcttactaatagca

SEQ ID NO: 35523 - DNA, 75 bp, Artificial Sequence
  Synthetic
ttagttatcacaataacactaaataaggttacagagtatctcacaaacatcaatgttctatactgttatgaatgt

SEQ ID NO: 35524 - DNA, 75 bp, Artificial Sequence
  Synthetic
taaaatatattggggattttacaaataaatgtggcttttgcacatgtggagagttggaagatcaagaaggtttaa

SEQ ID NO: 35525 - DNA, 75 bp, Artificial Sequence
  Synthetic
gagttggaagatcaagaaggtttaaaaatacataaagttagcagaaagtgcatatataaatatcaactaacctgg

SEQ ID NO: 35526 - DNA, 75 bp, Artificial Sequence
  Synthetic
aaatacataaagttagcagaaagtgcatatataaatatcaactaacctggtctaaaataatcatgacaatactag

SEQ ID NO: 35527 - DNA, 75 bp, Artificial Sequence
  Synthetic
catcctaatagtcgcagcatcggatgattgctggacaaaaaaatctttagagatggaatgtataggccctttaca

SEQ ID NO: 35528 - DNA, 75 bp, Artificial Sequence
  Synthetic
gattgctggacaaaaaaatctttagagatggaatgtataggccctttacagcaagtggatacatgcgacgataaa

SEQ ID NO: 35529 - DNA, 75 bp, Artificial Sequence
  Synthetic
gcaagcagatcttatagtggggaggcaagaaagctagtgagagcatctaaaatatcggacctggatgcagcacag

SEQ ID NO: 35530 - DNA, 75 bp, Artificial Sequence
  Synthetic
caagaaagctagtgagagcatctaaaatatcggacctggatgcagcacaggtggggctattaggatctacgatag

SEQ ID NO: 35531 - DNA, 75 bp, Artificial Sequence
  Synthetic
ctccttgaatcagtattcctgggaaagcattgtgattactataaaactttcgaacataatagtggctactcacag

SEQ ID NO: 35532 - DNA, 75 bp, Artificial Sequence
  Synthetic
cacatcattttgatatttgctcaagacatagcacccatcatttctgtagatgtatctcagatgggacaaagtgtc

SEQ ID NO: 35533 - DNA, 75 bp, Artificial Sequence
  Synthetic
acatagcacccatcatttctgtagatgtatctcagatgggacaaagtgtcaaaatggggatttggactttgcagg

SEQ ID NO: 35534 - DNA, 75 bp, Artificial Sequence
  Synthetic
aaaaaggatttttttgagcacgacttcaagctattctgcactcttgtagaaaatgcttttccaggcacaacagag

SEQ ID NO: 35535 - DNA, 75 bp, Artificial Sequence
  Synthetic
tcaagctattctgcactcttgtagaaaatgcttttccaggcacaacagagtcacttttttatgaaatgttgtcta

SEQ ID NO: 35536 - DNA, 75 bp, Artificial Sequence
  Synthetic
gctattagataaattaacaagaaaatttgggaataacaatatgtttgtagggatatggaaatttggacagtatct

SEQ ID NO: 35537 - DNA, 75 bp, Artificial Sequence
  Synthetic
tttgggaataacaatatgtttgtagggatatggaaatttggacagtatctaatgtcactgccatatattaatgaa

SEQ ID NO: 35538 - DNA, 75 bp, Artificial Sequence
  Synthetic
ctaaaatactagaggttacagaccagcaccatcggtctatatctggaaggcaagaatcattggctagtgctaccc

SEQ ID NO: 35539 - DNA, 75 bp, Artificial Sequence
  Synthetic
gcaccatcggtctatatctggaaggcaagaatcattggctagtgctacccctgggagtaagtccaaggaatgtgg

SEQ ID NO: 35540 - DNA, 75 bp, Artificial Sequence
  Synthetic
agtcccaggtttagtgttccgatggaaggattaatggcatgtggggactcaccaaattacaaaatttataaaaca

SEQ ID NO: 35541 - DNA, 75 bp, Artificial Sequence
  Synthetic
aaggattaatggcatgtggggactcaccaaattacaaaatttataaaacaccaacaaagctttataaatcaaaca

SEQ ID NO: 35542 - DNA, 75 bp, Artificial Sequence
  Synthetic
tgatgtccattgttctcaggagctaagcccagcatcacaagaatctgttgacaggataaaacaaattacttgctt

SEQ ID NO: 35543 - DNA, 75 bp, Artificial Sequence
  Synthetic
tctgacagaacctgaagtaagtgatgacgttttttcaattgcaatatctacgtgcaaagttcaagataagggggt

SEQ ID NO: 35544 - DNA, 75 bp, Artificial Sequence
  Synthetic
aacgtaataaaatgtgatagtgggctgatatattatactgaccagagagatgggcaggatacaggcaatgatttc

SEQ ID NO: 35545 - DNA, 75 bp, Artificial Sequence
  Synthetic
tgatatattatactgaccagagagatgggcaggatacaggcaatgatttcggagagtattgtttgtcccatagct

SEQ ID NO: 35546 - DNA, 75 bp, Artificial Sequence
  Synthetic
cccggcaataattagggactgtttatgggagtaccattcgcggaaatccaaatatatcaccagcttggacttaga

SEQ ID NO: 35547 - DNA, 75 bp, Artificial Sequence
  Synthetic
tgggagtaccattcgcggaaatccaaatatatcaccagcttggacttagagaatctagaagaattcaaaagggct

SEQ ID NO: 35548 - DNA, 75 bp, Artificial Sequence
  Synthetic
ttatagtttataatttcaaaccaacagctaatcttccccatataaagccggtgtacaaatatatcacagtgcaag

SEQ ID NO: 35549 - DNA, 75 bp, Artificial Sequence
  Synthetic
ttcagcatatatagctgctagtatgccagctttgagcggaacaagtataggatataatataatgtctagagataa

SEQ ID NO: 35550 - DNA, 75 bp, Artificial Sequence
  Synthetic
ccagctttgagcggaacaagtataggatataatataatgtctagagataatttcccattatttgatataattata

SEQ ID NO: 35551 - DNA, 75 bp, Artificial Sequence
  Synthetic
caacttacaatcatatatatgacacaggccccactataggaattaatgtaatgcatgatgaacattgcacagggc

SEQ ID NO: 35552 - DNA, 75 bp, Artificial Sequence
  Synthetic
agaaaattggattacatttgctcaagagagaactagtcgttggggatgcgaagaatttgggtgccttgctgtaaa

SEQ ID NO: 35553 - DNA, 75 bp, Artificial Sequence
  Synthetic
gagagaactagtcgttggggatgcgaagaatttgggtgccttgctgtaaatacaggctgtgtttttggttcttgt

SEQ ID NO: 35554 - DNA, 75 bp, Artificial Sequence
  Synthetic
aggtgtatcgaaaagcagttgaggagagtgttttattgacagtatgtataacttacccaggcaaaacattctgca

SEQ ID NO: 35555 - DNA, 75 bp, Artificial Sequence
  Synthetic
aatcacagatgagttagaattacagttcaaaacagttgatacaaaaacattacccaatatcttagctgtccaaaa

SEQ ID NO: 35556 - DNA, 75 bp, Artificial Sequence
  Synthetic
ttcaaaacagttgatacaaaaacattacccaatatcttagctgtccaaaaccataagttatatagtggacaaatt

SEQ ID NO: 35557 - DNA, 75 bp, Artificial Sequence
  Synthetic
gctgtggcaacatacagagaaccaattcatctattataggcacaggtactgcaaagtttgattatgtttgtcatg

SEQ ID NO: 35558 - DNA, 75 bp, Artificial Sequence
  Synthetic
ttcatctattataggcacaggtactgcaaagtttgattatgtttgtcatggtgcttccaggaaagatatcattgt

SEQ ID NO: 35559 - DNA, 75 bp, Artificial Sequence
  Synthetic
gagtcatgcaaattattgaaggaggaacaatctttaatgttcgcagataaccatgaaactattgacgtagctaat

SEQ ID NO: 35560 - DNA, 75 bp, Artificial Sequence
  Synthetic
aacaatctttaatgttcgcagataaccatgaaactattgacgtagctaatgtcagacatctccttggagatctgc

SEQ ID NO: 35561 - DNA, 75 bp, Artificial Sequence
  Synthetic
aaggtataagtcatttgctgaaaacccagatttagaaatagaggcaaagtgtgttgggtgcccatcatgttttac

SEQ ID NO: 35562 - DNA, 75 bp, Artificial Sequence
  Synthetic
ccagatttagaaatagaggcaaagtgtgttgggtgcccatcatgttttactagttactcctgcagcttcaagatt

SEQ ID NO: 35563 - DNA, 75 bp, Artificial Sequence
  Synthetic
caattgaagggccttgtacgacttttcataatagattaatgattacctctacaaaacaagattatggcatcaaaa

SEQ ID NO: 35564 - DNA, 75 bp, Artificial Sequence
  Synthetic
tcataatagattaatgattacctctacaaaacaagattatggcatcaaaatgagctgtaaaacaaaaccaaaaga

SEQ ID NO: 35565 - DNA, 75 bp, Artificial Sequence
  Synthetic
aaaacttacacagtattgttcacaacagttgagaaaaatgataaaatcgaaataagcacaggggatcaaacatcc

SEQ ID NO: 35566 - DNA, 75 bp, Artificial Sequence
  Synthetic
tttatccaagagagggatgatagatgcaaaacatggttatgcagagttagggatgaagggatcagtgttattttt

SEQ ID NO: 35567 - DNA, 75 bp, Artificial Sequence
  Synthetic
agtgatcagtattattgtcctatttctagcaatctacatcttcttgcctatggtgttcaaacttagagatgtgtt

SEQ ID NO: 35568 - DNA, 75 bp, Artificial Sequence
  Synthetic
caggaaataaagcataaataattttctaagaaatcatcattttagtttttaaagaaattttatatattagcctta

SEQ ID NO: 35569 - DNA, 75 bp, Artificial Sequence
  Synthetic
ctaagaaatcatcattttagtttttaaagaaattttatatattagccttagggcaaattagctgttattatatcg

SEQ ID NO: 35570 - DNA, 75 bp, Artificial Sequence
  Synthetic
ttacatatcagatatctataattggagaagagttcaaacaaagattcccaaatatacccatacaattagatttta

SEQ ID NO: 35571 - DNA, 75 bp, Artificial Sequence
  Synthetic
cacataagatttttatgctaaagggagactatatgagaccaacgcaagctgagatcgataagggttgggagctaa

SEQ ID NO: 35572 - DNA, 75 bp, Artificial Sequence
  Synthetic
gataaattgacttcacttgcagaggcagacatcattgaggagttaccggagatcattggaagagttacatttcct

SEQ ID NO: 35573 - DNA, 75 bp, Artificial Sequence
  Synthetic
caacatagacaatcctcctaagcatttaatagggaacgaaatcctaatttatagaatcagagagatgaccaaact

SEQ ID NO: 35574 - DNA, 75 bp, Artificial Sequence
  Synthetic
ggaaataaacttttaaattctagacatggattaaaatttgaatatatggaagaaatcattctagatgaaaaatat

SEQ ID NO: 35575 - DNA, 75 bp, Artificial Sequence
  Synthetic
agaaggaataatgaaggattacaatccagaggccctagatataacaaaatggttcctgtctgtccagttgtttta

SEQ ID NO: 35576 - DNA, 75 bp, Artificial Sequence
  Synthetic
tccaaaagccactatgtggcaaaaatgatgacagcatttttaaaaagtacaattttcttatgtaggagcacacta

SEQ ID NO: 35577 - DNA, 75 bp, Artificial Sequence
  Synthetic
agtagtgtactccacactacaaacttgctattgttgaaaatcgctgtgctattaaatctaacagaaggtcattaa

SEQ ID NO: 35578 - DNA, 75 bp, Artificial Sequence
  Synthetic
atgctattcctgctcatactagcctttttagggttctcaacaagcaaccctattgcaactaggtgtttccatggg

SEQ ID NO: 35579 - DNA, 75 bp, Artificial Sequence
  Synthetic
ttttagggttctcaacaagcaaccctattgcaactaggtgtttccatgggggccaattaatagcagagtcaaagt

SEQ ID NO: 35580 - DNA, 75 bp, Artificial Sequence
  Synthetic
tattgcaactaggtgtttccatgggggccaattaatagcagagtcaaagtctgctacatctatatcagaattctg

SEQ ID NO: 35581 - DNA, 75 bp, Artificial Sequence
  Synthetic
aaatctgaagtggtatacataaagaatgatactggattatttggtcataataaagtttttagaagctggacaata

SEQ ID NO: 35582 - DNA, 75 bp, Artificial Sequence
  Synthetic
atgatactggattatttggtcataataaagtttttagaagctggacaataaaagattggaaactctgcaacccta

SEQ ID NO: 35583 - DNA, 75 bp, Artificial Sequence
  Synthetic
tgtaattgaggttaacaaagatcttagtctaatgacaaagacatacatatgtagtagagattgcactataaccat

SEQ ID NO: 35584 - DNA, 75 bp, Artificial Sequence
  Synthetic
agtctaatgacaaagacatacatatgtagtagagattgcactataaccatagataaagaggaagctcagattatc

SEQ ID NO: 35585 - DNA, 75 bp, Artificial Sequence
  Synthetic
ttgaagtgtctggcactacattaagttcaggatggtttaaaagcaaggcgtctgtcaccctggatagaacctgtg

SEQ ID NO: 35586 - DNA, 75 bp, Artificial Sequence
  Synthetic
ttcaggatggtttaaaagcaaggcgtctgtcaccctggatagaacctgtgagcatgttaaggttacttgtggaaa

SEQ ID NO: 35587 - DNA, 75 bp, Artificial Sequence
  Synthetic
tttaaacaccacatgtcatgtgttaggttcttccacaataccatattacctggcaatatgataacctcaatgtgc

SEQ ID NO: 35588 - DNA, 75 bp, Artificial Sequence
  Synthetic
ggttcttccacaataccatattacctggcaatatgataacctcaatgtgccagaatatagaattaataattatct

SEQ ID NO: 35589 - DNA, 75 bp, Artificial Sequence
  Synthetic
attaatggttatgcttacaaaaacttatatatgttatttactgatgccaattttcatgccgatagcttatcttta

SEQ ID NO: 35590 - DNA, 75 bp, Artificial Sequence
  Synthetic
tatatatgttatttactgatgccaattttcatgccgatagcttatctttatggttgggcctacaataagagctgc

SEQ ID NO: 35591 - DNA, 75 bp, Artificial Sequence
  Synthetic
cataccatccatttactaattgtgggtcacattgtgtttgtggcttgaaatttgaggcatcagataggatgagaa

SEQ ID NO: 35592 - DNA, 75 bp, Artificial Sequence
  Synthetic
gtcacattgtgtttgtggcttgaaatttgaggcatcagataggatgagaatccatagagaatctggcttgtgtca

SEQ ID NO: 35593 - DNA, 75 bp, Artificial Sequence
  Synthetic
agacttttgtgtaaatctaaagggtcatctttagttatatctggattattgtccatgttaatcttaagcttcgta

SEQ ID NO: 35594 - DNA, 75 bp, Artificial Sequence
  Synthetic
catctttagttatatctggattattgtccatgttaatcttaagcttcgtaacgcctatagaggggactataacta

SEQ ID NO: 35595 - DNA, 75 bp, Artificial Sequence
  Synthetic
actggaagagataacagatgttgttgaaggactggtatctgagcagaatataaaggagtatattgttttctatac

SEQ ID NO: 35596 - DNA, 75 bp, Artificial Sequence
  Synthetic
gaaggactggtatctgagcagaatataaaggagtatattgttttctatacctcattgtttggaagtttaatacta

SEQ ID NO: 35597 - DNA, 75 bp, Artificial Sequence
  Synthetic
ctttaagcaaaataacaagcatattagcaaaaagaaatgttatttattgcgaagaatgctcaatgtatcattcaa

SEQ ID NO: 35598 - DNA, 75 bp, Artificial Sequence
  Synthetic
agcaaaaagaaatgttatttattgcgaagaatgctcaatgtatcattcaaaaagaggcataaagtacaatggtga

SEQ ID NO: 35599 - DNA, 75 bp, Artificial Sequence
  Synthetic
acatgcaatgaacaagaggatacagaaggattagtaatacataaagttagtaagagatgcacatataaataccag

SEQ ID NO: 35600 - DNA, 75 bp, Artificial Sequence
  Synthetic
aaggattagtaatacataaagttagtaagagatgcacatataaataccagctaaagtgggctaaagtgctgatga

SEQ ID NO: 35601 - DNA, 75 bp, Artificial Sequence
  Synthetic
gcaaaacactattctaattgttgcagctgaaacagattgctggacaaaaaaaagcctagatatagactgtatagg

SEQ ID NO: 35602 - DNA, 75 bp, Artificial Sequence
  Synthetic
gctgaaacagattgctggacaaaaaaaagcctagatatagactgtataggaccaatgctagatataggctcttgc

SEQ ID NO: 35603 - DNA, 75 bp, Artificial Sequence
  Synthetic
atgcagaagcacagaaattggtgagccagtctaaaataagtcaactagatgcagaccaagcatcgttgttaggca

SEQ ID NO: 35604 - DNA, 75 bp, Artificial Sequence
  Synthetic
ccagtctaaaataagtcaactagatgcagaccaagcatcgttgttaggcaactctatagatagtgctattaaggc

SEQ ID NO: 35605 - DNA, 75 bp, Artificial Sequence
  Synthetic
acaatgcacttgttggaaacaatattcttaatgaaaaattgcgattattacacgagtttcaaccataacagtggc

SEQ ID NO: 35606 - DNA, 75 bp, Artificial Sequence
  Synthetic
tcttaatgaaaaattgcgattattacacgagtttcaaccataacagtggctattcacaagccaaatggcgattga

SEQ ID NO: 35607 - DNA, 75 bp, Artificial Sequence
  Synthetic
atgctccagacatagcacccaccatttctgccaatgtataaatgatggaaccaaatgtcagaatggtgattggga

SEQ ID NO: 35608 - DNA, 75 bp, Artificial Sequence
  Synthetic
ttctgccaatgtataaatgatggaaccaaatgtcagaatggtgattgggatttcgctggtgaaatgaatgaaact

SEQ ID NO: 35609 - DNA, 75 bp, Artificial Sequence
  Synthetic
cacatgatctgaatttgttttacacaatttttgaaaatgcattcccaggaacaactgaatccttattttatcaat

SEQ ID NO: 35610 - DNA, 75 bp, Artificial Sequence
  Synthetic
aatttttgaaaatgcattcccaggaacaactgaatccttattttatcaattgatccaaaagaaaaatactacagg

SEQ ID NO: 35611 - DNA, 75 bp, Artificial Sequence
  Synthetic
ataactaaatatggtaataataacatgttcgttggaatctggaaatttggacagtacttacttacattaccatat

SEQ ID NO: 35612 - DNA, 75 bp, Artificial Sequence
  Synthetic
tgttcgttggaatctggaaatttggacagtacttacttacattaccatatataaataatactgaattgagccaga

SEQ ID NO: 35613 - DNA, 75 bp, Artificial Sequence
  Synthetic
acaagaactattaagtaggtcgcactctggcaggcaggagtctatgtccaatgcaattcagggcagtattacaaa

SEQ ID NO: 35614 - DNA, 75 bp, Artificial Sequence
  Synthetic
tctggcaggcaggagtctatgtccaatgcaattcagggcagtattacaaaagaatgccataatgcaaaaggtgtt

SEQ ID NO: 35615 - DNA, 75 bp, Artificial Sequence
  Synthetic
ttccaattggtaaccttacagcatgtggtgactcacctaattataaaatatataagactccagaaaaattgtata

SEQ ID NO: 35616 - DNA, 75 bp, Artificial Sequence
  Synthetic
tggtgactcacctaattataaaatatataagactccagaaaaattgtataaatcaaataataaaggggaagtttg

SEQ ID NO: 35617 - DNA, 75 bp, Artificial Sequence
  Synthetic
aatgattttgagcctgcagatgaagaagttgtcaataaaattaagaaactcacttgcttcttaacagacgtctca

SEQ ID NO: 35618 - DNA, 75 bp, Artificial Sequence
  Synthetic
aagttgtcaataaaattaagaaactcacttgcttcttaacagacgtctcagttgaagtagacatcttttcagtgg

SEQ ID NO: 35619 - DNA, 75 bp, Artificial Sequence
  Synthetic
caaaggcgtctgtacagtaaatggtgctaaatggaatataatcaagtgtgatagtggattatactattttacaga

SEQ ID NO: 35620 - DNA, 75 bp, Artificial Sequence
  Synthetic
gctaaatggaatataatcaagtgtgatagtggattatactattttacagaccatagagaaggccaggacacaggc

SEQ ID NO: 35621 - DNA, 75 bp, Artificial Sequence
  Synthetic
ctcacagttgcaatactgagcgattccctatcaacccagacacattaaaagattgtacttgggagttccattcca

SEQ ID NO: 35622 - DNA, 75 bp, Artificial Sequence
  Synthetic
ccctatcaacccagacacattaaaagattgtacttgggagttccattccagaaagtctaaatatatttcaaccat

SEQ ID NO: 35623 - DNA, 75 bp, Artificial Sequence
  Synthetic
aggagggcaatggcagaaaagttatcacacaccctaacaatttacaattttaaaccaacagctaaccttcctcat

SEQ ID NO: 35624 - DNA, 75 bp, Artificial Sequence
  Synthetic
cacacaccctaacaatttacaattttaaaccaacagctaaccttcctcatattaggccaacctacaaattcatta

SEQ ID NO: 35625 - DNA, 75 bp, Artificial Sequence
  Synthetic
cggtattgaatcagcatacatcttgtctagcatccctgcattaggtggaattagtgttggttataatgttcaaac

SEQ ID NO: 35626 - DNA, 75 bp, Artificial Sequence
  Synthetic
tctagcatccctgcattaggtggaattagtgttggttataatgttcaaaccaaagacaacttcccattgttggat

SEQ ID NO: 35627 - DNA, 75 bp, Artificial Sequence
  Synthetic
tcatcaggacaacatacaatcatatttatgataccgggcctactataggtataaacacacaacatgatgagcact

SEQ ID NO: 35628 - DNA, 75 bp, Artificial Sequence
  Synthetic
ttatgataccgggcctactataggtataaacacacaacatgatgagcactgtacagggccgtgcccagctgtggt

SEQ ID NO: 35629 - DNA, 75 bp, Artificial Sequence
  Synthetic
ttttctcaggaaagaacaagtagatggggatgtgaagaatttggttgcttggccatcaacacagggtgtgttttt

SEQ ID NO: 35630 - DNA, 75 bp, Artificial Sequence
  Synthetic
ggggatgtgaagaatttggttgcttggccatcaacacagggtgtgtttttggttcttgccaagatataatacatc

SEQ ID NO: 35631 - DNA, 75 bp, Artificial Sequence
  Synthetic
agtagaagaggaagttgtcttaacggtgtgcatcaattttccaggcaataattactgcactgaaataaatgccat

SEQ ID NO: 35632 - DNA, 75 bp, Artificial Sequence
  Synthetic
gtgtgcatcaattttccaggcaataattactgcactgaaataaatgccattgagcctaagataacagatgagata

SEQ ID NO: 35633 - DNA, 75 bp, Artificial Sequence
  Synthetic
caaaaaccttacccaaccttcttgcagtgcagaatcacaagctttacagtggccagataaacgatttgggctctt

SEQ ID NO: 35634 - DNA, 75 bp, Artificial Sequence
  Synthetic
agtgcagaatcacaagctttacagtggccagataaacgatttgggctctttttcacaaggttgtggaaatgtcca

SEQ ID NO: 35635 - DNA, 75 bp, Artificial Sequence
  Synthetic
atgggtacagtcaaatttgattatgtctgccacggcgctagtaggaaagatgtgatagtcaggaggtgctacaac

SEQ ID NO: 35636 - DNA, 75 bp, Artificial Sequence
  Synthetic
tctgccacggcgctagtaggaaagatgtgatagtcaggaggtgctacaacaataattttgattcatgcaaattac

SEQ ID NO: 35637 - DNA, 75 bp, Artificial Sequence
  Synthetic
tgcagataatcatgagactctagaggtagcacacacaaagcatctgataggtgaattacagtttaagataatgtt

SEQ ID NO: 35638 - DNA, 75 bp, Artificial Sequence
  Synthetic
gtagcacacacaaagcatctgataggtgaattacagtttaagataatgttaggagatataagatacaaatcattt

SEQ ID NO: 35639 - DNA, 75 bp, Artificial Sequence
  Synthetic
atgcaaaatgtgtcgggtgtccatcatgttttgaaagctactcctgcaactttcaaatagtgtcaaatatagaca

SEQ ID NO: 35640 - DNA, 75 bp, Artificial Sequence
  Synthetic
atgttttgaaagctactcctgcaactttcaaatagtgtcaaatatagacactgtgtgctcagtcgaagggccatg

SEQ ID NO: 35641 - DNA, 75 bp, Artificial Sequence
  Synthetic
atatcagctaacaaacagtcatatgggcttaaaatgagttgccaaacaaagcctaaccaaaatgaagagttcatt

SEQ ID NO: 35642 - DNA, 75 bp, Artificial Sequence
  Synthetic
ggcttaaaatgagttgccaaacaaagcctaaccaaaatgaagagttcattatctgtaacaggaaatacagtgtct

SEQ ID NO: 35643 - DNA, 75 bp, Artificial Sequence
  Synthetic
caaaatagaagtgaacacaggggaccagacttcatatatttatgaaaaggacagcagatgtaagacttggttgtg

SEQ ID NO: 35644 - DNA, 75 bp, Artificial Sequence
  Synthetic
cagacttcatatatttatgaaaaggacagcagatgtaagacttggttgtgcagggttagagatgaggggatcagt

SEQ ID NO: 35645 - DNA, 75 bp, Artificial Sequence
  Synthetic
tctttgggagctattttagcataatattttatgttgttgttggaattattgtccttttcttgattatatacatat

SEQ ID NO: 35646 - DNA, 75 bp, Artificial Sequence
  Synthetic
ccaatgttcttcaaactaaaagatgttttgaaaagaaatgaatatttgtatcttcaggaactgaaacataaatga

SEQ ID NO: 35647 - DNA, 75 bp, Artificial Sequence
  Synthetic
aggctctttaatgattgagttggaatttcatgatgtcgctgctaacaccagcagtacttttgacccagaggtcgc

SEQ ID NO: 35648 - DNA, 75 bp, Artificial Sequence
  Synthetic
attccttgccaggtacctacttgagaagatgctgaaagtcagtgaaccagagaaattgattattaaatcaaaaat

SEQ ID NO: 35649 - DNA, 75 bp, Artificial Sequence
  Synthetic
gggatcacttggaatgatggagaggaagtttatctctctttcttcccaggatcagagatgttcttaggaactttc

SEQ ID NO: 35650 - DNA, 75 bp, Artificial Sequence
  Synthetic
atcagagatgttcttaggaactttcagattctaccccttagcaatcgggatctacaaagttcagcgcaaggaaat

SEQ ID NO: 35651 - DNA, 75 bp, Artificial Sequence
  Synthetic
atgcggcagaggtacatgggactagaagcagcaacttggactgttagtaaattgacagaagttcagtctgcactg

SEQ ID NO: 35652 - DNA, 75 bp, Artificial Sequence
  Synthetic
agaaaaccaatgttagtgcagctgccagggacttccttgctaaattcggaatcaacatgtaagcagggatgcatt

SEQ ID NO: 35653 - DNA, 75 bp, Artificial Sequence
  Synthetic
gtgggtggttggggacagaaagacagcgggctaaatcaacattatattgttaatggtattttaagttttaggtgg

SEQ ID NO: 35654 - DNA, 75 bp, Artificial Sequence
  Synthetic
agtagtgtactccacactacaaacttgctattgttgaaaaatgcgaatctactagagacaagagaagtgaatttg

SEQ ID NO: 35655 - DNA, 75 bp, Artificial Sequence
  Synthetic
tgctattgttgaaaaatgcgaatctactagagacaagagaagtgaatttgaggctccccaatgattgagttggaa

SEQ ID NO: 35656 - DNA, 75 bp, Artificial Sequence
  Synthetic
gcagtacttttgacccagaggcagcatacgctaactttaagcgtgtccacaccactgggcttacttatgaccaca

SEQ ID NO: 35657 - DNA, 75 bp, Artificial Sequence
  Synthetic
accttgggggctggaagattactgtatataatacgaattttcctggcaaccggaacaacccaagtcctgacgatg

SEQ ID NO: 35658 - DNA, 75 bp, Artificial Sequence
  Synthetic
attccttgccaagtccttacttgaaaagatgctgaaggtcagtgcaccggagaaattgattataaaatcaaaaat

SEQ ID NO: 35659 - DNA, 75 bp, Artificial Sequence
  Synthetic
aagatgctgaaggtcagtgcaccggagaaattgattataaaatcaaaaataaccagccctttggctgaaaagaat

SEQ ID NO: 35660 - DNA, 75 bp, Artificial Sequence
  Synthetic
aggtttatctctctttcttccctggctcagagatgttcctaggtacatttcatttctaccctttgccaattggaa

SEQ ID NO: 35661 - DNA, 75 bp, Artificial Sequence
  Synthetic
ctcagagatgttcctaggtacatttcatttctaccctttgccaattggaatctaccaagggctccgcagagactt

SEQ ID NO: 35662 - DNA, 75 bp, Artificial Sequence
  Synthetic
ctgcggctgatgtacatgggactagaagcatcatcctggactgtgagtaaattgactgaagggcagtctgcactg

SEQ ID NO: 35663 - DNA, 75 bp, Artificial Sequence
  Synthetic
aagcatcatcctggactgtgagtaaattgactgaagggcagtctgcactgacagttgtctctggcttaggctgga

SEQ ID NO: 35664 - DNA, 75 bp, Artificial Sequence
  Synthetic
cagagacttcctggctaagtttggcatcaacatgtaagtatggacacttttttaatctggcaaaattctacaatc

SEQ ID NO: 35665 - DNA, 75 bp, Artificial Sequence
  Synthetic
atcaacatgtaagtatggacacttttttaatctggcaaaattctacaatcttaatcaggctaaaagggtttttaa

SEQ ID NO: 35666 - DNA, 75 bp, Artificial Sequence
  Synthetic
gtgggtggttggggacagaaagacaatgggttcattcaacattttgattttaatggatatataagttttaggtgg

SEQ ID NO: 35667 - DNA, 75 bp, Artificial Sequence
  Synthetic
attaattttagtgcgtattcttcagaaagatggaacacattcttatataaagccagagcagagacagaggtggat

SEQ ID NO: 35668 - DNA, 75 bp, Artificial Sequence
  Synthetic
ttagaatttagttcaggaaagtctctatttacctttttctgaaacatatcttcattggtttatttaattggacat

SEQ ID NO: 35669 - DNA, 75 bp, Artificial Sequence
  Synthetic
cacctatagaaggcacgttaaccaactacccaaatgaaaaacaatacacactggaagagattgcagatgttgttg

SEQ ID NO: 35670 - DNA, 75 bp, Artificial Sequence
  Synthetic
ctacccaaatgaaaaacaatacacactggaagagattgcagatgttgttgaagggataataacagagcagcatct

SEQ ID NO: 35671 - DNA, 75 bp, Artificial Sequence
  Synthetic
tcattatttggggggctaatattattattaactcttatactgtctataacaataaacaaggtaacagatcttctc

SEQ ID NO: 35672 - DNA, 75 bp, Artificial Sequence
  Synthetic
tattaactcttatactgtctataacaataaacaaggtaacagatcttctcgcaagcactaatgttatttattgtg

SEQ ID NO: 35673 - DNA, 75 bp, Artificial Sequence
  Synthetic
aaaaggaataaagtataatggagatttcactaataaatgtggattttgcacctgcagtgagcaagaagatgtaga

SEQ ID NO: 35674 - DNA, 75 bp, Artificial Sequence
  Synthetic
ttcactaataaatgtggattttgcacctgcagtgagcaagaagatgtagagggagttattatacataaagtaagc

SEQ ID NO: 35675 - DNA, 75 bp, Artificial Sequence
  Synthetic
ttaaatgggtaagagtaataatgattatactagctttgcttttgacaattcagaacacagtcttaattgttgctg

SEQ ID NO: 35676 - DNA, 75 bp, Artificial Sequence
  Synthetic
tatactagctttgcttttgacaattcagaacacagtcttaattgttgctgctgaagtagattgctggacaaaaaa

SEQ ID NO: 35677 - DNA, 75 bp, Artificial Sequence
  Synthetic
cctttacttaatataggctcatgcactgataaatcaagtaggacatatgaaacagaagttaacaaattagtaaga

SEQ ID NO: 35678 - DNA, 75 bp, Artificial Sequence
  Synthetic
ctgataaatcaagtaggacatatgaaacagaagttaacaaattagtaagacaatctaaggttacacatgctgatg

SEQ ID NO: 35679 - DNA, 75 bp, Artificial Sequence
  Synthetic
cactttagataatgcaattaaagccgtaaggtcacaaaagacatatgagactatgcatttcctagagactgtatt

SEQ ID NO: 35680 - DNA, 75 bp, Artificial Sequence
  Synthetic
gtaaggtcacaaaagacatatgagactatgcatttcctagagactgtattcttaatgaaaaattgtgactattat

SEQ ID NO: 35681 - DNA, 75 bp, Artificial Sequence
  Synthetic
attcacaaacaaaatggaggcttatagctaaaacaagccactttgatatctgttcacggcatagcacccatcact

SEQ ID NO: 35682 - DNA, 75 bp, Artificial Sequence
  Synthetic
agctaaaacaagccactttgatatctgttcacggcatagcacccatcacttttgcaggtgtgtaaatgaagggac

SEQ ID NO: 35683 - DNA, 75 bp, Artificial Sequence
  Synthetic
tttgctggagagatgaacgacacctacaatagcaagaatgatttctacctccatgatttagatcttttctataca

SEQ ID NO: 35684 - DNA, 75 bp, Artificial Sequence
  Synthetic
acaatagcaagaatgatttctacctccatgatttagatcttttctatacactccttgaaaatgcattccccggca

SEQ ID NO: 35685 - DNA, 75 bp, Artificial Sequence
  Synthetic
ccttcagaagaaaaacacaactggtgcatcgaaattattaggaaaattaataacaaaatatggaaataacaacat

SEQ ID NO: 35686 - DNA, 75 bp, Artificial Sequence
  Synthetic
cagtatcttctcaagctgccatacataaatgatacagaattgagtactgataggaaatcaactataataaaatca

SEQ ID NO: 35687 - DNA, 75 bp, Artificial Sequence
  Synthetic
caacaggtgttgagcaggtctcaaacagggaggcaagaatccttatctagtgcaactccaggcactgcaacaaag

SEQ ID NO: 35688 - DNA, 75 bp, Artificial Sequence
  Synthetic
tgcaactccaggcactgcaacaaaggagtgttcaaatgcaaaagatataggttgcattagcccaaggtttggcat

SEQ ID NO: 35689 - DNA, 75 bp, Artificial Sequence
  Synthetic
gagtgttcaaatgcaaaagatataggttgcattagcccaaggtttggcattcctataggaaacctcactgcatgt

SEQ ID NO: 35690 - DNA, 75 bp, Artificial Sequence
  Synthetic
ataaaaccccagagaaaatctataagtcaaataatagaggagaagtttggtgttcagatgatgtccactgcttaa

SEQ ID NO: 35691 - DNA, 75 bp, Artificial Sequence
  Synthetic
gtcaaataatagaggagaagtttggtgttcagatgatgtccactgcttaacagactttgaacctgcagaagagga

SEQ ID NO: 35692 - DNA, 75 bp, Artificial Sequence
  Synthetic
acttgtttcttaacagatgtaacaacaaaaactgatgtattttctgttgctatatcaacgtgcaaaatggttgat

SEQ ID NO: 35693 - DNA, 75 bp, Artificial Sequence
  Synthetic
caaaaactgatgtattttctgttgctatatcaacgtgcaaaatggttgataagggtgtatgtacagtcaatgatg

SEQ ID NO: 35694 - DNA, 75 bp, Artificial Sequence
  Synthetic
atgattttggagaatactgtatctctcacagttgcaacactgaaagattccccatcaatccagatgtcctgaagg

SEQ ID NO: 35695 - DNA, 75 bp, Artificial Sequence
  Synthetic
aataaagttatttcatttatttcacaaaattatttcattaaattattgcctcagggcaaattagctgtttttgtt

SEQ ID NO: 35696 - DNA, 75 bp, Artificial Sequence
  Synthetic
agtagtgtactccacactaataacttacaaatcttgagaacctttgatacatccagtactagcttggcctttaaa

SEQ ID NO: 35697 - DNA, 75 bp, Artificial Sequence
  Synthetic
cgctgctaacaccagcagtacttttgacccagaggttgcatacattaactttaagcgtatctacaccactgggct

SEQ ID NO: 35698 - DNA, 75 bp, Artificial Sequence
  Synthetic
ttaagcgtatctacaccactgggcttagttatgaccacattcgaatcttctacattaaaggacgcgagattaaaa

SEQ ID NO: 35699 - DNA, 75 bp, Artificial Sequence
  Synthetic
attttcctggcaaccggaacagtccagttccagacgatggtcttaccctccacagactcagtggattccttgccc

SEQ ID NO: 35700 - DNA, 75 bp, Artificial Sequence
  Synthetic
ggtgagtgaaccagaaaagctgattatcaagtccaaaataatcaaccctttggctgaaaaaaatgggattacatg

SEQ ID NO: 35701 - DNA, 75 bp, Artificial Sequence
  Synthetic
atcaagtccaaaataatcaaccctttggctgaaaaaaatgggattacatggtcagatggagaagaggtgtacctc

SEQ ID NO: 35702 - DNA, 75 bp, Artificial Sequence
  Synthetic
tcttaggaacattcaagttttatccactggcaatcggaatttacaaagtccagagaaaagaaatggaacctaaat

SEQ ID NO: 35703 - DNA, 75 bp, Artificial Sequence
  Synthetic
actggcaatcggaatttacaaagtccagagaaaagaaatggaacctaaatacctggaaaaaaccatgaggcagag

SEQ ID NO: 35704 - DNA, 75 bp, Artificial Sequence
  Synthetic
tggacagtcagcaaagtgaatgaggttcagtctgctctgacggtagtttcaggacttggatggaagaaaacaaat

SEQ ID NO: 35705 - DNA, 75 bp, Artificial Sequence
  Synthetic
ttcagtctgctctgacggtagtttcaggacttggatggaagaaaacaaatgtaagtgctgctgctagggagttcc

SEQ ID NO: 35706 - DNA, 75 bp, Artificial Sequence
  Synthetic
atcagacaggaggacaaaatcagatcaaattaacttatttcccaatttggctaaaagagtcttcggactcaaaca

SEQ ID NO: 35707 - DNA, 75 bp, Artificial Sequence
  Synthetic
ggggacagaaaaaaatcggaatacatcaagatgagttataatatgctgtttaagttttaggtggagcacactact

SEQ ID NO: 35708 - DNA, 75 bp, Artificial Sequence
  Synthetic
agtagtgtactccacactacaaacctgctaacgctgagaatcactatgacatctaatccaatagaaaatcatctt

SEQ ID NO: 35709 - DNA, 75 bp, Artificial Sequence
  Synthetic
gtcttaccctccaccgactcagtggattccttgccaggtacctacttgagaagatgcttaaagtcagtgaaccgg

SEQ ID NO: 35710 - DNA, 75 bp, Artificial Sequence
  Synthetic
aatcaaccctttggcggaaaaaaacgggatcacttggtatgatggagaggaagtttacctctctttcttccctgg

SEQ ID NO: 35711 - DNA, 75 bp, Artificial Sequence
  Synthetic
gggatcacttggtatgatggagaggaagtttacctctctttcttccctggctctgagatgtgcctggggacccaa

SEQ ID NO: 35712 - DNA, 75 bp, Artificial Sequence
  Synthetic
tctaccaagtccaacgcaaagaaatggaaccgaaattccttgaaaaaacattgaagcaaagatccttgggactag

SEQ ID NO: 35713 - DNA, 75 bp, Artificial Sequence
  Synthetic
ggaaccgaaattccttgaaaaaacattgaagcaaagatccttgggactagaaccttcaacctggaccatcagcca

SEQ ID NO: 35714 - DNA, 75 bp, Artificial Sequence
  Synthetic
acagtggtctctggcttgggttggaagaaaactaatgtaggtgctgcagctaggaacttccttgctaaatttgga

SEQ ID NO: 35715 - DNA, 75 bp, Artificial Sequence
  Synthetic
agaaaactaatgtaggtgctgcagctaggaacttccttgctaaatttggaatcaacatgtaaggagggaaacaat

SEQ ID NO: 35716 - DNA, 75 bp, Artificial Sequence
  Synthetic
aaaatttggctaaaagggtggattcaacccgcgaaataacagccatacagatgggtggcttggggacgagaaaaa

SEQ ID NO: 35717 - DNA, 75 bp, Artificial Sequence
  Synthetic
atgggtggcttggggacgagaaaaaactggcttaaccttaaatatgtgcttcataatgaatttaggttaaagtgg

SEQ ID NO: 35718 - DNA, 75 bp, Artificial Sequence
  Synthetic
agtagtgtactccacactacaaacttgccattgatgaggaatattgagcaaaaaggagaggagagtatttgagat

SEQ ID NO: 35719 - DNA, 75 bp, Artificial Sequence
  Synthetic
tgccattgatgaggaatattgagcaaaaaggagaggagagtatttgagatcccttaaatgattgagttggaattt

SEQ ID NO: 35720 - DNA, 75 bp, Artificial Sequence
  Synthetic
gttcttttgacccagaggcagcatacgctaactttaagcgtgtccacaccactgggcttagttacgaccacatac

SEQ ID NO: 35721 - DNA, 75 bp, Artificial Sequence
  Synthetic
ttgggggctggaagattgctgtatataatacgaattttcctggcaacaggaacagcccagttcctgacgatggtc

SEQ ID NO: 35722 - DNA, 75 bp, Artificial Sequence
  Synthetic
ccttgccaggttcttacttgagaagatgctgaaaatgagtgaaccagaaaaattaattataaaggcaaaaataat

SEQ ID NO: 35723 - DNA, 75 bp, Artificial Sequence
  Synthetic
atgctgaaaatgagtgaaccagaaaaattaattataaaggcaaaaataatcaacccactggctgaaaaaaatagg

SEQ ID NO: 35724 - DNA, 75 bp, Artificial Sequence
  Synthetic
tttacctgtctttcttccctggctcagaaatgttcctaggtacatttaaattctacccattggcaattgggattt

SEQ ID NO: 35725 - DNA, 75 bp, Artificial Sequence
  Synthetic
agaaatgttcctaggtacatttaaattctacccattggcaattgggatttacaaagtgcaaaggaaagaaatgga

SEQ ID NO: 35726 - DNA, 75 bp, Artificial Sequence
  Synthetic
aggcagaggtacatgggccttgaagcatcaagctggacagtgagcaaattaactgatgttcaatcagcacttaca

SEQ ID NO: 35727 - DNA, 75 bp, Artificial Sequence
  Synthetic
catcaagctggacagtgagcaaattaactgatgttcaatcagcacttacagttgtttctggcttaggctggaaga

SEQ ID NO: 35728 - DNA, 75 bp, Artificial Sequence
  Synthetic
agacttcctggctaaatttggcatcaatatgtaatttggtaatttgaattaatctggcaaacattttaaaattta

SEQ ID NO: 35729 - DNA, 75 bp, Artificial Sequence
  Synthetic
aatatgtaatttggtaatttgaattaatctggcaaacattttaaaatttaatcaggctaaatgtgggttttaaac

SEQ ID NO: 35730 - DNA, 75 bp, Artificial Sequence
  Synthetic
ggtggttgcggaccaaaaaaccattggaagttcattcaacattctgatttggtatataagttttaggtggagcac

SEQ ID NO: 35731 - DNA, 75 bp, Artificial Sequence
  Synthetic
tagtgggttatattatttcactgatcacagagatgggcaagacacaggtaatgattttggagaatactgtatctc

SEQ ID NO: 35732 - DNA, 75 bp, Artificial Sequence
  Synthetic
gaaatcgataagggttgggagctaatgagtcagagagtttacacagagagggaaattataacagatgtgacaaaa

SEQ ID NO: 35733 - DNA, 75 bp, Artificial Sequence
  Synthetic
gggcaaagaatgcagatagaaagctaataggttcaacagcaaaattaatatacctatctaatagtttacaaagta

SEQ ID NO: 35734 - DNA, 75 bp, Artificial Sequence
  Synthetic
aagaaaggcagaagtttatgaagaacttctttggcatagggaaacataagagttttaaagataagacatccagcg

SEQ ID NO: 35735 - DNA, 75 bp, Artificial Sequence
  Synthetic
actacaaacttgctattgttgaaaatcgctgtgctatcaaatctaacagaaggtcattaaaggctctttaatgat

SEQ ID NO: 35736 - DNA, 75 bp, Artificial Sequence
  Synthetic
gctaacaccagcagtacttttgacccagaggtcgcatacgctaactttaagcgtgtctacaccactgggcttagt

SEQ ID NO: 35737 - DNA, 75 bp, Artificial Sequence
  Synthetic
caaaaagaagtgaatgggaagttacacttaaccttgggggctggaagattactgtatataatacgaattttcctg

SEQ ID NO: 35738 - DNA, 75 bp, Artificial Sequence
  Synthetic
cgatggtcttaccctccaccgcctcagtggattccttgccaggtacctacttgagaagatgctaaaagtcagtga

SEQ ID NO: 35739 - DNA, 75 bp, Artificial Sequence
  Synthetic
tttgggtgggtggttggggacagaaagacagcggactaaattaacattacattattgatggtattttaagtttta

SEQ ID NO: 35740 - DNA, 75 bp, Artificial Sequence
  Synthetic
cttcataaaataaagttatttcatttatttcacaaaattatttcattaaattagctgtttttgttatcggtagca

SEQ ID NO: 35741 - DNA, 75 bp, Artificial Sequence
  Synthetic
agtagtgtactccacactacaaacttgctattgttgaaaatcgctgtgctatcaaatttaacagaaagtcattaa

SEQ ID NO: 35742 - DNA, 75 bp, Artificial Sequence
  Synthetic
atcagaaatgttcctaggaactttcagattctaccccttagcaattgggatctacaaagtccagcgcaaggaaat

SEQ ID NO: 35743 - DNA, 75 bp, Artificial Sequence
  Synthetic
agtagtgtactaccgatacaatccacatctagataaaggttcttcaagatgctattcctgctcatactagccttt

SEQ ID NO: 35744 - DNA, 75 bp, Artificial Sequence
  Synthetic
tcaattatggtattatttattctgaaattatagtaaatataacgccttagggcaaactagctgtttttgataccg

SEQ ID NO: 35745 - DNA, 75 bp, Artificial Sequence
  Synthetic
cagcagttgttgctaaggatatcagcactgatatccttgaagcaagacatgattactttggtcgtgaactatgct

SEQ ID NO: 35746 - DNA, 75 bp, Artificial Sequence
  Synthetic
taatgttcttttagatgaaattgtcttagatgtgtgccctggggtaaatctcatggattataatatcccaaatgt

SEQ ID NO: 35747 - DNA, 75 bp, Artificial Sequence
  Synthetic
ttagatgtgtgccctggggtaaatctcatggattataatatcccaaatgtgactccagacaactacatctgggat

SEQ ID NO: 35748 - DNA, 75 bp, Artificial Sequence
  Synthetic
acaaggtctcagttggaactgatagtagtgaaattacttataaaaagtacaccaccttgatcctaccaattatgg

SEQ ID NO: 35749 - DNA, 75 bp, Artificial Sequence
  Synthetic
ggctataatacgtgccaacccactgacataccaattgacaattataggggagaacttccgtgaaagatatccaaa

SEQ ID NO: 35750 - DNA, 75 bp, Artificial Sequence
  Synthetic
atcagatcaccctatatatcaagagttcctagggtccatgcctagaagattcgttgatctattcaatgaggctat

SEQ ID NO: 35751 - DNA, 75 bp, Artificial Sequence
  Synthetic
tcgttgatctattcaatgaggctattgagttcagtgcttactctgctgagaggtggaatacattgctttacaaag

SEQ ID NO: 35752 - DNA, 75 bp, Artificial Sequence
  Synthetic
attatatgaagccaactcagaatgagattgacaaaggctgggaaatgatgagtataagggttgcccaggagagag

SEQ ID NO: 35753 - DNA, 75 bp, Artificial Sequence
  Synthetic
gattgacaaaggctgggaaatgatgagtataagggttgcccaggagagagatatcataaccgacacaacaaagca

SEQ ID NO: 35754 - DNA, 75 bp, Artificial Sequence
  Synthetic
actaagaacaataataggaaactcttaggatcaactgctaaattgatcttcttgtcaaattcactcaaatctata

SEQ ID NO: 35755 - DNA, 75 bp, Artificial Sequence
  Synthetic
taggatcaactgctaaattgatcttcttgtcaaattcactcaaatctataaatgaacagtccacttggtcagaat

SEQ ID NO: 35756 - DNA, 75 bp, Artificial Sequence
  Synthetic
ggatataggaaataatataggtcaatatgagtcgttatgtgcagagaggaaaatgattgctagatcaacaggaaa

SEQ ID NO: 35757 - DNA, 75 bp, Artificial Sequence
  Synthetic
tatgagtcgttatgtgcagagaggaaaatgattgctagatcaacaggaaaaaagatagataataagagacttgat

SEQ ID NO: 35758 - DNA, 75 bp, Artificial Sequence
  Synthetic
tcttatgggagcaacaatttatcttagcaaatgaactctttaaaaatcaagagagacaaaaatttctaaagaact

SEQ ID NO: 35759 - DNA, 75 bp, Artificial Sequence
  Synthetic
agcaaatgaactctttaaaaatcaagagagacaaaaatttctaaagaacttttttggaattggtaaacacaagtc

SEQ ID NO: 35760 - DNA, 75 bp, Artificial Sequence
  Synthetic
attgacattgagaaaccgaaaatactggacttcaataatagcatcgttttaatggctgccaaggctatggtaaat

SEQ ID NO: 35761 - DNA, 75 bp, Artificial Sequence
  Synthetic
aatggctgccaaggctatggtaaataagaataaagtgttcctctcccagcagaacactttaaatgacttccatcc

SEQ ID NO: 35762 - DNA, 75 bp, Artificial Sequence
  Synthetic
ggcttattcctattgagttcactattattatataataataaccctttaatatctcttactgatgtactgaatttt

SEQ ID NO: 35763 - DNA, 75 bp, Artificial Sequence
  Synthetic
gtttatatggttaatctaatcaaaatgggatgcagttctgcaaatgagcaatctagcaaaatacaattgagaaac

SEQ ID NO: 35764 - DNA, 75 bp, Artificial Sequence
  Synthetic
tgggatgcagttctgcaaatgagcaatctagcaaaatacaattgagaaacatttatttatctgactatgacataa

SEQ ID NO: 35765 - DNA, 75 bp, Artificial Sequence
  Synthetic
ttagatacatcaagacataatcatcttagaaacagagtggagagtagaaataatttcagaaggagcataactact

SEQ ID NO: 35766 - DNA, 75 bp, Artificial Sequence
  Synthetic
taatttcagaaggagcataactactattagcacctttactagttcaaaatcttgcgttaaagttggggattttaa

SEQ ID NO: 35767 - DNA, 75 bp, Artificial Sequence
  Synthetic
ccctagaaaaatataggctgtcaaaccctctgtttctagaagatgaagaacaaacattagaaacacaacactgca

SEQ ID NO: 35768 - DNA, 75 bp, Artificial Sequence
  Synthetic
accgaattataaagattatatatctgttaaggtatttgacagactttatgaattattaaaaaatgagacattaaa

SEQ ID NO: 35769 - DNA, 75 bp, Artificial Sequence
  Synthetic
gttaaggtatttgacagactttatgaattattaaaaaatgagacattaaataatgactcttttattgagcaagca

SEQ ID NO: 35770 - DNA, 75 bp, Artificial Sequence
  Synthetic
agtttacattcacatttttcaataaagggcagaaaacagcaaaagatagggagatttttgtgggagaatttgaag

SEQ ID NO: 35771 - DNA, 75 bp, Artificial Sequence
  Synthetic
gagatttttgtgggagaatttgaagccaaaatgtgcatgtatgttgtagaaagaatatcaaaagaaaggtgcaaa

SEQ ID NO: 35772 - DNA, 75 bp, Artificial Sequence
  Synthetic
tcttattttttatgtcaaactacatgcagaagcatttaataataccagatgatcttattgcgaatatcttagatc

SEQ ID NO: 35773 - DNA, 75 bp, Artificial Sequence
  Synthetic
gatcttattgcgaatatcttagatcagaaaactccctataaaaatgacttaatactcgaggccacaaatggattg

SEQ ID NO: 35774 - DNA, 75 bp, Artificial Sequence
  Synthetic
tgtgcaatgttggtctacaaggacataattaaagagtctttaaagctacttgaaggggattgtttagtcaactcc

SEQ ID NO: 35775 - DNA, 75 bp, Artificial Sequence
  Synthetic
tctgcttatcatttggttgtcaagcaaatatgaaaaaaacatatgtgacgcatacctgtaaagaatttgtttcac

SEQ ID NO: 35776 - DNA, 75 bp, Artificial Sequence
  Synthetic
atctgtttatggtcgatttctgttacccagtgtaggtgattgtgcatacattggcccttatgaagatttagcaag

SEQ ID NO: 35777 - DNA, 75 bp, Artificial Sequence
  Synthetic
cccagtgtaggtgattgtgcatacattggcccttatgaagatttagcaagtagattatcagcagcacaacaaagc

SEQ ID NO: 35778 - DNA, 75 bp, Artificial Sequence
  Synthetic
tagcatgggtggcaataagttgtagccactggataacatacttaacatacaatatgctagatgatcaaataaact

SEQ ID NO: 35779 - DNA, 75 bp, Artificial Sequence
  Synthetic
aatatgctagatgatcaaataaactctcctcttaattatctccccttcaagagccgccatgacataccagtagaa

SEQ ID NO: 35780 - DNA, 75 bp, Artificial Sequence
  Synthetic
tgtatttgatagctttagttgggttagaagcaggaaacctttggtttttgatgaatatcttaaaaaaacttgtcc

SEQ ID NO: 35781 - DNA, 75 bp, Artificial Sequence
  Synthetic
tcattgaagggcttagacgattcagatattttcaggctcaaaatattgagatatttaaccttggatacagaaata

SEQ ID NO: 35782 - DNA, 75 bp, Artificial Sequence
  Synthetic
ctagtgatatgagaagcaggtcattacttacaccaagaaagttcactactgtaggttcattaaataagttagtat

SEQ ID NO: 35783 - DNA, 75 bp, Artificial Sequence
  Synthetic
ttatcaaatgatcaatagggatattagccaattgccattggacataaatgatgtgaaagtagtttttaaatattg

SEQ ID NO: 35784 - DNA, 75 bp, Artificial Sequence
  Synthetic
agccaattgccattggacataaatgatgtgaaagtagtttttaaatattgtattttgaatgatccattgatgata

SEQ ID NO: 35785 - DNA, 75 bp, Artificial Sequence
  Synthetic
tccaccattccccagcattagttctcaaggcatttagcaaatctactactgatatagcaggtgctgatccaatag

SEQ ID NO: 35786 - DNA, 75 bp, Artificial Sequence
  Synthetic
tggtacacaatgcattatttgaagcagattgttagcggttcagtgaaaggtacaatagtcacaactagtactact

SEQ ID NO: 35787 - DNA, 75 bp, Artificial Sequence
  Synthetic
tcttacctctattatttagaatgcaatctttgacacaatcagatctgaacaagtttgacgcattaaaaacaaatg

SEQ ID NO: 35788 - DNA, 75 bp, Artificial Sequence
  Synthetic
aacaaatcggtctctgaattcaggcattgttgacctaacgatatctggatacttaaggtcaatacgaatagtggg

SEQ ID NO: 35789 - DNA, 75 bp, Artificial Sequence
  Synthetic
ggaagataagacattgaaagttgctgaacttacagtgcctaatttttatccaaatacagtatttcatgctggaaa

SEQ ID NO: 35790 - DNA, 75 bp, Artificial Sequence
  Synthetic
gcacacatctacacttatcaagtttcaactatagatcatataataaaaagaaatgaggaaggactatcaactaga

SEQ ID NO: 35791 - DNA, 75 bp, Artificial Sequence
  Synthetic
aaatgatgttttttaatggtcctgatataaaggcgggcattataaatctgacagcattgatgagaacccaagaat

SEQ ID NO: 35792 - DNA, 75 bp, Artificial Sequence
  Synthetic
aggaacaaggggaactcatctttctctcagatgaaattatggattttactatttcggaagaaatagaatctatgc

SEQ ID NO: 35793 - DNA, 75 bp, Artificial Sequence
  Synthetic
ttctactcaaagaagaatctcggaataataaatactattagttctataataaatttattagagacaaatgagtgg

SEQ ID NO: 35794 - DNA, 75 bp, Artificial Sequence
  Synthetic
tcgtctatattgctaaactcttttcatatagctatgttattagaagggatggatagagaatttcacttgttcact

SEQ ID NO: 35795 - DNA, 75 bp, Artificial Sequence
  Synthetic
tgagaagactatattccttattgagaaagaaatgaacaaggaagcaaactttgaagatttcttagatgagctaga

SEQ ID NO: 35796 - DNA, 75 bp, Artificial Sequence
  Synthetic
aaagaaatgaacaaggaagcaaactttgaagatttcttagatgagctagaattttcatcaggtaaatccatgttc

SEQ ID NO: 35797 - DNA, 75 bp, Artificial Sequence
  Synthetic
tgatccggaaaaattgattataaaatcaaaaattgttaatccgcttgcagagaaaaatggcataacctgggcaga

SEQ ID NO: 35798 - DNA, 75 bp, Artificial Sequence
  Synthetic
aaagagatggaaccaaagtatctggagaagaccatgcgccaaagatatatgggtttggaagcatcaacttggaca

SEQ ID NO: 35799 - DNA, 75 bp, Artificial Sequence
  Synthetic
agtttggcattagcatgtaaatgtactgtcagaattgtaatctggataaattgtatttttaaaatttggttaaaa

SEQ ID NO: 35800 - DNA, 75 bp, Artificial Sequence
  Synthetic
aatcacaactataattgcaagatgttgctacttcttgtcttattaatcccctgctatgtatcagcctctcctgta

SEQ ID NO: 35801 - DNA, 75 bp, Artificial Sequence
  Synthetic
aaagatgatgtctctactattaagtcagaaataacatatgagaagaacaacactggcttatttgcacataacaaa

SEQ ID NO: 35802 - DNA, 75 bp, Artificial Sequence
  Synthetic
actggaaaaattgtaaccctgttcccacagcagggggcagcataaatgttatagaagtcaatacggatttgagct

SEQ ID NO: 35803 - DNA, 75 bp, Artificial Sequence
  Synthetic
cacagcagggggcagcataaatgttatagaagtcaatacggatttgagcttgaccacaaaaacatatgtgtgtag

SEQ ID NO: 35804 - DNA, 75 bp, Artificial Sequence
  Synthetic
aaagaagatgctcagataattttccaaactgagaagttgaaccattttgaggtctctgggactacattgagctca

SEQ ID NO: 35805 - DNA, 75 bp, Artificial Sequence
  Synthetic
taacattagataggacttgtgaacatattaaagtaacatgtgggaaaaagaccttacaattccatgcctgtttta

SEQ ID NO: 35806 - DNA, 75 bp, Artificial Sequence
  Synthetic
acaatggctacttccatctgtcaaaatatagaactcataattataataagtctgacattaattatctttatcctg

SEQ ID NO: 35807 - DNA, 75 bp, Artificial Sequence
  Synthetic
tatgctatctactgatgccactatttatgccaattgcatacttttatggttggtcatataacaaaagctgtaaaa

SEQ ID NO: 35808 - DNA, 75 bp, Artificial Sequence
  Synthetic
tatgccaattgcatacttttatggttggtcatataacaaaagctgtaaaaaatgctcatgttgtggcctagctta

SEQ ID NO: 35809 - DNA, 75 bp, Artificial Sequence
  Synthetic
cactgtgtatgcgggctaaaatttgaagcatcagataggatgagaatacacagagaatcaggattatgtcaaggc

SEQ ID NO: 35810 - DNA, 75 bp, Artificial Sequence
  Synthetic
aagcatcagataggatgagaatacacagagaatcaggattatgtcaaggctacaaaagtctacgtgtggctaggt

SEQ ID NO: 35811 - DNA, 75 bp, Artificial Sequence
  Synthetic
tcttataatctcaatattattatctatgttgatactaagctttgttacaccaatagaggggacattaactaatta

SEQ ID NO: 35812 - DNA, 75 bp, Artificial Sequence
  Synthetic
atgttgatactaagctttgttacaccaatagaggggacattaactaattacccagaatcaaggaagtatgatctg

SEQ ID NO: 35813 - DNA, 75 bp, Artificial Sequence
  Synthetic
gattcattgtagaaaaagggataaaagaatacgtagtcttttatacttctatttttggggctttattcttactaa

SEQ ID NO: 35814 - DNA, 75 bp, Artificial Sequence
  Synthetic
tggcattagttatcataatagcactaaacaaggttacagagtatcttacaaacatcaatgttttatactgtcatg

SEQ ID NO: 35815 - DNA, 75 bp, Artificial Sequence
  Synthetic
tttaaaaatacataaagttagcagaaagtgcatatataaatatcaactcacctggtccaaaataatcatgatgat

SEQ ID NO: 35816 - DNA, 75 bp, Artificial Sequence
  Synthetic
ggaggcaaaaaagctagtgagagcatctaaaatatcagatttgaatgcagcacaggtggggctattgggatctac

SEQ ID NO: 35817 - DNA, 75 bp, Artificial Sequence
  Synthetic
agaaagcagagaacatattcaaccatgcatctccttgaatcagtattcctgggaaagcattgtgattactataaa

SEQ ID NO: 35818 - DNA, 75 bp, Artificial Sequence
  Synthetic
tgcatctccttgaatcagtattcctgggaaagcattgtgattactataaagctttcgaacataacagtggctact

SEQ ID NO: 35819 - DNA, 75 bp, Artificial Sequence
  Synthetic
taaaacacatcattttgatatttgctcaagacatagtactcatcatttctgtagatgcatctcagatgggacaaa

SEQ ID NO: 35820 - DNA, 75 bp, Artificial Sequence
  Synthetic
tcaagacatagtactcatcatttctgtagatgcatctcagatgggacaaagtgccaaaatggggattgggatttt

SEQ ID NO: 35821 - DNA, 75 bp, Artificial Sequence
  Synthetic
agtcgaaaaaagacttttttgagcatgacctcaagctgttctgcactcttgtagaaaatgcttttccaggcacaa

SEQ ID NO: 35822 - DNA, 75 bp, Artificial Sequence
  Synthetic
tgacctcaagctgttctgcactcttgtagaaaatgcttttccaggcacaacagagtcactcttttatgaaatgtt

SEQ ID NO: 35823 - DNA, 75 bp, Artificial Sequence
  Synthetic
aaaaagctattagataaactaacaaaaaaatttggaaataacaatatgttcgtaggaatatggaaatttgggcaa

SEQ ID NO: 35824 - DNA, 75 bp, Artificial Sequence
  Synthetic
aaaaatttggaaataacaatatgttcgtaggaatatggaaatttgggcaatatctaatgtcactgccatatgtca

SEQ ID NO: 35825 - DNA, 75 bp, Artificial Sequence
  Synthetic
acttgctaaaatattggaggttacagatcagcaccatcggtctatatctggaaggcaagagtcattggctagtgc

SEQ ID NO: 35826 - DNA, 75 bp, Artificial Sequence
  Synthetic
gatcagcaccatcggtctatatctggaaggcaagagtcattggctagtgctacccctgggagtaagtccaaggag

SEQ ID NO: 35827 - DNA, 75 bp, Artificial Sequence
  Synthetic
gtataagccctaggtttggtgttccgatggaaggattattggcatgtggggactcaccaaattacaaaatttata

SEQ ID NO: 35828 - DNA, 75 bp, Artificial Sequence
  Synthetic
gatggaaggattattggcatgtggggactcaccaaattacaaaatttataaaacaccagcaaagctttataaatc

SEQ ID NO: 35829 - DNA, 75 bp, Artificial Sequence
  Synthetic
tcaggtgacgttcattgttcccaggagctaagcccagcatcacaagaatctgttgacaggataaaacaaattact

SEQ ID NO: 35830 - DNA, 75 bp, Artificial Sequence
  Synthetic
tgctttttgacggaacctgaagtaagtgatgacgttttttcaattgcaatatccacgtgcaaagttcaagataag

SEQ ID NO: 35831 - DNA, 75 bp, Artificial Sequence
  Synthetic
ataaacccggcaataatcagtgattgtttatgggagtaccattcccgaaaatccaagtacatcaccagcttggac

SEQ ID NO: 35832 - DNA, 75 bp, Artificial Sequence
  Synthetic
gtttatgggagtaccattcccgaaaatccaagtacatcaccagcttggacctggaaagtctagaagaatttaaaa

SEQ ID NO: 35833 - DNA, 75 bp, Artificial Sequence
  Synthetic
tactcttatagtgtataatttcaaaccaacagctaatcttcctcatataaagccgatatacaaatatatcacagt

SEQ ID NO: 35834 - DNA, 75 bp, Artificial Sequence
  Synthetic
ccaacagctaatcttcctcatataaagccgatatacaaatatatcacagtgcaaggggtggagaattctgatgga

SEQ ID NO: 35835 - DNA, 75 bp, Artificial Sequence
  Synthetic
gtatgccagctttaagcggaacaagtataggatataatataatgtctagagataactttccattatttgatataa

SEQ ID NO: 35836 - DNA, 75 bp, Artificial Sequence
  Synthetic
aacaaaggtgtatagaaaggcagttgaggagagtgtcttattaacagtatgtataacttaccctggtaaaacatt

SEQ ID NO: 35837 - DNA, 75 bp, Artificial Sequence
  Synthetic
acaaggttgtgggaacatacagaaaaccaattcatccattataggaacaggtactgcaaagtttgattatgtgtg

SEQ ID NO: 35838 - DNA, 75 bp, Artificial Sequence
  Synthetic
accaattcatccattataggaacaggtactgcaaagtttgattatgtgtgtcacggtgcttccagaaaagatatc

SEQ ID NO: 35839 - DNA, 75 bp, Artificial Sequence
  Synthetic
gatctgaggtacaagtcatttgcagaaaacccagatttggaaatagaggcaaagtgtgttggatgcccatcatgt

SEQ ID NO: 35840 - DNA, 75 bp, Artificial Sequence
  Synthetic
aaaacccagatttggaaatagaggcaaagtgtgttggatgcccatcatgttttactagttactcctgcagcttca

SEQ ID NO: 35841 - DNA, 75 bp, Artificial Sequence
  Synthetic
atgctcaattgaagggccttgtacaacttttcataataggttgatgatcacctctacaaaacaagattatggcat

SEQ ID NO: 35842 - DNA, 75 bp, Artificial Sequence
  Synthetic
acttttcataataggttgatgatcacctctacaaaacaagattatggcatcaaaatgagctgtaagacaaagcca

SEQ ID NO: 35843 - DNA, 75 bp, Artificial Sequence
  Synthetic
tggaagctactttagtatagctttttatgtagtggtcagtattattgtcctatttctagcaatctacatcttctt

SEQ ID NO: 35844 - DNA, 75 bp, Artificial Sequence
  Synthetic
tatgtagtggtcagtattattgtcctatttctagcaatctacatcttcttacctatggtgttcaaactcagagat

SEQ ID NO: 35845 - DNA, 75 bp, Artificial Sequence
  Synthetic
acttgcaggaaataaagcataagtaattaattgagaaatcatcattttagttttaaaaataaactttatatatta

SEQ ID NO: 35846 - DNA, 75 bp, Artificial Sequence
  Synthetic
attaattgagaaatcatcattttagttttaaaaataaactttatatattagccttagggcaaattagctgttatt

SEQ ID NO: 35847 - DNA, 75 bp, Artificial Sequence
  Synthetic
ttacaataaaacccatcaaaaaaatggatgatcagatgtatgatcagttcttgaagaggattcaagcttctagga

SEQ ID NO: 35848 - DNA, 75 bp, Artificial Sequence
  Synthetic
tactgatattctagaagcaagacatgattactttggtcgtgaactatgctcagccataggaattgaatacaagaa

SEQ ID NO: 35849 - DNA, 75 bp, Artificial Sequence
  Synthetic
gattactttggtcgtgaactatgctcagccataggaattgaatacaagaataatgttcttttagatgagattatc

SEQ ID NO: 35850 - DNA, 75 bp, Artificial Sequence
  Synthetic
tcatggattataatatcccaaatgtgactccggacaattacatctgggatggtgatttcttgattataatggact

SEQ ID NO: 35851 - DNA, 75 bp, Artificial Sequence
  Synthetic
gactccggacaattacatctgggatggtgatttcttgattataatggactataaagtatcagttggaactgatag

SEQ ID NO: 35852 - DNA, 75 bp, Artificial Sequence
  Synthetic
actaccttaattctaccaattatggagagtctaggcatccctacagaagtagctataatacgtgccaacccactt

SEQ ID NO: 35853 - DNA, 75 bp, Artificial Sequence
  Synthetic
agagtctaggcatccctacagaagtagctataatacgtgccaacccacttacataccaattgacaattatagggg

SEQ ID NO: 35854 - DNA, 75 bp, Artificial Sequence
  Synthetic
cattccactgcagttggattttacaaaattctttgaattgcgtaaaatgttattagacaaatttgcagacgatga

SEQ ID NO: 35855 - DNA, 75 bp, Artificial Sequence
  Synthetic
aaattctttgaattgcgtaaaatgttattagacaaatttgcagacgatgaggaattcttgctgatgattgcacat

SEQ ID NO: 35856 - DNA, 75 bp, Artificial Sequence
  Synthetic
ggtgtgtagatgataccccagaattatcagaccatcctgtatatcaagaatttctaggatccatgcctagaagat

SEQ ID NO: 35857 - DNA, 75 bp, Artificial Sequence
  Synthetic
atcagaccatcctgtatatcaagaatttctaggatccatgcctagaagatttgttgacctattccatgaagctat

SEQ ID NO: 35858 - DNA, 75 bp, Artificial Sequence
  Synthetic
agatggaatacactgctgtatagagcaaaatctataacagatgaagattatcaagattacttatcaaggaaggca

SEQ ID NO: 35859 - DNA, 75 bp, Artificial Sequence
  Synthetic
caaaatctataacagatgaagattatcaagattacttatcaaggaaggcacataatatattcgatatggatggga

SEQ ID NO: 35860 - DNA, 75 bp, Artificial Sequence
  Synthetic
gattgacaagggttgggaaatgatgagcatgagagttgcacaagagcgagatatcataactgatacaacaaaaca

SEQ ID NO: 35861 - DNA, 75 bp, Artificial Sequence
  Synthetic
agcatgagagttgcacaagagcgagatatcataactgatacaacaaaacagaaaccctctatccatttcatttgg

SEQ ID NO: 35862 - DNA, 75 bp, Artificial Sequence
  Synthetic
tgggatcaactgctaagttgattttcttatcaaattcactcaaatctataaatgagcaatccacttggtcagagt

SEQ ID NO: 35863 - DNA, 75 bp, Artificial Sequence
  Synthetic
cttatcaaattcactcaaatctataaatgagcaatccacttggtcagagtcattaattgcaattggtatgagtat

SEQ ID NO: 35864 - DNA, 75 bp, Artificial Sequence
  Synthetic
tatgagtcactatgtgcagaaaggaagatgattgctagatcgacagggaaaaagatagataataaaagacttgat

SEQ ID NO: 35865 - DNA, 75 bp, Artificial Sequence
  Synthetic
agatgattgctagatcgacagggaaaaagatagataataaaagacttgatgcagtaaaaattggtaatgcccttg

SEQ ID NO: 35866 - DNA, 75 bp, Artificial Sequence
  Synthetic
agcaaatgagctctttaaaaatcaagaaagacaaaaatttctaaagaacttttttggaattggtaaacacaagtc

SEQ ID NO: 35867 - DNA, 75 bp, Artificial Sequence
  Synthetic
gaaagacaaaaatttctaaagaacttttttggaattggtaaacacaagtcatttaaagacaaaactgccacagac

SEQ ID NO: 35868 - DNA, 75 bp, Artificial Sequence
  Synthetic
tagattttaataatagcattgttttaatggcagctaaggctatggtaaataagaataaagtgttcctctcccagc

SEQ ID NO: 35869 - DNA, 75 bp, Artificial Sequence
  Synthetic
aatggcagctaaggctatggtaaataagaataaagtgttcctctcccagcaaaacaccttgaatgattcccatcc

SEQ ID NO: 35870 - DNA, 75 bp, Artificial Sequence
  Synthetic
atagaagaggcatctgaagaaacagcagagatactaaagaaaatctcaaaaacttgcttttggcaatgcattact

SEQ ID NO: 35871 - DNA, 75 bp, Artificial Sequence
  Synthetic
cagagatactaaagaaaatctcaaaaacttgcttttggcaatgcattactgatatatctacattgatgcggaata

SEQ ID NO: 35872 - DNA, 75 bp, Artificial Sequence
  Synthetic
gcacaatacttttagagtagcaatgtgtgcaaatgattcagtttatgggttggttttcccatcttcagatataaa

SEQ ID NO: 35873 - DNA, 75 bp, Artificial Sequence
  Synthetic
tgtgcaaatgattcagtttatgggttggttttcccatcttcagatataaagaccaaaagagctacagtagtcttc

SEQ ID NO: 35874 - DNA, 75 bp, Artificial Sequence
  Synthetic
aaaaggatattatggatgcaggggccttgttcacaacacttgaattgaaaacgaaaaattacatatctatcagca

SEQ ID NO: 35875 - DNA, 75 bp, Artificial Sequence
  Synthetic
cttgttcacaacacttgaattgaaaacgaaaaattacatatctatcagcaaggccatcagattggacaaagaaag

SEQ ID NO: 35876 - DNA, 75 bp, Artificial Sequence
  Synthetic
ggtctattcttattaagttcattactgttatataataacaatcctttaatatcccttgttgatgtattaaatttt

SEQ ID NO: 35877 - DNA, 75 bp, Artificial Sequence
  Synthetic
tgttatataataacaatcctttaatatcccttgttgatgtattaaattttacattttatactagcttatcaataa

SEQ ID NO: 35878 - DNA, 75 bp, Artificial Sequence
  Synthetic
gccttctcgatatatgataatgaattctttggctatatctagccacgtcaaagattatatagcagagaaattttc

SEQ ID NO: 35879 - DNA, 75 bp, Artificial Sequence
  Synthetic
tctttggctatatctagccacgtcaaagattatatagcagagaaattttcaccatataccaaaactttgtttagt

SEQ ID NO: 35880 - DNA, 75 bp, Artificial Sequence
  Synthetic
tgggatgcagttctgcaaatgagcaatctagtaaaatacaattgagaaacatctatttatctgattatgacataa

SEQ ID NO: 35881 - DNA, 75 bp, Artificial Sequence
  Synthetic
atctagtaaaatacaattgagaaacatctatttatctgattatgacataacccaaaaaggtgtacatgacgaaag

SEQ ID NO: 35882 - DNA, 75 bp, Artificial Sequence
  Synthetic
ggcaaagttaatcttaaggaatacataaatcagatttatttacctttttatttcaatgctaaggggctacatgaa

SEQ ID NO: 35883 - DNA, 75 bp, Artificial Sequence
  Synthetic
taaatcagatttatttacctttttatttcaatgctaaggggctacatgaaaaacatcacgtgatgatggacttgg

SEQ ID NO: 35884 - DNA, 75 bp, Artificial Sequence
  Synthetic
gaaccaacgctctgaaaatctggggatatggtcaaaagcagaaaagaagcaacatgtgaatttaccaattttgat

SEQ ID NO: 35885 - DNA, 75 bp, Artificial Sequence
  Synthetic
atatggtcaaaagcagaaaagaagcaacatgtgaatttaccaattttgattcactccttatcaaaatcactcatt

SEQ ID NO: 35886 - DNA, 75 bp, Artificial Sequence
  Synthetic
ttagaaatagagtagaaagtaggaacaattttagaaggagcataacaaccattagtaccttcaccagttcaaaat

SEQ ID NO: 35887 - DNA, 75 bp, Artificial Sequence
  Synthetic
caattttagaaggagcataacaaccattagtaccttcaccagttcaaaatcttgtgttaaagttggagacttcaa

SEQ ID NO: 35888 - DNA, 75 bp, Artificial Sequence
  Synthetic
aaacaaaaggaaacaaataacaagactctagaaaaatataggttgtcaaatcctctatttttggaggacgaagaa

SEQ ID NO: 35889 - DNA, 75 bp, Artificial Sequence
  Synthetic
ctctagaaaaatataggttgtcaaatcctctatttttggaggacgaagaacaaacattggagacacaacactgta

SEQ ID NO: 35890 - DNA, 75 bp, Artificial Sequence
  Synthetic
accaaattataaggattatatatctgttaaggtatttgacagactttatgagttactaaaaaatgagacactgaa

SEQ ID NO: 35891 - DNA, 75 bp, Artificial Sequence
  Synthetic
gttaaggtatttgacagactttatgagttactaaaaaatgagacactgaaaaatgactcttttattgagcaagca

SEQ ID NO: 35892 - DNA, 75 bp, Artificial Sequence
  Synthetic
agtttgtatttacatttttcaataaagggcagaaaacagcaaaagacagggagatttttgtgggagaatttgaag

SEQ ID NO: 35893 - DNA, 75 bp, Artificial Sequence
  Synthetic
agggcagaaaacagcaaaagacagggagatttttgtgggagaatttgaagccaagatgtgcatgtatgtagtaga

SEQ ID NO: 35894 - DNA, 75 bp, Artificial Sequence
  Synthetic
ttgaatagtgatgagatgattagtgagcctggtgattcaaaattgagaatcttagaaaagaaagctgaagaggaa

SEQ ID NO: 35895 - DNA, 75 bp, Artificial Sequence
  Synthetic
agcctggtgattcaaaattgagaatcttagaaaagaaagctgaagaggaaataagattcattgttgaaaggacaa

SEQ ID NO: 35896 - DNA, 75 bp, Artificial Sequence
  Synthetic
cacaaaagcattaaaacttgaaataaatgctgatatgtctaaatggagtgcccaagatgttttttacaaatattt

SEQ ID NO: 35897 - DNA, 75 bp, Artificial Sequence
  Synthetic
aatgctgatatgtctaaatggagtgcccaagatgttttttacaaatatttttggttgattgctttagacccaata

SEQ ID NO: 35898 - DNA, 75 bp, Artificial Sequence
  Synthetic
ttttattttttatgtcaaactacatgcaaaagcatttaataataccagatgatctcattgcgaatatcttagacc

SEQ ID NO: 35899 - DNA, 75 bp, Artificial Sequence
  Synthetic
gcaaaagcatttaataataccagatgatctcattgcgaatatcttagaccagaaaaccccttataaaaatgactt

SEQ ID NO: 35900 - DNA, 75 bp, Artificial Sequence
  Synthetic
aataggaatttcgttaatatcaagaggaattggctccagggcaattttaattatatatccagctatgtacacagt

SEQ ID NO: 35901 - DNA, 75 bp, Artificial Sequence
  Synthetic
ggaattggctccagggcaattttaattatatatccagctatgtacacagttgtgcaatgttagtctacaaggata

SEQ ID NO: 35902 - DNA, 75 bp, Artificial Sequence
  Synthetic
tgaaggggattgtttagttaactctatggtccattcagatgacaaccagacttcactggcaatcttacaaaataa

SEQ ID NO: 35903 - DNA, 75 bp, Artificial Sequence
  Synthetic
atggtccattcagatgacaaccagacttcactggcaatcttacaaaataaggtccctgatgatatgattatacaa

SEQ ID NO: 35904 - DNA, 75 bp, Artificial Sequence
  Synthetic
tctgcttatcatttggttgtcaagcaaatatgaagaaaacatatgttacacatacttgtaaagaatttgtttcac

SEQ ID NO: 35905 - DNA, 75 bp, Artificial Sequence
  Synthetic
aaatatgaagaaaacatatgttacacatacttgtaaagaatttgtttcactctttaatcttcatggggagcctct

SEQ ID NO: 35906 - DNA, 75 bp, Artificial Sequence
  Synthetic
cctagcgtaggtgattgtgcatacattggtccttatgaagacttggcaagtagattatcagcagcacaacaaagt

SEQ ID NO: 35907 - DNA, 75 bp, Artificial Sequence
  Synthetic
ttggtccttatgaagacttggcaagtagattatcagcagcacaacaaagtataaaacatggttgtccaccaagtt

SEQ ID NO: 35908 - DNA, 75 bp, Artificial Sequence
  Synthetic
ccactggataacatatctaacatacaatatgctagatgatcaaataaattctcctcttaactatcttccctttaa

SEQ ID NO: 35909 - DNA, 75 bp, Artificial Sequence
  Synthetic
aatatgctagatgatcaaataaattctcctcttaactatcttccctttaagagtcgtcatgatataccggtagaa

SEQ ID NO: 35910 - DNA, 75 bp, Artificial Sequence
  Synthetic
tgtatctgatagctttagttggtttagaagcaggaaacctttggtttttgatgaatatcctaaaaaaactagttc

SEQ ID NO: 35911 - DNA, 75 bp, Artificial Sequence
  Synthetic
agaagcaggaaacctttggtttttgatgaatatcctaaaaaaactagttccattggataagcaacgagaaacaat

SEQ ID NO: 35912 - DNA, 75 bp, Artificial Sequence
  Synthetic
tcattgaagggcttaaacgattcagatatcttcagactcaaaatattaagatatttgactttagacacagaaata

SEQ ID NO: 35913 - DNA, 75 bp, Artificial Sequence
  Synthetic
atatcttcagactcaaaatattaagatatttgactttagacacagaaataactggcgacaataatatgggggaaa

SEQ ID NO: 35914 - DNA, 75 bp, Artificial Sequence
  Synthetic
actcacaccaagaaagtttactactgtaagttcattaaacaagttgatatcatataatgattttaaagaatctat

SEQ ID NO: 35915 - DNA, 75 bp, Artificial Sequence
  Synthetic
gtaagttcattaaacaagttgatatcatataatgattttaaagaatctatgtctactgacaattataaggaaaat

SEQ ID NO: 35916 - DNA, 75 bp, Artificial Sequence
  Synthetic
agttgttggtcacaaaaggtgaagataaagaacaattcatgcaatctatactgtatagatataattcaaagagat

SEQ ID NO: 35917 - DNA, 75 bp, Artificial Sequence
  Synthetic
taaagaacaattcatgcaatctatactgtatagatataattcaaagagatttaaagaaagtttgtccatacagaa

SEQ ID NO: 35918 - DNA, 75 bp, Artificial Sequence
  Synthetic
atattattctcccacaagccaattatagattacagtagtatcttcgacaaactaacttctctagcagagtcagat

SEQ ID NO: 35919 - DNA, 75 bp, Artificial Sequence
  Synthetic
tagattacagtagtatcttcgacaaactaacttctctagcagagtcagatttaattgcagagctgccagaaatta

SEQ ID NO: 35920 - DNA, 75 bp, Artificial Sequence
  Synthetic
ttatcaaatgatcaacagagatattggccaattaccattagacatcaatgatgtaaaagtagtatttaaatattg

SEQ ID NO: 35921 - DNA, 75 bp, Artificial Sequence
  Synthetic
ggccaattaccattagacatcaatgatgtaaaagtagtatttaaatattgtattttgaatgatccattgatgata

SEQ ID NO: 35922 - DNA, 75 bp, Artificial Sequence
  Synthetic
gcgttagaggaaccccacaggacagaacagggttgagtgctaaccaaatgcccgaatttagaaatatgaaactca

SEQ ID NO: 35923 - DNA, 75 bp, Artificial Sequence
  Synthetic
aacagggttgagtgctaaccaaatgcccgaatttagaaatatgaaactcatccatcattccccagcattggttct

SEQ ID NO: 35924 - DNA, 75 bp, Artificial Sequence
  Synthetic
gatatagcaggcgctgatcctatagaactggcaaaggacttacaccatcttgaggagtttttatcaaacacgggg

SEQ ID NO: 35925 - DNA, 75 bp, Artificial Sequence
  Synthetic
aactggcaaaggacttacaccatcttgaggagtttttatcaaacacggggatacaagacaaaataaatcaaaata

SEQ ID NO: 35926 - DNA, 75 bp, Artificial Sequence
  Synthetic
cgatacagaaattcttatgtacaaaataagagagataacaaagctataccagctctgctatgattatataaagtc

SEQ ID NO: 35927 - DNA, 75 bp, Artificial Sequence
  Synthetic
ataagagagataacaaagctataccagctctgctatgattatataaagtcaactgaacacaaagttaaggttttt

SEQ ID NO: 35928 - DNA, 75 bp, Artificial Sequence
  Synthetic
ctgttgatttctgcaccttgatacaaggcaataccattagggatgataaatggtacacaatgcattatttaaaac

SEQ ID NO: 35929 - DNA, 75 bp, Artificial Sequence
  Synthetic
aggcaataccattagggatgataaatggtacacaatgcattatttaaaacaaattgttagtggttcagtgaaagg

SEQ ID NO: 35930 - DNA, 75 bp, Artificial Sequence
  Synthetic
gagcaattaatagcatcagagtgctttagagtgttatgtcattttgcagactcttttgtagaagaagggagtcgc

SEQ ID NO: 35931 - DNA, 75 bp, Artificial Sequence
  Synthetic
ttagagtgttatgtcattttgcagactcttttgtagaagaagggagtcgcttgagtttcattacagaggtcatag

SEQ ID NO: 35932 - DNA, 75 bp, Artificial Sequence
  Synthetic
tgtcaattctctatataatataatattaggaagtaacatgagactcgactttttacctctactatttagaatgca

SEQ ID NO: 35933 - DNA, 75 bp, Artificial Sequence
  Synthetic
ttaggaagtaacatgagactcgactttttacctctactatttagaatgcaatctttaacacaatcagatttgaac

SEQ ID NO: 35934 - DNA, 75 bp, Artificial Sequence
  Synthetic
aaagagtttcatggaacaattggcaaacaaatcgatctttgaattcaggcattattgatctgacaatatctgggt

SEQ ID NO: 35935 - DNA, 75 bp, Artificial Sequence
  Synthetic
aacaaatcgatctttgaattcaggcattattgatctgacaatatctgggtatctacgatcaatacgaatagtagg

SEQ ID NO: 35936 - DNA, 75 bp, Artificial Sequence
  Synthetic
gaactcacagtacctaatttttatccaaatacagtatttcatgctggcaataaattattgaattccaagcatggc

SEQ ID NO: 35937 - DNA, 75 bp, Artificial Sequence
  Synthetic
caaatacagtatttcatgctggcaataaattattgaattccaagcatggcctaaagttcgaatatatgcaggagg

SEQ ID NO: 35938 - DNA, 75 bp, Artificial Sequence
  Synthetic
ctacataacattccaaaaaaagagagcacacatttacacttatcaggtctctaccatagaccatataataaaaag

SEQ ID NO: 35939 - DNA, 75 bp, Artificial Sequence
  Synthetic
gcacacatttacacttatcaggtctctaccatagaccatataataaaaagaaatgaagaaggactatcaactaga

SEQ ID NO: 35940 - DNA, 75 bp, Artificial Sequence
  Synthetic
cagtctgtcctgttgtattatcagttagagatgaactcttcaggatgaatatggacaatgtcttcagtttaaaca

SEQ ID NO: 35941 - DNA, 75 bp, Artificial Sequence
  Synthetic
tagagatgaactcttcaggatgaatatggacaatgtcttcagtttaaacatgacaaattttagcatgtcacgatt

SEQ ID NO: 35942 - DNA, 75 bp, Artificial Sequence
  Synthetic
accataaagaaggcgcacatgtctaaaatgatgttcttcaatggtcccgacataaaggcaggcattgtgaatctg

SEQ ID NO: 35943 - DNA, 75 bp, Artificial Sequence
  Synthetic
aaatgatgttcttcaatggtcccgacataaaggcaggcattgtgaatctgacggcattaatgagaacccaagaat

SEQ ID NO: 35944 - DNA, 75 bp, Artificial Sequence
  Synthetic
ctgcaaatcaagcattataccattttgcaggatactagactgttccggtgaagaacaaggagaactcatcttcct

SEQ ID NO: 35945 - DNA, 75 bp, Artificial Sequence
  Synthetic
tgcaggatactagactgttccggtgaagaacaaggagaactcatcttcctctctgacgaaattatggatttcact

SEQ ID NO: 35946 - DNA, 75 bp, Artificial Sequence
  Synthetic
caatatttactataaaatatcaaaagaaaggttcagagaagatgacatataaaaatgcaatatcaaaattggtaa

SEQ ID NO: 35947 - DNA, 75 bp, Artificial Sequence
  Synthetic
gaaaggttcagagaagatgacatataaaaatgcaatatcaaaattggtaaccagaggtgtagaagaaataaaaga

SEQ ID NO: 35948 - DNA, 75 bp, Artificial Sequence
  Synthetic
ttctactcaaaaaagaatctcgggataataaacactatcagctctataataaatttactagaaacaaatgaatgg

SEQ ID NO: 35949 - DNA, 75 bp, Artificial Sequence
  Synthetic
taataaacactatcagctctataataaatttactagaaacaaatgaatggtcatctatcttgcttaattcatttc

SEQ ID NO: 35950 - DNA, 75 bp, Artificial Sequence
  Synthetic
ggatagggagtttcacttgttcactctgccagctgccttctacataaatacagctgcaggaataatcaactggac

SEQ ID NO: 35951 - DNA, 75 bp, Artificial Sequence
  Synthetic
ctgccagctgccttctacataaatacagctgcaggaataatcaactggaccaagatgctaaaatttataaaatca

SEQ ID NO: 35952 - DNA, 75 bp, Artificial Sequence
  Synthetic
ggtcaacaatgatgaaaagattcattgagaaaacaatatttcttatcgagaaggaaatgaacaaggaagcaaact

SEQ ID NO: 35953 - DNA, 75 bp, Artificial Sequence
  Synthetic
tgagaaaacaatatttcttatcgagaaggaaatgaacaaggaagcaaactttgaagatttcttagatgaattaga

SEQ ID NO: 35954 - DNA, 75 bp, Artificial Sequence
  Synthetic
acctttttctaagcaacagcaccaaacacaaccataattggccatttccaaaagccactctgtggcactaccata

SEQ ID NO: 35955 - DNA, 75 bp, Artificial Sequence
  Synthetic
acacaaccataattggccatttccaaaagccactctgtggcactaccataaaacggcatttgagatcaatttctt

SEQ ID NO: 35956 - DNA, 75 bp, Artificial Sequence
  Synthetic
agtagtgtactccacactaaaaactttcaattgctgattttccaaaccttatacaaagggtgtatccgatgattg

SEQ ID NO: 35957 - DNA, 75 bp, Artificial Sequence
  Synthetic
tgacccagaaaaactgattataaaatcaaaaattattaatccgcttgcagagaagaatggtataacctgggcaga

SEQ ID NO: 35958 - DNA, 75 bp, Artificial Sequence
  Synthetic
tcaaaaattattaatccgcttgcagagaagaatggtataacctgggcagacggggaggaagtttatctctcattc

SEQ ID NO: 35959 - DNA, 75 bp, Artificial Sequence
  Synthetic
gaactttcagattctatccattggcaattggcatttataaagtgcagaggaaggagatggaaccgaaatatctgg

SEQ ID NO: 35960 - DNA, 75 bp, Artificial Sequence
  Synthetic
aattggcatttataaagtgcagaggaaggagatggaaccgaaatatctggagaagaccatgcgccaaagatacat

SEQ ID NO: 35961 - DNA, 75 bp, Artificial Sequence
  Synthetic
gtcagtaaattgaacgaagttcaatctgcactgactgtggtgtcaggacttgggtggaagaaaacaaatgtaagc

SEQ ID NO: 35962 - DNA, 75 bp, Artificial Sequence
  Synthetic
ctgcactgactgtggtgtcaggacttgggtggaagaaaacaaatgtaagcagtgctgctagagaattcctagcaa

SEQ ID NO: 35963 - DNA, 75 bp, Artificial Sequence
  Synthetic
tcatcagaattgtaatctggataaattgtattttgaatttggctaaaagagtcttcggactcaaaataaaaaaac

SEQ ID NO: 35964 - DNA, 75 bp, Artificial Sequence
  Synthetic
agcttgttgggtgggtggttggggacagaaagagttcagcaaactgtttttgaagcattgcagtttcttttaagt

SEQ ID NO: 35965 - DNA, 75 bp, Artificial Sequence
  Synthetic
agtagtgtactaccgatacatcacaaacctttcagagacacatctttatttccaagatgagaattctaatactgc

SEQ ID NO: 35966 - DNA, 75 bp, Artificial Sequence
  Synthetic
aacctttcagagacacatctttatttccaagatgagaattctaatactgcttttagcagtcactcaactggctgt

SEQ ID NO: 35967 - DNA, 75 bp, Artificial Sequence
  Synthetic
ttttagcagtcactcaactggctgtgagtagcccagttatcactagatgctttcatggtgggcaactgattgcag

SEQ ID NO: 35968 - DNA, 75 bp, Artificial Sequence
  Synthetic
tataacagttgataggaaaaatgcccaaattatatttcagacagacaaacttaatcattttgaagtgacaggaac

SEQ ID NO: 35969 - DNA, 75 bp, Artificial Sequence
  Synthetic
tcgatctgccaaaatattgagctgattataataacaatattggcattatgtatatttataattatgataatctta

SEQ ID NO: 35970 - DNA, 75 bp, Artificial Sequence
  Synthetic
ttttgcttatggatgggcgtacaacaggagttgtaagaaatgcacttgttgcggattggcatatcatccctttac

SEQ ID NO: 35971 - DNA, 75 bp, Artificial Sequence
  Synthetic
ggctccaaatttgaaacatcggacagaatgaggatgcaccgagaatcagggttatgtcagggttttaaaagcctg

SEQ ID NO: 35972 - DNA, 75 bp, Artificial Sequence
  Synthetic
gaatgaggatgcaccgagaatcagggttatgtcagggttttaaaagcctgagagtagcaagaaggctttgcaaat

SEQ ID NO: 35973 - DNA, 75 bp, Artificial Sequence
  Synthetic
catcttactctcagtgctgattctatcctttgtaacacccatagaagggactctcacaaactaccctactgatca

SEQ ID NO: 35974 - DNA, 75 bp, Artificial Sequence
  Synthetic
tcctttgtaacacccatagaagggactctcacaaactaccctactgatcagaaatatactttagatgagatagca

SEQ ID NO: 35975 - DNA, 75 bp, Artificial Sequence
  Synthetic
aagattctacaaaatactatataatattatatacatcactcttcggtgcaggtctgaccatcatttttgcaggag

SEQ ID NO: 35976 - DNA, 75 bp, Artificial Sequence
  Synthetic
attatatacatcactcttcggtgcaggtctgaccatcatttttgcaggagtagcattggggttaacaattatact

SEQ ID NO: 35977 - DNA, 75 bp, Artificial Sequence
  Synthetic
attttttgcaacgaatgcaacatgtaccatagcaaaaaatcaatcaaatatgtaggtgatttcactaataaatgt

SEQ ID NO: 35978 - DNA, 75 bp, Artificial Sequence
  Synthetic
gggttttgtacgtgtgggctgctagaggatccagagggtgttgttgtacataaagctaaaaaatcctgtacatat

SEQ ID NO: 35979 - DNA, 75 bp, Artificial Sequence
  Synthetic
aatagcccgttttgtgctcagtgcattgctgacaattcttgtgcgcaaggttcttgggaatttgatacacatatg

SEQ ID NO: 35980 - DNA, 75 bp, Artificial Sequence
  Synthetic
atatcagccaacagaattaacccgatctggtggtcaacaaacatcattagcaaattctgtagtaggtcaagcaac

SEQ ID NO: 35981 - DNA, 75 bp, Artificial Sequence
  Synthetic
caaattctgtagtaggtcaagcaacgaaagaatgtaaaaagtacaaagatgttagttgcttaagcccaagatttg

SEQ ID NO: 35982 - DNA, 75 bp, Artificial Sequence
  Synthetic
atttataaaaagccaaaaaaagtctacaaagctcatgacaaagaagaaacatggtgcattaatgatcagcattgc

SEQ ID NO: 35983 - DNA, 75 bp, Artificial Sequence
  Synthetic
ccgatactgtagaaaaattgaaacctatgaaatgttggttagttgaccctggcaagaatgatgatgtctactcta

SEQ ID NO: 35984 - DNA, 75 bp, Artificial Sequence
  Synthetic
tatgaaatgttggttagttgaccctggcaagaatgatgatgtctactctattgcaataaaaacatgtagagtggt

SEQ ID NO: 35985 - DNA, 75 bp, Artificial Sequence
  Synthetic
tcacaaaaatggaatataatcaaatgtgattctggtccgctctactacagtgaccacataccaggggaagataca

SEQ ID NO: 35986 - DNA, 75 bp, Artificial Sequence
  Synthetic
gtgattctggtccgctctactacagtgaccacataccaggggaagatacaggcaatgatataggacattattgtg

SEQ ID NO: 35987 - DNA, 75 bp, Artificial Sequence
  Synthetic
atacccaattaatcctgatgttgttactgactgtgtgtgggaatttacttctaggaaatcacaatatataggcaa

SEQ ID NO: 35988 - DNA, 75 bp, Artificial Sequence
  Synthetic
gatctccatgcagtctcttgaagattacgaaaaggctttaactgacagattgacccataccttggaaacctatag

SEQ ID NO: 35989 - DNA, 75 bp, Artificial Sequence
  Synthetic
ttactgcacaaggagtcgaaaactcagacggtatagaaggggcattcataacagccagtatcccagccgctgggg

SEQ ID NO: 35990 - DNA, 75 bp, Artificial Sequence
  Synthetic
atcaaaagatggcttcccactccttgatctaatagtttttgtgaagagtgctgtgataaaaagcacatacaacca

SEQ ID NO: 35991 - DNA, 75 bp, Artificial Sequence
  Synthetic
gatctaatagtttttgtgaagagtgctgtgataaaaagcacatacaaccatatatatgatactgggccaacaatt

SEQ ID NO: 35992 - DNA, 75 bp, Artificial Sequence
  Synthetic
attgcactggccaatgtccaagcaatatagaacatgaggctaactggttgacattttcacaagaaagaactagca

SEQ ID NO: 35993 - DNA, 75 bp, Artificial Sequence
  Synthetic
tatagaacatgaggctaactggttgacattttcacaagaaagaactagcagatggggatgcgaagagtttgggtg

SEQ ID NO: 35994 - DNA, 75 bp, Artificial Sequence
  Synthetic
tttgggtcttgtcaagatgtaattagaccagaaacaaaagtttacaggaaagctgtagatgaagttgttatttta

SEQ ID NO: 35995 - DNA, 75 bp, Artificial Sequence
  Synthetic
gaccagaaacaaaagtttacaggaaagctgtagatgaagttgttattttaacagtttgtattacatatccaggac

SEQ ID NO: 35996 - DNA, 75 bp, Artificial Sequence
  Synthetic
catagagccaaaaataacggaagaaattgaactccagtttaaaacagttgacacgaaaacactaccatatatagt

SEQ ID NO: 35997 - DNA, 75 bp, Artificial Sequence
  Synthetic
ccaaaaaacaaacagcagcattttaggaactgggacaccaaaatttgattatacttgccatggtgctagtaggaa

SEQ ID NO: 35998 - DNA, 75 bp, Artificial Sequence
  Synthetic
actgtttataatacaaatcacttaattggtgagttagctataaaattgatattaggggatatccagtataaatta

SEQ ID NO: 35999 - DNA, 75 bp, Artificial Sequence
  Synthetic
tgattgctttgagagctattcctgcaatttccaaatagtatcaaatatagacacaatctgcagccttgaagggcc

SEQ ID NO: 36000 - DNA, 75 bp, Artificial Sequence
  Synthetic
tcaattaaagcaatgcagcaaaattatgctgtaaaactctcctgccagaaggatccaagaccatcagggactttt

SEQ ID NO: 36001 - DNA, 75 bp, Artificial Sequence
  Synthetic
agtgtaatttttgaaccaattaaagccttctttgggagttatttcagcatcttcttctacataattgttgttgta

SEQ ID NO: 36002 - DNA, 75 bp, Artificial Sequence
  Synthetic
tttttatgccaatgtttatgaagttaaaggaagtgttgaaagcaaatgagaagctttacttgcaagaaattaagc

SEQ ID NO: 36003 - DNA, 75 bp, Artificial Sequence
  Synthetic
attcattgttaaatacattcaaaattcatattgacacattgtgtcaaaaaacaaggctgttttgttatcggtagc

SEQ ID NO: 36004 - DNA, 75 bp, Artificial Sequence
  Synthetic
ctagaggagcatgaaatatttcaagagtttattaattccatgccaccaagatttgtatcacttttcaaagaagca

SEQ ID NO: 36005 - DNA, 75 bp, Artificial Sequence
  Synthetic
tgtgttatgggaacaacaattcatcttagcaaacgacttatttaaaaatcaagaaaggcagaagttcatgaaaaa

SEQ ID NO: 36006 - DNA, 75 bp, Artificial Sequence
  Synthetic
agttttaaagataagacatctagcgacattgaaacggataagcctaaaatcttagatttcaataatactatagtc

SEQ ID NO: 36007 - DNA, 75 bp, Artificial Sequence
  Synthetic
acattgaaacggataagcctaaaatcttagatttcaataatactatagtcctgatggctgcaagaacaatggtta

SEQ ID NO: 36008 - DNA, 75 bp, Artificial Sequence
  Synthetic
tattctgtattttatgtgcaattatatgcaaaaactattaatacttccagatgatttaattgcaaatatcttaga

SEQ ID NO: 36009 - DNA, 75 bp, Artificial Sequence
  Synthetic
agttaaatgggtacttgaatgcaccattatatttgatagcattagtcggcttggaagctgggaacttatggtttt

SEQ ID NO: 36010 - DNA, 75 bp, Artificial Sequence
  Synthetic
tcactcttaacgcctcgcaaatttacaacattgggatccttaaataaactagtttcctataatgactttagatct

SEQ ID NO: 36011 - DNA, 75 bp, Artificial Sequence
  Synthetic
agcagatactgttttcccataaaccaatcatagattacagcagtatatttgataaattaacctcacttgcagaag

SEQ ID NO: 36012 - DNA, 75 bp, Artificial Sequence
  Synthetic
attatgtgttaaaggaacaccacaagatagaactggcctcagtgcaagtcaaatgcctgaatttagaaatatgaa

SEQ ID NO: 36013 - DNA, 75 bp, Artificial Sequence
  Synthetic
tgtctctagaaaatgtttttagtttaaacatgacaaactttagcatgtctagattatttgtttcacctgacgaag

SEQ ID NO: 36014 - DNA, 75 bp, Artificial Sequence
  Synthetic
cgttttgtagaatattagaatgtaatggcgatgagcaaggagaactaatatttctttcagatgaagtcatggatt

SEQ ID NO: 36015 - DNA, 75 bp, Artificial Sequence
  Synthetic
tccaaaagcactatgtggcaaaaatgataacagcattcaaaaaagtacaattttcttatgtaggagcacactact

SEQ ID NO: 36016 - DNA, 75 bp, Artificial Sequence
  Synthetic
ctacactactattatcaaggaatcattgcaaaatgctatttcccataattttactgatgatacagctggtatctt

SEQ ID NO: 36017 - DNA, 75 bp, Artificial Sequence
  Synthetic
ttgcaaaatgctatttcccataattttactgatgatacagctggtatcttcaacaccattgtcaacaaggtgttt

SEQ ID NO: 36018 - DNA, 75 bp, Artificial Sequence
  Synthetic
ttactgatgatacagctggtatcttcaacaccattgtcaacaaggtgtttccatgagggaactttggtcaaggag

SEQ ID NO: 36019 - DNA, 75 bp, Artificial Sequence
  Synthetic
aattctgtctcaaagatgatgtctcaatgattaaatcagagataacataccaaaaaaatgatacaggggtatatg

SEQ ID NO: 36020 - DNA, 75 bp, Artificial Sequence
  Synthetic
aatgattaaatcagagataacataccaaaaaaatgatacaggggtatatggccatagtaaaatttatagaaattg

SEQ ID NO: 36021 - DNA, 75 bp, Artificial Sequence
  Synthetic
aacccagtgccttcagcaggaggaagtattaatgtcatagaagtgaatgaagatatgagtttggcaacaaaaaat

SEQ ID NO: 36022 - DNA, 75 bp, Artificial Sequence
  Synthetic
gtattaatgtcatagaagtgaatgaagatatgagtttggcaacaaaaaattatatctgcaccagagattgtgtga

SEQ ID NO: 36023 - DNA, 75 bp, Artificial Sequence
  Synthetic
aatagttttccaaacagataatttgaaccattttgaagtgtcagggactacattaagttctggctggtttaaaac

SEQ ID NO: 36024 - DNA, 75 bp, Artificial Sequence
  Synthetic
aaccattttgaagtgtcagggactacattaagttctggctggtttaaaacaaaagcatctgttacattagataga

SEQ ID NO: 36025 - DNA, 75 bp, Artificial Sequence
  Synthetic
gtggcaaaaaaacagtacaattccatgcgtgcttcagaaatcatatgtcatgtgtaagatttttccacaatacta

SEQ ID NO: 36026 - DNA, 75 bp, Artificial Sequence
  Synthetic
tgcgtgcttcagaaatcatatgtcatgtgtaagatttttccacaatactattctgcctggatacatggcaacatc

SEQ ID NO: 36027 - DNA, 75 bp, Artificial Sequence
  Synthetic
attataattgtattgactatagcaatctttattatgttagttatcttgacgaaaacttatatatgttatttatta

SEQ ID NO: 36028 - DNA, 75 bp, Artificial Sequence
  Synthetic
tctttattatgttagttatcttgacgaaaacttatatatgttatttattaatgccactctttatgcctattgcat

SEQ ID NO: 36029 - DNA, 75 bp, Artificial Sequence
  Synthetic
aagctgtaaaaagtgtaattgctgtggccttgcatatcacccatttactaattgtgggtcattctgtgtatgtgg

SEQ ID NO: 36030 - DNA, 75 bp, Artificial Sequence
  Synthetic
ggccttgcatatcacccatttactaattgtgggtcattctgtgtatgtggtttgaagtttgaagcatcagataga

SEQ ID NO: 36031 - DNA, 75 bp, Artificial Sequence
  Synthetic
tttgccaaggttataagagtctaagagtagcacgaaggctgtgcaaatcaaaaggctcatcttttgttatatcta

SEQ ID NO: 36032 - DNA, 75 bp, Artificial Sequence
  Synthetic
agtagcacgaaggctgtgcaaatcaaaaggctcatcttttgttatatctatccttctgtcattgtttattttatc

SEQ ID NO: 36033 - DNA, 75 bp, Artificial Sequence
  Synthetic
atgactaattatcctgaggaaaggaaatatacactagaggaaatagcagatgttatagaaggtttctaccaagaa

SEQ ID NO: 36034 - DNA, 75 bp, Artificial Sequence
  Synthetic
aatatacactagaggaaatagcagatgttatagaaggtttctaccaagaagctaagataaaagaatatattgttt

SEQ ID NO: 36035 - DNA, 75 bp, Artificial Sequence
  Synthetic
tattttaatttcctcaatgctgatattgtataaacttcaaaacataacatattttctgagcaaattcaacgtgat

SEQ ID NO: 36036 - DNA, 75 bp, Artificial Sequence
  Synthetic
ttgtataaacttcaaaacataacatattttctgagcaaattcaacgtgatgtattgttcagaatgcagcatgtat

SEQ ID NO: 36037 - DNA, 75 bp, Artificial Sequence
  Synthetic
tgggtgattttactaataaatgtggcttctgcacttgtggtgaattggaagatgctgaaggattaagtatacata

SEQ ID NO: 36038 - DNA, 75 bp, Artificial Sequence
  Synthetic
cttctgcacttgtggtgaattggaagatgctgaaggattaagtatacataaagtgacaaaaagatgtacatatgc

SEQ ID NO: 36039 - DNA, 75 bp, Artificial Sequence
  Synthetic
atactagcaacattgttaattctattaattggtcaaaacacgctgctggttgtatctgcacaagcagattgctgg

SEQ ID NO: 36040 - DNA, 75 bp, Artificial Sequence
  Synthetic
taattggtcaaaacacgctgctggttgtatctgcacaagcagattgctgggagaaaacagaaatcacaatagact

SEQ ID NO: 36041 - DNA, 75 bp, Artificial Sequence
  Synthetic
tacatgtattaaacaagaagaaaaaacatatgcaaaagaagcacaaacacttgttgatcagaataaaatatcaca

SEQ ID NO: 36042 - DNA, 75 bp, Artificial Sequence
  Synthetic
acatatgcaaaagaagcacaaacacttgttgatcagaataaaatatcacaagcagacgcaaaacaagttgacatg

SEQ ID NO: 36043 - DNA, 75 bp, Artificial Sequence
  Synthetic
tcaaggcaatcaggtcacagaaaacatacacaacaatgcatatgctggaagccatattcctgagtaaatactgtg

SEQ ID NO: 36044 - DNA, 75 bp, Artificial Sequence
  Synthetic
atacacaacaatgcatatgctggaagccatattcctgagtaaatactgtgattattacagtctatttgaacataa

SEQ ID NO: 36045 - DNA, 75 bp, Artificial Sequence
  Synthetic
agactgattgcaaaaacagagagttttgacatttgtagtagacacactactcatcatttttgtagatgcatgagt

SEQ ID NO: 36046 - DNA, 75 bp, Artificial Sequence
  Synthetic
ttgacatttgtagtagacacactactcatcatttttgtagatgcatgagtgatgagacaaagtgtaagaatggtg

SEQ ID NO: 36047 - DNA, 75 bp, Artificial Sequence
  Synthetic
ttcaacttatcacagtaagagcaacttcctactacatgacttaagattattttacaaaatatatagtgcagcatt

SEQ ID NO: 36048 - DNA, 75 bp, Artificial Sequence
  Synthetic
ttcctactacatgacttaagattattttacaaaatatatagtgcagcatttccaggattatcagaagcaatgctt

SEQ ID NO: 36049 - DNA, 75 bp, Artificial Sequence
  Synthetic
caacaaacgcaataaaattattggaaaaattattcacaaaatatagctacaataatttattggtagggatattaa

SEQ ID NO: 36050 - DNA, 75 bp, Artificial Sequence
  Synthetic
aaaattattcacaaaatatagctacaataatttattggtagggatattaagatttggaaaatttttatttagcat

SEQ ID NO: 36051 - DNA, 75 bp, Artificial Sequence
  Synthetic
ggtggtgctcaaaaagcaatgatattgagacctactgatgaactaagaaccacatattctggtaagcaagaatct

SEQ ID NO: 36052 - DNA, 75 bp, Artificial Sequence
  Synthetic
tgagacctactgatgaactaagaaccacatattctggtaagcaagaatctttatcaaattcagttgttggcgaac

SEQ ID NO: 36053 - DNA, 75 bp, Artificial Sequence
  Synthetic
aaaaatatcctgcattagtcctagatttaatattcctttatcaagtatgatagcatgtggaaaccaacctaatta

SEQ ID NO: 36054 - DNA, 75 bp, Artificial Sequence
  Synthetic
tttaatattcctttatcaagtatgatagcatgtggaaaccaacctaattaccaaatctataaagaaccttctaaa

SEQ ID NO: 36055 - DNA, 75 bp, Artificial Sequence
  Synthetic
acacttggtgcaataaagatatacactgcttaaatgattttgagtcaattgaccaatcagcccttgatagattaa

SEQ ID NO: 36056 - DNA, 75 bp, Artificial Sequence
  Synthetic
ctgcttaaatgattttgagtcaattgaccaatcagcccttgatagattaaaaacaatgacatgcttcctaataga

SEQ ID NO: 36057 - DNA, 75 bp, Artificial Sequence
  Synthetic
tctattgctattcatagttgtaaagtcaaagataaaggacagtgtacaataagagacaaaaaatggaatattata

SEQ ID NO: 36058 - DNA, 75 bp, Artificial Sequence
  Synthetic
tcaaagataaaggacagtgtacaataagagacaaaaaatggaatattataaaatgtgacagtgaactattgtatt

SEQ ID NO: 36059 - DNA, 75 bp, Artificial Sequence
  Synthetic
cacagggaatgaaattggccattattgtctaagtcataaatgtggaacagacagataccctataaatccagaaat

SEQ ID NO: 36060 - DNA, 75 bp, Artificial Sequence
  Synthetic
tgtctaagtcataaatgtggaacagacagataccctataaatccagaaattattaaagattgtatctgggaattc

SEQ ID NO: 36061 - DNA, 75 bp, Artificial Sequence
  Synthetic
atagagtagacttggagagcttggaagaattcaaaagagctttatcagataagttgacacacactttaaccattt

SEQ ID NO: 36062 - DNA, 75 bp, Artificial Sequence
  Synthetic
agaattcaaaagagctttatcagataagttgacacacactttaaccatttataactttaaaccaactgctaattt

SEQ ID NO: 36063 - DNA, 75 bp, Artificial Sequence
  Synthetic
tatattactgctctgggagtagaaaattctgatggcctcgaggctgcatatatattaacaagtataccagcatta

SEQ ID NO: 36064 - DNA, 75 bp, Artificial Sequence
  Synthetic
attctgatggcctcgaggctgcatatatattaacaagtataccagcattaggaggaacaagtattggttataaca

SEQ ID NO: 36065 - DNA, 75 bp, Artificial Sequence
  Synthetic
aatggatgttataatctatgttaagagtgctgtaatacaaacaacttacaatcatatatatgatacaggaccgac

SEQ ID NO: 36066 - DNA, 75 bp, Artificial Sequence
  Synthetic
agtgctgtaatacaaacaacttacaatcatatatatgatacaggaccgaccataggaataaattcaaaacatgat

SEQ ID NO: 36067 - DNA, 75 bp, Artificial Sequence
  Synthetic
aaaatataacacatgaccaaaattggttaacattttcacaagaaagggcaagcagatggggttgtgaagaatttg

SEQ ID NO: 36068 - DNA, 75 bp, Artificial Sequence
  Synthetic
gttaacattttcacaagaaagggcaagcagatggggttgtgaagaatttgggtgtctagcaataaatacaggttg

SEQ ID NO: 36069 - DNA, 75 bp, Artificial Sequence
  Synthetic
ataagatcagacacaaaggtttataaaaaggcattagaagaaacagtagttttaactgtttgcataaactaccct

SEQ ID NO: 36070 - DNA, 75 bp, Artificial Sequence
  Synthetic
aaaaggcattagaagaaacagtagttttaactgtttgcataaactaccctggtaacacattttgcactgaggtca

SEQ ID NO: 36071 - DNA, 75 bp, Artificial Sequence
  Synthetic
tgatgttgaattacaatttaaaacagttgatactaagactttacctaacctccttgcagttactaatcataaatt

SEQ ID NO: 36072 - DNA, 75 bp, Artificial Sequence
  Synthetic
gttgatactaagactttacctaacctccttgcagttactaatcataaattatacagtggccaaataaatgactta

SEQ ID NO: 36073 - DNA, 75 bp, Artificial Sequence
  Synthetic
atgttcagaagaccaattcaactgtaatgggtgctggtacagtgaaatttgattacatatgtcatggtgcaagta

SEQ ID NO: 36074 - DNA, 75 bp, Artificial Sequence
  Synthetic
aatgggtgctggtacagtgaaatttgattacatatgtcatggtgcaagtaggaaagacataattataagaaggtg

SEQ ID NO: 36075 - DNA, 75 bp, Artificial Sequence
  Synthetic
tctttattaaaggaagaaaaagatttgatctttgcagataatcatgaaacaataacagtatctaattcaaaacat

SEQ ID NO: 36076 - DNA, 75 bp, Artificial Sequence
  Synthetic
tgatctttgcagataatcatgaaacaataacagtatctaattcaaaacatcttgtgggagaattgcaaattaaat

SEQ ID NO: 36077 - DNA, 75 bp, Artificial Sequence
  Synthetic
actatttgcagagagaccagagttagaggtggatgcaaaatgtgtaggatgtccttcatgttttgagagttattc

SEQ ID NO: 36078 - DNA, 75 bp, Artificial Sequence
  Synthetic
gaggtggatgcaaaatgtgtaggatgtccttcatgttttgagagttattcctgtaatttccaaatagtcacaaat

SEQ ID NO: 36079 - DNA, 75 bp, Artificial Sequence
  Synthetic
gcccttgcactattttccataacagaattattatcagttctacaaagcaatcttatggtattaagatgagttgcc

SEQ ID NO: 36080 - DNA, 75 bp, Artificial Sequence
  Synthetic
aattattatcagttctacaaagcaatcttatggtattaagatgagttgccccacaaaaccaaatcacatagaaaa

SEQ ID NO: 36081 - DNA, 75 bp, Artificial Sequence
  Synthetic
gatattctattcgatacagtggcaaaaaatgataaaatagagattgatacaggagatcaaacattattcgtgagg

SEQ ID NO: 36082 - DNA, 75 bp, Artificial Sequence
  Synthetic
aaaatgataaaatagagattgatacaggagatcaaacattattcgtgagggagaaagacaccaggtgtaagactt

SEQ ID NO: 36083 - DNA, 75 bp, Artificial Sequence
  Synthetic
tataagtgttatctttgagcctttaagagctttctttggaagttacttcagtattattttttatattattcttgc

SEQ ID NO: 36084 - DNA, 75 bp, Artificial Sequence
  Synthetic
agagctttctttggaagttacttcagtattattttttatattattcttgctgcaatattaatatttgtgggtgtt

SEQ ID NO: 36085 - DNA, 75 bp, Artificial Sequence
  Synthetic
gattaagagatgttcttaaaaggaatgaacatttatatttgcaagagataaaacataaataattatacataaatt

SEQ ID NO: 36086 - DNA, 75 bp, Artificial Sequence
  Synthetic
aaacataaataattatacataaatttaaaaacattatttattactaaaatgccttcgggcaaagtaagcagtttg

SEQ ID NO: 36087 - DNA, 75 bp, Artificial Sequence
  Synthetic
agtagtgtactccacttgaatactttgaaaatatcgtgctattacttgttgcttccagaaggaattgaattgagt

SEQ ID NO: 36088 - DNA, 75 bp, Artificial Sequence
  Synthetic
tttcctggaaacaggaacaacccaattggtaacaacgatcttaccatccaccggctttctggatatttagcaaga

SEQ ID NO: 36089 - DNA, 75 bp, Artificial Sequence
  Synthetic
gttatgtcggacttggttttctatgatgtcgcatccacaggtgcaaatggatttgatcctgatgcagggtatgtg

SEQ ID NO: 36090 - DNA, 75 bp, Artificial Sequence
  Synthetic
tgggtccttgagcatttcactgaagatgacgatgagtcccaaagagaactcataagaagcaccatcataaacccg

SEQ ID NO: 36091 - DNA, 75 bp, Artificial Sequence
  Synthetic
atgtcgcatccacaggtgcaaatggatttgatcctgatgcagggtatgtggacttctgtgctaaacatggagaat

SEQ ID NO: 36092 - DNA, 75 bp, Artificial Sequence
  Synthetic
ggaacaatggcccagaaatttatctttcattcttcccaggaacagaaatgtttctagaagttttcaaattctacc

SEQ ID NO: 36093 - DNA, 75 bp, Artificial Sequence
  Synthetic
cttcttcctcaatgccgcaaaggccaaggctgctctctcgcgtaagccagagaggaaagctaatcctaaatttgg

SEQ ID NO: 36094 - DNA, 75 bp, Artificial Sequence
  Synthetic
ctttaaccattggaatttacagagtcaagcatggtatgatggatcctcagtacctaaagaaggcacttaggcaac

SEQ ID NO: 36095 - DNA, 75 bp, Artificial Sequence
  Synthetic
aatcattttccagcaaacaggaacaatccaattggtaacaacgatcttaccatccaccgcatctcaggatacctt

SEQ ID NO: 36096 - DNA, 75 bp, Artificial Sequence
  Synthetic
atccaattggtaacaacgatcttaccatccaccgcatctcaggataccttgccagatgggtcctagagcaataca

SEQ ID NO: 36097 - DNA, 75 bp, Artificial Sequence
  Synthetic
atggatggcacagaagacagtgctcattgctaaaagcctaaaggatgttgagcagcttaaatggggaagaggagg

SEQ ID NO: 36098 - DNA, 75 bp, Artificial Sequence
  Synthetic
agcagcttaaatggggaagaggaggacttagtgatgctgcaagaactttcttgatcaaatttggtgtaaagctgc

SEQ ID NO: 36099 - DNA, 75 bp, Artificial Sequence
  Synthetic
agaactggtgaaaacaacagttatcaacccaattgcggagtcaaatggcatcagatgggagaatggtgcagaaat

SEQ ID NO: 36100 - DNA, 75 bp, Artificial Sequence
  Synthetic
aacccaattgcggagtcaaatggcatcagatgggagaatggtgcagaaatttatttggcattctttccaggaaca

SEQ ID NO: 36101 - DNA, 75 bp, Artificial Sequence
  Synthetic
tttaccctttgactattggaatctacagagtcaaaaacggaatgatggactcacagtatctgaagaaagccttaa

SEQ ID NO: 36102 - DNA, 75 bp, Artificial Sequence
  Synthetic
aggtcttatgaccataaacatagcagcataatgggtgggtggtaggggacagcaacttaatagatctcaggtcat

SEQ ID NO: 36103 - DNA, 75 bp, Artificial Sequence
  Synthetic
tcacagtatctgaagaaagccttaaggcagaggtatggttcactaactgctgaaaagtggatgtcccaaaagacc

SEQ ID NO: 36104 - DNA, 75 bp, Artificial Sequence
  Synthetic
ggcatgattgcaaagagtctaaaggaagtcgagcagcttaaatggggtagaggcggtttgagcgacactgctaga

SEQ ID NO: 36105 - DNA, 75 bp, Artificial Sequence
  Synthetic
actttccttcagaagttcgggataaagttgccataagctccggcaggcaaattgtttaggactaaattttaaaat

SEQ ID NO: 36106 - DNA, 75 bp, Artificial Sequence
  Synthetic
ttggctaactaaaagggttcctaggggcccacaaccatagcagctaaatgggtgggtggtaggggacagcaaaat

SEQ ID NO: 36107 - DNA, 75 bp, Artificial Sequence
  Synthetic
ggtgggtggtaggggacagcaaaataatagaagctaaatcattaatttaataaaaggtattcagtggagcacact

SEQ ID NO: 36108 - DNA, 75 bp, Artificial Sequence
  Synthetic
agtagtgtactaccaagtatagataacgtttgaatattaaagttttgaatcaaagccaaagatgatttgtatatt

SEQ ID NO: 36109 - DNA, 75 bp, Artificial Sequence
  Synthetic
acgtttgaatattaaagttttgaatcaaagccaaagatgatttgtatattggtgctaattacagttgcagctgca

SEQ ID NO: 36110 - DNA, 75 bp, Artificial Sequence
  Synthetic
atcaatgtaatagaagttggtgatgacctgtcactccatactgaatcatatgtttgcagcgcagattgtaccata

SEQ ID NO: 36111 - DNA, 75 bp, Artificial Sequence
  Synthetic
tttagttacacttactctattaatctttatattgttaagcattttaagtaagacttatatatgttatttattaat

SEQ ID NO: 36112 - DNA, 75 bp, Artificial Sequence
  Synthetic
gcctatattcatccccatagcatatatatacggtacaatttacaataagtcgtgcaaaaaatgcaaattatgtgg

SEQ ID NO: 36113 - DNA, 75 bp, Artificial Sequence
  Synthetic
aatgatgtaccatttatagatataattttggatataaggcccgaagtagacccattaaccatagatgcaccacat

SEQ ID NO: 36114 - DNA, 75 bp, Artificial Sequence
  Synthetic
attactgcggtactggtcttaacctttgtgacaccaatcaactccatggttttaggagagagtaaagaaaccttt

SEQ ID NO: 36115 - DNA, 75 bp, Artificial Sequence
  Synthetic
gctttttaagaaataccagcacagattcttaaatgtttacgcaatgtactgtgaagaatgtgacatgtatcatga

SEQ ID NO: 36116 - DNA, 75 bp, Artificial Sequence
  Synthetic
ttcttaaatgtttacgcaatgtactgtgaagaatgtgacatgtatcatgacaagtctgggttgaaaggacatggt

SEQ ID NO: 36117 - DNA, 75 bp, Artificial Sequence
  Synthetic
gcacatgtggtcaatatgaagatgctgcaggtttgatggctcacaggaaaacctataactgcttagtgcagtaca

SEQ ID NO: 36118 - DNA, 75 bp, Artificial Sequence
  Synthetic
ctggtgcaagactgggtgccctgaattttggaaacaccccatttataaagagtttaaaatgagtatgccagtacc

SEQ ID NO: 36119 - DNA, 75 bp, Artificial Sequence
  Synthetic
tgcaggtttgatggctcacaggaaaacctataactgcttagtgcagtacaaagcaaagtggatgatgaacttcct

SEQ ID NO: 36120 - DNA, 75 bp, Artificial Sequence
  Synthetic
aataacagggataccagatgatattgcgggtgctttaagatatatagaagagaaggaagatttccatgtccagct

SEQ ID NO: 36121 - DNA, 75 bp, Artificial Sequence
  Synthetic
aaatactgtgactattatacccaattctcagataactcaggatacagtcagacaacatggagagtgtacttaagg

SEQ ID NO: 36122 - DNA, 75 bp, Artificial Sequence
  Synthetic
agtatgaagaattctgcatgtccctaaaaagcaaagcaagatcatcatggaagcagataatgaacaaaaaattag

SEQ ID NO: 36123 - DNA, 75 bp, Artificial Sequence
  Synthetic
tatatccaaatcagcacttttgcagatgtgtaaaaaatggtgagaagtgcagcagctccaattgggactttgcca

SEQ ID NO: 36124 - DNA, 75 bp, Artificial Sequence
  Synthetic
ttaaatctagccctaacagctttgcatcatgccttcagggggacctcatctgcatatatagcaacaatgctctca

SEQ ID NO: 36125 - DNA, 75 bp, Artificial Sequence
  Synthetic
gtaaataatgacctgatagacaaaagtgagaagttgaaattattcaaaaatttctgcggtataggcaaacacaag

SEQ ID NO: 36126 - DNA, 75 bp, Artificial Sequence
  Synthetic
tgcatatatagcaacaatgctctcaaaaaagtccaatgatgacttgattgcatacacaaataagataaaaacaaa

SEQ ID NO: 36127 - DNA, 75 bp, Artificial Sequence
  Synthetic
catacacaaataagataaaaacaaaattcccaggtgatgcattgttgaaggctataatagattatatagcatata

SEQ ID NO: 36128 - DNA, 75 bp, Artificial Sequence
  Synthetic
tgaaaagtttgccaggtatggcaaatttcaaatatgatgaattctgggatgaattattgtacaaacccaacccag

SEQ ID NO: 36129 - DNA, 75 bp, Artificial Sequence
  Synthetic
tttatactgaatgaatttggatccaaaattaaagatgctaataaagaaacatatgacaatatgcacaaaatattt

SEQ ID NO: 36130 - DNA, 75 bp, Artificial Sequence
  Synthetic
gaattattgtacaaacccaacccagcaaaggcctcaaaccttgctagaggaaaggagtcatcttacaacttcaaa

SEQ ID NO: 36131 - DNA, 75 bp, Artificial Sequence
  Synthetic
tatagtatttccttcggctgacataaaaactaagaaagcaactgtagtttatagcattatagtgctgcataaaga

SEQ ID NO: 36132 - DNA, 75 bp, Artificial Sequence
  Synthetic
gtataggaaaccatcaggtggtgtattccaatctagcactgatcagtctatatactgcttgctggatagccattg

SEQ ID NO: 36133 - DNA, 75 bp, Artificial Sequence
  Synthetic
caggaggagctggatgcggtaaagaaatccaaatgttgggaaattgaatatcctgacgtaaagctcatccaagaa

SEQ ID NO: 36134 - DNA, 75 bp, Artificial Sequence
  Synthetic
tgaatgggtacatttccatatctagagctataaggctagataaagagaggtgccaaagaattgtttcctcacctg

SEQ ID NO: 36135 - DNA, 75 bp, Artificial Sequence
  Synthetic
tgaaagattctgggaactgcaatgttgcaactaacagatggccagtgatacaatgtgagaatgacaaattttact

SEQ ID NO: 36136 - DNA, 75 bp, Artificial Sequence
  Synthetic
gtgatgagcgatattatgaatttttctatatacactagcctgtctatcacaaagagtgttctatctttaacagag

SEQ ID NO: 36137 - DNA, 75 bp, Artificial Sequence
  Synthetic
tgcttaagccctggatgtactactgtccggtaccctattaatccaaagcacatctctaactgtaattggcaagta

SEQ ID NO: 36138 - DNA, 75 bp, Artificial Sequence
  Synthetic
tgcttgctttgatgcttatgaccagagacagcgtgtccaacttagagatatatatttatctgattatgacataac

SEQ ID NO: 36139 - DNA, 75 bp, Artificial Sequence
  Synthetic
aaacttcaaacaagcctatctctattcaagtatgcaaaaacaaaaaacttgccgcacatcaaaccaatttataaa

SEQ ID NO: 36140 - DNA, 75 bp, Artificial Sequence
  Synthetic
tcaagtatgcaaaaacaaaaaacttgccgcacatcaaaccaatttataaatatataactatagaaggaacagaaa

SEQ ID NO: 36141 - DNA, 75 bp, Artificial Sequence
  Synthetic
gccgcacatcaaaccaatttataaatatataactatagaaggaacagaaactgcagaaggtatagagagtgcata

SEQ ID NO: 36142 - DNA, 75 bp, Artificial Sequence
  Synthetic
gctgggacatctatcggattcaaaatcaattctaaagagggcaagcacttgctagatgttatagcatatgtaaaa

SEQ ID NO: 36143 - DNA, 75 bp, Artificial Sequence
  Synthetic
gctagatgttatagcatatgtaaaaagtgcctcatactcttcagtgtatacaaaattgtactcaactggcccaac

SEQ ID NO: 36144 - DNA, 75 bp, Artificial Sequence
  Synthetic
atcagggataaatactaaacatgatgaattgtgtactggcccatgcccagcaaatatcaatcatcaggttgggtg

SEQ ID NO: 36145 - DNA, 75 bp, Artificial Sequence
  Synthetic
gctgacatttgcaagagagaggacaagctcatggggatgcgaagagtttggttgcctggctgtaagtgatgggtg

SEQ ID NO: 36146 - DNA, 75 bp, Artificial Sequence
  Synthetic
agctcatggggatgcgaagagtttggttgcctggctgtaagtgatgggtgtgtatttggatcatgccaagatata

SEQ ID NO: 36147 - DNA, 75 bp, Artificial Sequence
  Synthetic
gacaaaacatactgtacaaacttaaaccctgttacccctattataacagatctatttgaggtacagttcaaaact

SEQ ID NO: 36148 - DNA, 75 bp, Artificial Sequence
  Synthetic
accctgttacccctattataacagatctatttgaggtacagttcaaaactgtagagacctacagcttgcccagaa

SEQ ID NO: 36149 - DNA, 75 bp, Artificial Sequence
  Synthetic
ttatgagatgctgaggaatgctatgccgaattatacagattatatatcaactaaagtatttgataggttatatga

SEQ ID NO: 36150 - DNA, 75 bp, Artificial Sequence
  Synthetic
gtagagacctacagcttgcccagaattgttgctgtgcaaaaccatgagattaagattgggcaaataaatgattta

SEQ ID NO: 36151 - DNA, 75 bp, Artificial Sequence
  Synthetic
ccaatgttcgtgacagatgaacaagtatgccttgaagttgggcactgcaattatgagatgctgaggaatgctatg

SEQ ID NO: 36152 - DNA, 75 bp, Artificial Sequence
  Synthetic
cttcgacaatgattaccaagcatgcaaattccttcaaagccctgctagttacagacttgaagaagacagtggcac

SEQ ID NO: 36153 - DNA, 75 bp, Artificial Sequence
  Synthetic
aaattccttcaaagccctgctagttacagacttgaagaagacagtggcactgtgaccataattgactacaaaaag

SEQ ID NO: 36154 - DNA, 75 bp, Artificial Sequence
  Synthetic
gcaattgaagcattagctgcagaaggatatgagagtaatctagaaaaaattgaaaagctttcacttggcaaagca

SEQ ID NO: 36155 - DNA, 75 bp, Artificial Sequence
  Synthetic
ttgcgaattaacgttgcacaccacaattgaagccagctgcccaattaaaagctcgtgcacagtatttcatgacag

SEQ ID NO: 36156 - DNA, 75 bp, Artificial Sequence
  Synthetic
attgaagccagctgcccaattaaaagctcgtgcacagtatttcatgacaggattcttgtgactccaaatgaacac

SEQ ID NO: 36157 - DNA, 75 bp, Artificial Sequence
  Synthetic
caaagcctatcatagaactagcaccagttgatcagacagcatatataagagaaaaagatgaaaggtgtaaaactt

SEQ ID NO: 36158 - DNA, 75 bp, Artificial Sequence
  Synthetic
agttgatcagacagcatatataagagaaaaagatgaaaggtgtaaaacttggatgtgtagggtaagagatgaagg

SEQ ID NO: 36159 - DNA, 75 bp, Artificial Sequence
  Synthetic
gaaaaagatgaaaggtgtaaaacttggatgtgtagggtaagagatgaaggactgcaggtcatcttggagccattt

SEQ ID NO: 36160 - DNA, 75 bp, Artificial Sequence
  Synthetic
actgcaggtcatcttggagccatttaaaaatttatttggatcttatattgggatattttacacatttattatatc

SEQ ID NO: 36161 - DNA, 75 bp, Artificial Sequence
  Synthetic
tatagtagcattattggttattatctatgtactactacctatatgctttaagttaagggatacccttagaaagca

SEQ ID NO: 36162 - DNA, 75 bp, Artificial Sequence
  Synthetic
agttaagggatacccttagaaagcatgaagatgcatataagagagagatgaaaattagataggggatctatgcag

SEQ ID NO: 36163 - DNA, 75 bp, Artificial Sequence
  Synthetic
attctatttgtagtatagctgttgttaagtggggggtggggaactaacaacagcgtaaatttattttgcaaacat

SEQ ID NO: 36164 - DNA, 75 bp, Artificial Sequence
  Synthetic
agtagtgtactccacttgaatactttgaaaataaattgttgttgactgttttttacctaaggggaaattatcaag

SEQ ID NO: 36165 - DNA, 75 bp, Artificial Sequence
  Synthetic
agtgtgatgtcggatttggtgttttatgatgtcgcatcaacaggtgcaaatggatttgatcctgatgcagggtat

SEQ ID NO: 36166 - DNA, 75 bp, Artificial Sequence
  Synthetic
aatcactcaaccttgctgcagttaggatcttcttcctcaatgccgcaaaggccaaggctgctctctcgcgtaagc

SEQ ID NO: 36167 - DNA, 75 bp, Artificial Sequence
  Synthetic
agttgttgagcaaatacaccccggtcatgcagaaaagagagtcagtagtcaaccaaatagctgaagttaagaact

SEQ ID NO: 36168 - DNA, 75 bp, Artificial Sequence
  Synthetic
attttgacacctagaaaattcacaacagcaggcagtttaaggaaattatattctttcagtaagtaccaggataga

SEQ ID NO: 36169 - DNA, 75 bp, Artificial Sequence
  Synthetic
tcacagagtcaagcaaggcatgatggaccctcaatacctgaagaaggccttaaggcaacgctatggcactctcac

SEQ ID NO: 36170 - DNA, 75 bp, Artificial Sequence
  Synthetic
gaccctcaatacctgaagaaggccttaaggcaacgctatggcactctcacagcagataagtggatgtcacagaag

SEQ ID NO: 36171 - DNA, 75 bp, Artificial Sequence
  Synthetic
gttgcagcaattgctaagagcctgaaggatgtagagcagcttaaatggggaaaaggaggcctgagcgatactgct

SEQ ID NO: 36172 - DNA, 75 bp, Artificial Sequence
  Synthetic
gaagatatgaaagattatatggaatctgtgatattccgatataactccaaaaggttcaaagaaagtttgtcaata

SEQ ID NO: 36173 - DNA, 75 bp, Artificial Sequence
  Synthetic
aaaaggaggcctgagcgatactgctaaaacattcctgcagaaatttggcatcaggcttccataaatatggcatga

SEQ ID NO: 36174 - DNA, 75 bp, Artificial Sequence
  Synthetic
aacagatattgttctcacataagcccataatagacttttctggtatcagggacaaatatataaacctacatgata

SEQ ID NO: 36175 - DNA, 75 bp, Artificial Sequence
  Synthetic
aattggttatccaaaagggttttcttaagggaacccacaaaaatagcagctaaatgggtgggtggtaggggacag

SEQ ID NO: 36176 - DNA, 75 bp, Artificial Sequence
  Synthetic
gtagagctctagagaaggaacctgacatattaggaaaagtaacatttacagaggcttatagattattaatgaggg

SEQ ID NO: 36177 - DNA, 75 bp, Artificial Sequence
  Synthetic
taaatgggtgggtggtaggggacagcaaaaaactataaatcaggtcataaataaaataaaatgtattcagtggag

SEQ ID NO: 36178 - DNA, 75 bp, Artificial Sequence
  Synthetic
agtagtgtactcctatctacaaaacttacagaaaattcagtcatatcacaatatatgcataatggactatcaaga

SEQ ID NO: 36179 - DNA, 75 bp, Artificial Sequence
  Synthetic
gtatcaacaattcttggctaggattaatactgcaagggatgcatgtgtagccaaggatatcgatgttgacctatt

SEQ ID NO: 36180 - DNA, 75 bp, Artificial Sequence
  Synthetic
tgataactattgcaaacacacatatattgtcaatatacgggagtcctcaacggaggatgggcatgtcctgttcaa

SEQ ID NO: 36181 - DNA, 75 bp, Artificial Sequence
  Synthetic
aatactgcaagggatgcatgtgtagccaaggatatcgatgttgacctattaatggccagacatgattattttgga

SEQ ID NO: 36182 - DNA, 75 bp, Artificial Sequence
  Synthetic
gttttgagagcatatagtaaaaataatcctgacatccagggtgctgatcccacggaaatggctagagatttagtt

SEQ ID NO: 36183 - DNA, 75 bp, Artificial Sequence
  Synthetic
ttatctatatataaataatgtgttatatatcatagattataaggtctctgtatcgaatgaaagcagtgttataac

SEQ ID NO: 36184 - DNA, 75 bp, Artificial Sequence
  Synthetic
tatatcatagattataaggtctctgtatcgaatgaaagcagtgttataacatatgacaaatattatgagttaact

SEQ ID NO: 36185 - DNA, 75 bp, Artificial Sequence
  Synthetic
aactttaccctacaatagtggtggatataaacttcaatcaattttttgacttaaaacaattactctatgaaaaat

SEQ ID NO: 36186 - DNA, 75 bp, Artificial Sequence
  Synthetic
tataaacttcaatcaattttttgacttaaaacaattactctatgaaaaattcggtgatgatgaagaattcctatt

SEQ ID NO: 36187 - DNA, 75 bp, Artificial Sequence
  Synthetic
acagatattgtctggtggccataaagccataatgcagcataatgccactagtgagcaaaatattgcttttgagtg

SEQ ID NO: 36188 - DNA, 75 bp, Artificial Sequence
  Synthetic
catttataaagagtttaaaatgagtatgccagtacctgagcggaggctctttgaagaatctgtcaagttcaatgc

SEQ ID NO: 36189 - DNA, 75 bp, Artificial Sequence
  Synthetic
ttgaagaatctgtcaagttcaatgcttatgaatctgagagatggaatactaacttggttaaaatcagagaatata

SEQ ID NO: 36190 - DNA, 75 bp, Artificial Sequence
  Synthetic
aacttggttaaaatcagagaatatacaaagaaagactattcggagcatatttcaaaatctgcaaaaaatattttc

SEQ ID NO: 36191 - DNA, 75 bp, Artificial Sequence
  Synthetic
tgagagggttacatggaatgattggcaaacatctcgtcacttggacatgggttcaattaatctaacaataaccgg

SEQ ID NO: 36192 - DNA, 75 bp, Artificial Sequence
  Synthetic
aagcccaaaatattagactttgatgacgcaaatatgtatctagctagcctaaccatgatggaacagagtaagaag

SEQ ID NO: 36193 - DNA, 75 bp, Artificial Sequence
  Synthetic
tcaacccaggatgtttgcacggcacatttaagtgtatgaatgggtacatttccatatctagagctataaggctag

SEQ ID NO: 36194 - DNA, 75 bp, Artificial Sequence
  Synthetic
ttaataaaattgttgaaaactaatgagtggtccacagttatagataaatgtattcatatatgtttaataaagaat

SEQ ID NO: 36195 - DNA, 75 bp, Artificial Sequence
  Synthetic
tccatatctagagctataaggctagataaagagaggtgccaaagaattgtttcctcacctggactgtttttaaca

SEQ ID NO: 36196 - DNA, 75 bp, Artificial Sequence
  Synthetic
atttaagtgtatgaatgggtacatttccatatctagagctataaggctagataaagagaggtgccaaagaattgt

SEQ ID NO: 36197 - DNA, 75 bp, Artificial Sequence
  Synthetic
atagtttaccagggacagatataccaccatggaatgtcatgacagagaacttcaaaaagaaatgtattgctctga

SEQ ID NO: 36198 - DNA, 75 bp, Artificial Sequence
  Synthetic
ctttaacagagccagcacgctacatgattatgaactcattagctatctccagcaatgttaaggactatatagcag

SEQ ID NO: 36199 - DNA, 75 bp, Artificial Sequence
  Synthetic
gattatgaactcattagctatctccagcaatgttaaggactatatagcagagaaattttccccttacacaaagac

SEQ ID NO: 36200 - DNA, 75 bp, Artificial Sequence
  Synthetic
acttagagatatatatttatctgattatgacataacccaaaaaggtattaaagacaatagagagctaacaagtat

SEQ ID NO: 36201 - DNA, 75 bp, Artificial Sequence
  Synthetic
atggttccctggtagtgtaacattaaaggagtatttaacacaaatatacttaccattttatttcaatgctaaagg

SEQ ID NO: 36202 - DNA, 75 bp, Artificial Sequence
  Synthetic
taccattttatttcaatgctaaaggactacatgagaagcaccatgtcatggtggatctagcaaagactatattag

SEQ ID NO: 36203 - DNA, 75 bp, Artificial Sequence
  Synthetic
gtggatctagcaaagactatattagaaatagagtgcgaacagagggaaaacataaaggagatatggtctacaaat

SEQ ID NO: 36204 - DNA, 75 bp, Artificial Sequence
  Synthetic
aaatagagtgcgaacagagggaaaacataaaggagatatggtctacaaattgtaccaaacagacagtgaacctta

SEQ ID NO: 36205 - DNA, 75 bp, Artificial Sequence
  Synthetic
cataaaggagatatggtctacaaattgtaccaaacagacagtgaaccttaaaattttgatccattccttgtgcaa

SEQ ID NO: 36206 - DNA, 75 bp, Artificial Sequence
  Synthetic
gaatttactagcagacacttcaagacacaaccacttgcggaacagaatagaaaataggaacaattttagaaggtc

SEQ ID NO: 36207 - DNA, 75 bp, Artificial Sequence
  Synthetic
agttcgaagtcttgcctcaaaataggggactttagaaaagagaaagagctgcagtcagttaaacagaagaaaatc

SEQ ID NO: 36208 - DNA, 75 bp, Artificial Sequence
  Synthetic
gggcactgcaattatgagatgctgaggaatgctatgccgaattatacagattatatatcaactaaagtatttgat

SEQ ID NO: 36209 - DNA, 75 bp, Artificial Sequence
  Synthetic
agagcaaataatggatatgatggtcgaccacaaaaagttctatttcacatttttcaataaaggccagaaaacgtc

SEQ ID NO: 36210 - DNA, 75 bp, Artificial Sequence
  Synthetic
acgcagttgagagaatagcaaaagaaagatgtaaattaaatcctgatgaaatgatatctgagccgggtgatggca

SEQ ID NO: 36211 - DNA, 75 bp, Artificial Sequence
  Synthetic
aagatgtaaattaaatcctgatgaaatgatatctgagccgggtgatggcaagttgaaggtgttggagcaaaaatc

SEQ ID NO: 36212 - DNA, 75 bp, Artificial Sequence
  Synthetic
gccagatgaattattattcaatttgctggaccaaaaagttgcataccagaatgatataatagctactatgactaa

SEQ ID NO: 36213 - DNA, 75 bp, Artificial Sequence
  Synthetic
aaccaaacatcgataacaatagttcaggataagatggaaaatgataaaattatagattttgcaatgaaagaattt

SEQ ID NO: 36214 - DNA, 75 bp, Artificial Sequence
  Synthetic
aggataagatggaaaatgataaaattatagattttgcaatgaaagaatttgagagagcctgtttgacatttggat

SEQ ID NO: 36215 - DNA, 75 bp, Artificial Sequence
  Synthetic
gagagagcctgtttgacatttggatgccaagcaaatatgaaaaagacatatgtaacaaattgtataaaagagttt

SEQ ID NO: 36216 - DNA, 75 bp, Artificial Sequence
  Synthetic
aacccttttcaatatatggcagattcctattaacatctgtgggtgattgtgcctatatagggccttatgaagatt

SEQ ID NO: 36217 - DNA, 75 bp, Artificial Sequence
  Synthetic
gcctatatagggccttatgaagatttagctagtcgaatatcatcagcccagacagccataaagcatggttgtcca

SEQ ID NO: 36218 - DNA, 75 bp, Artificial Sequence
  Synthetic
gacagccataaagcatggttgtccacccagtctagcatgggtgtccatagcaataagtcattggatgacctctct

SEQ ID NO: 36219 - DNA, 75 bp, Artificial Sequence
  Synthetic
gacatacaacatgctaccagggcagtcaaatgacccaattgattatttccctgcagaaaataggaaggatatccc

SEQ ID NO: 36220 - DNA, 75 bp, Artificial Sequence
  Synthetic
gctccgttgtcaatgattagtacagttggattggaatctgggaatttatacttcttgataaagttgttgagcaaa

SEQ ID NO: 36221 - DNA, 75 bp, Artificial Sequence
  Synthetic
ctaacagataatgaaatatttaggcttaaaatactcagatatttagttctagatgcagagatggaccctagtgat

SEQ ID NO: 36222 - DNA, 75 bp, Artificial Sequence
  Synthetic
aggcatggttgaattgttcacttatttgcttgagaaacctgagttgttagtgactaaaggagaagatatgaaaga

SEQ ID NO: 36223 - DNA, 75 bp, Artificial Sequence
  Synthetic
ctggtatcagggacaaatatataaacctacatgatagtagagctctagagaaggaacctgacatattaggaaaag

SEQ ID NO: 36224 - DNA, 75 bp, Artificial Sequence
  Synthetic
attaatgagggacctgtctagcctagaactaaccaatgatgacatccaagtaatttattcttacataatacttaa

SEQ ID NO: 36225 - DNA, 75 bp, Artificial Sequence
  Synthetic
atgaagcagagaaaggacaacgggatatagtctttgaactaaaagagatgactagattttatcaggtttgctatg

SEQ ID NO: 36226 - DNA, 75 bp, Artificial Sequence
  Synthetic
ttatgacataataaagaatgggtataatcgaactgacttcataccattgctttttagaactggcgatttaagaca

SEQ ID NO: 36227 - DNA, 75 bp, Artificial Sequence
  Synthetic
attgacatatgcagaattatgtctaactaggaaaactcccgagaatataactataagtggcagaaaattgctagg

SEQ ID NO: 36228 - DNA, 75 bp, Artificial Sequence
  Synthetic
aatatgtccaaaatccaaacatacccaggcaattattatataacatatagaaagaaagatcgccaccagtttgta

SEQ ID NO: 36229 - DNA, 75 bp, Artificial Sequence
  Synthetic
tatctaaataatgatatattttctctttcaaggattaaagtcgggcttgacgaatttgcaacaataaaaaaagca

SEQ ID NO: 36230 - DNA, 75 bp, Artificial Sequence
  Synthetic
tgtaacaaattgtataaaagagtttgtctcattatttaacttgtatggcgaacccttttcaatatatggcagatt

SEQ ID NO: 36231 - DNA, 75 bp, Artificial Sequence
  Synthetic
ccctatgaactttacagagggtgaagcaatacattcaacaccgatctttaatatatattactcaaaaagaggaga

SEQ ID NO: 36232 - DNA, 75 bp, Artificial Sequence
  Synthetic
taataaagaatggtatggatcacatgtaccattcatttgatgtccctaaatgttttatggggaatcctatcacta

SEQ ID NO: 36233 - DNA, 75 bp, Artificial Sequence
  Synthetic
gtcctgttcaacaatgccagaatttagaaacttaaaattaatacatcattccccagccttagttttgagagcata

SEQ ID NO: 36234 - DNA, 75 bp, Artificial Sequence
  Synthetic
ttggaaattggctaaaattcaaaaagagggggattaacagcaactgtataaatttgtagataggagcacactact

SEQ ID NO: 36235 - DNA, 75 bp, Artificial Sequence
  Synthetic
agtagtgtactcctatctacaaaacttacaaagaattcagtcatatcacaatatatgcgtaatggactaccaaga

SEQ ID NO: 36236 - DNA, 75 bp, Artificial Sequence
  Synthetic
gtatcaacaattcttggctaggattaatactgcaagggacgcatgtgtagccaaggatatcgatgtcgacctatt

SEQ ID NO: 36237 - DNA, 75 bp, Artificial Sequence
  Synthetic
taacaataatcggagaagataacaaattgacatatgcagaattatgtctaactaggaaaactcctgagaatataa

SEQ ID NO: 36238 - DNA, 75 bp, Artificial Sequence
  Synthetic
gaaacacagagagatttctcagaattcactaaactgatgaaaaaggaaggtgggaggagcaatatagagtttgat

SEQ ID NO: 36239 - DNA, 75 bp, Artificial Sequence
  Synthetic
tcactaaactgatgaaaaaggaaggtgggaggagcaatatagagtttgattagtagttatgagtttacagagaac

SEQ ID NO: 36240 - DNA, 75 bp, Artificial Sequence
  Synthetic
caaataagaatgagattagtgaggggtggacattaatggttgagagggttcaagatcagagagaaatctcaaaat

SEQ ID NO: 36241 - DNA, 75 bp, Artificial Sequence
  Synthetic
tcaaactcatattgctttcaaagtccttacaaagcataaaaggtatatcaacttacacagaagcatttaaatctt

SEQ ID NO: 36242 - DNA, 75 bp, Artificial Sequence
  Synthetic
agccagataattttatactgaatgaatttggatccagaattaaagatgctaataaagaaacatatgacaatatgc

SEQ ID NO: 36243 - DNA, 75 bp, Artificial Sequence
  Synthetic
acctgcctactattcaaacatgataatccaactctagtgatgagcgatattatgaatttctctatatacactagc

SEQ ID NO: 36244 - DNA, 75 bp, Artificial Sequence
  Synthetic
gggactttagaaaagaaaaagagctgcagtcagttaaacagaagaaaatcttagaggtacagagtcgcaaaatga

SEQ ID NO: 36245 - DNA, 75 bp, Artificial Sequence
  Synthetic
gcagtcagttaaacagaagaaaatcttagaggtacagagtcgcaaaatgagattagcaaatccaatgttcgtgac

SEQ ID NO: 36246 - DNA, 75 bp, Artificial Sequence
  Synthetic
gaatatgaagctaaaatgtgtatgtacgcagttgagaggatagcaaaagaaagatgtaaattaaatcctgatgaa

SEQ ID NO: 36247 - DNA, 75 bp, Artificial Sequence
  Synthetic
ccctatcctctacccacaggagaaagagagaatattatacttcatgtgcaactacatggataaagaattaatact

SEQ ID NO: 36248 - DNA, 75 bp, Artificial Sequence
  Synthetic
ctggaccaaaaagttgcataccagaatgatataatagctactatgactaaccaattaaattcaaacacagttctg

SEQ ID NO: 36249 - DNA, 75 bp, Artificial Sequence
  Synthetic
atgatataatagctactatgactaaccaattaaattcaaacacagttctgataaagagaaattggctccaaggga

SEQ ID NO: 36250 - DNA, 75 bp, Artificial Sequence
  Synthetic
caataagtcattggatgacctctctaacatacaacatgttaccagggcagtcaaatgacccaattgattatttcc

SEQ ID NO: 36251 - DNA, 75 bp, Artificial Sequence
  Synthetic
cagcagagaataggaaggatatccccatagaattgaatggtgtattagatgctccgttgtcaatgattagtacag

SEQ ID NO: 36252 - DNA, 75 bp, Artificial Sequence
  Synthetic
attaatgagggacctatctagcctagaactaaccaatgatgacatccaagtaatttattcttacataatacttaa

SEQ ID NO: 36253 - DNA, 75 bp, Artificial Sequence
  Synthetic
cgaccctatgatgataactattgcaaacacacatatattgtcaatatatggaagtcctcaacggaggatgggtat

SEQ ID NO: 36254 - DNA, 75 bp, Artificial Sequence
  Synthetic
aacacacatatattgtcaatatatggaagtcctcaacggaggatgggtatgtcctgttcaacgatgccagaattt

SEQ ID NO: 36255 - DNA, 75 bp, Artificial Sequence
  Synthetic
aaaatgaaagttaggattgctataaatgaagcagagaaaggacaacgagatatagtttttgaactaaaagagatg

SEQ ID NO: 36256 - DNA, 75 bp, Artificial Sequence
  Synthetic
atgaagcagagaaaggacaacgagatatagtttttgaactaaaagagatgactagattctatcaggtttgctatg

SEQ ID NO: 36257 - DNA, 75 bp, Artificial Sequence
  Synthetic
cccattttgcagactcattcatagattcattatctaggtcagcctttttgcagttgataatagatgaattcagtt

SEQ ID NO: 36258 - DNA, 75 bp, Artificial Sequence
  Synthetic
aatcgaactgacttcataccattgctttttagaactggcgatttaagacaggctgacttagacaaatatgatgcc

SEQ ID NO: 36259 - DNA, 75 bp, Artificial Sequence
  Synthetic
ggaatgattggcaaacatctcgtcacttggacatgggttcaattaatctaacaataaccggttataataggtcaa

SEQ ID NO: 36260 - DNA, 75 bp, Artificial Sequence
  Synthetic
gttgacatatgcagagctatgtctaactaggaaaactcctgagaatataactataagcggcagaaagttgctagg

SEQ ID NO: 36261 - DNA, 75 bp, Artificial Sequence
  Synthetic
taacaaggaggaatgaagagcatatggctatcaggaccaggatatacaatgaaataactccagtatgtgtagtta

SEQ ID NO: 36262 - DNA, 75 bp, Artificial Sequence
  Synthetic
cactttagcaaaatggtctcatttgaaggacccccaattaagacagggctcctcgaccttactgaattgatgaaa

SEQ ID NO: 36263 - DNA, 75 bp, Artificial Sequence
  Synthetic
aaggacccccaattaagacagggctcctcgaccttactgaattgatgaaatcccaagatttgcttaaccttaatt

SEQ ID NO: 36264 - DNA, 75 bp, Artificial Sequence
  Synthetic
tgtgaggggtcagacaatataaatgatggcttagagtttctgtccgatgaccctatgaactttacagaaggtgaa

SEQ ID NO: 36265 - DNA, 75 bp, Artificial Sequence
  Synthetic
ctaagatttttgaagaagctttcacattcagtgagaatggcttcatatcaccagagaatcttggttgcttagaag

SEQ ID NO: 36266 - DNA, 75 bp, Artificial Sequence
  Synthetic
tcactaaactgatgaagaaggagggtgggaggagcaatatagagtttgattagtagttataagtttacagagaac

SEQ ID NO: 36267 - DNA, 75 bp, Artificial Sequence
  Synthetic
agtagtgtactccacttgaatactttgaaaataaattgttgttgactgtttttacctaaggggaaattatcaaga

SEQ ID NO: 36268 - DNA, 75 bp, Artificial Sequence
  Synthetic
caaagtggggggtggggggactaacaacagcgtaaatttattttacaaacgttatctatacttggtagtacacta

SEQ ID NO: 36269 - DNA, 75 bp, Artificial Sequence
  Synthetic
ggatgtagagcagcttaaatggggaaaaggaggcctgagtgatactgctaaaacattcctgcagaaatttggcat

SEQ ID NO: 36270 - DNA, 75 bp, Artificial Sequence
  Synthetic
gaatttaagatgagtatgcccgtcccagagcgcagactttttgaggaatctgtaagatttaatgcttatgaatct

SEQ ID NO: 36271 - DNA, 75 bp, Artificial Sequence
  Synthetic
tagtctctgattggcatgattgcaggcctaagaagatcattgggggacacatcaatgtaatagaagttggtgatg

SEQ ID NO: 36272 - DNA, 75 bp, Artificial Sequence
  Synthetic
gcctaagaagatcattgggggacacatcaatgtaatagaagttggtgatgacctatcgctccatactgaatcata

SEQ ID NO: 36273 - DNA, 75 bp, Artificial Sequence
  Synthetic
ggtgtagacaaagagactgcgcaggtcagacttcagacagataccacaaatcattttgaaattgcaggcactact

SEQ ID NO: 36274 - DNA, 75 bp, Artificial Sequence
  Synthetic
gtgaagtcaggatggttcaagagcacgacatatataactcttgatcaaacctgcgaacaccttaaagtttcctgc

SEQ ID NO: 36275 - DNA, 75 bp, Artificial Sequence
  Synthetic
ctgcgaacaccttaaagtttcctgcggcccaaaatctgtacagttccatgcctgcttcaatcagcatatgtcttg

SEQ ID NO: 36276 - DNA, 75 bp, Artificial Sequence
  Synthetic
ggcccaaaatctgtacagttccatgcctgcttcaatcagcatatgtcttgtgtcagatttttacacaggacaata

SEQ ID NO: 36277 - DNA, 75 bp, Artificial Sequence
  Synthetic
ttgcctggctccattgccaattccatatgtcagaatattgaaatcataattttagttacacttactctattaatc

SEQ ID NO: 36278 - DNA, 75 bp, Artificial Sequence
  Synthetic
tatgtcagaatattgaaatcataattttagttacacttactctattaatctttatattgttaagcattttaagta

SEQ ID NO: 36279 - DNA, 75 bp, Artificial Sequence
  Synthetic
cctagtgtatcatccattcacagagtgtggcacacattgtgtctgtggtgctcgctatgatacttcagatagaat

SEQ ID NO: 36280 - DNA, 75 bp, Artificial Sequence
  Synthetic
tgttggaaatggtatcgaggataaattcttattattttacctgtatcttgaattatgctgtaagctggggtctta

SEQ ID NO: 36281 - DNA, 75 bp, Artificial Sequence
  Synthetic
gctatttaagaaataccagcacagatttttaaatgtttacgcaatgtactgtgaggaatgtgacatgtatcatga

SEQ ID NO: 36282 - DNA, 75 bp, Artificial Sequence
  Synthetic
cgcaggcttgatggcccacaggaaaacctataactgcttagtgcagtacaaagcaaagtggatgatgaatttcct

SEQ ID NO: 36283 - DNA, 75 bp, Artificial Sequence
  Synthetic
acctataactgcttagtgcagtacaaagcaaagtggatgatgaatttcctgataatttacatattcttaatttta

SEQ ID NO: 36284 - DNA, 75 bp, Artificial Sequence
  Synthetic
aagctgctggaactgatttcaccacctgcctagagactgagagtataaattggaactgcactgggccatttttga

SEQ ID NO: 36285 - DNA, 75 bp, Artificial Sequence
  Synthetic
tggaactgcactgggccatttttgaacctcgggaattgtcaaaaacagcaaaagaaggaaccttacaccaacatt

SEQ ID NO: 36286 - DNA, 75 bp, Artificial Sequence
  Synthetic
caatttccgtactagatatccctataataacagggattccggatgatattgcaggtgctttaagatatatagaag

SEQ ID NO: 36287 - DNA, 75 bp, Artificial Sequence
  Synthetic
gcaggtgctttaagatatatagaagaaagggaagatttccatgtccagctaactatagaatacgcaatgctgagt

SEQ ID NO: 36288 - DNA, 75 bp, Artificial Sequence
  Synthetic
gacaacatggagggtatacttaaggtctcatgattttgaggcatgtatactatatccaaatcaacatttctgcag

SEQ ID NO: 36289 - DNA, 75 bp, Artificial Sequence
  Synthetic
agcagctccaattgggactttgccaatgaaatgaaggatttttactctgggaaacaaacaaagtttgataaagac

SEQ ID NO: 36290 - DNA, 75 bp, Artificial Sequence
  Synthetic
atatggtcaacagattgcaccaagcagacagttaaccttaaagtcttaatacattctttgtgcaaaaatttactt

SEQ ID NO: 36291 - DNA, 75 bp, Artificial Sequence
  Synthetic
ctagcaatttcatcaaaatctataaaaacctgcaagaatgttaaggatgttgcctgtttatcaccaaggtcaggc

SEQ ID NO: 36292 - DNA, 75 bp, Artificial Sequence
  Synthetic
gtatagaaaaccaccaggtggtgtattccaatctagcactgatcggtctatatactgcttactagatagccattg

SEQ ID NO: 36293 - DNA, 75 bp, Artificial Sequence
  Synthetic
caggaggagctagatgcagtgaaaaaatccaaatgttgggagattgaatatcctgatgtaaagcccctccaagaa

SEQ ID NO: 36294 - DNA, 75 bp, Artificial Sequence
  Synthetic
tgcaactaacagatggccagtgatacaatgcgagaatgacaaattttactactcagagcttcaaaaagattatga

SEQ ID NO: 36295 - DNA, 75 bp, Artificial Sequence
  Synthetic
tccggtaccctattaatccaaagcatatctctaactgtaattggcaggtaagcagatccagcatagcgaagatag

SEQ ID NO: 36296 - DNA, 75 bp, Artificial Sequence
  Synthetic
tatctctaactgtaattggcaggtaagcagatccagcatagcgaagatagatgtgcataatattgaagacattga

SEQ ID NO: 36297 - DNA, 75 bp, Artificial Sequence
  Synthetic
acaatataagaaggctataactcaaaaacttcaaacaagcctatctctattcaagtatgcaaaaacaaaaaactt

SEQ ID NO: 36298 - DNA, 75 bp, Artificial Sequence
  Synthetic
tggatctatcctagtaaattcgttggtgcattctgatgataatcaaacttctataactattgttcaagataaggt

SEQ ID NO: 36299 - DNA, 75 bp, Artificial Sequence
  Synthetic
gtagagacttacagcttgcccagaattgtcgctgtgcaaaaccatgaaattaagattgggcaaataaatgaccta

SEQ ID NO: 36300 - DNA, 75 bp, Artificial Sequence
  Synthetic
ttatggcaatggagttcctagatttgattacttatgccatttagctagcagaaaggaggtcattgttagaaaatg

SEQ ID NO: 36301 - DNA, 75 bp, Artificial Sequence
  Synthetic
tgtgactataattgattacaagaagatattaggcacaatcaagatgaaggcaattttaggagatgtcaaatataa

SEQ ID NO: 36302 - DNA, 75 bp, Artificial Sequence
  Synthetic
actgcagaagggtcatgcactggctgtatcaattgctttgagaatatccattgcgaattaacgttgcataccaca

SEQ ID NO: 36303 - DNA, 75 bp, Artificial Sequence
  Synthetic
ttgcgaattaacgttgcataccacaattgaagccagctgtccaattaaaagctcatgcacagtattccatgacag

SEQ ID NO: 36304 - DNA, 75 bp, Artificial Sequence
  Synthetic
gaactctttacttatctacttgagaagccagaattacttgtgacaaaaggtgaggacatgaaagattatatggaa

SEQ ID NO: 36305 - DNA, 75 bp, Artificial Sequence
  Synthetic
cagaaaggccagggaatacacttacaattaaagtttgcaatactaagattgaggcatctatggcccttgtcgacg

SEQ ID NO: 36306 - DNA, 75 bp, Artificial Sequence
  Synthetic
aaaaatttatttggatcttatattgggatattttacacatttattatatctatagtggcattattggttatcatc

SEQ ID NO: 36307 - DNA, 75 bp, Artificial Sequence
  Synthetic
ggatattttacacatttattatatctatagtggcattattggttatcatctatgtgctattgcctatatgcttta

SEQ ID NO: 36308 - DNA, 75 bp, Artificial Sequence
  Synthetic
atacataattttaaatgatccgatgatgataactattgcaaacacgcacatattatcaatatatggaagtcctca

SEQ ID NO: 36309 - DNA, 75 bp, Artificial Sequence
  Synthetic
agtagtgtactaccaagcatagaaaacgttcaaatcttaacttattccaaatatggaagtcctaaacttaatctg

SEQ ID NO: 36310 - DNA, 75 bp, Artificial Sequence
  Synthetic
acgttcaaatcttaacttattccaaatatggaagtcctaaacttaatctggttgctgacattatgctcggctagt

SEQ ID NO: 36311 - DNA, 75 bp, Artificial Sequence
  Synthetic
atggggctatagtgaagcaaaacccatcaaaggaggcagtgacagaagtttgcctaaaagatgacgtgagcatga

SEQ ID NO: 36312 - DNA, 75 bp, Artificial Sequence
  Synthetic
aaatgcgacagggacatttgccaacaacatagcaatgagaaaatggttggttgcagattggcatgattgtaggcc

SEQ ID NO: 36313 - DNA, 75 bp, Artificial Sequence
  Synthetic
aatgttattgaagttggcgatgacttgtcacttcatacagaatcatatatttgcagtgccgactgtgtcataacg

SEQ ID NO: 36314 - DNA, 75 bp, Artificial Sequence
  Synthetic
tgtcacttcatacagaatcatatatttgcagtgccgactgtgtcataacggtcgacaaggaaacagctcaaattc

SEQ ID NO: 36315 - DNA, 75 bp, Artificial Sequence
  Synthetic
ctttgaagttgctggtactacagttaaatcagggtggttcaagagtactacatatattacacttgatcaaacatg

SEQ ID NO: 36316 - DNA, 75 bp, Artificial Sequence
  Synthetic
aaatcagggtggttcaagagtactacatatattacacttgatcaaacatgcgagcatcttaaagtatcatgtgga

SEQ ID NO: 36317 - DNA, 75 bp, Artificial Sequence
  Synthetic
gctttaatcagcacatgtcatgtgtgcgattcctgcataggacaatacttccaggttcaatagcaaattctatat

SEQ ID NO: 36318 - DNA, 75 bp, Artificial Sequence
  Synthetic
gcgattcctgcataggacaatacttccaggttcaatagcaaattctatatgtcagaacatagaaataattatcct

SEQ ID NO: 36319 - DNA, 75 bp, Artificial Sequence
  Synthetic
atatttttaacaatagttagtaagacatatgtatgttacttattaatgcctatatttattccaatagcatatatt

SEQ ID NO: 36320 - DNA, 75 bp, Artificial Sequence
  Synthetic
catatgtatgttacttattaatgcctatatttattccaatagcatatatttacggatggatatataacaaatctt

SEQ ID NO: 36321 - DNA, 75 bp, Artificial Sequence
  Synthetic
agtttaccacccatttactgagtgtgggacacattgtgtttgtggtgcaaggtatgaaacgtctgataggatgaa

SEQ ID NO: 36322 - DNA, 75 bp, Artificial Sequence
  Synthetic
gggacacattgtgtttgtggtgcaaggtatgaaacgtctgataggatgaaattgcatagagcatctggattgtgt

SEQ ID NO: 36323 - DNA, 75 bp, Artificial Sequence
  Synthetic
ccagagttatgtgtaagtcaaaagggccagcatcagttttatccatcatgacagcaattcttatactaacatttg

SEQ ID NO: 36324 - DNA, 75 bp, Artificial Sequence
  Synthetic
gccagcatcagttttatccatcatgacagcaattcttatactaacatttgttactcctattagtgctatggtcat

SEQ ID NO: 36325 - DNA, 75 bp, Artificial Sequence
  Synthetic
ctagatgaattgcctgatgatatggtacaaatggcagaaagagtaaatatatactaccagatcattattattaat

SEQ ID NO: 36326 - DNA, 75 bp, Artificial Sequence
  Synthetic
tacaaatggcagaaagagtaaatatatactaccagatcattattattaattacagcataacatgggctttcttat

SEQ ID NO: 36327 - DNA, 75 bp, Artificial Sequence
  Synthetic
ctttaagaaatatcaacataggttcttgagcttttatgcaatgtattgtaaagaatgtgacatgtaccatgagag

SEQ ID NO: 36328 - DNA, 75 bp, Artificial Sequence
  Synthetic
ttgagcttttatgcaatgtattgtaaagaatgtgacatgtaccatgagagagcaggtttgacatattggggtgac

SEQ ID NO: 36329 - DNA, 75 bp, Artificial Sequence
  Synthetic
ctgaaaatatcaatgatggtctggagtttttatcagacgatccaatgaactttactgaaggtgaggccatacact

SEQ ID NO: 36330 - DNA, 75 bp, Artificial Sequence
  Synthetic
catgtgggcaatttgaggatgttactgggttaatggtgcataagaaatcttataattgtataattaaatacaaag

SEQ ID NO: 36331 - DNA, 75 bp, Artificial Sequence
  Synthetic
tgggttaatggtgcataagaaatcttataattgtataattaaatacaaagcaaaatggataagagacatactaat

SEQ ID NO: 36332 - DNA, 75 bp, Artificial Sequence
  Synthetic
aaagattcactattgtttgttggtgcaacaggaaccgattttgctgcatgcatagatgagaaaacagtcacatgg

SEQ ID NO: 36333 - DNA, 75 bp, Artificial Sequence
  Synthetic
caacaggaaccgattttgctgcatgcatagatgagaaaacagtcacatggaattgtactggaccatttctaaact

SEQ ID NO: 36334 - DNA, 75 bp, Artificial Sequence
  Synthetic
gaagattggttatgctgatattgctgatcagttgaaaggtctgggtgcaatatcagtgctagatattccaatgat

SEQ ID NO: 36335 - DNA, 75 bp, Artificial Sequence
  Synthetic
aaaaaggatgccggatgagatatctgggtcactgaagtatattgatggtttagagacataccatgaacaactgac

SEQ ID NO: 36336 - DNA, 75 bp, Artificial Sequence
  Synthetic
tactgtgattattatacacagtacactgataattcaggttacagtcaaactgtgtggaggacttatttgcgatct

SEQ ID NO: 36337 - DNA, 75 bp, Artificial Sequence
  Synthetic
catgattttggtgcatgtgtcgtttatccaaatcaacatttctgcagatgtgtaaaacatggtgataagtgtaat

SEQ ID NO: 36338 - DNA, 75 bp, Artificial Sequence
  Synthetic
aaatgaagacattttatactggtcaaaaagcaaaattcaacaaagatctaaacttggcattattagtattacaca

SEQ ID NO: 36339 - DNA, 75 bp, Artificial Sequence
  Synthetic
gaattttgtttaaatactttgctataaggccaattacattgtgatgggagatttgatcttttatgatgtcgcatc

SEQ ID NO: 36340 - DNA, 75 bp, Artificial Sequence
  Synthetic
atatattgcagaaagtatggcccggaaagataacaggtctatgacacattttgccttagagataaagaaaaagtt

SEQ ID NO: 36341 - DNA, 75 bp, Artificial Sequence
  Synthetic
aaggccaattacattgtgatgggagatttgatcttttatgatgtcgcatcaacaggtgcaaatggatttgatcca

SEQ ID NO: 36342 - DNA, 75 bp, Artificial Sequence
  Synthetic
ttaatagattacatttcttatttacaatcacttgcagagatgtctacttttgaacttgatgaggattgggaagat

SEQ ID NO: 36343 - DNA, 75 bp, Artificial Sequence
  Synthetic
ttgcgcatggggaagctatcaatttgtcagccgttaggatcttcttccttaatgccgcaaaagccaaagctgctc

SEQ ID NO: 36344 - DNA, 75 bp, Artificial Sequence
  Synthetic
aatcacttgcagagatgtctacttttgaacttgatgaggattgggaagatttcaagtataaacccgaaccaacag

SEQ ID NO: 36345 - DNA, 75 bp, Artificial Sequence
  Synthetic
gtcagccgttaggatcttcttccttaatgccgcaaaagccaaagctgctctctctcgtaaaccggagaggaaagc

SEQ ID NO: 36346 - DNA, 75 bp, Artificial Sequence
  Synthetic
aactgatcagtataatttcaaaaatgcagatagtaatagcaatgttaaagtctgcaaaaacattcaaaaagtgtc

SEQ ID NO: 36347 - DNA, 75 bp, Artificial Sequence
  Synthetic
ctggaaacaggaacaacccaattggtaacaacgatcttaccatccatcggctttcaggatatcttgccagatggg

SEQ ID NO: 36348 - DNA, 75 bp, Artificial Sequence
  Synthetic
gcagatagtaatagcaatgttaaagtctgcaaaaacattcaaaaagtgtcatgcatttcacctagatccagggct

SEQ ID NO: 36349 - DNA, 75 bp, Artificial Sequence
  Synthetic
gagaacatgcgaacccatcagtatatatgatgcccaatgttagtatttatcaatctaattcagagaggagtcact

SEQ ID NO: 36350 - DNA, 75 bp, Artificial Sequence
  Synthetic
agatgaatcccagaaggaattaatccagagcaccatcatcaatcctattgctgagtccaatgggatacactgggc

SEQ ID NO: 36351 - DNA, 75 bp, Artificial Sequence
  Synthetic
tatgatgcccaatgttagtatttatcaatctaattcagagaggagtcactactgtatagctgactcacattgttt

SEQ ID NO: 36352 - DNA, 75 bp, Artificial Sequence
  Synthetic
cagagcaccatcatcaatcctattgctgagtccaatgggatacactgggcaaatggggttgaaatatacctttca

SEQ ID NO: 36353 - DNA, 75 bp, Artificial Sequence
  Synthetic
gaactcttaaatgcattgaaaaaatctaaatgttgggctaaagaaatggatgatattgttctgcataaacaatct

SEQ ID NO: 36354 - DNA, 75 bp, Artificial Sequence
  Synthetic
tggaagccttcagattttatcctctaacaattggaatctacagagtcaaacacgggctgatggaccctcagtatc

SEQ ID NO: 36355 - DNA, 75 bp, Artificial Sequence
  Synthetic
ctaaatgttgggctaaagaaatggatgatattgttctgcataaacaatctgatggcttaaggagttgtagaatga

SEQ ID NO: 36356 - DNA, 75 bp, Artificial Sequence
  Synthetic
aacaattggaatctacagagtcaaacacgggctgatggaccctcagtatctaaagaaggctctacgacagcgcta

SEQ ID NO: 36357 - DNA, 75 bp, Artificial Sequence
  Synthetic
agaaaatgactggactattgttctgtgtgagaatggcaattattattattcagaagctcacagagactatgataa

SEQ ID NO: 36358 - DNA, 75 bp, Artificial Sequence
  Synthetic
atggcacaaaaaaccactatgattgctaaaagcctgaaggatgtagagcagctgaagtggggtaaggggggtctt

SEQ ID NO: 36359 - DNA, 75 bp, Artificial Sequence
  Synthetic
tgtgagaatggcaattattattattcagaagctcacagagactatgataaagatcaagatgttggccatttttgt

SEQ ID NO: 36360 - DNA, 75 bp, Artificial Sequence
  Synthetic
ctaaaagcctgaaggatgtagagcagctgaagtggggtaaggggggtcttagtgatgctgctagaacattccttc

SEQ ID NO: 36361 - DNA, 75 bp, Artificial Sequence
  Synthetic
gctacccaataaataaaagacatattagaaattgtgattggcagatctcccattcaacaattgacaagatctcag

SEQ ID NO: 36362 - DNA, 75 bp, Artificial Sequence
  Synthetic
aattgatggtcctctaatgaattcggcattttaaatttaaattttaaatcacattatattaaattggtcattcca

SEQ ID NO: 36363 - DNA, 75 bp, Artificial Sequence
  Synthetic
aattgatggtcctctaatgaattcggcattttaaatttaaattttaaatcacattatatttaattggtcattcca

SEQ ID NO: 36364 - DNA, 75 bp, Artificial Sequence
  Synthetic
aattgatggtcctctaatgaattcggcattttaaatttaaattttaaatcacattatattcaattggtcattcca

SEQ ID NO: 36365 - DNA, 75 bp, Artificial Sequence
  Synthetic
aattgatggtcctctaatgaattcggcattttaaatttaaattttaaatcacattatattgaattggtcattcca

SEQ ID NO: 36366 - DNA, 75 bp, Artificial Sequence
  Synthetic
tagaaattgtgattggcagatctcccattcaacaattgacaagatctcagttcaagaattggctgatatagagca

SEQ ID NO: 36367 - DNA, 75 bp, Artificial Sequence
  Synthetic
taacagcaaaatgggtgggtggtaggggacagcaaagaattagatctcaggtcatgattaaaataaaatgtattc

SEQ ID NO: 36368 - DNA, 75 bp, Artificial Sequence
  Synthetic
ttacaaacaagcctatcaatcttcaagtatgtgaagacaaaaaatcttccacatattaaaccagcatataaatac

SEQ ID NO: 36369 - DNA, 75 bp, Artificial Sequence
  Synthetic
agtatgtgaagacaaaaaatcttccacatattaaaccagcatataaatacataactgtggaaggtattgaaactg

SEQ ID NO: 36370 - DNA, 75 bp, Artificial Sequence
  Synthetic
acgttcaaagagtgaaagtataagacagattaaggatgattgccttaatatttctgattgcaattgctgctgcaa

SEQ ID NO: 36371 - DNA, 75 bp, Artificial Sequence
  Synthetic
cagattaaggatgattgccttaatatttctgattgcaattgctgctgcaagcccagtataccagagatgcttcca

SEQ ID NO: 36372 - DNA, 75 bp, Artificial Sequence
  Synthetic
agtagtgtactaccaagtatagataacgttcaaagagtgaaagtataagacagattaaggatgattgccttaata

SEQ ID NO: 36373 - DNA, 75 bp, Artificial Sequence
  Synthetic
agaatctgaaatccctgcactagctggaacagctattggttttaaaataaactcgagggagggcaactacctaat

SEQ ID NO: 36374 - DNA, 75 bp, Artificial Sequence
  Synthetic
ccatccaaagacgcagttacagaagtctgccttaaagatgatgttagcatgataaagaccgaagcaaaatatatg

SEQ ID NO: 36375 - DNA, 75 bp, Artificial Sequence
  Synthetic
tctgccttaaagatgatgttagcatgataaagaccgaagcaaaatatatgaaaaatgatacgggaacattttcaa

SEQ ID NO: 36376 - DNA, 75 bp, Artificial Sequence
  Synthetic
gcatcatattcagcaacatacacaaagctatatacaactggtccaactataggagtaaatactaagcatgatgaa

SEQ ID NO: 36377 - DNA, 75 bp, Artificial Sequence
  Synthetic
ggttgcagactggcatgattgtaggccccaaaaatcatctggagggcacatcaatgtaatagaagttggtgatga

SEQ ID NO: 36378 - DNA, 75 bp, Artificial Sequence
  Synthetic
taatagatcataaagaaggctggttaacctttgcaaaagaaagaactagcacatggggttgtgaagaatttggtt

SEQ ID NO: 36379 - DNA, 75 bp, Artificial Sequence
  Synthetic
ccccaaaaatcatctggagggcacatcaatgtaatagaagttggtgatgatctctcattgcacacagaagcatac

SEQ ID NO: 36380 - DNA, 75 bp, Artificial Sequence
  Synthetic
acatggggttgtgaagaatttggttgtttagcagttagcgatggctgtgtatttggatcttgtcaagatatcata

SEQ ID NO: 36381 - DNA, 75 bp, Artificial Sequence
  Synthetic
gtgttgataaggaaacagcacaaataaggctacaaacagacagcaccacccactttgaaatagctgggacaactg

SEQ ID NO: 36382 - DNA, 75 bp, Artificial Sequence
  Synthetic
aaagatgagttagctgtctataggaaaactactgaagagctcactacagtagaattatgcctaacattctcagat

SEQ ID NO: 36383 - DNA, 75 bp, Artificial Sequence
  Synthetic
aaactactgaagagctcactacagtagaattatgcctaacattctcagataaaacatattgcactaatctgaatg

SEQ ID NO: 36384 - DNA, 75 bp, Artificial Sequence
  Synthetic
aaggctacaaacagacagcaccacccactttgaaatagctgggacaactgtaaaatcaggttggtttaaaagcac

SEQ ID NO: 36385 - DNA, 75 bp, Artificial Sequence
  Synthetic
tgtgaacatctgaaagtctcatgtggcccaaagtccatacaattccatgcatgtttcaatcagcatatgtcttgt

SEQ ID NO: 36386 - DNA, 75 bp, Artificial Sequence
  Synthetic
gtttgaagttcaattcaaaactgttgaatcgtacacattgccaagaataatagctattaaaaatcatgaaattaa

SEQ ID NO: 36387 - DNA, 75 bp, Artificial Sequence
  Synthetic
gaatcgtacacattgccaagaataatagctattaaaaatcatgaaattaaggttgggcagatcaatgatctaggt

SEQ ID NO: 36388 - DNA, 75 bp, Artificial Sequence
  Synthetic
gcccaaagtccatacaattccatgcatgtttcaatcagcatatgtcttgtgtaagattcctgcatagaacaatat

SEQ ID NO: 36389 - DNA, 75 bp, Artificial Sequence
  Synthetic
atgccaaaatattgagataattatccttgtaacattaacgctattaatctttatatttcttagtatacttagtaa

SEQ ID NO: 36390 - DNA, 75 bp, Artificial Sequence
  Synthetic
ttcaaaaaataaatgggacaaattatggcaatggagtgccgaaatttgattacttatgccatttggcaagtagga

SEQ ID NO: 36391 - DNA, 75 bp, Artificial Sequence
  Synthetic
tggcaatggagtgccgaaatttgattacttatgccatttggcaagtaggaaagaagttatcataagaaaatgttt

SEQ ID NO: 36392 - DNA, 75 bp, Artificial Sequence
  Synthetic
cttgtaacattaacgctattaatctttatatttcttagtatacttagtaagacgtatatctgttacattttaatg

SEQ ID NO: 36393 - DNA, 75 bp, Artificial Sequence
  Synthetic
tatatggttggatttataacaaatcttgcaagaaatgtaagttatgtggtttagtatatcatccatttactgaat

SEQ ID NO: 36394 - DNA, 75 bp, Artificial Sequence
  Synthetic
tttctgcaaagtcctccaagctatcgcttagaggagcatcaaggcacagtaacagtcatagattataaaaagatc

SEQ ID NO: 36395 - DNA, 75 bp, Artificial Sequence
  Synthetic
ttgcaagaaatgtaagttatgtggtttagtatatcatccatttactgaatgtggaacccattgtgtgtgtggtgc

SEQ ID NO: 36396 - DNA, 75 bp, Artificial Sequence
  Synthetic
aacagtcatagattataaaaagatcctaggcattataaagatgaaagctatattaggagatgtaaaatacaaaaa

SEQ ID NO: 36397 - DNA, 75 bp, Artificial Sequence
  Synthetic
aagttgcatagatcttctggattatgtccagggtataagagtttaagagctgcaagagtaatgtgtaagtcaaaa

SEQ ID NO: 36398 - DNA, 75 bp, Artificial Sequence
  Synthetic
gtccagggtataagagtttaagagctgcaagagtaatgtgtaagtcaaaaggcccagcatcgattctgtcggtac

SEQ ID NO: 36399 - DNA, 75 bp, Artificial Sequence
  Synthetic
gctgaaggaacatgtgctggatgtataaattgttttgaaaacattcactgtgaatttactatacataccacagta

SEQ ID NO: 36400 - DNA, 75 bp, Artificial Sequence
  Synthetic
taaattgttttgaaaacattcactgtgaatttactatacataccacagtagaagcaagttgccctatagtgacag

SEQ ID NO: 36401 - DNA, 75 bp, Artificial Sequence
  Synthetic
tgtaacacctatgaatgcattaaccctaggttcttcagaggagaactacaaactggagaatctaccagatgatat

SEQ ID NO: 36402 - DNA, 75 bp, Artificial Sequence
  Synthetic
ctaggttcttcagaggagaactacaaactggagaatctaccagatgatatgttggacatggctgaaaggatagat

SEQ ID NO: 36403 - DNA, 75 bp, Artificial Sequence
  Synthetic
actgatcacaccagacgagcataaatatgcattaaaagttgtatgtcaggaaaagcctaaattgtctctaaaatt

SEQ ID NO: 36404 - DNA, 75 bp, Artificial Sequence
  Synthetic
tatgcattaaaagttgtatgtcaggaaaagcctaaattgtctctaaaatttaagatctgtaacacaaatattgat

SEQ ID NO: 36405 - DNA, 75 bp, Artificial Sequence
  Synthetic
attatagtataacctggggcttagtaatactcctaggtttaactttcatcctattcagaagattccagcatagat

SEQ ID NO: 36406 - DNA, 75 bp, Artificial Sequence
  Synthetic
aatactcctaggtttaactttcatcctattcagaagattccagcatagattcttaaattgttatgccatgtattg

SEQ ID NO: 36407 - DNA, 75 bp, Artificial Sequence
  Synthetic
agccaatcctagagcttgcaccagttgaccaaactacatacattagagagaaagacgaaagatgcaaaacgtgga

SEQ ID NO: 36408 - DNA, 75 bp, Artificial Sequence
  Synthetic
tgaccaaactacatacattagagagaaagacgaaagatgcaaaacgtggatgtgcagggttcgagatgaaggatt

SEQ ID NO: 36409 - DNA, 75 bp, Artificial Sequence
  Synthetic
aagaatggtttagtaaggaatggtgactttacaaacaagtgtagacaatgcacttgtgggcagtatgaagatgca

SEQ ID NO: 36410 - DNA, 75 bp, Artificial Sequence
  Synthetic
actttacaaacaagtgtagacaatgcacttgtgggcagtatgaagatgcagctggattaataatccatcaaaaat

SEQ ID NO: 36411 - DNA, 75 bp, Artificial Sequence
  Synthetic
aacctttttggctcttacattgggatattttatacaggtatattatgtattatatgcctccttattgttatttac

SEQ ID NO: 36412 - DNA, 75 bp, Artificial Sequence
  Synthetic
tattttatacaggtatattatgtattatatgcctccttattgttatttacatcatattgcctatttgtttcaagt

SEQ ID NO: 36413 - DNA, 75 bp, Artificial Sequence
  Synthetic
agcaaagtggattcgaaatatactgttaacatatatcatattaatactgattaaagactctgttctactgacatc

SEQ ID NO: 36414 - DNA, 75 bp, Artificial Sequence
  Synthetic
ttaacatatatcatattaatactgattaaagactctgttctactgacatctgcagaaggccctgatttttctgta

SEQ ID NO: 36415 - DNA, 75 bp, Artificial Sequence
  Synthetic
agatgcatacaagaaggagatgaaaataagataattcaaataagcatgggatgttagtataggtttaaatagatt

SEQ ID NO: 36416 - DNA, 75 bp, Artificial Sequence
  Synthetic
ggaattgcactggccctttcctaaaccttggaagatgcgaaaagactcaaaaaaaagccagctatgctacaattg

SEQ ID NO: 36417 - DNA, 75 bp, Artificial Sequence
  Synthetic
ttgggttttataggggtggggtcaaacaaaactgctgaacttattttagaatcatttaaatatacttggtagcac

SEQ ID NO: 36418 - DNA, 75 bp, Artificial Sequence
  Synthetic
ccttggaagatgcgaaaagactcaaaaaaaagccagctatgctacaattgctacacagttaagaagtatagatgc

SEQ ID NO: 36419 - DNA, 75 bp, Artificial Sequence
  Synthetic
attgcaaagataccagaagatatatctggggcactgaaatacatagagagtttaaaaacttaccatgagcaattg

SEQ ID NO: 36420 - DNA, 75 bp, Artificial Sequence
  Synthetic
ctggggcactgaaatacatagagagtttaaaaacttaccatgagcaattgacggcagaatatgctatgctgacta

SEQ ID NO: 36421 - DNA, 75 bp, Artificial Sequence
  Synthetic
tagtgataattctggttatagccagacaagctggaggaaattcttaagatcacacgattttgaatcttgcataat

SEQ ID NO: 36422 - DNA, 75 bp, Artificial Sequence
  Synthetic
acaagctggaggaaattcttaagatcacacgattttgaatcttgcataatttacccaaatcaacacttttgtaga

SEQ ID NO: 36423 - DNA, 75 bp, Artificial Sequence
  Synthetic
gcagtgctaaatgggactttgcaagtgaaatgaaaggattttacttgaataaacaagccaaatttaacaaagatt

SEQ ID NO: 36424 - DNA, 75 bp, Artificial Sequence
  Synthetic
tcaggcttcagacagataccacaaatcattttgaaattgcaggcactactgtgaagtcaggatggttcaaaagca

SEQ ID NO: 36425 - DNA, 75 bp, Artificial Sequence
  Synthetic
tgaaatgaaaggattttacttgaataaacaagccaaatttaacaaagatttaaatttagccttatctacctttca

SEQ ID NO: 36426 - DNA, 75 bp, Artificial Sequence
  Synthetic
tcttatgtaacagaattgatatcaaagaacaaaaatagctccttgttaatgtatgtatcagaaataaaaagaaaa

SEQ ID NO: 36427 - DNA, 75 bp, Artificial Sequence
  Synthetic
agaacaaaaatagctccttgttaatgtatgtatcagaaataaaaagaaaattcccagggaatgcactgctagttg

SEQ ID NO: 36428 - DNA, 75 bp, Artificial Sequence
  Synthetic
acaatcattgagcgagatctctggcttcgaacttggggatgaatgggaagactttaaatatgatccagaacccac

SEQ ID NO: 36429 - DNA, 75 bp, Artificial Sequence
  Synthetic
ttcgaacttggggatgaatgggaagactttaaatatgatccagaacccacagagccagctttgatgccaagatcg

SEQ ID NO: 36430 - DNA, 75 bp, Artificial Sequence
  Synthetic
aaaatgctgccagtgttagtaagacaaaaacttgcgaaaatataaaaagagtcttatgtttatctcccagatcaa

SEQ ID NO: 36431 - DNA, 75 bp, Artificial Sequence
  Synthetic
aaaaacttgcgaaaatataaaaagagtcttatgtttatctcccagatcaagagcaacatttgatgatgttgtagc

SEQ ID NO: 36432 - DNA, 75 bp, Artificial Sequence
  Synthetic
ctcgctatgatacttcagatagaatgaaactgcacagagcttctggattgtgccccggttataaaagcctaagag

SEQ ID NO: 36433 - DNA, 75 bp, Artificial Sequence
  Synthetic
gtatatatgttaccaaatatcactatataccaatcgaatatagagaggagtcattattgcattgctgattcgcat

SEQ ID NO: 36434 - DNA, 75 bp, Artificial Sequence
  Synthetic
agggcctgcatcaatactgtctataattactgcagtactggtcttaacctttgtgacaccaatcaattctatggt

SEQ ID NO: 36435 - DNA, 75 bp, Artificial Sequence
  Synthetic
tataccaatcgaatatagagaggagtcattattgcattgctgattcgcattgtctagaagaattcgaattggtaa

SEQ ID NO: 36436 - DNA, 75 bp, Artificial Sequence
  Synthetic
tttaggggagagtaaagaaacttttgaacttgaagagcttccagacgacatgttggaaatggcatcaagaataaa

SEQ ID NO: 36437 - DNA, 75 bp, Artificial Sequence
  Synthetic
aaagtcaacatgttgggctggagaaattgatgatatagttctacataaacaaagtgatggcctgaggagctgtag

SEQ ID NO: 36438 - DNA, 75 bp, Artificial Sequence
  Synthetic
attgatgatatagttctacataaacaaagtgatggcctgaggagctgtagaataaaagacacaggaacctgcgat

SEQ ID NO: 36439 - DNA, 75 bp, Artificial Sequence
  Synthetic
ttttatgtgaaaacaataatttctattattctgaagtgcatagagattatgataaagatcaagatataggtcatt

SEQ ID NO: 36440 - DNA, 75 bp, Artificial Sequence
  Synthetic
ttattctgaagtgcatagagattatgataaagatcaagatataggtcatttttgcctaagtccgcgttgtaatat

SEQ ID NO: 36441 - DNA, 75 bp, Artificial Sequence
  Synthetic
caaatctgggttgaaaaggcatggtgatttcaccaacaaatgcaggcagtgcacatgcggtcaatatgaagatgc

SEQ ID NO: 36442 - DNA, 75 bp, Artificial Sequence
  Synthetic
catataagaacctgcaagtggcaaatttcacattctacaatagataaaattaccgtacatgagttggcagatatt

SEQ ID NO: 36443 - DNA, 75 bp, Artificial Sequence
  Synthetic
tttcacattctacaatagataaaattaccgtacatgagttggcagatattgaacaatataaaaaagctattacgc

SEQ ID NO: 36444 - DNA, 75 bp, Artificial Sequence
  Synthetic
attcaaatacaaaaggacaaagaatttaccacatataaagccaatttataaatacattgcaatagaaggtacaga

SEQ ID NO: 36445 - DNA, 75 bp, Artificial Sequence
  Synthetic
ttaccacatataaagccaatttataaatacattgcaatagaaggtacagaaacagtagaaggtattgaaaatgct

SEQ ID NO: 36446 - DNA, 75 bp, Artificial Sequence
  Synthetic
tggcaggtactgctataggttttaaaatcaattcaaaggatggcaatcacttgatggatgtaataggatatgtaa

SEQ ID NO: 36447 - DNA, 75 bp, Artificial Sequence
  Synthetic
aatcaattcaaaggatggcaatcacttgatggatgtaataggatatgtaaagagtgcatcttattcatctacata

SEQ ID NO: 36448 - DNA, 75 bp, Artificial Sequence
  Synthetic
acaatagggatcaacacgaagcatgatgaaaaatgcactgggagctgtcctacacaagtcaagcataaaaccggt

SEQ ID NO: 36449 - DNA, 75 bp, Artificial Sequence
  Synthetic
atgaaaaatgcactgggagctgtcctacacaagtcaagcataaaaccggttggttaacatttgcaaaagaaagaa

SEQ ID NO: 36450 - DNA, 75 bp, Artificial Sequence
  Synthetic
tggatgtttggctattagtgatggctgcgtatttgggtcatgtcaggacataataaaggatgaattgaccgttta

SEQ ID NO: 36451 - DNA, 75 bp, Artificial Sequence
  Synthetic
tgcgtatttgggtcatgtcaggacataataaaggatgaattgaccgtttataggaaaaccactgacgaagtgaca

SEQ ID NO: 36452 - DNA, 75 bp, Artificial Sequence
  Synthetic
cagacaagacttattgcacaaatttgaatgctgttacacctataataacagataaatttgaggtgcaattcaaaa

SEQ ID NO: 36453 - DNA, 75 bp, Artificial Sequence
  Synthetic
gaaacaaacaaagtttgataaagacttaaatctagccttaacagccttgcatcatgctttcagggggacttcatc

SEQ ID NO: 36454 - DNA, 75 bp, Artificial Sequence
  Synthetic
gaatgctgttacacctataataacagataaatttgaggtgcaattcaaaaccgtggaatcttactcattgccaag

SEQ ID NO: 36455 - DNA, 75 bp, Artificial Sequence
  Synthetic
atcaaggttggacaaattaatgatattggagtctattcaaaaggatgtggtaatgtacaaaaggtaaatggaaca

SEQ ID NO: 36456 - DNA, 75 bp, Artificial Sequence
  Synthetic
ttggagtctattcaaaaggatgtggtaatgtacaaaaggtaaatggaacaagttatggaaatggtgtaccaaaat

SEQ ID NO: 36457 - DNA, 75 bp, Artificial Sequence
  Synthetic
tgaaaagtctgccaggtatgacaaatttcaaatatgataaattctgggatgagctattgtacaaacccaacccag

SEQ ID NO: 36458 - DNA, 75 bp, Artificial Sequence
  Synthetic
tagaaaagaagttaccattaggaaatgctttgacaacgattaccaggcttgtaaatttttacagacaccttcaag

SEQ ID NO: 36459 - DNA, 75 bp, Artificial Sequence
  Synthetic
tgctttgacaacgattaccaggcttgtaaatttttacagacaccttcaagttataggcttgaagaacatcagggc

SEQ ID NO: 36460 - DNA, 75 bp, Artificial Sequence
  Synthetic
aaaggagtcatcttacaacttcaaactagcaatttcatcaaaatctataaaaacctgcaagaatgttaaggatgt

SEQ ID NO: 36461 - DNA, 75 bp, Artificial Sequence
  Synthetic
aaatactgggttctattaaaatgaaggcaatcttaggagatgtcaagtacaaaaattatgctagtaatattgata

SEQ ID NO: 36462 - DNA, 75 bp, Artificial Sequence
  Synthetic
ggcaatcttaggagatgtcaagtacaaaaattatgctagtaatattgatatcaatgctgaaggttcttgtgctgg

SEQ ID NO: 36463 - DNA, 75 bp, Artificial Sequence
  Synthetic
cattgtgagttcacaattcatagcacagtggaaaccagttgtcaaattgaaagcgactgtacaagtttccatgac

SEQ ID NO: 36464 - DNA, 75 bp, Artificial Sequence
  Synthetic
tctagaagaatttgaggctatcaaccaggaggaactggatgcagtaaaaaaatccaaatgttgggaaattgaata

SEQ ID NO: 36465 - DNA, 75 bp, Artificial Sequence
  Synthetic
caggaggaactggatgcagtaaaaaaatccaaatgttgggaaattgaatattctgatgtaaaacccctccaagaa

SEQ ID NO: 36466 - DNA, 75 bp, Artificial Sequence
  Synthetic
cagtggaaaccagttgtcaaattgaaagcgactgtacaagtttccatgacagggtgttaataacaccaaatgaac

SEQ ID NO: 36467 - DNA, 75 bp, Artificial Sequence
  Synthetic
ccatgacaaacctgcttcttcgcttaaatttaaaatttgtaacacgaaagtcgaggcagctatgactttagtaga

SEQ ID NO: 36468 - DNA, 75 bp, Artificial Sequence
  Synthetic
aaatttaaaatttgtaacacgaaagtcgaggcagctatgactttagtagatgcgagacccataatagagttagca

SEQ ID NO: 36469 - DNA, 75 bp, Artificial Sequence
  Synthetic
caaaactcaagatattggtcactattgcttaagccctggatgcactactgttcggtaccctattaatccaaagca

SEQ ID NO: 36470 - DNA, 75 bp, Artificial Sequence
  Synthetic
gagaaaaagatgaaagatgcaaaacttggatgtgcagagttagggatgaaggaatacaggttatttttgagcctt

SEQ ID NO: 36471 - DNA, 75 bp, Artificial Sequence
  Synthetic
ttggatgtgcagagttagggatgaaggaatacaggttatttttgagcctttcaaaaatttatttggctcatatat

SEQ ID NO: 36472 - DNA, 75 bp, Artificial Sequence
  Synthetic
tgtattattgtattatttttaatcgtttatatagtgctaccaatttgcttcaagctcaaagacactctaaagcaa

SEQ ID NO: 36473 - DNA, 75 bp, Artificial Sequence
  Synthetic
tttatatagtgctaccaatttgcttcaagctcaaagacactctaaagcaacatgaagatgcatacaaaagggaaa

SEQ ID NO: 36474 - DNA, 75 bp, Artificial Sequence
  Synthetic
ttatattttctaaggggtacttatataagtgggttggggtcaaaaataataacggctatattaaagattgaaaca

SEQ ID NO: 36475 - DNA, 75 bp, Artificial Sequence
  Synthetic
taagtgggttggggtcaaaaataataacggctatattaaagattgaaacattatatatacttggtagcacactac

SEQ ID NO: 36476 - DNA, 75 bp, Artificial Sequence
  Synthetic
agtagtgtactccacttgaatactttgagaatatattgaaataaacttctatagaaggcatacttggttgatatg

SEQ ID NO: 36477 - DNA, 75 bp, Artificial Sequence
  Synthetic
tgggttcttgagcacttcactgaagatgacgatgagtcccaaagagaactcataaggagcaccatcataaaccca

SEQ ID NO: 36478 - DNA, 75 bp, Artificial Sequence
  Synthetic
agcagcttaaatgggggagaggaggacttagtgatgctgcaagaaccttcctgatcaaatttggtgtaaaactgc

SEQ ID NO: 36479 - DNA, 75 bp, Artificial Sequence
  Synthetic
ttgagtaaattttggattaataaattggcaaatttcacaattggttaaaattcaattcttataattggcttccaa

SEQ ID NO: 36480 - DNA, 75 bp, Artificial Sequence
  Synthetic
aaatatgcattaaaaatggtgtgcacagaaaagccggggaacacactcacaattaaagtttgcaatactaagatt

SEQ ID NO: 36481 - DNA, 75 bp, Artificial Sequence
  Synthetic
ttacaaaaaattcagtcatatcacaatatatgcataatggactaccaagagtatcaacaattcttggctaggatt

SEQ ID NO: 36482 - DNA, 75 bp, Artificial Sequence
  Synthetic
agtagtgtactccacttgaatactttgaaaataaattgttgttgactgttttttacctaagggaaattataaaga

SEQ ID NO: 36483 - DNA, 75 bp, Artificial Sequence
  Synthetic
gatggccagacatgattattttggaagagagctatgcaagtccttaaatatagaatatagaaatgatgtaccatt

SEQ ID NO: 36484 - DNA, 75 bp, Artificial Sequence
  Synthetic
tcaacccaatcgctgagtctaatggtgtgggatgggacagtgggccagagatctatctatcatttttcccaggaa

SEQ ID NO: 36485 - DNA, 75 bp, Artificial Sequence
  Synthetic
ttccaatagaaatagttatcatccgtatagaccctgtaagtaaagatttgcatattaactctgatagatttaaag

SEQ ID NO: 36486 - DNA, 75 bp, Artificial Sequence
  Synthetic
cagaaatgtttttggagactttcaaattctacccactgaccattggaattcacagagtcaagcaaggcatgatgg

SEQ ID NO: 36487 - DNA, 75 bp, Artificial Sequence
  Synthetic
aaaggaggcctgagcgatactgctaaaacattcctgcagaaatttggcatcaggctcccataaatagagcatgag

SEQ ID NO: 36488 - DNA, 75 bp, Artificial Sequence
  Synthetic
aaatttatatatgttaatttgattaattggttatccaaaagggttttcttaagggaacccacaaaaatagcagct

SEQ ID NO: 36489 - DNA, 75 bp, Artificial Sequence
  Synthetic
caaaaaattagagcccaaacaaataaacaatgcccttgttttatgggaacagcagtttatggtaaataatgacct

SEQ ID NO: 36490 - DNA, 75 bp, Artificial Sequence
  Synthetic
tatagatataattttggatataaggcctgaagtagacccattaactatagatgcaccacatattaccccagacaa

SEQ ID NO: 36491 - DNA, 75 bp, Artificial Sequence
  Synthetic
agggacatatctgatagattaagtattccaatagaaatagttatcatccgtatagaccctgtaagcagagatttg

SEQ ID NO: 36492 - DNA, 75 bp, Artificial Sequence
  Synthetic
cttacggcaccctggtgcaagactggatgccctgaattctggaagcaccccatttataaagaatttaaaatgagt

SEQ ID NO: 36493 - DNA, 75 bp, Artificial Sequence
  Synthetic
ctggctagtggattttataagcaaccaaataagaatgagattagtgaggggtggacattaatggtcgaaagagtt

SEQ ID NO: 36494 - DNA, 75 bp, Artificial Sequence
  Synthetic
ctctccatgaccagaaacccagcatacattttatatggggagcccataacccaggaaatagtaataatgcaacct

SEQ ID NO: 36495 - DNA, 75 bp, Artificial Sequence
  Synthetic
acattttatatggggagcccataacccaggaaatagtaataatgcaacctttaaactcattttgctttcaaagtc

SEQ ID NO: 36496 - DNA, 75 bp, Artificial Sequence
  Synthetic
acttacacagaggcgtttaaatctttaggaaaaatgatggatattggggataaggctattgaatatgaagaattc

SEQ ID NO: 36497 - DNA, 75 bp, Artificial Sequence
  Synthetic
gatcatcatggaagcagataatgaataaaaaattagagcccaaacaaataaacaatgcccttgtcttatgggaac

SEQ ID NO: 36498 - DNA, 75 bp, Artificial Sequence
  Synthetic
gatagacaaaaatgagaaattgaaattatttaagaatttctgcggtataggtaaacacaagcaattcaagaataa

SEQ ID NO: 36499 - DNA, 75 bp, Artificial Sequence
  Synthetic
aagcccaaaatattagactttgatgacgcaaatatgtatttggctagcctgactatgatggaacaaagtaagaag

SEQ ID NO: 36500 - DNA, 75 bp, Artificial Sequence
  Synthetic
acaaaatatttgagacaagatattggcaatgcatatctgatttctctactctgatgaaaaatatcttatctgtgt

SEQ ID NO: 36501 - DNA, 75 bp, Artificial Sequence
  Synthetic
aatgtctttgctatagtatttccttcagctgacataaaaactaaaaaagcaactgtagtctatagcattatagtg

SEQ ID NO: 36502 - DNA, 75 bp, Artificial Sequence
  Synthetic
gataaaagtcttcattcttccggcaaaatcatacacaacaacagatttctgttcactcatgcaggggaatttaat

SEQ ID NO: 36503 - DNA, 75 bp, Artificial Sequence
  Synthetic
aaggagtatttaacacaaatatacttaccattctatttcaatgctaagggattgcatgagaagcaccatgttatg

SEQ ID NO: 36504 - DNA, 75 bp, Artificial Sequence
  Synthetic
aaaggacagagagatatttgttggagaatatgaagctaaaatgtgcatgtatgcagttgagaggatagcaaaaga

SEQ ID NO: 36505 - DNA, 75 bp, Artificial Sequence
  Synthetic
atgcagttgagaggatagcaaaagaaagatgtaaattaaatcctgatgaaatgatatctgagccgggagatggca

SEQ ID NO: 36506 - DNA, 75 bp, Artificial Sequence
  Synthetic
agaacaagaaattcgatttttggtcgagacaacaagacaaaagaatcgtgaaatagacgaggcaattgaagcatt

SEQ ID NO: 36507 - DNA, 75 bp, Artificial Sequence
  Synthetic
ttggcaaagcaaagggcctaaagatggaaataaatgcagacatgtctaaatggagtgctcaggatgttttttaca

SEQ ID NO: 36508 - DNA, 75 bp, Artificial Sequence
  Synthetic
aatatttctggctcatagccttagaccctatcctctacccacaggaaaaagagagaatattatacttcatgtgca

SEQ ID NO: 36509 - DNA, 75 bp, Artificial Sequence
  Synthetic
ccatagctgtgcaatgtctgtgtataaagaaatattaaaagaggccataacattactagatgggtctatactagt

SEQ ID NO: 36510 - DNA, 75 bp, Artificial Sequence
  Synthetic
tcaaatgacccaattgattatttcccagcagaaaataggaaggacatccctatagaattaaatggtgtattagat

SEQ ID NO: 36511 - DNA, 75 bp, Artificial Sequence
  Synthetic
cagcagaaaataggaaggacatccctatagaattaaatggtgtattagatgctccattgtcaatgattagtacag

SEQ ID NO: 36512 - DNA, 75 bp, Artificial Sequence
  Synthetic
ctttttgataaagttgttgagcaaatacaccccagtcatgcaaaaaagagagtcagtagtcaaccaaatagctga

SEQ ID NO: 36513 - DNA, 75 bp, Artificial Sequence
  Synthetic
agtagtgtactccacttgaatactttgagaattatcttgaaataactttgttatatcgtttgcttcacaattgtg

SEQ ID NO: 36514 - DNA, 75 bp, Artificial Sequence
  Synthetic
tcaatcttacagccgttagaatcttcttccttaatgccgcaaaagccaaagctgctctctctcgcaagccggaga

SEQ ID NO: 36515 - DNA, 75 bp, Artificial Sequence
  Synthetic
gagggaggtctattttgacacctaggaaattcacaacagcaggtagtttaaggaaattatattctttcagtaagt

SEQ ID NO: 36516 - DNA, 75 bp, Artificial Sequence
  Synthetic
cattttcctggaaacaggaacaacccaattggtaacaacgatcttaccatccacagaatttcaggatatttagct

SEQ ID NO: 36517 - DNA, 75 bp, Artificial Sequence
  Synthetic
tataattccaaaagattcaaagaaagtttgtcaatacagaatccagcacaattatttatagaacaaatattgttc

SEQ ID NO: 36518 - DNA, 75 bp, Artificial Sequence
  Synthetic
agggaggggatgaagctcagaaagaactaattcggacaacaatcattaaccctattgcagaatccaatggaatac

SEQ ID NO: 36519 - DNA, 75 bp, Artificial Sequence
  Synthetic
actaattcggacaacaatcattaaccctattgcagaatccaatggaatacattgggcaaatggagcagaaattta

SEQ ID NO: 36520 - DNA, 75 bp, Artificial Sequence
  Synthetic
atgtttcttgaggctttcaaattctacccactgacaattgggatatacagagtcaagcatggaatgatggatgcc

SEQ ID NO: 36521 - DNA, 75 bp, Artificial Sequence
  Synthetic
acccactgacaattgggatatacagagtcaagcatggaatgatggatgcccagtacctgaagaaggcattgagac

SEQ ID NO: 36522 - DNA, 75 bp, Artificial Sequence
  Synthetic
cgagtggatggcacaaaaaactgttttaatcacaaaaagcctaaaggatgttgagcagttgaagtggggaagagg

SEQ ID NO: 36523 - DNA, 75 bp, Artificial Sequence
  Synthetic
ttaatcacaaaaagcctaaaggatgttgagcagttgaagtggggaagaggaggtttgagtgatgctgccagaaca

SEQ ID NO: 36524 - DNA, 75 bp, Artificial Sequence
  Synthetic
aggaacttgaaattaatacatcattcccctgccttggttttgagagcatatagtaaaaataatcctgacatccag

SEQ ID NO: 36525 - DNA, 75 bp, Artificial Sequence
  Synthetic
ttccataagtttgatgctatccacatagattcggcgctataattggatttaaatttcatcctttaagattggttt

SEQ ID NO: 36526 - DNA, 75 bp, Artificial Sequence
  Synthetic
atagcagcaaaatgggtgggtggtaggggacagcaaactttttgatcttaagtcattgataaaataaaatgtatt

SEQ ID NO: 36527 - DNA, 75 bp, Artificial Sequence
  Synthetic
agtagtgtactcctatctacaaaacttacaaagaattcagtcatatcacaatatatgcgtaatggaccatcagga

SEQ ID NO: 36528 - DNA, 75 bp, Artificial Sequence
  Synthetic
ttacaaagaattcagtcatatcacaatatatgcgtaatggaccatcaggaatatcaacaattcttagctaggatt

SEQ ID NO: 36529 - DNA, 75 bp, Artificial Sequence
  Synthetic
aatggccagacatgattattttggaagggagctatgtaagtccttaaatatagaatatagaaacgatataccatt

SEQ ID NO: 36530 - DNA, 75 bp, Artificial Sequence
  Synthetic
cctgaaatagatccattaaccatagatgcaccacatataaccccagacaattatttatatataaataatgtgttg

SEQ ID NO: 36531 - DNA, 75 bp, Artificial Sequence
  Synthetic
atgcaccacatataaccccagacaattatttatatataaataatgtgttgtatattatagattacaaagtctctg

SEQ ID NO: 36532 - DNA, 75 bp, Artificial Sequence
  Synthetic
cccattttgcagattcattcatagattcattgtctaggtcagcctttttgcagttgataatagatgaattcagtt

SEQ ID NO: 36533 - DNA, 75 bp, Artificial Sequence
  Synthetic
gtatgacaaatattatgagctaactagagatatatctgacagattaagtatcccaatagaaatagttattatccg

SEQ ID NO: 36534 - DNA, 75 bp, Artificial Sequence
  Synthetic
agagatatatctgacagattaagtatcccaatagaaatagttattatccgcatagaccctgtaagcaaagatttg

SEQ ID NO: 36535 - DNA, 75 bp, Artificial Sequence
  Synthetic
atgccagtgcctgagcgaaggctcttcgaagaatcagtcaaatttaatgcttatgaatcagaaagatggaacact

SEQ ID NO: 36536 - DNA, 75 bp, Artificial Sequence
  Synthetic
acgtatattgataagatccttagactatctaaataatgatatattttctctttcaaggattaaagtcgggcttga

SEQ ID NO: 36537 - DNA, 75 bp, Artificial Sequence
  Synthetic
tcaagcttatattgctttcaaagtctctacaaagcataaaaggtatatcaacttacacagaggcttttaaatctt

SEQ ID NO: 36538 - DNA, 75 bp, Artificial Sequence
  Synthetic
attcagcgagaatggcttcatatcacctgagaatcttggttgcttagaagctgtggtatcattaataaaattgtt

SEQ ID NO: 36539 - DNA, 75 bp, Artificial Sequence
  Synthetic
cctgagaatcttggttgcttagaagctgtggtatcattaataaaattgttgaaaactaatgagtggtccacagtt

SEQ ID NO: 36540 - DNA, 75 bp, Artificial Sequence
  Synthetic
tgttttatggggaaccctatcactagagacataaattgggtgatgtttagagaatttatcaatagtttaccaggg

SEQ ID NO: 36541 - DNA, 75 bp, Artificial Sequence
  Synthetic
agccagataattttgtactgaatgaattcgggtcgagaattaaagatgccaataaagaaacatatgacaacatgt

SEQ ID NO: 36542 - DNA, 75 bp, Artificial Sequence
  Synthetic
tgacagagaacttcaagaagaaatgtattgctctaataaactccaagtttgaaacacagagagatttctcagaat

SEQ ID NO: 36543 - DNA, 75 bp, Artificial Sequence
  Synthetic
attcgggtcgagaattaaagatgccaataaagaaacatatgacaacatgtacaaaatatttgagacacggtattg

SEQ ID NO: 36544 - DNA, 75 bp, Artificial Sequence
  Synthetic
tcactaaattgatgaagaaggaaggtgggaggagcaatatagagtttgattagtagttatgagcttatagagaac

SEQ ID NO: 36545 - DNA, 75 bp, Artificial Sequence
  Synthetic
gaataactttgatataaacctgacataaagtccattacactattgcaatgggtgatttggttttctatgatgtcg

SEQ ID NO: 36546 - DNA, 75 bp, Artificial Sequence
  Synthetic
taaagtccattacactattgcaatgggtgatttggttttctatgatgtcgcatccacaggtgcaaatggatttga

SEQ ID NO: 36547 - DNA, 75 bp, Artificial Sequence
  Synthetic
ttcttcacctggattgtttttaacaacttgcctgctatttaaacatgacaacccaaccctagtgatgagtgacat

SEQ ID NO: 36548 - DNA, 75 bp, Artificial Sequence
  Synthetic
atggctaaccatggggagtcgatcagtctgtcaaccgttaggatcttcttccttaatgccgcaaaagccaaagct

SEQ ID NO: 36549 - DNA, 75 bp, Artificial Sequence
  Synthetic
gtctgtcaaccgttaggatcttcttccttaatgccgcaaaagccaaagctgctctcactcgtaagccggagcgga

SEQ ID NO: 36550 - DNA, 75 bp, Artificial Sequence
  Synthetic
tttcctggaaacaggaacaacccaattggtaacaacgatcttaccttgcaccggatttcaggatatctagctaga

SEQ ID NO: 36551 - DNA, 75 bp, Artificial Sequence
  Synthetic
gtgaggacgagtcacaaaaggagctgatcaagagcactgtcatcaatccaattgccgagtccaacgggattcgct

SEQ ID NO: 36552 - DNA, 75 bp, Artificial Sequence
  Synthetic
gatcaagagcactgtcatcaatccaattgccgagtccaacgggattcgctggggcaacggtgtagaaatctatct

SEQ ID NO: 36553 - DNA, 75 bp, Artificial Sequence
  Synthetic
tttctggaattgttcaaattctacccattgacaattggcatctacagagtgaaacatggaatgatggatgctcag

SEQ ID NO: 36554 - DNA, 75 bp, Artificial Sequence
  Synthetic
cattgacaattggcatctacagagtgaaacatggaatgatggatgctcagtacctaaaaaaagctctgagacagc

SEQ ID NO: 36555 - DNA, 75 bp, Artificial Sequence
  Synthetic
gtggatttagcaaagactatattagaaatagagtgcgaacaaagagaaaatataaaggagatatggtctgcaaat

SEQ ID NO: 36556 - DNA, 75 bp, Artificial Sequence
  Synthetic
atggatggctcaaaagacatctatgattacaaagagcctcaaagatgtggagcagctaaagtggggaaagggtgg

SEQ ID NO: 36557 - DNA, 75 bp, Artificial Sequence
  Synthetic
aaatcttgattcattccttgtgtaaaaatttactcgcagacacctctagacacaatcatttgcggaacaggatag

SEQ ID NO: 36558 - DNA, 75 bp, Artificial Sequence
  Synthetic
attacaaagagcctcaaagatgtggagcagctaaagtggggaaagggtggtctcagcgatactgccagagctttc

SEQ ID NO: 36559 - DNA, 75 bp, Artificial Sequence
  Synthetic
aaatttactcgcagacacctctagacacaatcatttgcggaacaggatagagaatagaaataatttcaggaggtc

SEQ ID NO: 36560 - DNA, 75 bp, Artificial Sequence
  Synthetic
catgagtctgatgctctcctggtagattcggcattttaattaggtctaaattttaattttaaattggcttccaaa

SEQ ID NO: 36561 - DNA, 75 bp, Artificial Sequence
  Synthetic
agttcaaagtcttgtctcaaaataggggattttagaaaggaaaaagagctacaatcggttaaacaaaagaagatt

SEQ ID NO: 36562 - DNA, 75 bp, Artificial Sequence
  Synthetic
gggattttagaaaggaaaaagagctacaatcggttaaacaaaagaagattttagaagtacagagtcgcaaaatga

SEQ ID NO: 36563 - DNA, 75 bp, Artificial Sequence
  Synthetic
agcaaaatgggtgggtggtaggggacagcaatatgtcgtatgtcaggtcattgataaaataaaatgtattcagtg

SEQ ID NO: 36564 - DNA, 75 bp, Artificial Sequence
  Synthetic
agtagtgtactaccaagtataaataacgttcaaagagtaaagtgaataaacatcatacatgatgatctggattct

SEQ ID NO: 36565 - DNA, 75 bp, Artificial Sequence
  Synthetic
acgttcaaagagtaaagtgaataaacatcatacatgatgatctggattctgctcactgttgtcactgtgacaatt

SEQ ID NO: 36566 - DNA, 75 bp, Artificial Sequence
  Synthetic
catcatacatgatgatctggattctgctcactgttgtcactgtgacaattgcaaatccagtctaccaacgttgct

SEQ ID NO: 36567 - DNA, 75 bp, Artificial Sequence
  Synthetic
gggttttaacagacaagcctgttatagaacagataatggatatgatggttgatcacaagaaattctacttcacat

SEQ ID NO: 36568 - DNA, 75 bp, Artificial Sequence
  Synthetic
aaatccatcaaaggaggcagttactgaagtatgtctgaaagatgatgtcagcatgatcaaaactgaggcaaaata

SEQ ID NO: 36569 - DNA, 75 bp, Artificial Sequence
  Synthetic
gaagtatgtctgaaagatgatgtcagcatgatcaaaactgaggcaaaatatgtgaaaaatttgaccggaacattt

SEQ ID NO: 36570 - DNA, 75 bp, Artificial Sequence
  Synthetic
agaacagataatggatatgatggttgatcacaagaaattctacttcacatttttcaacaaaggccagaaaacatc

SEQ ID NO: 36571 - DNA, 75 bp, Artificial Sequence
  Synthetic
gaatatgaagccaaaatgtgcatgtatgcagtagagaggatagcaaaagagagatgtaaactaaaccctgatgaa

SEQ ID NO: 36572 - DNA, 75 bp, Artificial Sequence
  Synthetic
ggctagttgctgattggcatgattgtaggccacaaaaaagagctggcggacacataaatgttattgaagtaggcg

SEQ ID NO: 36573 - DNA, 75 bp, Artificial Sequence
  Synthetic
taggccacaaaaaagagctggcggacacataaatgttattgaagtaggcgatgacctgtctttacacacagagtc

SEQ ID NO: 36574 - DNA, 75 bp, Artificial Sequence
  Synthetic
atgcagtagagaggatagcaaaagagagatgtaaactaaaccctgatgaaatgatatctgagccaggagatggta

SEQ ID NO: 36575 - DNA, 75 bp, Artificial Sequence
  Synthetic
agaacaagaaattcggttcttagttgagactacaagacagaagaatcgtgaaatagatgaagcaattgaggcatt

SEQ ID NO: 36576 - DNA, 75 bp, Artificial Sequence
  Synthetic
attagtgttgataaagaaacagcacaaataaggttacagacagacaccactaatcattttgaagttgcaggaaca

SEQ ID NO: 36577 - DNA, 75 bp, Artificial Sequence
  Synthetic
aaataaggttacagacagacaccactaatcattttgaagttgcaggaacaactgtaaaatcgggatggtttaaga

SEQ ID NO: 36578 - DNA, 75 bp, Artificial Sequence
  Synthetic
gagactacaagacagaagaatcgtgaaatagatgaagcaattgaggcattagctgcagaagggtatgagagtaat

SEQ ID NO: 36579 - DNA, 75 bp, Artificial Sequence
  Synthetic
gacttgtgagcgcctgaaagtctcttgcggacctaaatctattcaattccatgcatgctttaatcaacatatgtc

SEQ ID NO: 36580 - DNA, 75 bp, Artificial Sequence
  Synthetic
tgcggacctaaatctattcaattccatgcatgctttaatcaacatatgtcatgtgttagatttttacatcgtact

SEQ ID NO: 36581 - DNA, 75 bp, Artificial Sequence
  Synthetic
gagagaatactatactttatgtgcaattatatggagaaagaattaatactgccagatgaattgttatttaattta

SEQ ID NO: 36582 - DNA, 75 bp, Artificial Sequence
  Synthetic
ctatttgtcaaaacatagaaataataatattggttactcttacattactaatattcatactcttgagtattttga

SEQ ID NO: 36583 - DNA, 75 bp, Artificial Sequence
  Synthetic
aatattggttactcttacattactaatattcatactcttgagtattttgagtaagacatacatatgttacatact

SEQ ID NO: 36584 - DNA, 75 bp, Artificial Sequence
  Synthetic
atgatataattgctactatgactaaccagttaaattccaacactattctgataaagagaaattggcttcaaggga

SEQ ID NO: 36585 - DNA, 75 bp, Artificial Sequence
  Synthetic
ccagttaaattccaacactattctgataaagagaaattggcttcaagggaattttaactatacctcaagctatgt

SEQ ID NO: 36586 - DNA, 75 bp, Artificial Sequence
  Synthetic
tatatatatggttgggtttataacaagtcatgtaaaaaatgcaagttatgtggcttagtttaccatccattcaca

SEQ ID NO: 36587 - DNA, 75 bp, Artificial Sequence
  Synthetic
agtcatgtaaaaaatgcaagttatgtggcttagtttaccatccattcacagaatgtgggacacactgtgtctgtg

SEQ ID NO: 36588 - DNA, 75 bp, Artificial Sequence
  Synthetic
gatgaagttgcatagagcttcaggattatgtcctggttataaaagcttaagagcagcaagagtaatgtgcaaatc

SEQ ID NO: 36589 - DNA, 75 bp, Artificial Sequence
  Synthetic
ttatgtcctggttataaaagcttaagagcagcaagagtaatgtgcaaatcaaaaggcccagcatcaatactatct

SEQ ID NO: 36590 - DNA, 75 bp, Artificial Sequence
  Synthetic
catttattacacctatgaatgctatggtgcttggctcatcagaagaggtgtataaattagaggatctacctgatg

SEQ ID NO: 36591 - DNA, 75 bp, Artificial Sequence
  Synthetic
ggtgcttggctcatcagaagaggtgtataaattagaggatctacctgatgatatgctgaacatggcggagaagat

SEQ ID NO: 36592 - DNA, 75 bp, Artificial Sequence
  Synthetic
ttgaattatagtactacatgggggctattaatcttgttgttaatagtgtcttgtctgttcaaaaagtatcatctt

SEQ ID NO: 36593 - DNA, 75 bp, Artificial Sequence
  Synthetic
tattaatcttgttgttaatagtgtcttgtctgttcaaaaagtatcatcttgtatttttgaattattatgccttgt

SEQ ID NO: 36594 - DNA, 75 bp, Artificial Sequence
  Synthetic
caataagccactggatgacttctttaacatacaacatgctaccgggacaatcaaatgaccctattgattatttcc

SEQ ID NO: 36595 - DNA, 75 bp, Artificial Sequence
  Synthetic
tgaaaagaaaaatctagtatataatggggatttttcaaacaaatgtctgcagtgtacatgcgggcaatatgaaga

SEQ ID NO: 36596 - DNA, 75 bp, Artificial Sequence
  Synthetic
ggggatttttcaaacaaatgtctgcagtgtacatgcgggcaatatgaagatgctacaggtttgatagtccatcaa

SEQ ID NO: 36597 - DNA, 75 bp, Artificial Sequence
  Synthetic
cagcagagaataggaaagatatacctatagagttaaatggtgttttagatgccccattatcaatgatcagcacag

SEQ ID NO: 36598 - DNA, 75 bp, Artificial Sequence
  Synthetic
ataaggcaaaatggtttataaatatacttataatatataccatattagtactcctgaaagactctgtgttgatgg

SEQ ID NO: 36599 - DNA, 75 bp, Artificial Sequence
  Synthetic
acttataatatataccatattagtactcctgaaagactctgtgttgatggctgctgctgaaagaccagatttcaa

SEQ ID NO: 36600 - DNA, 75 bp, Artificial Sequence
  Synthetic
tacacaccagtcatgcaaaaaagggaatcagtagtcaaccaaatagccgaagttaagaattggaaagttgaagat

SEQ ID NO: 36601 - DNA, 75 bp, Artificial Sequence
  Synthetic
tcattaaattgtactgggccatttataaatttgggaggatgtaaaaaacctcaaaagagggcgagctatcaatca

SEQ ID NO: 36602 - DNA, 75 bp, Artificial Sequence
  Synthetic
ttaaaatactcagatatctagttctagatgcagaaatggaccctagtgacattatgggtgagacaagcgacatga

SEQ ID NO: 36603 - DNA, 75 bp, Artificial Sequence
  Synthetic
taaatttgggaggatgtaaaaaacctcaaaagagggcgagctatcaatcaatagctgaacagttaaaagcaatca

SEQ ID NO: 36604 - DNA, 75 bp, Artificial Sequence
  Synthetic
agatgcagaaatggaccctagtgacattatgggtgagacaagcgacatgagagggaggtctatcttgacacctag

SEQ ID NO: 36605 - DNA, 75 bp, Artificial Sequence
  Synthetic
tatgatttcaaaaataccagatgatatatccggagctttaagacatattgaaaatctcaaaacataccatgaaca

SEQ ID NO: 36606 - DNA, 75 bp, Artificial Sequence
  Synthetic
aggaaattatattcttttagtaagtaccaagatagactgtcttcccctggaggcatggtcgaattgttcacttac

SEQ ID NO: 36607 - DNA, 75 bp, Artificial Sequence
  Synthetic
atatccggagctttaagacatattgaaaatctcaaaacataccatgaacaactaacagcagaatttgcaatgttg

SEQ ID NO: 36608 - DNA, 75 bp, Artificial Sequence
  Synthetic
accaagatagactgtcttcccctggaggcatggtcgaattgttcacttacctgcttgagaaacctgagttattag

SEQ ID NO: 36609 - DNA, 75 bp, Artificial Sequence
  Synthetic
aattctctgacaattccggatatagccaaaccagctggagaacatatttacggtctcatgattttgaggtatgca

SEQ ID NO: 36610 - DNA, 75 bp, Artificial Sequence
  Synthetic
ccaaaccagctggagaacatatttacggtctcatgattttgaggtatgcatcgcatatccaaatcaacatttttg

SEQ ID NO: 36611 - DNA, 75 bp, Artificial Sequence
  Synthetic
tataattccaaaagattcaaagaaagtctgtcaatacaaaatccagcacaactatttatagaacaaatattgttc

SEQ ID NO: 36612 - DNA, 75 bp, Artificial Sequence
  Synthetic
tgcacaagtgctaactgggattttgctaatgagatgaagaattactatactggaaaacagattagatttgacaaa

SEQ ID NO: 36613 - DNA, 75 bp, Artificial Sequence
  Synthetic
ctggtattagggacaagtatataaatttacatgatagcagagccctagagaaagagcctgatatattagggaaag

SEQ ID NO: 36614 - DNA, 75 bp, Artificial Sequence
  Synthetic
ctaatgagatgaagaattactatactggaaaacagattagatttgacaaagatctaaatttagcacttactacac

SEQ ID NO: 36615 - DNA, 75 bp, Artificial Sequence
  Synthetic
tttacatgatagcagagccctagagaaagagcctgatatattagggaaagtaacattcacagaagcttataggtt

SEQ ID NO: 36616 - DNA, 75 bp, Artificial Sequence
  Synthetic
cacatattacatgtcagacatattagcagagacaaaagcgaactcattgagagactacgcattagcactcaagag

SEQ ID NO: 36617 - DNA, 75 bp, Artificial Sequence
  Synthetic
gagctgaccaatgatgatatccaggtgatctattcctacataatacttaatgatcccatgatgataactactgca

SEQ ID NO: 36618 - DNA, 75 bp, Artificial Sequence
  Synthetic
gcagagacaaaagcgaactcattgagagactacgcattagcactcaagagtaagtaccctggaaatgccttgttg

SEQ ID NO: 36619 - DNA, 75 bp, Artificial Sequence
  Synthetic
tgatctattcctacataatacttaatgatcccatgatgataactactgcaaacacgcatatattgtcaatatacg

SEQ ID NO: 36620 - DNA, 75 bp, Artificial Sequence
  Synthetic
acttgcaacccctaaatgaggctacaaaattcaagcttagtagtgattgggaagactttaaatataattctgaac

SEQ ID NO: 36621 - DNA, 75 bp, Artificial Sequence
  Synthetic
aaaattcaagcttagtagtgattgggaagactttaaatataattctgaaccagaagcaagggcattaatgcctcg

SEQ ID NO: 36622 - DNA, 75 bp, Artificial Sequence
  Synthetic
tttagcaatgcagaaagcacaaataaggtaaaagtttgcaagaacatacaacgtgtaatgtgcttatctccaaga

SEQ ID NO: 36623 - DNA, 75 bp, Artificial Sequence
  Synthetic
aggtaaaagtttgcaagaacatacaacgtgtaatgtgcttatctccaagatccaaagctacagttgaggacatta

SEQ ID NO: 36624 - DNA, 75 bp, Artificial Sequence
  Synthetic
atcagtgtatatggttccaaacactactatataccagtccaacattgagaggagccattactgtatagctgactc

SEQ ID NO: 36625 - DNA, 75 bp, Artificial Sequence
  Synthetic
actatataccagtccaacattgagaggagccattactgtatagctgactcacattgcctagaagaatatgagcta

SEQ ID NO: 36626 - DNA, 75 bp, Artificial Sequence
  Synthetic
taaagaaatccacatgctggactggagagttagaaaatgttataccacataaacaaagtgatgggatccggagct

SEQ ID NO: 36627 - DNA, 75 bp, Artificial Sequence
  Synthetic
agagttagaaaatgttataccacataaacaaagtgatgggatccggagctgcaggacgaagaacacagggagatg

SEQ ID NO: 36628 - DNA, 75 bp, Artificial Sequence
  Synthetic
gctcactcatgcagggaaatttaataaaagataatgagtggtacacagttcattatttaaaacagatattgtccg

SEQ ID NO: 36629 - DNA, 75 bp, Artificial Sequence
  Synthetic
gtcatcttgtgtgaaaatgataaatattactactcagaattaaataaagactatgataaggatcaagatataggt

SEQ ID NO: 36630 - DNA, 75 bp, Artificial Sequence
  Synthetic
attactactcagaattaaataaagactatgataaggatcaagatataggtcatgtctgtttaagccctagatgca

SEQ ID NO: 36631 - DNA, 75 bp, Artificial Sequence
  Synthetic
aagacacatcactaattgcaagtgggaaaaccctgctggaacaatcagtagaatagagacccattcattagctga

SEQ ID NO: 36632 - DNA, 75 bp, Artificial Sequence
  Synthetic
gaaaaccctgctggaacaatcagtagaatagagacccattcattagctgatatagagcaatataagaaagcaata

SEQ ID NO: 36633 - DNA, 75 bp, Artificial Sequence
  Synthetic
caatttttaaatatgaaaaaacaaagaacttaccacatataaaacctatttataaatatataaccatagaaggta

SEQ ID NO: 36634 - DNA, 75 bp, Artificial Sequence
  Synthetic
gaacttaccacatataaaacctatttataaatatataaccatagaaggtacagaaactgttgaaggtgtggaaaa

SEQ ID NO: 36635 - DNA, 75 bp, Artificial Sequence
  Synthetic
tttggatatgggtttaattaatctgacaataactggttacaatagatctataacaataattggagaggataacaa

SEQ ID NO: 36636 - DNA, 75 bp, Artificial Sequence
  Synthetic
gcattggctggcacttcaataggattcaaggtaaattcaagagatggtgatcatctgatggacataattgcatat

SEQ ID NO: 36637 - DNA, 75 bp, Artificial Sequence
  Synthetic
actaggaaaactcctgagaatataactataagtggtaggaaactgctaggctcaaggcatggacttaaatttgaa

SEQ ID NO: 36638 - DNA, 75 bp, Artificial Sequence
  Synthetic
ctcaaggcatggacttaaatttgaaaacatgtctaagattcaaacatacccaggcaattattatataacgtatag

SEQ ID NO: 36639 - DNA, 75 bp, Artificial Sequence
  Synthetic
tcaaggtaaattcaagagatggtgatcatctgatggacataattgcatatattaaggttgcatcttattcatcaa

SEQ ID NO: 36640 - DNA, 75 bp, Artificial Sequence
  Synthetic
accaaccattggtattaatacaaaacatgatgaaaagtgcacaggtaattgcccagcaagattagaacataaagt

SEQ ID NO: 36641 - DNA, 75 bp, Artificial Sequence
  Synthetic
catgatgaaaagtgcacaggtaattgcccagcaagattagaacataaagtaggctggctcacctttgctaaagaa

SEQ ID NO: 36642 - DNA, 75 bp, Artificial Sequence
  Synthetic
aatttggctgtctagctgtaagtgatggttgtgtctttggttcatgtcaagacatcataaaagaggaactatctg

SEQ ID NO: 36643 - DNA, 75 bp, Artificial Sequence
  Synthetic
tggttgtgtctttggttcatgtcaagacatcataaaagaggaactatctgtttacaggaaagatacagaagaagt

SEQ ID NO: 36644 - DNA, 75 bp, Artificial Sequence
  Synthetic
tttgcagataaaacgtactgcacaagtttaaatgctattaccccaatcataacagaaaagtttgaagtgcagttt

SEQ ID NO: 36645 - DNA, 75 bp, Artificial Sequence
  Synthetic
gtttaaatgctattaccccaatcataacagaaaagtttgaagtgcagtttaaaactgttgaatcttattccttac

SEQ ID NO: 36646 - DNA, 75 bp, Artificial Sequence
  Synthetic
tctcgatcttactgaattgatgagatctcaggatttactaaacctcaactacgataatataaggaatagtaattt

SEQ ID NO: 36647 - DNA, 75 bp, Artificial Sequence
  Synthetic
tgagattagaattggccaaataaatgatttgggcagctattctaaaggatgtggaaatgttcaaagggtgaatgg

SEQ ID NO: 36648 - DNA, 75 bp, Artificial Sequence
  Synthetic
gatttgggcagctattctaaaggatgtggaaatgttcaaagggtgaatggcacaaattatggtagtggtcaacca

SEQ ID NO: 36649 - DNA, 75 bp, Artificial Sequence
  Synthetic
ccagccgaaaagaagtgattgtcagaaagtgctttgacaatgattatcaagcatgcaaattcctgcagacaccat

SEQ ID NO: 36650 - DNA, 75 bp, Artificial Sequence
  Synthetic
aagacatatgacatacagaaatgcaattaaattactgatagagagagagactaagatctttgaggaggctttcac

SEQ ID NO: 36651 - DNA, 75 bp, Artificial Sequence
  Synthetic
aaagtgctttgacaatgattatcaagcatgcaaattcctgcagacaccatcaagctacagattagaagagcatga

SEQ ID NO: 36652 - DNA, 75 bp, Artificial Sequence
  Synthetic
aaaaagatcctaggtactataaaaatgaaagcaattttaggtgatgtcagatacaagaattatgcttcagccatt

SEQ ID NO: 36653 - DNA, 75 bp, Artificial Sequence
  Synthetic
ccagagaatcttggttgcttggaagctatagtatcattaataaaattgttgaaaaccaacgagtggtcctcagtt

SEQ ID NO: 36654 - DNA, 75 bp, Artificial Sequence
  Synthetic
tgaaagcaattttaggtgatgtcagatacaagaattatgcttcagccattgatataaatgctgaaggggtttgtg

SEQ ID NO: 36655 - DNA, 75 bp, Artificial Sequence
  Synthetic
tatacactgtgaatttacaatacatactacaattgaagcaagttgccctattgagagcgactgtgtatcttttca

SEQ ID NO: 36656 - DNA, 75 bp, Artificial Sequence
  Synthetic
actacaattgaagcaagttgccctattgagagcgactgtgtatcttttcacgatagaatgctagtcacaccaaat

SEQ ID NO: 36657 - DNA, 75 bp, Artificial Sequence
  Synthetic
tatagccttgataaactctaagtttgaaacacaaagagatttttcagaattcactaaattgatgaagaaagaggg

SEQ ID NO: 36658 - DNA, 75 bp, Artificial Sequence
  Synthetic
tatgtgaagacaagccaggaagtgcactgaagttcaaaatatgcaacacaaagattgatgctgctatgacattgg

SEQ ID NO: 36659 - DNA, 75 bp, Artificial Sequence
  Synthetic
actgaagttcaaaatatgcaacacaaagattgatgctgctatgacattggttgatgctaaaccaatcctagaatt

SEQ ID NO: 36660 - DNA, 75 bp, Artificial Sequence
  Synthetic
gaaacacaaagagatttttcagaattcactaaattgatgaagaaagagggtggaaggagcaatatcgagtttgat

SEQ ID NO: 36661 - DNA, 75 bp, Artificial Sequence
  Synthetic
atcagagaaaaagatgagaggtgcaagacttggatgtgtagggtgcgagatgagggcatcaaggttttactagaa

SEQ ID NO: 36662 - DNA, 75 bp, Artificial Sequence
  Synthetic
agtagtgtactccacttgaatactttgaaaataaattgttgttgactgtttttacctaagggaaataatcaagag

SEQ ID NO: 36663 - DNA, 75 bp, Artificial Sequence
  Synthetic
agacttggatgtgtagggtgcgagatgagggcatcaaggttttactagaaccatttaagaatttatttggttcat

SEQ ID NO: 36664 - DNA, 75 bp, Artificial Sequence
  Synthetic
cctaattattattgcagcaataattataatttatataatactgcctatctgcttcaaattaagggacaccttaaa

SEQ ID NO: 36665 - DNA, 75 bp, Artificial Sequence
  Synthetic
ataatttatataatactgcctatctgcttcaaattaagggacaccttaaagaagcatgaagatgcttatagaaag

SEQ ID NO: 36666 - DNA, 75 bp, Artificial Sequence
  Synthetic
ggtctaaaagttgcaaaaaggcgcatttagattagatttatttattttgggttataaatttggggtaattagggt

SEQ ID NO: 36667 - DNA, 75 bp, Artificial Sequence
  Synthetic
gttataaatttggggtaattagggttggggtgggttaagaagagcagctttagaaatttgtagaatcattatgta

SEQ ID NO: 36668 - DNA, 75 bp, Artificial Sequence
  Synthetic
aacccaattggtaacaacgatcttaccatccacagattatctgggtatttagccagatgggtccttgatcagtat

SEQ ID NO: 36669 - DNA, 75 bp, Artificial Sequence
  Synthetic
ccatccacagattatctgggtatttagccagatgggtccttgatcagtataatgagaatgatgacgagtctcagc

SEQ ID NO: 36670 - DNA, 75 bp, Artificial Sequence
  Synthetic
ttacaaaaactttagtttgaaaccaatatatgtatcatggaccatcaggaataccagcagttcctcgcgaggatc

SEQ ID NO: 36671 - DNA, 75 bp, Artificial Sequence
  Synthetic
atatatgtatcatggaccatcaggaataccagcagttcctcgcgaggatcaatactgcaagggatgcctgcattg

SEQ ID NO: 36672 - DNA, 75 bp, Artificial Sequence
  Synthetic
agtagtgtactcctatctacaaaacttacaaaaactttagtttgaaaccaatatatgtatcatggaccatcagga

SEQ ID NO: 36673 - DNA, 75 bp, Artificial Sequence
  Synthetic
agccagatgggtccttgatcagtataatgagaatgatgacgagtctcagcatgagttgatcagaacaactatcat

SEQ ID NO: 36674 - DNA, 75 bp, Artificial Sequence
  Synthetic
gatggctaggcatgactatttcggaaaggagttatgcaaatctttaaatatagaatataggaatgatgtaccatt

SEQ ID NO: 36675 - DNA, 75 bp, Artificial Sequence
  Synthetic
aaggagttatgcaaatctttaaatatagaatataggaatgatgtaccatttatagatataatcctagatataaga

SEQ ID NO: 36676 - DNA, 75 bp, Artificial Sequence
  Synthetic
acagagtcaagcaaggcatgatggaccctcagtacctgaagaaggcattgaggcaacgctatggcacccttacag

SEQ ID NO: 36677 - DNA, 75 bp, Artificial Sequence
  Synthetic
ccctcagtacctgaagaaggcattgaggcaacgctatggcacccttacagcagataaatggatgtcacagaaggt

SEQ ID NO: 36678 - DNA, 75 bp, Artificial Sequence
  Synthetic
atgccccttatattactcctgataattatctgtatgtagacaacatattgtatctaatagattataaagtatccg

SEQ ID NO: 36679 - DNA, 75 bp, Artificial Sequence
  Synthetic
ttatctgtatgtagacaacatattgtatctaatagattataaagtatccgtatccaatgagagtagcataataac

SEQ ID NO: 36680 - DNA, 75 bp, Artificial Sequence
  Synthetic
agagatatatctagacgaatgaatatagaaatagagatagttatagtgagaatagatcctgtaagtaaagagttg

SEQ ID NO: 36681 - DNA, 75 bp, Artificial Sequence
  Synthetic
tagaaatagagatagttatagtgagaatagatcctgtaagtaaagagttgcatattagctccaatagattcaaag

SEQ ID NO: 36682 - DNA, 75 bp, Artificial Sequence
  Synthetic
aacattcctgcagaaatttggcatcaggcttccataaagagagaataaggcattcaaattaggttccaaattcta

SEQ ID NO: 36683 - DNA, 75 bp, Artificial Sequence
  Synthetic
tataaattttgatcaattctttgatttaaaacaattgttgtatgagaaattcggtgatgatgaagaattccttct

SEQ ID NO: 36684 - DNA, 75 bp, Artificial Sequence
  Synthetic
agtagtgtactaccaagtatagataacgtttgaatattaaagttttgaatcaaagccaaagatgatttacatact

SEQ ID NO: 36685 - DNA, 75 bp, Artificial Sequence
  Synthetic
caaagtatcacatggtgattttacattaactgctccatggtgtaaagaaggatgtccagatttctggaaacaccc

SEQ ID NO: 36686 - DNA, 75 bp, Artificial Sequence
  Synthetic
aggatggggctatagtgaagcaaaacccatccaaagaggcagtcacggaggtgtgcctaaaggatgatgtcagta

SEQ ID NO: 36687 - DNA, 75 bp, Artificial Sequence
  Synthetic
atgccagttcctgaaaggagactctttgaggaatcagtgaagtttaatgcttatgagtctgagagatggaacaca

SEQ ID NO: 36688 - DNA, 75 bp, Artificial Sequence
  Synthetic
ttgaggaatcagtgaagtttaatgcttatgagtctgagagatggaacacaaatttaataaaaataagagaatata
